United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 36

SEQ ID NO: 1502329 - DNA, 22 bp, Homo sapiens
ggtggctgacccagtccctggg

SEQ ID NO: 1502330 - DNA, 11 bp, Homo sapiens
ggtggctgggc

SEQ ID NO: 1502331 - DNA, 12 bp, Homo sapiens
ggtggctgggca

SEQ ID NO: 1502332 - DNA, 13 bp, Homo sapiens
ggtggctgggcag

SEQ ID NO: 1502333 - DNA, 17 bp, Homo sapiens
ggtggctgggcccagca

SEQ ID NO: 1502334 - DNA, 18 bp, Homo sapiens
ggtggctgggcccagcag

SEQ ID NO: 1502335 - DNA, 23 bp, Homo sapiens
ggtggctgggcccagcaggggcc

SEQ ID NO: 1502336 - DNA, 16 bp, Homo sapiens
ggtggcttgagctaga

SEQ ID NO: 1502337 - DNA, 20 bp, Homo sapiens
ggtgggaactcacgtgggga

SEQ ID NO: 1502338 - DNA, 15 bp, Homo sapiens
ggtgggaagaaagaa

SEQ ID NO: 1502339 - DNA, 16 bp, Homo sapiens
ggtgggaatcagatct

SEQ ID NO: 1502340 - DNA, 20 bp, Homo sapiens
ggtgggacccccgtggggca

SEQ ID NO: 1502341 - DNA, 17 bp, Homo sapiens
ggtgggatggaggagaa

SEQ ID NO: 1502342 - DNA, 22 bp, Homo sapiens
ggtgggattttttcccttttta

SEQ ID NO: 1502343 - DNA, 20 bp, Homo sapiens
ggtgggcagatcatgggtca

SEQ ID NO: 1502344 - DNA, 18 bp, Homo sapiens
ggtgggcagctgggcccc

SEQ ID NO: 1502345 - DNA, 14 bp, Homo sapiens
ggtgggcaggtggt

SEQ ID NO: 1502346 - DNA, 13 bp, Homo sapiens
ggtgggccagagc

SEQ ID NO: 1502347 - DNA, 17 bp, Homo sapiens
ggtgggcccaggaccag

SEQ ID NO: 1502348 - DNA, 18 bp, Homo sapiens
ggtgggcccaggaccagc

SEQ ID NO: 1502349 - DNA, 22 bp, Homo sapiens
ggtgggcccaggaccagctggg

SEQ ID NO: 1502350 - DNA, 16 bp, Homo sapiens
ggtgggctctgtgcag

SEQ ID NO: 1502351 - DNA, 14 bp, Homo sapiens
ggtgggctggggct

SEQ ID NO: 1502352 - DNA, 14 bp, Homo sapiens
ggtggggagacctg

SEQ ID NO: 1502353 - DNA, 21 bp, Homo sapiens
ggtggggagctagaggccacc

SEQ ID NO: 1502354 - DNA, 14 bp, Homo sapiens
ggtggggatcctgc

SEQ ID NO: 1502355 - DNA, 13 bp, Homo sapiens
ggtggggctgctc

SEQ ID NO: 1502356 - DNA, 15 bp, Homo sapiens
ggtggggctgtcctg

SEQ ID NO: 1502357 - DNA, 17 bp, Homo sapiens
ggtgggggctgtcctgc

SEQ ID NO: 1502358 - DNA, 15 bp, Homo sapiens
ggtgggggtggaatt

SEQ ID NO: 1502359 - DNA, 16 bp, Homo sapiens
ggtgggtggtggggag

SEQ ID NO: 1502360 - DNA, 12 bp, Homo sapiens
ggtggtaaagaa

SEQ ID NO: 1502361 - DNA, 15 bp, Homo sapiens
ggtggtaaattcaga

SEQ ID NO: 1502362 - DNA, 16 bp, Homo sapiens
ggtggtaccctctgga

SEQ ID NO: 1502363 - DNA, 22 bp, Homo sapiens
ggtggtactttattcttgctgg

SEQ ID NO: 1502364 - DNA, 18 bp, Homo sapiens
ggtggtagatttcctcct

SEQ ID NO: 1502365 - DNA, 21 bp, Homo sapiens
ggtggtctgttggcaggctgg

SEQ ID NO: 1502366 - DNA, 17 bp, Homo sapiens
ggtggtcttccttctac

SEQ ID NO: 1502367 - DNA, 17 bp, Homo sapiens
ggtggtgcccgtgcccg

SEQ ID NO: 1502368 - DNA, 16 bp, Homo sapiens
ggtggttaaggccagg

SEQ ID NO: 1502369 - DNA, 23 bp, Homo sapiens
ggtgtagctcttagaggaaggag

SEQ ID NO: 1502370 - DNA, 21 bp, Homo sapiens
ggtgtaggggccacctcctcc

SEQ ID NO: 1502371 - DNA, 22 bp, Homo sapiens
ggtgtatgcacagggtgtggta

SEQ ID NO: 1502372 - DNA, 14 bp, Homo sapiens
ggtgtattatcatt

SEQ ID NO: 1502373 - DNA, 16 bp, Homo sapiens
ggtgtattatcatttt

SEQ ID NO: 1502374 - DNA, 13 bp, Homo sapiens
ggtgtatttaaac

SEQ ID NO: 1502375 - DNA, 18 bp, Homo sapiens
ggtgtcagaccctggagg

SEQ ID NO: 1502376 - DNA, 12 bp, Homo sapiens
ggtgtcaggcag

SEQ ID NO: 1502377 - DNA, 22 bp, Homo sapiens
ggtgtcaggcccgtcggagctg

SEQ ID NO: 1502378 - DNA, 17 bp, Homo sapiens
ggtgtcagtatccaggc

SEQ ID NO: 1502379 - DNA, 15 bp, Homo sapiens
ggtgtccaccatccc

SEQ ID NO: 1502380 - DNA, 20 bp, Homo sapiens
ggtgtccaccatccccagct

SEQ ID NO: 1502381 - DNA, 12 bp, Homo sapiens
ggtgtccagggt

SEQ ID NO: 1502382 - DNA, 20 bp, Homo sapiens
ggtgtccccaacgtcccctc

SEQ ID NO: 1502383 - DNA, 20 bp, Homo sapiens
ggtgtccccgctgctgtgca

SEQ ID NO: 1502384 - DNA, 15 bp, Homo sapiens
ggtgtcctgcctgtc

SEQ ID NO: 1502385 - DNA, 19 bp, Homo sapiens
ggtgtcctgcctgtctgcc

SEQ ID NO: 1502386 - DNA, 19 bp, Homo sapiens
ggtgtctccaaccccccag

SEQ ID NO: 1502387 - DNA, 23 bp, Homo sapiens
ggtgtctccaaccccccagcact

SEQ ID NO: 1502388 - DNA, 15 bp, Homo sapiens
ggtgtctccttaagc

SEQ ID NO: 1502389 - DNA, 18 bp, Homo sapiens
ggtgtctggggtgaggga

SEQ ID NO: 1502390 - DNA, 20 bp, Homo sapiens
ggtgtcttgggcagagctgg

SEQ ID NO: 1502391 - DNA, 17 bp, Homo sapiens
ggtgtgaacccgggagc

SEQ ID NO: 1502392 - DNA, 14 bp, Homo sapiens
ggtgtgaccatgtt

SEQ ID NO: 1502393 - DNA, 21 bp, Homo sapiens
ggtgtgactctagcaaggctc

SEQ ID NO: 1502394 - DNA, 17 bp, Homo sapiens
ggtgtgcatgccacgcc

SEQ ID NO: 1502395 - DNA, 13 bp, Homo sapiens
ggtgtgcctgcag

SEQ ID NO: 1502396 - DNA, 14 bp, Homo sapiens
ggtgtgcctgtgct

SEQ ID NO: 1502397 - DNA, 15 bp, Homo sapiens
ggtgtgcctgtgctc

SEQ ID NO: 1502398 - DNA, 21 bp, Homo sapiens
ggtgtgcctgtgctcctgccc

SEQ ID NO: 1502399 - DNA, 19 bp, Homo sapiens
ggtgtggctgctcccagcc

SEQ ID NO: 1502400 - DNA, 22 bp, Homo sapiens
ggtgtgggatctggggagagcg

SEQ ID NO: 1502401 - DNA, 15 bp, Homo sapiens
ggtgtggggtggggt

SEQ ID NO: 1502402 - DNA, 15 bp, Homo sapiens
ggtgtgggtgtcctg

SEQ ID NO: 1502403 - DNA, 17 bp, Homo sapiens
ggtgtgtccctggacac

SEQ ID NO: 1502404 - DNA, 20 bp, Homo sapiens
ggtgtgtccctggacacagc

SEQ ID NO: 1502405 - DNA, 17 bp, Homo sapiens
ggtgttaattttgctaa

SEQ ID NO: 1502406 - DNA, 20 bp, Homo sapiens
ggtgttacacagcccaagag

SEQ ID NO: 1502407 - DNA, 22 bp, Homo sapiens
ggtgttaggcatgtcccaccca

SEQ ID NO: 1502408 - DNA, 17 bp, Homo sapiens
gggattatgggtcacag

SEQ ID NO: 1502409 - DNA, 15 bp, Homo sapiens
gggattcaggctgct

SEQ ID NO: 1502410 - DNA, 17 bp, Homo sapiens
gggattcctgacccagg

SEQ ID NO: 1502411 - DNA, 21 bp, Homo sapiens
gggattcctgacccaggccgc

SEQ ID NO: 1502412 - DNA, 19 bp, Homo sapiens
gggattctggttccagggt

SEQ ID NO: 1502413 - DNA, 16 bp, Homo sapiens
gggattgctgaggcac

SEQ ID NO: 1502414 - DNA, 23 bp, Homo sapiens
gggatttcaaacttaaacaaaaa

SEQ ID NO: 1502415 - DNA, 13 bp, Homo sapiens
gggatttctggga

SEQ ID NO: 1502416 - DNA, 15 bp, Homo sapiens
gggattttagtaagt

SEQ ID NO: 1502417 - DNA, 23 bp, Homo sapiens
gggcaacgaagaaaaaaaataac

SEQ ID NO: 1502418 - DNA, 21 bp, Homo sapiens
gggcaagacctcttccctctg

SEQ ID NO: 1502419 - DNA, 16 bp, Homo sapiens
gggcaagctaggcccc

SEQ ID NO: 1502420 - DNA, 22 bp, Homo sapiens
gggcaagctaggccccagaggc

SEQ ID NO: 1502421 - DNA, 20 bp, Homo sapiens
gggcaagggttaaggcctga

SEQ ID NO: 1502422 - DNA, 14 bp, Homo sapiens
gggcaaggtgggtg

SEQ ID NO: 1502423 - DNA, 11 bp, Homo sapiens
gggcacaccac

SEQ ID NO: 1502424 - DNA, 13 bp, Homo sapiens
gggcacagccctc

SEQ ID NO: 1502425 - DNA, 14 bp, Homo sapiens
gggcacagcctagg

SEQ ID NO: 1502426 - DNA, 12 bp, Homo sapiens
gggcacagggca

SEQ ID NO: 1502427 - DNA, 17 bp, Homo sapiens
gggcacagggcaccaga

SEQ ID NO: 1502428 - DNA, 18 bp, Homo sapiens
gggcacagggcaccagag

SEQ ID NO: 1502429 - DNA, 19 bp, Homo sapiens
gggcacagggcaccagagg

SEQ ID NO: 1502430 - DNA, 20 bp, Homo sapiens
gggcacagggcaccagaggc

SEQ ID NO: 1502431 - DNA, 23 bp, Homo sapiens
gggcacaggtgtctgccccctct

SEQ ID NO: 1502432 - DNA, 13 bp, Homo sapiens
gggcacagtgggc

SEQ ID NO: 1502433 - DNA, 13 bp, Homo sapiens
gggcaccagaggc

SEQ ID NO: 1502434 - DNA, 15 bp, Homo sapiens
gggcaccagaggccg

SEQ ID NO: 1502435 - DNA, 20 bp, Homo sapiens
gggcaccgggaccccctcac

SEQ ID NO: 1502436 - DNA, 23 bp, Homo sapiens
gggcacggcgggatcctccacag

SEQ ID NO: 1502437 - DNA, 22 bp, Homo sapiens
gggcactccgcgccgatgccac

SEQ ID NO: 1502438 - DNA, 13 bp, Homo sapiens
gggcactggtggc

SEQ ID NO: 1502439 - DNA, 20 bp, Homo sapiens
gggcactttaaatgaagcta

SEQ ID NO: 1502440 - DNA, 14 bp, Homo sapiens
gggcagagccatgg

SEQ ID NO: 1502441 - DNA, 15 bp, Homo sapiens
gggcagagccatggg

SEQ ID NO: 1502442 - DNA, 17 bp, Homo sapiens
gggcagagccatgggcc

SEQ ID NO: 1502443 - DNA, 14 bp, Homo sapiens
gggcagaggctgga

SEQ ID NO: 1502444 - DNA, 15 bp, Homo sapiens
gggcagaggctggag

SEQ ID NO: 1502445 - DNA, 14 bp, Homo sapiens
gggcagagggcaga

SEQ ID NO: 1502446 - DNA, 15 bp, Homo sapiens
gggcagagggcagag

SEQ ID NO: 1502447 - DNA, 15 bp, Homo sapiens
gggcagagggctgga

SEQ ID NO: 1502448 - DNA, 16 bp, Homo sapiens
gggcagagggctggag

SEQ ID NO: 1502449 - DNA, 22 bp, Homo sapiens
gggcagagggctggaggcccag

SEQ ID NO: 1502450 - DNA, 16 bp, Homo sapiens
gggcagattttcagca

SEQ ID NO: 1502451 - DNA, 11 bp, Homo sapiens
gggcagcactc

SEQ ID NO: 1502452 - DNA, 22 bp, Homo sapiens
gggcagccgctaggagagactg

SEQ ID NO: 1502453 - DNA, 20 bp, Homo sapiens
gggcagcctggctcccagga

SEQ ID NO: 1502454 - DNA, 23 bp, Homo sapiens
gggcagcctggctcccaggacac

SEQ ID NO: 1502455 - DNA, 18 bp, Homo sapiens
gggcagcgcatgtgtgca

SEQ ID NO: 1502456 - DNA, 15 bp, Homo sapiens
gggcagcgggccagg

SEQ ID NO: 1502457 - DNA, 18 bp, Homo sapiens
gggcagcgggccaggccc

SEQ ID NO: 1502458 - DNA, 17 bp, Homo sapiens
gggcagctgggccccac

SEQ ID NO: 1502459 - DNA, 16 bp, Homo sapiens
gggcaggaaggagagc

SEQ ID NO: 1502460 - DNA, 21 bp, Homo sapiens
gggcaggaaggagagcctgct

SEQ ID NO: 1502461 - DNA, 18 bp, Homo sapiens
gggcaggagggccctacc

SEQ ID NO: 1502462 - DNA, 16 bp, Homo sapiens
gggcaggagtgccagg

SEQ ID NO: 1502463 - DNA, 22 bp, Homo sapiens
gggcaggagtgccaggaccagc

SEQ ID NO: 1502464 - DNA, 23 bp, Homo sapiens
gggcaggagtgccaggaccagcc

SEQ ID NO: 1502465 - DNA, 13 bp, Homo sapiens
gggcaggcctggg

SEQ ID NO: 1502466 - DNA, 12 bp, Homo sapiens
gggcaggctggg

SEQ ID NO: 1502467 - DNA, 16 bp, Homo sapiens
gggcaggctgggccat

SEQ ID NO: 1502468 - DNA, 14 bp, Homo sapiens
gggcagggaaggac

SEQ ID NO: 1502469 - DNA, 15 bp, Homo sapiens
gggcagggaaggaca

SEQ ID NO: 1502470 - DNA, 15 bp, Homo sapiens
gggcagggagctggg

SEQ ID NO: 1502471 - DNA, 12 bp, Homo sapiens
gggcagggcagc

SEQ ID NO: 1502472 - DNA, 15 bp, Homo sapiens
gtaactaattttgtt

SEQ ID NO: 1502473 - DNA, 18 bp, Homo sapiens
gtaactactttttatact

SEQ ID NO: 1502474 - DNA, 17 bp, Homo sapiens
gtaattcaggtttttcc

SEQ ID NO: 1502475 - DNA, 12 bp, Homo sapiens
gtaattctaaat

SEQ ID NO: 1502476 - DNA, 13 bp, Homo sapiens
gtaattctttctg

SEQ ID NO: 1502477 - DNA, 15 bp, Homo sapiens
gtaattctttctgtc

SEQ ID NO: 1502478 - DNA, 16 bp, Homo sapiens
gtaattgaataaagtt

SEQ ID NO: 1502479 - DNA, 17 bp, Homo sapiens
gtaattgacagagtaaa

SEQ ID NO: 1502480 - DNA, 16 bp, Homo sapiens
gtaattgcttacattt

SEQ ID NO: 1502481 - DNA, 22 bp, Homo sapiens
gtaattgcttacatttttacaa

SEQ ID NO: 1502482 - DNA, 23 bp, Homo sapiens
gtaattgcttacatttttacaat

SEQ ID NO: 1502483 - DNA, 12 bp, Homo sapiens
gtaattggtaat

SEQ ID NO: 1502484 - DNA, 16 bp, Homo sapiens
gtaattgtacaatact

SEQ ID NO: 1502485 - DNA, 18 bp, Homo sapiens
gtaattgtccctctgtgg

SEQ ID NO: 1502486 - DNA, 18 bp, Homo sapiens
gtaattgttttggaataa

SEQ ID NO: 1502487 - DNA, 19 bp, Homo sapiens
gtaatttaaaattgtgatg

SEQ ID NO: 1502488 - DNA, 16 bp, Homo sapiens
gtaatttaaacaggcc

SEQ ID NO: 1502489 - DNA, 22 bp, Homo sapiens
gtaatttaaacatttgttcctg

SEQ ID NO: 1502490 - DNA, 21 bp, Homo sapiens
gtaatttaaatgaaagaaaat

SEQ ID NO: 1502491 - DNA, 19 bp, Homo sapiens
gtaatttaagtgacacaga

SEQ ID NO: 1502492 - DNA, 12 bp, Homo sapiens
gtaatttcaaaa

SEQ ID NO: 1502493 - DNA, 14 bp, Homo sapiens
gtaatttgaagatt

SEQ ID NO: 1502494 - DNA, 12 bp, Homo sapiens
gtacaaaacaat

SEQ ID NO: 1502495 - DNA, 16 bp, Homo sapiens
gtacaaaataaacaaa

SEQ ID NO: 1502496 - DNA, 11 bp, Homo sapiens
gtacaaataaa

SEQ ID NO: 1502497 - DNA, 15 bp, Homo sapiens
gtacaaataaacctg

SEQ ID NO: 1502498 - DNA, 18 bp, Homo sapiens
gtacaaatgtaagcaaag

SEQ ID NO: 1502499 - DNA, 17 bp, Homo sapiens
gtacaactgtatttatt

SEQ ID NO: 1502500 - DNA, 18 bp, Homo sapiens
gtacaactgtatttatta

SEQ ID NO: 1502501 - DNA, 16 bp, Homo sapiens
gtacaaggtaattgtt

SEQ ID NO: 1502502 - DNA, 17 bp, Homo sapiens
gtacaaggtaattgttt

SEQ ID NO: 1502503 - DNA, 16 bp, Homo sapiens
gtacaataatgtactc

SEQ ID NO: 1502504 - DNA, 20 bp, Homo sapiens
gtacaataatgtactcacat

SEQ ID NO: 1502505 - DNA, 13 bp, Homo sapiens
gtacaatacaatg

SEQ ID NO: 1502506 - DNA, 20 bp, Homo sapiens
gtacaatacaatgtacaatt

SEQ ID NO: 1502507 - DNA, 21 bp, Homo sapiens
gtacaatacaatgtacaatta

SEQ ID NO: 1502508 - DNA, 24 bp, Homo sapiens
gtacaatctggctcactgcagcct

SEQ ID NO: 1502509 - DNA, 20 bp, Homo sapiens
gtacaatggtttattcccaa

SEQ ID NO: 1502510 - DNA, 21 bp, Homo sapiens
gtacaattactaaattgtata

SEQ ID NO: 1502511 - DNA, 17 bp, Homo sapiens
gtacaattatgtctctt

SEQ ID NO: 1502512 - DNA, 22 bp, Homo sapiens
gtacaattcattgttttgcaaa

SEQ ID NO: 1502513 - DNA, 18 bp, Homo sapiens
gtacaattttaaagttct

SEQ ID NO: 1502514 - DNA, 17 bp, Homo sapiens
gtacacccaattttaaa

SEQ ID NO: 1502515 - DNA, 18 bp, Homo sapiens
gtacacgggaccagctca

SEQ ID NO: 1502516 - DNA, 14 bp, Homo sapiens
gtacactgaatatt

SEQ ID NO: 1502517 - DNA, 14 bp, Homo sapiens
gtacagaaaacatg

SEQ ID NO: 1502518 - DNA, 20 bp, Homo sapiens
gtacagaaaacatgtttaaa

SEQ ID NO: 1502519 - DNA, 16 bp, Homo sapiens
gtacagactgttttac

SEQ ID NO: 1502520 - DNA, 12 bp, Homo sapiens
gtacagatcaag

SEQ ID NO: 1502521 - DNA, 21 bp, Homo sapiens
gtacagcgcggaggaggaggg

SEQ ID NO: 1502522 - DNA, 14 bp, Homo sapiens
gtacagcttctgga

SEQ ID NO: 1502523 - DNA, 15 bp, Homo sapiens
gtacaggagaggcag

SEQ ID NO: 1502524 - DNA, 21 bp, Homo sapiens
gtacaggcaaaacacgcaagg

SEQ ID NO: 1502525 - DNA, 17 bp, Homo sapiens
gtacagtaggataagcc

SEQ ID NO: 1502526 - DNA, 14 bp, Homo sapiens
gtacagtgaggagg

SEQ ID NO: 1502527 - DNA, 16 bp, Homo sapiens
gtacagtgtgtaaagt

SEQ ID NO: 1502528 - DNA, 17 bp, Homo sapiens
gtacataactcctgtcc

SEQ ID NO: 1502529 - DNA, 18 bp, Homo sapiens
gtacataactcctgtccc

SEQ ID NO: 1502530 - DNA, 18 bp, Homo sapiens
gtacatagtaaagtattt

SEQ ID NO: 1502531 - DNA, 17 bp, Homo sapiens
gtacatagttatttatt

SEQ ID NO: 1502532 - DNA, 18 bp, Homo sapiens
gtacatagttatttattt

SEQ ID NO: 1502533 - DNA, 14 bp, Homo sapiens
gtacatatatgtat

SEQ ID NO: 1502534 - DNA, 16 bp, Homo sapiens
gtacatatatgtataa

SEQ ID NO: 1502535 - DNA, 14 bp, Homo sapiens
gtacatatgtaatt

SEQ ID NO: 1502536 - DNA, 19 bp, Homo sapiens
gtacatggaataacatgta

SEQ ID NO: 1502537 - DNA, 16 bp, Homo sapiens
gtacatgtatgaaatt

SEQ ID NO: 1502538 - DNA, 19 bp, Homo sapiens
gtacattacactaaattat

SEQ ID NO: 1502539 - DNA, 17 bp, Homo sapiens
gtacattcaatgtttat

SEQ ID NO: 1502540 - DNA, 15 bp, Homo sapiens
gtacatttaaaattg

SEQ ID NO: 1502541 - DNA, 13 bp, Homo sapiens
gtacatttaaatt

SEQ ID NO: 1502542 - DNA, 14 bp, Homo sapiens
gtacatttctataa

SEQ ID NO: 1502543 - DNA, 18 bp, Homo sapiens
gtacatttttaaattctt

SEQ ID NO: 1502544 - DNA, 20 bp, Homo sapiens
gtacattttttgaaatgctg

SEQ ID NO: 1502545 - DNA, 16 bp, Homo sapiens
gtaccaaacaaggaag

SEQ ID NO: 1502546 - DNA, 14 bp, Homo sapiens
gtaccaatcatttt

SEQ ID NO: 1502547 - DNA, 15 bp, Homo sapiens
gtaccaatgctgttg

SEQ ID NO: 1502548 - DNA, 18 bp, Homo sapiens
gtaccaattgtcaaatta

SEQ ID NO: 1502549 - DNA, 14 bp, Homo sapiens
gtaccactcaggcc

SEQ ID NO: 1502550 - DNA, 16 bp, Homo sapiens
gtaccagttaattttt

SEQ ID NO: 1502551 - DNA, 20 bp, Homo sapiens
gtaccagttaatttttccaa

SEQ ID NO: 1502552 - DNA, 23 bp, Homo sapiens
gtaccagttaatttttccaacta

SEQ ID NO: 1502553 - DNA, 17 bp, Homo sapiens
gtaccatagaaaaatgt

SEQ ID NO: 1502554 - DNA, 17 bp, Homo sapiens
gtaccatcaataaagta

SEQ ID NO: 1502555 - DNA, 15 bp, Homo sapiens
gtaccatgaatattt

SEQ ID NO: 1502556 - DNA, 14 bp, Homo sapiens
gtaccatttgcatg

SEQ ID NO: 1502557 - DNA, 12 bp, Homo sapiens
gtacccagccat

SEQ ID NO: 1502558 - DNA, 12 bp, Homo sapiens
gtacccagctcc

SEQ ID NO: 1502559 - DNA, 22 bp, Homo sapiens
gtacccattctgttttccccca

SEQ ID NO: 1502560 - DNA, 17 bp, Homo sapiens
gtacccctaaaatccca

SEQ ID NO: 1502561 - DNA, 20 bp, Homo sapiens
gtacccgcctgagctcctgc

SEQ ID NO: 1502562 - DNA, 17 bp, Homo sapiens
gtaccctcctggctctt

SEQ ID NO: 1502563 - DNA, 18 bp, Homo sapiens
gtaccctctcagctccag

SEQ ID NO: 1502564 - DNA, 20 bp, Homo sapiens
gtacccttccacctcctaga

SEQ ID NO: 1502565 - DNA, 13 bp, Homo sapiens
gtaccctttaaga

SEQ ID NO: 1502566 - DNA, 20 bp, Homo sapiens
gtaccctttaagatatccat

SEQ ID NO: 1502567 - DNA, 16 bp, Homo sapiens
gtaccgatttctgcta

SEQ ID NO: 1502568 - DNA, 18 bp, Homo sapiens
gtaccgcccggcagcccc

SEQ ID NO: 1502569 - DNA, 17 bp, Homo sapiens
gtacctagctggctctg

SEQ ID NO: 1502570 - DNA, 16 bp, Homo sapiens
gtacctatggctgcct

SEQ ID NO: 1502571 - DNA, 17 bp, Homo sapiens
gtacctatggctgcctg

SEQ ID NO: 1502572 - DNA, 23 bp, Homo sapiens
gtacctatggctgcctgcatcta

SEQ ID NO: 1502573 - DNA, 19 bp, Homo sapiens
gtacctcctctcagtgttt

SEQ ID NO: 1502574 - DNA, 23 bp, Homo sapiens
gtacctctagaatcccagcagca

SEQ ID NO: 1502575 - DNA, 23 bp, Homo sapiens
gtacctgaaaagtaacttggctt

SEQ ID NO: 1502576 - DNA, 16 bp, Homo sapiens
gtacctgcaagcagaa

SEQ ID NO: 1502577 - DNA, 21 bp, Homo sapiens
gtacctgggaaaggacccacc

SEQ ID NO: 1502578 - DNA, 21 bp, Homo sapiens
gtacctgtagtgagaaactga

SEQ ID NO: 1502579 - DNA, 21 bp, Homo sapiens
gtaccttcagaataagcttcc

SEQ ID NO: 1502580 - DNA, 23 bp, Homo sapiens
gtaccttgaacactgggggaggg

SEQ ID NO: 1502581 - DNA, 17 bp, Homo sapiens
gtaccttgctgtggggc

SEQ ID NO: 1502582 - DNA, 15 bp, Homo sapiens
gtaccttgtgcccag

SEQ ID NO: 1502583 - DNA, 16 bp, Homo sapiens
gtaccttgtgcccagg

SEQ ID NO: 1502584 - DNA, 18 bp, Homo sapiens
gtacgaatctcatccctc

SEQ ID NO: 1502585 - DNA, 20 bp, Homo sapiens
gtacgaatctcatccctcaa

SEQ ID NO: 1502586 - DNA, 16 bp, Homo sapiens
gtacgatcaagttgtt

SEQ ID NO: 1502587 - DNA, 19 bp, Homo sapiens
gtactcacatataacatgc

SEQ ID NO: 1502588 - DNA, 15 bp, Homo sapiens
gtactccagcctggg

SEQ ID NO: 1502589 - DNA, 14 bp, Homo sapiens
gtactcctcccagg

SEQ ID NO: 1502590 - DNA, 17 bp, Homo sapiens
gtactctctgctctagc

SEQ ID NO: 1502591 - DNA, 19 bp, Homo sapiens
gtactctctgctctagcca

SEQ ID NO: 1502592 - DNA, 14 bp, Homo sapiens
gtactctttaacat

SEQ ID NO: 1502593 - DNA, 22 bp, Homo sapiens
gtactgaaagccttagggaagc

SEQ ID NO: 1502594 - DNA, 14 bp, Homo sapiens
gtactgaatttttt

SEQ ID NO: 1502595 - DNA, 18 bp, Homo sapiens
gtactgaatttttttgta

SEQ ID NO: 1502596 - DNA, 19 bp, Homo sapiens
gtactgaatttttttgtaa

SEQ ID NO: 1502597 - DNA, 20 bp, Homo sapiens
gtactgaatttttttgtaat

SEQ ID NO: 1502598 - DNA, 15 bp, Homo sapiens
gtactgacccaggac

SEQ ID NO: 1502599 - DNA, 16 bp, Homo sapiens
gtactgacccaggacc

SEQ ID NO: 1502600 - DNA, 20 bp, Homo sapiens
gtactgactttgcttgcttt

SEQ ID NO: 1502601 - DNA, 14 bp, Homo sapiens
gtactgataaaata

SEQ ID NO: 1502602 - DNA, 15 bp, Homo sapiens
gtactgatttcagta

SEQ ID NO: 1502603 - DNA, 21 bp, Homo sapiens
gtactgcattttttacttttt

SEQ ID NO: 1502604 - DNA, 20 bp, Homo sapiens
gtactggcaataagatacac

SEQ ID NO: 1502605 - DNA, 21 bp, Homo sapiens
gtactggggtgggatcttgga

SEQ ID NO: 1502606 - DNA, 15 bp, Homo sapiens
gtactggtaattgta

SEQ ID NO: 1502607 - DNA, 17 bp, Homo sapiens
gtactggtaattgtaca

SEQ ID NO: 1502608 - DNA, 19 bp, Homo sapiens
gtactggtaattgtacaat

SEQ ID NO: 1502609 - DNA, 16 bp, Homo sapiens
gtactggtcccttcct

SEQ ID NO: 1502610 - DNA, 17 bp, Homo sapiens
gtactgttcggaagggg

SEQ ID NO: 1502611 - DNA, 14 bp, Homo sapiens
gtactgttctgtgt

SEQ ID NO: 1502612 - DNA, 21 bp, Homo sapiens
gtactgttgctttaatatgag

SEQ ID NO: 1502613 - DNA, 15 bp, Homo sapiens
gtacttaataaattc

SEQ ID NO: 1502614 - DNA, 16 bp, Homo sapiens
gtacttacccggagaa

SEQ ID NO: 1502615 - DNA, 16 bp, Homo sapiens
gtacttagcagctatc

SEQ ID NO: 1502616 - DNA, 13 bp, Homo sapiens
gtacttattactg

SEQ ID NO: 1502617 - DNA, 15 bp, Homo sapiens
gtacttcactgtcag

SEQ ID NO: 1502618 - DNA, 15 bp, Homo sapiens
gtacttcctttctcc

SEQ ID NO: 1502619 - DNA, 14 bp, Homo sapiens
gtacttctgtgttc

SEQ ID NO: 1502620 - DNA, 17 bp, Homo sapiens
gtacttctgtgttcatt

SEQ ID NO: 1502621 - DNA, 16 bp, Homo sapiens
gtacttcttattgcaa

SEQ ID NO: 1502622 - DNA, 18 bp, Homo sapiens
gtacttcttgaatataaa

SEQ ID NO: 1502623 - DNA, 20 bp, Homo sapiens
gtacttcttgaatataaaaa

SEQ ID NO: 1502624 - DNA, 17 bp, Homo sapiens
gtacttgaatttttctt

SEQ ID NO: 1502625 - DNA, 18 bp, Homo sapiens
gtacttgctccttttgct

SEQ ID NO: 1502626 - DNA, 21 bp, Homo sapiens
gtacttggagtattggggtct

SEQ ID NO: 1502627 - DNA, 21 bp, Homo sapiens
gtacttgtgaaacacagctgt

SEQ ID NO: 1502628 - DNA, 22 bp, Homo sapiens
gtacttgtgaaacacagctgtt

SEQ ID NO: 1502629 - DNA, 17 bp, Homo sapiens
gtacttgtttgctatga

SEQ ID NO: 1502630 - DNA, 16 bp, Homo sapiens
gtactttaaaaaggaa

SEQ ID NO: 1502631 - DNA, 14 bp, Homo sapiens
gtactttaaaaatt

SEQ ID NO: 1502632 - DNA, 14 bp, Homo sapiens
gtactttattcttg

SEQ ID NO: 1502633 - DNA, 18 bp, Homo sapiens
gtactttattcttgctgg

SEQ ID NO: 1502634 - DNA, 22 bp, Homo sapiens
gtactttattcttgctgggcat

SEQ ID NO: 1502635 - DNA, 21 bp, Homo sapiens
gtactttatttttctgataga

SEQ ID NO: 1502636 - DNA, 11 bp, Homo sapiens
gtactttctgt

SEQ ID NO: 1502637 - DNA, 19 bp, Homo sapiens
gtactttctgttaaaatgc

SEQ ID NO: 1502638 - DNA, 21 bp, Homo sapiens
gtactttctgttaaaatgcat

SEQ ID NO: 1502639 - DNA, 17 bp, Homo sapiens
gtacttttaaaaacata

SEQ ID NO: 1502640 - DNA, 18 bp, Homo sapiens
gtacttttcattctcttt

SEQ ID NO: 1502641 - DNA, 22 bp, Homo sapiens
gtacttttcattctcttttaat

SEQ ID NO: 1502642 - DNA, 21 bp, Homo sapiens
gtacttttcccatttgtaatt

SEQ ID NO: 1502643 - DNA, 24 bp, Homo sapiens
gtacttttgagtgtgtgtgtgcat

SEQ ID NO: 1502644 - DNA, 20 bp, Homo sapiens
gtacttttttaaatattttc

SEQ ID NO: 1502645 - DNA, 21 bp, Homo sapiens
gtacttttttaaatattttct

SEQ ID NO: 1502646 - DNA, 17 bp, Homo sapiens
gtagaaaatatgtccca

SEQ ID NO: 1502647 - DNA, 20 bp, Homo sapiens
gtagaaatatctgaaaatgt

SEQ ID NO: 1502648 - DNA, 16 bp, Homo sapiens
gtagaactcactctgg

SEQ ID NO: 1502649 - DNA, 15 bp, Homo sapiens
gtagaactcagcagt

SEQ ID NO: 1502650 - DNA, 14 bp, Homo sapiens
gtagaactgttcat

SEQ ID NO: 1502651 - DNA, 16 bp, Homo sapiens
gtagaagatggactct

SEQ ID NO: 1502652 - DNA, 19 bp, Homo sapiens
gtagaaggttgacacagtt

SEQ ID NO: 1502653 - DNA, 14 bp, Homo sapiens
gtagaattgtatat

SEQ ID NO: 1502654 - DNA, 14 bp, Homo sapiens
gtagaccaaaataa

SEQ ID NO: 1502655 - DNA, 16 bp, Homo sapiens
gtagaccaaaataaaa

SEQ ID NO: 1502656 - DNA, 20 bp, Homo sapiens
gtagaccttgttacttctga

SEQ ID NO: 1502657 - DNA, 13 bp, Homo sapiens
gtagactagtgcc

SEQ ID NO: 1502658 - DNA, 21 bp, Homo sapiens
gtagagacgggttcaccatgt

SEQ ID NO: 1502659 - DNA, 13 bp, Homo sapiens
gtagagaggcccg

SEQ ID NO: 1502660 - DNA, 14 bp, Homo sapiens
gtagagccagcttg

SEQ ID NO: 1502661 - DNA, 18 bp, Homo sapiens
gtagagctagctgccact

SEQ ID NO: 1502662 - DNA, 14 bp, Homo sapiens
gtagaggcttgttt

SEQ ID NO: 1502663 - DNA, 15 bp, Homo sapiens
gtagagtcatctcca

SEQ ID NO: 1502664 - DNA, 20 bp, Homo sapiens
gtagagtgtagactgtggct

SEQ ID NO: 1502665 - DNA, 14 bp, Homo sapiens
gtagatcaggtttg

SEQ ID NO: 1502666 - DNA, 15 bp, Homo sapiens
gtagatccatttcca

SEQ ID NO: 1502667 - DNA, 15 bp, Homo sapiens
gtagatcctgagatg

SEQ ID NO: 1502668 - DNA, 21 bp, Homo sapiens
gtagatctatattagatcaaa

SEQ ID NO: 1502669 - DNA, 14 bp, Homo sapiens
gtagatgctgaggc

SEQ ID NO: 1502670 - DNA, 18 bp, Homo sapiens
gtagattcgctgtcccct

SEQ ID NO: 1502671 - DNA, 16 bp, Homo sapiens
gtagattctgtggaac

SEQ ID NO: 1502672 - DNA, 19 bp, Homo sapiens
gtagattcttacaaggccc

SEQ ID NO: 1502673 - DNA, 17 bp, Homo sapiens
gtagatttcctcctccc

SEQ ID NO: 1502674 - DNA, 14 bp, Homo sapiens
gtagattttccaaa

SEQ ID NO: 1502675 - DNA, 11 bp, Homo sapiens
gtagcactgag

SEQ ID NO: 1502676 - DNA, 15 bp, Homo sapiens
gtagcagagttaaat

SEQ ID NO: 1502677 - DNA, 17 bp, Homo sapiens
gtagcagcaggctcagg

SEQ ID NO: 1502678 - DNA, 12 bp, Homo sapiens
gtagcagctgga

SEQ ID NO: 1502679 - DNA, 12 bp, Homo sapiens
gtagcaggggaa

SEQ ID NO: 1502680 - DNA, 17 bp, Homo sapiens
gtagcaggtaccactga

SEQ ID NO: 1502681 - DNA, 19 bp, Homo sapiens
gtagccaaggtgggctgag

SEQ ID NO: 1502682 - DNA, 12 bp, Homo sapiens
gtagccactggc

SEQ ID NO: 1502683 - DNA, 17 bp, Homo sapiens
gtagccatcaagcactt

SEQ ID NO: 1502684 - DNA, 20 bp, Homo sapiens
gtagccatcccatgaacaca

SEQ ID NO: 1502685 - DNA, 22 bp, Homo sapiens
gtagccatgatttgtcccagcc

SEQ ID NO: 1502686 - DNA, 23 bp, Homo sapiens
gtagccatgatttgtcccagcct

SEQ ID NO: 1502687 - DNA, 15 bp, Homo sapiens
gtagccatggctcag

SEQ ID NO: 1502688 - DNA, 16 bp, Homo sapiens
gtagccatggctcagg

SEQ ID NO: 1502689 - DNA, 21 bp, Homo sapiens
gtagccatggctcaggcaagc

SEQ ID NO: 1502690 - DNA, 19 bp, Homo sapiens
gtagccccctggcctctgt

SEQ ID NO: 1502691 - DNA, 18 bp, Homo sapiens
gtatatgttgtaataaaa

SEQ ID NO: 1502692 - DNA, 15 bp, Homo sapiens
gtatattccaccatt

SEQ ID NO: 1502693 - DNA, 13 bp, Homo sapiens
gtatatttatact

SEQ ID NO: 1502694 - DNA, 15 bp, Homo sapiens
gtatatttgtacaaa

SEQ ID NO: 1502695 - DNA, 17 bp, Homo sapiens
gtatattttaatgaata

SEQ ID NO: 1502696 - DNA, 19 bp, Homo sapiens
gtatatttttttaatttaa

SEQ ID NO: 1502697 - DNA, 12 bp, Homo sapiens
gtatcacagtgt

SEQ ID NO: 1502698 - DNA, 14 bp, Homo sapiens
gtatcattaatgta

SEQ ID NO: 1502699 - DNA, 22 bp, Homo sapiens
gtatcattacaattttctgtaa

SEQ ID NO: 1502700 - DNA, 14 bp, Homo sapiens
gtatccaatgtctt

SEQ ID NO: 1502701 - DNA, 20 bp, Homo sapiens
gtatccaggttccctcccag

SEQ ID NO: 1502702 - DNA, 16 bp, Homo sapiens
gtatcctaaactttag

SEQ ID NO: 1502703 - DNA, 15 bp, Homo sapiens
gtatcggagacagtg

SEQ ID NO: 1502704 - DNA, 15 bp, Homo sapiens
gtatctaaaaaataa

SEQ ID NO: 1502705 - DNA, 20 bp, Homo sapiens
gtatctatatatgtgtatgt

SEQ ID NO: 1502706 - DNA, 15 bp, Homo sapiens
gtatctatttgtaca

SEQ ID NO: 1502707 - DNA, 16 bp, Homo sapiens
gtattgttgaaaaagt

SEQ ID NO: 1502708 - DNA, 18 bp, Homo sapiens
gtatttaaactatcttgt

SEQ ID NO: 1502709 - DNA, 17 bp, Homo sapiens
gtatttaacagaaattg

SEQ ID NO: 1502710 - DNA, 16 bp, Homo sapiens
gtatttaattttgaca

SEQ ID NO: 1502711 - DNA, 13 bp, Homo sapiens
gtatttatatatt

SEQ ID NO: 1502712 - DNA, 16 bp, Homo sapiens
gtatttatatatttat

SEQ ID NO: 1502713 - DNA, 16 bp, Homo sapiens
gtatttatatttggaa

SEQ ID NO: 1502714 - DNA, 23 bp, Homo sapiens
gtatttatatttggaaagagacc

SEQ ID NO: 1502715 - DNA, 14 bp, Homo sapiens
gtatttatttaaaa

SEQ ID NO: 1502716 - DNA, 21 bp, Homo sapiens
gtatttatttaaaagattcat

SEQ ID NO: 1502717 - DNA, 19 bp, Homo sapiens
gtatttattttttcttttc

SEQ ID NO: 1502718 - DNA, 16 bp, Homo sapiens
gtatttccagtgcaat

SEQ ID NO: 1502719 - DNA, 14 bp, Homo sapiens
gtatttctcaggaa

SEQ ID NO: 1502720 - DNA, 15 bp, Homo sapiens
gtatttgagagactg

SEQ ID NO: 1502721 - DNA, 20 bp, Homo sapiens
gtatttgagttggctttgct

SEQ ID NO: 1502722 - DNA, 12 bp, Homo sapiens
gtatttgctaat

SEQ ID NO: 1502723 - DNA, 15 bp, Homo sapiens
gtatttgctgtattg

SEQ ID NO: 1502724 - DNA, 20 bp, Homo sapiens
gtatttggaaataaagtcag

SEQ ID NO: 1502725 - DNA, 13 bp, Homo sapiens
gtatttgtattaa

SEQ ID NO: 1502726 - DNA, 19 bp, Homo sapiens
gtcccctcccatctgggag

SEQ ID NO: 1502727 - DNA, 19 bp, Homo sapiens
gtcccctccgccgtgccgg

SEQ ID NO: 1502728 - DNA, 11 bp, Homo sapiens
gtcccctctgt

SEQ ID NO: 1502729 - DNA, 17 bp, Homo sapiens
gtcccctgccccagagg

SEQ ID NO: 1502730 - DNA, 12 bp, Homo sapiens
gtcccctgcggg

SEQ ID NO: 1502731 - DNA, 20 bp, Homo sapiens
gtcccctgcgggcgcgggca

SEQ ID NO: 1502732 - DNA, 20 bp, Homo sapiens
gtcccctgctactcctgtgc

SEQ ID NO: 1502733 - DNA, 12 bp, Homo sapiens
gtcccctggcag

SEQ ID NO: 1502734 - DNA, 13 bp, Homo sapiens
gtcccctggcagt

SEQ ID NO: 1502735 - DNA, 12 bp, Homo sapiens
gtcccctgtccc

SEQ ID NO: 1502736 - DNA, 12 bp, Homo sapiens
gtcccctgttga

SEQ ID NO: 1502737 - DNA, 21 bp, Homo sapiens
gtcccctgttgattatcttca

SEQ ID NO: 1502738 - DNA, 11 bp, Homo sapiens
gtccccttctc

SEQ ID NO: 1502739 - DNA, 13 bp, Homo sapiens
gtccccttctctc

SEQ ID NO: 1502740 - DNA, 14 bp, Homo sapiens
gtccccttctctca

SEQ ID NO: 1502741 - DNA, 18 bp, Homo sapiens
gtccccttctctcatctc

SEQ ID NO: 1502742 - DNA, 13 bp, Homo sapiens
gtcccctttcctc

SEQ ID NO: 1502743 - DNA, 19 bp, Homo sapiens
gtcccgatagggtatttga

SEQ ID NO: 1502744 - DNA, 17 bp, Homo sapiens
gtcccgcactctgcccc

SEQ ID NO: 1502745 - DNA, 13 bp, Homo sapiens
gtcccgcggtgct

SEQ ID NO: 1502746 - DNA, 12 bp, Homo sapiens
gtcccgctgctg

SEQ ID NO: 1502747 - DNA, 20 bp, Homo sapiens
gtcccgctgctgtgctctgg

SEQ ID NO: 1502748 - DNA, 14 bp, Homo sapiens
gtcccggccagctc

SEQ ID NO: 1502749 - DNA, 18 bp, Homo sapiens
gtcccggccagctctgga

SEQ ID NO: 1502750 - DNA, 14 bp, Homo sapiens
gtcccggccgcgcc

SEQ ID NO: 1502751 - DNA, 20 bp, Homo sapiens
gtcccggccgcgccgccgcc

SEQ ID NO: 1502752 - DNA, 23 bp, Homo sapiens
gtcccggttcagacccctgcctg

SEQ ID NO: 1502753 - DNA, 19 bp, Homo sapiens
gtccctaattctcttcgct

SEQ ID NO: 1502754 - DNA, 16 bp, Homo sapiens
gtccctacacccctcc

SEQ ID NO: 1502755 - DNA, 22 bp, Homo sapiens
gtccctatgtatttgcagttca

SEQ ID NO: 1502756 - DNA, 14 bp, Homo sapiens
gtccctcaggttcc

SEQ ID NO: 1502757 - DNA, 16 bp, Homo sapiens
gtccctctcactcccc

SEQ ID NO: 1502758 - DNA, 17 bp, Homo sapiens
gtccctctcactcccca

SEQ ID NO: 1502759 - DNA, 21 bp, Homo sapiens
gtccctctcactccccagccc

SEQ ID NO: 1502760 - DNA, 18 bp, Homo sapiens
gtccctctcagtgccttc

SEQ ID NO: 1502761 - DNA, 19 bp, Homo sapiens
gtccctctcagtgccttct

SEQ ID NO: 1502762 - DNA, 18 bp, Homo sapiens
gtccttcccctcttcttc

SEQ ID NO: 1502763 - DNA, 23 bp, Homo sapiens
gtccttcctttaggtctggttgt

SEQ ID NO: 1502764 - DNA, 19 bp, Homo sapiens
gtccttgatgccagagggc

SEQ ID NO: 1502765 - DNA, 22 bp, Homo sapiens
gtccttgcacactcccctgcac

SEQ ID NO: 1502766 - DNA, 16 bp, Homo sapiens
gtccttgcacctgcat

SEQ ID NO: 1502767 - DNA, 18 bp, Homo sapiens
gtccttgcacctgcatcc

SEQ ID NO: 1502768 - DNA, 14 bp, Homo sapiens
gtccttgctttggg

SEQ ID NO: 1502769 - DNA, 17 bp, Homo sapiens
gtccttgggcctggcca

SEQ ID NO: 1502770 - DNA, 18 bp, Homo sapiens
gtccttgggcctggccag

SEQ ID NO: 1502771 - DNA, 24 bp, Homo sapiens
gtccttgggcctggccagtcttcc

SEQ ID NO: 1502772 - DNA, 13 bp, Homo sapiens
gtcctttagaaac

SEQ ID NO: 1502773 - DNA, 14 bp, Homo sapiens
gtcctttagtacct

SEQ ID NO: 1502774 - DNA, 22 bp, Homo sapiens
gtcctttatgtggaaaacagaa

SEQ ID NO: 1502775 - DNA, 15 bp, Homo sapiens
gtcctttccatctgt

SEQ ID NO: 1502776 - DNA, 11 bp, Homo sapiens
gtcctttccct

SEQ ID NO: 1502777 - DNA, 16 bp, Homo sapiens
gtcctttctcctgata

SEQ ID NO: 1502778 - DNA, 20 bp, Homo sapiens
gtcctttctggaagtttctg

SEQ ID NO: 1502779 - DNA, 18 bp, Homo sapiens
gtcctttgcgcctgtgac

SEQ ID NO: 1502780 - DNA, 21 bp, Homo sapiens
gtccttttgacactgctctaa

SEQ ID NO: 1502781 - DNA, 17 bp, Homo sapiens
gtccttttgtaccatgg

SEQ ID NO: 1502782 - DNA, 18 bp, Homo sapiens
gtcgaaggggaggcacac

SEQ ID NO: 1502783 - DNA, 19 bp, Homo sapiens
gtcgaaggggaggcacact

SEQ ID NO: 1502784 - DNA, 14 bp, Homo sapiens
gtcgagagggctgt

SEQ ID NO: 1502785 - DNA, 20 bp, Homo sapiens
gtcgaggccacattgctggc

SEQ ID NO: 1502786 - DNA, 21 bp, Homo sapiens
gtcgaggccacattgctggct

SEQ ID NO: 1502787 - DNA, 17 bp, Homo sapiens
gtcgcaggatccgctgc

SEQ ID NO: 1502788 - DNA, 19 bp, Homo sapiens
gtcgccagtcactgctgca

SEQ ID NO: 1502789 - DNA, 12 bp, Homo sapiens
gtcgcccaggag

SEQ ID NO: 1502790 - DNA, 13 bp, Homo sapiens
gtcgcccaggaga

SEQ ID NO: 1502791 - DNA, 21 bp, Homo sapiens
gtcgcctgtaatgccagcgct

SEQ ID NO: 1502792 - DNA, 15 bp, Homo sapiens
gtcgcgctggacagc

SEQ ID NO: 1502793 - DNA, 11 bp, Homo sapiens
gtcgctcctgc

SEQ ID NO: 1502794 - DNA, 23 bp, Homo sapiens
gtcgctgcctccatggcagcagc

SEQ ID NO: 1502795 - DNA, 13 bp, Homo sapiens
gtcggagctgcct

SEQ ID NO: 1502796 - DNA, 16 bp, Homo sapiens
gtcggagctgcctgca

SEQ ID NO: 1502797 - DNA, 17 bp, Homo sapiens
gtcggagtgcctggagt

SEQ ID NO: 1502798 - DNA, 18 bp, Homo sapiens
gtcggagtgcctggagtc

SEQ ID NO: 1502799 - DNA, 14 bp, Homo sapiens
gtcggatcctgtga

SEQ ID NO: 1502800 - DNA, 13 bp, Homo sapiens
gtcggatctcaca

SEQ ID NO: 1502801 - DNA, 14 bp, Homo sapiens
gtcggatctcacag

SEQ ID NO: 1502802 - DNA, 16 bp, Homo sapiens
gtcggcatgccaggac

SEQ ID NO: 1502803 - DNA, 17 bp, Homo sapiens
gtcggccgaccaggctg

SEQ ID NO: 1502804 - DNA, 15 bp, Homo sapiens
gtcgggaggagcagc

SEQ ID NO: 1502805 - DNA, 18 bp, Homo sapiens
gtcgggagttcgagacca

SEQ ID NO: 1502806 - DNA, 14 bp, Homo sapiens
gtcgggcaccagcc

SEQ ID NO: 1502807 - DNA, 18 bp, Homo sapiens
gtcgggggctgaggggca

SEQ ID NO: 1502808 - DNA, 13 bp, Homo sapiens
gtcggggtggggg

SEQ ID NO: 1502809 - DNA, 15 bp, Homo sapiens
gtcggtctgctttgg

SEQ ID NO: 1502810 - DNA, 15 bp, Homo sapiens
gtcgtagaattcctt

SEQ ID NO: 1502811 - DNA, 17 bp, Homo sapiens
gtcgtcatcagatgctt

SEQ ID NO: 1502812 - DNA, 22 bp, Homo sapiens
gtcgtcttgaacgagcagccca

SEQ ID NO: 1502813 - DNA, 12 bp, Homo sapiens
gtcgtgcctgtg

SEQ ID NO: 1502814 - DNA, 18 bp, Homo sapiens
gtcgtgcctgtgtccatg

SEQ ID NO: 1502815 - DNA, 19 bp, Homo sapiens
gtcgtgggccagtccccga

SEQ ID NO: 1502816 - DNA, 19 bp, Homo sapiens
gtcgttttcataacttgct

SEQ ID NO: 1502817 - DNA, 11 bp, Homo sapiens
gtctaaaactc

SEQ ID NO: 1502818 - DNA, 20 bp, Homo sapiens
gtctaaagatggagtttcta

SEQ ID NO: 1502819 - DNA, 23 bp, Homo sapiens
gtctaaagatggagtttctaagg

SEQ ID NO: 1502820 - DNA, 16 bp, Homo sapiens
gtctaaataagtttgc

SEQ ID NO: 1502821 - DNA, 15 bp, Homo sapiens
gtctaaatgctgaaa

SEQ ID NO: 1502822 - DNA, 16 bp, Homo sapiens
gtctaactcagaatta

SEQ ID NO: 1502823 - DNA, 12 bp, Homo sapiens
gtctaagattct

SEQ ID NO: 1502824 - DNA, 22 bp, Homo sapiens
gtctaagcaagatgttttgtat

SEQ ID NO: 1502825 - DNA, 23 bp, Homo sapiens
gtctaagcagttttgtaaatgta

SEQ ID NO: 1502826 - DNA, 13 bp, Homo sapiens
gtctaaggaagaa

SEQ ID NO: 1502827 - DNA, 11 bp, Homo sapiens
gtctactgtgg

SEQ ID NO: 1502828 - DNA, 19 bp, Homo sapiens
gtctagattcaaaggttct

SEQ ID NO: 1502829 - DNA, 22 bp, Homo sapiens
gtctagattcaaaggttctagg

SEQ ID NO: 1502830 - DNA, 14 bp, Homo sapiens
gtctaggacacagt

SEQ ID NO: 1502831 - DNA, 21 bp, Homo sapiens
gtctaggagacagagccaagc

SEQ ID NO: 1502832 - DNA, 18 bp, Homo sapiens
gtctagtgtattctcttc

SEQ ID NO: 1502833 - DNA, 22 bp, Homo sapiens
gtctagttcctgatgacccagg

SEQ ID NO: 1502834 - DNA, 20 bp, Homo sapiens
gtctataatggaaacattta

SEQ ID NO: 1502835 - DNA, 22 bp, Homo sapiens
gtctataccttaagaatgccaa

SEQ ID NO: 1502836 - DNA, 14 bp, Homo sapiens
gtctatcattgttg

SEQ ID NO: 1502837 - DNA, 12 bp, Homo sapiens
gtctatgaagtt

SEQ ID NO: 1502838 - DNA, 20 bp, Homo sapiens
gtctatgaagttgctgttta

SEQ ID NO: 1502839 - DNA, 21 bp, Homo sapiens
gtctatgacttatttccttca

SEQ ID NO: 1502840 - DNA, 15 bp, Homo sapiens
gtctattctgagcct

SEQ ID NO: 1502841 - DNA, 18 bp, Homo sapiens
gtctattctgagccttga

SEQ ID NO: 1502842 - DNA, 20 bp, Homo sapiens
gtctatttccactgaacaaa

SEQ ID NO: 1502843 - DNA, 22 bp, Homo sapiens
gtctatttccactgaacaaaac

SEQ ID NO: 1502844 - DNA, 20 bp, Homo sapiens
gtctatttggattattcttt

SEQ ID NO: 1502845 - DNA, 11 bp, Homo sapiens
gtctattttaa

SEQ ID NO: 1502846 - DNA, 16 bp, Homo sapiens
gtctattttaaaataa

SEQ ID NO: 1502847 - DNA, 23 bp, Homo sapiens
gtctattttattatgagctttct

SEQ ID NO: 1502848 - DNA, 20 bp, Homo sapiens
gtctattttgtatatttgta

SEQ ID NO: 1502849 - DNA, 18 bp, Homo sapiens
gtctcaaaataaagcaat

SEQ ID NO: 1502850 - DNA, 20 bp, Homo sapiens
gtctcaaactcctgggctca

SEQ ID NO: 1502851 - DNA, 22 bp, Homo sapiens
gtctcaagagggcactggtggc

SEQ ID NO: 1502852 - DNA, 14 bp, Homo sapiens
gtctcaagggtggc

SEQ ID NO: 1502853 - DNA, 17 bp, Homo sapiens
gtctcacagagaagctc

SEQ ID NO: 1502854 - DNA, 19 bp, Homo sapiens
gtctcacagtgttgcccag

SEQ ID NO: 1502855 - DNA, 23 bp, Homo sapiens
gtctcacagtgttgcccaggctg

SEQ ID NO: 1502856 - DNA, 13 bp, Homo sapiens
gtctcacccatgc

SEQ ID NO: 1502857 - DNA, 23 bp, Homo sapiens
gtctcacccatgcaagcagagga

SEQ ID NO: 1502858 - DNA, 22 bp, Homo sapiens
gtctcacccattatctggaata

SEQ ID NO: 1502859 - DNA, 14 bp, Homo sapiens
gtctcactcctgag

SEQ ID NO: 1502860 - DNA, 15 bp, Homo sapiens
gtctcactgaaacat

SEQ ID NO: 1502861 - DNA, 16 bp, Homo sapiens
gtctcagagagttaat

SEQ ID NO: 1502862 - DNA, 14 bp, Homo sapiens
gtctcagagcacag

SEQ ID NO: 1502863 - DNA, 16 bp, Homo sapiens
gtctcagcctcctgag

SEQ ID NO: 1502864 - DNA, 14 bp, Homo sapiens
gtctcagcctctgc

SEQ ID NO: 1502865 - DNA, 15 bp, Homo sapiens
gtctcagcctctgcc

SEQ ID NO: 1502866 - DNA, 16 bp, Homo sapiens
gtctcagcctctgcca

SEQ ID NO: 1502867 - DNA, 17 bp, Homo sapiens
gtctcagcctctgccag

SEQ ID NO: 1502868 - DNA, 20 bp, Homo sapiens
gtctcagcctctgccagcgc

SEQ ID NO: 1502869 - DNA, 12 bp, Homo sapiens
gtctcaggagca

SEQ ID NO: 1502870 - DNA, 16 bp, Homo sapiens
gtctcaggagcatggg

SEQ ID NO: 1502871 - DNA, 14 bp, Homo sapiens
gtctcagtttcttg

SEQ ID NO: 1502872 - DNA, 21 bp, Homo sapiens
gtctcagtttgtgtgtcttaa

SEQ ID NO: 1502873 - DNA, 15 bp, Homo sapiens
gtctcatccccaggg

SEQ ID NO: 1502874 - DNA, 14 bp, Homo sapiens
gtctcatctcttca

SEQ ID NO: 1502875 - DNA, 20 bp, Homo sapiens
gtctcattccgttgtctgtg

SEQ ID NO: 1502876 - DNA, 17 bp, Homo sapiens
gtctcattcgcctttgt

SEQ ID NO: 1502877 - DNA, 10 bp, Homo sapiens
gtctcatttt

SEQ ID NO: 1502878 - DNA, 17 bp, Homo sapiens
gtctccaaccccccagc

SEQ ID NO: 1502879 - DNA, 20 bp, Homo sapiens
gtctccaaccccccagcact

SEQ ID NO: 1502880 - DNA, 14 bp, Homo sapiens
gtctccaagggagg

SEQ ID NO: 1502881 - DNA, 20 bp, Homo sapiens
gtctccacctacacccctgt

SEQ ID NO: 1502882 - DNA, 21 bp, Homo sapiens
gtctccactaaatgagctcct

SEQ ID NO: 1502883 - DNA, 11 bp, Homo sapiens
gtctccagccc

SEQ ID NO: 1502884 - DNA, 12 bp, Homo sapiens
gtctccagctgc

SEQ ID NO: 1502885 - DNA, 13 bp, Homo sapiens
gtctccagctgcc

SEQ ID NO: 1502886 - DNA, 15 bp, Homo sapiens
gtctccagctgcctg

SEQ ID NO: 1502887 - DNA, 17 bp, Homo sapiens
gtctccagctgcctggg

SEQ ID NO: 1502888 - DNA, 18 bp, Homo sapiens
gtctccagctgcctgggc

SEQ ID NO: 1502889 - DNA, 19 bp, Homo sapiens
gtctccagctgcctgggcc

SEQ ID NO: 1502890 - DNA, 20 bp, Homo sapiens
gtctccagggccccccaact

SEQ ID NO: 1502891 - DNA, 18 bp, Homo sapiens
gtctccaggggcctgcag

SEQ ID NO: 1502892 - DNA, 22 bp, Homo sapiens
gtctccaggggctgcttcctcc

SEQ ID NO: 1502893 - DNA, 19 bp, Homo sapiens
gtctccatatcagctctct

SEQ ID NO: 1502894 - DNA, 18 bp, Homo sapiens
gtctccatgaagagcttg

SEQ ID NO: 1502895 - DNA, 22 bp, Homo sapiens
gtctccatgaggtactggtccc

SEQ ID NO: 1502896 - DNA, 19 bp, Homo sapiens
gtctcccatatgcagaaat

SEQ ID NO: 1502897 - DNA, 19 bp, Homo sapiens
gtctccccaattctcccct

SEQ ID NO: 1502898 - DNA, 16 bp, Homo sapiens
gtctccctctcctgcc

SEQ ID NO: 1502899 - DNA, 18 bp, Homo sapiens
gtctccctctcctgccta

SEQ ID NO: 1502900 - DNA, 19 bp, Homo sapiens
gtctccctctcctgcctac

SEQ ID NO: 1502901 - DNA, 20 bp, Homo sapiens
gtctccctctcctgcctact

SEQ ID NO: 1502902 - DNA, 15 bp, Homo sapiens
gtctccctgcacagc

SEQ ID NO: 1502903 - DNA, 17 bp, Homo sapiens
gtctccctgcacagcct

SEQ ID NO: 1502904 - DNA, 11 bp, Homo sapiens
gtctccctggc

SEQ ID NO: 1502905 - DNA, 12 bp, Homo sapiens
gtctccctggct

SEQ ID NO: 1502906 - DNA, 15 bp, Homo sapiens
gtctccctggctccc

SEQ ID NO: 1502907 - DNA, 18 bp, Homo sapiens
gtctccctggtgcctctg

SEQ ID NO: 1502908 - DNA, 19 bp, Homo sapiens
gtctccctggtgcctctgt

SEQ ID NO: 1502909 - DNA, 16 bp, Homo sapiens
gtctcccttctctctc

SEQ ID NO: 1502910 - DNA, 13 bp, Homo sapiens
gtctccgagagag

SEQ ID NO: 1502911 - DNA, 14 bp, Homo sapiens
gtctcctatcctgg

SEQ ID NO: 1502912 - DNA, 18 bp, Homo sapiens
gtctcctatcctggtttt

SEQ ID NO: 1502913 - DNA, 19 bp, Homo sapiens
gtctcctcagggtgggggg

SEQ ID NO: 1502914 - DNA, 22 bp, Homo sapiens
gtctcctcagggtggggggtga

SEQ ID NO: 1502915 - DNA, 23 bp, Homo sapiens
gtctcctcccagcggcctccggc

SEQ ID NO: 1502916 - DNA, 12 bp, Homo sapiens
gtctcctccctc

SEQ ID NO: 1502917 - DNA, 13 bp, Homo sapiens
gtctcctctccat

SEQ ID NO: 1502918 - DNA, 16 bp, Homo sapiens
gtctcctctccatttt

SEQ ID NO: 1502919 - DNA, 14 bp, Homo sapiens
gtctcctctctgag

SEQ ID NO: 1502920 - DNA, 22 bp, Homo sapiens
gtctcctcttaaaaaataaaaa

SEQ ID NO: 1502921 - DNA, 23 bp, Homo sapiens
gtctcctcttaaaaaataaaaac

SEQ ID NO: 1502922 - DNA, 20 bp, Homo sapiens
gtctcctgtcttcagagcaa

SEQ ID NO: 1502923 - DNA, 17 bp, Homo sapiens
gtctccttactctgagc

SEQ ID NO: 1502924 - DNA, 20 bp, Homo sapiens
gtctccttactctgagccca

SEQ ID NO: 1502925 - DNA, 15 bp, Homo sapiens
gtctccttcagcacg

SEQ ID NO: 1502926 - DNA, 16 bp, Homo sapiens
gtctccttcagcacgg

SEQ ID NO: 1502927 - DNA, 11 bp, Homo sapiens
gtctccttggc

SEQ ID NO: 1502928 - DNA, 17 bp, Homo sapiens
gtctccttggctgtctg

SEQ ID NO: 1502929 - DNA, 15 bp, Homo sapiens
gtctcctttgcactg

SEQ ID NO: 1502930 - DNA, 14 bp, Homo sapiens
gtctcctttgctct

SEQ ID NO: 1502931 - DNA, 17 bp, Homo sapiens
gtctcgaactcctggcc

SEQ ID NO: 1502932 - DNA, 20 bp, Homo sapiens
gtctcgaactcctggcctca

SEQ ID NO: 1502933 - DNA, 14 bp, Homo sapiens
gtctcgatctcctg

SEQ ID NO: 1502934 - DNA, 15 bp, Homo sapiens
gtctcgatctcctga

SEQ ID NO: 1502935 - DNA, 18 bp, Homo sapiens
gtctcgcagcctgaagcc

SEQ ID NO: 1502936 - DNA, 20 bp, Homo sapiens
gtctcgcagcctgaagcctg

SEQ ID NO: 1502937 - DNA, 22 bp, Homo sapiens
gtctcgcagcctgaagcctgga

SEQ ID NO: 1502938 - DNA, 22 bp, Homo sapiens
gtctcggggcttgccccactct

SEQ ID NO: 1502939 - DNA, 22 bp, Homo sapiens
gtctctaagccaactttaattg

SEQ ID NO: 1502940 - DNA, 18 bp, Homo sapiens
gtctctagagcagggatt

SEQ ID NO: 1502941 - DNA, 17 bp, Homo sapiens
gtctctataccaataaa

SEQ ID NO: 1502942 - DNA, 18 bp, Homo sapiens
gtctctatattatgtctt

SEQ ID NO: 1502943 - DNA, 16 bp, Homo sapiens
gtctctcacagatgtg

SEQ ID NO: 1502944 - DNA, 12 bp, Homo sapiens
gtctctcagaat

SEQ ID NO: 1502945 - DNA, 16 bp, Homo sapiens
gtctctcccaccccgg

SEQ ID NO: 1502946 - DNA, 22 bp, Homo sapiens
gtctctcccaccccggcctcca

SEQ ID NO: 1502947 - DNA, 14 bp, Homo sapiens
gtctctctccaggt

SEQ ID NO: 1502948 - DNA, 21 bp, Homo sapiens
gtctctctccaggtcagcctg

SEQ ID NO: 1502949 - DNA, 19 bp, Homo sapiens
gtctctcttctctccagct

SEQ ID NO: 1502950 - DNA, 17 bp, Homo sapiens
gtctctctttctccctc

SEQ ID NO: 1502951 - DNA, 20 bp, Homo sapiens
gtctctctttctccctcacc

SEQ ID NO: 1502952 - DNA, 15 bp, Homo sapiens
gtctctgagtccttt

SEQ ID NO: 1502953 - DNA, 13 bp, Homo sapiens
gtctctgccatgt

SEQ ID NO: 1502954 - DNA, 15 bp, Homo sapiens
gtctctgccatgtgg

SEQ ID NO: 1502955 - DNA, 15 bp, Homo sapiens
gtctctgccccagcc

SEQ ID NO: 1502956 - DNA, 16 bp, Homo sapiens
gtctctgccccagcct

SEQ ID NO: 1502957 - DNA, 18 bp, Homo sapiens
gtctctgccccagcctgt

SEQ ID NO: 1502958 - DNA, 17 bp, Homo sapiens
gtctctgctggcccagc

SEQ ID NO: 1502959 - DNA, 21 bp, Homo sapiens
gtctctggcagttctggaatg

SEQ ID NO: 1502960 - DNA, 13 bp, Homo sapiens
gtctctgggagcc

SEQ ID NO: 1502961 - DNA, 14 bp, Homo sapiens
gtctcttctccact

SEQ ID NO: 1502962 - DNA, 19 bp, Homo sapiens
gtctcttctgggcaccctc

SEQ ID NO: 1502963 - DNA, 20 bp, Homo sapiens
gtctcttcttggggcccagt

SEQ ID NO: 1502964 - DNA, 13 bp, Homo sapiens
gtctcttgaggga

SEQ ID NO: 1502965 - DNA, 18 bp, Homo sapiens
gtctctttaagttttgat

SEQ ID NO: 1502966 - DNA, 16 bp, Homo sapiens
gtctgaaacagagaac

SEQ ID NO: 1502967 - DNA, 21 bp, Homo sapiens
gtctgaaactggcttccccac

SEQ ID NO: 1502968 - DNA, 12 bp, Homo sapiens
gtctgaacaaag

SEQ ID NO: 1502969 - DNA, 13 bp, Homo sapiens
gtctgaacccttg

SEQ ID NO: 1502970 - DNA, 19 bp, Homo sapiens
gtctgaacccttgtgcttg

SEQ ID NO: 1502971 - DNA, 19 bp, Homo sapiens
gtctgaaggacacttcctg

SEQ ID NO: 1502972 - DNA, 20 bp, Homo sapiens
gtctgaaggacacttcctgc

SEQ ID NO: 1502973 - DNA, 17 bp, Homo sapiens
gtctgaagtcactgcac

SEQ ID NO: 1502974 - DNA, 17 bp, Homo sapiens
gtctgaatattctagaa

SEQ ID NO: 1502975 - DNA, 14 bp, Homo sapiens
gtctgaccagagaa

SEQ ID NO: 1502976 - DNA, 17 bp, Homo sapiens
gtctgaccagagaatgc

SEQ ID NO: 1502977 - DNA, 21 bp, Homo sapiens
gtctgaccagagaatgcacct

SEQ ID NO: 1502978 - DNA, 14 bp, Homo sapiens
gtctgacctggtgg

SEQ ID NO: 1502979 - DNA, 20 bp, Homo sapiens
gtctgactccagagtctgag

SEQ ID NO: 1502980 - DNA, 10 bp, Homo sapiens
gtctgagact

SEQ ID NO: 1502981 - DNA, 15 bp, Homo sapiens
gtctgagccctggtg

SEQ ID NO: 1502982 - DNA, 20 bp, Homo sapiens
gtctgagcggcgcagagccc

SEQ ID NO: 1502983 - DNA, 22 bp, Homo sapiens
gtctgaggcctcatccctcgga

SEQ ID NO: 1502984 - DNA, 14 bp, Homo sapiens
gtctgagtctatgt

SEQ ID NO: 1502985 - DNA, 18 bp, Homo sapiens
gtctgagtctgagtcctg

SEQ ID NO: 1502986 - DNA, 17 bp, Homo sapiens
gtgaaagcatatgggtt

SEQ ID NO: 1502987 - DNA, 21 bp, Homo sapiens
gtgaaatagttcaaagccaag

SEQ ID NO: 1502988 - DNA, 15 bp, Homo sapiens
gtgaaatggctgggg

SEQ ID NO: 1502989 - DNA, 20 bp, Homo sapiens
gtgaaatgtatgtctgtcta

SEQ ID NO: 1502990 - DNA, 22 bp, Homo sapiens
gtgaaatttacagttactgcct

SEQ ID NO: 1502991 - DNA, 20 bp, Homo sapiens
gtgaaatttacatcatttct

SEQ ID NO: 1502992 - DNA, 18 bp, Homo sapiens
gtgaacaaaagatgctct

SEQ ID NO: 1502993 - DNA, 19 bp, Homo sapiens
gtgaacaaaagatgctctt

SEQ ID NO: 1502994 - DNA, 13 bp, Homo sapiens
gtgaacacacaca

SEQ ID NO: 1502995 - DNA, 15 bp, Homo sapiens
gtgaacagctggtgc

SEQ ID NO: 1502996 - DNA, 16 bp, Homo sapiens
gtgaacagctggtgcc

SEQ ID NO: 1502997 - DNA, 14 bp, Homo sapiens
gtgaacattcccag

SEQ ID NO: 1502998 - DNA, 20 bp, Homo sapiens
gtgaaccaacccccatctcc

SEQ ID NO: 1502999 - DNA, 14 bp, Homo sapiens
gtgaaccctggggc

SEQ ID NO: 1503000 - DNA, 21 bp, Homo sapiens
gtgaaccctggggcctgactg

SEQ ID NO: 1503001 - DNA, 17 bp, Homo sapiens
gtgaactagggaagctc

SEQ ID NO: 1503002 - DNA, 20 bp, Homo sapiens
gtgaactatttctacacagt

SEQ ID NO: 1503003 - DNA, 23 bp, Homo sapiens
gtgaactcaccctgggagccagt

SEQ ID NO: 1503004 - DNA, 20 bp, Homo sapiens
gtgaactgcaaagctttggc

SEQ ID NO: 1503005 - DNA, 18 bp, Homo sapiens
gtgaactggaagaaagca

SEQ ID NO: 1503006 - DNA, 17 bp, Homo sapiens
gtgaacttgactgggtg

SEQ ID NO: 1503007 - DNA, 14 bp, Homo sapiens
gtgaagaaccctat

SEQ ID NO: 1503008 - DNA, 20 bp, Homo sapiens
gtgaagaaccctgcagggcc

SEQ ID NO: 1503009 - DNA, 13 bp, Homo sapiens
gtgaagaagcctg

SEQ ID NO: 1503010 - DNA, 14 bp, Homo sapiens
gtgaagaatacatc

SEQ ID NO: 1503011 - DNA, 21 bp, Homo sapiens
gtgaagaatgcacaagaatgg

SEQ ID NO: 1503012 - DNA, 18 bp, Homo sapiens
gtgaagactgggtgagga

SEQ ID NO: 1503013 - DNA, 15 bp, Homo sapiens
gtgaagacttcttgg

SEQ ID NO: 1503014 - DNA, 15 bp, Homo sapiens
gtgaagagccggtgg

SEQ ID NO: 1503015 - DNA, 20 bp, Homo sapiens
gtgaagaggctgcttctcta

SEQ ID NO: 1503016 - DNA, 22 bp, Homo sapiens
gtgaagatgcaatcagacaagt

SEQ ID NO: 1503017 - DNA, 17 bp, Homo sapiens
gtgaagcagcactgtga

SEQ ID NO: 1503018 - DNA, 18 bp, Homo sapiens
gtgaagcagcactgtgag

SEQ ID NO: 1503019 - DNA, 16 bp, Homo sapiens
gtgaagcagtgcctcg

SEQ ID NO: 1503020 - DNA, 18 bp, Homo sapiens
gtgaagcatgctttgctg

SEQ ID NO: 1503021 - DNA, 18 bp, Homo sapiens
gtgaaggatccaggaata

SEQ ID NO: 1503022 - DNA, 18 bp, Homo sapiens
gtgaagggaagtggggag

SEQ ID NO: 1503023 - DNA, 21 bp, Homo sapiens
gtgaaggtattttgtagatgt

SEQ ID NO: 1503024 - DNA, 19 bp, Homo sapiens
gtgaagtaacccctcctgg

SEQ ID NO: 1503025 - DNA, 21 bp, Homo sapiens
gtgaagtaacccctcctggct

SEQ ID NO: 1503026 - DNA, 17 bp, Homo sapiens
gtgaagtatactgtatt

SEQ ID NO: 1503027 - DNA, 15 bp, Homo sapiens
gtgaagtgaatctga

SEQ ID NO: 1503028 - DNA, 16 bp, Homo sapiens
gtgaagtgaatctgat

SEQ ID NO: 1503029 - DNA, 14 bp, Homo sapiens
gtgaagtgtatatg

SEQ ID NO: 1503030 - DNA, 15 bp, Homo sapiens
gtgaataaaaaccct

SEQ ID NO: 1503031 - DNA, 18 bp, Homo sapiens
gtgaataaaaaccctgta

SEQ ID NO: 1503032 - DNA, 23 bp, Homo sapiens
gtgaataatcatgtgaaatgttt

SEQ ID NO: 1503033 - DNA, 14 bp, Homo sapiens
gtgaataattacag

SEQ ID NO: 1503034 - DNA, 16 bp, Homo sapiens
gtgaatccaggaggca

SEQ ID NO: 1503035 - DNA, 15 bp, Homo sapiens
gtgaatcctggcaag

SEQ ID NO: 1503036 - DNA, 17 bp, Homo sapiens
gtgaatcgcagctgtgg

SEQ ID NO: 1503037 - DNA, 11 bp, Homo sapiens
gtgaatcttga

SEQ ID NO: 1503038 - DNA, 13 bp, Homo sapiens
gtgggtggagaag

SEQ ID NO: 1503039 - DNA, 16 bp, Homo sapiens
gtgggtggagtcaggc

SEQ ID NO: 1503040 - DNA, 20 bp, Homo sapiens
gtgggtggcacctcctgaga

SEQ ID NO: 1503041 - DNA, 14 bp, Homo sapiens
gtgggtggtgggga

SEQ ID NO: 1503042 - DNA, 22 bp, Homo sapiens
gtgggtgtgggacacctgggag

SEQ ID NO: 1503043 - DNA, 19 bp, Homo sapiens
gtgggtttctctgtgctct

SEQ ID NO: 1503044 - DNA, 22 bp, Homo sapiens
gtgggttttattgtccttcaga

SEQ ID NO: 1503045 - DNA, 18 bp, Homo sapiens
gtgggttttttagttgaa

SEQ ID NO: 1503046 - DNA, 14 bp, Homo sapiens
gtggtaaattcaga

SEQ ID NO: 1503047 - DNA, 16 bp, Homo sapiens
gtggtaaattcagaca

SEQ ID NO: 1503048 - DNA, 13 bp, Homo sapiens
gtggtaactgcca

SEQ ID NO: 1503049 - DNA, 15 bp, Homo sapiens
gtggtaagtggagga

SEQ ID NO: 1503050 - DNA, 15 bp, Homo sapiens
gtggtaatctacacc

SEQ ID NO: 1503051 - DNA, 23 bp, Homo sapiens
gtggtacccaggctttagcatta

SEQ ID NO: 1503052 - DNA, 20 bp, Homo sapiens
gtggtactttattcttgctg

SEQ ID NO: 1503053 - DNA, 13 bp, Homo sapiens
gtggtagctccag

SEQ ID NO: 1503054 - DNA, 16 bp, Homo sapiens
gtggtaggggcaggga

SEQ ID NO: 1503055 - DNA, 16 bp, Homo sapiens
gtggtagtatctcgta

SEQ ID NO: 1503056 - DNA, 15 bp, Homo sapiens
gtggtatgtctgcca

SEQ ID NO: 1503057 - DNA, 16 bp, Homo sapiens
gtggtcacagcggagg

SEQ ID NO: 1503058 - DNA, 18 bp, Homo sapiens
gtggtcacagcggaggtg

SEQ ID NO: 1503059 - DNA, 15 bp, Homo sapiens
gtggtcagagtgcca

SEQ ID NO: 1503060 - DNA, 20 bp, Homo sapiens
gtggtcatgctcagccttgc

SEQ ID NO: 1503061 - DNA, 19 bp, Homo sapiens
gtggtccagcgtcactcca

SEQ ID NO: 1503062 - DNA, 16 bp, Homo sapiens
gtggtccagctcttgg

SEQ ID NO: 1503063 - DNA, 23 bp, Homo sapiens
gtggtccagctcttggcccctgt

SEQ ID NO: 1503064 - DNA, 20 bp, Homo sapiens
gtggtcctcctatctccctg

SEQ ID NO: 1503065 - DNA, 20 bp, Homo sapiens
gtggtctctgccccagcctg

SEQ ID NO: 1503066 - DNA, 21 bp, Homo sapiens
gtggtctctgccccagcctgt

SEQ ID NO: 1503067 - DNA, 21 bp, Homo sapiens
gtggtctcttcttggggccca

SEQ ID NO: 1503068 - DNA, 23 bp, Homo sapiens
gtggtctcttcttggggcccagt

SEQ ID NO: 1503069 - DNA, 13 bp, Homo sapiens
gtggtctgttggc

SEQ ID NO: 1503070 - DNA, 12 bp, Homo sapiens
gtggtcttcctt

SEQ ID NO: 1503071 - DNA, 16 bp, Homo sapiens
gtggtctttctggaga

SEQ ID NO: 1503072 - DNA, 17 bp, Homo sapiens
gtggtctttctggagag

SEQ ID NO: 1503073 - DNA, 17 bp, Homo sapiens
gtggtgacacctccccc

SEQ ID NO: 1503074 - DNA, 13 bp, Homo sapiens
gtggtgagatcat

SEQ ID NO: 1503075 - DNA, 22 bp, Homo sapiens
gtggtgaggggctttctcttcc

SEQ ID NO: 1503076 - DNA, 17 bp, Homo sapiens
gtggtgccatccccagg

SEQ ID NO: 1503077 - DNA, 21 bp, Homo sapiens
gtggtgcgtttataattggct

SEQ ID NO: 1503078 - DNA, 14 bp, Homo sapiens
gtggtgctgggact

SEQ ID NO: 1503079 - DNA, 17 bp, Homo sapiens
gtggtggcagtggaggt

SEQ ID NO: 1503080 - DNA, 23 bp, Homo sapiens
gtggtggcatacgcctgtagtcc

SEQ ID NO: 1503081 - DNA, 20 bp, Homo sapiens
gtggtggggaggggcgctgg

SEQ ID NO: 1503082 - DNA, 21 bp, Homo sapiens
gtggtgtgcggagtctcctct

SEQ ID NO: 1503083 - DNA, 20 bp, Homo sapiens
gtggtgtgtccctggacaca

SEQ ID NO: 1503084 - DNA, 15 bp, Homo sapiens
gtggtgtttattgca

SEQ ID NO: 1503085 - DNA, 21 bp, Homo sapiens
gtggttacagtgcagacaggc

SEQ ID NO: 1503086 - DNA, 21 bp, Homo sapiens
gtggttatgttcccagcagtg

SEQ ID NO: 1503087 - DNA, 20 bp, Homo sapiens
gtggttcagtgccttcctct

SEQ ID NO: 1503088 - DNA, 21 bp, Homo sapiens
gtggttccatgcagccttggg

SEQ ID NO: 1503089 - DNA, 13 bp, Homo sapiens
gtggttccgggct

SEQ ID NO: 1503090 - DNA, 20 bp, Homo sapiens
gtgtaaaaaatggaaaaaaa

SEQ ID NO: 1503091 - DNA, 16 bp, Homo sapiens
gtgtaaaaagcctcct

SEQ ID NO: 1503092 - DNA, 17 bp, Homo sapiens
gtgtaacaattgtgtag

SEQ ID NO: 1503093 - DNA, 12 bp, Homo sapiens
gtgtaacagctg

SEQ ID NO: 1503094 - DNA, 15 bp, Homo sapiens
gtgtaacagctgagg

SEQ ID NO: 1503095 - DNA, 21 bp, Homo sapiens
gtgtaacatccaagccagagt

SEQ ID NO: 1503096 - DNA, 21 bp, Homo sapiens
gtgtaaccagttataaataca

SEQ ID NO: 1503097 - DNA, 15 bp, Homo sapiens
gtgtaacttcctgct

SEQ ID NO: 1503098 - DNA, 17 bp, Homo sapiens
gtgtaacttcctgctgc

SEQ ID NO: 1503099 - DNA, 20 bp, Homo sapiens
gtgtaacttgcttaaatttc

SEQ ID NO: 1503100 - DNA, 13 bp, Homo sapiens
gtgtaagaactgt

SEQ ID NO: 1503101 - DNA, 17 bp, Homo sapiens
gtgtaagaactgtacat

SEQ ID NO: 1503102 - DNA, 21 bp, Homo sapiens
gtgtaagaactgtacattgtg

SEQ ID NO: 1503103 - DNA, 22 bp, Homo sapiens
gtgtaagaactgtacattgtga

SEQ ID NO: 1503104 - DNA, 23 bp, Homo sapiens
gtgtaatttaaaattgtgatgtg

SEQ ID NO: 1503105 - DNA, 23 bp, Homo sapiens
gtgtaatttaagtgacacagaca

SEQ ID NO: 1503106 - DNA, 15 bp, Homo sapiens
gtgtaatttgaagat

SEQ ID NO: 1503107 - DNA, 14 bp, Homo sapiens
gtgtacaaaactgt

SEQ ID NO: 1503108 - DNA, 21 bp, Homo sapiens
gtgtacacgggactgacgcaa

SEQ ID NO: 1503109 - DNA, 18 bp, Homo sapiens
gtgtacagaattctgcta

SEQ ID NO: 1503110 - DNA, 12 bp, Homo sapiens
gtgtacagtgtg

SEQ ID NO: 1503111 - DNA, 19 bp, Homo sapiens
gtgtacatagagcaatgtt

SEQ ID NO: 1503112 - DNA, 17 bp, Homo sapiens
gtgtacatcatgttatt

SEQ ID NO: 1503113 - DNA, 17 bp, Homo sapiens
gtgtacatggaataaca

SEQ ID NO: 1503114 - DNA, 20 bp, Homo sapiens
gtgtaccacctaatgtttat

SEQ ID NO: 1503115 - DNA, 16 bp, Homo sapiens
gtgtaccacttcctga

SEQ ID NO: 1503116 - DNA, 19 bp, Homo sapiens
gtgtaccacttcctgaggc

SEQ ID NO: 1503117 - DNA, 21 bp, Homo sapiens
gtgtacctcctctcagtgttt

SEQ ID NO: 1503118 - DNA, 13 bp, Homo sapiens
gtgtactgataaa

SEQ ID NO: 1503119 - DNA, 14 bp, Homo sapiens
gtgtagaacactaa

SEQ ID NO: 1503120 - DNA, 15 bp, Homo sapiens
gtgtagaacactaat

SEQ ID NO: 1503121 - DNA, 21 bp, Homo sapiens
gtgtagccagccaggtgcatg

SEQ ID NO: 1503122 - DNA, 16 bp, Homo sapiens
gtgtagcctaaagggc

SEQ ID NO: 1503123 - DNA, 19 bp, Homo sapiens
gtgtagcctaaagggcagg

SEQ ID NO: 1503124 - DNA, 21 bp, Homo sapiens
gtgtagcctaaagggcagggc

SEQ ID NO: 1503125 - DNA, 14 bp, Homo sapiens
gtgtagcctgtgca

SEQ ID NO: 1503126 - DNA, 16 bp, Homo sapiens
gtgtagccttgcccgg

SEQ ID NO: 1503127 - DNA, 23 bp, Homo sapiens
gtgtagctgcaaaaataatcatg

SEQ ID NO: 1503128 - DNA, 18 bp, Homo sapiens
gtgtagctgtaagggcag

SEQ ID NO: 1503129 - DNA, 22 bp, Homo sapiens
gtgtagctgtaagggcagtgcc

SEQ ID NO: 1503130 - DNA, 14 bp, Homo sapiens
gtgtagctgtgaaa

SEQ ID NO: 1503131 - DNA, 14 bp, Homo sapiens
gtgtagctttgctc

SEQ ID NO: 1503132 - DNA, 17 bp, Homo sapiens
gtgtagtggaagagcag

SEQ ID NO: 1503133 - DNA, 22 bp, Homo sapiens
gtgtagtggaagagcagcctga

SEQ ID NO: 1503134 - DNA, 14 bp, Homo sapiens
gtgtatagtgttca

SEQ ID NO: 1503135 - DNA, 15 bp, Homo sapiens
gtgtcacagagagct

SEQ ID NO: 1503136 - DNA, 15 bp, Homo sapiens
gtgtcagagcccagc

SEQ ID NO: 1503137 - DNA, 16 bp, Homo sapiens
gtgtcagagcccagcc

SEQ ID NO: 1503138 - DNA, 22 bp, Homo sapiens
gtgtcaggcccgtcggagctgc

SEQ ID NO: 1503139 - DNA, 17 bp, Homo sapiens
gtgtcaggccctctgcc

SEQ ID NO: 1503140 - DNA, 20 bp, Homo sapiens
gtgtcaggccctctgcctgc

SEQ ID NO: 1503141 - DNA, 21 bp, Homo sapiens
gtgtcatataaactcatttat

SEQ ID NO: 1503142 - DNA, 20 bp, Homo sapiens
gtgtcatatgactgattact

SEQ ID NO: 1503143 - DNA, 20 bp, Homo sapiens
gtgtcatctaattaagggaa

SEQ ID NO: 1503144 - DNA, 16 bp, Homo sapiens
gtgtcatgaagaatgt

SEQ ID NO: 1503145 - DNA, 19 bp, Homo sapiens
gtgtcatgaagtgcacagg

SEQ ID NO: 1503146 - DNA, 21 bp, Homo sapiens
gtgtcattcccctttgcactg

SEQ ID NO: 1503147 - DNA, 18 bp, Homo sapiens
gtgtcatttatgaaaaga

SEQ ID NO: 1503148 - DNA, 13 bp, Homo sapiens
gtgtccacctggc

SEQ ID NO: 1503149 - DNA, 12 bp, Homo sapiens
gtgtccactgag

SEQ ID NO: 1503150 - DNA, 22 bp, Homo sapiens
gtgtccagcagctgcgggtctg

SEQ ID NO: 1503151 - DNA, 19 bp, Homo sapiens
gtgtccagggtcctctagc

SEQ ID NO: 1503152 - DNA, 20 bp, Homo sapiens
gtgtccagttttggaggctg

SEQ ID NO: 1503153 - DNA, 19 bp, Homo sapiens
gtgtccatcccagcggctg

SEQ ID NO: 1503154 - DNA, 18 bp, Homo sapiens
gtgtccatgcgctcaggg

SEQ ID NO: 1503155 - DNA, 14 bp, Homo sapiens
gtgtcccagccacg

SEQ ID NO: 1503156 - DNA, 17 bp, Homo sapiens
gtgtcccagccacgcag

SEQ ID NO: 1503157 - DNA, 21 bp, Homo sapiens
gtgtcccagccacgcagggcc

SEQ ID NO: 1503158 - DNA, 13 bp, Homo sapiens
gtgtcccaggcag

SEQ ID NO: 1503159 - DNA, 22 bp, Homo sapiens
gtgtcccatgacccacccctgt

SEQ ID NO: 1503160 - DNA, 20 bp, Homo sapiens
gtgtccccaacgtcccctcc

SEQ ID NO: 1503161 - DNA, 16 bp, Homo sapiens
gtgtccctggacacag

SEQ ID NO: 1503162 - DNA, 19 bp, Homo sapiens
gtgtccctggacacagctc

SEQ ID NO: 1503163 - DNA, 22 bp, Homo sapiens
gtgtccctggacacagctcttc

SEQ ID NO: 1503164 - DNA, 15 bp, Homo sapiens
gtgtcctctccctgc

SEQ ID NO: 1503165 - DNA, 21 bp, Homo sapiens
gtgtcctgaaacgctcctttg

SEQ ID NO: 1503166 - DNA, 13 bp, Homo sapiens
gtgtcctgaccac

SEQ ID NO: 1503167 - DNA, 20 bp, Homo sapiens
gtgtcctggtaattcctctc

SEQ ID NO: 1503168 - DNA, 16 bp, Homo sapiens
gtgtcctggtgctctc

SEQ ID NO: 1503169 - DNA, 23 bp, Homo sapiens
gtgtcctggtgctctctgccact

SEQ ID NO: 1503170 - DNA, 19 bp, Homo sapiens
gtgtccttgcacctgcatc

SEQ ID NO: 1503171 - DNA, 23 bp, Homo sapiens
gtgtcgaggccacattgctggct

SEQ ID NO: 1503172 - DNA, 17 bp, Homo sapiens
gtgtcgagtcaaaatgt

SEQ ID NO: 1503173 - DNA, 17 bp, Homo sapiens
gtgtctaagattctaga

SEQ ID NO: 1503174 - DNA, 12 bp, Homo sapiens
gtgtctcagcct

SEQ ID NO: 1503175 - DNA, 17 bp, Homo sapiens
gtgtctcagcctctgcc

SEQ ID NO: 1503176 - DNA, 17 bp, Homo sapiens
gtgtctccaacccccca

SEQ ID NO: 1503177 - DNA, 16 bp, Homo sapiens
gtgtctccccgtgtcc

SEQ ID NO: 1503178 - DNA, 22 bp, Homo sapiens
gtgtctccccgtgtcctctccc

SEQ ID NO: 1503179 - DNA, 14 bp, Homo sapiens
gtgtctctcccacc

SEQ ID NO: 1503180 - DNA, 18 bp, Homo sapiens
gtgtctgacttttgttaa

SEQ ID NO: 1503181 - DNA, 18 bp, Homo sapiens
gtgtctgcagtcctggtg

SEQ ID NO: 1503182 - DNA, 20 bp, Homo sapiens
gtgtctgccaaacacattta

SEQ ID NO: 1503183 - DNA, 22 bp, Homo sapiens
gtgtctgccagctgggcccagc

SEQ ID NO: 1503184 - DNA, 22 bp, Homo sapiens
gtgtctggagacctggatttga

SEQ ID NO: 1503185 - DNA, 12 bp, Homo sapiens
gtgtctggtggg

SEQ ID NO: 1503186 - DNA, 16 bp, Homo sapiens
gtgtctgtacacgtgt

SEQ ID NO: 1503187 - DNA, 14 bp, Homo sapiens
gtgtctgtatttat

SEQ ID NO: 1503188 - DNA, 16 bp, Homo sapiens
gtgtctgtctttgtgg

SEQ ID NO: 1503189 - DNA, 20 bp, Homo sapiens
gtgtctgtgccctccaaaga

SEQ ID NO: 1503190 - DNA, 12 bp, Homo sapiens
gtgtctgtttgg

SEQ ID NO: 1503191 - DNA, 14 bp, Homo sapiens
gtgtcttaattatt

SEQ ID NO: 1503192 - DNA, 12 bp, Homo sapiens
gtgtcttagcat

SEQ ID NO: 1503193 - DNA, 15 bp, Homo sapiens
gtgtcttccataatg

SEQ ID NO: 1503194 - DNA, 20 bp, Homo sapiens
gtgtcttgggcagagctggc

SEQ ID NO: 1503195 - DNA, 14 bp, Homo sapiens
gtgtgaaaaaagaa

SEQ ID NO: 1503196 - DNA, 13 bp, Homo sapiens
gtgtgaaatatat

SEQ ID NO: 1503197 - DNA, 20 bp, Homo sapiens
gtgtgaactcaccctgggag

SEQ ID NO: 1503198 - DNA, 22 bp, Homo sapiens
gtgtgacaattctgtttttaat

SEQ ID NO: 1503199 - DNA, 17 bp, Homo sapiens
gtgtgacagtgtatggg

SEQ ID NO: 1503200 - DNA, 19 bp, Homo sapiens
gtgtgacagtttccaaatt

SEQ ID NO: 1503201 - DNA, 18 bp, Homo sapiens
gtgtgacatttggagagg

SEQ ID NO: 1503202 - DNA, 16 bp, Homo sapiens
gtgtgaccatgttcat

SEQ ID NO: 1503203 - DNA, 15 bp, Homo sapiens
gtgtgagctatgcaa

SEQ ID NO: 1503204 - DNA, 16 bp, Homo sapiens
gtgtgaggagctgctg

SEQ ID NO: 1503205 - DNA, 19 bp, Homo sapiens
gtgtgaggagctgctggct

SEQ ID NO: 1503206 - DNA, 17 bp, Homo sapiens
gtgtgagtgagcacacc

SEQ ID NO: 1503207 - DNA, 17 bp, Homo sapiens
gtgtgagtggcagccat

SEQ ID NO: 1503208 - DNA, 16 bp, Homo sapiens
gtgtgattgaatctga

SEQ ID NO: 1503209 - DNA, 15 bp, Homo sapiens
gtgtgcacgagtggg

SEQ ID NO: 1503210 - DNA, 20 bp, Homo sapiens
gtgtgcacgcctgcaggctg

SEQ ID NO: 1503211 - DNA, 13 bp, Homo sapiens
gtgtgcagacagc

SEQ ID NO: 1503212 - DNA, 21 bp, Homo sapiens
gtgtgcatagcgtcctgccct

SEQ ID NO: 1503213 - DNA, 11 bp, Homo sapiens
gtgtgcatgtg

SEQ ID NO: 1503214 - DNA, 14 bp, Homo sapiens
gtgtgcatgtgtgt

SEQ ID NO: 1503215 - DNA, 19 bp, Homo sapiens
gtgtgcatgtgtgtgtctg

SEQ ID NO: 1503216 - DNA, 17 bp, Homo sapiens
gtgtgcccagcacctgg

SEQ ID NO: 1503217 - DNA, 12 bp, Homo sapiens
gtgtgccccact

SEQ ID NO: 1503218 - DNA, 17 bp, Homo sapiens
gtgtgccccactccagc

SEQ ID NO: 1503219 - DNA, 19 bp, Homo sapiens
gtgtgccccactccagcct

SEQ ID NO: 1503220 - DNA, 15 bp, Homo sapiens
gtgtgcctgcagccc

SEQ ID NO: 1503221 - DNA, 12 bp, Homo sapiens
gtgtgcctgtgc

SEQ ID NO: 1503222 - DNA, 15 bp, Homo sapiens
gtgtgcctgtgctcc

SEQ ID NO: 1503223 - DNA, 22 bp, Homo sapiens
gtgtgcctgtgctcctgcccag

SEQ ID NO: 1503224 - DNA, 13 bp, Homo sapiens
gtgtgcctgtggc

SEQ ID NO: 1503225 - DNA, 14 bp, Homo sapiens
gtgtgcctgtggca

SEQ ID NO: 1503226 - DNA, 16 bp, Homo sapiens
gtgtgcgctctgtgga

SEQ ID NO: 1503227 - DNA, 16 bp, Homo sapiens
gtgtgcgctgcctggc

SEQ ID NO: 1503228 - DNA, 14 bp, Homo sapiens
gtgtgcgtgcgtgt

SEQ ID NO: 1503229 - DNA, 19 bp, Homo sapiens
gtgtgcgtgcgtgtgcgtg

SEQ ID NO: 1503230 - DNA, 14 bp, Homo sapiens
gtgtgctgacaact

SEQ ID NO: 1503231 - DNA, 17 bp, Homo sapiens
gtgtggagagagaggct

SEQ ID NO: 1503232 - DNA, 20 bp, Homo sapiens
gtgtggagagggaatgtgaa

SEQ ID NO: 1503233 - DNA, 22 bp, Homo sapiens
gtgtggagttcaccttggaagg

SEQ ID NO: 1503234 - DNA, 19 bp, Homo sapiens
gtgtggattgcctctgaaa

SEQ ID NO: 1503235 - DNA, 20 bp, Homo sapiens
gtgtggccgcctggcaggtg

SEQ ID NO: 1503236 - DNA, 14 bp, Homo sapiens
gtgtggctcctggg

SEQ ID NO: 1503237 - DNA, 17 bp, Homo sapiens
gtgtgggagtgtgtaat

SEQ ID NO: 1503238 - DNA, 15 bp, Homo sapiens
gtgtgggatacttag

SEQ ID NO: 1503239 - DNA, 17 bp, Homo sapiens
gtgtgggatctggggag

SEQ ID NO: 1503240 - DNA, 22 bp, Homo sapiens
gtgtgggctgcccttgttgcct

SEQ ID NO: 1503241 - DNA, 19 bp, Homo sapiens
gtgtggggacacagcagtg

SEQ ID NO: 1503242 - DNA, 13 bp, Homo sapiens
gtgtggggcatgg

SEQ ID NO: 1503243 - DNA, 18 bp, Homo sapiens
gtgtgggtttggttagag

SEQ ID NO: 1503244 - DNA, 23 bp, Homo sapiens
gtgtggtctctgccccagcctgt

SEQ ID NO: 1503245 - DNA, 21 bp, Homo sapiens
gtgtggtgaggggctttctct

SEQ ID NO: 1503246 - DNA, 17 bp, Homo sapiens
gtgtggtgctacaggga

SEQ ID NO: 1503247 - DNA, 17 bp, Homo sapiens
gtgtggtggagccaggg

SEQ ID NO: 1503248 - DNA, 15 bp, Homo sapiens
gtgtgtactctgtcc

SEQ ID NO: 1503249 - DNA, 17 bp, Homo sapiens
gtgtgtactctgtccag

SEQ ID NO: 1503250 - DNA, 21 bp, Homo sapiens
gtgtgtatgactaaagagaga

SEQ ID NO: 1503251 - DNA, 12 bp, Homo sapiens
gtgtgtatgtgg

SEQ ID NO: 1503252 - DNA, 13 bp, Homo sapiens
gtgtgtatgtggg

SEQ ID NO: 1503253 - DNA, 12 bp, Homo sapiens
gtgtgtatttgt

SEQ ID NO: 1503254 - DNA, 21 bp, Homo sapiens
gtgtgtatttgtattaataaa

SEQ ID NO: 1503255 - DNA, 20 bp, Homo sapiens
gtgtgtcagacgagcagtga

SEQ ID NO: 1503256 - DNA, 16 bp, Homo sapiens
gtgtgtcagctgaggc

SEQ ID NO: 1503257 - DNA, 19 bp, Homo sapiens
gtgtgtcaggccctctgcc

SEQ ID NO: 1503258 - DNA, 18 bp, Homo sapiens
gtgtgtccaaaactgcct

SEQ ID NO: 1503259 - DNA, 18 bp, Homo sapiens
gtgtgtcccaggcaggga

SEQ ID NO: 1503260 - DNA, 16 bp, Homo sapiens
gtgtgtccctggacac

SEQ ID NO: 1503261 - DNA, 18 bp, Homo sapiens
gtgtgtccctggacacag

SEQ ID NO: 1503262 - DNA, 21 bp, Homo sapiens
gtgtgtccctggacacagctc

SEQ ID NO: 1503263 - DNA, 22 bp, Homo sapiens
gtgtgtccctggacacagctct

SEQ ID NO: 1503264 - DNA, 17 bp, Homo sapiens
gtgtgtctgcttttaaa

SEQ ID NO: 1503265 - DNA, 13 bp, Homo sapiens
gtgtgtctgtcct

SEQ ID NO: 1503266 - DNA, 13 bp, Homo sapiens
gtgtgtctgtctt

SEQ ID NO: 1503267 - DNA, 21 bp, Homo sapiens
gtgtgtcttaattattatttg

SEQ ID NO: 1503268 - DNA, 21 bp, Homo sapiens
gtgtgtgcagagtccatttcc

SEQ ID NO: 1503269 - DNA, 19 bp, Homo sapiens
gtgtgtgccttgggtctca

SEQ ID NO: 1503270 - DNA, 17 bp, Homo sapiens
gtgtgtgcttacagtaa

SEQ ID NO: 1503271 - DNA, 14 bp, Homo sapiens
gtgtgtggcagggg

SEQ ID NO: 1503272 - DNA, 15 bp, Homo sapiens
gtgtgtggtgctaca

SEQ ID NO: 1503273 - DNA, 12 bp, Homo sapiens
gtgtgtgtatgt

SEQ ID NO: 1503274 - DNA, 14 bp, Homo sapiens
gtgtgtgtatgtgg

SEQ ID NO: 1503275 - DNA, 16 bp, Homo sapiens
gtgtgtgtatgtgtga

SEQ ID NO: 1503276 - DNA, 17 bp, Homo sapiens
gtgtgtgtatgtttgca

SEQ ID NO: 1503277 - DNA, 15 bp, Homo sapiens
gtgtgtgtggcaggg

SEQ ID NO: 1503278 - DNA, 10 bp, Homo sapiens
gtgtgtgtgt

SEQ ID NO: 1503279 - DNA, 13 bp, Homo sapiens
gtgtgtgtgtgca

SEQ ID NO: 1503280 - DNA, 12 bp, Homo sapiens
gtgtgtgtgtgt

SEQ ID NO: 1503281 - DNA, 15 bp, Homo sapiens
gtgtgtgtgtgtgca

SEQ ID NO: 1503282 - DNA, 14 bp, Homo sapiens
gtgtgtgtgtgtgt

SEQ ID NO: 1503283 - DNA, 15 bp, Homo sapiens
gtgtgtgtgtgtgta

SEQ ID NO: 1503284 - DNA, 14 bp, Homo sapiens
gtgtgttgtctctt

SEQ ID NO: 1503285 - DNA, 16 bp, Homo sapiens
gtgtgttgtctcttga

SEQ ID NO: 1503286 - DNA, 13 bp, Homo sapiens
gtgtgttgtcttg

SEQ ID NO: 1503287 - DNA, 14 bp, Homo sapiens
gtgtgttgtgtgtg

SEQ ID NO: 1503288 - DNA, 22 bp, Homo sapiens
gtgtgtttagaagggttcagga

SEQ ID NO: 1503289 - DNA, 16 bp, Homo sapiens
gtgtgtttatgtgtgt

SEQ ID NO: 1503290 - DNA, 14 bp, Homo sapiens
gtgtgtttgtgatt

SEQ ID NO: 1503291 - DNA, 16 bp, Homo sapiens
gtgtgtttgtgtgtgt

SEQ ID NO: 1503292 - DNA, 20 bp, Homo sapiens
gtgtgttttcccaaagcact

SEQ ID NO: 1503293 - DNA, 14 bp, Homo sapiens
gtgtgttttgtaca

SEQ ID NO: 1503294 - DNA, 21 bp, Homo sapiens
gtgttaaaaggaaaaataaca

SEQ ID NO: 1503295 - DNA, 16 bp, Homo sapiens
gtgttacctgtgtgct

SEQ ID NO: 1503296 - DNA, 14 bp, Homo sapiens
gtgttactttttgt

SEQ ID NO: 1503297 - DNA, 13 bp, Homo sapiens
gtgttagccagga

SEQ ID NO: 1503298 - DNA, 14 bp, Homo sapiens
gtgttaggtcaata

SEQ ID NO: 1503299 - DNA, 21 bp, Homo sapiens
gtgttagtggcaccgcctccc

SEQ ID NO: 1503300 - DNA, 14 bp, Homo sapiens
gtgttagtgtgtgt

SEQ ID NO: 1503301 - DNA, 18 bp, Homo sapiens
gtgttagtgtgtgtgcat

SEQ ID NO: 1503302 - DNA, 12 bp, Homo sapiens
gtgttagttccc

SEQ ID NO: 1503303 - DNA, 17 bp, Homo sapiens
gtgttatcttttgaatt

SEQ ID NO: 1503304 - DNA, 17 bp, Homo sapiens
gtgttattacttcctca

SEQ ID NO: 1503305 - DNA, 16 bp, Homo sapiens
gtgttatttaaagaag

SEQ ID NO: 1503306 - DNA, 14 bp, Homo sapiens
gtgttcaagaaata

SEQ ID NO: 1503307 - DNA, 23 bp, Homo sapiens
gtgttcaatatttagaaaatttt

SEQ ID NO: 1503308 - DNA, 18 bp, Homo sapiens
gtgttcacaaactgtgaa

SEQ ID NO: 1503309 - DNA, 21 bp, Homo sapiens
gtgttcaccttcaaaatgttc

SEQ ID NO: 1503310 - DNA, 23 bp, Homo sapiens
gtgttcagctctttccaaattaa

SEQ ID NO: 1503311 - DNA, 12 bp, Homo sapiens
gtgttcatacat

SEQ ID NO: 1503312 - DNA, 11 bp, Homo sapiens
gtgttcatttt

SEQ ID NO: 1503313 - DNA, 14 bp, Homo sapiens
gtgttcctggaagc

SEQ ID NO: 1503314 - DNA, 14 bp, Homo sapiens
gtgttcgtttccat

SEQ ID NO: 1503315 - DNA, 17 bp, Homo sapiens
gtgttcgtttccatcat

SEQ ID NO: 1503316 - DNA, 22 bp, Homo sapiens
gtgttctattgctgagaagcaa

SEQ ID NO: 1503317 - DNA, 20 bp, Homo sapiens
gtgttctcatgaagcaggag

SEQ ID NO: 1503318 - DNA, 14 bp, Homo sapiens
gtgttctctagaat

SEQ ID NO: 1503319 - DNA, 12 bp, Homo sapiens
gtgttctgctcc

SEQ ID NO: 1503320 - DNA, 23 bp, Homo sapiens
gtgttctgctccataccttttct

SEQ ID NO: 1503321 - DNA, 18 bp, Homo sapiens
gtgttctgctcctgcttt

SEQ ID NO: 1503322 - DNA, 12 bp, Homo sapiens
gtgttctgctga

SEQ ID NO: 1503323 - DNA, 18 bp, Homo sapiens
gtgttctgtttgaaacta

SEQ ID NO: 1503324 - DNA, 14 bp, Homo sapiens
gtgttctgtttgtt

SEQ ID NO: 1503325 - DNA, 16 bp, Homo sapiens
gtgttgaaaatgttca

SEQ ID NO: 1503326 - DNA, 18 bp, Homo sapiens
gtgttgaacacaattgat

SEQ ID NO: 1503327 - DNA, 21 bp, Homo sapiens
gtgttggctaatgaagggaaa

SEQ ID NO: 1503328 - DNA, 15 bp, Homo sapiens
gtgttgggacctgct

SEQ ID NO: 1503329 - DNA, 24 bp, Homo sapiens
gtgttgggacctgctgctccatgg

SEQ ID NO: 1503330 - DNA, 15 bp, Homo sapiens
gtgttgtctcttgag

SEQ ID NO: 1503331 - DNA, 18 bp, Homo sapiens
gtgttgtcttgaaagatt

SEQ ID NO: 1503332 - DNA, 13 bp, Homo sapiens
gtgttgtgttcct

SEQ ID NO: 1503333 - DNA, 16 bp, Homo sapiens
gtgttgtgttcctggc

SEQ ID NO: 1503334 - DNA, 17 bp, Homo sapiens
gtgttgtgttcctggct

SEQ ID NO: 1503335 - DNA, 14 bp, Homo sapiens
gtgttgttgttgct

SEQ ID NO: 1503336 - DNA, 17 bp, Homo sapiens
gtgttgttgttgctgct

SEQ ID NO: 1503337 - DNA, 12 bp, Homo sapiens
gtgtttaaaaaa

SEQ ID NO: 1503338 - DNA, 21 bp, Homo sapiens
gtgtttaattgtactcaatgg

SEQ ID NO: 1503339 - DNA, 13 bp, Homo sapiens
gtgtttataaaat

SEQ ID NO: 1503340 - DNA, 13 bp, Homo sapiens
gtgtttcattggt

SEQ ID NO: 1503341 - DNA, 15 bp, Homo sapiens
gtgtttcccataatt

SEQ ID NO: 1503342 - DNA, 17 bp, Homo sapiens
gtgtttctattgacttc

SEQ ID NO: 1503343 - DNA, 12 bp, Homo sapiens
gtgtttctgtat

SEQ ID NO: 1503344 - DNA, 19 bp, Homo sapiens
gtgtttgcagctgtgagaa

SEQ ID NO: 1503345 - DNA, 21 bp, Homo sapiens
gtgtttgggtcacccctccag

SEQ ID NO: 1503346 - DNA, 20 bp, Homo sapiens
gtgtttggtttcccattggt

SEQ ID NO: 1503347 - DNA, 17 bp, Homo sapiens
gtgtttgtatgtctgtg

SEQ ID NO: 1503348 - DNA, 14 bp, Homo sapiens
gtgtttgtgtgtgt

SEQ ID NO: 1503349 - DNA, 14 bp, Homo sapiens
gtgttttaatttaa

SEQ ID NO: 1503350 - DNA, 23 bp, Homo sapiens
gtgttttcaagcacaacccacca

SEQ ID NO: 1503351 - DNA, 19 bp, Homo sapiens
gtgttttcttgtaaatgtt

SEQ ID NO: 1503352 - DNA, 20 bp, Homo sapiens
gtgttttcttgtaaatgttt

SEQ ID NO: 1503353 - DNA, 22 bp, Homo sapiens
gtgtttttacaaaatacaaaaa

SEQ ID NO: 1503354 - DNA, 17 bp, Homo sapiens
gtgtttttagctgtgac

SEQ ID NO: 1503355 - DNA, 13 bp, Homo sapiens
gtcctcatggaga

SEQ ID NO: 1503356 - DNA, 15 bp, Homo sapiens
gtcctcattataaaa

SEQ ID NO: 1503357 - DNA, 21 bp, Homo sapiens
gtcctccaaagactgaaggag

SEQ ID NO: 1503358 - DNA, 21 bp, Homo sapiens
gtcctccactcgacccagaat

SEQ ID NO: 1503359 - DNA, 18 bp, Homo sapiens
gtcctccagaagcctctg

SEQ ID NO: 1503360 - DNA, 19 bp, Homo sapiens
gtcctccagaagcctctgg

SEQ ID NO: 1503361 - DNA, 16 bp, Homo sapiens
gtcctcccaccttggc

SEQ ID NO: 1503362 - DNA, 15 bp, Homo sapiens
gtcctccccctgcca

SEQ ID NO: 1503363 - DNA, 17 bp, Homo sapiens
gtcctccccctgccagt

SEQ ID NO: 1503364 - DNA, 19 bp, Homo sapiens
gtcctccccctgccagtgc

SEQ ID NO: 1503365 - DNA, 22 bp, Homo sapiens
gtcctccccctgccagtgcctt

SEQ ID NO: 1503366 - DNA, 16 bp, Homo sapiens
gtcctcccctcaagga

SEQ ID NO: 1503367 - DNA, 14 bp, Homo sapiens
gtcctccccttggg

SEQ ID NO: 1503368 - DNA, 18 bp, Homo sapiens
gtcctccccttgggcggc

SEQ ID NO: 1503369 - DNA, 16 bp, Homo sapiens
gtcctcccgagctcct

SEQ ID NO: 1503370 - DNA, 16 bp, Homo sapiens
gtcctcccgggccctc

SEQ ID NO: 1503371 - DNA, 22 bp, Homo sapiens
gtcctcccgggccctcccttgg

SEQ ID NO: 1503372 - DNA, 14 bp, Homo sapiens
gtcctccctcccaa

SEQ ID NO: 1503373 - DNA, 20 bp, Homo sapiens
gtcctccctcccaaggagcc

SEQ ID NO: 1503374 - DNA, 17 bp, Homo sapiens
gtcctccctcctgcagg

SEQ ID NO: 1503375 - DNA, 20 bp, Homo sapiens
gtcctccctcctgcaggctg

SEQ ID NO: 1503376 - DNA, 22 bp, Homo sapiens
gtcctccctgatcccaccccct

SEQ ID NO: 1503377 - DNA, 14 bp, Homo sapiens
gtcctccgcctact

SEQ ID NO: 1503378 - DNA, 16 bp, Homo sapiens
gtcctccgcctactgt

SEQ ID NO: 1503379 - DNA, 20 bp, Homo sapiens
gtcctccgcctactgtccct

SEQ ID NO: 1503380 - DNA, 19 bp, Homo sapiens
gtcctcctatctccctggc

SEQ ID NO: 1503381 - DNA, 13 bp, Homo sapiens
gtcctcctcacct

SEQ ID NO: 1503382 - DNA, 21 bp, Homo sapiens
gtcctcctcggatcaccgaga

SEQ ID NO: 1503383 - DNA, 19 bp, Homo sapiens
gtcctcctgtgctatttgt

SEQ ID NO: 1503384 - DNA, 17 bp, Homo sapiens
gtcctctagcaggccta

SEQ ID NO: 1503385 - DNA, 15 bp, Homo sapiens
gtcctctcagaactc

SEQ ID NO: 1503386 - DNA, 12 bp, Homo sapiens
gtcctctctctg

SEQ ID NO: 1503387 - DNA, 18 bp, Homo sapiens
gtcctctctctgtggggc

SEQ ID NO: 1503388 - DNA, 18 bp, Homo sapiens
gtcctctctgagtcaaat

SEQ ID NO: 1503389 - DNA, 21 bp, Homo sapiens
gtcctctctgagtcaaatcca

SEQ ID NO: 1503390 - DNA, 13 bp, Homo sapiens
gtcctctgctcca

SEQ ID NO: 1503391 - DNA, 18 bp, Homo sapiens
gtcctctggagccctaac

SEQ ID NO: 1503392 - DNA, 14 bp, Homo sapiens
gtcctctgtagtat

SEQ ID NO: 1503393 - DNA, 14 bp, Homo sapiens
gtcctcttattcct

SEQ ID NO: 1503394 - DNA, 17 bp, Homo sapiens
gtcctcttcaagtactg

SEQ ID NO: 1503395 - DNA, 19 bp, Homo sapiens
gttcatattccatatttat

SEQ ID NO: 1503396 - DNA, 19 bp, Homo sapiens
gttcatatttatactttgc

SEQ ID NO: 1503397 - DNA, 17 bp, Homo sapiens
gttcatatttattgatt

SEQ ID NO: 1503398 - DNA, 12 bp, Homo sapiens
gttcatcagtgt

SEQ ID NO: 1503399 - DNA, 19 bp, Homo sapiens
gttcatccaatcctcactg

SEQ ID NO: 1503400 - DNA, 20 bp, Homo sapiens
gttcatccaatcctcactgg

SEQ ID NO: 1503401 - DNA, 21 bp, Homo sapiens
gttcatccaatcctcactggg

SEQ ID NO: 1503402 - DNA, 16 bp, Homo sapiens
gttcatctcatttgta

SEQ ID NO: 1503403 - DNA, 12 bp, Homo sapiens
gttcatcttgca

SEQ ID NO: 1503404 - DNA, 19 bp, Homo sapiens
gttcatgagaatctatatt

SEQ ID NO: 1503405 - DNA, 18 bp, Homo sapiens
gttcatgcagacaaagcc

SEQ ID NO: 1503406 - DNA, 22 bp, Homo sapiens
gttcatgcagacaaagccctgt

SEQ ID NO: 1503407 - DNA, 15 bp, Homo sapiens
gttcatgcagctgtg

SEQ ID NO: 1503408 - DNA, 18 bp, Homo sapiens
gttcatgccattctgcct

SEQ ID NO: 1503409 - DNA, 16 bp, Homo sapiens
gttcatggtgatcagt

SEQ ID NO: 1503410 - DNA, 22 bp, Homo sapiens
gttcatgtctgaaacagagaac

SEQ ID NO: 1503411 - DNA, 18 bp, Homo sapiens
gttcattagaaatatttt

SEQ ID NO: 1503412 - DNA, 18 bp, Homo sapiens
gttcattataatctcaaa

SEQ ID NO: 1503413 - DNA, 16 bp, Homo sapiens
gttcattcaagctatt

SEQ ID NO: 1503414 - DNA, 18 bp, Homo sapiens
gttcattgcaattaaact

SEQ ID NO: 1503415 - DNA, 16 bp, Homo sapiens
gttcattgcactttga

SEQ ID NO: 1503416 - DNA, 13 bp, Homo sapiens
gttcatttgtgta

SEQ ID NO: 1503417 - DNA, 12 bp, Homo sapiens
gttcattttagt

SEQ ID NO: 1503418 - DNA, 19 bp, Homo sapiens
gttcattttgagtattttt

SEQ ID NO: 1503419 - DNA, 14 bp, Homo sapiens
gttccaacctcctg

SEQ ID NO: 1503420 - DNA, 18 bp, Homo sapiens
gttccaacctcctgctct

SEQ ID NO: 1503421 - DNA, 20 bp, Homo sapiens
gttccaacctcctgctctgg

SEQ ID NO: 1503422 - DNA, 22 bp, Homo sapiens
gttccaacctcctgctctggga

SEQ ID NO: 1503423 - DNA, 18 bp, Homo sapiens
gttccaagagtctaaaga

SEQ ID NO: 1503424 - DNA, 20 bp, Homo sapiens
gttccaagagtctaaagatg

SEQ ID NO: 1503425 - DNA, 20 bp, Homo sapiens
gttccaccattgctggaaaa

SEQ ID NO: 1503426 - DNA, 14 bp, Homo sapiens
gttccacctgccac

SEQ ID NO: 1503427 - DNA, 16 bp, Homo sapiens
gttccacgtgttttat

SEQ ID NO: 1503428 - DNA, 15 bp, Homo sapiens
gttccacttgtttgc

SEQ ID NO: 1503429 - DNA, 19 bp, Homo sapiens
gttccacttgtttgcactg

SEQ ID NO: 1503430 - DNA, 20 bp, Homo sapiens
gttccacttgtttgcactgt

SEQ ID NO: 1503431 - DNA, 11 bp, Homo sapiens
gttccagctga

SEQ ID NO: 1503432 - DNA, 20 bp, Homo sapiens
gttccagtgaggaaccctga

SEQ ID NO: 1503433 - DNA, 12 bp, Homo sapiens
gttccatgcagc

SEQ ID NO: 1503434 - DNA, 17 bp, Homo sapiens
gttccatgcctgagggt

SEQ ID NO: 1503435 - DNA, 23 bp, Homo sapiens
gttccattgaagccgactctggc

SEQ ID NO: 1503436 - DNA, 23 bp, Homo sapiens
gttccatttttcctctgttcaca

SEQ ID NO: 1503437 - DNA, 18 bp, Homo sapiens
gttcccaataaaagtgac

SEQ ID NO: 1503438 - DNA, 19 bp, Homo sapiens
gttcccaccaggctgctca

SEQ ID NO: 1503439 - DNA, 15 bp, Homo sapiens
gttcccaccattccc

SEQ ID NO: 1503440 - DNA, 18 bp, Homo sapiens
gttcccatgtagccccct

SEQ ID NO: 1503441 - DNA, 22 bp, Homo sapiens
gttcccattattatttctgttc

SEQ ID NO: 1503442 - DNA, 19 bp, Homo sapiens
gttccccaagggccctggc

SEQ ID NO: 1503443 - DNA, 20 bp, Homo sapiens
gttccccaagggccctggca

SEQ ID NO: 1503444 - DNA, 18 bp, Homo sapiens
gttccccacacagggcac

SEQ ID NO: 1503445 - DNA, 12 bp, Homo sapiens
gttccccagaga

SEQ ID NO: 1503446 - DNA, 13 bp, Homo sapiens
gttccccagagaa

SEQ ID NO: 1503447 - DNA, 19 bp, Homo sapiens
gttccccttggcttcctcc

SEQ ID NO: 1503448 - DNA, 19 bp, Homo sapiens
gttcccggagcacagccct

SEQ ID NO: 1503449 - DNA, 16 bp, Homo sapiens
gttcccgtttctccac

SEQ ID NO: 1503450 - DNA, 18 bp, Homo sapiens
gttcccgtttctccacct

SEQ ID NO: 1503451 - DNA, 18 bp, Homo sapiens
gttccctagagagaataa

SEQ ID NO: 1503452 - DNA, 19 bp, Homo sapiens
gttccctagagagaataaa

SEQ ID NO: 1503453 - DNA, 21 bp, Homo sapiens
gttccctaggggacacttccc

SEQ ID NO: 1503454 - DNA, 15 bp, Homo sapiens
gttccctctccctgt

SEQ ID NO: 1503455 - DNA, 17 bp, Homo sapiens
gttccctctccctgttg

SEQ ID NO: 1503456 - DNA, 15 bp, Homo sapiens
gttccctctggcttc

SEQ ID NO: 1503457 - DNA, 18 bp, Homo sapiens
gttccctgaaaacccaga

SEQ ID NO: 1503458 - DNA, 13 bp, Homo sapiens
gttccctgggctg

SEQ ID NO: 1503459 - DNA, 17 bp, Homo sapiens
gttccctgtcagaggct

SEQ ID NO: 1503460 - DNA, 20 bp, Homo sapiens
gttccctgtcagaggctaag

SEQ ID NO: 1503461 - DNA, 22 bp, Homo sapiens
gttcccttcctcttcctgccct

SEQ ID NO: 1503462 - DNA, 21 bp, Homo sapiens
gttcccttgaaactttgggaa

SEQ ID NO: 1503463 - DNA, 13 bp, Homo sapiens
gttcccttggcct

SEQ ID NO: 1503464 - DNA, 16 bp, Homo sapiens
gttcccttggcctcag

SEQ ID NO: 1503465 - DNA, 19 bp, Homo sapiens
gttccctttccttccatcc

SEQ ID NO: 1503466 - DNA, 22 bp, Homo sapiens
gttccctttccttccatcccta

SEQ ID NO: 1503467 - DNA, 19 bp, Homo sapiens
gttcctactttagccactg

SEQ ID NO: 1503468 - DNA, 16 bp, Homo sapiens
gttcctcgccctgggt

SEQ ID NO: 1503469 - DNA, 22 bp, Homo sapiens
gttcctcggtgggccagagctg

SEQ ID NO: 1503470 - DNA, 15 bp, Homo sapiens
gttcctctatacttt

SEQ ID NO: 1503471 - DNA, 21 bp, Homo sapiens
gttcctctatactttgttctg

SEQ ID NO: 1503472 - DNA, 14 bp, Homo sapiens
gttcctctgcctgc

SEQ ID NO: 1503473 - DNA, 15 bp, Homo sapiens
gttcctctgcctgcc

SEQ ID NO: 1503474 - DNA, 16 bp, Homo sapiens
gttcctctgcctgccc

SEQ ID NO: 1503475 - DNA, 14 bp, Homo sapiens
gttcctgctccgtg

SEQ ID NO: 1503476 - DNA, 15 bp, Homo sapiens
gttcctgctgtattt

SEQ ID NO: 1503477 - DNA, 19 bp, Homo sapiens
gttcctgctgtatttcctg

SEQ ID NO: 1503478 - DNA, 13 bp, Homo sapiens
gttcctggagttt

SEQ ID NO: 1503479 - DNA, 19 bp, Homo sapiens
gttcctggcccactctgta

SEQ ID NO: 1503480 - DNA, 22 bp, Homo sapiens
gttcctggccttctgaactcca

SEQ ID NO: 1503481 - DNA, 12 bp, Homo sapiens
gttcctggctga

SEQ ID NO: 1503482 - DNA, 23 bp, Homo sapiens
gttcctggctgatgatccagaac

SEQ ID NO: 1503483 - DNA, 17 bp, Homo sapiens
gttcctgtggccaggag

SEQ ID NO: 1503484 - DNA, 20 bp, Homo sapiens
gttcctgtggggttgttttt

SEQ ID NO: 1503485 - DNA, 20 bp, Homo sapiens
gttcctgttcagtaataaaa

SEQ ID NO: 1503486 - DNA, 15 bp, Homo sapiens
gttccttactgcaga

SEQ ID NO: 1503487 - DNA, 15 bp, Homo sapiens
gttccttatccctct

SEQ ID NO: 1503488 - DNA, 17 bp, Homo sapiens
gttccttatccctctct

SEQ ID NO: 1503489 - DNA, 21 bp, Homo sapiens
gttccttccgatgacagtgct

SEQ ID NO: 1503490 - DNA, 12 bp, Homo sapiens
gttccttctctg

SEQ ID NO: 1503491 - DNA, 12 bp, Homo sapiens
gttccttgcctt

SEQ ID NO: 1503492 - DNA, 13 bp, Homo sapiens
gttccttgcctta

SEQ ID NO: 1503493 - DNA, 23 bp, Homo sapiens
gttccttgccttaataaatatgt

SEQ ID NO: 1503494 - DNA, 19 bp, Homo sapiens
gttccttgctagccctggg

SEQ ID NO: 1503495 - DNA, 21 bp, Homo sapiens
gttccttggtcctagtaagaa

SEQ ID NO: 1503496 - DNA, 21 bp, Homo sapiens
gttcctttcatctctctacct

SEQ ID NO: 1503497 - DNA, 23 bp, Homo sapiens
gttcctttccttttctttaaaga

SEQ ID NO: 1503498 - DNA, 15 bp, Homo sapiens
gttcctttctctggg

SEQ ID NO: 1503499 - DNA, 16 bp, Homo sapiens
gttcctttctctgggc

SEQ ID NO: 1503500 - DNA, 17 bp, Homo sapiens
gttcctttttaaatgtg

SEQ ID NO: 1503501 - DNA, 19 bp, Homo sapiens
gttcctttttaaatgtgaa

SEQ ID NO: 1503502 - DNA, 20 bp, Homo sapiens
gttcctttttaaatgtgaat

SEQ ID NO: 1503503 - DNA, 20 bp, Homo sapiens
gttcctttttcaaaaaccag

SEQ ID NO: 1503504 - DNA, 19 bp, Homo sapiens
gttcgagaccaacctgacc

SEQ ID NO: 1503505 - DNA, 17 bp, Homo sapiens
gttcgagaccagcctgg

SEQ ID NO: 1503506 - DNA, 20 bp, Homo sapiens
gtttattcttctagagttca

SEQ ID NO: 1503507 - DNA, 20 bp, Homo sapiens
gtttatttaaggatggatgg

SEQ ID NO: 1503508 - DNA, 19 bp, Homo sapiens
gtttatttatcagtgacag

SEQ ID NO: 1503509 - DNA, 16 bp, Homo sapiens
gtttatttcacttgat

SEQ ID NO: 1503510 - DNA, 20 bp, Homo sapiens
gtttatttccactattttca

SEQ ID NO: 1503511 - DNA, 21 bp, Homo sapiens
gtttatttccactattttcaa

SEQ ID NO: 1503512 - DNA, 12 bp, Homo sapiens
gtttattttcag

SEQ ID NO: 1503513 - DNA, 19 bp, Homo sapiens
gtttcaaacacaaatgcag

SEQ ID NO: 1503514 - DNA, 22 bp, Homo sapiens
gtttcaaagcacaataactagt

SEQ ID NO: 1503515 - DNA, 15 bp, Homo sapiens
gtttcaaatctgtaa

SEQ ID NO: 1503516 - DNA, 20 bp, Homo sapiens
gtttcaagttattcaaattt

SEQ ID NO: 1503517 - DNA, 23 bp, Homo sapiens
gtttcaagttattcaaatttgta

SEQ ID NO: 1503518 - DNA, 17 bp, Homo sapiens
gtttcaagttttaaagt

SEQ ID NO: 1503519 - DNA, 22 bp, Homo sapiens
gtttcaattccacctgcaatca

SEQ ID NO: 1503520 - DNA, 22 bp, Homo sapiens
gtttcacaggtcaataaactta

SEQ ID NO: 1503521 - DNA, 15 bp, Homo sapiens
gtttcacatatttgt

SEQ ID NO: 1503522 - DNA, 21 bp, Homo sapiens
gtttcactgaaatgtttggat

SEQ ID NO: 1503523 - DNA, 19 bp, Homo sapiens
gtttcactgtactgcatgt

SEQ ID NO: 1503524 - DNA, 20 bp, Homo sapiens
gtttcactgtactgcatgtg

SEQ ID NO: 1503525 - DNA, 21 bp, Homo sapiens
gtttcactgtactgcatgtga

SEQ ID NO: 1503526 - DNA, 15 bp, Homo sapiens
gtttcagaccccccc

SEQ ID NO: 1503527 - DNA, 14 bp, Homo sapiens
gtttcagtaaataa

SEQ ID NO: 1503528 - DNA, 23 bp, Homo sapiens
gtttcagtgaagatgctgtaaat

SEQ ID NO: 1503529 - DNA, 18 bp, Homo sapiens
gtttcagtttgttggaaa

SEQ ID NO: 1503530 - DNA, 13 bp, Homo sapiens
gtttcatatttct

SEQ ID NO: 1503531 - DNA, 14 bp, Homo sapiens
gtttcatatttctt

SEQ ID NO: 1503532 - DNA, 19 bp, Homo sapiens
gtttcattggtctctatct

SEQ ID NO: 1503533 - DNA, 16 bp, Homo sapiens
gtttcatttctgcaga

SEQ ID NO: 1503534 - DNA, 15 bp, Homo sapiens
gtttccaaaggttcc

SEQ ID NO: 1503535 - DNA, 22 bp, Homo sapiens
gtttccacgatgaaaaacttcc

SEQ ID NO: 1503536 - DNA, 16 bp, Homo sapiens
gtttccacttgtgggc

SEQ ID NO: 1503537 - DNA, 20 bp, Homo sapiens
gtttccacttgtgggcttca

SEQ ID NO: 1503538 - DNA, 20 bp, Homo sapiens
gtttccagacttccttgaga

SEQ ID NO: 1503539 - DNA, 17 bp, Homo sapiens
gtttccagcagaagaca

SEQ ID NO: 1503540 - DNA, 21 bp, Homo sapiens
gtttccatagcaacaggaaaa

SEQ ID NO: 1503541 - DNA, 15 bp, Homo sapiens
gtttccatcatgtct

SEQ ID NO: 1503542 - DNA, 17 bp, Homo sapiens
gtttccatcatgtctgt

SEQ ID NO: 1503543 - DNA, 21 bp, Homo sapiens
gtttccatttctcaatcagtg

SEQ ID NO: 1503544 - DNA, 16 bp, Homo sapiens
gtttcccattggttca

SEQ ID NO: 1503545 - DNA, 19 bp, Homo sapiens
gtttccccagggaaggaaa

SEQ ID NO: 1503546 - DNA, 22 bp, Homo sapiens
gtttcccctagcttactgataa

SEQ ID NO: 1503547 - DNA, 13 bp, Homo sapiens
gtttccctgctga

SEQ ID NO: 1503548 - DNA, 15 bp, Homo sapiens
gtttcccttgctttg

SEQ ID NO: 1503549 - DNA, 19 bp, Homo sapiens
gtttcctatttaatacagc

SEQ ID NO: 1503550 - DNA, 22 bp, Homo sapiens
gtttcctctgttcaaagctgcc

SEQ ID NO: 1503551 - DNA, 23 bp, Homo sapiens
gtttcctctgttcaaagctgcct

SEQ ID NO: 1503552 - DNA, 22 bp, Homo sapiens
gtttcctgaaacaacttggaaa

SEQ ID NO: 1503553 - DNA, 15 bp, Homo sapiens
gtttcctgacattgt

SEQ ID NO: 1503554 - DNA, 15 bp, Homo sapiens
gtttcctggaagcag

SEQ ID NO: 1503555 - DNA, 11 bp, Homo sapiens
gtttcctggca

SEQ ID NO: 1503556 - DNA, 18 bp, Homo sapiens
gtttcgaagttgatgcaa

SEQ ID NO: 1503557 - DNA, 16 bp, Homo sapiens
gtttcgactggtccag

SEQ ID NO: 1503558 - DNA, 15 bp, Homo sapiens
gtttcgtttctgtat

SEQ ID NO: 1503559 - DNA, 18 bp, Homo sapiens
gtttctaagattctaaag

SEQ ID NO: 1503560 - DNA, 20 bp, Homo sapiens
gtttctaagattctaaaggt

SEQ ID NO: 1503561 - DNA, 22 bp, Homo sapiens
gtttctaaggtccggtgttcta

SEQ ID NO: 1503562 - DNA, 13 bp, Homo sapiens
gtttctacattca

SEQ ID NO: 1503563 - DNA, 18 bp, Homo sapiens
gtttctagaattttatat

SEQ ID NO: 1503564 - DNA, 23 bp, Homo sapiens
gtttctagaattttatatcattg

SEQ ID NO: 1503565 - DNA, 16 bp, Homo sapiens
gtttctagaggcctca

SEQ ID NO: 1503566 - DNA, 18 bp, Homo sapiens
gtttctagaggcctcagt

SEQ ID NO: 1503567 - DNA, 20 bp, Homo sapiens
gtttctagaggcctcagttt

SEQ ID NO: 1503568 - DNA, 15 bp, Homo sapiens
gtttctagggaaatg

SEQ ID NO: 1503569 - DNA, 18 bp, Homo sapiens
gtttctagggaaatgaaa

SEQ ID NO: 1503570 - DNA, 22 bp, Homo sapiens
gtttctatactgtttgtaatat

SEQ ID NO: 1503571 - DNA, 14 bp, Homo sapiens
gtttctattctgtc

SEQ ID NO: 1503572 - DNA, 17 bp, Homo sapiens
gtttctcaaaagaggtt

SEQ ID NO: 1503573 - DNA, 19 bp, Homo sapiens
gtttctcacattgctgtat

SEQ ID NO: 1503574 - DNA, 19 bp, Homo sapiens
gtttctcagaatccaaaga

SEQ ID NO: 1503575 - DNA, 21 bp, Homo sapiens
gtttctcagatccttgtttca

SEQ ID NO: 1503576 - DNA, 23 bp, Homo sapiens
gtttctccccctgggctctgccc

SEQ ID NO: 1503577 - DNA, 17 bp, Homo sapiens
gtttctccttgaaatga

SEQ ID NO: 1503578 - DNA, 19 bp, Homo sapiens
gtttctccttttcctatcc

SEQ ID NO: 1503579 - DNA, 16 bp, Homo sapiens
gtttctcgtgctgcat

SEQ ID NO: 1503580 - DNA, 23 bp, Homo sapiens
gtttctcgtgctgcatccctgtg

SEQ ID NO: 1503581 - DNA, 15 bp, Homo sapiens
gtttctctcttccct

SEQ ID NO: 1503582 - DNA, 20 bp, Homo sapiens
gtttctcttctagatgattt

SEQ ID NO: 1503583 - DNA, 16 bp, Homo sapiens
gtttctgggtcctgaa

SEQ ID NO: 1503584 - DNA, 18 bp, Homo sapiens
gtttctggtggtctgttg

SEQ ID NO: 1503585 - DNA, 21 bp, Homo sapiens
gtttctggtggtctgttggca

SEQ ID NO: 1503586 - DNA, 22 bp, Homo sapiens
gtttctgtatatgattctctgt

SEQ ID NO: 1503587 - DNA, 18 bp, Homo sapiens
gtttctgtgaaattctca

SEQ ID NO: 1503588 - DNA, 18 bp, Homo sapiens
gtttctgtttcaaagcac

SEQ ID NO: 1503589 - DNA, 15 bp, Homo sapiens
gtttcttaagaaaac

SEQ ID NO: 1503590 - DNA, 12 bp, Homo sapiens
gtttcttagccc

SEQ ID NO: 1503591 - DNA, 11 bp, Homo sapiens
gtttcttccaa

SEQ ID NO: 1503592 - DNA, 13 bp, Homo sapiens
gtttcttccaaag

SEQ ID NO: 1503593 - DNA, 18 bp, Homo sapiens
gtttcttcctgccagcag

SEQ ID NO: 1503594 - DNA, 23 bp, Homo sapiens
gtttcttcttcatgcttttgctt

SEQ ID NO: 1503595 - DNA, 14 bp, Homo sapiens
gtttcttctttcta

SEQ ID NO: 1503596 - DNA, 18 bp, Homo sapiens
gtttcttgacaagctgac

SEQ ID NO: 1503597 - DNA, 23 bp, Homo sapiens
gtttcttgcttggaagccaggta

SEQ ID NO: 1503598 - DNA, 15 bp, Homo sapiens
gttttcaaaacacat

SEQ ID NO: 1503599 - DNA, 22 bp, Homo sapiens
gttttcaaccggaaggaggcca

SEQ ID NO: 1503600 - DNA, 18 bp, Homo sapiens
gttttcaacctctagaat

SEQ ID NO: 1503601 - DNA, 13 bp, Homo sapiens
gttttcacttgta

SEQ ID NO: 1503602 - DNA, 19 bp, Homo sapiens
gttttcagaacctcttccc

SEQ ID NO: 1503603 - DNA, 21 bp, Homo sapiens
gttttcagaacctcttcccca

SEQ ID NO: 1503604 - DNA, 16 bp, Homo sapiens
gttttcaggtccagag

SEQ ID NO: 1503605 - DNA, 24 bp, Homo sapiens
gttttcataacttgctgaatttca

SEQ ID NO: 1503606 - DNA, 14 bp, Homo sapiens
gttttccaccctgg

SEQ ID NO: 1503607 - DNA, 14 bp, Homo sapiens
gttttcccctggcc

SEQ ID NO: 1503608 - DNA, 23 bp, Homo sapiens
gttttcccctggcctcagttccc

SEQ ID NO: 1503609 - DNA, 16 bp, Homo sapiens
gttttccctgaagtta

SEQ ID NO: 1503610 - DNA, 15 bp, Homo sapiens
gttttccttctgtta

SEQ ID NO: 1503611 - DNA, 23 bp, Homo sapiens
gttttctaatacgagccttctca

SEQ ID NO: 1503612 - DNA, 21 bp, Homo sapiens
gttttctagcaattttctttg

SEQ ID NO: 1503613 - DNA, 18 bp, Homo sapiens
gttttctcctcccaggaa

SEQ ID NO: 1503614 - DNA, 20 bp, Homo sapiens
gttttctcctgcctgtgctg

SEQ ID NO: 1503615 - DNA, 20 bp, Homo sapiens
gttttctccttcccttcttt

SEQ ID NO: 1503616 - DNA, 21 bp, Homo sapiens
gttttctccttcccttctttg

SEQ ID NO: 1503617 - DNA, 16 bp, Homo sapiens
gttttctctaacttct

SEQ ID NO: 1503618 - DNA, 19 bp, Homo sapiens
gttttctctcggctcccca

SEQ ID NO: 1503619 - DNA, 15 bp, Homo sapiens
gttttctctgcataa

SEQ ID NO: 1503620 - DNA, 13 bp, Homo sapiens
gttttctgaaaca

SEQ ID NO: 1503621 - DNA, 22 bp, Homo sapiens
gttttctgagaaagactattca

SEQ ID NO: 1503622 - DNA, 13 bp, Homo sapiens
gttttctgagccc

SEQ ID NO: 1503623 - DNA, 14 bp, Homo sapiens
gttttctgagcccg

SEQ ID NO: 1503624 - DNA, 15 bp, Homo sapiens
gttttctgagcccgg

SEQ ID NO: 1503625 - DNA, 17 bp, Homo sapiens
gttttctgagcccgggc

SEQ ID NO: 1503626 - DNA, 16 bp, Homo sapiens
gttttctgtaaataac

SEQ ID NO: 1503627 - DNA, 16 bp, Homo sapiens
gttttcttaacttaaa

SEQ ID NO: 1503628 - DNA, 15 bp, Homo sapiens
gttttcttcccatca

SEQ ID NO: 1503629 - DNA, 13 bp, Homo sapiens
gttttcttctttc

SEQ ID NO: 1503630 - DNA, 17 bp, Homo sapiens
gttttcttctttccctg

SEQ ID NO: 1503631 - DNA, 17 bp, Homo sapiens
gttttgatgagaaaaaa

SEQ ID NO: 1503632 - DNA, 21 bp, Homo sapiens
gttttgatgtttgtggcctca

SEQ ID NO: 1503633 - DNA, 21 bp, Homo sapiens
gttttgattttggaaagatgt

SEQ ID NO: 1503634 - DNA, 16 bp, Homo sapiens
gttttgcaataacttc

SEQ ID NO: 1503635 - DNA, 17 bp, Homo sapiens
gttttgcacattttgtg

SEQ ID NO: 1503636 - DNA, 22 bp, Homo sapiens
gttttgccccaagtcctcattt

SEQ ID NO: 1503637 - DNA, 20 bp, Homo sapiens
gttttgcttgggcctccctg

SEQ ID NO: 1503638 - DNA, 17 bp, Homo sapiens
gttttggacagtttacc

SEQ ID NO: 1503639 - DNA, 19 bp, Homo sapiens
gttttggagagtttgcctg

SEQ ID NO: 1503640 - DNA, 23 bp, Homo sapiens
gttttggatttggagagaaatat

SEQ ID NO: 1503641 - DNA, 20 bp, Homo sapiens
gttttggcaaacgctaaaga

SEQ ID NO: 1503642 - DNA, 20 bp, Homo sapiens
gttttggctgaaattctcct

SEQ ID NO: 1503643 - DNA, 15 bp, Homo sapiens
gttttgggcctccat

SEQ ID NO: 1503644 - DNA, 18 bp, Homo sapiens
gttttgtaaaactgttat

SEQ ID NO: 1503645 - DNA, 14 bp, Homo sapiens
gttttgtaaaagaa

SEQ ID NO: 1503646 - DNA, 23 bp, Homo sapiens
gttttgtaaatgtactggtaatt

SEQ ID NO: 1503647 - DNA, 16 bp, Homo sapiens
gttttgtaagatgctg

SEQ ID NO: 1503648 - DNA, 18 bp, Homo sapiens
gttttgtaagatgctggg

SEQ ID NO: 1503649 - DNA, 18 bp, Homo sapiens
gttttgtataaaatctga

SEQ ID NO: 1503650 - DNA, 19 bp, Homo sapiens
gttttgtataaataataaa

SEQ ID NO: 1503651 - DNA, 17 bp, Homo sapiens
gttttgtgtttgttgta

SEQ ID NO: 1503652 - DNA, 16 bp, Homo sapiens
gttttgttcccctcct

SEQ ID NO: 1503653 - DNA, 22 bp, Homo sapiens
gttttgttcccctcctccactc

SEQ ID NO: 1503654 - DNA, 15 bp, Homo sapiens
gttttgttctttaaa

SEQ ID NO: 1503655 - DNA, 17 bp, Homo sapiens
gttttgttttaaaatta

SEQ ID NO: 1503656 - DNA, 16 bp, Homo sapiens
gttttgttttgtttta

SEQ ID NO: 1503657 - DNA, 19 bp, Homo sapiens
gtttttaaaaagagtaatt

SEQ ID NO: 1503658 - DNA, 19 bp, Homo sapiens
gtttttaaataaagaacaa

SEQ ID NO: 1503659 - DNA, 22 bp, Homo sapiens
gtttttaaataaagaacaattg

SEQ ID NO: 1503660 - DNA, 18 bp, Homo sapiens
gtttttaaatgaggatta

SEQ ID NO: 1503661 - DNA, 22 bp, Homo sapiens
gtttttaagaaaaacatgtcat

SEQ ID NO: 1503662 - DNA, 14 bp, Homo sapiens
gtttttaagctgtt

SEQ ID NO: 1503663 - DNA, 15 bp, Homo sapiens
gtttttaagctgttt

SEQ ID NO: 1503664 - DNA, 11 bp, Homo sapiens
gtttttacagc

SEQ ID NO: 1503665 - DNA, 13 bp, Homo sapiens
gtttttacagtta

SEQ ID NO: 1503666 - DNA, 16 bp, Homo sapiens
gtttttactgctctga

SEQ ID NO: 1503667 - DNA, 16 bp, Homo sapiens
gtttttattttcaaga

SEQ ID NO: 1503668 - DNA, 13 bp, Homo sapiens
gtttttatttttg

SEQ ID NO: 1503669 - DNA, 14 bp, Homo sapiens
gtttttcatctttt

SEQ ID NO: 1503670 - DNA, 21 bp, Homo sapiens
gtttttcatcttttattttgg

SEQ ID NO: 1503671 - DNA, 18 bp, Homo sapiens
gtttttcatttgttttgc

SEQ ID NO: 1503672 - DNA, 13 bp, Homo sapiens
gtttttctatata

SEQ ID NO: 1503673 - DNA, 18 bp, Homo sapiens
gtttttctttttccacaa

SEQ ID NO: 1503674 - DNA, 15 bp, Homo sapiens
gtttttgcatgaaat

SEQ ID NO: 1503675 - DNA, 10 bp, Homo sapiens
gtttttgctt

SEQ ID NO: 1503676 - DNA, 13 bp, Homo sapiens
gtttttgcttctc

SEQ ID NO: 1503677 - DNA, 10 bp, Homo sapiens
gtttttggaa

SEQ ID NO: 1503678 - DNA, 15 bp, Homo sapiens
gtttttggtgtttct

SEQ ID NO: 1503679 - DNA, 15 bp, Homo sapiens
gtttttgtttggaga

SEQ ID NO: 1503680 - DNA, 16 bp, Homo sapiens
gtttttgtttttgcat

SEQ ID NO: 1503681 - DNA, 14 bp, Homo sapiens
gttttttaaagcaa

SEQ ID NO: 1503682 - DNA, 19 bp, Homo sapiens
gttttttaagatagtgtaa

SEQ ID NO: 1503683 - DNA, 13 bp, Homo sapiens
gttttttcctttg

SEQ ID NO: 1503684 - DNA, 14 bp, Homo sapiens
gttttttcgtgttt

SEQ ID NO: 1503685 - DNA, 12 bp, Homo sapiens
gttttttgaaaa

SEQ ID NO: 1503686 - DNA, 13 bp, Homo sapiens
gttttttgtaact

SEQ ID NO: 1503687 - DNA, 18 bp, Homo sapiens
gttttttgttcttgcgat

SEQ ID NO: 1503688 - DNA, 13 bp, Homo sapiens
gtttttttccagt

SEQ ID NO: 1503689 - DNA, 17 bp, Homo sapiens
gtttttttcctcatgta

SEQ ID NO: 1503690 - DNA, 20 bp, Homo sapiens
gtttttttcctcatgtaaca

SEQ ID NO: 1503691 - DNA, 22 bp, Homo sapiens
gtttttttcctcatgtaacatt

SEQ ID NO: 1503692 - DNA, 19 bp, Homo sapiens
gtttttttcttctgtattt

SEQ ID NO: 1503693 - DNA, 18 bp, Homo sapiens
gtttttttctttggctgc

SEQ ID NO: 1503694 - DNA, 10 bp, Homo sapiens
gtttttttgc

SEQ ID NO: 1503695 - DNA, 19 bp, Homo sapiens
gtttttttgtatagaccaa

SEQ ID NO: 1503696 - DNA, 19 bp, Homo sapiens
gtttttttttttcttaaat

SEQ ID NO: 1503697 - DNA, 20 bp, Homo sapiens
gttttttttttttttatgtg

SEQ ID NO: 1503698 - DNA, 18 bp, Homo sapiens
taaaaaaaaaaacaaagc

SEQ ID NO: 1503699 - DNA, 17 bp, Homo sapiens
taaaaaaaaaaggatga

SEQ ID NO: 1503700 - DNA, 16 bp, Homo sapiens
taaaaaaaagaaatga

SEQ ID NO: 1503701 - DNA, 15 bp, Homo sapiens
taaaaaaaagatgaa

SEQ ID NO: 1503702 - DNA, 12 bp, Homo sapiens
taaaaaaagcaa

SEQ ID NO: 1503703 - DNA, 13 bp, Homo sapiens
taaaaaaagcaaa

SEQ ID NO: 1503704 - DNA, 14 bp, Homo sapiens
taaaaaaagcaaaa

SEQ ID NO: 1503705 - DNA, 20 bp, Homo sapiens
taaaaaaagctaaattacat

SEQ ID NO: 1503706 - DNA, 15 bp, Homo sapiens
taaaaaaataaaata

SEQ ID NO: 1503707 - DNA, 13 bp, Homo sapiens
taaaaaaataaca

SEQ ID NO: 1503708 - DNA, 20 bp, Homo sapiens
taaaaaaataataataatgt

SEQ ID NO: 1503709 - DNA, 13 bp, Homo sapiens
taaaaaaatttga

SEQ ID NO: 1503710 - DNA, 18 bp, Homo sapiens
taaaaaaatttttgcaaa

SEQ ID NO: 1503711 - DNA, 19 bp, Homo sapiens
taaaaaacactaaacattc

SEQ ID NO: 1503712 - DNA, 13 bp, Homo sapiens
taaaaaactcttt

SEQ ID NO: 1503713 - DNA, 13 bp, Homo sapiens
taaaaaagaaaaa

SEQ ID NO: 1503714 - DNA, 16 bp, Homo sapiens
taaaaaagcaaggcac

SEQ ID NO: 1503715 - DNA, 21 bp, Homo sapiens
taaaaaagtgtttaccctgaa

SEQ ID NO: 1503716 - DNA, 12 bp, Homo sapiens
taaaaaataaca

SEQ ID NO: 1503717 - DNA, 13 bp, Homo sapiens
taaaaaataacat

SEQ ID NO: 1503718 - DNA, 15 bp, Homo sapiens
taaaaaataacatat

SEQ ID NO: 1503719 - DNA, 18 bp, Homo sapiens
taaaaaataacatattct

SEQ ID NO: 1503720 - DNA, 22 bp, Homo sapiens
taaaaaataacatattcttgct

SEQ ID NO: 1503721 - DNA, 16 bp, Homo sapiens
taaaaaatattttctc

SEQ ID NO: 1503722 - DNA, 22 bp, Homo sapiens
taaaaaatcatgccagtatttt

SEQ ID NO: 1503723 - DNA, 12 bp, Homo sapiens
taaaaaatggaa

SEQ ID NO: 1503724 - DNA, 16 bp, Homo sapiens
taaaaaatggagctca

SEQ ID NO: 1503725 - DNA, 13 bp, Homo sapiens
taaaaaatgtcca

SEQ ID NO: 1503726 - DNA, 13 bp, Homo sapiens
taaaaaatgtctc

SEQ ID NO: 1503727 - DNA, 16 bp, Homo sapiens
taaaaaatgtcttctt

SEQ ID NO: 1503728 - DNA, 14 bp, Homo sapiens
taaaaaatgttttc

SEQ ID NO: 1503729 - DNA, 16 bp, Homo sapiens
taaaaaattaaagccc

SEQ ID NO: 1503730 - DNA, 18 bp, Homo sapiens
taaaaaattgaaaagatt

SEQ ID NO: 1503731 - DNA, 17 bp, Homo sapiens
taaaaacaaaggaataa

SEQ ID NO: 1503732 - DNA, 15 bp, Homo sapiens
taaaaacaaccaaca

SEQ ID NO: 1503733 - DNA, 13 bp, Homo sapiens
taaaaacaacttt

SEQ ID NO: 1503734 - DNA, 19 bp, Homo sapiens
taaaaacaactttcacttc

SEQ ID NO: 1503735 - DNA, 21 bp, Homo sapiens
taaaaacactacctcttttga

SEQ ID NO: 1503736 - DNA, 17 bp, Homo sapiens
taaaaacagcattgctt

SEQ ID NO: 1503737 - DNA, 19 bp, Homo sapiens
taaaaacagcattgctttc

SEQ ID NO: 1503738 - DNA, 13 bp, Homo sapiens
taaaaaccctgta

SEQ ID NO: 1503739 - DNA, 14 bp, Homo sapiens
taaaaactcctttt

SEQ ID NO: 1503740 - DNA, 16 bp, Homo sapiens
taaaaagaaatctggt

SEQ ID NO: 1503741 - DNA, 21 bp, Homo sapiens
taaaaagaagatgaatggtct

SEQ ID NO: 1503742 - DNA, 21 bp, Homo sapiens
taaaaagaaggaaaatgatct

SEQ ID NO: 1503743 - DNA, 21 bp, Homo sapiens
taaaaagaattccaccaggct

SEQ ID NO: 1503744 - DNA, 21 bp, Homo sapiens
gttgaaaaagtttgtttttgc

SEQ ID NO: 1503745 - DNA, 22 bp, Homo sapiens
gttgaaaagactccaaagaaat

SEQ ID NO: 1503746 - DNA, 23 bp, Homo sapiens
gttgaaaagactccaaagaaatg

SEQ ID NO: 1503747 - DNA, 14 bp, Homo sapiens
gttgaaaagccaaa

SEQ ID NO: 1503748 - DNA, 12 bp, Homo sapiens
gttgaaagacat

SEQ ID NO: 1503749 - DNA, 14 bp, Homo sapiens
gttgaacaaaataa

SEQ ID NO: 1503750 - DNA, 19 bp, Homo sapiens
gttgaactgttagaatgta

SEQ ID NO: 1503751 - DNA, 20 bp, Homo sapiens
gttgaagagacagagacaag

SEQ ID NO: 1503752 - DNA, 15 bp, Homo sapiens
gttgaagaggaaggg

SEQ ID NO: 1503753 - DNA, 13 bp, Homo sapiens
gttgaagctctgg

SEQ ID NO: 1503754 - DNA, 18 bp, Homo sapiens
gttgaataaaagtgcaca

SEQ ID NO: 1503755 - DNA, 20 bp, Homo sapiens
gttgaatctgagctgcaggt

SEQ ID NO: 1503756 - DNA, 14 bp, Homo sapiens
gttgaatgctgctt

SEQ ID NO: 1503757 - DNA, 18 bp, Homo sapiens
gttgaattggtgaataaa

SEQ ID NO: 1503758 - DNA, 14 bp, Homo sapiens
gttgacaactgtga

SEQ ID NO: 1503759 - DNA, 21 bp, Homo sapiens
gttgacaccattctcctgcct

SEQ ID NO: 1503760 - DNA, 18 bp, Homo sapiens
gttgacatccaaatctag

SEQ ID NO: 1503761 - DNA, 14 bp, Homo sapiens
gttgactttcaggt

SEQ ID NO: 1503762 - DNA, 12 bp, Homo sapiens
gttgagaaatga

SEQ ID NO: 1503763 - DNA, 22 bp, Homo sapiens
gttgagatgttgtgtggcaatg

SEQ ID NO: 1503764 - DNA, 10 bp, Homo sapiens
gttgagcccc

SEQ ID NO: 1503765 - DNA, 15 bp, Homo sapiens
gttgagccccaagtc

SEQ ID NO: 1503766 - DNA, 19 bp, Homo sapiens
gttgagccccaagtcctga

SEQ ID NO: 1503767 - DNA, 17 bp, Homo sapiens
gttgagccccagtgctg

SEQ ID NO: 1503768 - DNA, 15 bp, Homo sapiens
gttgagcccctggag

SEQ ID NO: 1503769 - DNA, 19 bp, Homo sapiens
gttgagggaacagacagga

SEQ ID NO: 1503770 - DNA, 23 bp, Homo sapiens
gttgagggaacagacaggagaaa

SEQ ID NO: 1503771 - DNA, 16 bp, Homo sapiens
gttgaggtttttaaat

SEQ ID NO: 1503772 - DNA, 19 bp, Homo sapiens
gttgagtacagtgaggagg

SEQ ID NO: 1503773 - DNA, 14 bp, Homo sapiens
gttgagtctcctct

SEQ ID NO: 1503774 - DNA, 20 bp, Homo sapiens
gttgagtctcctctctgaga

SEQ ID NO: 1503775 - DNA, 21 bp, Homo sapiens
gttgagtctcctctctgagac

SEQ ID NO: 1503776 - DNA, 21 bp, Homo sapiens
gttgataaattccactggact

SEQ ID NO: 1503777 - DNA, 12 bp, Homo sapiens
gttgatagttta

SEQ ID NO: 1503778 - DNA, 22 bp, Homo sapiens
gttgatcatgtactttttagta

SEQ ID NO: 1503779 - DNA, 16 bp, Homo sapiens
gttgatctggaaccca

SEQ ID NO: 1503780 - DNA, 15 bp, Homo sapiens
gttgatggaaaataa

SEQ ID NO: 1503781 - DNA, 23 bp, Homo sapiens
gttgattcggtatccccccatct

SEQ ID NO: 1503782 - DNA, 14 bp, Homo sapiens
gttgatttctttcc

SEQ ID NO: 1503783 - DNA, 17 bp, Homo sapiens
gttgattttcatgattc

SEQ ID NO: 1503784 - DNA, 20 bp, Homo sapiens
gttgcaaactcagttccaaa

SEQ ID NO: 1503785 - DNA, 16 bp, Homo sapiens
gttgcaagatgtgaat

SEQ ID NO: 1503786 - DNA, 23 bp, Homo sapiens
gttgcaaggccgctgttcaccca

SEQ ID NO: 1503787 - DNA, 13 bp, Homo sapiens
gttgcacacagta

SEQ ID NO: 1503788 - DNA, 18 bp, Homo sapiens
gttgcactaactgctggt

SEQ ID NO: 1503789 - DNA, 22 bp, Homo sapiens
gttgcagataaactgatgtttg

SEQ ID NO: 1503790 - DNA, 21 bp, Homo sapiens
gttgcagcatgagactttctg

SEQ ID NO: 1503791 - DNA, 13 bp, Homo sapiens
gttgcagtgagct

SEQ ID NO: 1503792 - DNA, 21 bp, Homo sapiens
gttgccaaatatgtcctgggg

SEQ ID NO: 1503793 - DNA, 18 bp, Homo sapiens
gttgccaaattgctgcat

SEQ ID NO: 1503794 - DNA, 19 bp, Homo sapiens
gttgccaagctccaagccc

SEQ ID NO: 1503795 - DNA, 18 bp, Homo sapiens
gttgccacctgttaaaat

SEQ ID NO: 1503796 - DNA, 16 bp, Homo sapiens
gttgcctaataaacat

SEQ ID NO: 1503797 - DNA, 13 bp, Homo sapiens
gttgcctgacttt

SEQ ID NO: 1503798 - DNA, 12 bp, Homo sapiens
gttgccttttat

SEQ ID NO: 1503799 - DNA, 13 bp, Homo sapiens
gttgctgatttta

SEQ ID NO: 1503800 - DNA, 16 bp, Homo sapiens
gttgctgggagctgaa

SEQ ID NO: 1503801 - DNA, 15 bp, Homo sapiens
gttgctgtggctcca

SEQ ID NO: 1503802 - DNA, 23 bp, Homo sapiens
gttgctgttattatatttgacat

SEQ ID NO: 1503803 - DNA, 12 bp, Homo sapiens
gttgcttcagac

SEQ ID NO: 1503804 - DNA, 23 bp, Homo sapiens
gttgcttcttctacttcagtctt

SEQ ID NO: 1503805 - DNA, 16 bp, Homo sapiens
gttgctttgccagagc

SEQ ID NO: 1503806 - DNA, 14 bp, Homo sapiens
gttgcttttgaaaa

SEQ ID NO: 1503807 - DNA, 22 bp, Homo sapiens
gttggaaaagaatacagaaaga

SEQ ID NO: 1503808 - DNA, 14 bp, Homo sapiens
gttggaaccgtgtc

SEQ ID NO: 1503809 - DNA, 18 bp, Homo sapiens
gttggaaggatctgctga

SEQ ID NO: 1503810 - DNA, 19 bp, Homo sapiens
gttggaaggatctgctgag

SEQ ID NO: 1503811 - DNA, 15 bp, Homo sapiens
gttggacagccccct

SEQ ID NO: 1503812 - DNA, 14 bp, Homo sapiens
gttggacagctgct

SEQ ID NO: 1503813 - DNA, 16 bp, Homo sapiens
gttggacagctgcttg

SEQ ID NO: 1503814 - DNA, 21 bp, Homo sapiens
gttggacttttcgttaacatt

SEQ ID NO: 1503815 - DNA, 13 bp, Homo sapiens
gttggagaaagaa

SEQ ID NO: 1503816 - DNA, 12 bp, Homo sapiens
gttggagcaggg

SEQ ID NO: 1503817 - DNA, 13 bp, Homo sapiens
gttggagcagggg

SEQ ID NO: 1503818 - DNA, 21 bp, Homo sapiens
gttggagccactcctgtcccg

SEQ ID NO: 1503819 - DNA, 12 bp, Homo sapiens
gttggagcctgc

SEQ ID NO: 1503820 - DNA, 18 bp, Homo sapiens
gttggagctcattctgtc

SEQ ID NO: 1503821 - DNA, 22 bp, Homo sapiens
gttggatggatgggtggatggc

SEQ ID NO: 1503822 - DNA, 14 bp, Homo sapiens
gttggcagagaagg

SEQ ID NO: 1503823 - DNA, 17 bp, Homo sapiens
gttggcaggagctcctg

SEQ ID NO: 1503824 - DNA, 14 bp, Homo sapiens
gttggcaggcccac

SEQ ID NO: 1503825 - DNA, 17 bp, Homo sapiens
gttggcaggctggccag

SEQ ID NO: 1503826 - DNA, 19 bp, Homo sapiens
gttggcatagctctggggt

SEQ ID NO: 1503827 - DNA, 16 bp, Homo sapiens
gttggccaagcagaaa

SEQ ID NO: 1503828 - DNA, 19 bp, Homo sapiens
gttggccgtggtccagctc

SEQ ID NO: 1503829 - DNA, 22 bp, Homo sapiens
gttggccgtggtccagctcttg

SEQ ID NO: 1503830 - DNA, 16 bp, Homo sapiens
gttggctcaggcagac

SEQ ID NO: 1503831 - DNA, 12 bp, Homo sapiens
gttggctgctcc

SEQ ID NO: 1503832 - DNA, 13 bp, Homo sapiens
gttggctgctgcg

SEQ ID NO: 1503833 - DNA, 14 bp, Homo sapiens
gttggctgctgcgg

SEQ ID NO: 1503834 - DNA, 13 bp, Homo sapiens
gttggctgttcca

SEQ ID NO: 1503835 - DNA, 17 bp, Homo sapiens
gttggctgttccagact

SEQ ID NO: 1503836 - DNA, 12 bp, Homo sapiens
gttggctttgcc

SEQ ID NO: 1503837 - DNA, 20 bp, Homo sapiens
gttggctttgcccacccctc

SEQ ID NO: 1503838 - DNA, 17 bp, Homo sapiens
gttgggaaaggaacagg

SEQ ID NO: 1503839 - DNA, 18 bp, Homo sapiens
gttgggaacagcatggag

SEQ ID NO: 1503840 - DNA, 23 bp, Homo sapiens
gttgggaatgaggaaaattctta

SEQ ID NO: 1503841 - DNA, 18 bp, Homo sapiens
gttgggaggatacagagg

SEQ ID NO: 1503842 - DNA, 21 bp, Homo sapiens
gttgggaggatacagaggaga

SEQ ID NO: 1503843 - DNA, 22 bp, Homo sapiens
gttgggattcctgacccaggcc

SEQ ID NO: 1503844 - DNA, 23 bp, Homo sapiens
gttgggattcctgacccaggccg

SEQ ID NO: 1503845 - DNA, 14 bp, Homo sapiens
gttgggcagccaga

SEQ ID NO: 1503846 - DNA, 19 bp, Homo sapiens
taaaagctagatactggaa

SEQ ID NO: 1503847 - DNA, 20 bp, Homo sapiens
taaaagctagatactggaaa

SEQ ID NO: 1503848 - DNA, 14 bp, Homo sapiens
taaaagctataaag

SEQ ID NO: 1503849 - DNA, 15 bp, Homo sapiens
taaaagctttcatgt

SEQ ID NO: 1503850 - DNA, 16 bp, Homo sapiens
taaaagctttcatgtc

SEQ ID NO: 1503851 - DNA, 16 bp, Homo sapiens
taaaaggaaaaataac

SEQ ID NO: 1503852 - DNA, 14 bp, Homo sapiens
taaaaggatggcaa

SEQ ID NO: 1503853 - DNA, 18 bp, Homo sapiens
taaaaggcttgaagctgt

SEQ ID NO: 1503854 - DNA, 15 bp, Homo sapiens
taaaaggtaatgtgt

SEQ ID NO: 1503855 - DNA, 19 bp, Homo sapiens
taaaaggtgaccaatgatg

SEQ ID NO: 1503856 - DNA, 17 bp, Homo sapiens
taaaaggtgcaggtgtg

SEQ ID NO: 1503857 - DNA, 13 bp, Homo sapiens
taaaaggttgcca

SEQ ID NO: 1503858 - DNA, 22 bp, Homo sapiens
taaaaggttgccaaattgctgc

SEQ ID NO: 1503859 - DNA, 23 bp, Homo sapiens
taaaaggttgccaaattgctgca

SEQ ID NO: 1503860 - DNA, 12 bp, Homo sapiens
taaaagtaaaca

SEQ ID NO: 1503861 - DNA, 13 bp, Homo sapiens
taaaagtaaacat

SEQ ID NO: 1503862 - DNA, 19 bp, Homo sapiens
taaaagtaagttttaagga

SEQ ID NO: 1503863 - DNA, 15 bp, Homo sapiens
taaaagtactttaaa

SEQ ID NO: 1503864 - DNA, 15 bp, Homo sapiens
taaaagtgatcaata

SEQ ID NO: 1503865 - DNA, 15 bp, Homo sapiens
taaaagtgatctaca

SEQ ID NO: 1503866 - DNA, 17 bp, Homo sapiens
taaaagtgcacacctta

SEQ ID NO: 1503867 - DNA, 18 bp, Homo sapiens
taaaagtggtctctgctg

SEQ ID NO: 1503868 - DNA, 20 bp, Homo sapiens
taaaagtggtctctgctggg

SEQ ID NO: 1503869 - DNA, 12 bp, Homo sapiens
taaaagttactt

SEQ ID NO: 1503870 - DNA, 20 bp, Homo sapiens
taaaagtttgaggaatattt

SEQ ID NO: 1503871 - DNA, 16 bp, Homo sapiens
taaaagttttctccaa

SEQ ID NO: 1503872 - DNA, 21 bp, Homo sapiens
taaaagttttttattatgcat

SEQ ID NO: 1503873 - DNA, 22 bp, Homo sapiens
taaaagttttttattatgcatt

SEQ ID NO: 1503874 - DNA, 14 bp, Homo sapiens
taaaataaaaaagt

SEQ ID NO: 1503875 - DNA, 16 bp, Homo sapiens
taaaataaaaatttaa

SEQ ID NO: 1503876 - DNA, 16 bp, Homo sapiens
taaaataaactagata

SEQ ID NO: 1503877 - DNA, 15 bp, Homo sapiens
taaaataaattccta

SEQ ID NO: 1503878 - DNA, 24 bp, Homo sapiens
taaaataactagtgttgcttggac

SEQ ID NO: 1503879 - DNA, 17 bp, Homo sapiens
taaaataacttgcatct

SEQ ID NO: 1503880 - DNA, 21 bp, Homo sapiens
taaaataagcaggtggatcta

SEQ ID NO: 1503881 - DNA, 18 bp, Homo sapiens
taaaataattatataact

SEQ ID NO: 1503882 - DNA, 16 bp, Homo sapiens
taaaataattctgagt

SEQ ID NO: 1503883 - DNA, 17 bp, Homo sapiens
taaactttcccttggct

SEQ ID NO: 1503884 - DNA, 15 bp, Homo sapiens
taaacttttaattca

SEQ ID NO: 1503885 - DNA, 17 bp, Homo sapiens
taaacttttaattcatt

SEQ ID NO: 1503886 - DNA, 17 bp, Homo sapiens
taaactttttgttctgg

SEQ ID NO: 1503887 - DNA, 16 bp, Homo sapiens
taaactttttttctgt

SEQ ID NO: 1503888 - DNA, 18 bp, Homo sapiens
taaactttttttctgtac

SEQ ID NO: 1503889 - DNA, 20 bp, Homo sapiens
taaactttttttctgtacca

SEQ ID NO: 1503890 - DNA, 17 bp, Homo sapiens
taaacttttttttgaga

SEQ ID NO: 1503891 - DNA, 14 bp, Homo sapiens
taaagaaaaaaata

SEQ ID NO: 1503892 - DNA, 15 bp, Homo sapiens
taaagaaaaaaatac

SEQ ID NO: 1503893 - DNA, 16 bp, Homo sapiens
taaagaaaaatatgat

SEQ ID NO: 1503894 - DNA, 22 bp, Homo sapiens
taaagaaaaatatttaatgttg

SEQ ID NO: 1503895 - DNA, 20 bp, Homo sapiens
taaagaaacagctttcaagt

SEQ ID NO: 1503896 - DNA, 14 bp, Homo sapiens
taaagaaacatttc

SEQ ID NO: 1503897 - DNA, 14 bp, Homo sapiens
taaagaaagcagaa

SEQ ID NO: 1503898 - DNA, 23 bp, Homo sapiens
taaagaaaggaaaagaaaacaaa

SEQ ID NO: 1503899 - DNA, 19 bp, Homo sapiens
taaagaacaccctatattt

SEQ ID NO: 1503900 - DNA, 22 bp, Homo sapiens
taaagaacccctcgttagcctt

SEQ ID NO: 1503901 - DNA, 19 bp, Homo sapiens
taaagaactccttattttg

SEQ ID NO: 1503902 - DNA, 17 bp, Homo sapiens
taaagaagttgaagttt

SEQ ID NO: 1503903 - DNA, 14 bp, Homo sapiens
taaagaataaagtc

SEQ ID NO: 1503904 - DNA, 19 bp, Homo sapiens
taaagaatatgacttttta

SEQ ID NO: 1503905 - DNA, 19 bp, Homo sapiens
taaagaattttcatcccgt

SEQ ID NO: 1503906 - DNA, 15 bp, Homo sapiens
taaagacaaagacaa

SEQ ID NO: 1503907 - DNA, 19 bp, Homo sapiens
taaagacaaagacaaattc

SEQ ID NO: 1503908 - DNA, 21 bp, Homo sapiens
taaagacaaataaatgattat

SEQ ID NO: 1503909 - DNA, 15 bp, Homo sapiens
taaagacaacaaaag

SEQ ID NO: 1503910 - DNA, 19 bp, Homo sapiens
taaagacaacaaaagaaat

SEQ ID NO: 1503911 - DNA, 20 bp, Homo sapiens
taaagacaatcactgccaac

SEQ ID NO: 1503912 - DNA, 9 bp, Homo sapiens
taaagacag

SEQ ID NO: 1503913 - DNA, 10 bp, Homo sapiens
taaagacaga

SEQ ID NO: 1503914 - DNA, 15 bp, Homo sapiens
taaagaccagaaatt

SEQ ID NO: 1503915 - DNA, 16 bp, Homo sapiens
taaagaccagaaattc

SEQ ID NO: 1503916 - DNA, 19 bp, Homo sapiens
taaagacccagggggagaa

SEQ ID NO: 1503917 - DNA, 15 bp, Homo sapiens
taaagagaaaattga

SEQ ID NO: 1503918 - DNA, 12 bp, Homo sapiens
taaagagaagac

SEQ ID NO: 1503919 - DNA, 15 bp, Homo sapiens
taaagagcccttgcc

SEQ ID NO: 1503920 - DNA, 19 bp, Homo sapiens
taaagagcccttgcctccc

SEQ ID NO: 1503921 - DNA, 20 bp, Homo sapiens
taaagaggctgaaagaggcc

SEQ ID NO: 1503922 - DNA, 21 bp, Homo sapiens
taaagagtctagattcaaagg

SEQ ID NO: 1503923 - DNA, 17 bp, Homo sapiens
taaagatatttccaaga

SEQ ID NO: 1503924 - DNA, 22 bp, Homo sapiens
taaagatatttttatctttata

SEQ ID NO: 1503925 - DNA, 18 bp, Homo sapiens
taaagatcaagtgggcct

SEQ ID NO: 1503926 - DNA, 11 bp, Homo sapiens
taaagatgatc

SEQ ID NO: 1503927 - DNA, 21 bp, Homo sapiens
taaagatgatctactcagaaa

SEQ ID NO: 1503928 - DNA, 21 bp, Homo sapiens
taaagatgcaaggaccaggac

SEQ ID NO: 1503929 - DNA, 18 bp, Homo sapiens
taaagatggagtttctaa

SEQ ID NO: 1503930 - DNA, 21 bp, Homo sapiens
taaagatggagtttctaaggt

SEQ ID NO: 1503931 - DNA, 22 bp, Homo sapiens
taaagatggagtttctaaggtc

SEQ ID NO: 1503932 - DNA, 18 bp, Homo sapiens
taaagattctacaacaca

SEQ ID NO: 1503933 - DNA, 19 bp, Homo sapiens
taaagattctctttaaaaa

SEQ ID NO: 1503934 - DNA, 13 bp, Homo sapiens
taaagattgtgtg

SEQ ID NO: 1503935 - DNA, 22 bp, Homo sapiens
taaagatttatcaaatcagtca

SEQ ID NO: 1503936 - DNA, 17 bp, Homo sapiens
taaagatttctagtagg

SEQ ID NO: 1503937 - DNA, 13 bp, Homo sapiens
taaagatttctgt

SEQ ID NO: 1503938 - DNA, 14 bp, Homo sapiens
taaagatttcttga

SEQ ID NO: 1503939 - DNA, 15 bp, Homo sapiens
taaagattttgatct

SEQ ID NO: 1503940 - DNA, 21 bp, Homo sapiens
taaagattttgttttgttgga

SEQ ID NO: 1503941 - DNA, 22 bp, Homo sapiens
taaagcacagtctgatgacaca

SEQ ID NO: 1503942 - DNA, 18 bp, Homo sapiens
taaagcactttgcactta

SEQ ID NO: 1503943 - DNA, 20 bp, Homo sapiens
taaagcagagggactttgta

SEQ ID NO: 1503944 - DNA, 13 bp, Homo sapiens
taaagcatcctcc

SEQ ID NO: 1503945 - DNA, 19 bp, Homo sapiens
taaagcatgaaatgtgaat

SEQ ID NO: 1503946 - DNA, 20 bp, Homo sapiens
taaagcatgaaatgtgaatt

SEQ ID NO: 1503947 - DNA, 14 bp, Homo sapiens
taaagcattactct

SEQ ID NO: 1503948 - DNA, 13 bp, Homo sapiens
taaagcatttcct

SEQ ID NO: 1503949 - DNA, 17 bp, Homo sapiens
taaagccattctgatta

SEQ ID NO: 1503950 - DNA, 15 bp, Homo sapiens
taaagcctatttttc

SEQ ID NO: 1503951 - DNA, 13 bp, Homo sapiens
taaagcgtcctct

SEQ ID NO: 1503952 - DNA, 14 bp, Homo sapiens
taaagctcaaatga

SEQ ID NO: 1503953 - DNA, 14 bp, Homo sapiens
taaagctctgacat

SEQ ID NO: 1503954 - DNA, 16 bp, Homo sapiens
taaagctgttattctt

SEQ ID NO: 1503955 - DNA, 20 bp, Homo sapiens
taaagctgttattcttgtta

SEQ ID NO: 1503956 - DNA, 19 bp, Homo sapiens
taaagcttatttttctgtg

SEQ ID NO: 1503957 - DNA, 17 bp, Homo sapiens
taaagcttttggaagcc

SEQ ID NO: 1503958 - DNA, 21 bp, Homo sapiens
taaaggacacccctcgccccc

SEQ ID NO: 1503959 - DNA, 22 bp, Homo sapiens
taaaggagaaggcatgaaattg

SEQ ID NO: 1503960 - DNA, 10 bp, Homo sapiens
taaaggcagc

SEQ ID NO: 1503961 - DNA, 11 bp, Homo sapiens
taaaggcagct

SEQ ID NO: 1503962 - DNA, 19 bp, Homo sapiens
taaaggcagctgcctctgc

SEQ ID NO: 1503963 - DNA, 20 bp, Homo sapiens
taaaggcagctgcctctgct

SEQ ID NO: 1503964 - DNA, 24 bp, Homo sapiens
taaaggcagctgcctctgctccct

SEQ ID NO: 1503965 - DNA, 14 bp, Homo sapiens
taaaggcagttttc

SEQ ID NO: 1503966 - DNA, 19 bp, Homo sapiens
taaaggcctggaaccaggg

SEQ ID NO: 1503967 - DNA, 17 bp, Homo sapiens
taaaggcgctaatttat

SEQ ID NO: 1503968 - DNA, 14 bp, Homo sapiens
taaagggaagaaaa

SEQ ID NO: 1503969 - DNA, 22 bp, Homo sapiens
taaagggaagaaaacactgtta

SEQ ID NO: 1503970 - DNA, 23 bp, Homo sapiens
taaagggaagaaaacactgttat

SEQ ID NO: 1503971 - DNA, 20 bp, Homo sapiens
taaagggcccaatgaattat

SEQ ID NO: 1503972 - DNA, 21 bp, Homo sapiens
taaagggcccaatgaattatt

SEQ ID NO: 1503973 - DNA, 15 bp, Homo sapiens
taaaggggggagggg

SEQ ID NO: 1503974 - DNA, 20 bp, Homo sapiens
taaaggtattccttgttctt

SEQ ID NO: 1503975 - DNA, 21 bp, Homo sapiens
taaaggtcccttagccccgag

SEQ ID NO: 1503976 - DNA, 18 bp, Homo sapiens
taaaggtgtagaaaaggt

SEQ ID NO: 1503977 - DNA, 17 bp, Homo sapiens
taaaggttgccagcatg

SEQ ID NO: 1503978 - DNA, 16 bp, Homo sapiens
taaagtacctgtagtg

SEQ ID NO: 1503979 - DNA, 21 bp, Homo sapiens
taaagtacctgtagtgagaaa

SEQ ID NO: 1503980 - DNA, 22 bp, Homo sapiens
taaagtacctgtagtgagaaac

SEQ ID NO: 1503981 - DNA, 13 bp, Homo sapiens
taaagtagaagag

SEQ ID NO: 1503982 - DNA, 21 bp, Homo sapiens
taaagtatacaactgcctggg

SEQ ID NO: 1503983 - DNA, 19 bp, Homo sapiens
taaagtatatgtgcagtct

SEQ ID NO: 1503984 - DNA, 14 bp, Homo sapiens
taaagtatgaatct

SEQ ID NO: 1503985 - DNA, 23 bp, Homo sapiens
taaagtatgacccacattacttt

SEQ ID NO: 1503986 - DNA, 19 bp, Homo sapiens
taaagtatgtattatttac

SEQ ID NO: 1503987 - DNA, 19 bp, Homo sapiens
taaagtatttttgattaac

SEQ ID NO: 1503988 - DNA, 13 bp, Homo sapiens
taaagtcagatgg

SEQ ID NO: 1503989 - DNA, 21 bp, Homo sapiens
taaagtcatcatgaactggct

SEQ ID NO: 1503990 - DNA, 18 bp, Homo sapiens
taaagtcggtgattatat

SEQ ID NO: 1503991 - DNA, 20 bp, Homo sapiens
taaagtcggtgattatattt

SEQ ID NO: 1503992 - DNA, 15 bp, Homo sapiens
taaagtctaagcaag

SEQ ID NO: 1503993 - DNA, 16 bp, Homo sapiens
taaagtgataatttct

SEQ ID NO: 1503994 - DNA, 11 bp, Homo sapiens
taaagtgatta

SEQ ID NO: 1503995 - DNA, 22 bp, Homo sapiens
tcagctgtggggaacacagcta

SEQ ID NO: 1503996 - DNA, 22 bp, Homo sapiens
tcagcttatgggatccttgtct

SEQ ID NO: 1503997 - DNA, 14 bp, Homo sapiens
tcagcttgaatgtc

SEQ ID NO: 1503998 - DNA, 16 bp, Homo sapiens
tcagctttcaaagcat

SEQ ID NO: 1503999 - DNA, 17 bp, Homo sapiens
tcagctttcaaagcatt

SEQ ID NO: 1504000 - DNA, 17 bp, Homo sapiens
tcagctttcagagccag

SEQ ID NO: 1504001 - DNA, 21 bp, Homo sapiens
tcagctttctcgcgccctccc

SEQ ID NO: 1504002 - DNA, 21 bp, Homo sapiens
tcagctttctttaaagttctt

SEQ ID NO: 1504003 - DNA, 15 bp, Homo sapiens
tcagctttgagaagc

SEQ ID NO: 1504004 - DNA, 16 bp, Homo sapiens
tcagcttttgttctag

SEQ ID NO: 1504005 - DNA, 22 bp, Homo sapiens
tcaggaaaactgacagaggagg

SEQ ID NO: 1504006 - DNA, 19 bp, Homo sapiens
tcaggaaaaggttgaataa

SEQ ID NO: 1504007 - DNA, 18 bp, Homo sapiens
tcaggaaatatatatgtg

SEQ ID NO: 1504008 - DNA, 20 bp, Homo sapiens
tcaggaaatatatatgtgtg

SEQ ID NO: 1504009 - DNA, 18 bp, Homo sapiens
tcaggaaatgaaaggtga

SEQ ID NO: 1504010 - DNA, 18 bp, Homo sapiens
tcaggaacaagtaatgta

SEQ ID NO: 1504011 - DNA, 13 bp, Homo sapiens
tcaggaacagaag

SEQ ID NO: 1504012 - DNA, 12 bp, Homo sapiens
tcaggaagaaat

SEQ ID NO: 1504013 - DNA, 23 bp, Homo sapiens
tcaggaagagctatggcccagaa

SEQ ID NO: 1504014 - DNA, 13 bp, Homo sapiens
tcaggaattcagt

SEQ ID NO: 1504015 - DNA, 15 bp, Homo sapiens
tcaggaattcagtgc

SEQ ID NO: 1504016 - DNA, 13 bp, Homo sapiens
tcaggaatttaaa

SEQ ID NO: 1504017 - DNA, 20 bp, Homo sapiens
tcaggaatttaaaattaagt

SEQ ID NO: 1504018 - DNA, 13 bp, Homo sapiens
tcaggacccaggc

SEQ ID NO: 1504019 - DNA, 16 bp, Homo sapiens
tcaggacccaggccct

SEQ ID NO: 1504020 - DNA, 22 bp, Homo sapiens
tcaggacccaggccctccatgg

SEQ ID NO: 1504021 - DNA, 21 bp, Homo sapiens
tcaggacctctgtaggcagca

SEQ ID NO: 1504022 - DNA, 17 bp, Homo sapiens
tcaggacttgaaagaaa

SEQ ID NO: 1504023 - DNA, 18 bp, Homo sapiens
tcaggagaattagatttc

SEQ ID NO: 1504024 - DNA, 15 bp, Homo sapiens
tcaggagaggggcag

SEQ ID NO: 1504025 - DNA, 22 bp, Homo sapiens
tcaggagagtagaacagataat

SEQ ID NO: 1504026 - DNA, 18 bp, Homo sapiens
tcaggagcacaggcagct

SEQ ID NO: 1504027 - DNA, 15 bp, Homo sapiens
tcaggaggccctggt

SEQ ID NO: 1504028 - DNA, 22 bp, Homo sapiens
tcaggaggccctggtgtcaggc

SEQ ID NO: 1504029 - DNA, 18 bp, Homo sapiens
tcaggaggctgagacagg

SEQ ID NO: 1504030 - DNA, 22 bp, Homo sapiens
tcaggaggctgaggcagaagaa

SEQ ID NO: 1504031 - DNA, 13 bp, Homo sapiens
tcaggaggctgga

SEQ ID NO: 1504032 - DNA, 23 bp, Homo sapiens
tcaggagggtgacgcccagctcc

SEQ ID NO: 1504033 - DNA, 20 bp, Homo sapiens
tcaggagttagaggccagcc

SEQ ID NO: 1504034 - DNA, 18 bp, Homo sapiens
tcaggagttcaagaccag

SEQ ID NO: 1504035 - DNA, 22 bp, Homo sapiens
tcaggagttcaagaccagcctg

SEQ ID NO: 1504036 - DNA, 22 bp, Homo sapiens
tcaggagttgtgtctaggctgg

SEQ ID NO: 1504037 - DNA, 22 bp, Homo sapiens
tcaggagtttgagaccaggctg

SEQ ID NO: 1504038 - DNA, 23 bp, Homo sapiens
tcaggagtttgagaccaggctgg

SEQ ID NO: 1504039 - DNA, 18 bp, Homo sapiens
tcaggatactctgtcaga

SEQ ID NO: 1504040 - DNA, 18 bp, Homo sapiens
tcaggatattggttcttc

SEQ ID NO: 1504041 - DNA, 20 bp, Homo sapiens
tcaggatattggttcttccc

SEQ ID NO: 1504042 - DNA, 16 bp, Homo sapiens
tcaggatcaagaaagt

SEQ ID NO: 1504043 - DNA, 20 bp, Homo sapiens
tcaggatccaagctaagcac

SEQ ID NO: 1504044 - DNA, 20 bp, Homo sapiens
tcaggatccagtctggaaaa

SEQ ID NO: 1504045 - DNA, 18 bp, Homo sapiens
tcaggatgcacatttctg

SEQ ID NO: 1504046 - DNA, 15 bp, Homo sapiens
tcaggatgcccaggg

SEQ ID NO: 1504047 - DNA, 16 bp, Homo sapiens
tcaggatgcccagggc

SEQ ID NO: 1504048 - DNA, 15 bp, Homo sapiens
tcaggatgctgtgat

SEQ ID NO: 1504049 - DNA, 20 bp, Homo sapiens
tcaggatttaaaaactggaa

SEQ ID NO: 1504050 - DNA, 21 bp, Homo sapiens
tcaggcaagcccctcagccct

SEQ ID NO: 1504051 - DNA, 13 bp, Homo sapiens
tcaggcacacagc

SEQ ID NO: 1504052 - DNA, 14 bp, Homo sapiens
tcaggcactggtgg

SEQ ID NO: 1504053 - DNA, 16 bp, Homo sapiens
tcaggcactggtggca

SEQ ID NO: 1504054 - DNA, 20 bp, Homo sapiens
tcaggcagcaccacactggg

SEQ ID NO: 1504055 - DNA, 19 bp, Homo sapiens
tcaggcagcgttagggctg

SEQ ID NO: 1504056 - DNA, 13 bp, Homo sapiens
tcaggcagctcaa

SEQ ID NO: 1504057 - DNA, 22 bp, Homo sapiens
tcaggcataggcctgggtgctg

SEQ ID NO: 1504058 - DNA, 20 bp, Homo sapiens
tcaggcattggatatttttt

SEQ ID NO: 1504059 - DNA, 13 bp, Homo sapiens
tcaggcattttgt

SEQ ID NO: 1504060 - DNA, 14 bp, Homo sapiens
tcaggccagcccag

SEQ ID NO: 1504061 - DNA, 15 bp, Homo sapiens
tcaggccagcccagc

SEQ ID NO: 1504062 - DNA, 12 bp, Homo sapiens
tcaggccagggc

SEQ ID NO: 1504063 - DNA, 15 bp, Homo sapiens
tcaggccagggctca

SEQ ID NO: 1504064 - DNA, 16 bp, Homo sapiens
tcaggccaggtgcagt

SEQ ID NO: 1504065 - DNA, 17 bp, Homo sapiens
tcaggccccgggcttcc

SEQ ID NO: 1504066 - DNA, 16 bp, Homo sapiens
tcaggcccggcagggc

SEQ ID NO: 1504067 - DNA, 23 bp, Homo sapiens
tcaggcccgtcggagctgcctgc

SEQ ID NO: 1504068 - DNA, 17 bp, Homo sapiens
tcaggccctctgcctgc

SEQ ID NO: 1504069 - DNA, 18 bp, Homo sapiens
tcaggccctctgcctgca

SEQ ID NO: 1504070 - DNA, 16 bp, Homo sapiens
tcaggcctctgcagaa

SEQ ID NO: 1504071 - DNA, 20 bp, Homo sapiens
tcaggcgatccacctgtctc

SEQ ID NO: 1504072 - DNA, 21 bp, Homo sapiens
tcaggcgatccacctgtctca

SEQ ID NO: 1504073 - DNA, 16 bp, Homo sapiens
tcaggcggagctgctg

SEQ ID NO: 1504074 - DNA, 20 bp, Homo sapiens
tcaggcggggtgctgtggtg

SEQ ID NO: 1504075 - DNA, 18 bp, Homo sapiens
tcaggctaagaccctgtg

SEQ ID NO: 1504076 - DNA, 15 bp, Homo sapiens
tcaggctccattagg

SEQ ID NO: 1504077 - DNA, 16 bp, Homo sapiens
tcaggctccattagga

SEQ ID NO: 1504078 - DNA, 13 bp, Homo sapiens
tcaggctctgcac

SEQ ID NO: 1504079 - DNA, 18 bp, Homo sapiens
tcaggctctgcacagaca

SEQ ID NO: 1504080 - DNA, 16 bp, Homo sapiens
tcaggctcttctcctt

SEQ ID NO: 1504081 - DNA, 15 bp, Homo sapiens
tcaggctgcttggga

SEQ ID NO: 1504082 - DNA, 18 bp, Homo sapiens
tcaggcttcctggtgaga

SEQ ID NO: 1504083 - DNA, 19 bp, Homo sapiens
tcaggcttcctggtgagaa

SEQ ID NO: 1504084 - DNA, 15 bp, Homo sapiens
tcagggaagcccagc

SEQ ID NO: 1504085 - DNA, 18 bp, Homo sapiens
tcagggacagagacacct

SEQ ID NO: 1504086 - DNA, 16 bp, Homo sapiens
tcagggacagcagcct

SEQ ID NO: 1504087 - DNA, 20 bp, Homo sapiens
tcagggaccggtgctgcagg

SEQ ID NO: 1504088 - DNA, 15 bp, Homo sapiens
tcagggaggtcattt

SEQ ID NO: 1504089 - DNA, 13 bp, Homo sapiens
tcagggcagggct

SEQ ID NO: 1504090 - DNA, 14 bp, Homo sapiens
tcagggcagggctc

SEQ ID NO: 1504091 - DNA, 16 bp, Homo sapiens
tcagggccagaaggag

SEQ ID NO: 1504092 - DNA, 15 bp, Homo sapiens
tcagggccagactgg

SEQ ID NO: 1504093 - DNA, 17 bp, Homo sapiens
tcagggccaggtgcaga

SEQ ID NO: 1504094 - DNA, 13 bp, Homo sapiens
tcagggccatgct

SEQ ID NO: 1504095 - DNA, 15 bp, Homo sapiens
tcagggcccaagtcc

SEQ ID NO: 1504096 - DNA, 14 bp, Homo sapiens
tcagggcgctcaga

SEQ ID NO: 1504097 - DNA, 14 bp, Homo sapiens
tcaggggcctggag

SEQ ID NO: 1504098 - DNA, 15 bp, Homo sapiens
tcaggggcctggagg

SEQ ID NO: 1504099 - DNA, 16 bp, Homo sapiens
tcaggggcctggaggt

SEQ ID NO: 1504100 - DNA, 20 bp, Homo sapiens
tcaggggctctagggactgc

SEQ ID NO: 1504101 - DNA, 20 bp, Homo sapiens
tcaggggtacattctagctg

SEQ ID NO: 1504102 - DNA, 16 bp, Homo sapiens
tcaggggtcaggtgtc

SEQ ID NO: 1504103 - DNA, 18 bp, Homo sapiens
tcaggggtgcattctggc

SEQ ID NO: 1504104 - DNA, 17 bp, Homo sapiens
tcaggggtggagaagtg

SEQ ID NO: 1504105 - DNA, 13 bp, Homo sapiens
tcagggtataaat

SEQ ID NO: 1504106 - DNA, 22 bp, Homo sapiens
tcagtttaatgtctcctttgct

SEQ ID NO: 1504107 - DNA, 17 bp, Homo sapiens
tcagtttcacagaaaat

SEQ ID NO: 1504108 - DNA, 18 bp, Homo sapiens
tcagtttctccatcagct

SEQ ID NO: 1504109 - DNA, 15 bp, Homo sapiens
tcagtttgtgtgtct

SEQ ID NO: 1504110 - DNA, 14 bp, Homo sapiens
tcagttttccttct

SEQ ID NO: 1504111 - DNA, 16 bp, Homo sapiens
tcagttttccttctgt

SEQ ID NO: 1504112 - DNA, 19 bp, Homo sapiens
tcagttttccttctgttaa

SEQ ID NO: 1504113 - DNA, 17 bp, Homo sapiens
tcagtttttcatttgtt

SEQ ID NO: 1504114 - DNA, 17 bp, Homo sapiens
tcagttttttgttttac

SEQ ID NO: 1504115 - DNA, 13 bp, Homo sapiens
tcataaaaataaa

SEQ ID NO: 1504116 - DNA, 14 bp, Homo sapiens
tcataaaaataacc

SEQ ID NO: 1504117 - DNA, 12 bp, Homo sapiens
tcataaaactgt

SEQ ID NO: 1504118 - DNA, 16 bp, Homo sapiens
tcataaaataaagtat

SEQ ID NO: 1504119 - DNA, 22 bp, Homo sapiens
tcatggaacactcatgtctgga

SEQ ID NO: 1504120 - DNA, 14 bp, Homo sapiens
tcatggacactttg

SEQ ID NO: 1504121 - DNA, 23 bp, Homo sapiens
tcatggatgggggaactcagatc

SEQ ID NO: 1504122 - DNA, 17 bp, Homo sapiens
tcatggcagctgtttct

SEQ ID NO: 1504123 - DNA, 20 bp, Homo sapiens
tcatggcagctgtttctcat

SEQ ID NO: 1504124 - DNA, 22 bp, Homo sapiens
tcatggcagctgtttctcatga

SEQ ID NO: 1504125 - DNA, 19 bp, Homo sapiens
tcatggcgtaatgggcctg

SEQ ID NO: 1504126 - DNA, 20 bp, Homo sapiens
tcatggcgtaatgggcctgc

SEQ ID NO: 1504127 - DNA, 19 bp, Homo sapiens
tcatggctaatttaacacc

SEQ ID NO: 1504128 - DNA, 20 bp, Homo sapiens
tcatggcttttgctttccct

SEQ ID NO: 1504129 - DNA, 18 bp, Homo sapiens
tcatgggcaccaacctgc

SEQ ID NO: 1504130 - DNA, 21 bp, Homo sapiens
tcatggggatcaattttcatt

SEQ ID NO: 1504131 - DNA, 15 bp, Homo sapiens
tcatggtcctttctg

SEQ ID NO: 1504132 - DNA, 19 bp, Homo sapiens
tcatggtgatcagtgcaat

SEQ ID NO: 1504133 - DNA, 17 bp, Homo sapiens
tcatgtaaattttgtat

SEQ ID NO: 1504134 - DNA, 10 bp, Homo sapiens
tcatgtaaca

SEQ ID NO: 1504135 - DNA, 11 bp, Homo sapiens
tcatgtaacat

SEQ ID NO: 1504136 - DNA, 22 bp, Homo sapiens
tcatgtacttcctgtgtactct

SEQ ID NO: 1504137 - DNA, 23 bp, Homo sapiens
tcatgtacttcctgtgtactctt

SEQ ID NO: 1504138 - DNA, 22 bp, Homo sapiens
tcatgtactttttagtaatttc

SEQ ID NO: 1504139 - DNA, 22 bp, Homo sapiens
tcatgtagaactcagcagttga

SEQ ID NO: 1504140 - DNA, 16 bp, Homo sapiens
tcatttgttttgcttt

SEQ ID NO: 1504141 - DNA, 17 bp, Homo sapiens
tcatttgttttgctttt

SEQ ID NO: 1504142 - DNA, 14 bp, Homo sapiens
tcattttaattatt

SEQ ID NO: 1504143 - DNA, 15 bp, Homo sapiens
tcattttatgttaag

SEQ ID NO: 1504144 - DNA, 22 bp, Homo sapiens
tcattttattttcatgcttttt

SEQ ID NO: 1504145 - DNA, 15 bp, Homo sapiens
tcattttccccccac

SEQ ID NO: 1504146 - DNA, 10 bp, Homo sapiens
tcattttcct

SEQ ID NO: 1504147 - DNA, 13 bp, Homo sapiens
tcattttcctgtt

SEQ ID NO: 1504148 - DNA, 19 bp, Homo sapiens
tcattttgacaaagtgcct

SEQ ID NO: 1504149 - DNA, 15 bp, Homo sapiens
tcattttgagctgaa

SEQ ID NO: 1504150 - DNA, 13 bp, Homo sapiens
tcattttgcactg

SEQ ID NO: 1504151 - DNA, 13 bp, Homo sapiens
tcattttgcttta

SEQ ID NO: 1504152 - DNA, 17 bp, Homo sapiens
tcattttgtccatgtcc

SEQ ID NO: 1504153 - DNA, 17 bp, Homo sapiens
tcattttgtgttgaaga

SEQ ID NO: 1504154 - DNA, 21 bp, Homo sapiens
tcattttgttgcttttgtgaa

SEQ ID NO: 1504155 - DNA, 15 bp, Homo sapiens
tcatttttaatgtat

SEQ ID NO: 1504156 - DNA, 21 bp, Homo sapiens
tcatttttataacctggcaaa

SEQ ID NO: 1504157 - DNA, 12 bp, Homo sapiens
tcatttttgctg

SEQ ID NO: 1504158 - DNA, 22 bp, Homo sapiens
tcattttttatatatatgcata

SEQ ID NO: 1504159 - DNA, 12 bp, Homo sapiens
tcattttttcct

SEQ ID NO: 1504160 - DNA, 22 bp, Homo sapiens
tcatttttttagaaatgtgaag

SEQ ID NO: 1504161 - DNA, 16 bp, Homo sapiens
tcatttttttccaggc

SEQ ID NO: 1504162 - DNA, 18 bp, Homo sapiens
tcatttttttccaggctg

SEQ ID NO: 1504163 - DNA, 18 bp, Homo sapiens
tcatttttttctctctgg

SEQ ID NO: 1504164 - DNA, 20 bp, Homo sapiens
tcatttttttctctctggag

SEQ ID NO: 1504165 - DNA, 18 bp, Homo sapiens
tccaaaaaaaggaaaaat

SEQ ID NO: 1504166 - DNA, 20 bp, Homo sapiens
tccaaaaaaaggaaaaataa

SEQ ID NO: 1504167 - DNA, 15 bp, Homo sapiens
tccaaaaagaacaat

SEQ ID NO: 1504168 - DNA, 19 bp, Homo sapiens
tccaaaaagattttcagaa

SEQ ID NO: 1504169 - DNA, 20 bp, Homo sapiens
tccaaaaagattttcagaaa

SEQ ID NO: 1504170 - DNA, 21 bp, Homo sapiens
tccaaaaatgtgtaagaacaa

SEQ ID NO: 1504171 - DNA, 19 bp, Homo sapiens
tccaaaacctgcttccttc

SEQ ID NO: 1504172 - DNA, 13 bp, Homo sapiens
tccaaaagacaaa

SEQ ID NO: 1504173 - DNA, 20 bp, Homo sapiens
tccaaaagattgctgaaatt

SEQ ID NO: 1504174 - DNA, 22 bp, Homo sapiens
tccaaaatgaatgcaaaattgt

SEQ ID NO: 1504175 - DNA, 19 bp, Homo sapiens
tccaaacaccggcagaaaa

SEQ ID NO: 1504176 - DNA, 16 bp, Homo sapiens
tccaaaccaaataaaa

SEQ ID NO: 1504177 - DNA, 15 bp, Homo sapiens
tccaaaccaggacac

SEQ ID NO: 1504178 - DNA, 14 bp, Homo sapiens
tccaaacctccagc

SEQ ID NO: 1504179 - DNA, 21 bp, Homo sapiens
tccaaacctccagcctccctg

SEQ ID NO: 1504180 - DNA, 22 bp, Homo sapiens
tccaaacctggttcatatttat

SEQ ID NO: 1504181 - DNA, 19 bp, Homo sapiens
tccaaacctgtaacctttc

SEQ ID NO: 1504182 - DNA, 12 bp, Homo sapiens
tccaaagaaatg

SEQ ID NO: 1504183 - DNA, 13 bp, Homo sapiens
tccaaagagaaaa

SEQ ID NO: 1504184 - DNA, 17 bp, Homo sapiens
tccaaagagccttcaga

SEQ ID NO: 1504185 - DNA, 14 bp, Homo sapiens
tccaaagaggctgc

SEQ ID NO: 1504186 - DNA, 19 bp, Homo sapiens
tccaaagaggctgcccctc

SEQ ID NO: 1504187 - DNA, 23 bp, Homo sapiens
tccaaagcctagacaacctttct

SEQ ID NO: 1504188 - DNA, 13 bp, Homo sapiens
tccaaaggaggct

SEQ ID NO: 1504189 - DNA, 15 bp, Homo sapiens
tccaaagtaaaattg

SEQ ID NO: 1504190 - DNA, 19 bp, Homo sapiens
tccaaagtcacaggaagaa

SEQ ID NO: 1504191 - DNA, 19 bp, Homo sapiens
tccaaagtggagctgggag

SEQ ID NO: 1504192 - DNA, 14 bp, Homo sapiens
tccaaataaacatt

SEQ ID NO: 1504193 - DNA, 15 bp, Homo sapiens
tccaaataaacattt

SEQ ID NO: 1504194 - DNA, 23 bp, Homo sapiens
tccaaataaacattttttaagaa

SEQ ID NO: 1504195 - DNA, 16 bp, Homo sapiens
tccaaataaattcaat

SEQ ID NO: 1504196 - DNA, 16 bp, Homo sapiens
tccaaatctgtcctct

SEQ ID NO: 1504197 - DNA, 19 bp, Homo sapiens
tccaaatctgtcctctgta

SEQ ID NO: 1504198 - DNA, 18 bp, Homo sapiens
tccaaatgatcctagtaa

SEQ ID NO: 1504199 - DNA, 17 bp, Homo sapiens
tccaaatgtcctccaga

SEQ ID NO: 1504200 - DNA, 20 bp, Homo sapiens
tccaaatgtcctccagaagc

SEQ ID NO: 1504201 - DNA, 22 bp, Homo sapiens
tccaaatgtgatcaactgttca

SEQ ID NO: 1504202 - DNA, 18 bp, Homo sapiens
tccaaatgtgtcagaata

SEQ ID NO: 1504203 - DNA, 14 bp, Homo sapiens
tccaacaagaatgc

SEQ ID NO: 1504204 - DNA, 16 bp, Homo sapiens
tccaacaagaatgcat

SEQ ID NO: 1504205 - DNA, 18 bp, Homo sapiens
tccaacaccacagacaca

SEQ ID NO: 1504206 - DNA, 19 bp, Homo sapiens
tccaacagctcaagtcttc

SEQ ID NO: 1504207 - DNA, 14 bp, Homo sapiens
tccaacatttcttg

SEQ ID NO: 1504208 - DNA, 18 bp, Homo sapiens
tccaaccactgtgccact

SEQ ID NO: 1504209 - DNA, 23 bp, Homo sapiens
tccaaccaggagctgatggcagc

SEQ ID NO: 1504210 - DNA, 17 bp, Homo sapiens
tccaacccattagccat

SEQ ID NO: 1504211 - DNA, 18 bp, Homo sapiens
tccaacctaacccctttc

SEQ ID NO: 1504212 - DNA, 16 bp, Homo sapiens
tccaacctcctgctct

SEQ ID NO: 1504213 - DNA, 17 bp, Homo sapiens
tccaacctcctgctctg

SEQ ID NO: 1504214 - DNA, 18 bp, Homo sapiens
tccaacctcctgctctgg

SEQ ID NO: 1504215 - DNA, 19 bp, Homo sapiens
tccaacctcctgctctggg

SEQ ID NO: 1504216 - DNA, 20 bp, Homo sapiens
tccaacctcctgctctggga

SEQ ID NO: 1504217 - DNA, 21 bp, Homo sapiens
tccaacctcctgctctgggac

SEQ ID NO: 1504218 - DNA, 20 bp, Homo sapiens
tccaacctgaaggtcccctg

SEQ ID NO: 1504219 - DNA, 13 bp, Homo sapiens
tccaaccttccca

SEQ ID NO: 1504220 - DNA, 17 bp, Homo sapiens
tccaacgcccctgtggc

SEQ ID NO: 1504221 - DNA, 15 bp, Homo sapiens
tccaactaatgcctt

SEQ ID NO: 1504222 - DNA, 20 bp, Homo sapiens
tccaactactaatagaataa

SEQ ID NO: 1504223 - DNA, 21 bp, Homo sapiens
tccaactactaatagaataaa

SEQ ID NO: 1504224 - DNA, 23 bp, Homo sapiens
tccaactactaatagaataaagg

SEQ ID NO: 1504225 - DNA, 12 bp, Homo sapiens
tccaactccagc

SEQ ID NO: 1504226 - DNA, 14 bp, Homo sapiens
tccaactccagcaa

SEQ ID NO: 1504227 - DNA, 16 bp, Homo sapiens
tccaacttgtctggga

SEQ ID NO: 1504228 - DNA, 21 bp, Homo sapiens
tccaagaactctaaccagtgt

SEQ ID NO: 1504229 - DNA, 16 bp, Homo sapiens
tccaagaatccacatt

SEQ ID NO: 1504230 - DNA, 20 bp, Homo sapiens
tccaagaatccacatttcta

SEQ ID NO: 1504231 - DNA, 23 bp, Homo sapiens
tccaagaatccacatttctaaaa

SEQ ID NO: 1504232 - DNA, 19 bp, Homo sapiens
tccaagaatctatctgctt

SEQ ID NO: 1504233 - DNA, 17 bp, Homo sapiens
tccaagacatgtctgtt

SEQ ID NO: 1504234 - DNA, 20 bp, Homo sapiens
tccaagacatgtctgttcta

SEQ ID NO: 1504235 - DNA, 22 bp, Homo sapiens
tccaagacatgtctgttctaca

SEQ ID NO: 1504236 - DNA, 20 bp, Homo sapiens
tccaagactctagagtccaa

SEQ ID NO: 1504237 - DNA, 19 bp, Homo sapiens
tccaagagggtcctttagt

SEQ ID NO: 1504238 - DNA, 15 bp, Homo sapiens
tccaagattccggat

SEQ ID NO: 1504239 - DNA, 16 bp, Homo sapiens
tccaagattctagatg

SEQ ID NO: 1504240 - DNA, 20 bp, Homo sapiens
tccaagattctagatgatta

SEQ ID NO: 1504241 - DNA, 19 bp, Homo sapiens
tccaagcaagtagctttcc

SEQ ID NO: 1504242 - DNA, 23 bp, Homo sapiens
tccaagcaagtagctttccacat

SEQ ID NO: 1504243 - DNA, 16 bp, Homo sapiens
tccaagcagagtgttt

SEQ ID NO: 1504244 - DNA, 14 bp, Homo sapiens
tccaagcatttcat

SEQ ID NO: 1504245 - DNA, 15 bp, Homo sapiens
tccaagcatttcatg

SEQ ID NO: 1504246 - DNA, 17 bp, Homo sapiens
tccaagcatttcatgaa

SEQ ID NO: 1504247 - DNA, 20 bp, Homo sapiens
tccaagcatttcatgaaaaa

SEQ ID NO: 1504248 - DNA, 15 bp, Homo sapiens
tccaagcctccacag

SEQ ID NO: 1504249 - DNA, 21 bp, Homo sapiens
tccaagcgaggtcaacagaga

SEQ ID NO: 1504250 - DNA, 22 bp, Homo sapiens
tccaagcgaggtcaacagagaa

SEQ ID NO: 1504251 - DNA, 15 bp, Homo sapiens
tccaaggagaaacag

SEQ ID NO: 1504252 - DNA, 14 bp, Homo sapiens
tccaaggagaccaa

SEQ ID NO: 1504253 - DNA, 18 bp, Homo sapiens
tccaaggccctgcttttt

SEQ ID NO: 1504254 - DNA, 23 bp, Homo sapiens
tccaaggccctgctttttttctt

SEQ ID NO: 1504255 - DNA, 20 bp, Homo sapiens
tccaagggacagcccacggt

SEQ ID NO: 1504256 - DNA, 14 bp, Homo sapiens
tccagcctgtgtgt

SEQ ID NO: 1504257 - DNA, 15 bp, Homo sapiens
tccagcctttccaag

SEQ ID NO: 1504258 - DNA, 17 bp, Homo sapiens
tccagcgagagagtttc

SEQ ID NO: 1504259 - DNA, 21 bp, Homo sapiens
tccagcgagagagtttcaaaa

SEQ ID NO: 1504260 - DNA, 20 bp, Homo sapiens
tccagcgatggtgctgccca

SEQ ID NO: 1504261 - DNA, 22 bp, Homo sapiens
tccagcgatggtgctgcccagg

SEQ ID NO: 1504262 - DNA, 20 bp, Homo sapiens
tccagcgggacaccctggtt

SEQ ID NO: 1504263 - DNA, 19 bp, Homo sapiens
tccagcgtcactccagtgc

SEQ ID NO: 1504264 - DNA, 15 bp, Homo sapiens
tccagctcccactcc

SEQ ID NO: 1504265 - DNA, 12 bp, Homo sapiens
tccagctctgac

SEQ ID NO: 1504266 - DNA, 16 bp, Homo sapiens
tccagctctgacatcc

SEQ ID NO: 1504267 - DNA, 17 bp, Homo sapiens
tccagctctgacatccc

SEQ ID NO: 1504268 - DNA, 18 bp, Homo sapiens
tccagctctgacatccct

SEQ ID NO: 1504269 - DNA, 19 bp, Homo sapiens
tccagctctgacatccctt

SEQ ID NO: 1504270 - DNA, 20 bp, Homo sapiens
tccagctctgacatcccttc

SEQ ID NO: 1504271 - DNA, 22 bp, Homo sapiens
tccagctctgacatcccttcct

SEQ ID NO: 1504272 - DNA, 10 bp, Homo sapiens
tccagctctt

SEQ ID NO: 1504273 - DNA, 13 bp, Homo sapiens
tccagctcttggc

SEQ ID NO: 1504274 - DNA, 14 bp, Homo sapiens
tccagctcttggcc

SEQ ID NO: 1504275 - DNA, 17 bp, Homo sapiens
tccagctctttagaatg

SEQ ID NO: 1504276 - DNA, 17 bp, Homo sapiens
tccagctgccaagtgct

SEQ ID NO: 1504277 - DNA, 22 bp, Homo sapiens
tccagctgccaagtgctctttg

SEQ ID NO: 1504278 - DNA, 14 bp, Homo sapiens
tccagctgctgtct

SEQ ID NO: 1504279 - DNA, 12 bp, Homo sapiens
tccagctggcct

SEQ ID NO: 1504280 - DNA, 14 bp, Homo sapiens
tccagctgggcctc

SEQ ID NO: 1504281 - DNA, 13 bp, Homo sapiens
tccagcttccaaa

SEQ ID NO: 1504282 - DNA, 17 bp, Homo sapiens
tccagcttgcattgatt

SEQ ID NO: 1504283 - DNA, 16 bp, Homo sapiens
tccagcttgctcttca

SEQ ID NO: 1504284 - DNA, 17 bp, Homo sapiens
tccagcttttgaacctt

SEQ ID NO: 1504285 - DNA, 15 bp, Homo sapiens
tccaggaaaaaataa

SEQ ID NO: 1504286 - DNA, 18 bp, Homo sapiens
tccaggaagaagcagggg

SEQ ID NO: 1504287 - DNA, 12 bp, Homo sapiens
tccaggaaggca

SEQ ID NO: 1504288 - DNA, 22 bp, Homo sapiens
tccaggaaggtagcccagcact

SEQ ID NO: 1504289 - DNA, 20 bp, Homo sapiens
tccaggaattcctcttttgc

SEQ ID NO: 1504290 - DNA, 19 bp, Homo sapiens
tccaggaattttgtgtgat

SEQ ID NO: 1504291 - DNA, 15 bp, Homo sapiens
tccaggactgggtct

SEQ ID NO: 1504292 - DNA, 21 bp, Homo sapiens
tccaggactgggtctgacctg

SEQ ID NO: 1504293 - DNA, 12 bp, Homo sapiens
tccaggagaagg

SEQ ID NO: 1504294 - DNA, 18 bp, Homo sapiens
tccaggagaagtgctccc

SEQ ID NO: 1504295 - DNA, 13 bp, Homo sapiens
tccaggagcctgg

SEQ ID NO: 1504296 - DNA, 23 bp, Homo sapiens
tccaggagcctggctccgtccag

SEQ ID NO: 1504297 - DNA, 18 bp, Homo sapiens
tccaggagcctgtgcctc

SEQ ID NO: 1504298 - DNA, 15 bp, Homo sapiens
tccaggaggcagtgg

SEQ ID NO: 1504299 - DNA, 20 bp, Homo sapiens
tccaggaggccttattttga

SEQ ID NO: 1504300 - DNA, 18 bp, Homo sapiens
tccaggatcctgcaggaa

SEQ ID NO: 1504301 - DNA, 19 bp, Homo sapiens
tccaggatctttgactgaa

SEQ ID NO: 1504302 - DNA, 20 bp, Homo sapiens
tccaggatctttgactgaaa

SEQ ID NO: 1504303 - DNA, 21 bp, Homo sapiens
tccaggattttaatttcagga

SEQ ID NO: 1504304 - DNA, 15 bp, Homo sapiens
tccaggcacagctga

SEQ ID NO: 1504305 - DNA, 17 bp, Homo sapiens
tccaggcacagctgagt

SEQ ID NO: 1504306 - DNA, 13 bp, Homo sapiens
tccaggcagatcc

SEQ ID NO: 1504307 - DNA, 14 bp, Homo sapiens
tccaggcagatcca

SEQ ID NO: 1504308 - DNA, 17 bp, Homo sapiens
tccaggcagatccagga

SEQ ID NO: 1504309 - DNA, 19 bp, Homo sapiens
tccaggcagatccaggact

SEQ ID NO: 1504310 - DNA, 22 bp, Homo sapiens
tccaggcagtcgggggctggcc

SEQ ID NO: 1504311 - DNA, 16 bp, Homo sapiens
tccaggccactgtggc

SEQ ID NO: 1504312 - DNA, 22 bp, Homo sapiens
tccaggccactgtggccagagc

SEQ ID NO: 1504313 - DNA, 11 bp, Homo sapiens
tccaggccagg

SEQ ID NO: 1504314 - DNA, 18 bp, Homo sapiens
tccaggccagggctcctg

SEQ ID NO: 1504315 - DNA, 17 bp, Homo sapiens
tccaggcccaactgtga

SEQ ID NO: 1504316 - DNA, 20 bp, Homo sapiens
tccaggcccaaggctcccgg

SEQ ID NO: 1504317 - DNA, 14 bp, Homo sapiens
tccaggcccatctc

SEQ ID NO: 1504318 - DNA, 15 bp, Homo sapiens
tccaggcccatctca

SEQ ID NO: 1504319 - DNA, 20 bp, Homo sapiens
tccaggccccacctcctcct

SEQ ID NO: 1504320 - DNA, 20 bp, Homo sapiens
tccaggcccctgaggactgg

SEQ ID NO: 1504321 - DNA, 21 bp, Homo sapiens
tccaggcccctgaggactgga

SEQ ID NO: 1504322 - DNA, 21 bp, Homo sapiens
tccaggccgcgccctttcccc

SEQ ID NO: 1504323 - DNA, 16 bp, Homo sapiens
tccaggcctgaccagg

SEQ ID NO: 1504324 - DNA, 14 bp, Homo sapiens
tccaggcctgcctc

SEQ ID NO: 1504325 - DNA, 18 bp, Homo sapiens
tccaggcctgcctcccac

SEQ ID NO: 1504326 - DNA, 22 bp, Homo sapiens
tccaggcctgtgaggtgcagag

SEQ ID NO: 1504327 - DNA, 20 bp, Homo sapiens
tccaggctcttcctggacct

SEQ ID NO: 1504328 - DNA, 11 bp, Homo sapiens
tccaggctgag

SEQ ID NO: 1504329 - DNA, 13 bp, Homo sapiens
tccaggctgagcc

SEQ ID NO: 1504330 - DNA, 15 bp, Homo sapiens
tccaggctgagccat

SEQ ID NO: 1504331 - DNA, 22 bp, Homo sapiens
tccatctcaaaaaaaaaaaaga

SEQ ID NO: 1504332 - DNA, 17 bp, Homo sapiens
tccatctcaaaacaaaa

SEQ ID NO: 1504333 - DNA, 18 bp, Homo sapiens
tccatctcaaaacaaaac

SEQ ID NO: 1504334 - DNA, 18 bp, Homo sapiens
tccatctccgcctccaca

SEQ ID NO: 1504335 - DNA, 14 bp, Homo sapiens
tccatctcgccacc

SEQ ID NO: 1504336 - DNA, 16 bp, Homo sapiens
tccatctcgccacccc

SEQ ID NO: 1504337 - DNA, 14 bp, Homo sapiens
tccatctcttctgc

SEQ ID NO: 1504338 - DNA, 13 bp, Homo sapiens
tccatctgacaaa

SEQ ID NO: 1504339 - DNA, 19 bp, Homo sapiens
tccatcttgtggggccagg

SEQ ID NO: 1504340 - DNA, 15 bp, Homo sapiens
tccatctttatagaa

SEQ ID NO: 1504341 - DNA, 13 bp, Homo sapiens
tccatctttttct

SEQ ID NO: 1504342 - DNA, 19 bp, Homo sapiens
tccatgaatgttcctgcct

SEQ ID NO: 1504343 - DNA, 15 bp, Homo sapiens
tccatgactggctgt

SEQ ID NO: 1504344 - DNA, 22 bp, Homo sapiens
tccatgagggcaggcacatgtt

SEQ ID NO: 1504345 - DNA, 18 bp, Homo sapiens
tccatgaggtactggtcc

SEQ ID NO: 1504346 - DNA, 14 bp, Homo sapiens
tccatgatggaata

SEQ ID NO: 1504347 - DNA, 21 bp, Homo sapiens
tccatgcaactggagttcctt

SEQ ID NO: 1504348 - DNA, 14 bp, Homo sapiens
tccatgccccagct

SEQ ID NO: 1504349 - DNA, 16 bp, Homo sapiens
tccatgccccagctct

SEQ ID NO: 1504350 - DNA, 19 bp, Homo sapiens
tccatgccccagctctgga

SEQ ID NO: 1504351 - DNA, 14 bp, Homo sapiens
tccatgccccagga

SEQ ID NO: 1504352 - DNA, 14 bp, Homo sapiens
tccatgcctgaggg

SEQ ID NO: 1504353 - DNA, 15 bp, Homo sapiens
tccatgcctgagggt

SEQ ID NO: 1504354 - DNA, 20 bp, Homo sapiens
tccatgcctgtagctttcct

SEQ ID NO: 1504355 - DNA, 22 bp, Homo sapiens
tccatgcctgtagctttcctgg

SEQ ID NO: 1504356 - DNA, 23 bp, Homo sapiens
tccatgcctgtagctttcctggt

SEQ ID NO: 1504357 - DNA, 21 bp, Homo sapiens
tccatgccttaaacctacctc

SEQ ID NO: 1504358 - DNA, 16 bp, Homo sapiens
tccatgcgctcagggc

SEQ ID NO: 1504359 - DNA, 18 bp, Homo sapiens
tccatgcgtgtttctgac

SEQ ID NO: 1504360 - DNA, 22 bp, Homo sapiens
tccatgcgtgtttctgactctg

SEQ ID NO: 1504361 - DNA, 17 bp, Homo sapiens
tccatgctataaaaact

SEQ ID NO: 1504362 - DNA, 21 bp, Homo sapiens
tccatgctcctcacctgtcta

SEQ ID NO: 1504363 - DNA, 17 bp, Homo sapiens
tccatgctgcaaaggag

SEQ ID NO: 1504364 - DNA, 19 bp, Homo sapiens
tccatgcttagtcactgcc

SEQ ID NO: 1504365 - DNA, 13 bp, Homo sapiens
tccatggcaccag

SEQ ID NO: 1504366 - DNA, 14 bp, Homo sapiens
tccatggcaccagc

SEQ ID NO: 1504367 - DNA, 15 bp, Homo sapiens
tccatggcaccagcc

SEQ ID NO: 1504368 - DNA, 18 bp, Homo sapiens
tccatggcaccagccccc

SEQ ID NO: 1504369 - DNA, 14 bp, Homo sapiens
tccatggccacccc

SEQ ID NO: 1504370 - DNA, 19 bp, Homo sapiens
tccatgggagccagctgct

SEQ ID NO: 1504371 - DNA, 20 bp, Homo sapiens
tccatgggagccagctgctt

SEQ ID NO: 1504372 - DNA, 20 bp, Homo sapiens
tccatgggatggttagtgtg

SEQ ID NO: 1504373 - DNA, 21 bp, Homo sapiens
tccatggtactgtagcagggg

SEQ ID NO: 1504374 - DNA, 14 bp, Homo sapiens
tccatggtggaagg

SEQ ID NO: 1504375 - DNA, 17 bp, Homo sapiens
tccatgtacttgtttgc

SEQ ID NO: 1504376 - DNA, 12 bp, Homo sapiens
tccatgtgcctt

SEQ ID NO: 1504377 - DNA, 20 bp, Homo sapiens
taaaatttccttcaggtttt

SEQ ID NO: 1504378 - DNA, 13 bp, Homo sapiens
taaaatttgtaat

SEQ ID NO: 1504379 - DNA, 15 bp, Homo sapiens
taaaatttgtaatat

SEQ ID NO: 1504380 - DNA, 13 bp, Homo sapiens
taaaatttgttct

SEQ ID NO: 1504381 - DNA, 20 bp, Homo sapiens
taaaatttgttcttgtattt

SEQ ID NO: 1504382 - DNA, 17 bp, Homo sapiens
taaaattttaggcaagt

SEQ ID NO: 1504383 - DNA, 21 bp, Homo sapiens
taaacaaaagcaaagatgcat

SEQ ID NO: 1504384 - DNA, 13 bp, Homo sapiens
taaacaaatcttt

SEQ ID NO: 1504385 - DNA, 11 bp, Homo sapiens
taaacaaatga

SEQ ID NO: 1504386 - DNA, 19 bp, Homo sapiens
taaacaaattcatattctg

SEQ ID NO: 1504387 - DNA, 15 bp, Homo sapiens
taaacaacagctgaa

SEQ ID NO: 1504388 - DNA, 18 bp, Homo sapiens
taaacaacagctgaagca

SEQ ID NO: 1504389 - DNA, 18 bp, Homo sapiens
taaacaacgcattgccac

SEQ ID NO: 1504390 - DNA, 21 bp, Homo sapiens
taaacaacgtgtatagtgcct

SEQ ID NO: 1504391 - DNA, 15 bp, Homo sapiens
taaacaagattttaa

SEQ ID NO: 1504392 - DNA, 21 bp, Homo sapiens
taaacaagattttaaagacat

SEQ ID NO: 1504393 - DNA, 16 bp, Homo sapiens
taaacaatgaagtgaa

SEQ ID NO: 1504394 - DNA, 21 bp, Homo sapiens
taaacaatgctgatttggtga

SEQ ID NO: 1504395 - DNA, 16 bp, Homo sapiens
taaacaatgtaaagta

SEQ ID NO: 1504396 - DNA, 14 bp, Homo sapiens
taaacaatgtataa

SEQ ID NO: 1504397 - DNA, 17 bp, Homo sapiens
taaacaatgtataaaga

SEQ ID NO: 1504398 - DNA, 22 bp, Homo sapiens
taaacacacagatacacacaca

SEQ ID NO: 1504399 - DNA, 17 bp, Homo sapiens
taaacacaggctgtcct

SEQ ID NO: 1504400 - DNA, 19 bp, Homo sapiens
taaacacaggctgtcctta

SEQ ID NO: 1504401 - DNA, 14 bp, Homo sapiens
taaacacagggaaa

SEQ ID NO: 1504402 - DNA, 14 bp, Homo sapiens
taaacactcacctt

SEQ ID NO: 1504403 - DNA, 17 bp, Homo sapiens
taaacactgtaatctta

SEQ ID NO: 1504404 - DNA, 19 bp, Homo sapiens
taaacacttatcttctgga

SEQ ID NO: 1504405 - DNA, 20 bp, Homo sapiens
taaacacttatcttctggat

SEQ ID NO: 1504406 - DNA, 16 bp, Homo sapiens
taaacagatataaatg

SEQ ID NO: 1504407 - DNA, 15 bp, Homo sapiens
taaacagatttttac

SEQ ID NO: 1504408 - DNA, 23 bp, Homo sapiens
taaacaggtatttttttaaatca

SEQ ID NO: 1504409 - DNA, 21 bp, Homo sapiens
taaacagtatattctttggtt

SEQ ID NO: 1504410 - DNA, 20 bp, Homo sapiens
taaacagtgagcctgaattt

SEQ ID NO: 1504411 - DNA, 23 bp, Homo sapiens
taaacagtgagcctgaattttgt

SEQ ID NO: 1504412 - DNA, 17 bp, Homo sapiens
taaacagtgcctgctga

SEQ ID NO: 1504413 - DNA, 13 bp, Homo sapiens
taaacagtgtctt

SEQ ID NO: 1504414 - DNA, 14 bp, Homo sapiens
taaacagttatttc

SEQ ID NO: 1504415 - DNA, 16 bp, Homo sapiens
taaacagttatttctg

SEQ ID NO: 1504416 - DNA, 14 bp, Homo sapiens
taaacataaaaact

SEQ ID NO: 1504417 - DNA, 22 bp, Homo sapiens
taaacataaaaactgatttgct

SEQ ID NO: 1504418 - DNA, 13 bp, Homo sapiens
tcccaccccaccc

SEQ ID NO: 1504419 - DNA, 13 bp, Homo sapiens
tcccaccccactc

SEQ ID NO: 1504420 - DNA, 14 bp, Homo sapiens
tcccaccccactcc

SEQ ID NO: 1504421 - DNA, 17 bp, Homo sapiens
tcccaccccactccagc

SEQ ID NO: 1504422 - DNA, 21 bp, Homo sapiens
tcccaccccactccagccctg

SEQ ID NO: 1504423 - DNA, 23 bp, Homo sapiens
tcccacccccacccccagctcaa

SEQ ID NO: 1504424 - DNA, 21 bp, Homo sapiens
tcccaccccctcctcccccag

SEQ ID NO: 1504425 - DNA, 22 bp, Homo sapiens
tcccaccccctcctcccccagt

SEQ ID NO: 1504426 - DNA, 20 bp, Homo sapiens
tcccacccccttctctgctc

SEQ ID NO: 1504427 - DNA, 21 bp, Homo sapiens
tcccacccccttctctgctcc

SEQ ID NO: 1504428 - DNA, 18 bp, Homo sapiens
tcccaccccggcctccac

SEQ ID NO: 1504429 - DNA, 18 bp, Homo sapiens
tcccacccgatgctgctt

SEQ ID NO: 1504430 - DNA, 20 bp, Homo sapiens
tcccacccgatgctgctttc

SEQ ID NO: 1504431 - DNA, 14 bp, Homo sapiens
tcccacccggccac

SEQ ID NO: 1504432 - DNA, 16 bp, Homo sapiens
tcccacccggccacag

SEQ ID NO: 1504433 - DNA, 14 bp, Homo sapiens
tcccaccgccccca

SEQ ID NO: 1504434 - DNA, 17 bp, Homo sapiens
tcccaccgcccccaccc

SEQ ID NO: 1504435 - DNA, 16 bp, Homo sapiens
tcccacctactgcact

SEQ ID NO: 1504436 - DNA, 17 bp, Homo sapiens
tcccacctagtgcccca

SEQ ID NO: 1504437 - DNA, 22 bp, Homo sapiens
tcccacctagtgccccagactg

SEQ ID NO: 1504438 - DNA, 15 bp, Homo sapiens
tcccacctccatccc

SEQ ID NO: 1504439 - DNA, 13 bp, Homo sapiens
tcccacctccctt

SEQ ID NO: 1504440 - DNA, 15 bp, Homo sapiens
tcccacctcccttcc

SEQ ID NO: 1504441 - DNA, 23 bp, Homo sapiens
tcccacctgacacaccaggcgct

SEQ ID NO: 1504442 - DNA, 13 bp, Homo sapiens
tcccaccttccca

SEQ ID NO: 1504443 - DNA, 14 bp, Homo sapiens
tcccaccttggcct

SEQ ID NO: 1504444 - DNA, 13 bp, Homo sapiens
tcccactcaccag

SEQ ID NO: 1504445 - DNA, 21 bp, Homo sapiens
tcccactcagaactctccagg

SEQ ID NO: 1504446 - DNA, 14 bp, Homo sapiens
tcccactcccggcc

SEQ ID NO: 1504447 - DNA, 16 bp, Homo sapiens
tcccactcctgctgca

SEQ ID NO: 1504448 - DNA, 22 bp, Homo sapiens
tcccactcctgctgcacaggcc

SEQ ID NO: 1504449 - DNA, 14 bp, Homo sapiens
tcccactctttgaa

SEQ ID NO: 1504450 - DNA, 15 bp, Homo sapiens
tcccactctttgaat

SEQ ID NO: 1504451 - DNA, 17 bp, Homo sapiens
tcccactgcactccagc

SEQ ID NO: 1504452 - DNA, 20 bp, Homo sapiens
tcccactgcactccagcctg

SEQ ID NO: 1504453 - DNA, 18 bp, Homo sapiens
tcccactgtatgatttat

SEQ ID NO: 1504454 - DNA, 18 bp, Homo sapiens
tcccacttcactgtgagg

SEQ ID NO: 1504455 - DNA, 22 bp, Homo sapiens
tcccactttcatctaccttttc

SEQ ID NO: 1504456 - DNA, 23 bp, Homo sapiens
tcccagaaacatctctggcccag

SEQ ID NO: 1504457 - DNA, 23 bp, Homo sapiens
tcccagaactttgggaggccaag

SEQ ID NO: 1504458 - DNA, 17 bp, Homo sapiens
tcccagaatctctgagc

SEQ ID NO: 1504459 - DNA, 19 bp, Homo sapiens
tcccagacattgatgggga

SEQ ID NO: 1504460 - DNA, 16 bp, Homo sapiens
tcccagagacaggaaa

SEQ ID NO: 1504461 - DNA, 17 bp, Homo sapiens
tcccagagacaggaaaa

SEQ ID NO: 1504462 - DNA, 18 bp, Homo sapiens
tcccagagacaggaaaat

SEQ ID NO: 1504463 - DNA, 9 bp, Homo sapiens
tcccagagc

SEQ ID NO: 1504464 - DNA, 15 bp, Homo sapiens
tcccagagcacctca

SEQ ID NO: 1504465 - DNA, 11 bp, Homo sapiens
tcccagagccc

SEQ ID NO: 1504466 - DNA, 19 bp, Homo sapiens
tcccagagcttattggcca

SEQ ID NO: 1504467 - DNA, 21 bp, Homo sapiens
tcccagagcttattggccact

SEQ ID NO: 1504468 - DNA, 22 bp, Homo sapiens
tcccagagcttattggccactg

SEQ ID NO: 1504469 - DNA, 23 bp, Homo sapiens
tcccagagcttattggccactgg

SEQ ID NO: 1504470 - DNA, 16 bp, Homo sapiens
tcccagaggagcagct

SEQ ID NO: 1504471 - DNA, 21 bp, Homo sapiens
tcccagaggagccaccagttc

SEQ ID NO: 1504472 - DNA, 13 bp, Homo sapiens
tcccagaggcaga

SEQ ID NO: 1504473 - DNA, 22 bp, Homo sapiens
tcccagaggtgggatcctccct

SEQ ID NO: 1504474 - DNA, 19 bp, Homo sapiens
tcccagaggttatctgcct

SEQ ID NO: 1504475 - DNA, 21 bp, Homo sapiens
tcccagaggttatctgcctgg

SEQ ID NO: 1504476 - DNA, 19 bp, Homo sapiens
tcccagagtcagaggagaa

SEQ ID NO: 1504477 - DNA, 23 bp, Homo sapiens
tcccagatgccttctagattcac

SEQ ID NO: 1504478 - DNA, 15 bp, Homo sapiens
tcccagatgctgtca

SEQ ID NO: 1504479 - DNA, 18 bp, Homo sapiens
tcccagattggctcacac

SEQ ID NO: 1504480 - DNA, 16 bp, Homo sapiens
tcccagtctctggcag

SEQ ID NO: 1504481 - DNA, 20 bp, Homo sapiens
tcccagtgggagcttcccgg

SEQ ID NO: 1504482 - DNA, 17 bp, Homo sapiens
tcccagtgggaggggca

SEQ ID NO: 1504483 - DNA, 23 bp, Homo sapiens
tcccagttcaggagtcccaagga

SEQ ID NO: 1504484 - DNA, 17 bp, Homo sapiens
tcccatagccaggaaac

SEQ ID NO: 1504485 - DNA, 15 bp, Homo sapiens
tcccatatcctgcct

SEQ ID NO: 1504486 - DNA, 18 bp, Homo sapiens
tcccatatcctgcctcag

SEQ ID NO: 1504487 - DNA, 14 bp, Homo sapiens
tcccatcaaaactc

SEQ ID NO: 1504488 - DNA, 15 bp, Homo sapiens
tcccatcatcctttg

SEQ ID NO: 1504489 - DNA, 15 bp, Homo sapiens
tcccatccaggcagt

SEQ ID NO: 1504490 - DNA, 15 bp, Homo sapiens
tcccatccccctgcc

SEQ ID NO: 1504491 - DNA, 16 bp, Homo sapiens
tcccatccccctgccc

SEQ ID NO: 1504492 - DNA, 14 bp, Homo sapiens
tcccatcctaccct

SEQ ID NO: 1504493 - DNA, 20 bp, Homo sapiens
tcccatcgtctcggccttca

SEQ ID NO: 1504494 - DNA, 16 bp, Homo sapiens
tcccatctccttcccc

SEQ ID NO: 1504495 - DNA, 21 bp, Homo sapiens
tcccatctccttcccccagcc

SEQ ID NO: 1504496 - DNA, 14 bp, Homo sapiens
tcccatctcttcct

SEQ ID NO: 1504497 - DNA, 13 bp, Homo sapiens
tcccatctggctc

SEQ ID NO: 1504498 - DNA, 14 bp, Homo sapiens
tcccatctggctca

SEQ ID NO: 1504499 - DNA, 13 bp, Homo sapiens
tcccatctggctt

SEQ ID NO: 1504500 - DNA, 13 bp, Homo sapiens
tcccatctgggag

SEQ ID NO: 1504501 - DNA, 19 bp, Homo sapiens
tcccatctgggagtcccct

SEQ ID NO: 1504502 - DNA, 23 bp, Homo sapiens
tcccatctgggagtccccttttc

SEQ ID NO: 1504503 - DNA, 15 bp, Homo sapiens
tcccatcttccaagg

SEQ ID NO: 1504504 - DNA, 17 bp, Homo sapiens
tcccatgaacacactgt

SEQ ID NO: 1504505 - DNA, 18 bp, Homo sapiens
tcccatgacccacccctg

SEQ ID NO: 1504506 - DNA, 12 bp, Homo sapiens
tcccatgctcca

SEQ ID NO: 1504507 - DNA, 14 bp, Homo sapiens
tcccatggctgaag

SEQ ID NO: 1504508 - DNA, 15 bp, Homo sapiens
tcccatggctgaagc

SEQ ID NO: 1504509 - DNA, 17 bp, Homo sapiens
tcccatggctgaagctg

SEQ ID NO: 1504510 - DNA, 22 bp, Homo sapiens
tcccatggctgaagctggagca

SEQ ID NO: 1504511 - DNA, 14 bp, Homo sapiens
tcccatggggaggg

SEQ ID NO: 1504512 - DNA, 21 bp, Homo sapiens
tcccatgggggcacttgagtt

SEQ ID NO: 1504513 - DNA, 22 bp, Homo sapiens
tcccatgggggcacttgagttt

SEQ ID NO: 1504514 - DNA, 15 bp, Homo sapiens
tcccatgtagccccc

SEQ ID NO: 1504515 - DNA, 12 bp, Homo sapiens
tcccatgtattt

SEQ ID NO: 1504516 - DNA, 15 bp, Homo sapiens
tcccatgtcacctca

SEQ ID NO: 1504517 - DNA, 21 bp, Homo sapiens
tcccattaggacaatcagtcc

SEQ ID NO: 1504518 - DNA, 15 bp, Homo sapiens
tcccattattatttc

SEQ ID NO: 1504519 - DNA, 17 bp, Homo sapiens
tcccattattatttctg

SEQ ID NO: 1504520 - DNA, 19 bp, Homo sapiens
tcccattattatttctgtt

SEQ ID NO: 1504521 - DNA, 21 bp, Homo sapiens
tcccattattatttctgttct

SEQ ID NO: 1504522 - DNA, 22 bp, Homo sapiens
tcccattattatttctgttctt

SEQ ID NO: 1504523 - DNA, 11 bp, Homo sapiens
tcccattccag

SEQ ID NO: 1504524 - DNA, 14 bp, Homo sapiens
tcccattccaggca

SEQ ID NO: 1504525 - DNA, 13 bp, Homo sapiens
tcccattcctgaa

SEQ ID NO: 1504526 - DNA, 15 bp, Homo sapiens
tcccattcctgaaga

SEQ ID NO: 1504527 - DNA, 12 bp, Homo sapiens
tcccattctaga

SEQ ID NO: 1504528 - DNA, 21 bp, Homo sapiens
tcccattctagatcctgcacc

SEQ ID NO: 1504529 - DNA, 12 bp, Homo sapiens
tcccatttcctt

SEQ ID NO: 1504530 - DNA, 14 bp, Homo sapiens
tcccatttccttgg

SEQ ID NO: 1504531 - DNA, 20 bp, Homo sapiens
tcccatttccttggaggcca

SEQ ID NO: 1504532 - DNA, 14 bp, Homo sapiens
tcccatttcttccc

SEQ ID NO: 1504533 - DNA, 18 bp, Homo sapiens
tcccattttggaagtttt

SEQ ID NO: 1504534 - DNA, 19 bp, Homo sapiens
tcccattttggaagttttc

SEQ ID NO: 1504535 - DNA, 17 bp, Homo sapiens
tccccaaagccactgga

SEQ ID NO: 1504536 - DNA, 21 bp, Homo sapiens
tccccaaagccactggaagga

SEQ ID NO: 1504537 - DNA, 14 bp, Homo sapiens
tccccaaagggtgt

SEQ ID NO: 1504538 - DNA, 16 bp, Homo sapiens
tccccaacgtcccctc

SEQ ID NO: 1504539 - DNA, 13 bp, Homo sapiens
tccccaactccat

SEQ ID NO: 1504540 - DNA, 17 bp, Homo sapiens
tccccaggtctctccac

SEQ ID NO: 1504541 - DNA, 10 bp, Homo sapiens
tccccagtgc

SEQ ID NO: 1504542 - DNA, 17 bp, Homo sapiens
tccccagtgcctgccac

SEQ ID NO: 1504543 - DNA, 21 bp, Homo sapiens
tccccagtgcctgccactctc

SEQ ID NO: 1504544 - DNA, 19 bp, Homo sapiens
tccccataagacaaacact

SEQ ID NO: 1504545 - DNA, 15 bp, Homo sapiens
tccccatatccaagt

SEQ ID NO: 1504546 - DNA, 15 bp, Homo sapiens
tccccatctccctgc

SEQ ID NO: 1504547 - DNA, 19 bp, Homo sapiens
tccccatctccctgcctgg

SEQ ID NO: 1504548 - DNA, 20 bp, Homo sapiens
tccccatctttgatccttct

SEQ ID NO: 1504549 - DNA, 16 bp, Homo sapiens
tccccatggagccagc

SEQ ID NO: 1504550 - DNA, 20 bp, Homo sapiens
tccccatgtgcctgcaccag

SEQ ID NO: 1504551 - DNA, 17 bp, Homo sapiens
tccccattcacagagcc

SEQ ID NO: 1504552 - DNA, 19 bp, Homo sapiens
tccccattcagacacttca

SEQ ID NO: 1504553 - DNA, 18 bp, Homo sapiens
tccccatttcccatctgc

SEQ ID NO: 1504554 - DNA, 19 bp, Homo sapiens
tcccccaaaccctgcttct

SEQ ID NO: 1504555 - DNA, 20 bp, Homo sapiens
tcccccaaaccctgcttctg

SEQ ID NO: 1504556 - DNA, 12 bp, Homo sapiens
tcccccaaagtt

SEQ ID NO: 1504557 - DNA, 14 bp, Homo sapiens
tcccccaaccccca

SEQ ID NO: 1504558 - DNA, 17 bp, Homo sapiens
tcccccaacccccaccc

SEQ ID NO: 1504559 - DNA, 21 bp, Homo sapiens
tcccccaacccccaccccaca

SEQ ID NO: 1504560 - DNA, 19 bp, Homo sapiens
tcccccaccccctccccag

SEQ ID NO: 1504561 - DNA, 20 bp, Homo sapiens
tcccccaccccctccccagg

SEQ ID NO: 1504562 - DNA, 18 bp, Homo sapiens
tcccccacccctccacgt

SEQ ID NO: 1504563 - DNA, 12 bp, Homo sapiens
tcccccacctga

SEQ ID NO: 1504564 - DNA, 15 bp, Homo sapiens
tcccccacctgacaa

SEQ ID NO: 1504565 - DNA, 22 bp, Homo sapiens
tcccccacctgacaatggcagc

SEQ ID NO: 1504566 - DNA, 14 bp, Homo sapiens
tcccccactgccac

SEQ ID NO: 1504567 - DNA, 15 bp, Homo sapiens
tcccccactgccaca

SEQ ID NO: 1504568 - DNA, 13 bp, Homo sapiens
tcccccagcaagc

SEQ ID NO: 1504569 - DNA, 12 bp, Homo sapiens
tcccccagcaga

SEQ ID NO: 1504570 - DNA, 23 bp, Homo sapiens
tcccccagcagaatggaggcagg

SEQ ID NO: 1504571 - DNA, 11 bp, Homo sapiens
tcccccagcca

SEQ ID NO: 1504572 - DNA, 12 bp, Homo sapiens
tcccccagccag

SEQ ID NO: 1504573 - DNA, 13 bp, Homo sapiens
tcccccagccagg

SEQ ID NO: 1504574 - DNA, 11 bp, Homo sapiens
tcccccagccc

SEQ ID NO: 1504575 - DNA, 15 bp, Homo sapiens
tcccccagcccaata

SEQ ID NO: 1504576 - DNA, 12 bp, Homo sapiens
tcccccagcctc

SEQ ID NO: 1504577 - DNA, 18 bp, Homo sapiens
tcccccagctctggtgag

SEQ ID NO: 1504578 - DNA, 14 bp, Homo sapiens
tcccccagtacctc

SEQ ID NO: 1504579 - DNA, 14 bp, Homo sapiens
tcccccatgtggct

SEQ ID NO: 1504580 - DNA, 15 bp, Homo sapiens
tcccccatgtggctg

SEQ ID NO: 1504581 - DNA, 21 bp, Homo sapiens
tccccccactctccccacact

SEQ ID NO: 1504582 - DNA, 12 bp, Homo sapiens
tccccccactgc

SEQ ID NO: 1504583 - DNA, 12 bp, Homo sapiens
tccccccagact

SEQ ID NO: 1504584 - DNA, 13 bp, Homo sapiens
tccccccagactc

SEQ ID NO: 1504585 - DNA, 14 bp, Homo sapiens
tcccccccagtgca

SEQ ID NO: 1504586 - DNA, 17 bp, Homo sapiens
tcccccccatgcactgt

SEQ ID NO: 1504587 - DNA, 19 bp, Homo sapiens
tccccccgagtctccggga

SEQ ID NO: 1504588 - DNA, 14 bp, Homo sapiens
tcccccctgctgcc

SEQ ID NO: 1504589 - DNA, 15 bp, Homo sapiens
tcccccctgctgccc

SEQ ID NO: 1504590 - DNA, 20 bp, Homo sapiens
tcccccctgctgcccagtgc

SEQ ID NO: 1504591 - DNA, 17 bp, Homo sapiens
tcccccgacactgctgc

SEQ ID NO: 1504592 - DNA, 22 bp, Homo sapiens
tcccccgcaggttatgtcagca

SEQ ID NO: 1504593 - DNA, 15 bp, Homo sapiens
tcccccgccagcccc

SEQ ID NO: 1504594 - DNA, 19 bp, Homo sapiens
tcccccggctgggcctcct

SEQ ID NO: 1504595 - DNA, 16 bp, Homo sapiens
tccccctcagcaagcc

SEQ ID NO: 1504596 - DNA, 18 bp, Homo sapiens
tccctccaccagcctgct

SEQ ID NO: 1504597 - DNA, 22 bp, Homo sapiens
tccctccaccagcctgctgaca

SEQ ID NO: 1504598 - DNA, 14 bp, Homo sapiens
tccctccaccccac

SEQ ID NO: 1504599 - DNA, 18 bp, Homo sapiens
tccctccactccatccct

SEQ ID NO: 1504600 - DNA, 21 bp, Homo sapiens
tccctccagtattgccccctc

SEQ ID NO: 1504601 - DNA, 13 bp, Homo sapiens
tccctccatccca

SEQ ID NO: 1504602 - DNA, 16 bp, Homo sapiens
tccctccattcatcct

SEQ ID NO: 1504603 - DNA, 22 bp, Homo sapiens
tccctcccaaggagccattctg

SEQ ID NO: 1504604 - DNA, 17 bp, Homo sapiens
tccctccccctccttgt

SEQ ID NO: 1504605 - DNA, 14 bp, Homo sapiens
tccctcccccttgt

SEQ ID NO: 1504606 - DNA, 21 bp, Homo sapiens
tccctcccctctcagaacata

SEQ ID NO: 1504607 - DNA, 19 bp, Homo sapiens
tccctcccctgccctggtc

SEQ ID NO: 1504608 - DNA, 16 bp, Homo sapiens
tccctcctcacctctg

SEQ ID NO: 1504609 - DNA, 17 bp, Homo sapiens
tccctcctcacctctgg

SEQ ID NO: 1504610 - DNA, 12 bp, Homo sapiens
tccctcctccca

SEQ ID NO: 1504611 - DNA, 13 bp, Homo sapiens
tccctcctcccat

SEQ ID NO: 1504612 - DNA, 14 bp, Homo sapiens
tccctcctcccatc

SEQ ID NO: 1504613 - DNA, 13 bp, Homo sapiens
tccctcctgagct

SEQ ID NO: 1504614 - DNA, 13 bp, Homo sapiens
tccctcctgcagg

SEQ ID NO: 1504615 - DNA, 14 bp, Homo sapiens
tccctcctgcaggc

SEQ ID NO: 1504616 - DNA, 17 bp, Homo sapiens
tccctcgccctgtgagg

SEQ ID NO: 1504617 - DNA, 14 bp, Homo sapiens
tccctcgctgtatg

SEQ ID NO: 1504618 - DNA, 14 bp, Homo sapiens
tccctcggaagccg

SEQ ID NO: 1504619 - DNA, 15 bp, Homo sapiens
tccctcggacccacc

SEQ ID NO: 1504620 - DNA, 18 bp, Homo sapiens
tccctcgggaagcagcca

SEQ ID NO: 1504621 - DNA, 24 bp, Homo sapiens
tccctcgtccgtctgtctcgatgc

SEQ ID NO: 1504622 - DNA, 19 bp, Homo sapiens
tccctcgtcttcagctgca

SEQ ID NO: 1504623 - DNA, 16 bp, Homo sapiens
tccctctaacccagtg

SEQ ID NO: 1504624 - DNA, 17 bp, Homo sapiens
tccctctaacccagtgg

SEQ ID NO: 1504625 - DNA, 16 bp, Homo sapiens
tccctctcactcccca

SEQ ID NO: 1504626 - DNA, 16 bp, Homo sapiens
tccctctcagtgcctt

SEQ ID NO: 1504627 - DNA, 16 bp, Homo sapiens
tccctctccctctctc

SEQ ID NO: 1504628 - DNA, 19 bp, Homo sapiens
tccctctccctctctctgg

SEQ ID NO: 1504629 - DNA, 12 bp, Homo sapiens
tccctctccctg

SEQ ID NO: 1504630 - DNA, 14 bp, Homo sapiens
tccctctcctgcct

SEQ ID NO: 1504631 - DNA, 22 bp, Homo sapiens
tccctctcggaaggctggctgg

SEQ ID NO: 1504632 - DNA, 23 bp, Homo sapiens
tccctctcggaaggctggctggg

SEQ ID NO: 1504633 - DNA, 15 bp, Homo sapiens
tccctctctcactcc

SEQ ID NO: 1504634 - DNA, 16 bp, Homo sapiens
tccctctctcataccc

SEQ ID NO: 1504635 - DNA, 19 bp, Homo sapiens
tccctctctcttctgctcc

SEQ ID NO: 1504636 - DNA, 21 bp, Homo sapiens
tccctctctcttctgctccac

SEQ ID NO: 1504637 - DNA, 15 bp, Homo sapiens
tccctctctggtttc

SEQ ID NO: 1504638 - DNA, 19 bp, Homo sapiens
tccctctcttccccttccc

SEQ ID NO: 1504639 - DNA, 17 bp, Homo sapiens
tccctctcttggctatt

SEQ ID NO: 1504640 - DNA, 16 bp, Homo sapiens
tccctctgccccaagc

SEQ ID NO: 1504641 - DNA, 14 bp, Homo sapiens
tccctctggcttcc

SEQ ID NO: 1504642 - DNA, 18 bp, Homo sapiens
tccctctgggccaatgct

SEQ ID NO: 1504643 - DNA, 18 bp, Homo sapiens
tccctctgggcctgttct

SEQ ID NO: 1504644 - DNA, 16 bp, Homo sapiens
tcctgagctgtcgctg

SEQ ID NO: 1504645 - DNA, 19 bp, Homo sapiens
tcctgagctgtcgctgcct

SEQ ID NO: 1504646 - DNA, 20 bp, Homo sapiens
tcctgagctgtcgctgcctc

SEQ ID NO: 1504647 - DNA, 15 bp, Homo sapiens
tcctgaggggcatct

SEQ ID NO: 1504648 - DNA, 18 bp, Homo sapiens
tcctgagggttttctcat

SEQ ID NO: 1504649 - DNA, 18 bp, Homo sapiens
tcctgataaacattaaac

SEQ ID NO: 1504650 - DNA, 18 bp, Homo sapiens
tcctgataataattgatc

SEQ ID NO: 1504651 - DNA, 17 bp, Homo sapiens
tcctgatagtcacctgc

SEQ ID NO: 1504652 - DNA, 17 bp, Homo sapiens
tcctgatgacccaggct

SEQ ID NO: 1504653 - DNA, 13 bp, Homo sapiens
tcctgatggccaa

SEQ ID NO: 1504654 - DNA, 21 bp, Homo sapiens
tcctgattattgaatgttata

SEQ ID NO: 1504655 - DNA, 19 bp, Homo sapiens
tcctgatttctctgaacag

SEQ ID NO: 1504656 - DNA, 19 bp, Homo sapiens
tcctgcaaaattttatagc

SEQ ID NO: 1504657 - DNA, 18 bp, Homo sapiens
tcctgcaactcaaggact

SEQ ID NO: 1504658 - DNA, 15 bp, Homo sapiens
tcctgcacacagaat

SEQ ID NO: 1504659 - DNA, 13 bp, Homo sapiens
tcctgcaccccag

SEQ ID NO: 1504660 - DNA, 15 bp, Homo sapiens
tcctgcaccccagca

SEQ ID NO: 1504661 - DNA, 20 bp, Homo sapiens
tcctgcaccccagcattcca

SEQ ID NO: 1504662 - DNA, 23 bp, Homo sapiens
tcctgcaccccagcattccagct

SEQ ID NO: 1504663 - DNA, 16 bp, Homo sapiens
tcctgcacgaagtggc

SEQ ID NO: 1504664 - DNA, 23 bp, Homo sapiens
tcctgcagaaagggccacccatg

SEQ ID NO: 1504665 - DNA, 17 bp, Homo sapiens
tcctgcagaccacgccc

SEQ ID NO: 1504666 - DNA, 22 bp, Homo sapiens
tcctgcagcaaacactccaccc

SEQ ID NO: 1504667 - DNA, 12 bp, Homo sapiens
tcctgcagcctc

SEQ ID NO: 1504668 - DNA, 16 bp, Homo sapiens
tcctgcagcctcctcc

SEQ ID NO: 1504669 - DNA, 22 bp, Homo sapiens
tcctgcagcctcctcctgacca

SEQ ID NO: 1504670 - DNA, 17 bp, Homo sapiens
tcctgcaggcaggaaca

SEQ ID NO: 1504671 - DNA, 15 bp, Homo sapiens
tcctgcagggcttct

SEQ ID NO: 1504672 - DNA, 18 bp, Homo sapiens
tcctgcagtagaaggtgc

SEQ ID NO: 1504673 - DNA, 14 bp, Homo sapiens
tcctgcatctctgt

SEQ ID NO: 1504674 - DNA, 15 bp, Homo sapiens
tcctgcatggtaggg

SEQ ID NO: 1504675 - DNA, 11 bp, Homo sapiens
tcctgcatgtt

SEQ ID NO: 1504676 - DNA, 14 bp, Homo sapiens
tcctgcatgttctg

SEQ ID NO: 1504677 - DNA, 20 bp, Homo sapiens
tcctgccagctgccttcctc

SEQ ID NO: 1504678 - DNA, 18 bp, Homo sapiens
tcctgcccaggagagcca

SEQ ID NO: 1504679 - DNA, 22 bp, Homo sapiens
tcctgcccaggagagccagccc

SEQ ID NO: 1504680 - DNA, 23 bp, Homo sapiens
tcctgcccaggagagccagccct

SEQ ID NO: 1504681 - DNA, 16 bp, Homo sapiens
tcctgcccaggagcag

SEQ ID NO: 1504682 - DNA, 19 bp, Homo sapiens
tcctgcccagtgttgtttg

SEQ ID NO: 1504683 - DNA, 22 bp, Homo sapiens
tcctgcccagtgttgtttgtaa

SEQ ID NO: 1504684 - DNA, 18 bp, Homo sapiens
tcctgccccaagggccca

SEQ ID NO: 1504685 - DNA, 22 bp, Homo sapiens
tcctgccccaagggcccagacc

SEQ ID NO: 1504686 - DNA, 15 bp, Homo sapiens
tcctgccccaggcct

SEQ ID NO: 1504687 - DNA, 11 bp, Homo sapiens
tcctgccctgc

SEQ ID NO: 1504688 - DNA, 14 bp, Homo sapiens
tcctgccctgcccc

SEQ ID NO: 1504689 - DNA, 12 bp, Homo sapiens
tcctgccctgtt

SEQ ID NO: 1504690 - DNA, 15 bp, Homo sapiens
tcctgcccttcctca

SEQ ID NO: 1504691 - DNA, 17 bp, Homo sapiens
tcctgcccttcctcagt

SEQ ID NO: 1504692 - DNA, 23 bp, Homo sapiens
tcctgcccttgaaccccctccct

SEQ ID NO: 1504693 - DNA, 20 bp, Homo sapiens
tcctgccgcagacgggcaca

SEQ ID NO: 1504694 - DNA, 21 bp, Homo sapiens
tcctgccgcagacgggcacag

SEQ ID NO: 1504695 - DNA, 22 bp, Homo sapiens
tcctgccgcagacgggcacaga

SEQ ID NO: 1504696 - DNA, 16 bp, Homo sapiens
tcctgccggtgggacc

SEQ ID NO: 1504697 - DNA, 13 bp, Homo sapiens
tcctgcctaaggt

SEQ ID NO: 1504698 - DNA, 16 bp, Homo sapiens
tcctgcctcagcctcc

SEQ ID NO: 1504699 - DNA, 19 bp, Homo sapiens
tcctgcctcagcctccaga

SEQ ID NO: 1504700 - DNA, 21 bp, Homo sapiens
tcctgcctccttgatatttgt

SEQ ID NO: 1504701 - DNA, 20 bp, Homo sapiens
tcctgcctgcccctctcccg

SEQ ID NO: 1504702 - DNA, 21 bp, Homo sapiens
tcctgcctggtcctccctccc

SEQ ID NO: 1504703 - DNA, 13 bp, Homo sapiens
tcctgcctgtggc

SEQ ID NO: 1504704 - DNA, 14 bp, Homo sapiens
tcctgcctgtggcg

SEQ ID NO: 1504705 - DNA, 19 bp, Homo sapiens
tcctgccttggcctcccaa

SEQ ID NO: 1504706 - DNA, 21 bp, Homo sapiens
tcctgccttggcctcccaagt

SEQ ID NO: 1504707 - DNA, 19 bp, Homo sapiens
tcctgcggagtgaagaggg

SEQ ID NO: 1504708 - DNA, 13 bp, Homo sapiens
tcctgcgtcctcc

SEQ ID NO: 1504709 - DNA, 14 bp, Homo sapiens
tcctgcgtcctcct

SEQ ID NO: 1504710 - DNA, 21 bp, Homo sapiens
tcctgcgtcctcctcacctca

SEQ ID NO: 1504711 - DNA, 17 bp, Homo sapiens
tcctgctacttccccag

SEQ ID NO: 1504712 - DNA, 21 bp, Homo sapiens
tcctgctacttccccagctct

SEQ ID NO: 1504713 - DNA, 22 bp, Homo sapiens
tcctgctagctgtagaaatgta

SEQ ID NO: 1504714 - DNA, 16 bp, Homo sapiens
tcctgctcacctgtgt

SEQ ID NO: 1504715 - DNA, 15 bp, Homo sapiens
tcctgctcatattgt

SEQ ID NO: 1504716 - DNA, 13 bp, Homo sapiens
tcctgctccagca

SEQ ID NO: 1504717 - DNA, 15 bp, Homo sapiens
tcctgctccagcagc

SEQ ID NO: 1504718 - DNA, 20 bp, Homo sapiens
tcctgctccagcagcacacc

SEQ ID NO: 1504719 - DNA, 21 bp, Homo sapiens
tcctgctccagcagcacacct

SEQ ID NO: 1504720 - DNA, 23 bp, Homo sapiens
tcctgctccatgactggctgtct

SEQ ID NO: 1504721 - DNA, 14 bp, Homo sapiens
tcctgctccgctgc

SEQ ID NO: 1504722 - DNA, 15 bp, Homo sapiens
tcctgctccgctgcc

SEQ ID NO: 1504723 - DNA, 17 bp, Homo sapiens
tcctgctccgctgcctg

SEQ ID NO: 1504724 - DNA, 15 bp, Homo sapiens
tcctgctcctcaccc

SEQ ID NO: 1504725 - DNA, 18 bp, Homo sapiens
tcctgctcctcacccctg

SEQ ID NO: 1504726 - DNA, 22 bp, Homo sapiens
tcctgctcctcacccctgtagg

SEQ ID NO: 1504727 - DNA, 20 bp, Homo sapiens
tcctgctcctccctgccccc

SEQ ID NO: 1504728 - DNA, 16 bp, Homo sapiens
tcctgctctcttcagg

SEQ ID NO: 1504729 - DNA, 14 bp, Homo sapiens
tcctgctctgggac

SEQ ID NO: 1504730 - DNA, 17 bp, Homo sapiens
tcctgctcttttgtgat

SEQ ID NO: 1504731 - DNA, 13 bp, Homo sapiens
tcctgctgacctc

SEQ ID NO: 1504732 - DNA, 23 bp, Homo sapiens
tcctgctgactatttgaccccca

SEQ ID NO: 1504733 - DNA, 12 bp, Homo sapiens
tcctgctgcacc

SEQ ID NO: 1504734 - DNA, 15 bp, Homo sapiens
tcctgctgcaccctg

SEQ ID NO: 1504735 - DNA, 23 bp, Homo sapiens
tcctgctgcaccctgcgcctcca

SEQ ID NO: 1504736 - DNA, 20 bp, Homo sapiens
tcctgctgccctcccacagc

SEQ ID NO: 1504737 - DNA, 20 bp, Homo sapiens
tcctgctgccttttctggag

SEQ ID NO: 1504738 - DNA, 19 bp, Homo sapiens
tcctgctgctggggccagc

SEQ ID NO: 1504739 - DNA, 21 bp, Homo sapiens
tcctgctgctgtaactgctga

SEQ ID NO: 1504740 - DNA, 23 bp, Homo sapiens
tcctgctgctgtaactgctgagc

SEQ ID NO: 1504741 - DNA, 24 bp, Homo sapiens
tcctgctgctgtaactgctgagcc

SEQ ID NO: 1504742 - DNA, 23 bp, Homo sapiens
tcctgctggtacctgccctctat

SEQ ID NO: 1504743 - DNA, 15 bp, Homo sapiens
tcctgctgtatttcc

SEQ ID NO: 1504744 - DNA, 17 bp, Homo sapiens
tcctgctgtatttcctg

SEQ ID NO: 1504745 - DNA, 15 bp, Homo sapiens
tcctgctgtcctggt

SEQ ID NO: 1504746 - DNA, 17 bp, Homo sapiens
tcctgctgtcctggtgg

SEQ ID NO: 1504747 - DNA, 10 bp, Homo sapiens
tcctgctgtg

SEQ ID NO: 1504748 - DNA, 13 bp, Homo sapiens
tcctgctgtgctg

SEQ ID NO: 1504749 - DNA, 12 bp, Homo sapiens
tcctgcttgcca

SEQ ID NO: 1504750 - DNA, 17 bp, Homo sapiens
tcctgcttgccaaggca

SEQ ID NO: 1504751 - DNA, 21 bp, Homo sapiens
tcctgcttttctgtcctgggc

SEQ ID NO: 1504752 - DNA, 16 bp, Homo sapiens
tcctggaaaagaagaa

SEQ ID NO: 1504753 - DNA, 23 bp, Homo sapiens
tcctggaaaattctatggaatag

SEQ ID NO: 1504754 - DNA, 15 bp, Homo sapiens
tcctggaaatattaa

SEQ ID NO: 1504755 - DNA, 15 bp, Homo sapiens
tcctggaagcagagc

SEQ ID NO: 1504756 - DNA, 20 bp, Homo sapiens
tcctggaagcaggtgctaca

SEQ ID NO: 1504757 - DNA, 15 bp, Homo sapiens
tcctggaaggacaca

SEQ ID NO: 1504758 - DNA, 16 bp, Homo sapiens
tcctggaaggacacag

SEQ ID NO: 1504759 - DNA, 23 bp, Homo sapiens
tcctggaaggacacagtgatgaa

SEQ ID NO: 1504760 - DNA, 14 bp, Homo sapiens
tcccctctgctgct

SEQ ID NO: 1504761 - DNA, 19 bp, Homo sapiens
tcccctctgtcatcactcc

SEQ ID NO: 1504762 - DNA, 15 bp, Homo sapiens
tcccctctgtgcttc

SEQ ID NO: 1504763 - DNA, 17 bp, Homo sapiens
tcccctcttcccttcaa

SEQ ID NO: 1504764 - DNA, 15 bp, Homo sapiens
tcccctgcactgtaa

SEQ ID NO: 1504765 - DNA, 17 bp, Homo sapiens
tcccctgcactgtaaaa

SEQ ID NO: 1504766 - DNA, 19 bp, Homo sapiens
tcccctgcactgtaaaatg

SEQ ID NO: 1504767 - DNA, 22 bp, Homo sapiens
tcccctgcactgtaaaatgtgg

SEQ ID NO: 1504768 - DNA, 19 bp, Homo sapiens
tcccctgccaccaggccac

SEQ ID NO: 1504769 - DNA, 13 bp, Homo sapiens
tcccctgccattt

SEQ ID NO: 1504770 - DNA, 14 bp, Homo sapiens
tcccctgcccccag

SEQ ID NO: 1504771 - DNA, 20 bp, Homo sapiens
tcccctgcccccaggactgg

SEQ ID NO: 1504772 - DNA, 19 bp, Homo sapiens
tcccctgccccttccttta

SEQ ID NO: 1504773 - DNA, 15 bp, Homo sapiens
tcccctgccctggtc

SEQ ID NO: 1504774 - DNA, 13 bp, Homo sapiens
tcccctgcccttc

SEQ ID NO: 1504775 - DNA, 20 bp, Homo sapiens
tcccctgcccttcctcctga

SEQ ID NO: 1504776 - DNA, 23 bp, Homo sapiens
tcccctgccggtgcacaggcctc

SEQ ID NO: 1504777 - DNA, 14 bp, Homo sapiens
tcccctgctcccag

SEQ ID NO: 1504778 - DNA, 14 bp, Homo sapiens
tcccctgctgaggc

SEQ ID NO: 1504779 - DNA, 18 bp, Homo sapiens
tcccctggagccagcagg

SEQ ID NO: 1504780 - DNA, 21 bp, Homo sapiens
tcccctggagccagcagggct

SEQ ID NO: 1504781 - DNA, 11 bp, Homo sapiens
tcccctggcag

SEQ ID NO: 1504782 - DNA, 19 bp, Homo sapiens
tcccctggcctcagttccc

SEQ ID NO: 1504783 - DNA, 22 bp, Homo sapiens
tcccctgggcatcttctggctt

SEQ ID NO: 1504784 - DNA, 20 bp, Homo sapiens
tcccctgggttaacaaatga

SEQ ID NO: 1504785 - DNA, 22 bp, Homo sapiens
tcccctgggttaacaaatgagc

SEQ ID NO: 1504786 - DNA, 14 bp, Homo sapiens
tcccctgtcccacc

SEQ ID NO: 1504787 - DNA, 17 bp, Homo sapiens
tcccctgtcccaccaac

SEQ ID NO: 1504788 - DNA, 18 bp, Homo sapiens
tcccctgtcccaccaact

SEQ ID NO: 1504789 - DNA, 12 bp, Homo sapiens
tcccctgtgggg

SEQ ID NO: 1504790 - DNA, 20 bp, Homo sapiens
tcccctgtggggatctcagg

SEQ ID NO: 1504791 - DNA, 17 bp, Homo sapiens
tccccttatctttctaa

SEQ ID NO: 1504792 - DNA, 11 bp, Homo sapiens
tccccttccct

SEQ ID NO: 1504793 - DNA, 13 bp, Homo sapiens
tccccttccctta

SEQ ID NO: 1504794 - DNA, 11 bp, Homo sapiens
tccccttcctg

SEQ ID NO: 1504795 - DNA, 16 bp, Homo sapiens
tccccttcctgtttca

SEQ ID NO: 1504796 - DNA, 18 bp, Homo sapiens
tccccttcgctgaaattg

SEQ ID NO: 1504797 - DNA, 23 bp, Homo sapiens
tccccttgatttaaacacacaga

SEQ ID NO: 1504798 - DNA, 17 bp, Homo sapiens
tccccttgcccagggct

SEQ ID NO: 1504799 - DNA, 22 bp, Homo sapiens
tccccttgcccagggctcagcc

SEQ ID NO: 1504800 - DNA, 16 bp, Homo sapiens
tccccttggcttcctc

SEQ ID NO: 1504801 - DNA, 20 bp, Homo sapiens
tcccctttactcagcccagc

SEQ ID NO: 1504802 - DNA, 22 bp, Homo sapiens
tcccctttactcagcccagctg

SEQ ID NO: 1504803 - DNA, 14 bp, Homo sapiens
tcccctttcctcta

SEQ ID NO: 1504804 - DNA, 13 bp, Homo sapiens
tcccctttcctgt

SEQ ID NO: 1504805 - DNA, 17 bp, Homo sapiens
tcccctttcctgtccca

SEQ ID NO: 1504806 - DNA, 17 bp, Homo sapiens
tcccctttgattcacag

SEQ ID NO: 1504807 - DNA, 13 bp, Homo sapiens
tcccctttgcact

SEQ ID NO: 1504808 - DNA, 19 bp, Homo sapiens
tcccctttgcactgtaatg

SEQ ID NO: 1504809 - DNA, 20 bp, Homo sapiens
tcccctttgcactgtaatga

SEQ ID NO: 1504810 - DNA, 21 bp, Homo sapiens
tcccctttgtattccttaaat

SEQ ID NO: 1504811 - DNA, 20 bp, Homo sapiens
tccccttttcttttctaccc

SEQ ID NO: 1504812 - DNA, 17 bp, Homo sapiens
tcctggcacgccctact

SEQ ID NO: 1504813 - DNA, 15 bp, Homo sapiens
tcctggcagcccaga

SEQ ID NO: 1504814 - DNA, 19 bp, Homo sapiens
tcctggcagcccagagact

SEQ ID NO: 1504815 - DNA, 14 bp, Homo sapiens
tcctggcagcctgc

SEQ ID NO: 1504816 - DNA, 20 bp, Homo sapiens
tcctggcaggtgccccagga

SEQ ID NO: 1504817 - DNA, 20 bp, Homo sapiens
tcctggcccactctgtaata

SEQ ID NO: 1504818 - DNA, 23 bp, Homo sapiens
tcctggccccgggctctggccac

SEQ ID NO: 1504819 - DNA, 22 bp, Homo sapiens
tcctggcccctccagaccctgc

SEQ ID NO: 1504820 - DNA, 19 bp, Homo sapiens
tcctggccctccactcctc

SEQ ID NO: 1504821 - DNA, 17 bp, Homo sapiens
tcctggcccttcagtct

SEQ ID NO: 1504822 - DNA, 18 bp, Homo sapiens
tcctggcctatccgctgc

SEQ ID NO: 1504823 - DNA, 23 bp, Homo sapiens
tcctggcctatccgctgccagcc

SEQ ID NO: 1504824 - DNA, 18 bp, Homo sapiens
tcctggcctcactggctg

SEQ ID NO: 1504825 - DNA, 12 bp, Homo sapiens
tcctggcctccc

SEQ ID NO: 1504826 - DNA, 19 bp, Homo sapiens
tcctggcctcccttctcct

SEQ ID NO: 1504827 - DNA, 12 bp, Homo sapiens
tcctggcctcct

SEQ ID NO: 1504828 - DNA, 17 bp, Homo sapiens
tcctggcctccttcccc

SEQ ID NO: 1504829 - DNA, 22 bp, Homo sapiens
tcctggccttgtgtcactggct

SEQ ID NO: 1504830 - DNA, 15 bp, Homo sapiens
tcctggctcaggccc

SEQ ID NO: 1504831 - DNA, 17 bp, Homo sapiens
tcctggctcaggcccag

SEQ ID NO: 1504832 - DNA, 18 bp, Homo sapiens
tcctggctcaggcccagc

SEQ ID NO: 1504833 - DNA, 19 bp, Homo sapiens
tcctggctcaggcccagct

SEQ ID NO: 1504834 - DNA, 19 bp, Homo sapiens
tcctggctctaccctgtct

SEQ ID NO: 1504835 - DNA, 23 bp, Homo sapiens
tcctggctctaccctgtctgtcc

SEQ ID NO: 1504836 - DNA, 19 bp, Homo sapiens
tcctggctgatgatccaga

SEQ ID NO: 1504837 - DNA, 14 bp, Homo sapiens
tcctggctgcactc

SEQ ID NO: 1504838 - DNA, 16 bp, Homo sapiens
tcctggctgcactctt

SEQ ID NO: 1504839 - DNA, 13 bp, Homo sapiens
tcctggctgccag

SEQ ID NO: 1504840 - DNA, 21 bp, Homo sapiens
tcctggctgtgaatgccaaag

SEQ ID NO: 1504841 - DNA, 20 bp, Homo sapiens
tcctggctgtgcccagcagg

SEQ ID NO: 1504842 - DNA, 22 bp, Homo sapiens
tcctggctgtgcccagcaggcc

SEQ ID NO: 1504843 - DNA, 19 bp, Homo sapiens
tcctgggaaggagggagct

SEQ ID NO: 1504844 - DNA, 21 bp, Homo sapiens
tcctgggaaggagggagctgc

SEQ ID NO: 1504845 - DNA, 18 bp, Homo sapiens
tcctgggaaggccacctc

SEQ ID NO: 1504846 - DNA, 17 bp, Homo sapiens
tcctgggagaacctcag

SEQ ID NO: 1504847 - DNA, 18 bp, Homo sapiens
tcctgggagaacctcagg

SEQ ID NO: 1504848 - DNA, 16 bp, Homo sapiens
tcctgggatgtaaacc

SEQ ID NO: 1504849 - DNA, 12 bp, Homo sapiens
tcctgggcaggt

SEQ ID NO: 1504850 - DNA, 15 bp, Homo sapiens
tcctgggcaggtggg

SEQ ID NO: 1504851 - DNA, 19 bp, Homo sapiens
tcctgggcatgggtccagg

SEQ ID NO: 1504852 - DNA, 20 bp, Homo sapiens
tcctgggcatgggtccaggg

SEQ ID NO: 1504853 - DNA, 16 bp, Homo sapiens
tcctgggccggctgag

SEQ ID NO: 1504854 - DNA, 21 bp, Homo sapiens
tcctgggccggctgagtggca

SEQ ID NO: 1504855 - DNA, 13 bp, Homo sapiens
tcctgggcctgca

SEQ ID NO: 1504856 - DNA, 16 bp, Homo sapiens
tcctgggcctgcagaa

SEQ ID NO: 1504857 - DNA, 14 bp, Homo sapiens
tcctgggcctgccc

SEQ ID NO: 1504858 - DNA, 15 bp, Homo sapiens
tcctgggcctgtccc

SEQ ID NO: 1504859 - DNA, 16 bp, Homo sapiens
tcctgggcctgtcccc

SEQ ID NO: 1504860 - DNA, 13 bp, Homo sapiens
tcctgggcctttg

SEQ ID NO: 1504861 - DNA, 13 bp, Homo sapiens
tcctgggcgccct

SEQ ID NO: 1504862 - DNA, 20 bp, Homo sapiens
tcctgggcgccctggaagcc

SEQ ID NO: 1504863 - DNA, 16 bp, Homo sapiens
tcctggggcagcactc

SEQ ID NO: 1504864 - DNA, 17 bp, Homo sapiens
tcctggggcagcactcc

SEQ ID NO: 1504865 - DNA, 20 bp, Homo sapiens
tcctggggcagcactcccca

SEQ ID NO: 1504866 - DNA, 20 bp, Homo sapiens
tcctggggccccgctgggat

SEQ ID NO: 1504867 - DNA, 21 bp, Homo sapiens
tcctggggccccgctgggatt

SEQ ID NO: 1504868 - DNA, 13 bp, Homo sapiens
tcctggggcctcg

SEQ ID NO: 1504869 - DNA, 23 bp, Homo sapiens
tcctggggtataaaactttcctc

SEQ ID NO: 1504870 - DNA, 19 bp, Homo sapiens
tcctggtaattcctctcca

SEQ ID NO: 1504871 - DNA, 23 bp, Homo sapiens
tcctggtaattcctctccaggcc

SEQ ID NO: 1504872 - DNA, 18 bp, Homo sapiens
tcctggtacccagccatc

SEQ ID NO: 1504873 - DNA, 23 bp, Homo sapiens
tcctggtcctgatgcccgttgtc

SEQ ID NO: 1504874 - DNA, 16 bp, Homo sapiens
tcctggtcctggctgc

SEQ ID NO: 1504875 - DNA, 20 bp, Homo sapiens
tcctggtcctggctgcactc

SEQ ID NO: 1504876 - DNA, 20 bp, Homo sapiens
tcctggtgccaatttcaagt

SEQ ID NO: 1504877 - DNA, 19 bp, Homo sapiens
tcctggtgctctctgccac

SEQ ID NO: 1504878 - DNA, 20 bp, Homo sapiens
tcctggtgctctctgccact

SEQ ID NO: 1504879 - DNA, 13 bp, Homo sapiens
tcctggtggctgg

SEQ ID NO: 1504880 - DNA, 19 bp, Homo sapiens
tcctggtggctgggcccag

SEQ ID NO: 1504881 - DNA, 20 bp, Homo sapiens
tcctggtggctgggcccagc

SEQ ID NO: 1504882 - DNA, 22 bp, Homo sapiens
tcctggtggggctgagcctgag

SEQ ID NO: 1504883 - DNA, 22 bp, Homo sapiens
tcctggtgggtcagcccagcac

SEQ ID NO: 1504884 - DNA, 23 bp, Homo sapiens
tcctggttcaaacgggtgcctgg

SEQ ID NO: 1504885 - DNA, 17 bp, Homo sapiens
tcctggttgttcctgca

SEQ ID NO: 1504886 - DNA, 20 bp, Homo sapiens
tcctggttgttcctgcatcc

SEQ ID NO: 1504887 - DNA, 22 bp, Homo sapiens
tcctggtttcataacttcctgt

SEQ ID NO: 1504888 - DNA, 23 bp, Homo sapiens
tcctggtttcataacttcctgta

SEQ ID NO: 1504889 - DNA, 18 bp, Homo sapiens
tcctgtaaataagagttg

SEQ ID NO: 1504890 - DNA, 15 bp, Homo sapiens
tcctgtaaatatatc

SEQ ID NO: 1504891 - DNA, 13 bp, Homo sapiens
tcctgtaattcct

SEQ ID NO: 1504892 - DNA, 14 bp, Homo sapiens
tcctgtacattgtg

SEQ ID NO: 1504893 - DNA, 16 bp, Homo sapiens
tcctgtagccactggc

SEQ ID NO: 1504894 - DNA, 24 bp, Homo sapiens
tcctgtagctttaaaaccacagct

SEQ ID NO: 1504895 - DNA, 21 bp, Homo sapiens
tcctgtagttgcgtggactct

SEQ ID NO: 1504896 - DNA, 19 bp, Homo sapiens
tcctgtattcttgtttgaa

SEQ ID NO: 1504897 - DNA, 18 bp, Homo sapiens
tcctgtccaacctaaccc

SEQ ID NO: 1504898 - DNA, 10 bp, Homo sapiens
tcctgtccca

SEQ ID NO: 1504899 - DNA, 18 bp, Homo sapiens
tcctgtcccgccttcctc

SEQ ID NO: 1504900 - DNA, 19 bp, Homo sapiens
tcctgtccctcatccatag

SEQ ID NO: 1504901 - DNA, 11 bp, Homo sapiens
tcctgtccctg

SEQ ID NO: 1504902 - DNA, 13 bp, Homo sapiens
tcctgtccctgta

SEQ ID NO: 1504903 - DNA, 19 bp, Homo sapiens
tcctgtccctgtagctcag

SEQ ID NO: 1504904 - DNA, 22 bp, Homo sapiens
tcctgtccctgtagctcagtca

SEQ ID NO: 1504905 - DNA, 15 bp, Homo sapiens
tcctgtcctggtcct

SEQ ID NO: 1504906 - DNA, 15 bp, Homo sapiens
tcctgtctaactgct

SEQ ID NO: 1504907 - DNA, 17 bp, Homo sapiens
tcctgtctcagcctcct

SEQ ID NO: 1504908 - DNA, 21 bp, Homo sapiens
tcctgtctcagcctcctgagt

SEQ ID NO: 1504909 - DNA, 13 bp, Homo sapiens
tcctgtctctgcc

SEQ ID NO: 1504910 - DNA, 14 bp, Homo sapiens
tcctgtctctgcct

SEQ ID NO: 1504911 - DNA, 12 bp, Homo sapiens
tcctgtctgcca

SEQ ID NO: 1504912 - DNA, 18 bp, Homo sapiens
tcctgtctgccctctggg

SEQ ID NO: 1504913 - DNA, 16 bp, Homo sapiens
tcctgtctggctcgga

SEQ ID NO: 1504914 - DNA, 14 bp, Homo sapiens
tcctgtcttatcct

SEQ ID NO: 1504915 - DNA, 18 bp, Homo sapiens
tcctgtctttaaggaaaa

SEQ ID NO: 1504916 - DNA, 17 bp, Homo sapiens
tcgaggcatggggcatg

SEQ ID NO: 1504917 - DNA, 21 bp, Homo sapiens
tcgaggccacattgctggctg

SEQ ID NO: 1504918 - DNA, 23 bp, Homo sapiens
tcgaggccacattgctggctgcc

SEQ ID NO: 1504919 - DNA, 20 bp, Homo sapiens
tcgaggggtgggctggtatc

SEQ ID NO: 1504920 - DNA, 15 bp, Homo sapiens
tcgagttcccagggt

SEQ ID NO: 1504921 - DNA, 22 bp, Homo sapiens
tcgatactgcgactttctgcct

SEQ ID NO: 1504922 - DNA, 23 bp, Homo sapiens
tcgatactgcgactttctgcctg

SEQ ID NO: 1504923 - DNA, 16 bp, Homo sapiens
tcgatcaaaaccttcc

SEQ ID NO: 1504924 - DNA, 23 bp, Homo sapiens
tcgatcaaaaccttccttccctg

SEQ ID NO: 1504925 - DNA, 13 bp, Homo sapiens
tcgatctcctgac

SEQ ID NO: 1504926 - DNA, 19 bp, Homo sapiens
tcgatgatgatgatgatga

SEQ ID NO: 1504927 - DNA, 13 bp, Homo sapiens
tcgcaaggcctgt

SEQ ID NO: 1504928 - DNA, 23 bp, Homo sapiens
tcgcaatagttttttacttctct

SEQ ID NO: 1504929 - DNA, 17 bp, Homo sapiens
tcgcacaggccctagct

SEQ ID NO: 1504930 - DNA, 17 bp, Homo sapiens
tcgcaccactgcactcc

SEQ ID NO: 1504931 - DNA, 21 bp, Homo sapiens
tcgcaccactgcactccagcc

SEQ ID NO: 1504932 - DNA, 22 bp, Homo sapiens
tcgcaccactgcactccagcct

SEQ ID NO: 1504933 - DNA, 21 bp, Homo sapiens
tcgcaccactgtgtatttaac

SEQ ID NO: 1504934 - DNA, 17 bp, Homo sapiens
tcgcaccattctcctgc

SEQ ID NO: 1504935 - DNA, 16 bp, Homo sapiens
tcgcaccattctgact

SEQ ID NO: 1504936 - DNA, 17 bp, Homo sapiens
tcgcaccattctgactc

SEQ ID NO: 1504937 - DNA, 18 bp, Homo sapiens
tcgcagacctaagccctg

SEQ ID NO: 1504938 - DNA, 11 bp, Homo sapiens
tcgcagcctga

SEQ ID NO: 1504939 - DNA, 19 bp, Homo sapiens
tcgcagcctgaagcctgga

SEQ ID NO: 1504940 - DNA, 15 bp, Homo sapiens
tcgcagctaccctca

SEQ ID NO: 1504941 - DNA, 16 bp, Homo sapiens
tcgcagctaccctcag

SEQ ID NO: 1504942 - DNA, 14 bp, Homo sapiens
tcgcagctgtgggt

SEQ ID NO: 1504943 - DNA, 20 bp, Homo sapiens
tcgcaggatccgctgccacc

SEQ ID NO: 1504944 - DNA, 16 bp, Homo sapiens
tcgcagggtgcaggag

SEQ ID NO: 1504945 - DNA, 13 bp, Homo sapiens
tcgcatggcagaa

SEQ ID NO: 1504946 - DNA, 13 bp, Homo sapiens
tcgcatttgtcaa

SEQ ID NO: 1504947 - DNA, 15 bp, Homo sapiens
tcgcatttgtcaatg

SEQ ID NO: 1504948 - DNA, 18 bp, Homo sapiens
tcgccacccctccttcct

SEQ ID NO: 1504949 - DNA, 18 bp, Homo sapiens
tcgccagtcactgctgca

SEQ ID NO: 1504950 - DNA, 21 bp, Homo sapiens
tcgccagtcactgctgcaagg

SEQ ID NO: 1504951 - DNA, 18 bp, Homo sapiens
tcgcccagacaccatgtg

SEQ ID NO: 1504952 - DNA, 11 bp, Homo sapiens
tcgcccaggag

SEQ ID NO: 1504953 - DNA, 22 bp, Homo sapiens
tcgcccatacccgtgacagtgg

SEQ ID NO: 1504954 - DNA, 18 bp, Homo sapiens
tcgccccagatcaccagc

SEQ ID NO: 1504955 - DNA, 22 bp, Homo sapiens
tcgccccagatcaccagcccgg

SEQ ID NO: 1504956 - DNA, 15 bp, Homo sapiens
tcgccccctgcctgc

SEQ ID NO: 1504957 - DNA, 18 bp, Homo sapiens
tcgccccctgcctgccat

SEQ ID NO: 1504958 - DNA, 15 bp, Homo sapiens
tcgcccgcccactgt

SEQ ID NO: 1504959 - DNA, 19 bp, Homo sapiens
tcgcccgcccactgtcctg

SEQ ID NO: 1504960 - DNA, 15 bp, Homo sapiens
tcgccctcctttccc

SEQ ID NO: 1504961 - DNA, 17 bp, Homo sapiens
tcgccctcctttccctt

SEQ ID NO: 1504962 - DNA, 16 bp, Homo sapiens
tcgcccttcagcccac

SEQ ID NO: 1504963 - DNA, 17 bp, Homo sapiens
tcgccgtccctcccagg

SEQ ID NO: 1504964 - DNA, 22 bp, Homo sapiens
tcgccgtgttactgttgcactg

SEQ ID NO: 1504965 - DNA, 11 bp, Homo sapiens
tcgcctgacaa

SEQ ID NO: 1504966 - DNA, 22 bp, Homo sapiens
tcgcctgacaaccactggtctg

SEQ ID NO: 1504967 - DNA, 14 bp, Homo sapiens
tcgccttaaactct

SEQ ID NO: 1504968 - DNA, 19 bp, Homo sapiens
tcgcctttgtcttgtactt

SEQ ID NO: 1504969 - DNA, 15 bp, Homo sapiens
tcgcgcccaaaagat

SEQ ID NO: 1504970 - DNA, 14 bp, Homo sapiens
tcgcgctggacagc

SEQ ID NO: 1504971 - DNA, 22 bp, Homo sapiens
tcgcggccctcagtagtccctg

SEQ ID NO: 1504972 - DNA, 21 bp, Homo sapiens
tcgcgggcagcgggccaggcc

SEQ ID NO: 1504973 - DNA, 16 bp, Homo sapiens
tcgcgtgccctcgctg

SEQ ID NO: 1504974 - DNA, 22 bp, Homo sapiens
tcgctccctgtagctctgcctc

SEQ ID NO: 1504975 - DNA, 21 bp, Homo sapiens
tcgctctgttgcccaggctgg

SEQ ID NO: 1504976 - DNA, 17 bp, Homo sapiens
tcgctgaaattgcttat

SEQ ID NO: 1504977 - DNA, 19 bp, Homo sapiens
tcgctgatatatgtgtttt

SEQ ID NO: 1504978 - DNA, 12 bp, Homo sapiens
tcgctgatgcag

SEQ ID NO: 1504979 - DNA, 23 bp, Homo sapiens
tcgctgcctccatggcagcagcc

SEQ ID NO: 1504980 - DNA, 14 bp, Homo sapiens
tcgctgctgctact

SEQ ID NO: 1504981 - DNA, 22 bp, Homo sapiens
tcgctggctttctctctggctt

SEQ ID NO: 1504982 - DNA, 20 bp, Homo sapiens
tcgctgggtcagtgctggaa

SEQ ID NO: 1504983 - DNA, 20 bp, Homo sapiens
tcgctgtaccctttaagata

SEQ ID NO: 1504984 - DNA, 17 bp, Homo sapiens
tcgctgtgatgcatgag

SEQ ID NO: 1504985 - DNA, 22 bp, Homo sapiens
tcgctgtgatgcatgagctccc

SEQ ID NO: 1504986 - DNA, 18 bp, Homo sapiens
tcgcttcctcagcctcca

SEQ ID NO: 1504987 - DNA, 22 bp, Homo sapiens
tcgcttctgtgtatctctttca

SEQ ID NO: 1504988 - DNA, 15 bp, Homo sapiens
tcgcttgagcccagg

SEQ ID NO: 1504989 - DNA, 19 bp, Homo sapiens
tcgctttattggctgagat

SEQ ID NO: 1504990 - DNA, 15 bp, Homo sapiens
tcggaagcagtgcct

SEQ ID NO: 1504991 - DNA, 22 bp, Homo sapiens
tcggaagcagtgccttccataa

SEQ ID NO: 1504992 - DNA, 21 bp, Homo sapiens
tcggacatgcttttctgccac

SEQ ID NO: 1504993 - DNA, 22 bp, Homo sapiens
tcggacccaccaaactgcacac

SEQ ID NO: 1504994 - DNA, 20 bp, Homo sapiens
tcggacccaccccaactctc

SEQ ID NO: 1504995 - DNA, 22 bp, Homo sapiens
tcggacccaccccaactctccc

SEQ ID NO: 1504996 - DNA, 23 bp, Homo sapiens
tcggacccaccccaactctcccc

SEQ ID NO: 1504997 - DNA, 12 bp, Homo sapiens
tcggagaagagc

SEQ ID NO: 1504998 - DNA, 14 bp, Homo sapiens
tcggagaagagctg

SEQ ID NO: 1504999 - DNA, 14 bp, Homo sapiens
tcggagacagtgat

SEQ ID NO: 1505000 - DNA, 23 bp, Homo sapiens
tcggagacagtgatctccatatg

SEQ ID NO: 1505001 - DNA, 12 bp, Homo sapiens
tcggagccaaca

SEQ ID NO: 1505002 - DNA, 22 bp, Homo sapiens
tcggagcctcatccgaggcagg

SEQ ID NO: 1505003 - DNA, 23 bp, Homo sapiens
tcggagcctcatccgaggcaggg

SEQ ID NO: 1505004 - DNA, 13 bp, Homo sapiens
tcggagctcctgt

SEQ ID NO: 1505005 - DNA, 17 bp, Homo sapiens
tcggagctgcctgcagc

SEQ ID NO: 1505006 - DNA, 20 bp, Homo sapiens
tcggagctgcctgcagcaca

SEQ ID NO: 1505007 - DNA, 16 bp, Homo sapiens
tcggagtgcctggagt

SEQ ID NO: 1505008 - DNA, 13 bp, Homo sapiens
tcggatcctgtga

SEQ ID NO: 1505009 - DNA, 19 bp, Homo sapiens
tcggatgacaccctggcct

SEQ ID NO: 1505010 - DNA, 21 bp, Homo sapiens
tcggatgacaccctggcctga

SEQ ID NO: 1505011 - DNA, 16 bp, Homo sapiens
tcggcccacagctccc

SEQ ID NO: 1505012 - DNA, 19 bp, Homo sapiens
tcggcccacagctcccacc

SEQ ID NO: 1505013 - DNA, 19 bp, Homo sapiens
tcggccccacatgggaacc

SEQ ID NO: 1505014 - DNA, 12 bp, Homo sapiens
tcggcctcccaa

SEQ ID NO: 1505015 - DNA, 19 bp, Homo sapiens
tcggcctccgaggctcccc

SEQ ID NO: 1505016 - DNA, 14 bp, Homo sapiens
tcggcctttgggtg

SEQ ID NO: 1505017 - DNA, 18 bp, Homo sapiens
tcggctggggactgctac

SEQ ID NO: 1505018 - DNA, 20 bp, Homo sapiens
tcggcttcttggaccttggc

SEQ ID NO: 1505019 - DNA, 17 bp, Homo sapiens
tcggcttggatcctggg

SEQ ID NO: 1505020 - DNA, 19 bp, Homo sapiens
tcggcttggatcctgggct

SEQ ID NO: 1505021 - DNA, 12 bp, Homo sapiens
tcgggaagcaga

SEQ ID NO: 1505022 - DNA, 17 bp, Homo sapiens
tccttgctgtcctaggc

SEQ ID NO: 1505023 - DNA, 19 bp, Homo sapiens
tccttggagtcccaggggc

SEQ ID NO: 1505024 - DNA, 17 bp, Homo sapiens
tccttggcatgccttcc

SEQ ID NO: 1505025 - DNA, 20 bp, Homo sapiens
tccttggctttatgcaaata

SEQ ID NO: 1505026 - DNA, 23 bp, Homo sapiens
tccttggctttatgcaaatacaa

SEQ ID NO: 1505027 - DNA, 20 bp, Homo sapiens
tccttgggcgtctctaatgt

SEQ ID NO: 1505028 - DNA, 14 bp, Homo sapiens
tccttgggctcctg

SEQ ID NO: 1505029 - DNA, 18 bp, Homo sapiens
tccttgggctcctggctg

SEQ ID NO: 1505030 - DNA, 17 bp, Homo sapiens
tccttggggcagggcct

SEQ ID NO: 1505031 - DNA, 21 bp, Homo sapiens
tccttggggcagggcctgggc

SEQ ID NO: 1505032 - DNA, 23 bp, Homo sapiens
tccttggggcagggcctgggcct

SEQ ID NO: 1505033 - DNA, 24 bp, Homo sapiens
tccttggggcagggcctgggcctc

SEQ ID NO: 1505034 - DNA, 23 bp, Homo sapiens
tccttggggttaagtctcctgtc

SEQ ID NO: 1505035 - DNA, 16 bp, Homo sapiens
tccttggtaaatacaa

SEQ ID NO: 1505036 - DNA, 19 bp, Homo sapiens
tccttggtcctagtaagaa

SEQ ID NO: 1505037 - DNA, 14 bp, Homo sapiens
tccttggtgcctgg

SEQ ID NO: 1505038 - DNA, 18 bp, Homo sapiens
tccttggtgcctggcctg

SEQ ID NO: 1505039 - DNA, 19 bp, Homo sapiens
tccttggtttgctagtatc

SEQ ID NO: 1505040 - DNA, 21 bp, Homo sapiens
tccttggtttgctagtatctt

SEQ ID NO: 1505041 - DNA, 15 bp, Homo sapiens
tccttgtcttgtaat

SEQ ID NO: 1505042 - DNA, 12 bp, Homo sapiens
tccttgtgcaaa

SEQ ID NO: 1505043 - DNA, 21 bp, Homo sapiens
tccttgttgtttcttgcctga

SEQ ID NO: 1505044 - DNA, 13 bp, Homo sapiens
tccttgtttcaaa

SEQ ID NO: 1505045 - DNA, 15 bp, Homo sapiens
tcctttaattgtaaa

SEQ ID NO: 1505046 - DNA, 14 bp, Homo sapiens
tcctttaccctctt

SEQ ID NO: 1505047 - DNA, 16 bp, Homo sapiens
tcctttacgtgtttaa

SEQ ID NO: 1505048 - DNA, 15 bp, Homo sapiens
tcctttatgtgaatt

SEQ ID NO: 1505049 - DNA, 15 bp, Homo sapiens
tcctttattgcagtt

SEQ ID NO: 1505050 - DNA, 13 bp, Homo sapiens
tcctttcaagggg

SEQ ID NO: 1505051 - DNA, 19 bp, Homo sapiens
tcctttcacaaccttctgt

SEQ ID NO: 1505052 - DNA, 14 bp, Homo sapiens
tcctttcagccaca

SEQ ID NO: 1505053 - DNA, 23 bp, Homo sapiens
tcctttcagccacatgccccagg

SEQ ID NO: 1505054 - DNA, 21 bp, Homo sapiens
tcctttcatctctctacctcc

SEQ ID NO: 1505055 - DNA, 16 bp, Homo sapiens
tcctttccttcccagg

SEQ ID NO: 1505056 - DNA, 17 bp, Homo sapiens
tcctttccttcccaggc

SEQ ID NO: 1505057 - DNA, 15 bp, Homo sapiens
tcctttctaaacaag

SEQ ID NO: 1505058 - DNA, 17 bp, Homo sapiens
tcctttctaagccctgt

SEQ ID NO: 1505059 - DNA, 21 bp, Homo sapiens
tcctttctaagccctgttctc

SEQ ID NO: 1505060 - DNA, 18 bp, Homo sapiens
tcctttctccagccagca

SEQ ID NO: 1505061 - DNA, 16 bp, Homo sapiens
tcctttctctcctggc

SEQ ID NO: 1505062 - DNA, 12 bp, Homo sapiens
tcctttctctgg

SEQ ID NO: 1505063 - DNA, 13 bp, Homo sapiens
tcctttctgtgca

SEQ ID NO: 1505064 - DNA, 14 bp, Homo sapiens
tcctttctttttct

SEQ ID NO: 1505065 - DNA, 16 bp, Homo sapiens
tcctttctttttcttc

SEQ ID NO: 1505066 - DNA, 17 bp, Homo sapiens
tcctttctttttcttct

SEQ ID NO: 1505067 - DNA, 19 bp, Homo sapiens
tcctttgagaatgtgattc

SEQ ID NO: 1505068 - DNA, 14 bp, Homo sapiens
tcctttgcactgag

SEQ ID NO: 1505069 - DNA, 15 bp, Homo sapiens
tcctttgcactgagg

SEQ ID NO: 1505070 - DNA, 15 bp, Homo sapiens
tcctttgcaggctca

SEQ ID NO: 1505071 - DNA, 17 bp, Homo sapiens
tcctttgcgcctgtgac

SEQ ID NO: 1505072 - DNA, 21 bp, Homo sapiens
tcctttgtattctgtcttcat

SEQ ID NO: 1505073 - DNA, 12 bp, Homo sapiens
tcctttgtcttc

SEQ ID NO: 1505074 - DNA, 22 bp, Homo sapiens
tcctttgtgtgtgtgtcagctg

SEQ ID NO: 1505075 - DNA, 15 bp, Homo sapiens
tcctttgtgtttcta

SEQ ID NO: 1505076 - DNA, 10 bp, Homo sapiens
tcctttgttc

SEQ ID NO: 1505077 - DNA, 19 bp, Homo sapiens
tcctttgttgtctacatta

SEQ ID NO: 1505078 - DNA, 20 bp, Homo sapiens
tcctttgtttaataaaggct

SEQ ID NO: 1505079 - DNA, 17 bp, Homo sapiens
tccttttaattttcctg

SEQ ID NO: 1505080 - DNA, 15 bp, Homo sapiens
tccttttcctctctc

SEQ ID NO: 1505081 - DNA, 11 bp, Homo sapiens
tccttttcctt

SEQ ID NO: 1505082 - DNA, 13 bp, Homo sapiens
tccttttgaactt

SEQ ID NO: 1505083 - DNA, 22 bp, Homo sapiens
tccttttgatggggagaaaggg

SEQ ID NO: 1505084 - DNA, 17 bp, Homo sapiens
tccttttgcctgcaggt

SEQ ID NO: 1505085 - DNA, 14 bp, Homo sapiens
tccttttgctgtct

SEQ ID NO: 1505086 - DNA, 20 bp, Homo sapiens
tccttttgctgtctttctct

SEQ ID NO: 1505087 - DNA, 13 bp, Homo sapiens
tccttttgttttg

SEQ ID NO: 1505088 - DNA, 17 bp, Homo sapiens
tccttttgttttgaagc

SEQ ID NO: 1505089 - DNA, 14 bp, Homo sapiens
tcctttttaaatgt

SEQ ID NO: 1505090 - DNA, 19 bp, Homo sapiens
tcctttttaaatgtgaatt

SEQ ID NO: 1505091 - DNA, 20 bp, Homo sapiens
tcctttttaaattcagtcct

SEQ ID NO: 1505092 - DNA, 12 bp, Homo sapiens
tcctttttaagg

SEQ ID NO: 1505093 - DNA, 22 bp, Homo sapiens
tcctttttcaaaaaccagccag

SEQ ID NO: 1505094 - DNA, 14 bp, Homo sapiens
tcctttttgacact

SEQ ID NO: 1505095 - DNA, 13 bp, Homo sapiens
tccttttttgtct

SEQ ID NO: 1505096 - DNA, 13 bp, Homo sapiens
tcgaaaacataaa

SEQ ID NO: 1505097 - DNA, 12 bp, Homo sapiens
tcgaaaggcctt

SEQ ID NO: 1505098 - DNA, 13 bp, Homo sapiens
tcgaaccaaggca

SEQ ID NO: 1505099 - DNA, 17 bp, Homo sapiens
tcgaaccaaggcagcct

SEQ ID NO: 1505100 - DNA, 19 bp, Homo sapiens
tcgaaccaaggcagcctcc

SEQ ID NO: 1505101 - DNA, 13 bp, Homo sapiens
tcgaacccactcc

SEQ ID NO: 1505102 - DNA, 14 bp, Homo sapiens
tcgaacccactccg

SEQ ID NO: 1505103 - DNA, 13 bp, Homo sapiens
tcgaactcctggc

SEQ ID NO: 1505104 - DNA, 13 bp, Homo sapiens
tcgaactgctttc

SEQ ID NO: 1505105 - DNA, 11 bp, Homo sapiens
tcgaagccatg

SEQ ID NO: 1505106 - DNA, 14 bp, Homo sapiens
tcgaagtattcaat

SEQ ID NO: 1505107 - DNA, 17 bp, Homo sapiens
tcgaagtgtttatgtaa

SEQ ID NO: 1505108 - DNA, 17 bp, Homo sapiens
tcgaatctctgtgcctt

SEQ ID NO: 1505109 - DNA, 22 bp, Homo sapiens
tcgaatctctgtgccttcgtct

SEQ ID NO: 1505110 - DNA, 17 bp, Homo sapiens
tcgaatcttaatttatt

SEQ ID NO: 1505111 - DNA, 19 bp, Homo sapiens
tcgaatgtaattggaatct

SEQ ID NO: 1505112 - DNA, 17 bp, Homo sapiens
tcgaattttatctgtgg

SEQ ID NO: 1505113 - DNA, 16 bp, Homo sapiens
tcgacagatgattttc

SEQ ID NO: 1505114 - DNA, 22 bp, Homo sapiens
tcgacatccgtcattgctgctg

SEQ ID NO: 1505115 - DNA, 17 bp, Homo sapiens
tcgaccaattcaaccct

SEQ ID NO: 1505116 - DNA, 19 bp, Homo sapiens
tcgacccagaatggagcct

SEQ ID NO: 1505117 - DNA, 23 bp, Homo sapiens
tcgaccccaaaggaacactgaca

SEQ ID NO: 1505118 - DNA, 12 bp, Homo sapiens
tcgacctcccca

SEQ ID NO: 1505119 - DNA, 15 bp, Homo sapiens
tcgactactgctcct

SEQ ID NO: 1505120 - DNA, 19 bp, Homo sapiens
tcgactactgctcctgtgg

SEQ ID NO: 1505121 - DNA, 21 bp, Homo sapiens
tcgagaaagaggcaccaggaa

SEQ ID NO: 1505122 - DNA, 15 bp, Homo sapiens
tcgagaactttcatt

SEQ ID NO: 1505123 - DNA, 15 bp, Homo sapiens
tcgagaccagcctgg

SEQ ID NO: 1505124 - DNA, 16 bp, Homo sapiens
tcgagaccatcctggc

SEQ ID NO: 1505125 - DNA, 19 bp, Homo sapiens
tcgagaccatcctggcccc

SEQ ID NO: 1505126 - DNA, 23 bp, Homo sapiens
tcgagaccatcctggcccctcca

SEQ ID NO: 1505127 - DNA, 18 bp, Homo sapiens
tcgagaccatcctggcta

SEQ ID NO: 1505128 - DNA, 19 bp, Homo sapiens
tcgagaccatcctggctaa

SEQ ID NO: 1505129 - DNA, 18 bp, Homo sapiens
tcgagacccaaaccccca

SEQ ID NO: 1505130 - DNA, 19 bp, Homo sapiens
tcgagagctggccaaagag

SEQ ID NO: 1505131 - DNA, 21 bp, Homo sapiens
tcgagagctggccaaagagcc

SEQ ID NO: 1505132 - DNA, 14 bp, Homo sapiens
tcgagcatttcttc

SEQ ID NO: 1505133 - DNA, 13 bp, Homo sapiens
tcgagccactgca

SEQ ID NO: 1505134 - DNA, 17 bp, Homo sapiens
tcgagcccacccagcat

SEQ ID NO: 1505135 - DNA, 14 bp, Homo sapiens
tcgaggagtaacaa

SEQ ID NO: 1505136 - DNA, 17 bp, Homo sapiens
tcgaggagtaacaatac

SEQ ID NO: 1505137 - DNA, 22 bp, Homo sapiens
tcggggcccttggggcctggct

SEQ ID NO: 1505138 - DNA, 23 bp, Homo sapiens
tcggggcccttggggcctggctt

SEQ ID NO: 1505139 - DNA, 13 bp, Homo sapiens
tcggtactcccat

SEQ ID NO: 1505140 - DNA, 16 bp, Homo sapiens
tcggtaggttcagcca

SEQ ID NO: 1505141 - DNA, 13 bp, Homo sapiens
tcggtatctggct

SEQ ID NO: 1505142 - DNA, 21 bp, Homo sapiens
tcggtatctggcttccctgga

SEQ ID NO: 1505143 - DNA, 12 bp, Homo sapiens
tcggtctgcttt

SEQ ID NO: 1505144 - DNA, 13 bp, Homo sapiens
tcggtgctccatc

SEQ ID NO: 1505145 - DNA, 13 bp, Homo sapiens
tcggtttctccaa

SEQ ID NO: 1505146 - DNA, 22 bp, Homo sapiens
tcggtttgccaaaattcatttc

SEQ ID NO: 1505147 - DNA, 16 bp, Homo sapiens
tcgtaatagcttctgt

SEQ ID NO: 1505148 - DNA, 19 bp, Homo sapiens
tcgtaatagcttctgtgtg

SEQ ID NO: 1505149 - DNA, 18 bp, Homo sapiens
tcgtacctgtccctccag

SEQ ID NO: 1505150 - DNA, 16 bp, Homo sapiens
tcgtacgcccaggaca

SEQ ID NO: 1505151 - DNA, 21 bp, Homo sapiens
tcgtacgcccaggacagctgg

SEQ ID NO: 1505152 - DNA, 15 bp, Homo sapiens
tcgtaggcagccacg

SEQ ID NO: 1505153 - DNA, 19 bp, Homo sapiens
tcgtaggtattagtgctag

SEQ ID NO: 1505154 - DNA, 19 bp, Homo sapiens
tcgtagtgtgtttaaataa

SEQ ID NO: 1505155 - DNA, 21 bp, Homo sapiens
tcgtataacacaatatgaata

SEQ ID NO: 1505156 - DNA, 16 bp, Homo sapiens
tcgtccaagggacagc

SEQ ID NO: 1505157 - DNA, 22 bp, Homo sapiens
tcgtccacaggggcaggcctgg

SEQ ID NO: 1505158 - DNA, 14 bp, Homo sapiens
tcgtccgtctgtct

SEQ ID NO: 1505159 - DNA, 18 bp, Homo sapiens
tcgtcctccccctgccag

SEQ ID NO: 1505160 - DNA, 23 bp, Homo sapiens
tcgtctctcccaccccctcccca

SEQ ID NO: 1505161 - DNA, 17 bp, Homo sapiens
tcgtcttcagctgcatt

SEQ ID NO: 1505162 - DNA, 22 bp, Homo sapiens
tcgtcttgaacgagcagcccag

SEQ ID NO: 1505163 - DNA, 18 bp, Homo sapiens
tcgtctttcccatgggga

SEQ ID NO: 1505164 - DNA, 19 bp, Homo sapiens
tcgtgacccttcagggcca

SEQ ID NO: 1505165 - DNA, 18 bp, Homo sapiens
tcgtgagctggggactca

SEQ ID NO: 1505166 - DNA, 19 bp, Homo sapiens
tcgtgatctgcccacctcg

SEQ ID NO: 1505167 - DNA, 23 bp, Homo sapiens
tcgtgatgtggaggaagagccac

SEQ ID NO: 1505168 - DNA, 14 bp, Homo sapiens
tcgtgcatttcaac

SEQ ID NO: 1505169 - DNA, 13 bp, Homo sapiens
tcgtgccagcagc

SEQ ID NO: 1505170 - DNA, 12 bp, Homo sapiens
tcgtgcctgtgt

SEQ ID NO: 1505171 - DNA, 22 bp, Homo sapiens
tcgtgctgcatccctgtgtcca

SEQ ID NO: 1505172 - DNA, 15 bp, Homo sapiens
tcgtgctgtgctctg

SEQ ID NO: 1505173 - DNA, 22 bp, Homo sapiens
tcgtggcacgtattgctgtgtc

SEQ ID NO: 1505174 - DNA, 21 bp, Homo sapiens
tcgtggccaacgtggacctgc

SEQ ID NO: 1505175 - DNA, 18 bp, Homo sapiens
tcgtggccagcccggctg

SEQ ID NO: 1505176 - DNA, 11 bp, Homo sapiens
tcgtggccttc

SEQ ID NO: 1505177 - DNA, 19 bp, Homo sapiens
tcgtggccttccccagcct

SEQ ID NO: 1505178 - DNA, 20 bp, Homo sapiens
tcgtggctttggcagtgttt

SEQ ID NO: 1505179 - DNA, 15 bp, Homo sapiens
tcgtgggtgtgtgta

SEQ ID NO: 1505180 - DNA, 15 bp, Homo sapiens
tcgtgtaaattatgt

SEQ ID NO: 1505181 - DNA, 22 bp, Homo sapiens
tcgtgtagtggaagagcagcct

SEQ ID NO: 1505182 - DNA, 14 bp, Homo sapiens
tcgtgtatcctggg

SEQ ID NO: 1505183 - DNA, 16 bp, Homo sapiens
tcgtgtatcctggggc

SEQ ID NO: 1505184 - DNA, 18 bp, Homo sapiens
tcgtgtatcctggggctc

SEQ ID NO: 1505185 - DNA, 15 bp, Homo sapiens
tcgtgtatttattac

SEQ ID NO: 1505186 - DNA, 14 bp, Homo sapiens
tcgtgtctctccca

SEQ ID NO: 1505187 - DNA, 17 bp, Homo sapiens
tcgttaaaaagttgttt

SEQ ID NO: 1505188 - DNA, 14 bp, Homo sapiens
tcgttaactgtgta

SEQ ID NO: 1505189 - DNA, 21 bp, Homo sapiens
tcgttaactgtgtatgtacat

SEQ ID NO: 1505190 - DNA, 14 bp, Homo sapiens
tcgttacctgccgc

SEQ ID NO: 1505191 - DNA, 18 bp, Homo sapiens
tcgttacctgccgcccat

SEQ ID NO: 1505192 - DNA, 19 bp, Homo sapiens
tcgttagtatctaacatgt

SEQ ID NO: 1505193 - DNA, 22 bp, Homo sapiens
tcgttctctgggtggccggctt

SEQ ID NO: 1505194 - DNA, 14 bp, Homo sapiens
tcgtttatattgta

SEQ ID NO: 1505195 - DNA, 19 bp, Homo sapiens
tcgtttattttcaagaata

SEQ ID NO: 1505196 - DNA, 12 bp, Homo sapiens
tcgtttctgtat

SEQ ID NO: 1505197 - DNA, 19 bp, Homo sapiens
tcgttttagtgtctgacct

SEQ ID NO: 1505198 - DNA, 18 bp, Homo sapiens
tcgtttttatattaatgt

SEQ ID NO: 1505199 - DNA, 11 bp, Homo sapiens
tcgtttttgta

SEQ ID NO: 1505200 - DNA, 14 bp, Homo sapiens
tctaaaacaataaa

SEQ ID NO: 1505201 - DNA, 19 bp, Homo sapiens
tctaaaactatggttccca

SEQ ID NO: 1505202 - DNA, 15 bp, Homo sapiens
tctaaaatcttatag

SEQ ID NO: 1505203 - DNA, 19 bp, Homo sapiens
tctaaaatgtgatgttcta

SEQ ID NO: 1505204 - DNA, 14 bp, Homo sapiens
tctaaaattctagt

SEQ ID NO: 1505205 - DNA, 19 bp, Homo sapiens
tctaaacagttatttctgt

SEQ ID NO: 1505206 - DNA, 13 bp, Homo sapiens
tctaaaccaaaac

SEQ ID NO: 1505207 - DNA, 20 bp, Homo sapiens
tctaaaccttacatgtgtaa

SEQ ID NO: 1505208 - DNA, 21 bp, Homo sapiens
tctaaactggcatctgctcta

SEQ ID NO: 1505209 - DNA, 12 bp, Homo sapiens
tctaaagaaaaa

SEQ ID NO: 1505210 - DNA, 14 bp, Homo sapiens
tctaaagagagtga

SEQ ID NO: 1505211 - DNA, 20 bp, Homo sapiens
tctaaagatggagtttctaa

SEQ ID NO: 1505212 - DNA, 21 bp, Homo sapiens
tctaaagatggagtttctaag

SEQ ID NO: 1505213 - DNA, 22 bp, Homo sapiens
tctaaagattctatagttctag

SEQ ID NO: 1505214 - DNA, 17 bp, Homo sapiens
tctaaagcagaggcaac

SEQ ID NO: 1505215 - DNA, 12 bp, Homo sapiens
tctaaagctctg

SEQ ID NO: 1505216 - DNA, 22 bp, Homo sapiens
tctaaaggtaccaaacaaggaa

SEQ ID NO: 1505217 - DNA, 23 bp, Homo sapiens
tctaaaggtaccaaacaaggaag

SEQ ID NO: 1505218 - DNA, 17 bp, Homo sapiens
tctaaagtaattggtta

SEQ ID NO: 1505219 - DNA, 20 bp, Homo sapiens
tctaaagtcatcatgaactg

SEQ ID NO: 1505220 - DNA, 15 bp, Homo sapiens
tctaaagttctaaga

SEQ ID NO: 1505221 - DNA, 16 bp, Homo sapiens
tctaaagttctaagat

SEQ ID NO: 1505222 - DNA, 18 bp, Homo sapiens
tctaaagttctaagattc

SEQ ID NO: 1505223 - DNA, 19 bp, Homo sapiens
tctaaagttctaagattct

SEQ ID NO: 1505224 - DNA, 18 bp, Homo sapiens
tctaaataaaaatatgta

SEQ ID NO: 1505225 - DNA, 23 bp, Homo sapiens
tctaaataaatttcccagttaaa

SEQ ID NO: 1505226 - DNA, 17 bp, Homo sapiens
tctaaatcttccttgtg

SEQ ID NO: 1505227 - DNA, 23 bp, Homo sapiens
tctaaatgcatatcctgagccat

SEQ ID NO: 1505228 - DNA, 20 bp, Homo sapiens
tctaaatgttattacttgta

SEQ ID NO: 1505229 - DNA, 19 bp, Homo sapiens
tctaacaaaaaaatatatt

SEQ ID NO: 1505230 - DNA, 14 bp, Homo sapiens
tctaacaataatat

SEQ ID NO: 1505231 - DNA, 20 bp, Homo sapiens
tctaacaataatatttcaag

SEQ ID NO: 1505232 - DNA, 23 bp, Homo sapiens
tctaacaataatatttcaagtgc

SEQ ID NO: 1505233 - DNA, 13 bp, Homo sapiens
tctaacagccctc

SEQ ID NO: 1505234 - DNA, 19 bp, Homo sapiens
tcctgtgaccccaccttga

SEQ ID NO: 1505235 - DNA, 21 bp, Homo sapiens
tcctgtgaccccaccttgacg

SEQ ID NO: 1505236 - DNA, 20 bp, Homo sapiens
tcctgtgcatgggtgaaggg

SEQ ID NO: 1505237 - DNA, 23 bp, Homo sapiens
tcctgtgcccacccgtcttcaat

SEQ ID NO: 1505238 - DNA, 14 bp, Homo sapiens
tcctgtgctatttg

SEQ ID NO: 1505239 - DNA, 22 bp, Homo sapiens
tcctgtgctatttgtacaaata

SEQ ID NO: 1505240 - DNA, 13 bp, Homo sapiens
tcctgtgctctgg

SEQ ID NO: 1505241 - DNA, 19 bp, Homo sapiens
tcctgtgctctggaggctg

SEQ ID NO: 1505242 - DNA, 23 bp, Homo sapiens
tcctgtggaaggcagagaaatct

SEQ ID NO: 1505243 - DNA, 18 bp, Homo sapiens
tcctgtggagatgacttg

SEQ ID NO: 1505244 - DNA, 15 bp, Homo sapiens
tcctgtggcagctgc

SEQ ID NO: 1505245 - DNA, 14 bp, Homo sapiens
tcctgtggcaggag

SEQ ID NO: 1505246 - DNA, 16 bp, Homo sapiens
tcctgtggcaggaggc

SEQ ID NO: 1505247 - DNA, 12 bp, Homo sapiens
tcctgtggcccc

SEQ ID NO: 1505248 - DNA, 12 bp, Homo sapiens
tcctgtggctcc

SEQ ID NO: 1505249 - DNA, 15 bp, Homo sapiens
tcctgtgtggagagg

SEQ ID NO: 1505250 - DNA, 16 bp, Homo sapiens
tcctgtgtggagaggg

SEQ ID NO: 1505251 - DNA, 18 bp, Homo sapiens
tcctgtgtgtactctgtc

SEQ ID NO: 1505252 - DNA, 20 bp, Homo sapiens
tcctgttaacgtcatctcag

SEQ ID NO: 1505253 - DNA, 22 bp, Homo sapiens
tcctgttaacgtcatctcaggg

SEQ ID NO: 1505254 - DNA, 14 bp, Homo sapiens
tcctgttactatgg

SEQ ID NO: 1505255 - DNA, 18 bp, Homo sapiens
tcctgttactctgtccca

SEQ ID NO: 1505256 - DNA, 22 bp, Homo sapiens
tcctgttctgaaaccttagttt

SEQ ID NO: 1505257 - DNA, 14 bp, Homo sapiens
tcctgttctgccca

SEQ ID NO: 1505258 - DNA, 15 bp, Homo sapiens
tcctgttctgcccac

SEQ ID NO: 1505259 - DNA, 23 bp, Homo sapiens
tcctgttctgcgctgtgtacaat

SEQ ID NO: 1505260 - DNA, 13 bp, Homo sapiens
tcctgttgacctt

SEQ ID NO: 1505261 - DNA, 22 bp, Homo sapiens
tcctgttgaccttcccacacaa

SEQ ID NO: 1505262 - DNA, 22 bp, Homo sapiens
tcctgttgctctgtttcttcct

SEQ ID NO: 1505263 - DNA, 23 bp, Homo sapiens
tcctgttgctgtcttcagtctca

SEQ ID NO: 1505264 - DNA, 12 bp, Homo sapiens
tcctgtttcaga

SEQ ID NO: 1505265 - DNA, 13 bp, Homo sapiens
tcctgtttctcat

SEQ ID NO: 1505266 - DNA, 20 bp, Homo sapiens
tcctgttttataatgaaccc

SEQ ID NO: 1505267 - DNA, 15 bp, Homo sapiens
tccttaaacatgaaa

SEQ ID NO: 1505268 - DNA, 15 bp, Homo sapiens
tccttaaactgtgtg

SEQ ID NO: 1505269 - DNA, 23 bp, Homo sapiens
tccttaaactgtgtggactgtga

SEQ ID NO: 1505270 - DNA, 13 bp, Homo sapiens
tccttaacatttc

SEQ ID NO: 1505271 - DNA, 14 bp, Homo sapiens
tccttaacatttct

SEQ ID NO: 1505272 - DNA, 22 bp, Homo sapiens
tccttaacccacctctcctgcc

SEQ ID NO: 1505273 - DNA, 21 bp, Homo sapiens
tccttacaagttagaaaacat

SEQ ID NO: 1505274 - DNA, 21 bp, Homo sapiens
tccttaccaatagcctgaatt

SEQ ID NO: 1505275 - DNA, 22 bp, Homo sapiens
tccttaccaatagcctgaattt

SEQ ID NO: 1505276 - DNA, 14 bp, Homo sapiens
tccttactctgagc

SEQ ID NO: 1505277 - DNA, 15 bp, Homo sapiens
tccttactctgagcc

SEQ ID NO: 1505278 - DNA, 18 bp, Homo sapiens
tccttactctgagcccag

SEQ ID NO: 1505279 - DNA, 18 bp, Homo sapiens
tccttagacctgagggac

SEQ ID NO: 1505280 - DNA, 17 bp, Homo sapiens
tccttagaccttccata

SEQ ID NO: 1505281 - DNA, 19 bp, Homo sapiens
tccttagagacatcaaaat

SEQ ID NO: 1505282 - DNA, 18 bp, Homo sapiens
tccttagcttagacctca

SEQ ID NO: 1505283 - DNA, 20 bp, Homo sapiens
tccttagcttagacctcagc

SEQ ID NO: 1505284 - DNA, 17 bp, Homo sapiens
tccttaggcctctgaga

SEQ ID NO: 1505285 - DNA, 16 bp, Homo sapiens
tccttagttggctgga

SEQ ID NO: 1505286 - DNA, 21 bp, Homo sapiens
tccttatcactgacacaaaaa

SEQ ID NO: 1505287 - DNA, 19 bp, Homo sapiens
tccttatccctctcttccc

SEQ ID NO: 1505288 - DNA, 22 bp, Homo sapiens
tccttatccctctcttcccctt

SEQ ID NO: 1505289 - DNA, 20 bp, Homo sapiens
tccttatgcatgaaatgaat

SEQ ID NO: 1505290 - DNA, 21 bp, Homo sapiens
tccttatgtatcagtgtcctt

SEQ ID NO: 1505291 - DNA, 15 bp, Homo sapiens
tccttatgtcctgtc

SEQ ID NO: 1505292 - DNA, 16 bp, Homo sapiens
tccttatttgccttct

SEQ ID NO: 1505293 - DNA, 20 bp, Homo sapiens
tccttcacaggcagtgcatg

SEQ ID NO: 1505294 - DNA, 14 bp, Homo sapiens
tccttcacatcctg

SEQ ID NO: 1505295 - DNA, 15 bp, Homo sapiens
tccttcaccagagcc

SEQ ID NO: 1505296 - DNA, 18 bp, Homo sapiens
tccttcactcatccagcc

SEQ ID NO: 1505297 - DNA, 19 bp, Homo sapiens
tccttcactggcgccttct

SEQ ID NO: 1505298 - DNA, 13 bp, Homo sapiens
tccttcagccctc

SEQ ID NO: 1505299 - DNA, 21 bp, Homo sapiens
tccttccaggcccccaccact

SEQ ID NO: 1505300 - DNA, 15 bp, Homo sapiens
tccttccatcaaata

SEQ ID NO: 1505301 - DNA, 13 bp, Homo sapiens
tccttccatcttc

SEQ ID NO: 1505302 - DNA, 12 bp, Homo sapiens
tccttcccaggc

SEQ ID NO: 1505303 - DNA, 17 bp, Homo sapiens
tccttcccaggcccttt

SEQ ID NO: 1505304 - DNA, 21 bp, Homo sapiens
tccttcccaggccctttggct

SEQ ID NO: 1505305 - DNA, 23 bp, Homo sapiens
tccttcccatgcctgtctctgtt

SEQ ID NO: 1505306 - DNA, 14 bp, Homo sapiens
tccttcccccagcc

SEQ ID NO: 1505307 - DNA, 17 bp, Homo sapiens
tccttcccccagcccaa

SEQ ID NO: 1505308 - DNA, 14 bp, Homo sapiens
tccttcccctgcac

SEQ ID NO: 1505309 - DNA, 16 bp, Homo sapiens
tccttcccctgcacct

SEQ ID NO: 1505310 - DNA, 17 bp, Homo sapiens
tccttcccctttcccca

SEQ ID NO: 1505311 - DNA, 14 bp, Homo sapiens
tccttccctctcct

SEQ ID NO: 1505312 - DNA, 15 bp, Homo sapiens
tccttccctggcttg

SEQ ID NO: 1505313 - DNA, 15 bp, Homo sapiens
tccttccctgggaag

SEQ ID NO: 1505314 - DNA, 18 bp, Homo sapiens
tccttccctgggaaggct

SEQ ID NO: 1505315 - DNA, 19 bp, Homo sapiens
tccttccctgggctgtgct

SEQ ID NO: 1505316 - DNA, 16 bp, Homo sapiens
tccttcctcctttcct

SEQ ID NO: 1505317 - DNA, 20 bp, Homo sapiens
tccttcctggagcccagagg

SEQ ID NO: 1505318 - DNA, 13 bp, Homo sapiens
tccttcctggcct

SEQ ID NO: 1505319 - DNA, 14 bp, Homo sapiens
tccttcctggcctg

SEQ ID NO: 1505320 - DNA, 13 bp, Homo sapiens
tccttcctgggga

SEQ ID NO: 1505321 - DNA, 15 bp, Homo sapiens
tccttccttcagggt

SEQ ID NO: 1505322 - DNA, 16 bp, Homo sapiens
tccttccttccctggc

SEQ ID NO: 1505323 - DNA, 16 bp, Homo sapiens
tccttccttgaccagc

SEQ ID NO: 1505324 - DNA, 20 bp, Homo sapiens
tccttcgaaaggccttcaga

SEQ ID NO: 1505325 - DNA, 16 bp, Homo sapiens
tccttcgggtgctgga

SEQ ID NO: 1505326 - DNA, 20 bp, Homo sapiens
tccttcgtccccagttgccg

SEQ ID NO: 1505327 - DNA, 19 bp, Homo sapiens
tccttcgtgtctctcccac

SEQ ID NO: 1505328 - DNA, 16 bp, Homo sapiens
tccttctaccccaagg

SEQ ID NO: 1505329 - DNA, 14 bp, Homo sapiens
tccttctgagctcc

SEQ ID NO: 1505330 - DNA, 15 bp, Homo sapiens
tccttctgagctcca

SEQ ID NO: 1505331 - DNA, 19 bp, Homo sapiens
tccttctgagctccacctc

SEQ ID NO: 1505332 - DNA, 23 bp, Homo sapiens
tccttctgagctccacctctggt

SEQ ID NO: 1505333 - DNA, 18 bp, Homo sapiens
tccttgaaaataaaaaga

SEQ ID NO: 1505334 - DNA, 17 bp, Homo sapiens
tccttgagacacggagc

SEQ ID NO: 1505335 - DNA, 16 bp, Homo sapiens
tccttgatctgtatat

SEQ ID NO: 1505336 - DNA, 22 bp, Homo sapiens
tccttgatgccagagggccagc

SEQ ID NO: 1505337 - DNA, 23 bp, Homo sapiens
tccttgatgccagagggccagca

SEQ ID NO: 1505338 - DNA, 20 bp, Homo sapiens
tccttgatgtacagatttta

SEQ ID NO: 1505339 - DNA, 22 bp, Homo sapiens
tccttgatttcaaagttttgtt

SEQ ID NO: 1505340 - DNA, 21 bp, Homo sapiens
tccttgccttaataaatatgt

SEQ ID NO: 1505341 - DNA, 14 bp, Homo sapiens
tccttgccttcttt

SEQ ID NO: 1505342 - DNA, 18 bp, Homo sapiens
tccttgccttctttactc

SEQ ID NO: 1505343 - DNA, 22 bp, Homo sapiens
tctaagatgtgatattctaaga

SEQ ID NO: 1505344 - DNA, 13 bp, Homo sapiens
tctaagattctaa

SEQ ID NO: 1505345 - DNA, 15 bp, Homo sapiens
tctaagattctaaag

SEQ ID NO: 1505346 - DNA, 16 bp, Homo sapiens
tctaagattctaaagg

SEQ ID NO: 1505347 - DNA, 19 bp, Homo sapiens
tctaagattctaaaggtcc

SEQ ID NO: 1505348 - DNA, 15 bp, Homo sapiens
tctaagattctagat

SEQ ID NO: 1505349 - DNA, 12 bp, Homo sapiens
tctaagattctg

SEQ ID NO: 1505350 - DNA, 13 bp, Homo sapiens
tctaagattctga

SEQ ID NO: 1505351 - DNA, 15 bp, Homo sapiens
tctaagcaagatgtt

SEQ ID NO: 1505352 - DNA, 19 bp, Homo sapiens
tctaagcaagatgttttgt

SEQ ID NO: 1505353 - DNA, 23 bp, Homo sapiens
tctaagcaagatgttttgtataa

SEQ ID NO: 1505354 - DNA, 18 bp, Homo sapiens
tctaagcagttttgtaaa

SEQ ID NO: 1505355 - DNA, 20 bp, Homo sapiens
tctaagcagttttgtaaatg

SEQ ID NO: 1505356 - DNA, 21 bp, Homo sapiens
tctaagcagttttgtaaatgt

SEQ ID NO: 1505357 - DNA, 22 bp, Homo sapiens
tctaagcagttttgtaaatgta

SEQ ID NO: 1505358 - DNA, 17 bp, Homo sapiens
tctaagccagttttcat

SEQ ID NO: 1505359 - DNA, 23 bp, Homo sapiens
tctaaggaaatggagaagctctg

SEQ ID NO: 1505360 - DNA, 18 bp, Homo sapiens
tctaaggcctaggattct

SEQ ID NO: 1505361 - DNA, 20 bp, Homo sapiens
tctaaggcctaggattctaa

SEQ ID NO: 1505362 - DNA, 16 bp, Homo sapiens
tctaaggctctgagag

SEQ ID NO: 1505363 - DNA, 17 bp, Homo sapiens
tctaaggctctgagagt

SEQ ID NO: 1505364 - DNA, 20 bp, Homo sapiens
tctaaggctctgagagtcta

SEQ ID NO: 1505365 - DNA, 22 bp, Homo sapiens
tctaaggctctgagagtctaga

SEQ ID NO: 1505366 - DNA, 23 bp, Homo sapiens
tctaaggtccggtgttctaagat

SEQ ID NO: 1505367 - DNA, 18 bp, Homo sapiens
tctaaggttctcatagga

SEQ ID NO: 1505368 - DNA, 15 bp, Homo sapiens
tctaagtaaaaccac

SEQ ID NO: 1505369 - DNA, 21 bp, Homo sapiens
tctaagtaaaaccacagcagt

SEQ ID NO: 1505370 - DNA, 22 bp, Homo sapiens
tctaagtcaaacacttgtgact

SEQ ID NO: 1505371 - DNA, 23 bp, Homo sapiens
tctaagtcagtttcacatatttg

SEQ ID NO: 1505372 - DNA, 18 bp, Homo sapiens
tctaagtgggcattgcca

SEQ ID NO: 1505373 - DNA, 21 bp, Homo sapiens
tctaagtgggcattgccatgt

SEQ ID NO: 1505374 - DNA, 13 bp, Homo sapiens
tctaagtttctaa

SEQ ID NO: 1505375 - DNA, 15 bp, Homo sapiens
tctaagtttctaaga

SEQ ID NO: 1505376 - DNA, 22 bp, Homo sapiens
tctaagtttctaagattctaaa

SEQ ID NO: 1505377 - DNA, 23 bp, Homo sapiens
tctaagtttctaagattctaaag

SEQ ID NO: 1505378 - DNA, 22 bp, Homo sapiens
tctaagttttagggtacatgtg

SEQ ID NO: 1505379 - DNA, 23 bp, Homo sapiens
tctaagttttagggtacatgtgc

SEQ ID NO: 1505380 - DNA, 15 bp, Homo sapiens
tctaataaactttat

SEQ ID NO: 1505381 - DNA, 21 bp, Homo sapiens
tctaataaatatactatgaaa

SEQ ID NO: 1505382 - DNA, 22 bp, Homo sapiens
tctaatagaactcagttttaac

SEQ ID NO: 1505383 - DNA, 18 bp, Homo sapiens
tctaatccttttccttat

SEQ ID NO: 1505384 - DNA, 20 bp, Homo sapiens
tctaatctagatatcgactt

SEQ ID NO: 1505385 - DNA, 13 bp, Homo sapiens
tctaatctcttat

SEQ ID NO: 1505386 - DNA, 17 bp, Homo sapiens
tctaatgaatgttccac

SEQ ID NO: 1505387 - DNA, 18 bp, Homo sapiens
tctaatgatcaaaacatg

SEQ ID NO: 1505388 - DNA, 20 bp, Homo sapiens
tctaatgggtatttaaacaa

SEQ ID NO: 1505389 - DNA, 14 bp, Homo sapiens
tctaatgtctgcag

SEQ ID NO: 1505390 - DNA, 13 bp, Homo sapiens
tctaatgtttgtg

SEQ ID NO: 1505391 - DNA, 15 bp, Homo sapiens
tctaattaattgtaa

SEQ ID NO: 1505392 - DNA, 22 bp, Homo sapiens
tctaattcccattttgcaaaat

SEQ ID NO: 1505393 - DNA, 21 bp, Homo sapiens
tctaattctattaaagtgcta

SEQ ID NO: 1505394 - DNA, 21 bp, Homo sapiens
tctaattgtaagtgaaattaa

SEQ ID NO: 1505395 - DNA, 13 bp, Homo sapiens
tctaatttataaa

SEQ ID NO: 1505396 - DNA, 23 bp, Homo sapiens
tctaatttatcttgtctctgggc

SEQ ID NO: 1505397 - DNA, 19 bp, Homo sapiens
tctaatttcaaaaatataa

SEQ ID NO: 1505398 - DNA, 14 bp, Homo sapiens
tctaatttttaaga

SEQ ID NO: 1505399 - DNA, 17 bp, Homo sapiens
tctacaaaaaaccagga

SEQ ID NO: 1505400 - DNA, 18 bp, Homo sapiens
tctacaaaaagtaaaaat

SEQ ID NO: 1505401 - DNA, 16 bp, Homo sapiens
tctacaactggagttt

SEQ ID NO: 1505402 - DNA, 15 bp, Homo sapiens
tctacaaggactcca

SEQ ID NO: 1505403 - DNA, 22 bp, Homo sapiens
tctacaaggactccattggatc

SEQ ID NO: 1505404 - DNA, 13 bp, Homo sapiens
tctacacagcctg

SEQ ID NO: 1505405 - DNA, 16 bp, Homo sapiens
tctacacagcctggac

SEQ ID NO: 1505406 - DNA, 16 bp, Homo sapiens
tctacacagtaaaaac

SEQ ID NO: 1505407 - DNA, 18 bp, Homo sapiens
tctacacagtaaaaactt

SEQ ID NO: 1505408 - DNA, 12 bp, Homo sapiens
tctacacatgtt

SEQ ID NO: 1505409 - DNA, 17 bp, Homo sapiens
tctacacatgttgcctt

SEQ ID NO: 1505410 - DNA, 15 bp, Homo sapiens
tctacaccaatgaaa

SEQ ID NO: 1505411 - DNA, 21 bp, Homo sapiens
tctacaccaatgaaaacatgt

SEQ ID NO: 1505412 - DNA, 18 bp, Homo sapiens
tctacagacttctccaga

SEQ ID NO: 1505413 - DNA, 19 bp, Homo sapiens
tctacagccttgtccccct

SEQ ID NO: 1505414 - DNA, 17 bp, Homo sapiens
tctacagtacttccaga

SEQ ID NO: 1505415 - DNA, 18 bp, Homo sapiens
tctacagtacttccagat

SEQ ID NO: 1505416 - DNA, 22 bp, Homo sapiens
tctacagtggttttatactgaa

SEQ ID NO: 1505417 - DNA, 23 bp, Homo sapiens
tctacagtggttttatactgaag

SEQ ID NO: 1505418 - DNA, 16 bp, Homo sapiens
tctacatactatggaa

SEQ ID NO: 1505419 - DNA, 21 bp, Homo sapiens
tctacatgaggaactgtagat

SEQ ID NO: 1505420 - DNA, 20 bp, Homo sapiens
tctacatgtgccaccaacat

SEQ ID NO: 1505421 - DNA, 23 bp, Homo sapiens
tctacatttcacctactttgtaa

SEQ ID NO: 1505422 - DNA, 22 bp, Homo sapiens
tctacatttgcagatgttcaaa

SEQ ID NO: 1505423 - DNA, 13 bp, Homo sapiens
tctacatttgttt

SEQ ID NO: 1505424 - DNA, 16 bp, Homo sapiens
tctacatttgtttgta

SEQ ID NO: 1505425 - DNA, 18 bp, Homo sapiens
tctacatttgtttgtatt

SEQ ID NO: 1505426 - DNA, 23 bp, Homo sapiens
tctaccagattctgcctatgtaa

SEQ ID NO: 1505427 - DNA, 19 bp, Homo sapiens
tctaccagtggtgctcaat

SEQ ID NO: 1505428 - DNA, 16 bp, Homo sapiens
tctaccccaaggccag

SEQ ID NO: 1505429 - DNA, 16 bp, Homo sapiens
tctaccccagactaga

SEQ ID NO: 1505430 - DNA, 18 bp, Homo sapiens
tctaccctcccaccccct

SEQ ID NO: 1505431 - DNA, 17 bp, Homo sapiens
tctagaacacaggcaaa

SEQ ID NO: 1505432 - DNA, 21 bp, Homo sapiens
tctagaagactgtcagcttcc

SEQ ID NO: 1505433 - DNA, 18 bp, Homo sapiens
tctagaagatgtgtaaac

SEQ ID NO: 1505434 - DNA, 22 bp, Homo sapiens
tctagaagatgtgtaaacaggt

SEQ ID NO: 1505435 - DNA, 17 bp, Homo sapiens
tctagaagccaagggaa

SEQ ID NO: 1505436 - DNA, 20 bp, Homo sapiens
tctagaagccaagggaaagg

SEQ ID NO: 1505437 - DNA, 21 bp, Homo sapiens
tctagaatattatgttcctca

SEQ ID NO: 1505438 - DNA, 18 bp, Homo sapiens
tctagaatcccagcagca

SEQ ID NO: 1505439 - DNA, 20 bp, Homo sapiens
tctagaatcccagcagcaga

SEQ ID NO: 1505440 - DNA, 18 bp, Homo sapiens
tctagaatgtaaagttat

SEQ ID NO: 1505441 - DNA, 16 bp, Homo sapiens
tctagaatgtggattt

SEQ ID NO: 1505442 - DNA, 17 bp, Homo sapiens
tctagacaagatattgt

SEQ ID NO: 1505443 - DNA, 18 bp, Homo sapiens
tctagacaagatattgta

SEQ ID NO: 1505444 - DNA, 14 bp, Homo sapiens
tctagacactgcca

SEQ ID NO: 1505445 - DNA, 19 bp, Homo sapiens
tctagacatggaggttcta

SEQ ID NO: 1505446 - DNA, 13 bp, Homo sapiens
tctagagacacat

SEQ ID NO: 1505447 - DNA, 22 bp, Homo sapiens
tctagagagccttaacttctta

SEQ ID NO: 1505448 - DNA, 19 bp, Homo sapiens
tctagaggcaagcctggcc

SEQ ID NO: 1505449 - DNA, 14 bp, Homo sapiens
tctagaggcctcag

SEQ ID NO: 1505450 - DNA, 13 bp, Homo sapiens
tctagagtccaag

SEQ ID NO: 1505451 - DNA, 20 bp, Homo sapiens
tctagagtccaaggtttaaa

SEQ ID NO: 1505452 - DNA, 18 bp, Homo sapiens
tctagagttcagagtcct

SEQ ID NO: 1505453 - DNA, 20 bp, Homo sapiens
tctagatcagatgctccaag

SEQ ID NO: 1505454 - DNA, 22 bp, Homo sapiens
tctagatcctgcaccccagcat

SEQ ID NO: 1505455 - DNA, 22 bp, Homo sapiens
tctagatgattttttgaaagtt

SEQ ID NO: 1505456 - DNA, 22 bp, Homo sapiens
tctagatgtttattcttctaga

SEQ ID NO: 1505457 - DNA, 23 bp, Homo sapiens
tctagatgtttattcttctagag

SEQ ID NO: 1505458 - DNA, 23 bp, Homo sapiens
tctagattaccccctcattgttt

SEQ ID NO: 1505459 - DNA, 13 bp, Homo sapiens
tctagattcaaag

SEQ ID NO: 1505460 - DNA, 17 bp, Homo sapiens
tctagattcaaaggttc

SEQ ID NO: 1505461 - DNA, 19 bp, Homo sapiens
tctagattcaaaggttcta

SEQ ID NO: 1505462 - DNA, 20 bp, Homo sapiens
tctagattcaaaggttctag

SEQ ID NO: 1505463 - DNA, 23 bp, Homo sapiens
tctagattcaaaggttctaggtt

SEQ ID NO: 1505464 - DNA, 13 bp, Homo sapiens
tctagattcataa

SEQ ID NO: 1505465 - DNA, 20 bp, Homo sapiens
tctagattcataaatacaaa

SEQ ID NO: 1505466 - DNA, 19 bp, Homo sapiens
tctagattccattggtcca

SEQ ID NO: 1505467 - DNA, 15 bp, Homo sapiens
tctagcaaatgttat

SEQ ID NO: 1505468 - DNA, 14 bp, Homo sapiens
tctagcaagaagat

SEQ ID NO: 1505469 - DNA, 17 bp, Homo sapiens
tctagcaagaagattct

SEQ ID NO: 1505470 - DNA, 19 bp, Homo sapiens
tctagcaagaagattctaa

SEQ ID NO: 1505471 - DNA, 21 bp, Homo sapiens
tctagcaagaagattctaaaa

SEQ ID NO: 1505472 - DNA, 19 bp, Homo sapiens
tctagcaagatagtcttca

SEQ ID NO: 1505473 - DNA, 18 bp, Homo sapiens
tctagcaattttctttgt

SEQ ID NO: 1505474 - DNA, 22 bp, Homo sapiens
tctagcaattttctttgtttct

SEQ ID NO: 1505475 - DNA, 16 bp, Homo sapiens
tctagcatcctcttaa

SEQ ID NO: 1505476 - DNA, 23 bp, Homo sapiens
tctagcatggcatatttttcaca

SEQ ID NO: 1505477 - DNA, 15 bp, Homo sapiens
tctagcccactccct

SEQ ID NO: 1505478 - DNA, 16 bp, Homo sapiens
tctagccgatggaaaa

SEQ ID NO: 1505479 - DNA, 22 bp, Homo sapiens
tctagcctggcaacagagcgag

SEQ ID NO: 1505480 - DNA, 15 bp, Homo sapiens
tctagcgcaaggcac

SEQ ID NO: 1505481 - DNA, 18 bp, Homo sapiens
tctagctgtatgatttgt

SEQ ID NO: 1505482 - DNA, 11 bp, Homo sapiens
tctagctgttg

SEQ ID NO: 1505483 - DNA, 18 bp, Homo sapiens
tctagctgttgagctgtt

SEQ ID NO: 1505484 - DNA, 16 bp, Homo sapiens
tctaggactgcagtgt

SEQ ID NO: 1505485 - DNA, 16 bp, Homo sapiens
tctaggagacagagcc

SEQ ID NO: 1505486 - DNA, 17 bp, Homo sapiens
tctaggagacagagcca

SEQ ID NO: 1505487 - DNA, 17 bp, Homo sapiens
tctaggagctgggagga

SEQ ID NO: 1505488 - DNA, 18 bp, Homo sapiens
tctaggagctgggaggaa

SEQ ID NO: 1505489 - DNA, 16 bp, Homo sapiens
tctaggattgggcctc

SEQ ID NO: 1505490 - DNA, 13 bp, Homo sapiens
tctaggctgcccc

SEQ ID NO: 1505491 - DNA, 17 bp, Homo sapiens
tctagggaaatgaaaga

SEQ ID NO: 1505492 - DNA, 23 bp, Homo sapiens
tctagggactgccaggctgtttc

SEQ ID NO: 1505493 - DNA, 21 bp, Homo sapiens
tctaggtacgatgacagtgtt

SEQ ID NO: 1505494 - DNA, 14 bp, Homo sapiens
tctaggtctcctca

SEQ ID NO: 1505495 - DNA, 16 bp, Homo sapiens
tctaggtctcctcagg

SEQ ID NO: 1505496 - DNA, 15 bp, Homo sapiens
tctaggtgtggctgt

SEQ ID NO: 1505497 - DNA, 14 bp, Homo sapiens
tctaggttctaaaa

SEQ ID NO: 1505498 - DNA, 23 bp, Homo sapiens
tctaggttctaaaaattgtgatc

SEQ ID NO: 1505499 - DNA, 17 bp, Homo sapiens
tctaggtttcaaagatg

SEQ ID NO: 1505500 - DNA, 20 bp, Homo sapiens
tctaggtttcaaagatgctg

SEQ ID NO: 1505501 - DNA, 16 bp, Homo sapiens
tctaggtttcagcaac

SEQ ID NO: 1505502 - DNA, 19 bp, Homo sapiens
tctagtaagatgcactgaa

SEQ ID NO: 1505503 - DNA, 17 bp, Homo sapiens
tctagtacttgaaaaag

SEQ ID NO: 1505504 - DNA, 22 bp, Homo sapiens
tctagtacttgggagacctgta

SEQ ID NO: 1505505 - DNA, 17 bp, Homo sapiens
tctagtatgaaattata

SEQ ID NO: 1505506 - DNA, 22 bp, Homo sapiens
tctagtatttatgggtggattt

SEQ ID NO: 1505507 - DNA, 15 bp, Homo sapiens
tctagtattttatct

SEQ ID NO: 1505508 - DNA, 21 bp, Homo sapiens
tctagtattttatctggaaca

SEQ ID NO: 1505509 - DNA, 18 bp, Homo sapiens
tctagtcaactgctgttt

SEQ ID NO: 1505510 - DNA, 19 bp, Homo sapiens
tctagtcacaaagactcct

SEQ ID NO: 1505511 - DNA, 15 bp, Homo sapiens
tctagtcacataaat

SEQ ID NO: 1505512 - DNA, 14 bp, Homo sapiens
tctagtccttgtct

SEQ ID NO: 1505513 - DNA, 20 bp, Homo sapiens
tctagtctcctttgcactga

SEQ ID NO: 1505514 - DNA, 18 bp, Homo sapiens
tctagtgaggaagacaag

SEQ ID NO: 1505515 - DNA, 23 bp, Homo sapiens
tctgccccagtagtcagaagcag

SEQ ID NO: 1505516 - DNA, 23 bp, Homo sapiens
tctgcccccgcgggttctagacg

SEQ ID NO: 1505517 - DNA, 23 bp, Homo sapiens
tctgccccctcccccatgggctg

SEQ ID NO: 1505518 - DNA, 19 bp, Homo sapiens
tctgccctatggatttgaa

SEQ ID NO: 1505519 - DNA, 18 bp, Homo sapiens
tctgccctccctccttcc

SEQ ID NO: 1505520 - DNA, 14 bp, Homo sapiens
tctgccctctgctg

SEQ ID NO: 1505521 - DNA, 15 bp, Homo sapiens
tctgccctctgctgc

SEQ ID NO: 1505522 - DNA, 18 bp, Homo sapiens
tctgccctgccctagctc

SEQ ID NO: 1505523 - DNA, 13 bp, Homo sapiens
tctgccctgcctg

SEQ ID NO: 1505524 - DNA, 18 bp, Homo sapiens
tctgccctgcctgaggag

SEQ ID NO: 1505525 - DNA, 15 bp, Homo sapiens
tctgccctggctgct

SEQ ID NO: 1505526 - DNA, 15 bp, Homo sapiens
tctgccctgtgtact

SEQ ID NO: 1505527 - DNA, 18 bp, Homo sapiens
tctgccgccccctcctga

SEQ ID NO: 1505528 - DNA, 18 bp, Homo sapiens
tctgccggtcccccatgc

SEQ ID NO: 1505529 - DNA, 16 bp, Homo sapiens
tctgcctaacttgtaa

SEQ ID NO: 1505530 - DNA, 14 bp, Homo sapiens
tctgcctaggagct

SEQ ID NO: 1505531 - DNA, 21 bp, Homo sapiens
tctgcctaggagctggctggc

SEQ ID NO: 1505532 - DNA, 16 bp, Homo sapiens
tctgcctcagcctcct

SEQ ID NO: 1505533 - DNA, 12 bp, Homo sapiens
tctgcctcccta

SEQ ID NO: 1505534 - DNA, 13 bp, Homo sapiens
tctgcctccctct

SEQ ID NO: 1505535 - DNA, 9 bp, Homo sapiens
tctgcctgc

SEQ ID NO: 1505536 - DNA, 12 bp, Homo sapiens
tctgcctgcccc

SEQ ID NO: 1505537 - DNA, 14 bp, Homo sapiens
tctgcctgccccgc

SEQ ID NO: 1505538 - DNA, 18 bp, Homo sapiens
tctgcctgctggggatta

SEQ ID NO: 1505539 - DNA, 12 bp, Homo sapiens
tctgcctggagt

SEQ ID NO: 1505540 - DNA, 21 bp, Homo sapiens
tctgcctggagtgtatgactg

SEQ ID NO: 1505541 - DNA, 17 bp, Homo sapiens
tctgcctggcctggctc

SEQ ID NO: 1505542 - DNA, 18 bp, Homo sapiens
tctgcctggcctggctcc

SEQ ID NO: 1505543 - DNA, 10 bp, Homo sapiens
tctgcctggg

SEQ ID NO: 1505544 - DNA, 14 bp, Homo sapiens
tctgcctgggatgg

SEQ ID NO: 1505545 - DNA, 13 bp, Homo sapiens
tctgcctgggcct

SEQ ID NO: 1505546 - DNA, 17 bp, Homo sapiens
tctgcctgggcctgtgc

SEQ ID NO: 1505547 - DNA, 20 bp, Homo sapiens
tctgcctgggcctgtgcagc

SEQ ID NO: 1505548 - DNA, 21 bp, Homo sapiens
tctgcctgggcctgtgcagca

SEQ ID NO: 1505549 - DNA, 13 bp, Homo sapiens
tctgcctgtattt

SEQ ID NO: 1505550 - DNA, 14 bp, Homo sapiens
tctgcctgtggcct

SEQ ID NO: 1505551 - DNA, 19 bp, Homo sapiens
tctgcctgtggccttgccc

SEQ ID NO: 1505552 - DNA, 21 bp, Homo sapiens
tctgcctgttataactctgca

SEQ ID NO: 1505553 - DNA, 21 bp, Homo sapiens
tctgccttcacaaatgtcatt

SEQ ID NO: 1505554 - DNA, 12 bp, Homo sapiens
tctgccttctca

SEQ ID NO: 1505555 - DNA, 18 bp, Homo sapiens
tctgccttctcaggcccc

SEQ ID NO: 1505556 - DNA, 23 bp, Homo sapiens
tctgccttctcaggccccgggct

SEQ ID NO: 1505557 - DNA, 20 bp, Homo sapiens
tctgcctttaattttcttgt

SEQ ID NO: 1505558 - DNA, 13 bp, Homo sapiens
tctgcctttgctc

SEQ ID NO: 1505559 - DNA, 22 bp, Homo sapiens
tctgcctttggggacttttctt

SEQ ID NO: 1505560 - DNA, 15 bp, Homo sapiens
tctgcgccaggcaga

SEQ ID NO: 1505561 - DNA, 13 bp, Homo sapiens
tctgcgcccttgt

SEQ ID NO: 1505562 - DNA, 22 bp, Homo sapiens
tctgcgctgaggcccagcccct

SEQ ID NO: 1505563 - DNA, 23 bp, Homo sapiens
tctgcgcttggtctttctgtgct

SEQ ID NO: 1505564 - DNA, 14 bp, Homo sapiens
tctgcggcagagtc

SEQ ID NO: 1505565 - DNA, 22 bp, Homo sapiens
tctgcgtggttcctttctcagc

SEQ ID NO: 1505566 - DNA, 18 bp, Homo sapiens
tctgctaaatatcaccta

SEQ ID NO: 1505567 - DNA, 15 bp, Homo sapiens
tctgctaaatttcaa

SEQ ID NO: 1505568 - DNA, 17 bp, Homo sapiens
tctggccaccctggccc

SEQ ID NO: 1505569 - DNA, 21 bp, Homo sapiens
tctggccagtgtttaaaactt

SEQ ID NO: 1505570 - DNA, 16 bp, Homo sapiens
tctggcccaccagggt

SEQ ID NO: 1505571 - DNA, 13 bp, Homo sapiens
tctggccccaggc

SEQ ID NO: 1505572 - DNA, 14 bp, Homo sapiens
tctggccctgcctt

SEQ ID NO: 1505573 - DNA, 15 bp, Homo sapiens
tctggccctggccct

SEQ ID NO: 1505574 - DNA, 12 bp, Homo sapiens
tctggccctggg

SEQ ID NO: 1505575 - DNA, 15 bp, Homo sapiens
tctggccgccacccc

SEQ ID NO: 1505576 - DNA, 20 bp, Homo sapiens
tctggccggtgctgggttcc

SEQ ID NO: 1505577 - DNA, 14 bp, Homo sapiens
tctggcctcccacc

SEQ ID NO: 1505578 - DNA, 23 bp, Homo sapiens
tctggcctcccacccgatgctgc

SEQ ID NO: 1505579 - DNA, 18 bp, Homo sapiens
tctggcggaggtctctgg

SEQ ID NO: 1505580 - DNA, 20 bp, Homo sapiens
tctggcgttctcaagaatct

SEQ ID NO: 1505581 - DNA, 16 bp, Homo sapiens
tctggctagaggccag

SEQ ID NO: 1505582 - DNA, 22 bp, Homo sapiens
tctggctagaggccagccccac

SEQ ID NO: 1505583 - DNA, 17 bp, Homo sapiens
tctggctccaggcagaa

SEQ ID NO: 1505584 - DNA, 13 bp, Homo sapiens
tctggctccctgc

SEQ ID NO: 1505585 - DNA, 21 bp, Homo sapiens
tctggctcggacccaccccaa

SEQ ID NO: 1505586 - DNA, 12 bp, Homo sapiens
tctggctctaat

SEQ ID NO: 1505587 - DNA, 22 bp, Homo sapiens
tctggctctaattcacagtgct

SEQ ID NO: 1505588 - DNA, 14 bp, Homo sapiens
tctggctgaaccct

SEQ ID NO: 1505589 - DNA, 17 bp, Homo sapiens
tctggctgaaccctgtg

SEQ ID NO: 1505590 - DNA, 13 bp, Homo sapiens
tctggctgagccc

SEQ ID NO: 1505591 - DNA, 14 bp, Homo sapiens
tctggctgggtcac

SEQ ID NO: 1505592 - DNA, 21 bp, Homo sapiens
tctggctgtaaggctctagat

SEQ ID NO: 1505593 - DNA, 14 bp, Homo sapiens
tctggctgtctaga

SEQ ID NO: 1505594 - DNA, 19 bp, Homo sapiens
tctggctgtctagaatgtg

SEQ ID NO: 1505595 - DNA, 22 bp, Homo sapiens
tctggcttagtgccacccacct

SEQ ID NO: 1505596 - DNA, 15 bp, Homo sapiens
tctggcttcagcccc

SEQ ID NO: 1505597 - DNA, 21 bp, Homo sapiens
tctggcttcagcccccaccag

SEQ ID NO: 1505598 - DNA, 22 bp, Homo sapiens
tctggcttcagcccccaccagg

SEQ ID NO: 1505599 - DNA, 12 bp, Homo sapiens
tctggcttccct

SEQ ID NO: 1505600 - DNA, 13 bp, Homo sapiens
tctggcttctctc

SEQ ID NO: 1505601 - DNA, 20 bp, Homo sapiens
tctggcttctctcttttcct

SEQ ID NO: 1505602 - DNA, 22 bp, Homo sapiens
tctggcttctctcttttcctcc

SEQ ID NO: 1505603 - DNA, 14 bp, Homo sapiens
tctggcttgactgg

SEQ ID NO: 1505604 - DNA, 22 bp, Homo sapiens
tctggcttgggcagggtctgtt

SEQ ID NO: 1505605 - DNA, 18 bp, Homo sapiens
tctggctttttctgccac

SEQ ID NO: 1505606 - DNA, 20 bp, Homo sapiens
tctgggaagggagagggcct

SEQ ID NO: 1505607 - DNA, 15 bp, Homo sapiens
tctgggaccctttcc

SEQ ID NO: 1505608 - DNA, 13 bp, Homo sapiens
tctgggacctcag

SEQ ID NO: 1505609 - DNA, 14 bp, Homo sapiens
tctgggacgtggac

SEQ ID NO: 1505610 - DNA, 21 bp, Homo sapiens
tctgggacttggtttccccaa

SEQ ID NO: 1505611 - DNA, 13 bp, Homo sapiens
tctgggagaaaat

SEQ ID NO: 1505612 - DNA, 22 bp, Homo sapiens
tctgggagaaaatcatcaagaa

SEQ ID NO: 1505613 - DNA, 14 bp, Homo sapiens
tctgggagcccaga

SEQ ID NO: 1505614 - DNA, 15 bp, Homo sapiens
tctgggagcccagaa

SEQ ID NO: 1505615 - DNA, 20 bp, Homo sapiens
tctgggagctgcgccggaca

SEQ ID NO: 1505616 - DNA, 20 bp, Homo sapiens
tctgggaggcaagaaaagga

SEQ ID NO: 1505617 - DNA, 16 bp, Homo sapiens
tctgggagtcacacag

SEQ ID NO: 1505618 - DNA, 18 bp, Homo sapiens
tctgggagtcacacagtg

SEQ ID NO: 1505619 - DNA, 17 bp, Homo sapiens
tctgggattaagggcaa

SEQ ID NO: 1505620 - DNA, 12 bp, Homo sapiens
tctgggcacagt

SEQ ID NO: 1505621 - DNA, 16 bp, Homo sapiens
tctgggcacagtgggc

SEQ ID NO: 1505622 - DNA, 19 bp, Homo sapiens
tctgggccaagttcctcta

SEQ ID NO: 1505623 - DNA, 18 bp, Homo sapiens
tctgggccccctcctccc

SEQ ID NO: 1505624 - DNA, 12 bp, Homo sapiens
tctgggcctctg

SEQ ID NO: 1505625 - DNA, 12 bp, Homo sapiens
tctgggcctgac

SEQ ID NO: 1505626 - DNA, 14 bp, Homo sapiens
tctgggcctgaggg

SEQ ID NO: 1505627 - DNA, 22 bp, Homo sapiens
tctgggctcctggaaccaatcc

SEQ ID NO: 1505628 - DNA, 17 bp, Homo sapiens
tctgggctgctacccag

SEQ ID NO: 1505629 - DNA, 14 bp, Homo sapiens
tctgggctgtgggc

SEQ ID NO: 1505630 - DNA, 22 bp, Homo sapiens
tctggggagagcggctggagaa

SEQ ID NO: 1505631 - DNA, 17 bp, Homo sapiens
tctggggatttctggga

SEQ ID NO: 1505632 - DNA, 18 bp, Homo sapiens
tctggggatttctgggat

SEQ ID NO: 1505633 - DNA, 16 bp, Homo sapiens
tctggggctctgggat

SEQ ID NO: 1505634 - DNA, 13 bp, Homo sapiens
tctggggctgtgt

SEQ ID NO: 1505635 - DNA, 15 bp, Homo sapiens
tctggggctgtgtta

SEQ ID NO: 1505636 - DNA, 19 bp, Homo sapiens
tctggggggacccagtgca

SEQ ID NO: 1505637 - DNA, 20 bp, Homo sapiens
tctggggggacccagtgcag

SEQ ID NO: 1505638 - DNA, 21 bp, Homo sapiens
tctgtgacgcagacagagggg

SEQ ID NO: 1505639 - DNA, 14 bp, Homo sapiens
tctgtgactggatc

SEQ ID NO: 1505640 - DNA, 15 bp, Homo sapiens
tctgtgactggatct

SEQ ID NO: 1505641 - DNA, 18 bp, Homo sapiens
tctgtgacttatctacca

SEQ ID NO: 1505642 - DNA, 17 bp, Homo sapiens
tctgtgagactcgagaa

SEQ ID NO: 1505643 - DNA, 18 bp, Homo sapiens
tctgtgaggtgctgatga

SEQ ID NO: 1505644 - DNA, 18 bp, Homo sapiens
tctgtgatccttggtgct

SEQ ID NO: 1505645 - DNA, 22 bp, Homo sapiens
tctgtgatccttggtgctgtgt

SEQ ID NO: 1505646 - DNA, 15 bp, Homo sapiens
tctgtgattggctgg

SEQ ID NO: 1505647 - DNA, 16 bp, Homo sapiens
tctgtgattgggtggg

SEQ ID NO: 1505648 - DNA, 22 bp, Homo sapiens
tctgtgccccatgcctgtccag

SEQ ID NO: 1505649 - DNA, 20 bp, Homo sapiens
tctgtgcctccctccccagt

SEQ ID NO: 1505650 - DNA, 16 bp, Homo sapiens
tctgtgcctgcactga

SEQ ID NO: 1505651 - DNA, 18 bp, Homo sapiens
tctgtgcctgcactgaga

SEQ ID NO: 1505652 - DNA, 16 bp, Homo sapiens
tctgtgccttcgtctt

SEQ ID NO: 1505653 - DNA, 22 bp, Homo sapiens
tctgtgctagggaaacttcccg

SEQ ID NO: 1505654 - DNA, 19 bp, Homo sapiens
tctgtgctcatcggagact

SEQ ID NO: 1505655 - DNA, 17 bp, Homo sapiens
tctgtgctgtgcctgct

SEQ ID NO: 1505656 - DNA, 12 bp, Homo sapiens
tctgtgcttgga

SEQ ID NO: 1505657 - DNA, 17 bp, Homo sapiens
tctgtggagctgccaca

SEQ ID NO: 1505658 - DNA, 18 bp, Homo sapiens
tctgtggagctgccacag

SEQ ID NO: 1505659 - DNA, 16 bp, Homo sapiens
tctgtggattctatat

SEQ ID NO: 1505660 - DNA, 12 bp, Homo sapiens
tctgtggcctgt

SEQ ID NO: 1505661 - DNA, 22 bp, Homo sapiens
tctgtggctttttgttcagaat

SEQ ID NO: 1505662 - DNA, 17 bp, Homo sapiens
tctgtgggtctctggaa

SEQ ID NO: 1505663 - DNA, 17 bp, Homo sapiens
tctgtggttcctctgct

SEQ ID NO: 1505664 - DNA, 20 bp, Homo sapiens
tctgtggttcctctgctcac

SEQ ID NO: 1505665 - DNA, 20 bp, Homo sapiens
tctgtggttttcccctccct

SEQ ID NO: 1505666 - DNA, 22 bp, Homo sapiens
tctgtggttttcccctccctgg

SEQ ID NO: 1505667 - DNA, 21 bp, Homo sapiens
tctgtgtaacatccaagccag

SEQ ID NO: 1505668 - DNA, 22 bp, Homo sapiens
tctgtgtaacatccaagccaga

SEQ ID NO: 1505669 - DNA, 23 bp, Homo sapiens
tctgtgtaacatccaagccagag

SEQ ID NO: 1505670 - DNA, 17 bp, Homo sapiens
tctgtgtaatctctgat

SEQ ID NO: 1505671 - DNA, 15 bp, Homo sapiens
tctgtgtagccgccc

SEQ ID NO: 1505672 - DNA, 17 bp, Homo sapiens
tctgtgtagccgccctg

SEQ ID NO: 1505673 - DNA, 18 bp, Homo sapiens
tctgtgtagccgccctga

SEQ ID NO: 1505674 - DNA, 20 bp, Homo sapiens
tctgtgtagccgccctgaga

SEQ ID NO: 1505675 - DNA, 23 bp, Homo sapiens
tctgtgtcaaggtgaagcacata

SEQ ID NO: 1505676 - DNA, 17 bp, Homo sapiens
tcttaaaccatttttgc

SEQ ID NO: 1505677 - DNA, 19 bp, Homo sapiens
tcttaaaccatttttgctg

SEQ ID NO: 1505678 - DNA, 12 bp, Homo sapiens
tcttaaactaaa

SEQ ID NO: 1505679 - DNA, 18 bp, Homo sapiens
tcttaaagaaacagcttt

SEQ ID NO: 1505680 - DNA, 22 bp, Homo sapiens
tcttaaagaaacagctttcaag

SEQ ID NO: 1505681 - DNA, 22 bp, Homo sapiens
tcttaaagcaaagtcacttctc

SEQ ID NO: 1505682 - DNA, 15 bp, Homo sapiens
tcttaaaggcctgga

SEQ ID NO: 1505683 - DNA, 21 bp, Homo sapiens
tcttaaatgcaagtgcctaga

SEQ ID NO: 1505684 - DNA, 22 bp, Homo sapiens
tcttaaatgctcattttctggt

SEQ ID NO: 1505685 - DNA, 23 bp, Homo sapiens
tcttaaatggaattattttgaat

SEQ ID NO: 1505686 - DNA, 14 bp, Homo sapiens
tcttaaattcattt

SEQ ID NO: 1505687 - DNA, 22 bp, Homo sapiens
tcttaaattcatttctagactc

SEQ ID NO: 1505688 - DNA, 22 bp, Homo sapiens
tcttaacaaaccaacatctttg

SEQ ID NO: 1505689 - DNA, 15 bp, Homo sapiens
tcttaacaaactctt

SEQ ID NO: 1505690 - DNA, 12 bp, Homo sapiens
tcttaacttctt

SEQ ID NO: 1505691 - DNA, 16 bp, Homo sapiens
tcttaagattaatttt

SEQ ID NO: 1505692 - DNA, 15 bp, Homo sapiens
tcttaagcagcatgg

SEQ ID NO: 1505693 - DNA, 21 bp, Homo sapiens
tcttaagcagcatggaaaaat

SEQ ID NO: 1505694 - DNA, 21 bp, Homo sapiens
tcttaagcaggtttgttttca

SEQ ID NO: 1505695 - DNA, 12 bp, Homo sapiens
tcttaagggcac

SEQ ID NO: 1505696 - DNA, 22 bp, Homo sapiens
tcttaagtgcccacatttgatg

SEQ ID NO: 1505697 - DNA, 14 bp, Homo sapiens
tcttaagtgtttct

SEQ ID NO: 1505698 - DNA, 17 bp, Homo sapiens
tcttaagtgtttctcaa

SEQ ID NO: 1505699 - DNA, 21 bp, Homo sapiens
tcttaagtgtttctcaaaaga

SEQ ID NO: 1505700 - DNA, 14 bp, Homo sapiens
tcttaatcattttt

SEQ ID NO: 1505701 - DNA, 14 bp, Homo sapiens
tcttaattaaaaga

SEQ ID NO: 1505702 - DNA, 21 bp, Homo sapiens
tcttaattaaaagaatatttt

SEQ ID NO: 1505703 - DNA, 20 bp, Homo sapiens
tcttaattattatttgtgtt

SEQ ID NO: 1505704 - DNA, 17 bp, Homo sapiens
tcttaattctttgttct

SEQ ID NO: 1505705 - DNA, 16 bp, Homo sapiens
tcttacaaaagctttg

SEQ ID NO: 1505706 - DNA, 21 bp, Homo sapiens
tcttacaattgcactgctgtt

SEQ ID NO: 1505707 - DNA, 14 bp, Homo sapiens
tcttacagagcctt

SEQ ID NO: 1505708 - DNA, 19 bp, Homo sapiens
tcttacagcacatcacctc

SEQ ID NO: 1505709 - DNA, 14 bp, Homo sapiens
tcttacatgttttc

SEQ ID NO: 1505710 - DNA, 12 bp, Homo sapiens
tcttcagctgca

SEQ ID NO: 1505711 - DNA, 20 bp, Homo sapiens
tcttcagcttgtgcacaatt

SEQ ID NO: 1505712 - DNA, 16 bp, Homo sapiens
tcttcaggaggccctg

SEQ ID NO: 1505713 - DNA, 16 bp, Homo sapiens
tcttcaggtggaaaaa

SEQ ID NO: 1505714 - DNA, 14 bp, Homo sapiens
tcttcagtctcaca

SEQ ID NO: 1505715 - DNA, 20 bp, Homo sapiens
tcttcagtctcacagagaag

SEQ ID NO: 1505716 - DNA, 16 bp, Homo sapiens
tcttcagtgactcctg

SEQ ID NO: 1505717 - DNA, 19 bp, Homo sapiens
tcttcagtgtaatgtgact

SEQ ID NO: 1505718 - DNA, 13 bp, Homo sapiens
tcttcagttaatt

SEQ ID NO: 1505719 - DNA, 15 bp, Homo sapiens
tcttcagttaattct

SEQ ID NO: 1505720 - DNA, 18 bp, Homo sapiens
tcttcatccggcagcctg

SEQ ID NO: 1505721 - DNA, 20 bp, Homo sapiens
tcttcatccggcagcctgga

SEQ ID NO: 1505722 - DNA, 14 bp, Homo sapiens
tcttcatgcaatga

SEQ ID NO: 1505723 - DNA, 15 bp, Homo sapiens
tcttcattccattga

SEQ ID NO: 1505724 - DNA, 14 bp, Homo sapiens
tcttcatttctctg

SEQ ID NO: 1505725 - DNA, 20 bp, Homo sapiens
tcttccaaagtaaaattgct

SEQ ID NO: 1505726 - DNA, 22 bp, Homo sapiens
tcttccaaccatttatcttgaa

SEQ ID NO: 1505727 - DNA, 20 bp, Homo sapiens
tcttccacagcacaaacaca

SEQ ID NO: 1505728 - DNA, 14 bp, Homo sapiens
tcttccacctgtgc

SEQ ID NO: 1505729 - DNA, 18 bp, Homo sapiens
tcttccagtcttcctgac

SEQ ID NO: 1505730 - DNA, 21 bp, Homo sapiens
tcttccatcatcactgtaaag

SEQ ID NO: 1505731 - DNA, 15 bp, Homo sapiens
tcttccatgctgtgc

SEQ ID NO: 1505732 - DNA, 17 bp, Homo sapiens
tcttccatgctgtgcgc

SEQ ID NO: 1505733 - DNA, 12 bp, Homo sapiens
tcttcccacagg

SEQ ID NO: 1505734 - DNA, 14 bp, Homo sapiens
tcttcccacaggag

SEQ ID NO: 1505735 - DNA, 18 bp, Homo sapiens
tcttcccagaatctctga

SEQ ID NO: 1505736 - DNA, 19 bp, Homo sapiens
tcttccccactccccacct

SEQ ID NO: 1505737 - DNA, 20 bp, Homo sapiens
tcttccccagaaaggagact

SEQ ID NO: 1505738 - DNA, 15 bp, Homo sapiens
tcttccccttccctt

SEQ ID NO: 1505739 - DNA, 13 bp, Homo sapiens
tcttcccgctccc

SEQ ID NO: 1505740 - DNA, 13 bp, Homo sapiens
tcttccctacctc

SEQ ID NO: 1505741 - DNA, 21 bp, Homo sapiens
tcttccctacctcaggcagga

SEQ ID NO: 1505742 - DNA, 22 bp, Homo sapiens
tcttccctctccctctctctgg

SEQ ID NO: 1505743 - DNA, 15 bp, Homo sapiens
tcttccctctcgctc

SEQ ID NO: 1505744 - DNA, 13 bp, Homo sapiens
tcttccctctggg

SEQ ID NO: 1505745 - DNA, 22 bp, Homo sapiens
tcttccctctgggcctgttctc

SEQ ID NO: 1505746 - DNA, 23 bp, Homo sapiens
tcttccctgaacgttttcttctt

SEQ ID NO: 1505747 - DNA, 16 bp, Homo sapiens
tcttccctgctttgca

SEQ ID NO: 1505748 - DNA, 21 bp, Homo sapiens
tcttccctggaaaccttccac

SEQ ID NO: 1505749 - DNA, 19 bp, Homo sapiens
tcttcccttaactccaaga

SEQ ID NO: 1505750 - DNA, 18 bp, Homo sapiens
tcttcccttagcctctcc

SEQ ID NO: 1505751 - DNA, 13 bp, Homo sapiens
tcttcccttctcc

SEQ ID NO: 1505752 - DNA, 14 bp, Homo sapiens
tcttcccttctccc

SEQ ID NO: 1505753 - DNA, 21 bp, Homo sapiens
tcttcccttttacatactgct

SEQ ID NO: 1505754 - DNA, 22 bp, Homo sapiens
tcttcccttttacatactgctg

SEQ ID NO: 1505755 - DNA, 21 bp, Homo sapiens
tcttccgtggtcagagtgcca

SEQ ID NO: 1505756 - DNA, 19 bp, Homo sapiens
tcttcctagttttctcctc

SEQ ID NO: 1505757 - DNA, 23 bp, Homo sapiens
tcttcctagttttctcctcccag

SEQ ID NO: 1505758 - DNA, 22 bp, Homo sapiens
tcttcctatccctctcctaact

SEQ ID NO: 1505759 - DNA, 20 bp, Homo sapiens
tcttcctctggttcctttca

SEQ ID NO: 1505760 - DNA, 18 bp, Homo sapiens
tcttcctcttagcctctg

SEQ ID NO: 1505761 - DNA, 20 bp, Homo sapiens
tcttcctcttagcctctgga

SEQ ID NO: 1505762 - DNA, 13 bp, Homo sapiens
tcttcctgacact

SEQ ID NO: 1505763 - DNA, 14 bp, Homo sapiens
tcttcctgagtggt

SEQ ID NO: 1505764 - DNA, 11 bp, Homo sapiens
tcttcctgccc

SEQ ID NO: 1505765 - DNA, 14 bp, Homo sapiens
tcttcctgctgctg

SEQ ID NO: 1505766 - DNA, 18 bp, Homo sapiens
tcttcctggacctgagtc

SEQ ID NO: 1505767 - DNA, 13 bp, Homo sapiens
tcttcctgtgatc

SEQ ID NO: 1505768 - DNA, 13 bp, Homo sapiens
tcttcctgtgtcc

SEQ ID NO: 1505769 - DNA, 16 bp, Homo sapiens
tcttcctgtgtcctga

SEQ ID NO: 1505770 - DNA, 23 bp, Homo sapiens
tcttccttctaccccaaggccag

SEQ ID NO: 1505771 - DNA, 18 bp, Homo sapiens
tcttccttgatgtttggg

SEQ ID NO: 1505772 - DNA, 20 bp, Homo sapiens
tcttcgctgtgatgcatgag

SEQ ID NO: 1505773 - DNA, 15 bp, Homo sapiens
tcttcggtttctgag

SEQ ID NO: 1505774 - DNA, 17 bp, Homo sapiens
tcttcggtttctgagca

SEQ ID NO: 1505775 - DNA, 15 bp, Homo sapiens
tcttcgtgaacatag

SEQ ID NO: 1505776 - DNA, 15 bp, Homo sapiens
tcttctaatttcaaa

SEQ ID NO: 1505777 - DNA, 16 bp, Homo sapiens
tcttctactcttgaga

SEQ ID NO: 1505778 - DNA, 22 bp, Homo sapiens
tcttctagatggaccccagcat

SEQ ID NO: 1505779 - DNA, 16 bp, Homo sapiens
tcttctatcattccaa

SEQ ID NO: 1505780 - DNA, 17 bp, Homo sapiens
tcttctcaagttctaag

SEQ ID NO: 1505781 - DNA, 21 bp, Homo sapiens
tcttctcaggctctgccctgc

SEQ ID NO: 1505782 - DNA, 13 bp, Homo sapiens
tcttctcattgtt

SEQ ID NO: 1505783 - DNA, 23 bp, Homo sapiens
tcttctcatttcacccctccctt

SEQ ID NO: 1505784 - DNA, 13 bp, Homo sapiens
tcttctccactgg

SEQ ID NO: 1505785 - DNA, 17 bp, Homo sapiens
tcttctccccgaggctg

SEQ ID NO: 1505786 - DNA, 14 bp, Homo sapiens
tcttctcctttcac

SEQ ID NO: 1505787 - DNA, 18 bp, Homo sapiens
tcttctctctggctcagg

SEQ ID NO: 1505788 - DNA, 21 bp, Homo sapiens
tcttctctggcgacagttttc

SEQ ID NO: 1505789 - DNA, 18 bp, Homo sapiens
tcttctctgtgagaaggt

SEQ ID NO: 1505790 - DNA, 13 bp, Homo sapiens
tcttctgaaatga

SEQ ID NO: 1505791 - DNA, 14 bp, Homo sapiens
tcttctgacgtgcc

SEQ ID NO: 1505792 - DNA, 12 bp, Homo sapiens
tcttctgcctgt

SEQ ID NO: 1505793 - DNA, 16 bp, Homo sapiens
tcttctgcctgttata

SEQ ID NO: 1505794 - DNA, 15 bp, Homo sapiens
tcttctgctccaccc

SEQ ID NO: 1505795 - DNA, 17 bp, Homo sapiens
tcttctgctccaccctt

SEQ ID NO: 1505796 - DNA, 22 bp, Homo sapiens
tcttctgctccacccttggcct

SEQ ID NO: 1505797 - DNA, 19 bp, Homo sapiens
tcttctggacttggtcttg

SEQ ID NO: 1505798 - DNA, 10 bp, Homo sapiens
tcttctggag

SEQ ID NO: 1505799 - DNA, 22 bp, Homo sapiens
tcttctggagatggaagcttgt

SEQ ID NO: 1505800 - DNA, 15 bp, Homo sapiens
tcttctgtccctgtt

SEQ ID NO: 1505801 - DNA, 21 bp, Homo sapiens
tcttctgtgtttataaaatat

SEQ ID NO: 1505802 - DNA, 22 bp, Homo sapiens
tcttctgtttcataatgcagaa

SEQ ID NO: 1505803 - DNA, 15 bp, Homo sapiens
tcttcttcaaacctt

SEQ ID NO: 1505804 - DNA, 13 bp, Homo sapiens
tcttcttccctcc

SEQ ID NO: 1505805 - DNA, 15 bp, Homo sapiens
tcttcttcttcagaa

SEQ ID NO: 1505806 - DNA, 17 bp, Homo sapiens
tcttcttgaaattttaa

SEQ ID NO: 1505807 - DNA, 21 bp, Homo sapiens
tcttcttggggcccagtgcat

SEQ ID NO: 1505808 - DNA, 19 bp, Homo sapiens
tcttcttgttgaccctttt

SEQ ID NO: 1505809 - DNA, 16 bp, Homo sapiens
tcttctttccctggac

SEQ ID NO: 1505810 - DNA, 18 bp, Homo sapiens
tcttctttccctggacag

SEQ ID NO: 1505811 - DNA, 22 bp, Homo sapiens
tcttctttccctggacaggcag

SEQ ID NO: 1505812 - DNA, 12 bp, Homo sapiens
tcttctttcctt

SEQ ID NO: 1505813 - DNA, 14 bp, Homo sapiens
tcttctttctgaga

SEQ ID NO: 1505814 - DNA, 12 bp, Homo sapiens
tcttctttgtgc

SEQ ID NO: 1505815 - DNA, 16 bp, Homo sapiens
tcttcttttggcttcc

SEQ ID NO: 1505816 - DNA, 12 bp, Homo sapiens
tcttgaaaagtt

SEQ ID NO: 1505817 - DNA, 21 bp, Homo sapiens
tcttgaaacctgttaaaacaa

SEQ ID NO: 1505818 - DNA, 19 bp, Homo sapiens
tcttgaaatgaaagggaaa

SEQ ID NO: 1505819 - DNA, 13 bp, Homo sapiens
tcttgaaatgtag

SEQ ID NO: 1505820 - DNA, 23 bp, Homo sapiens
tcttgaagcatttcaaagccctg

SEQ ID NO: 1505821 - DNA, 17 bp, Homo sapiens
tcttgaaggaaaaattc

SEQ ID NO: 1505822 - DNA, 19 bp, Homo sapiens
tcttgaaggaaaaattcaa

SEQ ID NO: 1505823 - DNA, 19 bp, Homo sapiens
tcttgaataaagtattcta

SEQ ID NO: 1505824 - DNA, 22 bp, Homo sapiens
tcttgaataacttttttatatt

SEQ ID NO: 1505825 - DNA, 12 bp, Homo sapiens
tcttgacaagct

SEQ ID NO: 1505826 - DNA, 19 bp, Homo sapiens
tcttgacagtatatttgaa

SEQ ID NO: 1505827 - DNA, 21 bp, Homo sapiens
tcttgaccaacagaaaccttt

SEQ ID NO: 1505828 - DNA, 23 bp, Homo sapiens
tcttgacgggagcattggcccct

SEQ ID NO: 1505829 - DNA, 15 bp, Homo sapiens
tcttgactctaaatg

SEQ ID NO: 1505830 - DNA, 18 bp, Homo sapiens
tcttgactctaaatgcag

SEQ ID NO: 1505831 - DNA, 21 bp, Homo sapiens
tcttgactctaaatgcagttt

SEQ ID NO: 1505832 - DNA, 14 bp, Homo sapiens
tcttgactttctga

SEQ ID NO: 1505833 - DNA, 14 bp, Homo sapiens
tcttgagcatcaat

SEQ ID NO: 1505834 - DNA, 21 bp, Homo sapiens
tcttgagctggcctctctagc

SEQ ID NO: 1505835 - DNA, 16 bp, Homo sapiens
tcttgaggaaaatatt

SEQ ID NO: 1505836 - DNA, 20 bp, Homo sapiens
tcttgaggaagcccaggctc

SEQ ID NO: 1505837 - DNA, 21 bp, Homo sapiens
tcttgagtttgtcgctcatgt

SEQ ID NO: 1505838 - DNA, 20 bp, Homo sapiens
tcttgatacccccctctgtc

SEQ ID NO: 1505839 - DNA, 21 bp, Homo sapiens
tcttgatacccccctctgtct

SEQ ID NO: 1505840 - DNA, 15 bp, Homo sapiens
tcttgatctgttctg

SEQ ID NO: 1505841 - DNA, 16 bp, Homo sapiens
tcttgatcttaaagat

SEQ ID NO: 1505842 - DNA, 22 bp, Homo sapiens
tcttgatgaaaagctttgtttg

SEQ ID NO: 1505843 - DNA, 19 bp, Homo sapiens
tcttgatgatcctcaagga

SEQ ID NO: 1505844 - DNA, 15 bp, Homo sapiens
tcttgatgtaaaatc

SEQ ID NO: 1505845 - DNA, 13 bp, Homo sapiens
tcttgattcctgg

SEQ ID NO: 1505846 - DNA, 15 bp, Homo sapiens
tcttgattcctggtt

SEQ ID NO: 1505847 - DNA, 16 bp, Homo sapiens
tcttgcaagcatgctt

SEQ ID NO: 1505848 - DNA, 17 bp, Homo sapiens
tcttgcaagcatgcttg

SEQ ID NO: 1505849 - DNA, 23 bp, Homo sapiens
tcttgcaccccaaagctttcctg

SEQ ID NO: 1505850 - DNA, 15 bp, Homo sapiens
tcttgcacccgcctc

SEQ ID NO: 1505851 - DNA, 18 bp, Homo sapiens
tcttgcacccgcctctcc

SEQ ID NO: 1505852 - DNA, 17 bp, Homo sapiens
tcttgcagcatttacta

SEQ ID NO: 1505853 - DNA, 21 bp, Homo sapiens
tcttgcataggctcttaagca

SEQ ID NO: 1505854 - DNA, 19 bp, Homo sapiens
tcttgcattgtgacaagaa

SEQ ID NO: 1505855 - DNA, 16 bp, Homo sapiens
tgaaattgcatacttt

SEQ ID NO: 1505856 - DNA, 19 bp, Homo sapiens
tgaaattgtatctcagtct

SEQ ID NO: 1505857 - DNA, 12 bp, Homo sapiens
tgaaatttaatg

SEQ ID NO: 1505858 - DNA, 17 bp, Homo sapiens
tgaaatttattcacata

SEQ ID NO: 1505859 - DNA, 12 bp, Homo sapiens
tgaaatttcaga

SEQ ID NO: 1505860 - DNA, 14 bp, Homo sapiens
tgaaattttaacct

SEQ ID NO: 1505861 - DNA, 16 bp, Homo sapiens
tgaaattttatatgct

SEQ ID NO: 1505862 - DNA, 16 bp, Homo sapiens
tgaacaaaataaattg

SEQ ID NO: 1505863 - DNA, 17 bp, Homo sapiens
tgaacaaacctgtgatc

SEQ ID NO: 1505864 - DNA, 12 bp, Homo sapiens
tgaacaaagtgc

SEQ ID NO: 1505865 - DNA, 16 bp, Homo sapiens
tgaacaaattctttag

SEQ ID NO: 1505866 - DNA, 14 bp, Homo sapiens
tgaacaagaattgg

SEQ ID NO: 1505867 - DNA, 15 bp, Homo sapiens
tgaacaagatttccc

SEQ ID NO: 1505868 - DNA, 23 bp, Homo sapiens
tgaacaagtgggccattagccag

SEQ ID NO: 1505869 - DNA, 13 bp, Homo sapiens
tgaacacaattga

SEQ ID NO: 1505870 - DNA, 22 bp, Homo sapiens
tgaacacaattgatacttcagg

SEQ ID NO: 1505871 - DNA, 14 bp, Homo sapiens
tgaacacagtgtct

SEQ ID NO: 1505872 - DNA, 20 bp, Homo sapiens
tgaacacagtgtctgttcag

SEQ ID NO: 1505873 - DNA, 14 bp, Homo sapiens
tgaacacatcagct

SEQ ID NO: 1505874 - DNA, 15 bp, Homo sapiens
tgaacacatgtgtat

SEQ ID NO: 1505875 - DNA, 14 bp, Homo sapiens
tgaacacatttctt

SEQ ID NO: 1505876 - DNA, 17 bp, Homo sapiens
tgaacactgggggaggg

SEQ ID NO: 1505877 - DNA, 16 bp, Homo sapiens
tgaacactgtgaccag

SEQ ID NO: 1505878 - DNA, 20 bp, Homo sapiens
tgaacagaaaacattctgat

SEQ ID NO: 1505879 - DNA, 14 bp, Homo sapiens
tgaacagcttgctg

SEQ ID NO: 1505880 - DNA, 15 bp, Homo sapiens
tgaacagcttgctgt

SEQ ID NO: 1505881 - DNA, 13 bp, Homo sapiens
tgaacaggaatcc

SEQ ID NO: 1505882 - DNA, 20 bp, Homo sapiens
tgaacagtttggggactcag

SEQ ID NO: 1505883 - DNA, 21 bp, Homo sapiens
tgaacagtttggggactcagg

SEQ ID NO: 1505884 - DNA, 23 bp, Homo sapiens
tgaacagtttggggactcaggac

SEQ ID NO: 1505885 - DNA, 12 bp, Homo sapiens
tgaacatattca

SEQ ID NO: 1505886 - DNA, 21 bp, Homo sapiens
tgaacatattcatgaaatgtg

SEQ ID NO: 1505887 - DNA, 17 bp, Homo sapiens
tgaacatattgttgaaa

SEQ ID NO: 1505888 - DNA, 22 bp, Homo sapiens
tgaacatccaagtctttcttct

SEQ ID NO: 1505889 - DNA, 17 bp, Homo sapiens
tgaacatccttccttcc

SEQ ID NO: 1505890 - DNA, 20 bp, Homo sapiens
tgaacatccttccttcccac

SEQ ID NO: 1505891 - DNA, 20 bp, Homo sapiens
tgaacatgtgccttttctga

SEQ ID NO: 1505892 - DNA, 23 bp, Homo sapiens
tgaacattaaaatatagagacag

SEQ ID NO: 1505893 - DNA, 23 bp, Homo sapiens
tgaacattgtactgttgctttaa

SEQ ID NO: 1505894 - DNA, 14 bp, Homo sapiens
tgaacatttatcaa

SEQ ID NO: 1505895 - DNA, 15 bp, Homo sapiens
tgaaccaaagcctct

SEQ ID NO: 1505896 - DNA, 15 bp, Homo sapiens
tgaaccaatctggat

SEQ ID NO: 1505897 - DNA, 12 bp, Homo sapiens
tgaaccaccgcg

SEQ ID NO: 1505898 - DNA, 17 bp, Homo sapiens
tgaaccactgcttctct

SEQ ID NO: 1505899 - DNA, 21 bp, Homo sapiens
tgaaccatcattataaacgtg

SEQ ID NO: 1505900 - DNA, 16 bp, Homo sapiens
tgaaccccatgggctt

SEQ ID NO: 1505901 - DNA, 19 bp, Homo sapiens
tgaaccccatgggcttgga

SEQ ID NO: 1505902 - DNA, 21 bp, Homo sapiens
tgaaccccatgggcttggact

SEQ ID NO: 1505903 - DNA, 21 bp, Homo sapiens
tgaacccccgccatccttcac

SEQ ID NO: 1505904 - DNA, 22 bp, Homo sapiens
tgaacccccgccatccttcacc

SEQ ID NO: 1505905 - DNA, 13 bp, Homo sapiens
tgaacccctggcc

SEQ ID NO: 1505906 - DNA, 14 bp, Homo sapiens
tgaacccctggcca

SEQ ID NO: 1505907 - DNA, 16 bp, Homo sapiens
tgaacccctggccagc

SEQ ID NO: 1505908 - DNA, 23 bp, Homo sapiens
tgaacccctggccagctctgagg

SEQ ID NO: 1505909 - DNA, 13 bp, Homo sapiens
tgaacccctgtgt

SEQ ID NO: 1505910 - DNA, 20 bp, Homo sapiens
tgaacccgggggacagaggt

SEQ ID NO: 1505911 - DNA, 13 bp, Homo sapiens
tgaaccctgtgct

SEQ ID NO: 1505912 - DNA, 15 bp, Homo sapiens
tgaaccctgtgctgg

SEQ ID NO: 1505913 - DNA, 13 bp, Homo sapiens
tgaacccttgctt

SEQ ID NO: 1505914 - DNA, 15 bp, Homo sapiens
tgaacccttgcttgc

SEQ ID NO: 1505915 - DNA, 20 bp, Homo sapiens
tgaacctattttcatttgta

SEQ ID NO: 1505916 - DNA, 21 bp, Homo sapiens
tgaacctattttcatttgtac

SEQ ID NO: 1505917 - DNA, 15 bp, Homo sapiens
tgaacctgctactta

SEQ ID NO: 1505918 - DNA, 18 bp, Homo sapiens
tgaacctggaaatgatgt

SEQ ID NO: 1505919 - DNA, 19 bp, Homo sapiens
tgaacctggaaatgatgtt

SEQ ID NO: 1505920 - DNA, 13 bp, Homo sapiens
tgaacctggatcc

SEQ ID NO: 1505921 - DNA, 18 bp, Homo sapiens
tgaacctgggaggcagag

SEQ ID NO: 1505922 - DNA, 15 bp, Homo sapiens
tgaaccttgagcaaa

SEQ ID NO: 1505923 - DNA, 21 bp, Homo sapiens
tgaacgagcagcccagggcct

SEQ ID NO: 1505924 - DNA, 20 bp, Homo sapiens
tgaacgatatgtagcagaaa

SEQ ID NO: 1505925 - DNA, 16 bp, Homo sapiens
tgaacgtccacatgaa

SEQ ID NO: 1505926 - DNA, 17 bp, Homo sapiens
tgaacgtgcttctttgt

SEQ ID NO: 1505927 - DNA, 18 bp, Homo sapiens
tgaacgtgcttctttgta

SEQ ID NO: 1505928 - DNA, 19 bp, Homo sapiens
tgaacgtgcttctttgtaa

SEQ ID NO: 1505929 - DNA, 15 bp, Homo sapiens
tgaacgttttcttct

SEQ ID NO: 1505930 - DNA, 21 bp, Homo sapiens
tgaacgttttcttctttccct

SEQ ID NO: 1505931 - DNA, 13 bp, Homo sapiens
tgaactattgaga

SEQ ID NO: 1505932 - DNA, 15 bp, Homo sapiens
tgaactattgagaag

SEQ ID NO: 1505933 - DNA, 21 bp, Homo sapiens
tgaactattgagaagatcgga

SEQ ID NO: 1505934 - DNA, 18 bp, Homo sapiens
tgaactattttaaataaa

SEQ ID NO: 1505935 - DNA, 17 bp, Homo sapiens
tgaactcaaactgagga

SEQ ID NO: 1505936 - DNA, 18 bp, Homo sapiens
tgaactcaaactgaggaa

SEQ ID NO: 1505937 - DNA, 15 bp, Homo sapiens
tgaactcaagctgcg

SEQ ID NO: 1505938 - DNA, 21 bp, Homo sapiens
tgaactcaccctgggagccag

SEQ ID NO: 1505939 - DNA, 17 bp, Homo sapiens
tgaactcattctcttct

SEQ ID NO: 1505940 - DNA, 21 bp, Homo sapiens
tgaactcattctcttcttgct

SEQ ID NO: 1505941 - DNA, 23 bp, Homo sapiens
tgaactccaccgaccaactgccc

SEQ ID NO: 1505942 - DNA, 22 bp, Homo sapiens
tgaactccatcgccatcttctt

SEQ ID NO: 1505943 - DNA, 13 bp, Homo sapiens
tgaactccttgtt

SEQ ID NO: 1505944 - DNA, 14 bp, Homo sapiens
tgaactcgcaggga

SEQ ID NO: 1505945 - DNA, 13 bp, Homo sapiens
tgaactctgacag

SEQ ID NO: 1505946 - DNA, 21 bp, Homo sapiens
tgaactctgttcccccaccct

SEQ ID NO: 1505947 - DNA, 14 bp, Homo sapiens
tgaactcttaatca

SEQ ID NO: 1505948 - DNA, 15 bp, Homo sapiens
tgaactcttaatcaa

SEQ ID NO: 1505949 - DNA, 23 bp, Homo sapiens
tgaactctttctggcctgccttc

SEQ ID NO: 1505950 - DNA, 12 bp, Homo sapiens
tgaactgaacac

SEQ ID NO: 1505951 - DNA, 15 bp, Homo sapiens
tgaactgacaatgaa

SEQ ID NO: 1505952 - DNA, 17 bp, Homo sapiens
tgaactgacaatgaagg

SEQ ID NO: 1505953 - DNA, 20 bp, Homo sapiens
tgaactgagcctagctacct

SEQ ID NO: 1505954 - DNA, 15 bp, Homo sapiens
tgaactggaagaaag

SEQ ID NO: 1505955 - DNA, 21 bp, Homo sapiens
tgaactggcaattgtctattt

SEQ ID NO: 1505956 - DNA, 22 bp, Homo sapiens
tgaactgggcgaatgtcttatt

SEQ ID NO: 1505957 - DNA, 14 bp, Homo sapiens
tgaactgtactact

SEQ ID NO: 1505958 - DNA, 15 bp, Homo sapiens
tgaactgtactactc

SEQ ID NO: 1505959 - DNA, 13 bp, Homo sapiens
tgaagaaaaagta

SEQ ID NO: 1505960 - DNA, 15 bp, Homo sapiens
tgaagaaaaagtaca

SEQ ID NO: 1505961 - DNA, 16 bp, Homo sapiens
tgaagaaaatacttaa

SEQ ID NO: 1505962 - DNA, 22 bp, Homo sapiens
tgaagaaaatacttaaatgtta

SEQ ID NO: 1505963 - DNA, 17 bp, Homo sapiens
tgaagaaattgtggggg

SEQ ID NO: 1505964 - DNA, 20 bp, Homo sapiens
tgaagaacagtaactgccat

SEQ ID NO: 1505965 - DNA, 16 bp, Homo sapiens
tgaagaactgcaggcc

SEQ ID NO: 1505966 - DNA, 20 bp, Homo sapiens
tgaagaactgcaggccctgg

SEQ ID NO: 1505967 - DNA, 13 bp, Homo sapiens
tgaagaagacaaa

SEQ ID NO: 1505968 - DNA, 14 bp, Homo sapiens
tgaagaagggggtg

SEQ ID NO: 1505969 - DNA, 20 bp, Homo sapiens
tgaagaatacatcagaaaat

SEQ ID NO: 1505970 - DNA, 22 bp, Homo sapiens
tgaagaatacatcagaaaataa

SEQ ID NO: 1505971 - DNA, 11 bp, Homo sapiens
tgaagaatctt

SEQ ID NO: 1505972 - DNA, 13 bp, Homo sapiens
tgaagaatgaaga

SEQ ID NO: 1505973 - DNA, 17 bp, Homo sapiens
tgaagaattatgtaata

SEQ ID NO: 1505974 - DNA, 21 bp, Homo sapiens
tgaagacaatttgatacataa

SEQ ID NO: 1505975 - DNA, 22 bp, Homo sapiens
tgaagacaatttgatacataat

SEQ ID NO: 1505976 - DNA, 18 bp, Homo sapiens
tgaagacacagcctcccc

SEQ ID NO: 1505977 - DNA, 19 bp, Homo sapiens
tgaagacacagcctccccc

SEQ ID NO: 1505978 - DNA, 21 bp, Homo sapiens
tgaagacattttttgctataa

SEQ ID NO: 1505979 - DNA, 13 bp, Homo sapiens
tgaagacccagca

SEQ ID NO: 1505980 - DNA, 15 bp, Homo sapiens
tgaagacccagcagg

SEQ ID NO: 1505981 - DNA, 22 bp, Homo sapiens
tgaagacccagcaggaagccag

SEQ ID NO: 1505982 - DNA, 21 bp, Homo sapiens
tgaagacctttattcacccct

SEQ ID NO: 1505983 - DNA, 13 bp, Homo sapiens
tgaagactccctg

SEQ ID NO: 1505984 - DNA, 20 bp, Homo sapiens
tgaagactccctgatcccag

SEQ ID NO: 1505985 - DNA, 21 bp, Homo sapiens
tgaagagaaaaaggctgaaaa

SEQ ID NO: 1505986 - DNA, 24 bp, Homo sapiens
tgaagagaaccgagcaaagatcaa

SEQ ID NO: 1505987 - DNA, 20 bp, Homo sapiens
tgaagagaagggcagggctg

SEQ ID NO: 1505988 - DNA, 15 bp, Homo sapiens
tgaagagaatgtatt

SEQ ID NO: 1505989 - DNA, 19 bp, Homo sapiens
tgaagagaatgtattctgt

SEQ ID NO: 1505990 - DNA, 21 bp, Homo sapiens
tgaagagaatgtattctgtat

SEQ ID NO: 1505991 - DNA, 12 bp, Homo sapiens
tgaagagacaga

SEQ ID NO: 1505992 - DNA, 22 bp, Homo sapiens
tgaagagagggacaggcactcc

SEQ ID NO: 1505993 - DNA, 16 bp, Homo sapiens
tgaagagatccttctg

SEQ ID NO: 1505994 - DNA, 17 bp, Homo sapiens
tgaagaggaggggaaga

SEQ ID NO: 1505995 - DNA, 15 bp, Homo sapiens
tgaagaggcgggcca

SEQ ID NO: 1505996 - DNA, 16 bp, Homo sapiens
tgaagaggcgggccag

SEQ ID NO: 1505997 - DNA, 17 bp, Homo sapiens
tgaagaggcgggccagc

SEQ ID NO: 1505998 - DNA, 18 bp, Homo sapiens
tgaagaggcgggccagcc

SEQ ID NO: 1505999 - DNA, 21 bp, Homo sapiens
tgaagaggcgggccagccagg

SEQ ID NO: 1506000 - DNA, 21 bp, Homo sapiens
tgaagagggagaagcatgaaa

SEQ ID NO: 1506001 - DNA, 17 bp, Homo sapiens
tgaagagggagaaggga

SEQ ID NO: 1506002 - DNA, 23 bp, Homo sapiens
tgaagaggggaggggcctaggga

SEQ ID NO: 1506003 - DNA, 20 bp, Homo sapiens
tgaagaggggcagcccttgc

SEQ ID NO: 1506004 - DNA, 14 bp, Homo sapiens
tgaagaggtctgat

SEQ ID NO: 1506005 - DNA, 17 bp, Homo sapiens
tgaagagtatccttcct

SEQ ID NO: 1506006 - DNA, 16 bp, Homo sapiens
tgaagagtgagagggc

SEQ ID NO: 1506007 - DNA, 13 bp, Homo sapiens
tgaagagttccaa

SEQ ID NO: 1506008 - DNA, 21 bp, Homo sapiens
tgaagatcagaacattcagct

SEQ ID NO: 1506009 - DNA, 19 bp, Homo sapiens
tgaagatctaaacttttga

SEQ ID NO: 1506010 - DNA, 17 bp, Homo sapiens
tgaagatgctgcctgta

SEQ ID NO: 1506011 - DNA, 16 bp, Homo sapiens
tgaagatgtctaatag

SEQ ID NO: 1506012 - DNA, 18 bp, Homo sapiens
tgaagattctcctgtgct

SEQ ID NO: 1506013 - DNA, 15 bp, Homo sapiens
tgaagatttcagagg

SEQ ID NO: 1506014 - DNA, 14 bp, Homo sapiens
tgaagcaaatcaga

SEQ ID NO: 1506015 - DNA, 23 bp, Homo sapiens
tgaagcacagcaccgggggagag

SEQ ID NO: 1506016 - DNA, 12 bp, Homo sapiens
tgaagcagaaat

SEQ ID NO: 1506017 - DNA, 13 bp, Homo sapiens
tgaagcagcctct

SEQ ID NO: 1506018 - DNA, 21 bp, Homo sapiens
tgaagcagggtttcttttctt

SEQ ID NO: 1506019 - DNA, 14 bp, Homo sapiens
tgaagcagtatttt

SEQ ID NO: 1506020 - DNA, 15 bp, Homo sapiens
tgaagcagtattttg

SEQ ID NO: 1506021 - DNA, 15 bp, Homo sapiens
tgaagcagtcagccc

SEQ ID NO: 1506022 - DNA, 16 bp, Homo sapiens
tgaagcagtcttgctc

SEQ ID NO: 1506023 - DNA, 20 bp, Homo sapiens
tgaagcagtcttgctctgtt

SEQ ID NO: 1506024 - DNA, 18 bp, Homo sapiens
tgaagcagtgcctcgagg

SEQ ID NO: 1506025 - DNA, 19 bp, Homo sapiens
tgaagcagtgcctcgaggc

SEQ ID NO: 1506026 - DNA, 16 bp, Homo sapiens
tgaagcagttcagaag

SEQ ID NO: 1506027 - DNA, 18 bp, Homo sapiens
tgaagcatgctctgtaag

SEQ ID NO: 1506028 - DNA, 18 bp, Homo sapiens
tgaagcatgctttgctgc

SEQ ID NO: 1506029 - DNA, 19 bp, Homo sapiens
tgaagcatgctttgctgct

SEQ ID NO: 1506030 - DNA, 21 bp, Homo sapiens
tgaagcattctccccagtgta

SEQ ID NO: 1506031 - DNA, 18 bp, Homo sapiens
tgaagcatttcaaagccc

SEQ ID NO: 1506032 - DNA, 23 bp, Homo sapiens
tgaagcatttcaaagccctgcct

SEQ ID NO: 1506033 - DNA, 14 bp, Homo sapiens
tgaagccaagtggg

SEQ ID NO: 1506034 - DNA, 21 bp, Homo sapiens
tgaagccaagtggggtgctgg

SEQ ID NO: 1506035 - DNA, 22 bp, Homo sapiens
tgaagccaagtggggtgctggg

SEQ ID NO: 1506036 - DNA, 16 bp, Homo sapiens
tgaagccactgaagct

SEQ ID NO: 1506037 - DNA, 11 bp, Homo sapiens
tgaagccagct

SEQ ID NO: 1506038 - DNA, 23 bp, Homo sapiens
tgaagccagctcacagtgctgtg

SEQ ID NO: 1506039 - DNA, 21 bp, Homo sapiens
tgaagccatgagttccagaaa

SEQ ID NO: 1506040 - DNA, 21 bp, Homo sapiens
tgaagccattggagagctgtc

SEQ ID NO: 1506041 - DNA, 15 bp, Homo sapiens
tgaagcccaataaac

SEQ ID NO: 1506042 - DNA, 16 bp, Homo sapiens
tgaagccgactctggc

SEQ ID NO: 1506043 - DNA, 20 bp, Homo sapiens
tgaagccgactctggccctg

SEQ ID NO: 1506044 - DNA, 14 bp, Homo sapiens
tgaagccggacagc

SEQ ID NO: 1506045 - DNA, 19 bp, Homo sapiens
tgaagcctctctccttggc

SEQ ID NO: 1506046 - DNA, 15 bp, Homo sapiens
tgaagccttagccag

SEQ ID NO: 1506047 - DNA, 15 bp, Homo sapiens
tgaagcgtttttctc

SEQ ID NO: 1506048 - DNA, 15 bp, Homo sapiens
tgaagctaagattta

SEQ ID NO: 1506049 - DNA, 22 bp, Homo sapiens
tgaagctctggtgacaccagcc

SEQ ID NO: 1506050 - DNA, 14 bp, Homo sapiens
tgaagctgcagtga

SEQ ID NO: 1506051 - DNA, 19 bp, Homo sapiens
tgaagctggagcagcggat

SEQ ID NO: 1506052 - DNA, 15 bp, Homo sapiens
tgaagctgggctctt

SEQ ID NO: 1506053 - DNA, 19 bp, Homo sapiens
tgaagctgttgtgtgaggt

SEQ ID NO: 1506054 - DNA, 15 bp, Homo sapiens
tgaagcttgactccc

SEQ ID NO: 1506055 - DNA, 13 bp, Homo sapiens
tgaagctttacca

SEQ ID NO: 1506056 - DNA, 15 bp, Homo sapiens
tgaagctttaccagg

SEQ ID NO: 1506057 - DNA, 15 bp, Homo sapiens
tgaagctttgcttat

SEQ ID NO: 1506058 - DNA, 14 bp, Homo sapiens
tgaaggaaaaattc

SEQ ID NO: 1506059 - DNA, 21 bp, Homo sapiens
tgaaggaaaagcaagaaacag

SEQ ID NO: 1506060 - DNA, 15 bp, Homo sapiens
tgaaggaaaatgata

SEQ ID NO: 1506061 - DNA, 16 bp, Homo sapiens
tgaaggaaaatgttca

SEQ ID NO: 1506062 - DNA, 16 bp, Homo sapiens
tgaaggaaacagttaa

SEQ ID NO: 1506063 - DNA, 21 bp, Homo sapiens
tgaaggaatagccagagagga

SEQ ID NO: 1506064 - DNA, 18 bp, Homo sapiens
tgaaggacacttcctgcc

SEQ ID NO: 1506065 - DNA, 20 bp, Homo sapiens
tgaaggactggattggccaa

SEQ ID NO: 1506066 - DNA, 18 bp, Homo sapiens
tgaaggagccacgtgaat

SEQ ID NO: 1506067 - DNA, 17 bp, Homo sapiens
tgaaggaggtcaggccc

SEQ ID NO: 1506068 - DNA, 14 bp, Homo sapiens
tgaaggcagtctga

SEQ ID NO: 1506069 - DNA, 19 bp, Homo sapiens
tgaaggccttattctacat

SEQ ID NO: 1506070 - DNA, 18 bp, Homo sapiens
tgaagggaaaggatattt

SEQ ID NO: 1506071 - DNA, 17 bp, Homo sapiens
tgaagggaagtggggag

SEQ ID NO: 1506072 - DNA, 16 bp, Homo sapiens
tgaagggacagctgct

SEQ ID NO: 1506073 - DNA, 22 bp, Homo sapiens
tgaatccaggaggcagtggaca

SEQ ID NO: 1506074 - DNA, 20 bp, Homo sapiens
tgaatcccacccacatgtga

SEQ ID NO: 1506075 - DNA, 11 bp, Homo sapiens
tgaatccctgg

SEQ ID NO: 1506076 - DNA, 17 bp, Homo sapiens
tgacctcgtgatccgcc

SEQ ID NO: 1506077 - DNA, 18 bp, Homo sapiens
tgacctcgtgatccgccc

SEQ ID NO: 1506078 - DNA, 18 bp, Homo sapiens
tgacctcgtgatccgcct

SEQ ID NO: 1506079 - DNA, 17 bp, Homo sapiens
tgacctctagagctgga

SEQ ID NO: 1506080 - DNA, 19 bp, Homo sapiens
tgacctctgttgtcctccc

SEQ ID NO: 1506081 - DNA, 19 bp, Homo sapiens
tgacctgaaataatatatt

SEQ ID NO: 1506082 - DNA, 20 bp, Homo sapiens
tgacctgaccccattcctga

SEQ ID NO: 1506083 - DNA, 21 bp, Homo sapiens
tgacctgaccccattcctgat

SEQ ID NO: 1506084 - DNA, 15 bp, Homo sapiens
tgacctgaggctgtg

SEQ ID NO: 1506085 - DNA, 11 bp, Homo sapiens
tgacctgcagg

SEQ ID NO: 1506086 - DNA, 22 bp, Homo sapiens
tgacctggcatctaattctgat

SEQ ID NO: 1506087 - DNA, 17 bp, Homo sapiens
tgacctgggtatcccct

SEQ ID NO: 1506088 - DNA, 12 bp, Homo sapiens
tgacctggtggg

SEQ ID NO: 1506089 - DNA, 14 bp, Homo sapiens
tgacctgtgtcact

SEQ ID NO: 1506090 - DNA, 19 bp, Homo sapiens
tgacctgttgccagcagat

SEQ ID NO: 1506091 - DNA, 16 bp, Homo sapiens
tgaccttacagccatt

SEQ ID NO: 1506092 - DNA, 21 bp, Homo sapiens
tgaccttagcgttctggactc

SEQ ID NO: 1506093 - DNA, 20 bp, Homo sapiens
tgaccttcagagccagccgg

SEQ ID NO: 1506094 - DNA, 19 bp, Homo sapiens
tgacgatcccatgttagct

SEQ ID NO: 1506095 - DNA, 19 bp, Homo sapiens
tgacgcaacccacgtgtaa

SEQ ID NO: 1506096 - DNA, 15 bp, Homo sapiens
tgacgcagacagagg

SEQ ID NO: 1506097 - DNA, 18 bp, Homo sapiens
tgacgcagacagagggga

SEQ ID NO: 1506098 - DNA, 20 bp, Homo sapiens
tgacgcagacagaggggatg

SEQ ID NO: 1506099 - DNA, 22 bp, Homo sapiens
tgacgcagccggagggaggcac

SEQ ID NO: 1506100 - DNA, 12 bp, Homo sapiens
tgacgccctgcg

SEQ ID NO: 1506101 - DNA, 21 bp, Homo sapiens
tgacgccctgcgttggagcca

SEQ ID NO: 1506102 - DNA, 22 bp, Homo sapiens
tgacgccctgcgttggagccac

SEQ ID NO: 1506103 - DNA, 15 bp, Homo sapiens
tgacgcttgtgacag

SEQ ID NO: 1506104 - DNA, 19 bp, Homo sapiens
tgacgcttgtgacagtgcc

SEQ ID NO: 1506105 - DNA, 20 bp, Homo sapiens
tgacgcttgtgacagtgcct

SEQ ID NO: 1506106 - DNA, 15 bp, Homo sapiens
tgacggacatccagg

SEQ ID NO: 1506107 - DNA, 19 bp, Homo sapiens
tgacggtgttaattttgct

SEQ ID NO: 1506108 - DNA, 20 bp, Homo sapiens
tgacggtgttaattttgcta

SEQ ID NO: 1506109 - DNA, 16 bp, Homo sapiens
tgacgtgccttttgca

SEQ ID NO: 1506110 - DNA, 16 bp, Homo sapiens
tgacgtgtgtggctgg

SEQ ID NO: 1506111 - DNA, 20 bp, Homo sapiens
tgacgtgtgtggctgggacc

SEQ ID NO: 1506112 - DNA, 14 bp, Homo sapiens
tgacgtttcttctt

SEQ ID NO: 1506113 - DNA, 19 bp, Homo sapiens
tgacgtttcttctttctag

SEQ ID NO: 1506114 - DNA, 14 bp, Homo sapiens
tgactaaaaatatt

SEQ ID NO: 1506115 - DNA, 22 bp, Homo sapiens
tgactaaaaatattataactta

SEQ ID NO: 1506116 - DNA, 18 bp, Homo sapiens
tgactaaactttttttct

SEQ ID NO: 1506117 - DNA, 16 bp, Homo sapiens
tgactaaagagagaat

SEQ ID NO: 1506118 - DNA, 17 bp, Homo sapiens
tgactaaagctatgtta

SEQ ID NO: 1506119 - DNA, 15 bp, Homo sapiens
tgactaaattcgtga

SEQ ID NO: 1506120 - DNA, 17 bp, Homo sapiens
tgactaacaggccaaag

SEQ ID NO: 1506121 - DNA, 15 bp, Homo sapiens
tgactaactcaaata

SEQ ID NO: 1506122 - DNA, 23 bp, Homo sapiens
tgactaatgctttttagaaagca

SEQ ID NO: 1506123 - DNA, 21 bp, Homo sapiens
tgactaattttacatgtttat

SEQ ID NO: 1506124 - DNA, 24 bp, Homo sapiens
tgactacgtcttaagtcagatttt

SEQ ID NO: 1506125 - DNA, 21 bp, Homo sapiens
tgactagaggcagggagggga

SEQ ID NO: 1506126 - DNA, 14 bp, Homo sapiens
tgactaggaaaaaa

SEQ ID NO: 1506127 - DNA, 22 bp, Homo sapiens
tgactaggcatacactgtagtt

SEQ ID NO: 1506128 - DNA, 17 bp, Homo sapiens
tgactagggattcaggc

SEQ ID NO: 1506129 - DNA, 23 bp, Homo sapiens
tgactagggattcaggctgcttg

SEQ ID NO: 1506130 - DNA, 24 bp, Homo sapiens
tgactatgcagaggcctgggggac

SEQ ID NO: 1506131 - DNA, 17 bp, Homo sapiens
tgactattcttgatgta

SEQ ID NO: 1506132 - DNA, 18 bp, Homo sapiens
tgactatttgacccccac

SEQ ID NO: 1506133 - DNA, 15 bp, Homo sapiens
tgactcaacatgtta

SEQ ID NO: 1506134 - DNA, 14 bp, Homo sapiens
tgactcaagaagtg

SEQ ID NO: 1506135 - DNA, 18 bp, Homo sapiens
tgactcaagattttttct

SEQ ID NO: 1506136 - DNA, 20 bp, Homo sapiens
tgactcaagattttttctgg

SEQ ID NO: 1506137 - DNA, 22 bp, Homo sapiens
tgactcaagattttttctggtc

SEQ ID NO: 1506138 - DNA, 13 bp, Homo sapiens
tgactcacccaag

SEQ ID NO: 1506139 - DNA, 15 bp, Homo sapiens
tgactcacccaagca

SEQ ID NO: 1506140 - DNA, 23 bp, Homo sapiens
tgactcaggatttaaaaactgga

SEQ ID NO: 1506141 - DNA, 13 bp, Homo sapiens
tgactcagttcca

SEQ ID NO: 1506142 - DNA, 15 bp, Homo sapiens
tgactcatcatttgt

SEQ ID NO: 1506143 - DNA, 15 bp, Homo sapiens
tgactcatggcagct

SEQ ID NO: 1506144 - DNA, 21 bp, Homo sapiens
tgactcatggcagctgtttct

SEQ ID NO: 1506145 - DNA, 13 bp, Homo sapiens
tgactccagagtc

SEQ ID NO: 1506146 - DNA, 23 bp, Homo sapiens
tgactccagagtctgagcccccg

SEQ ID NO: 1506147 - DNA, 15 bp, Homo sapiens
tgactccttaccaat

SEQ ID NO: 1506148 - DNA, 18 bp, Homo sapiens
tgactcgagtcacactca

SEQ ID NO: 1506149 - DNA, 17 bp, Homo sapiens
tgactcgggggtgggga

SEQ ID NO: 1506150 - DNA, 18 bp, Homo sapiens
tgactcgttacctgccgc

SEQ ID NO: 1506151 - DNA, 16 bp, Homo sapiens
tgactctataagcaaa

SEQ ID NO: 1506152 - DNA, 19 bp, Homo sapiens
tgactctcacctgtactat

SEQ ID NO: 1506153 - DNA, 13 bp, Homo sapiens
tgactctctgtga

SEQ ID NO: 1506154 - DNA, 14 bp, Homo sapiens
tgactctgaaatct

SEQ ID NO: 1506155 - DNA, 13 bp, Homo sapiens
tgactctgggcag

SEQ ID NO: 1506156 - DNA, 14 bp, Homo sapiens
tgactctgggcagg

SEQ ID NO: 1506157 - DNA, 15 bp, Homo sapiens
tgactctgggcaggg

SEQ ID NO: 1506158 - DNA, 17 bp, Homo sapiens
tgactctgggcagggac

SEQ ID NO: 1506159 - DNA, 13 bp, Homo sapiens
tgactgaacatta

SEQ ID NO: 1506160 - DNA, 18 bp, Homo sapiens
tgactgaagaagatgagc

SEQ ID NO: 1506161 - DNA, 18 bp, Homo sapiens
tgactgaaggggcacacc

SEQ ID NO: 1506162 - DNA, 19 bp, Homo sapiens
tgactgagataagaaaagc

SEQ ID NO: 1506163 - DNA, 19 bp, Homo sapiens
tgactgagcaagaccctgt

SEQ ID NO: 1506164 - DNA, 22 bp, Homo sapiens
tgactgagcaagaccctgtctc

SEQ ID NO: 1506165 - DNA, 15 bp, Homo sapiens
tgactgaggcctgct

SEQ ID NO: 1506166 - DNA, 16 bp, Homo sapiens
tgactgaggcctgctt

SEQ ID NO: 1506167 - DNA, 22 bp, Homo sapiens
tgactgaggcctgcttccccct

SEQ ID NO: 1506168 - DNA, 17 bp, Homo sapiens
tgactgatgattttcct

SEQ ID NO: 1506169 - DNA, 17 bp, Homo sapiens
tgactgcatcatatatt

SEQ ID NO: 1506170 - DNA, 17 bp, Homo sapiens
tgactgccccaactcct

SEQ ID NO: 1506171 - DNA, 13 bp, Homo sapiens
tgactggaggcct

SEQ ID NO: 1506172 - DNA, 14 bp, Homo sapiens
tgactggcaggtgc

SEQ ID NO: 1506173 - DNA, 16 bp, Homo sapiens
tgactggctgtctgcc

SEQ ID NO: 1506174 - DNA, 15 bp, Homo sapiens
tgactgggaaagtta

SEQ ID NO: 1506175 - DNA, 23 bp, Homo sapiens
tgactgggtagaggtatgtttgt

SEQ ID NO: 1506176 - DNA, 14 bp, Homo sapiens
tgactgtaattaat

SEQ ID NO: 1506177 - DNA, 17 bp, Homo sapiens
tgactgtgattagatca

SEQ ID NO: 1506178 - DNA, 14 bp, Homo sapiens
tgactgtgtttgca

SEQ ID NO: 1506179 - DNA, 15 bp, Homo sapiens
tgactgtgtttgcat

SEQ ID NO: 1506180 - DNA, 11 bp, Homo sapiens
tgactgtttat

SEQ ID NO: 1506181 - DNA, 14 bp, Homo sapiens
tgactgtttattta

SEQ ID NO: 1506182 - DNA, 19 bp, Homo sapiens
tgactgtttatttaaggat

SEQ ID NO: 1506183 - DNA, 17 bp, Homo sapiens
tgactgtttttgtagtg

SEQ ID NO: 1506184 - DNA, 13 bp, Homo sapiens
tgacttaatgtga

SEQ ID NO: 1506185 - DNA, 23 bp, Homo sapiens
tgacttactttaattactggaat

SEQ ID NO: 1506186 - DNA, 14 bp, Homo sapiens
tgacttagaaactg

SEQ ID NO: 1506187 - DNA, 20 bp, Homo sapiens
tgatataccaaattaaaaaa

SEQ ID NO: 1506188 - DNA, 16 bp, Homo sapiens
tgatatagaaagctgt

SEQ ID NO: 1506189 - DNA, 20 bp, Homo sapiens
tgatatatgagactttatgt

SEQ ID NO: 1506190 - DNA, 22 bp, Homo sapiens
tgatatatttgttgatattaag

SEQ ID NO: 1506191 - DNA, 13 bp, Homo sapiens
tgatatcaacagc

SEQ ID NO: 1506192 - DNA, 20 bp, Homo sapiens
tgatatcaacagcttcccta

SEQ ID NO: 1506193 - DNA, 21 bp, Homo sapiens
tgatatcatgcccctgtactc

SEQ ID NO: 1506194 - DNA, 15 bp, Homo sapiens
tgatatctataaaat

SEQ ID NO: 1506195 - DNA, 15 bp, Homo sapiens
tgatatgaccaaaat

SEQ ID NO: 1506196 - DNA, 19 bp, Homo sapiens
tgatatgcagttttcctta

SEQ ID NO: 1506197 - DNA, 19 bp, Homo sapiens
tgatatgcatttcctgctg

SEQ ID NO: 1506198 - DNA, 14 bp, Homo sapiens
tgatatgggactga

SEQ ID NO: 1506199 - DNA, 21 bp, Homo sapiens
tgatatgtaaacataattctt

SEQ ID NO: 1506200 - DNA, 17 bp, Homo sapiens
tgatattaaatttcaaa

SEQ ID NO: 1506201 - DNA, 15 bp, Homo sapiens
tgatattaatcaaaa

SEQ ID NO: 1506202 - DNA, 20 bp, Homo sapiens
tgatattatattaaacatac

SEQ ID NO: 1506203 - DNA, 16 bp, Homo sapiens
tgatattatttcttct

SEQ ID NO: 1506204 - DNA, 18 bp, Homo sapiens
tgatattatttcttctct

SEQ ID NO: 1506205 - DNA, 20 bp, Homo sapiens
tgatattatttcttctctta

SEQ ID NO: 1506206 - DNA, 18 bp, Homo sapiens
tgatattccatgaatgta

SEQ ID NO: 1506207 - DNA, 22 bp, Homo sapiens
tgatattccatgaatgtatcag

SEQ ID NO: 1506208 - DNA, 15 bp, Homo sapiens
tgatattctaagact

SEQ ID NO: 1506209 - DNA, 14 bp, Homo sapiens
tgatatttatagaa

SEQ ID NO: 1506210 - DNA, 13 bp, Homo sapiens
tgatatttcagaa

SEQ ID NO: 1506211 - DNA, 22 bp, Homo sapiens
tgatattttcaacgcagccctg

SEQ ID NO: 1506212 - DNA, 20 bp, Homo sapiens
tgatattttctgtgcctgaa

SEQ ID NO: 1506213 - DNA, 21 bp, Homo sapiens
tgatatttttatacaagtaat

SEQ ID NO: 1506214 - DNA, 14 bp, Homo sapiens
tgatatttttccat

SEQ ID NO: 1506215 - DNA, 19 bp, Homo sapiens
tgatcaaaaataaactagt

SEQ ID NO: 1506216 - DNA, 23 bp, Homo sapiens
tgatcaaaacctgtgccaggctg

SEQ ID NO: 1506217 - DNA, 16 bp, Homo sapiens
tgatcaaattcatttt

SEQ ID NO: 1506218 - DNA, 18 bp, Homo sapiens
tgatcaacatcttttctt

SEQ ID NO: 1506219 - DNA, 14 bp, Homo sapiens
tgatcaactgttca

SEQ ID NO: 1506220 - DNA, 17 bp, Homo sapiens
tgatcaagggaatgtaa

SEQ ID NO: 1506221 - DNA, 16 bp, Homo sapiens
tgatcaataaaatgtg

SEQ ID NO: 1506222 - DNA, 22 bp, Homo sapiens
tgatcacacagtgttagtgctg

SEQ ID NO: 1506223 - DNA, 14 bp, Homo sapiens
tgatcacagtgact

SEQ ID NO: 1506224 - DNA, 15 bp, Homo sapiens
tgatcacccaatgca

SEQ ID NO: 1506225 - DNA, 16 bp, Homo sapiens
tgatcagccttatgtg

SEQ ID NO: 1506226 - DNA, 17 bp, Homo sapiens
tgatcagctgtttgtca

SEQ ID NO: 1506227 - DNA, 19 bp, Homo sapiens
tgatcagctttcaaagcat

SEQ ID NO: 1506228 - DNA, 16 bp, Homo sapiens
tgatcaggcttcctgg

SEQ ID NO: 1506229 - DNA, 16 bp, Homo sapiens
tgatcaggtaactttc

SEQ ID NO: 1506230 - DNA, 23 bp, Homo sapiens
tgatcagtagtttgcatttcaga

SEQ ID NO: 1506231 - DNA, 21 bp, Homo sapiens
tgatcataagtctaaataaat

SEQ ID NO: 1506232 - DNA, 15 bp, Homo sapiens
tgatcatcgccagag

SEQ ID NO: 1506233 - DNA, 19 bp, Homo sapiens
tgatcattttccccccact

SEQ ID NO: 1506234 - DNA, 14 bp, Homo sapiens
tgatccaactaatg

SEQ ID NO: 1506235 - DNA, 14 bp, Homo sapiens
tgatccagcctttc

SEQ ID NO: 1506236 - DNA, 22 bp, Homo sapiens
tgatccagtttccggaaacaaa

SEQ ID NO: 1506237 - DNA, 19 bp, Homo sapiens
tgatcccaagtgccagtct

SEQ ID NO: 1506238 - DNA, 13 bp, Homo sapiens
tgatcccaccccc

SEQ ID NO: 1506239 - DNA, 14 bp, Homo sapiens
tgatcccaccccct

SEQ ID NO: 1506240 - DNA, 16 bp, Homo sapiens
tgatcccaccccctcc

SEQ ID NO: 1506241 - DNA, 17 bp, Homo sapiens
tgatcccaccccctcct

SEQ ID NO: 1506242 - DNA, 19 bp, Homo sapiens
tgatcccaccccctcctcc

SEQ ID NO: 1506243 - DNA, 22 bp, Homo sapiens
tgatcccaccccctcctccccc

SEQ ID NO: 1506244 - DNA, 18 bp, Homo sapiens
tgatcccacttcactgtg

SEQ ID NO: 1506245 - DNA, 12 bp, Homo sapiens
tgatcccagcac

SEQ ID NO: 1506246 - DNA, 18 bp, Homo sapiens
tgatccctgctctctgag

SEQ ID NO: 1506247 - DNA, 22 bp, Homo sapiens
tgatccgttccattgcaagctt

SEQ ID NO: 1506248 - DNA, 15 bp, Homo sapiens
tgatcctaagaattt

SEQ ID NO: 1506249 - DNA, 13 bp, Homo sapiens
tgatcctctattt

SEQ ID NO: 1506250 - DNA, 15 bp, Homo sapiens
tgatcctgctccagc

SEQ ID NO: 1506251 - DNA, 19 bp, Homo sapiens
tgatcctgctccagcagca

SEQ ID NO: 1506252 - DNA, 17 bp, Homo sapiens
tgatcctgctgacctca

SEQ ID NO: 1506253 - DNA, 20 bp, Homo sapiens
tgatcctgctgacctcactg

SEQ ID NO: 1506254 - DNA, 16 bp, Homo sapiens
tgatcctggaggccca

SEQ ID NO: 1506255 - DNA, 20 bp, Homo sapiens
tgatcctggaggcccagttc

SEQ ID NO: 1506256 - DNA, 16 bp, Homo sapiens
tgatccttctgagctc

SEQ ID NO: 1506257 - DNA, 21 bp, Homo sapiens
tgatccttctgagctccacct

SEQ ID NO: 1506258 - DNA, 16 bp, Homo sapiens
tgatccttggtgctgt

SEQ ID NO: 1506259 - DNA, 18 bp, Homo sapiens
tgatccttggtgctgtgt

SEQ ID NO: 1506260 - DNA, 18 bp, Homo sapiens
tgatcggagcctcctctc

SEQ ID NO: 1506261 - DNA, 18 bp, Homo sapiens
tgatcgtagacacaggga

SEQ ID NO: 1506262 - DNA, 22 bp, Homo sapiens
tgatcgtgctaaattttcagta

SEQ ID NO: 1506263 - DNA, 23 bp, Homo sapiens
tgatgaacatattcatgaaatgt

SEQ ID NO: 1506264 - DNA, 18 bp, Homo sapiens
tgatgaactcttaatcaa

SEQ ID NO: 1506265 - DNA, 18 bp, Homo sapiens
tgatgacaaaaaatgttt

SEQ ID NO: 1506266 - DNA, 19 bp, Homo sapiens
tgatgacccactaaagagt

SEQ ID NO: 1506267 - DNA, 18 bp, Homo sapiens
tgatgactcaagattttt

SEQ ID NO: 1506268 - DNA, 22 bp, Homo sapiens
tgatgagaattgtatgtcatgt

SEQ ID NO: 1506269 - DNA, 23 bp, Homo sapiens
tgatgagagaatggagacagagt

SEQ ID NO: 1506270 - DNA, 15 bp, Homo sapiens
tgatgagaggccagc

SEQ ID NO: 1506271 - DNA, 14 bp, Homo sapiens
tgatgagattttta

SEQ ID NO: 1506272 - DNA, 21 bp, Homo sapiens
tgatgagtgattgacacacag

SEQ ID NO: 1506273 - DNA, 17 bp, Homo sapiens
tgatgagttaactgtga

SEQ ID NO: 1506274 - DNA, 18 bp, Homo sapiens
tgatgagtttcactgtac

SEQ ID NO: 1506275 - DNA, 14 bp, Homo sapiens
tgatgataatgatg

SEQ ID NO: 1506276 - DNA, 13 bp, Homo sapiens
tgatgatcaaaac

SEQ ID NO: 1506277 - DNA, 21 bp, Homo sapiens
tgatgatcaaaacctgtgcca

SEQ ID NO: 1506278 - DNA, 13 bp, Homo sapiens
tgatgatccagaa

SEQ ID NO: 1506279 - DNA, 18 bp, Homo sapiens
tgatgatccagaacagtg

SEQ ID NO: 1506280 - DNA, 17 bp, Homo sapiens
tgatgatctttaaaata

SEQ ID NO: 1506281 - DNA, 13 bp, Homo sapiens
tgatgatgatgaa

SEQ ID NO: 1506282 - DNA, 19 bp, Homo sapiens
tgatgatgtctcttgtaga

SEQ ID NO: 1506283 - DNA, 18 bp, Homo sapiens
tgatgattttcctttttc

SEQ ID NO: 1506284 - DNA, 14 bp, Homo sapiens
tgatgcagacacag

SEQ ID NO: 1506285 - DNA, 22 bp, Homo sapiens
tgatgcatacagttttctagca

SEQ ID NO: 1506286 - DNA, 16 bp, Homo sapiens
tgatgcatgtctttta

SEQ ID NO: 1506287 - DNA, 15 bp, Homo sapiens
tgatgccagagggcc

SEQ ID NO: 1506288 - DNA, 17 bp, Homo sapiens
tgatgccagagggccag

SEQ ID NO: 1506289 - DNA, 22 bp, Homo sapiens
tgatgccagagggccagcaggc

SEQ ID NO: 1506290 - DNA, 15 bp, Homo sapiens
tgatgccaggtgcaa

SEQ ID NO: 1506291 - DNA, 15 bp, Homo sapiens
tgatgccattacaga

SEQ ID NO: 1506292 - DNA, 19 bp, Homo sapiens
tgatgccattacagaacca

SEQ ID NO: 1506293 - DNA, 18 bp, Homo sapiens
tgatgcctaattatgaat

SEQ ID NO: 1506294 - DNA, 16 bp, Homo sapiens
tgatgctaaataggag

SEQ ID NO: 1506295 - DNA, 15 bp, Homo sapiens
tgatgctatttatgc

SEQ ID NO: 1506296 - DNA, 16 bp, Homo sapiens
tgatgctatttatgca

SEQ ID NO: 1506297 - DNA, 14 bp, Homo sapiens
tgatgctccctccc

SEQ ID NO: 1506298 - DNA, 15 bp, Homo sapiens
tgatgctccctcccc

SEQ ID NO: 1506299 - DNA, 22 bp, Homo sapiens
tgatgctccctcccctgccctg

SEQ ID NO: 1506300 - DNA, 23 bp, Homo sapiens
tgatgctccctcccctgccctgg

SEQ ID NO: 1506301 - DNA, 13 bp, Homo sapiens
tgatgctgccccg

SEQ ID NO: 1506302 - DNA, 20 bp, Homo sapiens
tgatgctgggagttctaaca

SEQ ID NO: 1506303 - DNA, 21 bp, Homo sapiens
tgatgctttgaacatctcttt

SEQ ID NO: 1506304 - DNA, 13 bp, Homo sapiens
tgatggaaaataa

SEQ ID NO: 1506305 - DNA, 14 bp, Homo sapiens
tgatggaaaataaa

SEQ ID NO: 1506306 - DNA, 14 bp, Homo sapiens
tgatggaaccttaa

SEQ ID NO: 1506307 - DNA, 23 bp, Homo sapiens
tgatggaccagtggtttccagtc

SEQ ID NO: 1506308 - DNA, 18 bp, Homo sapiens
tgatggaccgggtgggcc

SEQ ID NO: 1506309 - DNA, 20 bp, Homo sapiens
tgatggaccgggtgggcctg

SEQ ID NO: 1506310 - DNA, 23 bp, Homo sapiens
tgatggaccgggtgggcctggcc

SEQ ID NO: 1506311 - DNA, 16 bp, Homo sapiens
tgatggagccccacct

SEQ ID NO: 1506312 - DNA, 15 bp, Homo sapiens
tgatggaggaaaaag

SEQ ID NO: 1506313 - DNA, 15 bp, Homo sapiens
tgatggaggctgcag

SEQ ID NO: 1506314 - DNA, 17 bp, Homo sapiens
tgatggaggctgcagcg

SEQ ID NO: 1506315 - DNA, 18 bp, Homo sapiens
tgatggagggtggaaata

SEQ ID NO: 1506316 - DNA, 15 bp, Homo sapiens
tgatggatcaccatt

SEQ ID NO: 1506317 - DNA, 22 bp, Homo sapiens
tgatggatgtcttctagctgca

SEQ ID NO: 1506318 - DNA, 19 bp, Homo sapiens
tgatggcaacagatctgga

SEQ ID NO: 1506319 - DNA, 23 bp, Homo sapiens
tgatggcaacagatctggaacct

SEQ ID NO: 1506320 - DNA, 14 bp, Homo sapiens
tgatggcagagcca

SEQ ID NO: 1506321 - DNA, 17 bp, Homo sapiens
tgatggccaagagcatc

SEQ ID NO: 1506322 - DNA, 16 bp, Homo sapiens
tgatggccaggccagg

SEQ ID NO: 1506323 - DNA, 19 bp, Homo sapiens
tgatggccaggccagggga

SEQ ID NO: 1506324 - DNA, 23 bp, Homo sapiens
tgatggccccatctggatgtaaa

SEQ ID NO: 1506325 - DNA, 17 bp, Homo sapiens
tgatggcccctccagca

SEQ ID NO: 1506326 - DNA, 18 bp, Homo sapiens
tgatggccttaatttcct

SEQ ID NO: 1506327 - DNA, 20 bp, Homo sapiens
tgatggccttaatttccttt

SEQ ID NO: 1506328 - DNA, 18 bp, Homo sapiens
tgatggcgcgggaggcac

SEQ ID NO: 1506329 - DNA, 21 bp, Homo sapiens
tgatggcgcgggaggcaccag

SEQ ID NO: 1506330 - DNA, 23 bp, Homo sapiens
tgatggcgcgggaggcaccagct

SEQ ID NO: 1506331 - DNA, 13 bp, Homo sapiens
tgatgggaaaact

SEQ ID NO: 1506332 - DNA, 18 bp, Homo sapiens
tgatgggaaaatatttcc

SEQ ID NO: 1506333 - DNA, 15 bp, Homo sapiens
tgatgggcgagtccc

SEQ ID NO: 1506334 - DNA, 14 bp, Homo sapiens
tgatggtgagctgg

SEQ ID NO: 1506335 - DNA, 14 bp, Homo sapiens
tgatggttcccctg

SEQ ID NO: 1506336 - DNA, 19 bp, Homo sapiens
tgatgtaaaatcttgtcat

SEQ ID NO: 1506337 - DNA, 14 bp, Homo sapiens
tgatgtaaggactg

SEQ ID NO: 1506338 - DNA, 17 bp, Homo sapiens
tgatgtaatctctctgc

SEQ ID NO: 1506339 - DNA, 23 bp, Homo sapiens
tgatgtaatctctctgcagctgc

SEQ ID NO: 1506340 - DNA, 15 bp, Homo sapiens
tgatgtacagatttt

SEQ ID NO: 1506341 - DNA, 18 bp, Homo sapiens
tgatgtacagtctgtcat

SEQ ID NO: 1506342 - DNA, 20 bp, Homo sapiens
tgatgtagggtaaggtgcct

SEQ ID NO: 1506343 - DNA, 15 bp, Homo sapiens
tgatgtatatgttta

SEQ ID NO: 1506344 - DNA, 11 bp, Homo sapiens
tgatgtatgtg

SEQ ID NO: 1506345 - DNA, 13 bp, Homo sapiens
tgatgtatgtgtg

SEQ ID NO: 1506346 - DNA, 21 bp, Homo sapiens
tgatgtatgtgtgaaacaatg

SEQ ID NO: 1506347 - DNA, 20 bp, Homo sapiens
tgatgtattctagctaatgt

SEQ ID NO: 1506348 - DNA, 11 bp, Homo sapiens
tgatgtcatct

SEQ ID NO: 1506349 - DNA, 16 bp, Homo sapiens
tgatgtcatcttgagc

SEQ ID NO: 1506350 - DNA, 15 bp, Homo sapiens
tgatgtcatgtactt

SEQ ID NO: 1506351 - DNA, 15 bp, Homo sapiens
tgatgtccagaagaa

SEQ ID NO: 1506352 - DNA, 16 bp, Homo sapiens
tgatgtgatattctgt

SEQ ID NO: 1506353 - DNA, 13 bp, Homo sapiens
tgatgtgccacta

SEQ ID NO: 1506354 - DNA, 18 bp, Homo sapiens
tgatgtgtttatttatag

SEQ ID NO: 1506355 - DNA, 16 bp, Homo sapiens
tgatgttaaatgtaat

SEQ ID NO: 1506356 - DNA, 20 bp, Homo sapiens
tgatgttaacccattccagt

SEQ ID NO: 1506357 - DNA, 16 bp, Homo sapiens
tgatgttccacctgcc

SEQ ID NO: 1506358 - DNA, 18 bp, Homo sapiens
tgatgttccacctgccac

SEQ ID NO: 1506359 - DNA, 14 bp, Homo sapiens
tgatgttctaaggc

SEQ ID NO: 1506360 - DNA, 15 bp, Homo sapiens
tgatgttctaaggct

SEQ ID NO: 1506361 - DNA, 18 bp, Homo sapiens
tgatgttctaaggctctg

SEQ ID NO: 1506362 - DNA, 19 bp, Homo sapiens
tgatgttctaaggctctga

SEQ ID NO: 1506363 - DNA, 17 bp, Homo sapiens
tgatgttgagggaacag

SEQ ID NO: 1506364 - DNA, 13 bp, Homo sapiens
tgatgttggaaga

SEQ ID NO: 1506365 - DNA, 17 bp, Homo sapiens
tgatgtttccagctgcc

SEQ ID NO: 1506366 - DNA, 18 bp, Homo sapiens
tgatgtttccagctgcca

SEQ ID NO: 1506367 - DNA, 14 bp, Homo sapiens
tgatgtttctgtga

SEQ ID NO: 1506368 - DNA, 15 bp, Homo sapiens
tgatgtttctgtgaa

SEQ ID NO: 1506369 - DNA, 17 bp, Homo sapiens
tgatgtttctgtgaaat

SEQ ID NO: 1506370 - DNA, 13 bp, Homo sapiens
tgatgtttgtcct

SEQ ID NO: 1506371 - DNA, 14 bp, Homo sapiens
tgatgtttgtgcag

SEQ ID NO: 1506372 - DNA, 20 bp, Homo sapiens
tgatgtttgtggcctcagaa

SEQ ID NO: 1506373 - DNA, 18 bp, Homo sapiens
tgatgttttcctataata

SEQ ID NO: 1506374 - DNA, 14 bp, Homo sapiens
tgatgttttgccgt

SEQ ID NO: 1506375 - DNA, 23 bp, Homo sapiens
tgatgttttttctgtaatgtaaa

SEQ ID NO: 1506376 - DNA, 15 bp, Homo sapiens
tgattaaatatttga

SEQ ID NO: 1506377 - DNA, 15 bp, Homo sapiens
tgattaacaatgtat

SEQ ID NO: 1506378 - DNA, 19 bp, Homo sapiens
tgattaacaatgtatttta

SEQ ID NO: 1506379 - DNA, 22 bp, Homo sapiens
tgattaacaatgtattttaata

SEQ ID NO: 1506380 - DNA, 15 bp, Homo sapiens
tgcaagaagtcttga

SEQ ID NO: 1506381 - DNA, 20 bp, Homo sapiens
tgcaagaagtcttgagaaaa

SEQ ID NO: 1506382 - DNA, 17 bp, Homo sapiens
tgcaagaccctcccatg

SEQ ID NO: 1506383 - DNA, 21 bp, Homo sapiens
tgcaagacctagtcccctttc

SEQ ID NO: 1506384 - DNA, 13 bp, Homo sapiens
tgcaagactcgaa

SEQ ID NO: 1506385 - DNA, 16 bp, Homo sapiens
tgcaagagaatctgat

SEQ ID NO: 1506386 - DNA, 20 bp, Homo sapiens
tgcaagagaatctgatcaat

SEQ ID NO: 1506387 - DNA, 15 bp, Homo sapiens
tgcaagagtgattgc

SEQ ID NO: 1506388 - DNA, 17 bp, Homo sapiens
tgcaagagtgattgcag

SEQ ID NO: 1506389 - DNA, 19 bp, Homo sapiens
tgcaagagtgattgcagct

SEQ ID NO: 1506390 - DNA, 20 bp, Homo sapiens
tgcaagagtgattgcagctt

SEQ ID NO: 1506391 - DNA, 13 bp, Homo sapiens
tgcaagagtggac

SEQ ID NO: 1506392 - DNA, 19 bp, Homo sapiens
tgcaagatgcttggttgtg

SEQ ID NO: 1506393 - DNA, 22 bp, Homo sapiens
tgcaagatggacacgagccaca

SEQ ID NO: 1506394 - DNA, 16 bp, Homo sapiens
tgcaagatgtgaatta

SEQ ID NO: 1506395 - DNA, 17 bp, Homo sapiens
tgcaagcagaggaccag

SEQ ID NO: 1506396 - DNA, 19 bp, Homo sapiens
tgcaagcaggactttgagg

SEQ ID NO: 1506397 - DNA, 13 bp, Homo sapiens
tgcaagccccagg

SEQ ID NO: 1506398 - DNA, 14 bp, Homo sapiens
tgcaagccccaggg

SEQ ID NO: 1506399 - DNA, 15 bp, Homo sapiens
tgcaagccccagggc

SEQ ID NO: 1506400 - DNA, 17 bp, Homo sapiens
tgcaagccccagggcct

SEQ ID NO: 1506401 - DNA, 15 bp, Homo sapiens
tgcaagcttcttgct

SEQ ID NO: 1506402 - DNA, 16 bp, Homo sapiens
tgcaaggaaggaaaga

SEQ ID NO: 1506403 - DNA, 23 bp, Homo sapiens
tgcaaggcctggtgtttcttgat

SEQ ID NO: 1506404 - DNA, 19 bp, Homo sapiens
tgcaaggtatttctccagt

SEQ ID NO: 1506405 - DNA, 13 bp, Homo sapiens
tgcaagttgagga

SEQ ID NO: 1506406 - DNA, 18 bp, Homo sapiens
tgcaagttgaggacttct

SEQ ID NO: 1506407 - DNA, 19 bp, Homo sapiens
tgcaagtttctgtttcaaa

SEQ ID NO: 1506408 - DNA, 16 bp, Homo sapiens
tgcaataaaatttaaa

SEQ ID NO: 1506409 - DNA, 19 bp, Homo sapiens
tgcaataaatctgacccag

SEQ ID NO: 1506410 - DNA, 23 bp, Homo sapiens
tgcaataaatctgacccagtgcc

SEQ ID NO: 1506411 - DNA, 15 bp, Homo sapiens
tgcaataactctggg

SEQ ID NO: 1506412 - DNA, 16 bp, Homo sapiens
tgcaataactctggga

SEQ ID NO: 1506413 - DNA, 19 bp, Homo sapiens
tgcaatagagactgtagat

SEQ ID NO: 1506414 - DNA, 22 bp, Homo sapiens
tgcaatagattactgatgtgat

SEQ ID NO: 1506415 - DNA, 20 bp, Homo sapiens
tgcaatagtgcaacatctct

SEQ ID NO: 1506416 - DNA, 14 bp, Homo sapiens
tgcaatatctgaag

SEQ ID NO: 1506417 - DNA, 15 bp, Homo sapiens
tgcaatatctgaagc

SEQ ID NO: 1506418 - DNA, 23 bp, Homo sapiens
tgcaatatttattacacaaagaa

SEQ ID NO: 1506419 - DNA, 14 bp, Homo sapiens
tgcaatccatttat

SEQ ID NO: 1506420 - DNA, 13 bp, Homo sapiens
tgcaatctactgg

SEQ ID NO: 1506421 - DNA, 20 bp, Homo sapiens
tgcaattaaacttccaaaga

SEQ ID NO: 1506422 - DNA, 22 bp, Homo sapiens
tgcaattgtaggggtgtgtgtg

SEQ ID NO: 1506423 - DNA, 12 bp, Homo sapiens
tgcaattgtctt

SEQ ID NO: 1506424 - DNA, 18 bp, Homo sapiens
tgcaatttcaaggttcta

SEQ ID NO: 1506425 - DNA, 20 bp, Homo sapiens
tgcaatttcaaggttctaac

SEQ ID NO: 1506426 - DNA, 19 bp, Homo sapiens
tgcaatttgggagatatat

SEQ ID NO: 1506427 - DNA, 17 bp, Homo sapiens
tgcaatttgtttaaaga

SEQ ID NO: 1506428 - DNA, 20 bp, Homo sapiens
tgcaattttaattgattatt

SEQ ID NO: 1506429 - DNA, 15 bp, Homo sapiens
tgcacaaacatgaaa

SEQ ID NO: 1506430 - DNA, 18 bp, Homo sapiens
tgcacaaacttgtgagca

SEQ ID NO: 1506431 - DNA, 18 bp, Homo sapiens
tgcacaacagagtaacta

SEQ ID NO: 1506432 - DNA, 13 bp, Homo sapiens
tgcacaagctcag

SEQ ID NO: 1506433 - DNA, 13 bp, Homo sapiens
tgcacaaggaaat

SEQ ID NO: 1506434 - DNA, 16 bp, Homo sapiens
tgcacaagtctttcca

SEQ ID NO: 1506435 - DNA, 15 bp, Homo sapiens
tgcacaataaaaatg

SEQ ID NO: 1506436 - DNA, 18 bp, Homo sapiens
tgcacaattttgtcctaa

SEQ ID NO: 1506437 - DNA, 14 bp, Homo sapiens
tgcacacacagctc

SEQ ID NO: 1506438 - DNA, 15 bp, Homo sapiens
tgcacacacagctcc

SEQ ID NO: 1506439 - DNA, 16 bp, Homo sapiens
tgcacacacctgcctg

SEQ ID NO: 1506440 - DNA, 14 bp, Homo sapiens
tgcacacaggacag

SEQ ID NO: 1506441 - DNA, 16 bp, Homo sapiens
tgcacacaggacagcg

SEQ ID NO: 1506442 - DNA, 13 bp, Homo sapiens
tgcacacagtgac

SEQ ID NO: 1506443 - DNA, 14 bp, Homo sapiens
tgcacacatatata

SEQ ID NO: 1506444 - DNA, 18 bp, Homo sapiens
tgcacaccttttccccag

SEQ ID NO: 1506445 - DNA, 21 bp, Homo sapiens
tgcacaccttttccccaggag

SEQ ID NO: 1506446 - DNA, 17 bp, Homo sapiens
tgcacacggctggtcac

SEQ ID NO: 1506447 - DNA, 23 bp, Homo sapiens
tgcacacggctggtcactctgcc

SEQ ID NO: 1506448 - DNA, 19 bp, Homo sapiens
tgcacactagcctctccag

SEQ ID NO: 1506449 - DNA, 21 bp, Homo sapiens
tgcacactagcctctccagga

SEQ ID NO: 1506450 - DNA, 18 bp, Homo sapiens
tgcacactcccctgcact

SEQ ID NO: 1506451 - DNA, 23 bp, Homo sapiens
tgcacacttgtgtgtgggctgtg

SEQ ID NO: 1506452 - DNA, 20 bp, Homo sapiens
tgcacagatgccatggcctg

SEQ ID NO: 1506453 - DNA, 15 bp, Homo sapiens
tgcacagcatttgct

SEQ ID NO: 1506454 - DNA, 20 bp, Homo sapiens
tgcacagcatttgctttcct

SEQ ID NO: 1506455 - DNA, 22 bp, Homo sapiens
tgcacagccaacgagacacatt

SEQ ID NO: 1506456 - DNA, 10 bp, Homo sapiens
tgcacagctg

SEQ ID NO: 1506457 - DNA, 16 bp, Homo sapiens
tgcacagctgcttgtc

SEQ ID NO: 1506458 - DNA, 23 bp, Homo sapiens
tgcacagctgcttgtcctgctct

SEQ ID NO: 1506459 - DNA, 11 bp, Homo sapiens
tgcacagctgt

SEQ ID NO: 1506460 - DNA, 19 bp, Homo sapiens
tgcacagctgtagtacccc

SEQ ID NO: 1506461 - DNA, 20 bp, Homo sapiens
tgcacaggcacacagggccc

SEQ ID NO: 1506462 - DNA, 21 bp, Homo sapiens
tgcacaggcagatgtttgcct

SEQ ID NO: 1506463 - DNA, 14 bp, Homo sapiens
tgcacaggcctctg

SEQ ID NO: 1506464 - DNA, 15 bp, Homo sapiens
tgcacaggcctctgc

SEQ ID NO: 1506465 - DNA, 14 bp, Homo sapiens
tgcacagggtgtgg

SEQ ID NO: 1506466 - DNA, 19 bp, Homo sapiens
tgcacagtacaataatgta

SEQ ID NO: 1506467 - DNA, 21 bp, Homo sapiens
tgcacagtacaataatgtact

SEQ ID NO: 1506468 - DNA, 16 bp, Homo sapiens
tgcacagtatttgtaa

SEQ ID NO: 1506469 - DNA, 17 bp, Homo sapiens
tgcacagtgacttctga

SEQ ID NO: 1506470 - DNA, 20 bp, Homo sapiens
tgcacagtgacttctgagat

SEQ ID NO: 1506471 - DNA, 21 bp, Homo sapiens
tgcacagtgacttctgagatc

SEQ ID NO: 1506472 - DNA, 17 bp, Homo sapiens
tgcacagtggcttcttt

SEQ ID NO: 1506473 - DNA, 16 bp, Homo sapiens
tgcacagtgtgtgact

SEQ ID NO: 1506474 - DNA, 22 bp, Homo sapiens
tgcacagttagcaaactttgta

SEQ ID NO: 1506475 - DNA, 23 bp, Homo sapiens
tgcacagttagttgtgaaagaaa

SEQ ID NO: 1506476 - DNA, 17 bp, Homo sapiens
tgcacatatggactctg

SEQ ID NO: 1506477 - DNA, 20 bp, Homo sapiens
tgcacatccgcgtgtgcctg

SEQ ID NO: 1506478 - DNA, 24 bp, Homo sapiens
tgcacatcttggctatgtaattct

SEQ ID NO: 1506479 - DNA, 16 bp, Homo sapiens
tgcacatgctgtctgg

SEQ ID NO: 1506480 - DNA, 23 bp, Homo sapiens
tgcacatgtcttgtacatgtgta

SEQ ID NO: 1506481 - DNA, 18 bp, Homo sapiens
tgcacatgtttcctctag

SEQ ID NO: 1506482 - DNA, 15 bp, Homo sapiens
tgcacattcctggcc

SEQ ID NO: 1506483 - DNA, 18 bp, Homo sapiens
tgcacattcctggccccg

SEQ ID NO: 1506484 - DNA, 21 bp, Homo sapiens
tgcacattgcctgttctgctt

SEQ ID NO: 1506485 - DNA, 16 bp, Homo sapiens
tgcacattttgtacat

SEQ ID NO: 1506486 - DNA, 17 bp, Homo sapiens
tgcacattttgtacatt

SEQ ID NO: 1506487 - DNA, 13 bp, Homo sapiens
tgcaccaaagaca

SEQ ID NO: 1506488 - DNA, 23 bp, Homo sapiens
tgcaccaagaaagcttcttcaga

SEQ ID NO: 1506489 - DNA, 12 bp, Homo sapiens
tgcaccaccaag

SEQ ID NO: 1506490 - DNA, 17 bp, Homo sapiens
tgattgaggagctgcac

SEQ ID NO: 1506491 - DNA, 18 bp, Homo sapiens
tgattgatcacacagtgt

SEQ ID NO: 1506492 - DNA, 20 bp, Homo sapiens
tgattgcagaattgtttaga

SEQ ID NO: 1506493 - DNA, 12 bp, Homo sapiens
tgattgcagctt

SEQ ID NO: 1506494 - DNA, 19 bp, Homo sapiens
tgattgcagttatttcaaa

SEQ ID NO: 1506495 - DNA, 19 bp, Homo sapiens
tgattggaagggcttttca

SEQ ID NO: 1506496 - DNA, 22 bp, Homo sapiens
tgattggaagggcttttcaaaa

SEQ ID NO: 1506497 - DNA, 23 bp, Homo sapiens
tgattggaagggcttttcaaaat

SEQ ID NO: 1506498 - DNA, 16 bp, Homo sapiens
tgattggaccaggcca

SEQ ID NO: 1506499 - DNA, 17 bp, Homo sapiens
tgattggaccaggccat

SEQ ID NO: 1506500 - DNA, 18 bp, Homo sapiens
tgattggattattcattt

SEQ ID NO: 1506501 - DNA, 21 bp, Homo sapiens
tgattggcctgtagagttgct

SEQ ID NO: 1506502 - DNA, 13 bp, Homo sapiens
tgattggctggtt

SEQ ID NO: 1506503 - DNA, 19 bp, Homo sapiens
tgattggcttaaatccagt

SEQ ID NO: 1506504 - DNA, 11 bp, Homo sapiens
tgattggcttt

SEQ ID NO: 1506505 - DNA, 18 bp, Homo sapiens
tgattggttgtgccttcc

SEQ ID NO: 1506506 - DNA, 17 bp, Homo sapiens
tgattgtctagtgagga

SEQ ID NO: 1506507 - DNA, 14 bp, Homo sapiens
tgattgtttacagt

SEQ ID NO: 1506508 - DNA, 16 bp, Homo sapiens
tgatttaaaacatgta

SEQ ID NO: 1506509 - DNA, 20 bp, Homo sapiens
tgatttaagtgtctcactaa

SEQ ID NO: 1506510 - DNA, 22 bp, Homo sapiens
tgatttaggagaagccaggaat

SEQ ID NO: 1506511 - DNA, 17 bp, Homo sapiens
tgatttataaacagaca

SEQ ID NO: 1506512 - DNA, 16 bp, Homo sapiens
tgatttattgaaattt

SEQ ID NO: 1506513 - DNA, 14 bp, Homo sapiens
tgatttcagttttt

SEQ ID NO: 1506514 - DNA, 22 bp, Homo sapiens
tgatttcagtttttcatttgtt

SEQ ID NO: 1506515 - DNA, 23 bp, Homo sapiens
tgatttcagtttttcatttgttt

SEQ ID NO: 1506516 - DNA, 16 bp, Homo sapiens
tgatttcatcttctgg

SEQ ID NO: 1506517 - DNA, 17 bp, Homo sapiens
tgatttcatcttctgga

SEQ ID NO: 1506518 - DNA, 13 bp, Homo sapiens
tgatttccaggcc

SEQ ID NO: 1506519 - DNA, 15 bp, Homo sapiens
tgatttccaggcccc

SEQ ID NO: 1506520 - DNA, 20 bp, Homo sapiens
tgatttccaggcccctgagg

SEQ ID NO: 1506521 - DNA, 15 bp, Homo sapiens
tgatttcctaaacat

SEQ ID NO: 1506522 - DNA, 18 bp, Homo sapiens
tgatttcctaaacataat

SEQ ID NO: 1506523 - DNA, 14 bp, Homo sapiens
tgatttctaattgt

SEQ ID NO: 1506524 - DNA, 13 bp, Homo sapiens
tgatttctagaac

SEQ ID NO: 1506525 - DNA, 19 bp, Homo sapiens
tgatttggtgaccaactgt

SEQ ID NO: 1506526 - DNA, 20 bp, Homo sapiens
tgatttgtcccagcctgggg

SEQ ID NO: 1506527 - DNA, 20 bp, Homo sapiens
tgatttgtgaaacagttgct

SEQ ID NO: 1506528 - DNA, 15 bp, Homo sapiens
tgattttaaatgtgt

SEQ ID NO: 1506529 - DNA, 17 bp, Homo sapiens
tgattttaaatgtgtga

SEQ ID NO: 1506530 - DNA, 22 bp, Homo sapiens
tgattttaagtttctctgcaga

SEQ ID NO: 1506531 - DNA, 21 bp, Homo sapiens
tgattttaatgaaatcaaatg

SEQ ID NO: 1506532 - DNA, 23 bp, Homo sapiens
tgattttaatgaaatcaaatgta

SEQ ID NO: 1506533 - DNA, 19 bp, Homo sapiens
tgattttacaattgaaatg

SEQ ID NO: 1506534 - DNA, 19 bp, Homo sapiens
tgattttagatttctttga

SEQ ID NO: 1506535 - DNA, 22 bp, Homo sapiens
tgattttaggagctaaggctct

SEQ ID NO: 1506536 - DNA, 17 bp, Homo sapiens
tgattttatgtttaaaa

SEQ ID NO: 1506537 - DNA, 12 bp, Homo sapiens
tgattttattct

SEQ ID NO: 1506538 - DNA, 20 bp, Homo sapiens
tgattttcaaagctttttcc

SEQ ID NO: 1506539 - DNA, 15 bp, Homo sapiens
tgattttcctttttc

SEQ ID NO: 1506540 - DNA, 16 bp, Homo sapiens
tgatttttaatggaaa

SEQ ID NO: 1506541 - DNA, 17 bp, Homo sapiens
tgatttttccgtccctt

SEQ ID NO: 1506542 - DNA, 13 bp, Homo sapiens
tgatttttctctt

SEQ ID NO: 1506543 - DNA, 22 bp, Homo sapiens
tgatttttgcctcttccagtct

SEQ ID NO: 1506544 - DNA, 21 bp, Homo sapiens
tgatttttggtcttctgttga

SEQ ID NO: 1506545 - DNA, 18 bp, Homo sapiens
tgatttttgtaagacaat

SEQ ID NO: 1506546 - DNA, 18 bp, Homo sapiens
tgattttttaagcagact

SEQ ID NO: 1506547 - DNA, 21 bp, Homo sapiens
tgattttttaaggagctgggg

SEQ ID NO: 1506548 - DNA, 23 bp, Homo sapiens
tgattttttaaggagctggggga

SEQ ID NO: 1506549 - DNA, 22 bp, Homo sapiens
tgcactgaggcagcgacctcaa

SEQ ID NO: 1506550 - DNA, 17 bp, Homo sapiens
tgcactgagggccacac

SEQ ID NO: 1506551 - DNA, 15 bp, Homo sapiens
tgcactgatgttgtg

SEQ ID NO: 1506552 - DNA, 18 bp, Homo sapiens
tgcactgcctgcatgagc

SEQ ID NO: 1506553 - DNA, 15 bp, Homo sapiens
tgcactgctgtaact

SEQ ID NO: 1506554 - DNA, 18 bp, Homo sapiens
tgcactggagtccagtct

SEQ ID NO: 1506555 - DNA, 21 bp, Homo sapiens
tgcactggagtccagtctctt

SEQ ID NO: 1506556 - DNA, 14 bp, Homo sapiens
tgcactgtaaaatg

SEQ ID NO: 1506557 - DNA, 20 bp, Homo sapiens
tgcactgtaaattgctggca

SEQ ID NO: 1506558 - DNA, 15 bp, Homo sapiens
tgcactgtatgctgg

SEQ ID NO: 1506559 - DNA, 15 bp, Homo sapiens
tgcactgtgaaggac

SEQ ID NO: 1506560 - DNA, 21 bp, Homo sapiens
tgcactgtgaatcctggcaag

SEQ ID NO: 1506561 - DNA, 15 bp, Homo sapiens
tgcactgtggtttca

SEQ ID NO: 1506562 - DNA, 18 bp, Homo sapiens
tgcactgtgtgctgactg

SEQ ID NO: 1506563 - DNA, 16 bp, Homo sapiens
tgcacttaaggcactc

SEQ ID NO: 1506564 - DNA, 15 bp, Homo sapiens
tgcacttaatggctg

SEQ ID NO: 1506565 - DNA, 18 bp, Homo sapiens
tgcacttatgatttcatg

SEQ ID NO: 1506566 - DNA, 19 bp, Homo sapiens
tgcacttatgatttcatgt

SEQ ID NO: 1506567 - DNA, 19 bp, Homo sapiens
tgcacttattgaccatttt

SEQ ID NO: 1506568 - DNA, 23 bp, Homo sapiens
tgcacttattgaccattttttaa

SEQ ID NO: 1506569 - DNA, 14 bp, Homo sapiens
tgcacttctgtaaa

SEQ ID NO: 1506570 - DNA, 22 bp, Homo sapiens
tgcactttttaagtttgaagag

SEQ ID NO: 1506571 - DNA, 20 bp, Homo sapiens
tgcactttttcttaatcatt

SEQ ID NO: 1506572 - DNA, 15 bp, Homo sapiens
tgcacttttttatga

SEQ ID NO: 1506573 - DNA, 15 bp, Homo sapiens
tgcagaaaatattta

SEQ ID NO: 1506574 - DNA, 16 bp, Homo sapiens
tgcagaaaatatttaa

SEQ ID NO: 1506575 - DNA, 15 bp, Homo sapiens
tgcagaaactactga

SEQ ID NO: 1506576 - DNA, 15 bp, Homo sapiens
tgcagaaaggagaga

SEQ ID NO: 1506577 - DNA, 17 bp, Homo sapiens
tgcagaaatagacaaaa

SEQ ID NO: 1506578 - DNA, 19 bp, Homo sapiens
tgcagaaatagacaaaaag

SEQ ID NO: 1506579 - DNA, 20 bp, Homo sapiens
tgcagaacccccaggtggcc

SEQ ID NO: 1506580 - DNA, 21 bp, Homo sapiens
tgcagaacccccaggtggcct

SEQ ID NO: 1506581 - DNA, 23 bp, Homo sapiens
tgcagaacccccaggtggcctgc

SEQ ID NO: 1506582 - DNA, 23 bp, Homo sapiens
tgcagaactcatttattcagcaa

SEQ ID NO: 1506583 - DNA, 15 bp, Homo sapiens
tgcagaactgtagct

SEQ ID NO: 1506584 - DNA, 14 bp, Homo sapiens
tgcagaagaagctg

SEQ ID NO: 1506585 - DNA, 15 bp, Homo sapiens
tgcagaaggaaagaa

SEQ ID NO: 1506586 - DNA, 14 bp, Homo sapiens
tgcagaagtattct

SEQ ID NO: 1506587 - DNA, 19 bp, Homo sapiens
tgcagaatatgacaatcta

SEQ ID NO: 1506588 - DNA, 14 bp, Homo sapiens
tgcagaatcccttt

SEQ ID NO: 1506589 - DNA, 23 bp, Homo sapiens
tgcagaatccctttgcacctgag

SEQ ID NO: 1506590 - DNA, 15 bp, Homo sapiens
tggcatttccctact

SEQ ID NO: 1506591 - DNA, 18 bp, Homo sapiens
tggccaaaagcagtaaat

SEQ ID NO: 1506592 - DNA, 19 bp, Homo sapiens
tggccaaacatcagacctg

SEQ ID NO: 1506593 - DNA, 20 bp, Homo sapiens
tggccaaagagcctttccaa

SEQ ID NO: 1506594 - DNA, 22 bp, Homo sapiens
tggccaacattgtaaaacccca

SEQ ID NO: 1506595 - DNA, 14 bp, Homo sapiens
tggccaactgcaaa

SEQ ID NO: 1506596 - DNA, 22 bp, Homo sapiens
tggccaactgcaaaaaaagcct

SEQ ID NO: 1506597 - DNA, 16 bp, Homo sapiens
tggccaagggggtgga

SEQ ID NO: 1506598 - DNA, 16 bp, Homo sapiens
tggccaaggtgtccag

SEQ ID NO: 1506599 - DNA, 22 bp, Homo sapiens
tggccaaggtgtccagggtcct

SEQ ID NO: 1506600 - DNA, 16 bp, Homo sapiens
tggccaatgcggccca

SEQ ID NO: 1506601 - DNA, 19 bp, Homo sapiens
tggccacagtgtcactggt

SEQ ID NO: 1506602 - DNA, 20 bp, Homo sapiens
tggccacagtgtcactggtc

SEQ ID NO: 1506603 - DNA, 16 bp, Homo sapiens
tggccaccaggctggc

SEQ ID NO: 1506604 - DNA, 17 bp, Homo sapiens
tggccaccaggctggcg

SEQ ID NO: 1506605 - DNA, 20 bp, Homo sapiens
tggccaccaggctggcgcag

SEQ ID NO: 1506606 - DNA, 21 bp, Homo sapiens
tggccaccaggctggcgcagc

SEQ ID NO: 1506607 - DNA, 23 bp, Homo sapiens
tggccaccaggctggcgcagcca

SEQ ID NO: 1506608 - DNA, 16 bp, Homo sapiens
tggccaccccgtgcca

SEQ ID NO: 1506609 - DNA, 11 bp, Homo sapiens
tggccaccctg

SEQ ID NO: 1506610 - DNA, 22 bp, Homo sapiens
tggccacctgaggtgggcccag

SEQ ID NO: 1506611 - DNA, 14 bp, Homo sapiens
tggccacgggggca

SEQ ID NO: 1506612 - DNA, 18 bp, Homo sapiens
tggccacgggggcagtgt

SEQ ID NO: 1506613 - DNA, 18 bp, Homo sapiens
tggccactaaagcttcag

SEQ ID NO: 1506614 - DNA, 22 bp, Homo sapiens
tggccactccagacccctggct

SEQ ID NO: 1506615 - DNA, 22 bp, Homo sapiens
tggccactgggtctcactcctg

SEQ ID NO: 1506616 - DNA, 21 bp, Homo sapiens
tggccacttgggtcttccctg

SEQ ID NO: 1506617 - DNA, 17 bp, Homo sapiens
tggccagagagggccca

SEQ ID NO: 1506618 - DNA, 18 bp, Homo sapiens
tggccagagagggcccag

SEQ ID NO: 1506619 - DNA, 21 bp, Homo sapiens
tggccagagagggcccagctg

SEQ ID NO: 1506620 - DNA, 13 bp, Homo sapiens
tggccagagctgg

SEQ ID NO: 1506621 - DNA, 14 bp, Homo sapiens
tggccagagctgga

SEQ ID NO: 1506622 - DNA, 23 bp, Homo sapiens
tggccagagctggaaggcagggc

SEQ ID NO: 1506623 - DNA, 18 bp, Homo sapiens
tggccagaggtgtcaccc

SEQ ID NO: 1506624 - DNA, 19 bp, Homo sapiens
tggccagcacaccaagtgg

SEQ ID NO: 1506625 - DNA, 11 bp, Homo sapiens
tggccagcccg

SEQ ID NO: 1506626 - DNA, 13 bp, Homo sapiens
tggccagcccggc

SEQ ID NO: 1506627 - DNA, 16 bp, Homo sapiens
tggccagcccggctgg

SEQ ID NO: 1506628 - DNA, 17 bp, Homo sapiens
tggccagcccggctggt

SEQ ID NO: 1506629 - DNA, 16 bp, Homo sapiens
tggccagcctggatct

SEQ ID NO: 1506630 - DNA, 20 bp, Homo sapiens
tggccagcgtcttgctctgt

SEQ ID NO: 1506631 - DNA, 18 bp, Homo sapiens
tggccagctctgagggga

SEQ ID NO: 1506632 - DNA, 23 bp, Homo sapiens
tggccagctctgaggggaggcac

SEQ ID NO: 1506633 - DNA, 15 bp, Homo sapiens
tgcagctactggaat

SEQ ID NO: 1506634 - DNA, 17 bp, Homo sapiens
tgcagctcaagggctgg

SEQ ID NO: 1506635 - DNA, 13 bp, Homo sapiens
tgcagctctcttt

SEQ ID NO: 1506636 - DNA, 21 bp, Homo sapiens
tgcagctgaaattgaaaagtt

SEQ ID NO: 1506637 - DNA, 21 bp, Homo sapiens
tgcagctgacctctgttgtcc

SEQ ID NO: 1506638 - DNA, 18 bp, Homo sapiens
tgcagctgatccatagga

SEQ ID NO: 1506639 - DNA, 13 bp, Homo sapiens
tgcagctgctccc

SEQ ID NO: 1506640 - DNA, 15 bp, Homo sapiens
tgcagctgctcccca

SEQ ID NO: 1506641 - DNA, 15 bp, Homo sapiens
tgcagctggcccact

SEQ ID NO: 1506642 - DNA, 13 bp, Homo sapiens
tgcagctgggccc

SEQ ID NO: 1506643 - DNA, 14 bp, Homo sapiens
tgcagctgggcccc

SEQ ID NO: 1506644 - DNA, 14 bp, Homo sapiens
tgcagctgtttcaa

SEQ ID NO: 1506645 - DNA, 20 bp, Homo sapiens
tgcagcttcaacttttctct

SEQ ID NO: 1506646 - DNA, 22 bp, Homo sapiens
tgcagctttatgttcatttgtt

SEQ ID NO: 1506647 - DNA, 14 bp, Homo sapiens
tgcagctttgcaaa

SEQ ID NO: 1506648 - DNA, 15 bp, Homo sapiens
tgcagctttgcaaac

SEQ ID NO: 1506649 - DNA, 19 bp, Homo sapiens
tgcagcttttggttaatat

SEQ ID NO: 1506650 - DNA, 20 bp, Homo sapiens
tgcagcttttggttaatatg

SEQ ID NO: 1506651 - DNA, 24 bp, Homo sapiens
tgcagcttttggttaatatgtctt

SEQ ID NO: 1506652 - DNA, 20 bp, Homo sapiens
tgcaggaacgagcactggcc

SEQ ID NO: 1506653 - DNA, 22 bp, Homo sapiens
tgcaggaacgagcactggccag

SEQ ID NO: 1506654 - DNA, 18 bp, Homo sapiens
tgcaggaagaggcccact

SEQ ID NO: 1506655 - DNA, 16 bp, Homo sapiens
tgcaggaataaggcct

SEQ ID NO: 1506656 - DNA, 17 bp, Homo sapiens
tgcaggaataaggcctt

SEQ ID NO: 1506657 - DNA, 14 bp, Homo sapiens
tgcaggacaggagg

SEQ ID NO: 1506658 - DNA, 19 bp, Homo sapiens
tgcaggacaggaggcggcc

SEQ ID NO: 1506659 - DNA, 20 bp, Homo sapiens
tgcaggacaggaggcggccc

SEQ ID NO: 1506660 - DNA, 23 bp, Homo sapiens
tgcaggacaggaggcggcccggc

SEQ ID NO: 1506661 - DNA, 14 bp, Homo sapiens
tgcaggacattaat

SEQ ID NO: 1506662 - DNA, 23 bp, Homo sapiens
tgcaggaccttgggcacatctgc

SEQ ID NO: 1506663 - DNA, 14 bp, Homo sapiens
tgcaggagctagtt

SEQ ID NO: 1506664 - DNA, 15 bp, Homo sapiens
tgcaggaggtggaga

SEQ ID NO: 1506665 - DNA, 14 bp, Homo sapiens
tgcaggatggtgtc

SEQ ID NO: 1506666 - DNA, 17 bp, Homo sapiens
tgcaggccactgtgagc

SEQ ID NO: 1506667 - DNA, 19 bp, Homo sapiens
tgcaggccccgcttgtcca

SEQ ID NO: 1506668 - DNA, 12 bp, Homo sapiens
tgcaggccctgg

SEQ ID NO: 1506669 - DNA, 17 bp, Homo sapiens
tgcaggccctggcctcc

SEQ ID NO: 1506670 - DNA, 19 bp, Homo sapiens
tgcaggccctggcctcccc

SEQ ID NO: 1506671 - DNA, 23 bp, Homo sapiens
tgcataagtaattaaaatatact

SEQ ID NO: 1506672 - DNA, 22 bp, Homo sapiens
tgcataataagctaaagaggct

SEQ ID NO: 1506673 - DNA, 24 bp, Homo sapiens
tgcataataagctaaagaggctga

SEQ ID NO: 1506674 - DNA, 17 bp, Homo sapiens
tgcataatagctacagt

SEQ ID NO: 1506675 - DNA, 19 bp, Homo sapiens
tgcataatgtccctctctt

SEQ ID NO: 1506676 - DNA, 23 bp, Homo sapiens
tgcataatgtccctctcttggct

SEQ ID NO: 1506677 - DNA, 17 bp, Homo sapiens
tgcataatgtttctgga

SEQ ID NO: 1506678 - DNA, 16 bp, Homo sapiens
tgcatactcaaggtga

SEQ ID NO: 1506679 - DNA, 22 bp, Homo sapiens
tgcatacttcctggattttctt

SEQ ID NO: 1506680 - DNA, 13 bp, Homo sapiens
tgcatactttgta

SEQ ID NO: 1506681 - DNA, 16 bp, Homo sapiens
tgcatagcgtcctgcc

SEQ ID NO: 1506682 - DNA, 19 bp, Homo sapiens
tgcatagcgtcctgccctg

SEQ ID NO: 1506683 - DNA, 18 bp, Homo sapiens
tgcataggaatttagaac

SEQ ID NO: 1506684 - DNA, 16 bp, Homo sapiens
tgcataggtttagcag

SEQ ID NO: 1506685 - DNA, 15 bp, Homo sapiens
tgcatagtcccagct

SEQ ID NO: 1506686 - DNA, 16 bp, Homo sapiens
tgcatagtcccagcta

SEQ ID NO: 1506687 - DNA, 20 bp, Homo sapiens
tgcatagtcccagctaccca

SEQ ID NO: 1506688 - DNA, 21 bp, Homo sapiens
tgcatagttgtagacaaagta

SEQ ID NO: 1506689 - DNA, 17 bp, Homo sapiens
tgcatatatatatgtgt

SEQ ID NO: 1506690 - DNA, 19 bp, Homo sapiens
tgcatatcacccttccctg

SEQ ID NO: 1506691 - DNA, 21 bp, Homo sapiens
tgcatatcctggtgtctagtt

SEQ ID NO: 1506692 - DNA, 13 bp, Homo sapiens
tgcatatctgcct

SEQ ID NO: 1506693 - DNA, 14 bp, Homo sapiens
tgcatatgagcctg

SEQ ID NO: 1506694 - DNA, 17 bp, Homo sapiens
tgcatattaaataataa

SEQ ID NO: 1506695 - DNA, 16 bp, Homo sapiens
tgcatattgtattact

SEQ ID NO: 1506696 - DNA, 18 bp, Homo sapiens
tgcatattttgagaaact

SEQ ID NO: 1506697 - DNA, 14 bp, Homo sapiens
tgcatcaaccagga

SEQ ID NO: 1506698 - DNA, 20 bp, Homo sapiens
tgcatcacatgatgaaaaat

SEQ ID NO: 1506699 - DNA, 12 bp, Homo sapiens
tgcatcagttca

SEQ ID NO: 1506700 - DNA, 19 bp, Homo sapiens
tgcatcatcatagaaaaac

SEQ ID NO: 1506701 - DNA, 17 bp, Homo sapiens
tgcatcatctgtagata

SEQ ID NO: 1506702 - DNA, 16 bp, Homo sapiens
tgcatccaactccagg

SEQ ID NO: 1506703 - DNA, 17 bp, Homo sapiens
tgcatccaactccagga

SEQ ID NO: 1506704 - DNA, 14 bp, Homo sapiens
tgcatccattcctc

SEQ ID NO: 1506705 - DNA, 23 bp, Homo sapiens
tggcacagacttctggaaggctg

SEQ ID NO: 1506706 - DNA, 13 bp, Homo sapiens
tggcacagccctg

SEQ ID NO: 1506707 - DNA, 15 bp, Homo sapiens
tggcacagccctgag

SEQ ID NO: 1506708 - DNA, 14 bp, Homo sapiens
tggcacaggactga

SEQ ID NO: 1506709 - DNA, 18 bp, Homo sapiens
tggcacagggcagtggga

SEQ ID NO: 1506710 - DNA, 15 bp, Homo sapiens
tggcacatcagaaag

SEQ ID NO: 1506711 - DNA, 15 bp, Homo sapiens
tggcacatgccacct

SEQ ID NO: 1506712 - DNA, 13 bp, Homo sapiens
tggcaccatcagc

SEQ ID NO: 1506713 - DNA, 15 bp, Homo sapiens
tggcaccatgtgcca

SEQ ID NO: 1506714 - DNA, 23 bp, Homo sapiens
tggcaccgcctccccacctccag

SEQ ID NO: 1506715 - DNA, 20 bp, Homo sapiens
tggcacctaatccaggcaga

SEQ ID NO: 1506716 - DNA, 16 bp, Homo sapiens
tggcacctcctgagaa

SEQ ID NO: 1506717 - DNA, 15 bp, Homo sapiens
tggcacgccctactc

SEQ ID NO: 1506718 - DNA, 19 bp, Homo sapiens
tggcacggagagaaggccc

SEQ ID NO: 1506719 - DNA, 16 bp, Homo sapiens
tggcacgtattgctgt

SEQ ID NO: 1506720 - DNA, 15 bp, Homo sapiens
tggcactataatgta

SEQ ID NO: 1506721 - DNA, 16 bp, Homo sapiens
tggcactataatgtaa

SEQ ID NO: 1506722 - DNA, 23 bp, Homo sapiens
tggcactcaactctgagcccata

SEQ ID NO: 1506723 - DNA, 13 bp, Homo sapiens
tggcactgactga

SEQ ID NO: 1506724 - DNA, 13 bp, Homo sapiens
tggcactgagccc

SEQ ID NO: 1506725 - DNA, 16 bp, Homo sapiens
tggcactgagcccccc

SEQ ID NO: 1506726 - DNA, 18 bp, Homo sapiens
tggcactgagccccccca

SEQ ID NO: 1506727 - DNA, 11 bp, Homo sapiens
tggcactggga

SEQ ID NO: 1506728 - DNA, 13 bp, Homo sapiens
tggcacttaagtg

SEQ ID NO: 1506729 - DNA, 20 bp, Homo sapiens
tggcacttagcccaagaggt

SEQ ID NO: 1506730 - DNA, 14 bp, Homo sapiens
tggcacttgcctgg

SEQ ID NO: 1506731 - DNA, 18 bp, Homo sapiens
tggcacttgcctgggtca

SEQ ID NO: 1506732 - DNA, 18 bp, Homo sapiens
tggcacttgtatttaatt

SEQ ID NO: 1506733 - DNA, 18 bp, Homo sapiens
tggcacttttttaaatat

SEQ ID NO: 1506734 - DNA, 15 bp, Homo sapiens
tggcagaagggaatt

SEQ ID NO: 1506735 - DNA, 15 bp, Homo sapiens
tggcagacaaacaga

SEQ ID NO: 1506736 - DNA, 17 bp, Homo sapiens
tggcagagaaggcctct

SEQ ID NO: 1506737 - DNA, 18 bp, Homo sapiens
tggcagagtttgtgtgtt

SEQ ID NO: 1506738 - DNA, 15 bp, Homo sapiens
tggcagattttacaa

SEQ ID NO: 1506739 - DNA, 16 bp, Homo sapiens
tggcagattttacaaa

SEQ ID NO: 1506740 - DNA, 22 bp, Homo sapiens
tggcagattttacaaaagatgt

SEQ ID NO: 1506741 - DNA, 14 bp, Homo sapiens
tggcagcagccagg

SEQ ID NO: 1506742 - DNA, 19 bp, Homo sapiens
tggcagcagccagggaccc

SEQ ID NO: 1506743 - DNA, 13 bp, Homo sapiens
tggcagccatgcc

SEQ ID NO: 1506744 - DNA, 14 bp, Homo sapiens
tggcagccatgcct

SEQ ID NO: 1506745 - DNA, 11 bp, Homo sapiens
tggcagcccag

SEQ ID NO: 1506746 - DNA, 12 bp, Homo sapiens
tggcagcccaga

SEQ ID NO: 1506747 - DNA, 17 bp, Homo sapiens
tggcagccctgtaggga

SEQ ID NO: 1506748 - DNA, 17 bp, Homo sapiens
tggcagccgtcccaggc

SEQ ID NO: 1506749 - DNA, 20 bp, Homo sapiens
tggcagccgtcccaggccac

SEQ ID NO: 1506750 - DNA, 16 bp, Homo sapiens
tggcagccgtgccttc

SEQ ID NO: 1506751 - DNA, 17 bp, Homo sapiens
tggcagccgtgccttca

SEQ ID NO: 1506752 - DNA, 19 bp, Homo sapiens
tggcagccgtgccttcagc

SEQ ID NO: 1506753 - DNA, 18 bp, Homo sapiens
tggcctcatgtggctgga

SEQ ID NO: 1506754 - DNA, 19 bp, Homo sapiens
tggcctcatgtggctggaa

SEQ ID NO: 1506755 - DNA, 20 bp, Homo sapiens
tggcctccaaaatattaaca

SEQ ID NO: 1506756 - DNA, 15 bp, Homo sapiens
tggcctccagctccc

SEQ ID NO: 1506757 - DNA, 19 bp, Homo sapiens
tggcctcccaaagtgctgg

SEQ ID NO: 1506758 - DNA, 23 bp, Homo sapiens
tggcctcccaaagtgctgggatt

SEQ ID NO: 1506759 - DNA, 15 bp, Homo sapiens
tggcctcccacccga

SEQ ID NO: 1506760 - DNA, 22 bp, Homo sapiens
tggcctcccacccgatgctgct

SEQ ID NO: 1506761 - DNA, 22 bp, Homo sapiens
tggcctcccagaatgctgggtt

SEQ ID NO: 1506762 - DNA, 23 bp, Homo sapiens
tggcctcccctgccaccaggcca

SEQ ID NO: 1506763 - DNA, 16 bp, Homo sapiens
tggcctccctgctcta

SEQ ID NO: 1506764 - DNA, 14 bp, Homo sapiens
tggcctccctgctg

SEQ ID NO: 1506765 - DNA, 15 bp, Homo sapiens
tggcctccctgctgt

SEQ ID NO: 1506766 - DNA, 16 bp, Homo sapiens
tggcctcccttctcct

SEQ ID NO: 1506767 - DNA, 17 bp, Homo sapiens
tggcctccgcagtgtct

SEQ ID NO: 1506768 - DNA, 17 bp, Homo sapiens
tggcctcgtgaggggca

SEQ ID NO: 1506769 - DNA, 21 bp, Homo sapiens
tggcctcgtgaggggcaagct

SEQ ID NO: 1506770 - DNA, 14 bp, Homo sapiens
tggcctctctatcc

SEQ ID NO: 1506771 - DNA, 19 bp, Homo sapiens
tggcctctgcaactgctca

SEQ ID NO: 1506772 - DNA, 14 bp, Homo sapiens
tggcctctggccag

SEQ ID NO: 1506773 - DNA, 17 bp, Homo sapiens
tggcctcttgagcagtg

SEQ ID NO: 1506774 - DNA, 19 bp, Homo sapiens
tggcctcttgagcagtggc

SEQ ID NO: 1506775 - DNA, 18 bp, Homo sapiens
tggcctgaactgaggaga

SEQ ID NO: 1506776 - DNA, 18 bp, Homo sapiens
tggcctgagatgcaggtg

SEQ ID NO: 1506777 - DNA, 16 bp, Homo sapiens
tggcctgagctggggc

SEQ ID NO: 1506778 - DNA, 14 bp, Homo sapiens
tggcctgcactaat

SEQ ID NO: 1506779 - DNA, 15 bp, Homo sapiens
tggcctgctgggaac

SEQ ID NO: 1506780 - DNA, 21 bp, Homo sapiens
tggcctgctgggctctccacc

SEQ ID NO: 1506781 - DNA, 11 bp, Homo sapiens
tggcctggaca

SEQ ID NO: 1506782 - DNA, 16 bp, Homo sapiens
tggcctggaggtgggg

SEQ ID NO: 1506783 - DNA, 18 bp, Homo sapiens
tggcctggaggtggggtt

SEQ ID NO: 1506784 - DNA, 16 bp, Homo sapiens
tggcctggcacacatc

SEQ ID NO: 1506785 - DNA, 18 bp, Homo sapiens
tggcctggcacacatcag

SEQ ID NO: 1506786 - DNA, 16 bp, Homo sapiens
tggcctggccaggagc

SEQ ID NO: 1506787 - DNA, 18 bp, Homo sapiens
tggcctggccaggagctc

SEQ ID NO: 1506788 - DNA, 16 bp, Homo sapiens
tggcctggcctccagc

SEQ ID NO: 1506789 - DNA, 11 bp, Homo sapiens
tggcctggctc

SEQ ID NO: 1506790 - DNA, 12 bp, Homo sapiens
tggcctggctcc

SEQ ID NO: 1506791 - DNA, 11 bp, Homo sapiens
tggcctgggca

SEQ ID NO: 1506792 - DNA, 13 bp, Homo sapiens
tggcctgggccac

SEQ ID NO: 1506793 - DNA, 17 bp, Homo sapiens
tggcctgggtctccctg

SEQ ID NO: 1506794 - DNA, 20 bp, Homo sapiens
tggcctggtccctggtcctt

SEQ ID NO: 1506795 - DNA, 18 bp, Homo sapiens
tggcctgtagagttgctg

SEQ ID NO: 1506796 - DNA, 18 bp, Homo sapiens
tggcctgtctcatcccca

SEQ ID NO: 1506797 - DNA, 24 bp, Homo sapiens
tggcctgtctcatccccaggggtc

SEQ ID NO: 1506798 - DNA, 14 bp, Homo sapiens
tggcctgtgctggg

SEQ ID NO: 1506799 - DNA, 20 bp, Homo sapiens
tggcctgtgctgggccagtg

SEQ ID NO: 1506800 - DNA, 15 bp, Homo sapiens
tggcctgtggcctgt

SEQ ID NO: 1506801 - DNA, 18 bp, Homo sapiens
tggcctgtgtccagcagc

SEQ ID NO: 1506802 - DNA, 14 bp, Homo sapiens
tggcctgttcccta

SEQ ID NO: 1506803 - DNA, 18 bp, Homo sapiens
tggcctgttccctagaga

SEQ ID NO: 1506804 - DNA, 18 bp, Homo sapiens
tggcctgtttcaacacag

SEQ ID NO: 1506805 - DNA, 17 bp, Homo sapiens
tggcctgtttgatgtat

SEQ ID NO: 1506806 - DNA, 23 bp, Homo sapiens
tggcctgtttgatgtatgtgtga

SEQ ID NO: 1506807 - DNA, 17 bp, Homo sapiens
tggccttaaagagggac

SEQ ID NO: 1506808 - DNA, 22 bp, Homo sapiens
tggccttccacgtcttcctcca

SEQ ID NO: 1506809 - DNA, 23 bp, Homo sapiens
tggccttccccttttgcctggct

SEQ ID NO: 1506810 - DNA, 21 bp, Homo sapiens
tggccttgcccgccagcctca

SEQ ID NO: 1506811 - DNA, 22 bp, Homo sapiens
tggccttgcccgtcgtgtgctg

SEQ ID NO: 1506812 - DNA, 23 bp, Homo sapiens
tggccttgcccgtcgtgtgctga

SEQ ID NO: 1506813 - DNA, 18 bp, Homo sapiens
tggccttgtaagaccctt

SEQ ID NO: 1506814 - DNA, 23 bp, Homo sapiens
tggcctttaagcctgcattctta

SEQ ID NO: 1506815 - DNA, 17 bp, Homo sapiens
tggcgactctgcagagt

SEQ ID NO: 1506816 - DNA, 17 bp, Homo sapiens
tggcgattccctctcac

SEQ ID NO: 1506817 - DNA, 23 bp, Homo sapiens
tggcgcaatctcggctcactgca

SEQ ID NO: 1506818 - DNA, 12 bp, Homo sapiens
tggcgcagccaa

SEQ ID NO: 1506819 - DNA, 13 bp, Homo sapiens
tggcgcagccaag

SEQ ID NO: 1506820 - DNA, 20 bp, Homo sapiens
tggcgcaggtgccatgcctg

SEQ ID NO: 1506821 - DNA, 22 bp, Homo sapiens
tggcgcaggtgccatgcctgct

SEQ ID NO: 1506822 - DNA, 23 bp, Homo sapiens
tggcgcccatcctagtgggcact

SEQ ID NO: 1506823 - DNA, 17 bp, Homo sapiens
tggcgcctccgagggac

SEQ ID NO: 1506824 - DNA, 12 bp, Homo sapiens
tggcgccttctc

SEQ ID NO: 1506825 - DNA, 18 bp, Homo sapiens
tggcgcgatctcagctca

SEQ ID NO: 1506826 - DNA, 13 bp, Homo sapiens
tggcgcgggaggc

SEQ ID NO: 1506827 - DNA, 18 bp, Homo sapiens
tggcgcgggaggcaccag

SEQ ID NO: 1506828 - DNA, 13 bp, Homo sapiens
tggcgctatattg

SEQ ID NO: 1506829 - DNA, 13 bp, Homo sapiens
tggcgcttagaga

SEQ ID NO: 1506830 - DNA, 20 bp, Homo sapiens
tggcgcttagagaggacaat

SEQ ID NO: 1506831 - DNA, 19 bp, Homo sapiens
tggcggcccttctgactgt

SEQ ID NO: 1506832 - DNA, 13 bp, Homo sapiens
tggcggccttccg

SEQ ID NO: 1506833 - DNA, 23 bp, Homo sapiens
tggcggctactcagcagccctcc

SEQ ID NO: 1506834 - DNA, 12 bp, Homo sapiens
tggctgctgccc

SEQ ID NO: 1506835 - DNA, 20 bp, Homo sapiens
tggctgctgcccccaccccg

SEQ ID NO: 1506836 - DNA, 16 bp, Homo sapiens
tggctgctgcctgctc

SEQ ID NO: 1506837 - DNA, 11 bp, Homo sapiens
tggctgctgcg

SEQ ID NO: 1506838 - DNA, 14 bp, Homo sapiens
tggctgctgttgct

SEQ ID NO: 1506839 - DNA, 15 bp, Homo sapiens
tggctgcttctctct

SEQ ID NO: 1506840 - DNA, 20 bp, Homo sapiens
tggctggaagatcctgcggg

SEQ ID NO: 1506841 - DNA, 13 bp, Homo sapiens
tggctggaagggg

SEQ ID NO: 1506842 - DNA, 15 bp, Homo sapiens
tggctggaggagctg

SEQ ID NO: 1506843 - DNA, 16 bp, Homo sapiens
tggctggaggagctgg

SEQ ID NO: 1506844 - DNA, 18 bp, Homo sapiens
tggctggaggagctggcc

SEQ ID NO: 1506845 - DNA, 18 bp, Homo sapiens
tggctggagtctcagagc

SEQ ID NO: 1506846 - DNA, 22 bp, Homo sapiens
tggctggcagctgagagccctg

SEQ ID NO: 1506847 - DNA, 21 bp, Homo sapiens
tggctggcaggcagttctaga

SEQ ID NO: 1506848 - DNA, 22 bp, Homo sapiens
tggctggcaggcagttctagaa

SEQ ID NO: 1506849 - DNA, 15 bp, Homo sapiens
tggctggcctcaccc

SEQ ID NO: 1506850 - DNA, 22 bp, Homo sapiens
tggctgggaacatgacccagcc

SEQ ID NO: 1506851 - DNA, 20 bp, Homo sapiens
tggctgggaagactatggtg

SEQ ID NO: 1506852 - DNA, 11 bp, Homo sapiens
tggctgggacc

SEQ ID NO: 1506853 - DNA, 12 bp, Homo sapiens
tggctgggacct

SEQ ID NO: 1506854 - DNA, 15 bp, Homo sapiens
tggctgggccttcac

SEQ ID NO: 1506855 - DNA, 14 bp, Homo sapiens
tggctggggcagag

SEQ ID NO: 1506856 - DNA, 15 bp, Homo sapiens
tggctggggcagagg

SEQ ID NO: 1506857 - DNA, 15 bp, Homo sapiens
tggctggggccgctg

SEQ ID NO: 1506858 - DNA, 17 bp, Homo sapiens
tggctggggccgctggg

SEQ ID NO: 1506859 - DNA, 20 bp, Homo sapiens
tggctggggccgctggggtc

SEQ ID NO: 1506860 - DNA, 21 bp, Homo sapiens
tggctggggtgggggtgggga

SEQ ID NO: 1506861 - DNA, 15 bp, Homo sapiens
tggctcacatttcat

SEQ ID NO: 1506862 - DNA, 14 bp, Homo sapiens
tggctcaccttccg

SEQ ID NO: 1506863 - DNA, 13 bp, Homo sapiens
tggctcacgcctg

SEQ ID NO: 1506864 - DNA, 16 bp, Homo sapiens
tggctcacgcctgtaa

SEQ ID NO: 1506865 - DNA, 15 bp, Homo sapiens
tggctcactgcagcc

SEQ ID NO: 1506866 - DNA, 15 bp, Homo sapiens
tggctcactggcagg

SEQ ID NO: 1506867 - DNA, 22 bp, Homo sapiens
tggctcagatcggccacagggc

SEQ ID NO: 1506868 - DNA, 14 bp, Homo sapiens
tggctcaggcagac

SEQ ID NO: 1506869 - DNA, 13 bp, Homo sapiens
tggctcaggccca

SEQ ID NO: 1506870 - DNA, 14 bp, Homo sapiens
tggctcaggcccag

SEQ ID NO: 1506871 - DNA, 20 bp, Homo sapiens
tggctcagggtcaaagacag

SEQ ID NO: 1506872 - DNA, 13 bp, Homo sapiens
tggctccactctt

SEQ ID NO: 1506873 - DNA, 18 bp, Homo sapiens
tggctccactcttgatct

SEQ ID NO: 1506874 - DNA, 19 bp, Homo sapiens
tggctccactcttgatctc

SEQ ID NO: 1506875 - DNA, 22 bp, Homo sapiens
tggctccactcttgatctctct

SEQ ID NO: 1506876 - DNA, 20 bp, Homo sapiens
tggctccattggtgttgaca

SEQ ID NO: 1506877 - DNA, 20 bp, Homo sapiens
tggctcccacaggcccttcc

SEQ ID NO: 1506878 - DNA, 23 bp, Homo sapiens
tggctcccatgaccatactgagg

SEQ ID NO: 1506879 - DNA, 22 bp, Homo sapiens
tggctccccacgagtcacctgc

SEQ ID NO: 1506880 - DNA, 15 bp, Homo sapiens
tggctccccctctgc

SEQ ID NO: 1506881 - DNA, 19 bp, Homo sapiens
tggctccctcctccaggcc

SEQ ID NO: 1506882 - DNA, 15 bp, Homo sapiens
tggctccctgcccct

SEQ ID NO: 1506883 - DNA, 16 bp, Homo sapiens
tggctcctatctgtgt

SEQ ID NO: 1506884 - DNA, 18 bp, Homo sapiens
tggctcctatctgtgttt

SEQ ID NO: 1506885 - DNA, 15 bp, Homo sapiens
tggctcctcctagga

SEQ ID NO: 1506886 - DNA, 21 bp, Homo sapiens
tggctcctgaggggcatctgc

SEQ ID NO: 1506887 - DNA, 15 bp, Homo sapiens
tggctcctgtctggc

SEQ ID NO: 1506888 - DNA, 17 bp, Homo sapiens
tggctccttcccatcgc

SEQ ID NO: 1506889 - DNA, 20 bp, Homo sapiens
tggctcgaatctctgtgcct

SEQ ID NO: 1506890 - DNA, 21 bp, Homo sapiens
tggctcgaatctctgtgcctt

SEQ ID NO: 1506891 - DNA, 19 bp, Homo sapiens
tggctcgcagggtgcagga

SEQ ID NO: 1506892 - DNA, 16 bp, Homo sapiens
tggctcggacccaccc

SEQ ID NO: 1506893 - DNA, 21 bp, Homo sapiens
tggctcggacccaccccaact

SEQ ID NO: 1506894 - DNA, 22 bp, Homo sapiens
tggctcggacccaccccaactc

SEQ ID NO: 1506895 - DNA, 17 bp, Homo sapiens
tggctcgttctcttctc

SEQ ID NO: 1506896 - DNA, 20 bp, Homo sapiens
tggctctaccctgtctgtcc

SEQ ID NO: 1506897 - DNA, 16 bp, Homo sapiens
tggctctcagaaggta

SEQ ID NO: 1506898 - DNA, 14 bp, Homo sapiens
tggctctccaagtg

SEQ ID NO: 1506899 - DNA, 19 bp, Homo sapiens
tggctctccaagtgccaga

SEQ ID NO: 1506900 - DNA, 23 bp, Homo sapiens
tggctctccaagtgccagaggtg

SEQ ID NO: 1506901 - DNA, 14 bp, Homo sapiens
tggctctgacaaga

SEQ ID NO: 1506902 - DNA, 21 bp, Homo sapiens
tggctctgaggtgcctgtccc

SEQ ID NO: 1506903 - DNA, 13 bp, Homo sapiens
tggctctgccccc

SEQ ID NO: 1506904 - DNA, 17 bp, Homo sapiens
tggctctgccccctccc

SEQ ID NO: 1506905 - DNA, 18 bp, Homo sapiens
tggctctgccccctcccc

SEQ ID NO: 1506906 - DNA, 11 bp, Homo sapiens
tggctctgggc

SEQ ID NO: 1506907 - DNA, 19 bp, Homo sapiens
tggctcttgatacccccct

SEQ ID NO: 1506908 - DNA, 21 bp, Homo sapiens
tggctcttgatacccccctct

SEQ ID NO: 1506909 - DNA, 23 bp, Homo sapiens
tggctcttgatacccccctctgt

SEQ ID NO: 1506910 - DNA, 14 bp, Homo sapiens
tggctctttcagag

SEQ ID NO: 1506911 - DNA, 20 bp, Homo sapiens
tggctctttctatcctgctc

SEQ ID NO: 1506912 - DNA, 19 bp, Homo sapiens
tggctgaaaatgcaaagct

SEQ ID NO: 1506913 - DNA, 23 bp, Homo sapiens
tggctgaaaatgcaaagctgaag

SEQ ID NO: 1506914 - DNA, 18 bp, Homo sapiens
tggctgaaattctcctgg

SEQ ID NO: 1506915 - DNA, 19 bp, Homo sapiens
tggctgaaattctcctgga

SEQ ID NO: 1506916 - DNA, 20 bp, Homo sapiens
tggctgaaattctcctggag

SEQ ID NO: 1506917 - DNA, 15 bp, Homo sapiens
tggctgaaccctgtg

SEQ ID NO: 1506918 - DNA, 18 bp, Homo sapiens
tggctgaaccctgtgctg

SEQ ID NO: 1506919 - DNA, 15 bp, Homo sapiens
tggctgaactacaag

SEQ ID NO: 1506920 - DNA, 13 bp, Homo sapiens
tggctgaagacat

SEQ ID NO: 1506921 - DNA, 19 bp, Homo sapiens
tggctgaagctggagcagc

SEQ ID NO: 1506922 - DNA, 17 bp, Homo sapiens
tggctgacccagtccct

SEQ ID NO: 1506923 - DNA, 20 bp, Homo sapiens
tggctgacccagtccctggg

SEQ ID NO: 1506924 - DNA, 13 bp, Homo sapiens
tggctgacccctc

SEQ ID NO: 1506925 - DNA, 17 bp, Homo sapiens
tggctgacccctctggt

SEQ ID NO: 1506926 - DNA, 20 bp, Homo sapiens
tggctgagaaaatgtaagga

SEQ ID NO: 1506927 - DNA, 14 bp, Homo sapiens
tggctgagacctgg

SEQ ID NO: 1506928 - DNA, 20 bp, Homo sapiens
tggctgagacctgggatttg

SEQ ID NO: 1506929 - DNA, 21 bp, Homo sapiens
tggctgagacctgggatttga

SEQ ID NO: 1506930 - DNA, 18 bp, Homo sapiens
tggctgaggttcctctgc

SEQ ID NO: 1506931 - DNA, 20 bp, Homo sapiens
tggctgagtggaatgcaggg

SEQ ID NO: 1506932 - DNA, 17 bp, Homo sapiens
tggctgatgatccagaa

SEQ ID NO: 1506933 - DNA, 22 bp, Homo sapiens
tggctgcaaataaggacagcag

SEQ ID NO: 1506934 - DNA, 22 bp, Homo sapiens
tggctgcaggaagaaacttttt

SEQ ID NO: 1506935 - DNA, 11 bp, Homo sapiens
tggctgccagg

SEQ ID NO: 1506936 - DNA, 12 bp, Homo sapiens
tggctgccaggc

SEQ ID NO: 1506937 - DNA, 22 bp, Homo sapiens
tggctgccaggcgttggtgcca

SEQ ID NO: 1506938 - DNA, 21 bp, Homo sapiens
tggctgcccagacccctctgg

SEQ ID NO: 1506939 - DNA, 14 bp, Homo sapiens
tggctgcccaggag

SEQ ID NO: 1506940 - DNA, 22 bp, Homo sapiens
tggctgcccatcatgtggcccc

SEQ ID NO: 1506941 - DNA, 17 bp, Homo sapiens
tggctgccctggccctg

SEQ ID NO: 1506942 - DNA, 17 bp, Homo sapiens
tggctgccggaggagca

SEQ ID NO: 1506943 - DNA, 13 bp, Homo sapiens
tggctgccttctt

SEQ ID NO: 1506944 - DNA, 15 bp, Homo sapiens
tggctgctagcactt

SEQ ID NO: 1506945 - DNA, 21 bp, Homo sapiens
tggctgctcccagcctcttgc

SEQ ID NO: 1506946 - DNA, 14 bp, Homo sapiens
tgggatgtcacagt

SEQ ID NO: 1506947 - DNA, 16 bp, Homo sapiens
tgggatgttcagcact

SEQ ID NO: 1506948 - DNA, 20 bp, Homo sapiens
tgggatgttcagcactgtcc

SEQ ID NO: 1506949 - DNA, 18 bp, Homo sapiens
tgggattatgggtcacag

SEQ ID NO: 1506950 - DNA, 19 bp, Homo sapiens
tgggattatgggtcacagg

SEQ ID NO: 1506951 - DNA, 17 bp, Homo sapiens
tgggattcctgacccag

SEQ ID NO: 1506952 - DNA, 23 bp, Homo sapiens
tgggattgacagaagcttctgcc

SEQ ID NO: 1506953 - DNA, 14 bp, Homo sapiens
tgggattgggggct

SEQ ID NO: 1506954 - DNA, 22 bp, Homo sapiens
tgggatttccagaaccacactt

SEQ ID NO: 1506955 - DNA, 15 bp, Homo sapiens
tgggatttcttcgct

SEQ ID NO: 1506956 - DNA, 19 bp, Homo sapiens
tgggatttcttcgctgctc

SEQ ID NO: 1506957 - DNA, 21 bp, Homo sapiens
tgggatttggggcctcaagaa

SEQ ID NO: 1506958 - DNA, 14 bp, Homo sapiens
tgggattttgcaaa

SEQ ID NO: 1506959 - DNA, 17 bp, Homo sapiens
tgggatttttgtttgac

SEQ ID NO: 1506960 - DNA, 15 bp, Homo sapiens
tgggcaaacagagct

SEQ ID NO: 1506961 - DNA, 13 bp, Homo sapiens
tgggcaaagcttg

SEQ ID NO: 1506962 - DNA, 23 bp, Homo sapiens
tgggcaaagcttgtcaaagatgc

SEQ ID NO: 1506963 - DNA, 12 bp, Homo sapiens
tgggcaacagag

SEQ ID NO: 1506964 - DNA, 16 bp, Homo sapiens
tgggcaacagagcaag

SEQ ID NO: 1506965 - DNA, 17 bp, Homo sapiens
tgggcaagacctcttcc

SEQ ID NO: 1506966 - DNA, 19 bp, Homo sapiens
tgggcaatgatggcaattt

SEQ ID NO: 1506967 - DNA, 22 bp, Homo sapiens
tgggcaccacctctgtgggcac

SEQ ID NO: 1506968 - DNA, 15 bp, Homo sapiens
tgggcacccacctcc

SEQ ID NO: 1506969 - DNA, 18 bp, Homo sapiens
tgggcacccacctccacc

SEQ ID NO: 1506970 - DNA, 19 bp, Homo sapiens
tgggcacctgcgcacaggt

SEQ ID NO: 1506971 - DNA, 17 bp, Homo sapiens
tgggcacggagggggac

SEQ ID NO: 1506972 - DNA, 24 bp, Homo sapiens
tgggcactccgcgccgatgccacc

SEQ ID NO: 1506973 - DNA, 15 bp, Homo sapiens
tgggcagaaggccaa

SEQ ID NO: 1506974 - DNA, 17 bp, Homo sapiens
tgggcagaaggccaaga

SEQ ID NO: 1506975 - DNA, 16 bp, Homo sapiens
tgggcagagctgcatc

SEQ ID NO: 1506976 - DNA, 18 bp, Homo sapiens
tgggcagagctggctctg

SEQ ID NO: 1506977 - DNA, 20 bp, Homo sapiens
tgggcagagctggctctgag

SEQ ID NO: 1506978 - DNA, 14 bp, Homo sapiens
tgggcagagggcct

SEQ ID NO: 1506979 - DNA, 15 bp, Homo sapiens
tgggcagattttcag

SEQ ID NO: 1506980 - DNA, 18 bp, Homo sapiens
tgggcagcatagcaagac

SEQ ID NO: 1506981 - DNA, 19 bp, Homo sapiens
tgggcagcccaacagcact

SEQ ID NO: 1506982 - DNA, 19 bp, Homo sapiens
tgggcagcttgagagggca

SEQ ID NO: 1506983 - DNA, 23 bp, Homo sapiens
tgggcaggaagtgaagagatcct

SEQ ID NO: 1506984 - DNA, 20 bp, Homo sapiens
tgggcaggatctcaagccag

SEQ ID NO: 1506985 - DNA, 21 bp, Homo sapiens
tgggcaggatctcaagccagc

SEQ ID NO: 1506986 - DNA, 23 bp, Homo sapiens
tgggcagggacccggggtctcct

SEQ ID NO: 1506987 - DNA, 21 bp, Homo sapiens
tgggcagggtctgtttggact

SEQ ID NO: 1506988 - DNA, 15 bp, Homo sapiens
tgggcaggtctgaga

SEQ ID NO: 1506989 - DNA, 17 bp, Homo sapiens
tgggcaggtgggagctg

SEQ ID NO: 1506990 - DNA, 16 bp, Homo sapiens
tgggcaggtggtggca

SEQ ID NO: 1506991 - DNA, 17 bp, Homo sapiens
tgggcagtgtggcctct

SEQ ID NO: 1506992 - DNA, 16 bp, Homo sapiens
tgggcagttggccagg

SEQ ID NO: 1506993 - DNA, 15 bp, Homo sapiens
tgggcatccacccag

SEQ ID NO: 1506994 - DNA, 19 bp, Homo sapiens
tgggcatcttttgtattaa

SEQ ID NO: 1506995 - DNA, 14 bp, Homo sapiens
tgggcattgctttc

SEQ ID NO: 1506996 - DNA, 14 bp, Homo sapiens
tgggcattgggctg

SEQ ID NO: 1506997 - DNA, 20 bp, Homo sapiens
tgggcatttcaatccatttt

SEQ ID NO: 1506998 - DNA, 15 bp, Homo sapiens
tgggcatttgtgagg

SEQ ID NO: 1506999 - DNA, 16 bp, Homo sapiens
tgggcatttgtgaggc

SEQ ID NO: 1507000 - DNA, 20 bp, Homo sapiens
tgggccaagagccgccgtgg

SEQ ID NO: 1507001 - DNA, 15 bp, Homo sapiens
tgggccacaggggac

SEQ ID NO: 1507002 - DNA, 19 bp, Homo sapiens
tgggccaccatgtctggct

SEQ ID NO: 1507003 - DNA, 17 bp, Homo sapiens
tgggccacccctcctag

SEQ ID NO: 1507004 - DNA, 22 bp, Homo sapiens
tgggccactggggactttattt

SEQ ID NO: 1507005 - DNA, 13 bp, Homo sapiens
tgggccagacatg

SEQ ID NO: 1507006 - DNA, 14 bp, Homo sapiens
tgggccagagctga

SEQ ID NO: 1507007 - DNA, 14 bp, Homo sapiens
tgggccagccacag

SEQ ID NO: 1507008 - DNA, 18 bp, Homo sapiens
tgggccagccacagagca

SEQ ID NO: 1507009 - DNA, 18 bp, Homo sapiens
tgggccagccctgcagcc

SEQ ID NO: 1507010 - DNA, 17 bp, Homo sapiens
tgggccagtggctgggg

SEQ ID NO: 1507011 - DNA, 24 bp, Homo sapiens
tgggccatgtccaaagaggctgcc

SEQ ID NO: 1507012 - DNA, 22 bp, Homo sapiens
tgggcccagctgggctctgcca

SEQ ID NO: 1507013 - DNA, 15 bp, Homo sapiens
tgggcccaggaccag

SEQ ID NO: 1507014 - DNA, 17 bp, Homo sapiens
tgggcccaggaccagct

SEQ ID NO: 1507015 - DNA, 14 bp, Homo sapiens
tgggcccaggcagg

SEQ ID NO: 1507016 - DNA, 16 bp, Homo sapiens
tgggcccaggcaggtc

SEQ ID NO: 1507017 - DNA, 18 bp, Homo sapiens
tgggcccaggcaggtctg

SEQ ID NO: 1507018 - DNA, 15 bp, Homo sapiens
tgggcccaggggctg

SEQ ID NO: 1507019 - DNA, 15 bp, Homo sapiens
tgggcccctggcact

SEQ ID NO: 1507020 - DNA, 22 bp, Homo sapiens
tgggccctgagtctgggcagct

SEQ ID NO: 1507021 - DNA, 15 bp, Homo sapiens
tgggccctgcacaga

SEQ ID NO: 1507022 - DNA, 14 bp, Homo sapiens
tgggccctgggctg

SEQ ID NO: 1507023 - DNA, 23 bp, Homo sapiens
tgggccctttttcccttccctcc

SEQ ID NO: 1507024 - DNA, 21 bp, Homo sapiens
tgggccgctgctttgcgctgg

SEQ ID NO: 1507025 - DNA, 18 bp, Homo sapiens
tgggccggctgagtggca

SEQ ID NO: 1507026 - DNA, 15 bp, Homo sapiens
tgggccgggcctggg

SEQ ID NO: 1507027 - DNA, 19 bp, Homo sapiens
tgggccgggcctggggctc

SEQ ID NO: 1507028 - DNA, 14 bp, Homo sapiens
tgggcctaaataaa

SEQ ID NO: 1507029 - DNA, 16 bp, Homo sapiens
tgggcctcaggctctg

SEQ ID NO: 1507030 - DNA, 18 bp, Homo sapiens
tgggcctcaggctctgca

SEQ ID NO: 1507031 - DNA, 19 bp, Homo sapiens
tgggcctcagtgtgcccat

SEQ ID NO: 1507032 - DNA, 19 bp, Homo sapiens
tgggcctcccctgggcagg

SEQ ID NO: 1507033 - DNA, 24 bp, Homo sapiens
tgggcctccttcccatgcctgtct

SEQ ID NO: 1507034 - DNA, 19 bp, Homo sapiens
tgggcctcggcccctccca

SEQ ID NO: 1507035 - DNA, 14 bp, Homo sapiens
tgggcctctcctgc

SEQ ID NO: 1507036 - DNA, 12 bp, Homo sapiens
tgggcctgaggg

SEQ ID NO: 1507037 - DNA, 13 bp, Homo sapiens
tgggcctgagggt

SEQ ID NO: 1507038 - DNA, 21 bp, Homo sapiens
tgggcctgagggtccacctgg

SEQ ID NO: 1507039 - DNA, 16 bp, Homo sapiens
tgggcctgcccaatgc

SEQ ID NO: 1507040 - DNA, 19 bp, Homo sapiens
tgggcctgccgggctgagg

SEQ ID NO: 1507041 - DNA, 14 bp, Homo sapiens
tgggcctgctccag

SEQ ID NO: 1507042 - DNA, 16 bp, Homo sapiens
tgggcctgctccagac

SEQ ID NO: 1507043 - DNA, 19 bp, Homo sapiens
tgggcctgcttttccagga

SEQ ID NO: 1507044 - DNA, 22 bp, Homo sapiens
tgggcctgcttttccaggatcc

SEQ ID NO: 1507045 - DNA, 17 bp, Homo sapiens
tgggcctggagccctgg

SEQ ID NO: 1507046 - DNA, 23 bp, Homo sapiens
tgggcctggagccctgggcggag

SEQ ID NO: 1507047 - DNA, 15 bp, Homo sapiens
tgggcctggccagtc

SEQ ID NO: 1507048 - DNA, 13 bp, Homo sapiens
tgggcctgggcct

SEQ ID NO: 1507049 - DNA, 15 bp, Homo sapiens
tgggcctgggcctgc

SEQ ID NO: 1507050 - DNA, 13 bp, Homo sapiens
tgggcctgtcccc

SEQ ID NO: 1507051 - DNA, 12 bp, Homo sapiens
tgggcctgtgca

SEQ ID NO: 1507052 - DNA, 17 bp, Homo sapiens
tgggcctgtgcagcagc

SEQ ID NO: 1507053 - DNA, 21 bp, Homo sapiens
tgggcctgtgcagcagcccag

SEQ ID NO: 1507054 - DNA, 22 bp, Homo sapiens
tgggcctgtgcagcagcccagc

SEQ ID NO: 1507055 - DNA, 19 bp, Homo sapiens
tgggcctgttctcttggct

SEQ ID NO: 1507056 - DNA, 21 bp, Homo sapiens
tgggcctgttctcttggctgc

SEQ ID NO: 1507057 - DNA, 16 bp, Homo sapiens
tgggccttcaccaagc

SEQ ID NO: 1507058 - DNA, 13 bp, Homo sapiens
tgggccttgctac

SEQ ID NO: 1507059 - DNA, 18 bp, Homo sapiens
tgggccttgctttgggct

SEQ ID NO: 1507060 - DNA, 21 bp, Homo sapiens
tgggcgagcatgggggctgcc

SEQ ID NO: 1507061 - DNA, 23 bp, Homo sapiens
tgggcgagcatgggggctgccag

SEQ ID NO: 1507062 - DNA, 21 bp, Homo sapiens
tgggcgagcccctccttctcc

SEQ ID NO: 1507063 - DNA, 14 bp, Homo sapiens
tgggcgcagtggct

SEQ ID NO: 1507064 - DNA, 17 bp, Homo sapiens
tgggcgcagtggctcac

SEQ ID NO: 1507065 - DNA, 20 bp, Homo sapiens
tgggcgcccaccctgggctc

SEQ ID NO: 1507066 - DNA, 15 bp, Homo sapiens
tgggcgccctggaag

SEQ ID NO: 1507067 - DNA, 19 bp, Homo sapiens
tgggcgtctgagctggggt

SEQ ID NO: 1507068 - DNA, 23 bp, Homo sapiens
tgggctaaggaagtatcagcact

SEQ ID NO: 1507069 - DNA, 15 bp, Homo sapiens
tgggctaccatctgc

SEQ ID NO: 1507070 - DNA, 13 bp, Homo sapiens
tgggctactggca

SEQ ID NO: 1507071 - DNA, 14 bp, Homo sapiens
tgggctactggcag

SEQ ID NO: 1507072 - DNA, 15 bp, Homo sapiens
tgggctactggcagc

SEQ ID NO: 1507073 - DNA, 18 bp, Homo sapiens
tgggctactggcagctcc

SEQ ID NO: 1507074 - DNA, 16 bp, Homo sapiens
tgggctactttgtcct

SEQ ID NO: 1507075 - DNA, 12 bp, Homo sapiens
tgggctatattc

SEQ ID NO: 1507076 - DNA, 22 bp, Homo sapiens
tgggctatattcctgacaaaag

SEQ ID NO: 1507077 - DNA, 21 bp, Homo sapiens
tgggctattgctgctgcccct

SEQ ID NO: 1507078 - DNA, 15 bp, Homo sapiens
tgggctcaaagccct

SEQ ID NO: 1507079 - DNA, 21 bp, Homo sapiens
tgggctcaaatgatcctccca

SEQ ID NO: 1507080 - DNA, 18 bp, Homo sapiens
tgggctcaaccagaaaag

SEQ ID NO: 1507081 - DNA, 13 bp, Homo sapiens
tgggctcagggct

SEQ ID NO: 1507082 - DNA, 20 bp, Homo sapiens
tgggctcagggctggagtgc

SEQ ID NO: 1507083 - DNA, 14 bp, Homo sapiens
tgggctcagggttg

SEQ ID NO: 1507084 - DNA, 15 bp, Homo sapiens
tgggctcagggttgg

SEQ ID NO: 1507085 - DNA, 21 bp, Homo sapiens
tgggctccacacagcagtgtc

SEQ ID NO: 1507086 - DNA, 23 bp, Homo sapiens
tgggctccacacagcagtgtccc

SEQ ID NO: 1507087 - DNA, 16 bp, Homo sapiens
tgggctcccgtgtttt

SEQ ID NO: 1507088 - DNA, 19 bp, Homo sapiens
tgggctcccgtgttttgta

SEQ ID NO: 1507089 - DNA, 19 bp, Homo sapiens
tgggctcctggaaccaatc

SEQ ID NO: 1507090 - DNA, 16 bp, Homo sapiens
tgggctcctggctgcc

SEQ ID NO: 1507091 - DNA, 19 bp, Homo sapiens
tgggctcctggctgccagg

SEQ ID NO: 1507092 - DNA, 21 bp, Homo sapiens
tgggctcctggctgccaggcg

SEQ ID NO: 1507093 - DNA, 15 bp, Homo sapiens
tgggctctcacccag

SEQ ID NO: 1507094 - DNA, 15 bp, Homo sapiens
tgggctctgccaccc

SEQ ID NO: 1507095 - DNA, 17 bp, Homo sapiens
tgggctctgccccagct

SEQ ID NO: 1507096 - DNA, 19 bp, Homo sapiens
tgggctctgccccagctct

SEQ ID NO: 1507097 - DNA, 20 bp, Homo sapiens
tgggctctgccccagctctg

SEQ ID NO: 1507098 - DNA, 17 bp, Homo sapiens
tgggctctgtgcagtca

SEQ ID NO: 1507099 - DNA, 18 bp, Homo sapiens
tgggctgaactgagccta

SEQ ID NO: 1507100 - DNA, 14 bp, Homo sapiens
tgggctgacccagc

SEQ ID NO: 1507101 - DNA, 20 bp, Homo sapiens
tgggctgacccagcatctcc

SEQ ID NO: 1507102 - DNA, 17 bp, Homo sapiens
tgggctgagcccctacc

SEQ ID NO: 1507103 - DNA, 16 bp, Homo sapiens
tgggctgagccctggc

SEQ ID NO: 1507104 - DNA, 16 bp, Homo sapiens
tgggctgccctggtgc

SEQ ID NO: 1507105 - DNA, 17 bp, Homo sapiens
tgggctgccctggtgct

SEQ ID NO: 1507106 - DNA, 15 bp, Homo sapiens
tgggctgctcctcat

SEQ ID NO: 1507107 - DNA, 16 bp, Homo sapiens
tgggctgctcctcatg

SEQ ID NO: 1507108 - DNA, 19 bp, Homo sapiens
tgggctgctgcaggccgtg

SEQ ID NO: 1507109 - DNA, 22 bp, Homo sapiens
tgggctggaacgtgaactcagt

SEQ ID NO: 1507110 - DNA, 15 bp, Homo sapiens
tgggctggactggcc

SEQ ID NO: 1507111 - DNA, 21 bp, Homo sapiens
tgggctgggccctctcttctc

SEQ ID NO: 1507112 - DNA, 16 bp, Homo sapiens
tgggctgggccctctt

SEQ ID NO: 1507113 - DNA, 15 bp, Homo sapiens
tgggctggggaggag

SEQ ID NO: 1507114 - DNA, 17 bp, Homo sapiens
tgggctggggaggagga

SEQ ID NO: 1507115 - DNA, 13 bp, Homo sapiens
tgggctggggctg

SEQ ID NO: 1507116 - DNA, 18 bp, Homo sapiens
tgggctggggctgctccc

SEQ ID NO: 1507117 - DNA, 19 bp, Homo sapiens
tgggctggggctgctcccc

SEQ ID NO: 1507118 - DNA, 22 bp, Homo sapiens
tgggctgggttgggtagggtgt

SEQ ID NO: 1507119 - DNA, 20 bp, Homo sapiens
tgggctggtatctcagaaag

SEQ ID NO: 1507120 - DNA, 15 bp, Homo sapiens
tgggctggttgctgt

SEQ ID NO: 1507121 - DNA, 12 bp, Homo sapiens
tgggctgtgagt

SEQ ID NO: 1507122 - DNA, 13 bp, Homo sapiens
tgggcttatatct

SEQ ID NO: 1507123 - DNA, 21 bp, Homo sapiens
tgggcttatatctggcctctg

SEQ ID NO: 1507124 - DNA, 19 bp, Homo sapiens
tgggcttatgtctctgcct

SEQ ID NO: 1507125 - DNA, 22 bp, Homo sapiens
tgggcttgaccaggcttggcct

SEQ ID NO: 1507126 - DNA, 17 bp, Homo sapiens
tgggcttggacttcctg

SEQ ID NO: 1507127 - DNA, 14 bp, Homo sapiens
tgggcttggcctgc

SEQ ID NO: 1507128 - DNA, 17 bp, Homo sapiens
tgggcttggcctgctgt

SEQ ID NO: 1507129 - DNA, 18 bp, Homo sapiens
tgggctttctccggggtc

SEQ ID NO: 1507130 - DNA, 14 bp, Homo sapiens
tgggctttgcaggc

SEQ ID NO: 1507131 - DNA, 16 bp, Homo sapiens
tgggctttgcaggctc

SEQ ID NO: 1507132 - DNA, 18 bp, Homo sapiens
tgggctttgcaggctctg

SEQ ID NO: 1507133 - DNA, 13 bp, Homo sapiens
tggggaaaatggc

SEQ ID NO: 1507134 - DNA, 22 bp, Homo sapiens
tggggaaaatggccatgcagga

SEQ ID NO: 1507135 - DNA, 21 bp, Homo sapiens
tggggaaacaacatttatatg

SEQ ID NO: 1507136 - DNA, 11 bp, Homo sapiens
tggggaaaggg

SEQ ID NO: 1507137 - DNA, 21 bp, Homo sapiens
tggggaaaggggacaaggaag

SEQ ID NO: 1507138 - DNA, 14 bp, Homo sapiens
tggggaagacagtg

SEQ ID NO: 1507139 - DNA, 17 bp, Homo sapiens
tggggaagacagtggcc

SEQ ID NO: 1507140 - DNA, 17 bp, Homo sapiens
tggggaagactgtggct

SEQ ID NO: 1507141 - DNA, 22 bp, Homo sapiens
tggggaaggagtacaaaacaat

SEQ ID NO: 1507142 - DNA, 21 bp, Homo sapiens
tggggaagggttttcttttct

SEQ ID NO: 1507143 - DNA, 20 bp, Homo sapiens
tggggaaggttatcagtgct

SEQ ID NO: 1507144 - DNA, 18 bp, Homo sapiens
tggggacacagcagtgag

SEQ ID NO: 1507145 - DNA, 14 bp, Homo sapiens
tggggacagcttcc

SEQ ID NO: 1507146 - DNA, 15 bp, Homo sapiens
tggggacagcttcct

SEQ ID NO: 1507147 - DNA, 17 bp, Homo sapiens
tggggacagttggcaga

SEQ ID NO: 1507148 - DNA, 18 bp, Homo sapiens
tggggacagttggcagag

SEQ ID NO: 1507149 - DNA, 21 bp, Homo sapiens
tggggacagttggcagagaag

SEQ ID NO: 1507150 - DNA, 15 bp, Homo sapiens
tggggaccaggagct

SEQ ID NO: 1507151 - DNA, 20 bp, Homo sapiens
tggggaccccactccctgct

SEQ ID NO: 1507152 - DNA, 14 bp, Homo sapiens
tggggaccccactt

SEQ ID NO: 1507153 - DNA, 18 bp, Homo sapiens
tggggacctggtaccctc

SEQ ID NO: 1507154 - DNA, 22 bp, Homo sapiens
tggggacgggggctgcttctcc

SEQ ID NO: 1507155 - DNA, 17 bp, Homo sapiens
tggggacgtgtgtcctt

SEQ ID NO: 1507156 - DNA, 20 bp, Homo sapiens
tggggacgtgtgtcctttgg

SEQ ID NO: 1507157 - DNA, 14 bp, Homo sapiens
tggggactcaggga

SEQ ID NO: 1507158 - DNA, 23 bp, Homo sapiens
tggggactgctacctctgagaag

SEQ ID NO: 1507159 - DNA, 21 bp, Homo sapiens
tggggactttatttatttcta

SEQ ID NO: 1507160 - DNA, 23 bp, Homo sapiens
tggggagaaataaattttgtttc

SEQ ID NO: 1507161 - DNA, 20 bp, Homo sapiens
tggggagacctggttggccg

SEQ ID NO: 1507162 - DNA, 15 bp, Homo sapiens
tggggagcagagaca

SEQ ID NO: 1507163 - DNA, 14 bp, Homo sapiens
tggggagcagctga

SEQ ID NO: 1507164 - DNA, 14 bp, Homo sapiens
tggggagctagagg

SEQ ID NO: 1507165 - DNA, 16 bp, Homo sapiens
tggggaggaaatagaa

SEQ ID NO: 1507166 - DNA, 15 bp, Homo sapiens
tggggaggaggagag

SEQ ID NO: 1507167 - DNA, 19 bp, Homo sapiens
tggggaggcactcgctgtt

SEQ ID NO: 1507168 - DNA, 14 bp, Homo sapiens
tggggaggcagcag

SEQ ID NO: 1507169 - DNA, 16 bp, Homo sapiens
tggggaggcagcagag

SEQ ID NO: 1507170 - DNA, 18 bp, Homo sapiens
tggggaggcagcagagcg

SEQ ID NO: 1507171 - DNA, 14 bp, Homo sapiens
tggggaggcaggca

SEQ ID NO: 1507172 - DNA, 17 bp, Homo sapiens
tggggaggcccaaatga

SEQ ID NO: 1507173 - DNA, 19 bp, Homo sapiens
tggggaggctgaggcagga

SEQ ID NO: 1507174 - DNA, 20 bp, Homo sapiens
tggggaggctgaggcaggag

SEQ ID NO: 1507175 - DNA, 23 bp, Homo sapiens
tggggagggacaagggattctgg

SEQ ID NO: 1507176 - DNA, 18 bp, Homo sapiens
tggggagggattctggtt

SEQ ID NO: 1507177 - DNA, 14 bp, Homo sapiens
tggggagggatttg

SEQ ID NO: 1507178 - DNA, 17 bp, Homo sapiens
tggggagggccgtaccc

SEQ ID NO: 1507179 - DNA, 20 bp, Homo sapiens
tggggaggggcgctggccca

SEQ ID NO: 1507180 - DNA, 14 bp, Homo sapiens
tggggagggggaag

SEQ ID NO: 1507181 - DNA, 16 bp, Homo sapiens
tggggagttaagacct

SEQ ID NO: 1507182 - DNA, 17 bp, Homo sapiens
tggggagttaagacctg

SEQ ID NO: 1507183 - DNA, 15 bp, Homo sapiens
tggggataataatac

SEQ ID NO: 1507184 - DNA, 14 bp, Homo sapiens
tggggatagaggaa

SEQ ID NO: 1507185 - DNA, 23 bp, Homo sapiens
tggggatagaggaaagggatggt

SEQ ID NO: 1507186 - DNA, 18 bp, Homo sapiens
tggggatccccgcctggc

SEQ ID NO: 1507187 - DNA, 18 bp, Homo sapiens
tggggatctcaggggctg

SEQ ID NO: 1507188 - DNA, 15 bp, Homo sapiens
tggggatgaggtcac

SEQ ID NO: 1507189 - DNA, 19 bp, Homo sapiens
tggggatgtaaccaagctg

SEQ ID NO: 1507190 - DNA, 21 bp, Homo sapiens
tggggatgtaaccaagctgta

SEQ ID NO: 1507191 - DNA, 20 bp, Homo sapiens
tggggcaagacagaaaagtg

SEQ ID NO: 1507192 - DNA, 19 bp, Homo sapiens
tggggcaagtccctgactc

SEQ ID NO: 1507193 - DNA, 18 bp, Homo sapiens
tggggcagaaatctgagg

SEQ ID NO: 1507194 - DNA, 13 bp, Homo sapiens
tggggcagacaca

SEQ ID NO: 1507195 - DNA, 13 bp, Homo sapiens
tggggcagcactc

SEQ ID NO: 1507196 - DNA, 20 bp, Homo sapiens
tggggcaggagtgccaggac

SEQ ID NO: 1507197 - DNA, 22 bp, Homo sapiens
tggggcaggagtgccaggacca

SEQ ID NO: 1507198 - DNA, 16 bp, Homo sapiens
tggggcaggctgggcc

SEQ ID NO: 1507199 - DNA, 18 bp, Homo sapiens
tggggcaggctgggccat

SEQ ID NO: 1507200 - DNA, 14 bp, Homo sapiens
tggggcagggcctg

SEQ ID NO: 1507201 - DNA, 14 bp, Homo sapiens
tggggcatcctgga

SEQ ID NO: 1507202 - DNA, 15 bp, Homo sapiens
tggggcatcctggat

SEQ ID NO: 1507203 - DNA, 17 bp, Homo sapiens
tggggcatcctggatga

SEQ ID NO: 1507204 - DNA, 17 bp, Homo sapiens
tggggcatgtgtgcctg

SEQ ID NO: 1507205 - DNA, 18 bp, Homo sapiens
tggggcatgtgtgcctgt

SEQ ID NO: 1507206 - DNA, 14 bp, Homo sapiens
tggggccagatcca

SEQ ID NO: 1507207 - DNA, 16 bp, Homo sapiens
tggggccagatccagc

SEQ ID NO: 1507208 - DNA, 19 bp, Homo sapiens
tggggccagatccagcctg

SEQ ID NO: 1507209 - DNA, 14 bp, Homo sapiens
tggggccagcatac

SEQ ID NO: 1507210 - DNA, 18 bp, Homo sapiens
tggggcccagccgatgtg

SEQ ID NO: 1507211 - DNA, 22 bp, Homo sapiens
tggggcccagtgcatggtggcc

SEQ ID NO: 1507212 - DNA, 17 bp, Homo sapiens
tggggcccctggcccag

SEQ ID NO: 1507213 - DNA, 19 bp, Homo sapiens
tggggccctgcccctagga

SEQ ID NO: 1507214 - DNA, 22 bp, Homo sapiens
tggggcccttgggccacgctct

SEQ ID NO: 1507215 - DNA, 23 bp, Homo sapiens
tggggccgaaaatgtttttaaag

SEQ ID NO: 1507216 - DNA, 16 bp, Homo sapiens
tggggccgctggggtc

SEQ ID NO: 1507217 - DNA, 14 bp, Homo sapiens
tggggcctcaagaa

SEQ ID NO: 1507218 - DNA, 18 bp, Homo sapiens
tggggcctccttgtccag

SEQ ID NO: 1507219 - DNA, 11 bp, Homo sapiens
tggggcctgcc

SEQ ID NO: 1507220 - DNA, 11 bp, Homo sapiens
tggggcctggc

SEQ ID NO: 1507221 - DNA, 22 bp, Homo sapiens
tggggcctggcccacgccctcc

SEQ ID NO: 1507222 - DNA, 23 bp, Homo sapiens
tggggcctggcccacgccctccc

SEQ ID NO: 1507223 - DNA, 13 bp, Homo sapiens
tggggcctggctt

SEQ ID NO: 1507224 - DNA, 20 bp, Homo sapiens
tggggcctggcttgctccag

SEQ ID NO: 1507225 - DNA, 23 bp, Homo sapiens
tggggcctggcttgctccagggt

SEQ ID NO: 1507226 - DNA, 22 bp, Homo sapiens
tggggcctgggagggttcccct

SEQ ID NO: 1507227 - DNA, 19 bp, Homo sapiens
tggggcgtggggagggccg

SEQ ID NO: 1507228 - DNA, 15 bp, Homo sapiens
tggggctcagagtgg

SEQ ID NO: 1507229 - DNA, 14 bp, Homo sapiens
tggggctcccgccc

SEQ ID NO: 1507230 - DNA, 11 bp, Homo sapiens
tggggctcctt

SEQ ID NO: 1507231 - DNA, 17 bp, Homo sapiens
tggggctcgccatgccg

SEQ ID NO: 1507232 - DNA, 15 bp, Homo sapiens
tggggctcgtggcct

SEQ ID NO: 1507233 - DNA, 19 bp, Homo sapiens
tggggctgagcctgaggcc

SEQ ID NO: 1507234 - DNA, 17 bp, Homo sapiens
tggggctgatctcaggg

SEQ ID NO: 1507235 - DNA, 20 bp, Homo sapiens
tggggctgatctcagggaag

SEQ ID NO: 1507236 - DNA, 13 bp, Homo sapiens
tggggctgcggga

SEQ ID NO: 1507237 - DNA, 12 bp, Homo sapiens
tggggctgctcc

SEQ ID NO: 1507238 - DNA, 13 bp, Homo sapiens
tggggctgctccc

SEQ ID NO: 1507239 - DNA, 17 bp, Homo sapiens
tggggctgctcctccag

SEQ ID NO: 1507240 - DNA, 22 bp, Homo sapiens
tggggctgtatttatctctgag

SEQ ID NO: 1507241 - DNA, 15 bp, Homo sapiens
tggggctgtcctgct

SEQ ID NO: 1507242 - DNA, 16 bp, Homo sapiens
tggggctgtcctgctg

SEQ ID NO: 1507243 - DNA, 17 bp, Homo sapiens
tggggctgtcctgctgc

SEQ ID NO: 1507244 - DNA, 20 bp, Homo sapiens
tggggctgtcctgctgccct

SEQ ID NO: 1507245 - DNA, 20 bp, Homo sapiens
tggggctgtgttatgaaaat

SEQ ID NO: 1507246 - DNA, 21 bp, Homo sapiens
tggggcttcaccagtctgtct

SEQ ID NO: 1507247 - DNA, 16 bp, Homo sapiens
tggggcttctcctgac

SEQ ID NO: 1507248 - DNA, 15 bp, Homo sapiens
tgggggaaaaaaagt

SEQ ID NO: 1507249 - DNA, 18 bp, Homo sapiens
tgggggaaggcaggagcc

SEQ ID NO: 1507250 - DNA, 20 bp, Homo sapiens
tgggggacagaaagagactc

SEQ ID NO: 1507251 - DNA, 21 bp, Homo sapiens
tgggggagtagatctttctag

SEQ ID NO: 1507252 - DNA, 16 bp, Homo sapiens
tgggggcacaggaggc

SEQ ID NO: 1507253 - DNA, 14 bp, Homo sapiens
tgggggcagggctg

SEQ ID NO: 1507254 - DNA, 15 bp, Homo sapiens
tgggggcagggctgt

SEQ ID NO: 1507255 - DNA, 22 bp, Homo sapiens
tgggggcgccctctctgctcct

SEQ ID NO: 1507256 - DNA, 15 bp, Homo sapiens
tgggggctggtgcca

SEQ ID NO: 1507257 - DNA, 16 bp, Homo sapiens
tgggggctggtgccag

SEQ ID NO: 1507258 - DNA, 15 bp, Homo sapiens
tgggggctgtcctgc

SEQ ID NO: 1507259 - DNA, 17 bp, Homo sapiens
tggggggacccagtgca

SEQ ID NO: 1507260 - DNA, 19 bp, Homo sapiens
tggggggacccagtgcaga

SEQ ID NO: 1507261 - DNA, 14 bp, Homo sapiens
tggggggctgtcct

SEQ ID NO: 1507262 - DNA, 14 bp, Homo sapiens
tgggggggtggccg

SEQ ID NO: 1507263 - DNA, 16 bp, Homo sapiens
tggggggtccagtctg

SEQ ID NO: 1507264 - DNA, 18 bp, Homo sapiens
tgggggtagagctgatcc

SEQ ID NO: 1507265 - DNA, 21 bp, Homo sapiens
tgggggtagagctgatccaga

SEQ ID NO: 1507266 - DNA, 16 bp, Homo sapiens
tgggggtagcagctgg

SEQ ID NO: 1507267 - DNA, 18 bp, Homo sapiens
tgggggtctgtgtgttta

SEQ ID NO: 1507268 - DNA, 16 bp, Homo sapiens
tgggggtgcaggcagc

SEQ ID NO: 1507269 - DNA, 19 bp, Homo sapiens
tgggggtgccgctgtctct

SEQ ID NO: 1507270 - DNA, 16 bp, Homo sapiens
tgggggtgctgctctc

SEQ ID NO: 1507271 - DNA, 11 bp, Homo sapiens
tgggggtggga

SEQ ID NO: 1507272 - DNA, 15 bp, Homo sapiens
tggggtaagccagag

SEQ ID NO: 1507273 - DNA, 19 bp, Homo sapiens
tggggtaagccagagcctg

SEQ ID NO: 1507274 - DNA, 15 bp, Homo sapiens
tggggtaggttggga

SEQ ID NO: 1507275 - DNA, 22 bp, Homo sapiens
tggggtcaagaaacagccagca

SEQ ID NO: 1507276 - DNA, 21 bp, Homo sapiens
tggggtcctcctgtgctattt

SEQ ID NO: 1507277 - DNA, 16 bp, Homo sapiens
tggggtcctggggcct

SEQ ID NO: 1507278 - DNA, 22 bp, Homo sapiens
tggggtcctgtggggcccccac

SEQ ID NO: 1507279 - DNA, 23 bp, Homo sapiens
tggggtcctgtggggcccccaca

SEQ ID NO: 1507280 - DNA, 22 bp, Homo sapiens
tggggtccttttttatacagga

SEQ ID NO: 1507281 - DNA, 22 bp, Homo sapiens
tggggtctccctctcctgccta

SEQ ID NO: 1507282 - DNA, 14 bp, Homo sapiens
tggggtctgacccc

SEQ ID NO: 1507283 - DNA, 17 bp, Homo sapiens
tggggtctgtgactgga

SEQ ID NO: 1507284 - DNA, 14 bp, Homo sapiens
tggggtgaggacca

SEQ ID NO: 1507285 - DNA, 15 bp, Homo sapiens
tggggtgagggagtt

SEQ ID NO: 1507286 - DNA, 22 bp, Homo sapiens
tggggtgcactcgccatttcct

SEQ ID NO: 1507287 - DNA, 16 bp, Homo sapiens
tggggtgcatctcctc

SEQ ID NO: 1507288 - DNA, 22 bp, Homo sapiens
tggggtgcttcctttcaggcca

SEQ ID NO: 1507289 - DNA, 16 bp, Homo sapiens
tggggtggcgtctgcc

SEQ ID NO: 1507290 - DNA, 15 bp, Homo sapiens
tggggtgtgctggga

SEQ ID NO: 1507291 - DNA, 19 bp, Homo sapiens
tggggtttatcagaattct

SEQ ID NO: 1507292 - DNA, 21 bp, Homo sapiens
tggggtttgtgtttgattggc

SEQ ID NO: 1507293 - DNA, 16 bp, Homo sapiens
tgggtaaaatactttt

SEQ ID NO: 1507294 - DNA, 12 bp, Homo sapiens
tgggtaagaaga

SEQ ID NO: 1507295 - DNA, 16 bp, Homo sapiens
tgggtaagaggagcag

SEQ ID NO: 1507296 - DNA, 15 bp, Homo sapiens
tgggtaattgtacaa

SEQ ID NO: 1507297 - DNA, 17 bp, Homo sapiens
tgggtaattgtacaata

SEQ ID NO: 1507298 - DNA, 20 bp, Homo sapiens
tgggtaattgtacaataaat

SEQ ID NO: 1507299 - DNA, 16 bp, Homo sapiens
tgggtacctgcaagca

SEQ ID NO: 1507300 - DNA, 22 bp, Homo sapiens
tgggtacctgcaagcagaactt

SEQ ID NO: 1507301 - DNA, 23 bp, Homo sapiens
tgggtactggagcttttaaaaat

SEQ ID NO: 1507302 - DNA, 16 bp, Homo sapiens
tgggtacttcttgaag

SEQ ID NO: 1507303 - DNA, 23 bp, Homo sapiens
tgggtaggaaagaggaagcaaat

SEQ ID NO: 1507304 - DNA, 16 bp, Homo sapiens
tgggtatcccctgcct

SEQ ID NO: 1507305 - DNA, 19 bp, Homo sapiens
tgggtatcccctgcctcct

SEQ ID NO: 1507306 - DNA, 20 bp, Homo sapiens
tgggtatcccctgcctcctg

SEQ ID NO: 1507307 - DNA, 13 bp, Homo sapiens
tgggtattaaact

SEQ ID NO: 1507308 - DNA, 21 bp, Homo sapiens
tgggtatttttataacaatat

SEQ ID NO: 1507309 - DNA, 23 bp, Homo sapiens
tgggtatttttataacaatataa

SEQ ID NO: 1507310 - DNA, 17 bp, Homo sapiens
tgggtcaaaaaaaagaa

SEQ ID NO: 1507311 - DNA, 23 bp, Homo sapiens
tgggtcaaagtggtacaggaagg

SEQ ID NO: 1507312 - DNA, 19 bp, Homo sapiens
tgggtcacacacggaggca

SEQ ID NO: 1507313 - DNA, 16 bp, Homo sapiens
tgggtcagaaccagag

SEQ ID NO: 1507314 - DNA, 15 bp, Homo sapiens
tgggtcagcccagca

SEQ ID NO: 1507315 - DNA, 20 bp, Homo sapiens
tgggtcagcccagcacctgc

SEQ ID NO: 1507316 - DNA, 19 bp, Homo sapiens
tgggtccaggaaggcagct

SEQ ID NO: 1507317 - DNA, 22 bp, Homo sapiens
tgggtccagggcctgacacccc

SEQ ID NO: 1507318 - DNA, 17 bp, Homo sapiens
tgggtccattcagatga

SEQ ID NO: 1507319 - DNA, 18 bp, Homo sapiens
tgggtcccgcactctgcc

SEQ ID NO: 1507320 - DNA, 18 bp, Homo sapiens
tgggtcccttgaaggaag

SEQ ID NO: 1507321 - DNA, 14 bp, Homo sapiens
tgggtcctgaagaa

SEQ ID NO: 1507322 - DNA, 14 bp, Homo sapiens
tgggtcctgcaatt

SEQ ID NO: 1507323 - DNA, 20 bp, Homo sapiens
tgggtcctgcaattctacag

SEQ ID NO: 1507324 - DNA, 21 bp, Homo sapiens
tgggtcctgcctggtcctccc

SEQ ID NO: 1507325 - DNA, 22 bp, Homo sapiens
tgggtccttgatgccagagggc

SEQ ID NO: 1507326 - DNA, 18 bp, Homo sapiens
tgggtctcactcctgagt

SEQ ID NO: 1507327 - DNA, 17 bp, Homo sapiens
tgggtctctgggcacag

SEQ ID NO: 1507328 - DNA, 24 bp, Homo sapiens
tgggtctgggatatggctgcccag

SEQ ID NO: 1507329 - DNA, 20 bp, Homo sapiens
tgggtcttgccatgtgctgg

SEQ ID NO: 1507330 - DNA, 15 bp, Homo sapiens
tgggtgaagggagag

SEQ ID NO: 1507331 - DNA, 21 bp, Homo sapiens
tgggtgaatatggtggaaaat

SEQ ID NO: 1507332 - DNA, 15 bp, Homo sapiens
tgggtgagccaagga

SEQ ID NO: 1507333 - DNA, 16 bp, Homo sapiens
tgggtgagccaaggac

SEQ ID NO: 1507334 - DNA, 17 bp, Homo sapiens
tgggtgattcctcccag

SEQ ID NO: 1507335 - DNA, 15 bp, Homo sapiens
tgggtgcgtctccag

SEQ ID NO: 1507336 - DNA, 18 bp, Homo sapiens
tgggtgctggctgcccag

SEQ ID NO: 1507337 - DNA, 13 bp, Homo sapiens
tgggtggagaagg

SEQ ID NO: 1507338 - DNA, 19 bp, Homo sapiens
tgggtggagaagggagggt

SEQ ID NO: 1507339 - DNA, 20 bp, Homo sapiens
tgggtggagaagggagggtg

SEQ ID NO: 1507340 - DNA, 20 bp, Homo sapiens
tgggtggagtcaggcttctc

SEQ ID NO: 1507341 - DNA, 21 bp, Homo sapiens
tgggtggcccctgctgtctct

SEQ ID NO: 1507342 - DNA, 16 bp, Homo sapiens
tgggtgggctctgtgc

SEQ ID NO: 1507343 - DNA, 19 bp, Homo sapiens
tgggtgggctctgtgcagt

SEQ ID NO: 1507344 - DNA, 15 bp, Homo sapiens
tgggtggggtgagga

SEQ ID NO: 1507345 - DNA, 20 bp, Homo sapiens
tgggtggggtgaggaccact

SEQ ID NO: 1507346 - DNA, 22 bp, Homo sapiens
tgggtggtaccctctggagggg

SEQ ID NO: 1507347 - DNA, 22 bp, Homo sapiens
tgggtgtaacaggtctcctctt

SEQ ID NO: 1507348 - DNA, 17 bp, Homo sapiens
tgggtgtattctctgta

SEQ ID NO: 1507349 - DNA, 22 bp, Homo sapiens
tgggtgtcctgcagaagaagct

SEQ ID NO: 1507350 - DNA, 13 bp, Homo sapiens
tgggtgtcctgcc

SEQ ID NO: 1507351 - DNA, 19 bp, Homo sapiens
tgggtgtcctgcctgtctg

SEQ ID NO: 1507352 - DNA, 23 bp, Homo sapiens
tgggtgtcctgcctgtctgcccc

SEQ ID NO: 1507353 - DNA, 23 bp, Homo sapiens
tgggtgtggccagcacaccaagt

SEQ ID NO: 1507354 - DNA, 18 bp, Homo sapiens
tgggtgtgtgtagccaag

SEQ ID NO: 1507355 - DNA, 14 bp, Homo sapiens
tgggttctgcctgc

SEQ ID NO: 1507356 - DNA, 19 bp, Homo sapiens
tgggttctgcctgccagct

SEQ ID NO: 1507357 - DNA, 22 bp, Homo sapiens
tgggttctgcctgccagctgca

SEQ ID NO: 1507358 - DNA, 12 bp, Homo sapiens
tgggttctttct

SEQ ID NO: 1507359 - DNA, 19 bp, Homo sapiens
tgggttgcgtcctgacggc

SEQ ID NO: 1507360 - DNA, 15 bp, Homo sapiens
tgggttggtgcacag

SEQ ID NO: 1507361 - DNA, 19 bp, Homo sapiens
tgggttggtgcacagtgat

SEQ ID NO: 1507362 - DNA, 12 bp, Homo sapiens
tgggtttcatgt

SEQ ID NO: 1507363 - DNA, 21 bp, Homo sapiens
tgggtttctctgtgctctgaa

SEQ ID NO: 1507364 - DNA, 21 bp, Homo sapiens
tgggtttggaccccagctggg

SEQ ID NO: 1507365 - DNA, 24 bp, Homo sapiens
tgggttttcttcccatcactggag

SEQ ID NO: 1507366 - DNA, 16 bp, Homo sapiens
tgggtttttcatcttt

SEQ ID NO: 1507367 - DNA, 22 bp, Homo sapiens
tggtaaacggtttttattaaag

SEQ ID NO: 1507368 - DNA, 13 bp, Homo sapiens
tggtaaatgtttc

SEQ ID NO: 1507369 - DNA, 14 bp, Homo sapiens
tggtaaatgtttct

SEQ ID NO: 1507370 - DNA, 18 bp, Homo sapiens
tggtaacaatagttctta

SEQ ID NO: 1507371 - DNA, 18 bp, Homo sapiens
tggtaacagttcatgttt

SEQ ID NO: 1507372 - DNA, 18 bp, Homo sapiens
tggtaaccagccacagta

SEQ ID NO: 1507373 - DNA, 21 bp, Homo sapiens
tggtaactgattacctgccaa

SEQ ID NO: 1507374 - DNA, 14 bp, Homo sapiens
tggtaactgccagc

SEQ ID NO: 1507375 - DNA, 16 bp, Homo sapiens
tggtaacttttgtgaa

SEQ ID NO: 1507376 - DNA, 24 bp, Homo sapiens
tggtaacttttgtgaattaggctg

SEQ ID NO: 1507377 - DNA, 20 bp, Homo sapiens
tggtaagcgatttgaaacac

SEQ ID NO: 1507378 - DNA, 22 bp, Homo sapiens
tggtaagggggtccctgtgctg

SEQ ID NO: 1507379 - DNA, 12 bp, Homo sapiens
tggtaagtggag

SEQ ID NO: 1507380 - DNA, 21 bp, Homo sapiens
tggtaataagggaaaaatcaa

SEQ ID NO: 1507381 - DNA, 21 bp, Homo sapiens
tggtaatcccctaaaataaca

SEQ ID NO: 1507382 - DNA, 23 bp, Homo sapiens
tggtaatcccctaaaataacagt

SEQ ID NO: 1507383 - DNA, 15 bp, Homo sapiens
tggtaatcttgctct

SEQ ID NO: 1507384 - DNA, 23 bp, Homo sapiens
tggtaatctttacctgtatacag

SEQ ID NO: 1507385 - DNA, 14 bp, Homo sapiens
tggtaatgttagca

SEQ ID NO: 1507386 - DNA, 15 bp, Homo sapiens
tggtaattcctctcc

SEQ ID NO: 1507387 - DNA, 15 bp, Homo sapiens
tggtaattgtacaat

SEQ ID NO: 1507388 - DNA, 22 bp, Homo sapiens
tggtaatttaagattccagaga

SEQ ID NO: 1507389 - DNA, 16 bp, Homo sapiens
tggtacaacggaggcc

SEQ ID NO: 1507390 - DNA, 20 bp, Homo sapiens
tggtacaacggaggcctgcg

SEQ ID NO: 1507391 - DNA, 18 bp, Homo sapiens
tggtacaatctggctcac

SEQ ID NO: 1507392 - DNA, 19 bp, Homo sapiens
tggtacaatctggctcact

SEQ ID NO: 1507393 - DNA, 16 bp, Homo sapiens
tggtacatggccagtg

SEQ ID NO: 1507394 - DNA, 17 bp, Homo sapiens
tggtacatgtcttccat

SEQ ID NO: 1507395 - DNA, 22 bp, Homo sapiens
tggtacccaggctttagcatta

SEQ ID NO: 1507396 - DNA, 15 bp, Homo sapiens
tggtaccctcctggc

SEQ ID NO: 1507397 - DNA, 16 bp, Homo sapiens
tggtaccctcctggct

SEQ ID NO: 1507398 - DNA, 14 bp, Homo sapiens
tggtaccctctgga

SEQ ID NO: 1507399 - DNA, 12 bp, Homo sapiens
tggtacctggac

SEQ ID NO: 1507400 - DNA, 16 bp, Homo sapiens
tggtacctgtgctttc

SEQ ID NO: 1507401 - DNA, 20 bp, Homo sapiens
tggtactactagatgtcttt

SEQ ID NO: 1507402 - DNA, 22 bp, Homo sapiens
tggtactccctctcaggatcca

SEQ ID NO: 1507403 - DNA, 17 bp, Homo sapiens
tggtactgactttgctt

SEQ ID NO: 1507404 - DNA, 21 bp, Homo sapiens
tggtactttattcttgctggg

SEQ ID NO: 1507405 - DNA, 19 bp, Homo sapiens
tggtacttttatgatgtat

SEQ ID NO: 1507406 - DNA, 21 bp, Homo sapiens
tggtacttttatgatgtatat

SEQ ID NO: 1507407 - DNA, 20 bp, Homo sapiens
tggtacttttgagtgtgtgt

SEQ ID NO: 1507408 - DNA, 17 bp, Homo sapiens
tggtagaccaaaataaa

SEQ ID NO: 1507409 - DNA, 18 bp, Homo sapiens
tggtagatgctgaggccc

SEQ ID NO: 1507410 - DNA, 18 bp, Homo sapiens
tggtagatgttcttttct

SEQ ID NO: 1507411 - DNA, 19 bp, Homo sapiens
tggtagattcgctgtcccc

SEQ ID NO: 1507412 - DNA, 17 bp, Homo sapiens
tggtagcagcaggctca

SEQ ID NO: 1507413 - DNA, 15 bp, Homo sapiens
tggtagctccagcga

SEQ ID NO: 1507414 - DNA, 22 bp, Homo sapiens
tggtaggaccaagcatcttggg

SEQ ID NO: 1507415 - DNA, 22 bp, Homo sapiens
tggtaggggagggcaggcttgg

SEQ ID NO: 1507416 - DNA, 19 bp, Homo sapiens
tggtagggtgggagtggtt

SEQ ID NO: 1507417 - DNA, 21 bp, Homo sapiens
tggtaggttgggacaccaggg

SEQ ID NO: 1507418 - DNA, 13 bp, Homo sapiens
tggtagtatctcg

SEQ ID NO: 1507419 - DNA, 16 bp, Homo sapiens
tggtagtatctcgtaa

SEQ ID NO: 1507420 - DNA, 22 bp, Homo sapiens
tggtagtggaatagtgaatact

SEQ ID NO: 1507421 - DNA, 15 bp, Homo sapiens
tggtagtgttcagta

SEQ ID NO: 1507422 - DNA, 12 bp, Homo sapiens
tggtataaaagg

SEQ ID NO: 1507423 - DNA, 22 bp, Homo sapiens
tggtatcctgtgacatgtaaca

SEQ ID NO: 1507424 - DNA, 13 bp, Homo sapiens
tggtatctcagaa

SEQ ID NO: 1507425 - DNA, 19 bp, Homo sapiens
tggtatctgggtaagaaga

SEQ ID NO: 1507426 - DNA, 14 bp, Homo sapiens
tggtatctttagat

SEQ ID NO: 1507427 - DNA, 19 bp, Homo sapiens
tggtatggaactctctcca

SEQ ID NO: 1507428 - DNA, 18 bp, Homo sapiens
tggtatgtaatttatgca

SEQ ID NO: 1507429 - DNA, 20 bp, Homo sapiens
tggtatgtaatttatgcaag

SEQ ID NO: 1507430 - DNA, 13 bp, Homo sapiens
tggtatgtctctt

SEQ ID NO: 1507431 - DNA, 15 bp, Homo sapiens
tggtatgtctcttta

SEQ ID NO: 1507432 - DNA, 13 bp, Homo sapiens
tggtatttctaat

SEQ ID NO: 1507433 - DNA, 14 bp, Homo sapiens
tggtatttctaatt

SEQ ID NO: 1507434 - DNA, 18 bp, Homo sapiens
tggtatttttttaaatca

SEQ ID NO: 1507435 - DNA, 13 bp, Homo sapiens
tggtcaacttaag

SEQ ID NO: 1507436 - DNA, 14 bp, Homo sapiens
tggtcaacttaagg

SEQ ID NO: 1507437 - DNA, 16 bp, Homo sapiens
tggtcaaggccacctc

SEQ ID NO: 1507438 - DNA, 21 bp, Homo sapiens
tggtcaaggccacctctgcct

SEQ ID NO: 1507439 - DNA, 23 bp, Homo sapiens
tggtcaagggctgtcattgcaca

SEQ ID NO: 1507440 - DNA, 19 bp, Homo sapiens
tggtcaagttcccaactga

SEQ ID NO: 1507441 - DNA, 22 bp, Homo sapiens
tggtcaatccgaagtatgaggg

SEQ ID NO: 1507442 - DNA, 15 bp, Homo sapiens
tggtcacaagcacaa

SEQ ID NO: 1507443 - DNA, 20 bp, Homo sapiens
tggtcacagccatgaagtca

SEQ ID NO: 1507444 - DNA, 16 bp, Homo sapiens
tggtcaccatgaaact

SEQ ID NO: 1507445 - DNA, 16 bp, Homo sapiens
tggtcaccttcgagta

SEQ ID NO: 1507446 - DNA, 15 bp, Homo sapiens
tggtcactctgccct

SEQ ID NO: 1507447 - DNA, 15 bp, Homo sapiens
tggtcagagccactc

SEQ ID NO: 1507448 - DNA, 22 bp, Homo sapiens
tggtcagagggactgtcagctg

SEQ ID NO: 1507449 - DNA, 17 bp, Homo sapiens
tggtcagagtgaattga

SEQ ID NO: 1507450 - DNA, 14 bp, Homo sapiens
tggtcagagtgcca

SEQ ID NO: 1507451 - DNA, 21 bp, Homo sapiens
tggtcaggtatttcagttctt

SEQ ID NO: 1507452 - DNA, 21 bp, Homo sapiens
tggtcaggttatactcctcct

SEQ ID NO: 1507453 - DNA, 18 bp, Homo sapiens
tggtcatcaccacccttc

SEQ ID NO: 1507454 - DNA, 14 bp, Homo sapiens
tggtcatgctcagc

SEQ ID NO: 1507455 - DNA, 21 bp, Homo sapiens
tggtcatgctcagccttgctg

SEQ ID NO: 1507456 - DNA, 14 bp, Homo sapiens
tggtcatttcaggc

SEQ ID NO: 1507457 - DNA, 18 bp, Homo sapiens
tggtcattttatgttaag

SEQ ID NO: 1507458 - DNA, 19 bp, Homo sapiens
tggtccaaaaaaaggaaaa

SEQ ID NO: 1507459 - DNA, 21 bp, Homo sapiens
tggtccaaaaaaaggaaaaat

SEQ ID NO: 1507460 - DNA, 21 bp, Homo sapiens
tggtccaaaagattgctgaaa

SEQ ID NO: 1507461 - DNA, 12 bp, Homo sapiens
tggtccagctct

SEQ ID NO: 1507462 - DNA, 15 bp, Homo sapiens
tggtccagctctgac

SEQ ID NO: 1507463 - DNA, 20 bp, Homo sapiens
tggtccagctctgacatccc

SEQ ID NO: 1507464 - DNA, 22 bp, Homo sapiens
tggtccagctcttggcccctgt

SEQ ID NO: 1507465 - DNA, 16 bp, Homo sapiens
tggtccaggccctgtg

SEQ ID NO: 1507466 - DNA, 19 bp, Homo sapiens
tggtccagggaagctggcc

SEQ ID NO: 1507467 - DNA, 21 bp, Homo sapiens
tggtccaggtcttcagtttcc

SEQ ID NO: 1507468 - DNA, 23 bp, Homo sapiens
tggtccatgtaaatactttccat

SEQ ID NO: 1507469 - DNA, 20 bp, Homo sapiens
tggtccatttgttcctgctt

SEQ ID NO: 1507470 - DNA, 15 bp, Homo sapiens
tggtcccatccaggc

SEQ ID NO: 1507471 - DNA, 18 bp, Homo sapiens
tggtcccatccaggcagt

SEQ ID NO: 1507472 - DNA, 19 bp, Homo sapiens
tggtcccatggctgaagct

SEQ ID NO: 1507473 - DNA, 23 bp, Homo sapiens
tggtccctcgtccacaggggcag

SEQ ID NO: 1507474 - DNA, 19 bp, Homo sapiens
tggtccctgccctcccctg

SEQ ID NO: 1507475 - DNA, 18 bp, Homo sapiens
tggtccctggtccttcac

SEQ ID NO: 1507476 - DNA, 15 bp, Homo sapiens
tggtccggtgtcctt

SEQ ID NO: 1507477 - DNA, 19 bp, Homo sapiens
tggtccgtgcccaggccct

SEQ ID NO: 1507478 - DNA, 16 bp, Homo sapiens
tggtcctccctcccaa

SEQ ID NO: 1507479 - DNA, 16 bp, Homo sapiens
tggtcctccgcctact

SEQ ID NO: 1507480 - DNA, 15 bp, Homo sapiens
tggtcctctctctgt

SEQ ID NO: 1507481 - DNA, 23 bp, Homo sapiens
tggtcctctctctgtggggctga

SEQ ID NO: 1507482 - DNA, 16 bp, Homo sapiens
tggtcctggctgcact

SEQ ID NO: 1507483 - DNA, 15 bp, Homo sapiens
tggtccttcactggc

SEQ ID NO: 1507484 - DNA, 17 bp, Homo sapiens
tggtccttcactggcgc

SEQ ID NO: 1507485 - DNA, 20 bp, Homo sapiens
tggtccttcactggcgcctt

SEQ ID NO: 1507486 - DNA, 17 bp, Homo sapiens
tggtcctttctggaagt

SEQ ID NO: 1507487 - DNA, 14 bp, Homo sapiens
tggtcgagtgacac

SEQ ID NO: 1507488 - DNA, 16 bp, Homo sapiens
tggtcggatctcacag

SEQ ID NO: 1507489 - DNA, 17 bp, Homo sapiens
tggtctaacactggcat

SEQ ID NO: 1507490 - DNA, 14 bp, Homo sapiens
tggtctaatgtttg

SEQ ID NO: 1507491 - DNA, 15 bp, Homo sapiens
tggtctaatgtttgt

SEQ ID NO: 1507492 - DNA, 17 bp, Homo sapiens
tggtctcaggcagcacc

SEQ ID NO: 1507493 - DNA, 20 bp, Homo sapiens
tggtctcaggcagcaccaca

SEQ ID NO: 1507494 - DNA, 15 bp, Homo sapiens
tggtctcccttctct

SEQ ID NO: 1507495 - DNA, 20 bp, Homo sapiens
tggtctcgatctcctgacct

SEQ ID NO: 1507496 - DNA, 10 bp, Homo sapiens
tggtctctgc

SEQ ID NO: 1507497 - DNA, 17 bp, Homo sapiens
tggtctctgcacccagt

SEQ ID NO: 1507498 - DNA, 15 bp, Homo sapiens
tggtctctgccccag

SEQ ID NO: 1507499 - DNA, 13 bp, Homo sapiens
tggtctctgctgg

SEQ ID NO: 1507500 - DNA, 14 bp, Homo sapiens
tggtctctgctggg

SEQ ID NO: 1507501 - DNA, 19 bp, Homo sapiens
tggtctcttcttggggccc

SEQ ID NO: 1507502 - DNA, 14 bp, Homo sapiens
tggtctgtctggat

SEQ ID NO: 1507503 - DNA, 15 bp, Homo sapiens
tggtctgtgaagagc

SEQ ID NO: 1507504 - DNA, 21 bp, Homo sapiens
tggtctgtgtaacatccaagc

SEQ ID NO: 1507505 - DNA, 22 bp, Homo sapiens
tggtctgtttgtctgaacaaag

SEQ ID NO: 1507506 - DNA, 22 bp, Homo sapiens
tggtcttccttctaccccaagg

SEQ ID NO: 1507507 - DNA, 21 bp, Homo sapiens
tggtcttctgttgacattcgg

SEQ ID NO: 1507508 - DNA, 17 bp, Homo sapiens
tggtcttgagatgtctt

SEQ ID NO: 1507509 - DNA, 13 bp, Homo sapiens
tggtctttgctcc

SEQ ID NO: 1507510 - DNA, 18 bp, Homo sapiens
tggtctttgtctgcaggt

SEQ ID NO: 1507511 - DNA, 16 bp, Homo sapiens
tggtcttttataattc

SEQ ID NO: 1507512 - DNA, 19 bp, Homo sapiens
tggtgaaacccccatctct

SEQ ID NO: 1507513 - DNA, 19 bp, Homo sapiens
tggtgaaattgactgatga

SEQ ID NO: 1507514 - DNA, 14 bp, Homo sapiens
tggtgaacactgtg

SEQ ID NO: 1507515 - DNA, 15 bp, Homo sapiens
tggtgaacactgtga

SEQ ID NO: 1507516 - DNA, 11 bp, Homo sapiens
tggtgaacagt

SEQ ID NO: 1507517 - DNA, 14 bp, Homo sapiens
tggtgaagggaagt

SEQ ID NO: 1507518 - DNA, 18 bp, Homo sapiens
tggtgaataactatgcca

SEQ ID NO: 1507519 - DNA, 17 bp, Homo sapiens
tggtgactgggaaagtt

SEQ ID NO: 1507520 - DNA, 19 bp, Homo sapiens
tggtgagaactgaggagcg

SEQ ID NO: 1507521 - DNA, 15 bp, Homo sapiens
tggtgagctgggaag

SEQ ID NO: 1507522 - DNA, 18 bp, Homo sapiens
tggtgagctgggaagctg

SEQ ID NO: 1507523 - DNA, 16 bp, Homo sapiens
tggtgaggggctttct

SEQ ID NO: 1507524 - DNA, 21 bp, Homo sapiens
tggtgagtcttggttctaaag

SEQ ID NO: 1507525 - DNA, 17 bp, Homo sapiens
tggtgatcaattaaatg

SEQ ID NO: 1507526 - DNA, 17 bp, Homo sapiens
tggtgattctccaggcc

SEQ ID NO: 1507527 - DNA, 14 bp, Homo sapiens
tggttctaaaggta

SEQ ID NO: 1507528 - DNA, 22 bp, Homo sapiens
tggttctaaggacctgaaattc

SEQ ID NO: 1507529 - DNA, 14 bp, Homo sapiens
tggttctatgctaa

SEQ ID NO: 1507530 - DNA, 14 bp, Homo sapiens
tggttctatttaat

SEQ ID NO: 1507531 - DNA, 21 bp, Homo sapiens
tggttctgtgctaatcaaaac

SEQ ID NO: 1507532 - DNA, 19 bp, Homo sapiens
tggttgaatgaataaaaca

SEQ ID NO: 1507533 - DNA, 20 bp, Homo sapiens
tggttgaatgaataaaacaa

SEQ ID NO: 1507534 - DNA, 15 bp, Homo sapiens
tggttgactgggttt

SEQ ID NO: 1507535 - DNA, 22 bp, Homo sapiens
tggttgaggtggaagccctcct

SEQ ID NO: 1507536 - DNA, 19 bp, Homo sapiens
tggttgatttgtaacacag

SEQ ID NO: 1507537 - DNA, 20 bp, Homo sapiens
tggttgcacttatgatttca

SEQ ID NO: 1507538 - DNA, 12 bp, Homo sapiens
tggttgcttcag

SEQ ID NO: 1507539 - DNA, 23 bp, Homo sapiens
tggttggccgtggtccagctctt

SEQ ID NO: 1507540 - DNA, 16 bp, Homo sapiens
tggttgggaatgagga

SEQ ID NO: 1507541 - DNA, 15 bp, Homo sapiens
tggttgggtcctcac

SEQ ID NO: 1507542 - DNA, 21 bp, Homo sapiens
tggttgtgccttcccttctct

SEQ ID NO: 1507543 - DNA, 19 bp, Homo sapiens
tggttgtggtgtagactgt

SEQ ID NO: 1507544 - DNA, 15 bp, Homo sapiens
tggttgttgccaact

SEQ ID NO: 1507545 - DNA, 21 bp, Homo sapiens
tggtttaaagaaagtgtattt

SEQ ID NO: 1507546 - DNA, 18 bp, Homo sapiens
tggtttaaatatgaatga

SEQ ID NO: 1507547 - DNA, 22 bp, Homo sapiens
tggtttaattaataatatgtac

SEQ ID NO: 1507548 - DNA, 15 bp, Homo sapiens
tggtttattcccaag

SEQ ID NO: 1507549 - DNA, 22 bp, Homo sapiens
tggtttcataacttcctgtact

SEQ ID NO: 1507550 - DNA, 19 bp, Homo sapiens
tggtttcctcattcctgaa

SEQ ID NO: 1507551 - DNA, 15 bp, Homo sapiens
tggtttctttttgaa

SEQ ID NO: 1507552 - DNA, 16 bp, Homo sapiens
tggtttgaaagattat

SEQ ID NO: 1507553 - DNA, 19 bp, Homo sapiens
tggtttgacaattttgtct

SEQ ID NO: 1507554 - DNA, 21 bp, Homo sapiens
tggtttgagacactggtttac

SEQ ID NO: 1507555 - DNA, 12 bp, Homo sapiens
tggtttgctagt

SEQ ID NO: 1507556 - DNA, 17 bp, Homo sapiens
tggtttggaatattaaa

SEQ ID NO: 1507557 - DNA, 20 bp, Homo sapiens
tggtttggaatattaaaaaa

SEQ ID NO: 1507558 - DNA, 20 bp, Homo sapiens
tggtttgggaatatccatgt

SEQ ID NO: 1507559 - DNA, 20 bp, Homo sapiens
tggtttgtatgagatggtta

SEQ ID NO: 1507560 - DNA, 20 bp, Homo sapiens
tggtttgtgtcaaaactggt

SEQ ID NO: 1507561 - DNA, 15 bp, Homo sapiens
tggtttgtgtgatca

SEQ ID NO: 1507562 - DNA, 20 bp, Homo sapiens
tggttttaacaactgtgctt

SEQ ID NO: 1507563 - DNA, 12 bp, Homo sapiens
tggttttaagaa

SEQ ID NO: 1507564 - DNA, 14 bp, Homo sapiens
tggttttagatttt

SEQ ID NO: 1507565 - DNA, 23 bp, Homo sapiens
tggttttatactgaaggaaaaac

SEQ ID NO: 1507566 - DNA, 20 bp, Homo sapiens
tggttttcaacctctagaat

SEQ ID NO: 1507567 - DNA, 22 bp, Homo sapiens
tggttttcccctccctgggttc

SEQ ID NO: 1507568 - DNA, 20 bp, Homo sapiens
tggttttctggtggggctgt

SEQ ID NO: 1507569 - DNA, 22 bp, Homo sapiens
tggttttcttgggggaaaatac

SEQ ID NO: 1507570 - DNA, 19 bp, Homo sapiens
tggttttgtaagatgctgg

SEQ ID NO: 1507571 - DNA, 16 bp, Homo sapiens
tggttttgtgccatct

SEQ ID NO: 1507572 - DNA, 21 bp, Homo sapiens
tggtttttactgctctgagaa

SEQ ID NO: 1507573 - DNA, 12 bp, Homo sapiens
tggtttttccaa

SEQ ID NO: 1507574 - DNA, 19 bp, Homo sapiens
tggtttttggctctttcag

SEQ ID NO: 1507575 - DNA, 22 bp, Homo sapiens
tggtttttgtagccttcctcca

SEQ ID NO: 1507576 - DNA, 16 bp, Homo sapiens
tgtaaaaaaagcaaaa

SEQ ID NO: 1507577 - DNA, 17 bp, Homo sapiens
tgtaaaaaagaaaaaca

SEQ ID NO: 1507578 - DNA, 18 bp, Homo sapiens
tgtaaaaaatggaaaaaa

SEQ ID NO: 1507579 - DNA, 21 bp, Homo sapiens
tgtaaaaaatggaaaaaaaca

SEQ ID NO: 1507580 - DNA, 16 bp, Homo sapiens
tgtaaaaaatggagct

SEQ ID NO: 1507581 - DNA, 19 bp, Homo sapiens
tgtaaaaaatggagctcag

SEQ ID NO: 1507582 - DNA, 23 bp, Homo sapiens
tgtaaaaacagcattgctttctg

SEQ ID NO: 1507583 - DNA, 18 bp, Homo sapiens
tgtaaaaagcctccttgt

SEQ ID NO: 1507584 - DNA, 16 bp, Homo sapiens
tgtaaaaatcttttga

SEQ ID NO: 1507585 - DNA, 14 bp, Homo sapiens
tgtaaaacaaaatt

SEQ ID NO: 1507586 - DNA, 14 bp, Homo sapiens
tgtaaaacaggtag

SEQ ID NO: 1507587 - DNA, 12 bp, Homo sapiens
tgtaaaactgtt

SEQ ID NO: 1507588 - DNA, 12 bp, Homo sapiens
tgtaaaataatt

SEQ ID NO: 1507589 - DNA, 15 bp, Homo sapiens
tgtaaaatatgtaaa

SEQ ID NO: 1507590 - DNA, 20 bp, Homo sapiens
tgtaaaatcttgtcatgtgt

SEQ ID NO: 1507591 - DNA, 15 bp, Homo sapiens
tgtaaaatgaaatta

SEQ ID NO: 1507592 - DNA, 17 bp, Homo sapiens
tgtaaaatgaattgaaa

SEQ ID NO: 1507593 - DNA, 23 bp, Homo sapiens
tgtaaaatgaattgaaaaacaat

SEQ ID NO: 1507594 - DNA, 18 bp, Homo sapiens
tgtaaaatgcaaaaaatc

SEQ ID NO: 1507595 - DNA, 20 bp, Homo sapiens
tgtaaaatgtgaagtgaatg

SEQ ID NO: 1507596 - DNA, 13 bp, Homo sapiens
tgtaaaattcata

SEQ ID NO: 1507597 - DNA, 19 bp, Homo sapiens
tgtaaacaatgtaaagtaa

SEQ ID NO: 1507598 - DNA, 18 bp, Homo sapiens
tgtaaacagcctcttttt

SEQ ID NO: 1507599 - DNA, 14 bp, Homo sapiens
tgtaaacagtgcct

SEQ ID NO: 1507600 - DNA, 22 bp, Homo sapiens
tgtaaaccataggtaatgatta

SEQ ID NO: 1507601 - DNA, 19 bp, Homo sapiens
tgtaaacgacaagaataat

SEQ ID NO: 1507602 - DNA, 23 bp, Homo sapiens
tgtaaactcaaaatatttgtaca

SEQ ID NO: 1507603 - DNA, 20 bp, Homo sapiens
tgtaaactgtatcaaatctg

SEQ ID NO: 1507604 - DNA, 17 bp, Homo sapiens
tgtaaactttatcactt

SEQ ID NO: 1507605 - DNA, 18 bp, Homo sapiens
tgtaaactttatcactta

SEQ ID NO: 1507606 - DNA, 13 bp, Homo sapiens
tgtaaagaaaaat

SEQ ID NO: 1507607 - DNA, 16 bp, Homo sapiens
tgtaaagaaaaatatt

SEQ ID NO: 1507608 - DNA, 18 bp, Homo sapiens
tgtaaagacaaataaatg

SEQ ID NO: 1507609 - DNA, 15 bp, Homo sapiens
tgtaaagatttctgt

SEQ ID NO: 1507610 - DNA, 18 bp, Homo sapiens
tgtaaagatttctgttca

SEQ ID NO: 1507611 - DNA, 19 bp, Homo sapiens
tgtaaagatttctgttcag

SEQ ID NO: 1507612 - DNA, 19 bp, Homo sapiens
tgtaaaggtatattgtgaa

SEQ ID NO: 1507613 - DNA, 17 bp, Homo sapiens
tgtaaaggtttcatgtt

SEQ ID NO: 1507614 - DNA, 16 bp, Homo sapiens
tgtaaagtaagacatc

SEQ ID NO: 1507615 - DNA, 18 bp, Homo sapiens
tgtaaagttatgtattta

SEQ ID NO: 1507616 - DNA, 13 bp, Homo sapiens
tgtaaagtttcta

SEQ ID NO: 1507617 - DNA, 14 bp, Homo sapiens
tgtaaagtttctag

SEQ ID NO: 1507618 - DNA, 13 bp, Homo sapiens
tgtaaataaagtc

SEQ ID NO: 1507619 - DNA, 15 bp, Homo sapiens
tgtaaataagagatt

SEQ ID NO: 1507620 - DNA, 12 bp, Homo sapiens
tgtaaatacacc

SEQ ID NO: 1507621 - DNA, 15 bp, Homo sapiens
tgtaaatattctata

SEQ ID NO: 1507622 - DNA, 20 bp, Homo sapiens
tgtaaatattctatatgaat

SEQ ID NO: 1507623 - DNA, 12 bp, Homo sapiens
tgtaaatattta

SEQ ID NO: 1507624 - DNA, 18 bp, Homo sapiens
tgtaaatatttatttatg

SEQ ID NO: 1507625 - DNA, 11 bp, Homo sapiens
tgtaaatcact

SEQ ID NO: 1507626 - DNA, 21 bp, Homo sapiens
tggtgatttgaaaaatataaa

SEQ ID NO: 1507627 - DNA, 22 bp, Homo sapiens
tggtgatttgaaaaatataaaa

SEQ ID NO: 1507628 - DNA, 15 bp, Homo sapiens
tggtgattttaaatg

SEQ ID NO: 1507629 - DNA, 11 bp, Homo sapiens
tggtgcaaaga

SEQ ID NO: 1507630 - DNA, 16 bp, Homo sapiens
tggtgcaaattcagaa

SEQ ID NO: 1507631 - DNA, 19 bp, Homo sapiens
tggtgcaagttgaggactt

SEQ ID NO: 1507632 - DNA, 22 bp, Homo sapiens
tggtgcaagttgaggacttctt

SEQ ID NO: 1507633 - DNA, 23 bp, Homo sapiens
tggtgcaagttgaggacttcttg

SEQ ID NO: 1507634 - DNA, 15 bp, Homo sapiens
tggtgcacagtgatt

SEQ ID NO: 1507635 - DNA, 16 bp, Homo sapiens
tggtgcattgctgtgt

SEQ ID NO: 1507636 - DNA, 20 bp, Homo sapiens
tggtgcattgttatttaata

SEQ ID NO: 1507637 - DNA, 21 bp, Homo sapiens
tggtgccaaatagccccagac

SEQ ID NO: 1507638 - DNA, 14 bp, Homo sapiens
tggtgccatcccca

SEQ ID NO: 1507639 - DNA, 12 bp, Homo sapiens
tggtgccccacc

SEQ ID NO: 1507640 - DNA, 14 bp, Homo sapiens
tggtgccccacctg

SEQ ID NO: 1507641 - DNA, 18 bp, Homo sapiens
tggtgccccacctgcctg

SEQ ID NO: 1507642 - DNA, 16 bp, Homo sapiens
tggtgccccaggacca

SEQ ID NO: 1507643 - DNA, 19 bp, Homo sapiens
tggtgcctatatctgagag

SEQ ID NO: 1507644 - DNA, 13 bp, Homo sapiens
tggtgcctccaga

SEQ ID NO: 1507645 - DNA, 18 bp, Homo sapiens
tggtgcctctgtgcacag

SEQ ID NO: 1507646 - DNA, 21 bp, Homo sapiens
tggtgcctctgtgcacagtgg

SEQ ID NO: 1507647 - DNA, 13 bp, Homo sapiens
tggtgcctgagag

SEQ ID NO: 1507648 - DNA, 18 bp, Homo sapiens
tggtgcctggcctggcac

SEQ ID NO: 1507649 - DNA, 23 bp, Homo sapiens
tggtgccttaccaagttgtgctt

SEQ ID NO: 1507650 - DNA, 17 bp, Homo sapiens
tggtgcgaccccccacc

SEQ ID NO: 1507651 - DNA, 19 bp, Homo sapiens
tggtgcgggcacaataaat

SEQ ID NO: 1507652 - DNA, 17 bp, Homo sapiens
tggtgcgggcctggccc

SEQ ID NO: 1507653 - DNA, 15 bp, Homo sapiens
tggtgctctctgcca

SEQ ID NO: 1507654 - DNA, 15 bp, Homo sapiens
tggtgctgggactga

SEQ ID NO: 1507655 - DNA, 16 bp, Homo sapiens
tggtgctgggactgag

SEQ ID NO: 1507656 - DNA, 19 bp, Homo sapiens
tggtgctgggactgagcca

SEQ ID NO: 1507657 - DNA, 21 bp, Homo sapiens
tggtgctgggactgagccagt

SEQ ID NO: 1507658 - DNA, 21 bp, Homo sapiens
tggtgctgtgtgccccactcc

SEQ ID NO: 1507659 - DNA, 14 bp, Homo sapiens
tggtgcttccccca

SEQ ID NO: 1507660 - DNA, 22 bp, Homo sapiens
tggtggacagggcccccggcca

SEQ ID NO: 1507661 - DNA, 17 bp, Homo sapiens
tggtggacagtcctggg

SEQ ID NO: 1507662 - DNA, 15 bp, Homo sapiens
tggtggagcagccag

SEQ ID NO: 1507663 - DNA, 18 bp, Homo sapiens
tggtggagcagccagagc

SEQ ID NO: 1507664 - DNA, 13 bp, Homo sapiens
tggtggagccagg

SEQ ID NO: 1507665 - DNA, 18 bp, Homo sapiens
tggtggagccagggcctc

SEQ ID NO: 1507666 - DNA, 18 bp, Homo sapiens
tggtggcacacgcctgta

SEQ ID NO: 1507667 - DNA, 20 bp, Homo sapiens
tggtggcacacgcctgtagt

SEQ ID NO: 1507668 - DNA, 19 bp, Homo sapiens
tggtggcactgagcccccc

SEQ ID NO: 1507669 - DNA, 19 bp, Homo sapiens
tggtggcagattttacaaa

SEQ ID NO: 1507670 - DNA, 15 bp, Homo sapiens
tggtggcatggaagg

SEQ ID NO: 1507671 - DNA, 21 bp, Homo sapiens
tggtggcccgacagcctggca

SEQ ID NO: 1507672 - DNA, 16 bp, Homo sapiens
tggtggccctgtgcct

SEQ ID NO: 1507673 - DNA, 17 bp, Homo sapiens
tggtggctcatgcctgt

SEQ ID NO: 1507674 - DNA, 19 bp, Homo sapiens
tggtggctgggcccagcag

SEQ ID NO: 1507675 - DNA, 19 bp, Homo sapiens
tggtggcttaagtgagcag

SEQ ID NO: 1507676 - DNA, 16 bp, Homo sapiens
tggtggggagaggcat

SEQ ID NO: 1507677 - DNA, 21 bp, Homo sapiens
tggtggggaggggcgctggcc

SEQ ID NO: 1507678 - DNA, 22 bp, Homo sapiens
tggtggggaggggcgctggccc

SEQ ID NO: 1507679 - DNA, 16 bp, Homo sapiens
tggtggggctgtcctg

SEQ ID NO: 1507680 - DNA, 12 bp, Homo sapiens
tggtgggtaatt

SEQ ID NO: 1507681 - DNA, 17 bp, Homo sapiens
tggtgggtggtgtcctg

SEQ ID NO: 1507682 - DNA, 17 bp, Homo sapiens
tggtgggtgtggccagc

SEQ ID NO: 1507683 - DNA, 15 bp, Homo sapiens
tggtggtctgttggc

SEQ ID NO: 1507684 - DNA, 15 bp, Homo sapiens
tggtggtgaaattga

SEQ ID NO: 1507685 - DNA, 16 bp, Homo sapiens
tggtggtttttgctct

SEQ ID NO: 1507686 - DNA, 11 bp, Homo sapiens
tggtgtatttt

SEQ ID NO: 1507687 - DNA, 18 bp, Homo sapiens
tggtgtcacatggggcct

SEQ ID NO: 1507688 - DNA, 18 bp, Homo sapiens
tggtgtcagaccctggag

SEQ ID NO: 1507689 - DNA, 13 bp, Homo sapiens
tggtgtcaggcag

SEQ ID NO: 1507690 - DNA, 18 bp, Homo sapiens
tggtgtcagtatccaggc

SEQ ID NO: 1507691 - DNA, 17 bp, Homo sapiens
tggtgtccacctggccc

SEQ ID NO: 1507692 - DNA, 18 bp, Homo sapiens
tggtgtccacctggcccc

SEQ ID NO: 1507693 - DNA, 21 bp, Homo sapiens
tggtgtcctgaagctgctgga

SEQ ID NO: 1507694 - DNA, 19 bp, Homo sapiens
tggtgtcctgaccaccctc

SEQ ID NO: 1507695 - DNA, 19 bp, Homo sapiens
tggtgtctccaacccccca

SEQ ID NO: 1507696 - DNA, 20 bp, Homo sapiens
tggtgtctccaaccccccag

SEQ ID NO: 1507697 - DNA, 17 bp, Homo sapiens
tggtgtctcttctttag

SEQ ID NO: 1507698 - DNA, 23 bp, Homo sapiens
tggtgtctcttctttagaacagg

SEQ ID NO: 1507699 - DNA, 16 bp, Homo sapiens
tggtgtcttggcactg

SEQ ID NO: 1507700 - DNA, 18 bp, Homo sapiens
tggtgtgaaacaaattaa

SEQ ID NO: 1507701 - DNA, 13 bp, Homo sapiens
tggtgtgaccatg

SEQ ID NO: 1507702 - DNA, 18 bp, Homo sapiens
tggtgtgaccatgttcat

SEQ ID NO: 1507703 - DNA, 16 bp, Homo sapiens
tggtgtggcaaagcct

SEQ ID NO: 1507704 - DNA, 17 bp, Homo sapiens
tggtgtggggcgtggat

SEQ ID NO: 1507705 - DNA, 16 bp, Homo sapiens
tggtgtgggtgtcctg

SEQ ID NO: 1507706 - DNA, 23 bp, Homo sapiens
tggtgtgggtgtcctgcctgtct

SEQ ID NO: 1507707 - DNA, 15 bp, Homo sapiens
tggtgtgtccctgga

SEQ ID NO: 1507708 - DNA, 23 bp, Homo sapiens
tggtgtgtccctggacacagctc

SEQ ID NO: 1507709 - DNA, 11 bp, Homo sapiens
tggtgtgtttc

SEQ ID NO: 1507710 - DNA, 23 bp, Homo sapiens
tggtgttacacagcccaagagga

SEQ ID NO: 1507711 - DNA, 14 bp, Homo sapiens
tggtgttcctgaag

SEQ ID NO: 1507712 - DNA, 16 bp, Homo sapiens
tggtgttcctggaagc

SEQ ID NO: 1507713 - DNA, 15 bp, Homo sapiens
tggtgtttgtctgtg

SEQ ID NO: 1507714 - DNA, 13 bp, Homo sapiens
tggttaaaaacct

SEQ ID NO: 1507715 - DNA, 22 bp, Homo sapiens
tggttaaaactgtacatttaaa

SEQ ID NO: 1507716 - DNA, 17 bp, Homo sapiens
tggttaaacattaatat

SEQ ID NO: 1507717 - DNA, 14 bp, Homo sapiens
tggttaaattaaca

SEQ ID NO: 1507718 - DNA, 14 bp, Homo sapiens
tggttaagagtcca

SEQ ID NO: 1507719 - DNA, 20 bp, Homo sapiens
tggttaatttttcctgcatg

SEQ ID NO: 1507720 - DNA, 17 bp, Homo sapiens
tggttacagtgcagaca

SEQ ID NO: 1507721 - DNA, 23 bp, Homo sapiens
tggttaccactcttttgctgtgc

SEQ ID NO: 1507722 - DNA, 18 bp, Homo sapiens
tggttatacaagttcttg

SEQ ID NO: 1507723 - DNA, 15 bp, Homo sapiens
tggttatagccctgc

SEQ ID NO: 1507724 - DNA, 12 bp, Homo sapiens
tggttatgaact

SEQ ID NO: 1507725 - DNA, 21 bp, Homo sapiens
tggttattggactccaggcct

SEQ ID NO: 1507726 - DNA, 15 bp, Homo sapiens
tggttattggttttt

SEQ ID NO: 1507727 - DNA, 17 bp, Homo sapiens
tggttatttcagccccc

SEQ ID NO: 1507728 - DNA, 20 bp, Homo sapiens
tggttatttggtattaaact

SEQ ID NO: 1507729 - DNA, 13 bp, Homo sapiens
tgtaaatttgtac

SEQ ID NO: 1507730 - DNA, 20 bp, Homo sapiens
tgtaaattttgtatgaaaaa

SEQ ID NO: 1507731 - DNA, 16 bp, Homo sapiens
tgtaacactcctctgc

SEQ ID NO: 1507732 - DNA, 11 bp, Homo sapiens
tgtaacactgt

SEQ ID NO: 1507733 - DNA, 11 bp, Homo sapiens
tgtaacagctg

SEQ ID NO: 1507734 - DNA, 21 bp, Homo sapiens
tgtaacaggtctcctcttaaa

SEQ ID NO: 1507735 - DNA, 15 bp, Homo sapiens
tgtaacatcataatt

SEQ ID NO: 1507736 - DNA, 21 bp, Homo sapiens
tgtaacatcataattacattc

SEQ ID NO: 1507737 - DNA, 16 bp, Homo sapiens
tgtaaccagttataaa

SEQ ID NO: 1507738 - DNA, 18 bp, Homo sapiens
tgtaaccagttataaata

SEQ ID NO: 1507739 - DNA, 20 bp, Homo sapiens
tgtaaccgtaacccaccccc

SEQ ID NO: 1507740 - DNA, 13 bp, Homo sapiens
tgtaacctgattc

SEQ ID NO: 1507741 - DNA, 14 bp, Homo sapiens
tgtaaccttgggtg

SEQ ID NO: 1507742 - DNA, 21 bp, Homo sapiens
tgtaaccttgggtggcccctg

SEQ ID NO: 1507743 - DNA, 16 bp, Homo sapiens
tgtaactaatttgtgg

SEQ ID NO: 1507744 - DNA, 16 bp, Homo sapiens
tgtaactacaaagctt

SEQ ID NO: 1507745 - DNA, 15 bp, Homo sapiens
tgtaactatttcttc

SEQ ID NO: 1507746 - DNA, 12 bp, Homo sapiens
tgtaactccacc

SEQ ID NO: 1507747 - DNA, 21 bp, Homo sapiens
tgtaactccagatagagaaat

SEQ ID NO: 1507748 - DNA, 18 bp, Homo sapiens
tgtaactctaaaagatcc

SEQ ID NO: 1507749 - DNA, 23 bp, Homo sapiens
tgtaactgcattgagaactgcat

SEQ ID NO: 1507750 - DNA, 16 bp, Homo sapiens
tgtaactgctgagcca

SEQ ID NO: 1507751 - DNA, 17 bp, Homo sapiens
tgtaactgctgagccac

SEQ ID NO: 1507752 - DNA, 21 bp, Homo sapiens
tgtaactggtagtgttcagta

SEQ ID NO: 1507753 - DNA, 17 bp, Homo sapiens
tgtaacttatattgaag

SEQ ID NO: 1507754 - DNA, 20 bp, Homo sapiens
tgtaacttatattgaagaca

SEQ ID NO: 1507755 - DNA, 23 bp, Homo sapiens
tgtaacttatattgaagacaatt

SEQ ID NO: 1507756 - DNA, 14 bp, Homo sapiens
tgtaacttattcca

SEQ ID NO: 1507757 - DNA, 15 bp, Homo sapiens
tgtaacttcctgctg

SEQ ID NO: 1507758 - DNA, 21 bp, Homo sapiens
tgtaagaacaactacctgagc

SEQ ID NO: 1507759 - DNA, 16 bp, Homo sapiens
tgtaagaacacatttt

SEQ ID NO: 1507760 - DNA, 19 bp, Homo sapiens
tgtaagaacacattttaaa

SEQ ID NO: 1507761 - DNA, 20 bp, Homo sapiens
tgtaagaacacattttaaat

SEQ ID NO: 1507762 - DNA, 18 bp, Homo sapiens
tgtaagaactacaaacaa

SEQ ID NO: 1507763 - DNA, 19 bp, Homo sapiens
tgtaagaactacaaacaaa

SEQ ID NO: 1507764 - DNA, 16 bp, Homo sapiens
tgtaagaactgtacat

SEQ ID NO: 1507765 - DNA, 19 bp, Homo sapiens
tgtaagaactgtacattgt

SEQ ID NO: 1507766 - DNA, 20 bp, Homo sapiens
tgtaagaagctgtgaatatt

SEQ ID NO: 1507767 - DNA, 17 bp, Homo sapiens
tgtaagaaggcaatatt

SEQ ID NO: 1507768 - DNA, 18 bp, Homo sapiens
tgtaagacatttgtatat

SEQ ID NO: 1507769 - DNA, 14 bp, Homo sapiens
tgtaagagaaaata

SEQ ID NO: 1507770 - DNA, 18 bp, Homo sapiens
tgtaagagcttgctccag

SEQ ID NO: 1507771 - DNA, 19 bp, Homo sapiens
tgtaagagcttgctccaga

SEQ ID NO: 1507772 - DNA, 19 bp, Homo sapiens
tgtaagatcgttctctgcc

SEQ ID NO: 1507773 - DNA, 20 bp, Homo sapiens
tgtaagatcgttctctgcct

SEQ ID NO: 1507774 - DNA, 15 bp, Homo sapiens
tgtaagatgctgggt

SEQ ID NO: 1507775 - DNA, 22 bp, Homo sapiens
tgtaagattatagattctaaag

SEQ ID NO: 1507776 - DNA, 17 bp, Homo sapiens
tgtaagcactctggatg

SEQ ID NO: 1507777 - DNA, 20 bp, Homo sapiens
tgtaagcatactttgtaaat

SEQ ID NO: 1507778 - DNA, 18 bp, Homo sapiens
tgtaagccatcagaagtt

SEQ ID NO: 1507779 - DNA, 22 bp, Homo sapiens
tgtaagctctactgaggtgcta

SEQ ID NO: 1507780 - DNA, 18 bp, Homo sapiens
tgtaaggactgtaaacat

SEQ ID NO: 1507781 - DNA, 14 bp, Homo sapiens
tgtaaggctctaga

SEQ ID NO: 1507782 - DNA, 15 bp, Homo sapiens
tgtaaggctctagat

SEQ ID NO: 1507783 - DNA, 13 bp, Homo sapiens
tgtaagggaaact

SEQ ID NO: 1507784 - DNA, 19 bp, Homo sapiens
tgtaagggaaactgccagc

SEQ ID NO: 1507785 - DNA, 12 bp, Homo sapiens
tgtaagggcagt

SEQ ID NO: 1507786 - DNA, 15 bp, Homo sapiens
tgtaagggcagtgcc

SEQ ID NO: 1507787 - DNA, 15 bp, Homo sapiens
tgtaagtaacacagt

SEQ ID NO: 1507788 - DNA, 23 bp, Homo sapiens
tgtaagtaattgcatttctgctc

SEQ ID NO: 1507789 - DNA, 18 bp, Homo sapiens
tgtaagtgagagagacaa

SEQ ID NO: 1507790 - DNA, 14 bp, Homo sapiens
tgtaagtgggccca

SEQ ID NO: 1507791 - DNA, 15 bp, Homo sapiens
tgtaagtgtgtgtgt

SEQ ID NO: 1507792 - DNA, 16 bp, Homo sapiens
tgtaagttatttcttg

SEQ ID NO: 1507793 - DNA, 14 bp, Homo sapiens
tgtaagttcacaac

SEQ ID NO: 1507794 - DNA, 16 bp, Homo sapiens
tgtaataaaaatagtt

SEQ ID NO: 1507795 - DNA, 16 bp, Homo sapiens
tgtaataaaggtcttt

SEQ ID NO: 1507796 - DNA, 16 bp, Homo sapiens
tgtaataaagtatata

SEQ ID NO: 1507797 - DNA, 13 bp, Homo sapiens
tgtaataaattca

SEQ ID NO: 1507798 - DNA, 22 bp, Homo sapiens
tgtaataactgtgaagtttaca

SEQ ID NO: 1507799 - DNA, 22 bp, Homo sapiens
tgtaatagttcagtagaattac

SEQ ID NO: 1507800 - DNA, 23 bp, Homo sapiens
tgtaatagttcagtagaattacc

SEQ ID NO: 1507801 - DNA, 17 bp, Homo sapiens
tgtaatataaagtattc

SEQ ID NO: 1507802 - DNA, 16 bp, Homo sapiens
tgtaatatattgtaca

SEQ ID NO: 1507803 - DNA, 17 bp, Homo sapiens
tgtaatatattgtacaa

SEQ ID NO: 1507804 - DNA, 13 bp, Homo sapiens
tgtaatatgaaat

SEQ ID NO: 1507805 - DNA, 14 bp, Homo sapiens
tgtaatattgtaaa

SEQ ID NO: 1507806 - DNA, 21 bp, Homo sapiens
tgtaatattgtaaatactgga

SEQ ID NO: 1507807 - DNA, 23 bp, Homo sapiens
tgtaatcaagcctttatggctgc

SEQ ID NO: 1507808 - DNA, 12 bp, Homo sapiens
tgtaatcatttg

SEQ ID NO: 1507809 - DNA, 20 bp, Homo sapiens
tgtaatccaggggtgtagat

SEQ ID NO: 1507810 - DNA, 13 bp, Homo sapiens
tgtaatcccagaa

SEQ ID NO: 1507811 - DNA, 15 bp, Homo sapiens
tgtaatcccagcact

SEQ ID NO: 1507812 - DNA, 16 bp, Homo sapiens
tgtaatcccagctact

SEQ ID NO: 1507813 - DNA, 23 bp, Homo sapiens
tgtaatcccagctactcaggagg

SEQ ID NO: 1507814 - DNA, 17 bp, Homo sapiens
tgtaatcgtgtgccatg

SEQ ID NO: 1507815 - DNA, 22 bp, Homo sapiens
tgtaatctctctgcagctgccg

SEQ ID NO: 1507816 - DNA, 18 bp, Homo sapiens
tgtaatcttaaaagtgta

SEQ ID NO: 1507817 - DNA, 18 bp, Homo sapiens
tgtaatgaaaatgaatat

SEQ ID NO: 1507818 - DNA, 13 bp, Homo sapiens
tgtaatgatcata

SEQ ID NO: 1507819 - DNA, 14 bp, Homo sapiens
tgtaatgctgcact

SEQ ID NO: 1507820 - DNA, 23 bp, Homo sapiens
tgtaatgtcaccaccttcccagc

SEQ ID NO: 1507821 - DNA, 13 bp, Homo sapiens
tgtctttgtaata

SEQ ID NO: 1507822 - DNA, 13 bp, Homo sapiens
tgtctttgtggga

SEQ ID NO: 1507823 - DNA, 16 bp, Homo sapiens
tgtcttttaaaatgca

SEQ ID NO: 1507824 - DNA, 18 bp, Homo sapiens
tgtcttttaatgcttcat

SEQ ID NO: 1507825 - DNA, 13 bp, Homo sapiens
tgtcttttaggac

SEQ ID NO: 1507826 - DNA, 20 bp, Homo sapiens
tgtcttttcaatcttctact

SEQ ID NO: 1507827 - DNA, 13 bp, Homo sapiens
tgtcttttgaata

SEQ ID NO: 1507828 - DNA, 17 bp, Homo sapiens
tgtcttttgacatttta

SEQ ID NO: 1507829 - DNA, 23 bp, Homo sapiens
tgtctttttctggactgaagcct

SEQ ID NO: 1507830 - DNA, 16 bp, Homo sapiens
tgtcttttttttcctt

SEQ ID NO: 1507831 - DNA, 19 bp, Homo sapiens
tgtcttttttttcctttga

SEQ ID NO: 1507832 - DNA, 13 bp, Homo sapiens
tgtgaaaaaagaa

SEQ ID NO: 1507833 - DNA, 17 bp, Homo sapiens
tgtgaaaaattaacttt

SEQ ID NO: 1507834 - DNA, 23 bp, Homo sapiens
tgtgaaacaatgttgtccaacaa

SEQ ID NO: 1507835 - DNA, 17 bp, Homo sapiens
tgtgaaacacagctgtt

SEQ ID NO: 1507836 - DNA, 21 bp, Homo sapiens
tgtgaaacagttgctgtgaac

SEQ ID NO: 1507837 - DNA, 15 bp, Homo sapiens
tgtgaaacatcttct

SEQ ID NO: 1507838 - DNA, 16 bp, Homo sapiens
tgtgaaactgaaggtc

SEQ ID NO: 1507839 - DNA, 14 bp, Homo sapiens
tgtgaaatgaaaac

SEQ ID NO: 1507840 - DNA, 17 bp, Homo sapiens
tgtgaaatgctttctgt

SEQ ID NO: 1507841 - DNA, 16 bp, Homo sapiens
tgtgaaattctcagag

SEQ ID NO: 1507842 - DNA, 13 bp, Homo sapiens
tgtgaaattgcat

SEQ ID NO: 1507843 - DNA, 18 bp, Homo sapiens
tgtgaaattgcatacttt

SEQ ID NO: 1507844 - DNA, 14 bp, Homo sapiens
tgtgaaatttacat

SEQ ID NO: 1507845 - DNA, 16 bp, Homo sapiens
tgtgaaccaaccccca

SEQ ID NO: 1507846 - DNA, 18 bp, Homo sapiens
tgtgaaccctggggcctg

SEQ ID NO: 1507847 - DNA, 22 bp, Homo sapiens
tgtgaaccctggggcctgactg

SEQ ID NO: 1507848 - DNA, 23 bp, Homo sapiens
tgtgaaccctggggcctgactgc

SEQ ID NO: 1507849 - DNA, 21 bp, Homo sapiens
tgtgaacgatttagaaagaag

SEQ ID NO: 1507850 - DNA, 20 bp, Homo sapiens
tgtgaactcaatctccaggg

SEQ ID NO: 1507851 - DNA, 22 bp, Homo sapiens
tgtgaactcaccctgggagcca

SEQ ID NO: 1507852 - DNA, 20 bp, Homo sapiens
tgtgaactggaagaaagcaa

SEQ ID NO: 1507853 - DNA, 17 bp, Homo sapiens
tgtgaagacccagcagg

SEQ ID NO: 1507854 - DNA, 18 bp, Homo sapiens
tgtgaagacccagcagga

SEQ ID NO: 1507855 - DNA, 14 bp, Homo sapiens
tgtgaagagaatgt

SEQ ID NO: 1507856 - DNA, 21 bp, Homo sapiens
tgtgaagagaatgtattctgt

SEQ ID NO: 1507857 - DNA, 23 bp, Homo sapiens
tgtgaagagaatgtattctgtat

SEQ ID NO: 1507858 - DNA, 16 bp, Homo sapiens
tgtgaagaggaacagt

SEQ ID NO: 1507859 - DNA, 22 bp, Homo sapiens
tgtgaagaggtctgattggctg

SEQ ID NO: 1507860 - DNA, 15 bp, Homo sapiens
tgtgaagcatgcttt

SEQ ID NO: 1507861 - DNA, 22 bp, Homo sapiens
tgtgaagcatgctttgctgcta

SEQ ID NO: 1507862 - DNA, 20 bp, Homo sapiens
tgtgaagtaacccctcctgg

SEQ ID NO: 1507863 - DNA, 23 bp, Homo sapiens
tgtgaagtaacccctcctggctg

SEQ ID NO: 1507864 - DNA, 14 bp, Homo sapiens
tgtgaagtttacat

SEQ ID NO: 1507865 - DNA, 20 bp, Homo sapiens
tgtgaagtttacattgtaaa

SEQ ID NO: 1507866 - DNA, 14 bp, Homo sapiens
tgtgaataattaca

SEQ ID NO: 1507867 - DNA, 12 bp, Homo sapiens
tgtgaatacatt

SEQ ID NO: 1507868 - DNA, 21 bp, Homo sapiens
tgtgaatacctgctcacgtca

SEQ ID NO: 1507869 - DNA, 18 bp, Homo sapiens
tgtgaatcgcaaggcctg

SEQ ID NO: 1507870 - DNA, 19 bp, Homo sapiens
tgtgaatcgcaaggcctgt

SEQ ID NO: 1507871 - DNA, 22 bp, Homo sapiens
tgtgaatcgcaaggcctgtgct

SEQ ID NO: 1507872 - DNA, 16 bp, Homo sapiens
tgtgaatcttgaataa

SEQ ID NO: 1507873 - DNA, 19 bp, Homo sapiens
tgtgaattaggctgtaact

SEQ ID NO: 1507874 - DNA, 20 bp, Homo sapiens
tgtgaattattgacactgaa

SEQ ID NO: 1507875 - DNA, 19 bp, Homo sapiens
tgtgaattgaaatgttcgt

SEQ ID NO: 1507876 - DNA, 22 bp, Homo sapiens
tgtgaattttctaaaagctttc

SEQ ID NO: 1507877 - DNA, 16 bp, Homo sapiens
tgtgaatttttaagct

SEQ ID NO: 1507878 - DNA, 20 bp, Homo sapiens
tgtgaatttttattgttgta

SEQ ID NO: 1507879 - DNA, 19 bp, Homo sapiens
tgtgacaaaggatgaagaa

SEQ ID NO: 1507880 - DNA, 20 bp, Homo sapiens
tgtgacaaaggatgaagaac

SEQ ID NO: 1507881 - DNA, 19 bp, Homo sapiens
tgtgacaattttgtacaaa

SEQ ID NO: 1507882 - DNA, 20 bp, Homo sapiens
tgtgacacatcgttttgggg

SEQ ID NO: 1507883 - DNA, 16 bp, Homo sapiens
tgtgacacctaactct

SEQ ID NO: 1507884 - DNA, 20 bp, Homo sapiens
tgtgacacctaactcttttc

SEQ ID NO: 1507885 - DNA, 15 bp, Homo sapiens
tgtgacacctggtgc

SEQ ID NO: 1507886 - DNA, 21 bp, Homo sapiens
tgtgacacctggtgcgggcct

SEQ ID NO: 1507887 - DNA, 13 bp, Homo sapiens
tgtgacactgatg

SEQ ID NO: 1507888 - DNA, 20 bp, Homo sapiens
tgtgacagaatcttgtattt

SEQ ID NO: 1507889 - DNA, 22 bp, Homo sapiens
tgtgacagtgaaatacatcctt

SEQ ID NO: 1507890 - DNA, 14 bp, Homo sapiens
tgtaatttcaaaat

SEQ ID NO: 1507891 - DNA, 17 bp, Homo sapiens
tgtaatttcaaaataca

SEQ ID NO: 1507892 - DNA, 15 bp, Homo sapiens
tgtaatttcgcctta

SEQ ID NO: 1507893 - DNA, 23 bp, Homo sapiens
tgtaattttaaaagtctatttta

SEQ ID NO: 1507894 - DNA, 23 bp, Homo sapiens
tgtaattttatttgttctttttc

SEQ ID NO: 1507895 - DNA, 20 bp, Homo sapiens
tgtaattttattttaaaatt

SEQ ID NO: 1507896 - DNA, 18 bp, Homo sapiens
tgtaatttttcaaaatcg

SEQ ID NO: 1507897 - DNA, 18 bp, Homo sapiens
tgtacaaaactgtaaata

SEQ ID NO: 1507898 - DNA, 20 bp, Homo sapiens
tgtacaaaactgtaaataaa

SEQ ID NO: 1507899 - DNA, 21 bp, Homo sapiens
tgtacaaaatcgattggcttt

SEQ ID NO: 1507900 - DNA, 24 bp, Homo sapiens
tgtacaaaattaagcaaatgttaa

SEQ ID NO: 1507901 - DNA, 15 bp, Homo sapiens
tgtacaaacagtatt

SEQ ID NO: 1507902 - DNA, 19 bp, Homo sapiens
tgtacaaaccaagagcttt

SEQ ID NO: 1507903 - DNA, 21 bp, Homo sapiens
tgtacaaaccaagagctttta

SEQ ID NO: 1507904 - DNA, 23 bp, Homo sapiens
tgtacaaagtagaagtcttagat

SEQ ID NO: 1507905 - DNA, 13 bp, Homo sapiens
tgtacaaataaac

SEQ ID NO: 1507906 - DNA, 18 bp, Homo sapiens
tgtacaaataaacctgag

SEQ ID NO: 1507907 - DNA, 15 bp, Homo sapiens
tgtacaacttaagtt

SEQ ID NO: 1507908 - DNA, 18 bp, Homo sapiens
tgtacaaggtaattgttt

SEQ ID NO: 1507909 - DNA, 19 bp, Homo sapiens
tgtacaatacaatgtacaa

SEQ ID NO: 1507910 - DNA, 19 bp, Homo sapiens
tgtacaattactaaattgt

SEQ ID NO: 1507911 - DNA, 22 bp, Homo sapiens
tgtacaattactaaattgtata

SEQ ID NO: 1507912 - DNA, 18 bp, Homo sapiens
tgtacaattttaaagttc

SEQ ID NO: 1507913 - DNA, 17 bp, Homo sapiens
tgtacacatatttgaag

SEQ ID NO: 1507914 - DNA, 20 bp, Homo sapiens
tgtacacattcctgcattca

SEQ ID NO: 1507915 - DNA, 21 bp, Homo sapiens
tgtacacctgcggggccaccc

SEQ ID NO: 1507916 - DNA, 13 bp, Homo sapiens
tgtacacgggact

SEQ ID NO: 1507917 - DNA, 15 bp, Homo sapiens
tgtacacgggactga

SEQ ID NO: 1507918 - DNA, 15 bp, Homo sapiens
tgtacactgaatatt

SEQ ID NO: 1507919 - DNA, 19 bp, Homo sapiens
tgtacactgaatatttata

SEQ ID NO: 1507920 - DNA, 22 bp, Homo sapiens
tgtacactggatatgttgttaa

SEQ ID NO: 1507921 - DNA, 15 bp, Homo sapiens
tgtacagaagagcaa

SEQ ID NO: 1507922 - DNA, 19 bp, Homo sapiens
tgtacagagtgcttttctg

SEQ ID NO: 1507923 - DNA, 15 bp, Homo sapiens
tgtacagatcaagaa

SEQ ID NO: 1507924 - DNA, 17 bp, Homo sapiens
tgtacaggactgtaaag

SEQ ID NO: 1507925 - DNA, 20 bp, Homo sapiens
tgtacaggtcacccatcagg

SEQ ID NO: 1507926 - DNA, 22 bp, Homo sapiens
tgtacaggtcacccatcaggac

SEQ ID NO: 1507927 - DNA, 17 bp, Homo sapiens
tgtacagtagattttcc

SEQ ID NO: 1507928 - DNA, 18 bp, Homo sapiens
tgtacagtagattttcca

SEQ ID NO: 1507929 - DNA, 20 bp, Homo sapiens
tgtacagtagattttccaaa

SEQ ID NO: 1507930 - DNA, 16 bp, Homo sapiens
tgtacataaaagaatt

SEQ ID NO: 1507931 - DNA, 19 bp, Homo sapiens
tgtacatacgatttaaggt

SEQ ID NO: 1507932 - DNA, 18 bp, Homo sapiens
tgtacatatatgtataat

SEQ ID NO: 1507933 - DNA, 23 bp, Homo sapiens
tgtacatattactgttgcattta

SEQ ID NO: 1507934 - DNA, 22 bp, Homo sapiens
tgtacatgaagaagctaaatcc

SEQ ID NO: 1507935 - DNA, 13 bp, Homo sapiens
tgtacatgtacat

SEQ ID NO: 1507936 - DNA, 14 bp, Homo sapiens
tgtacatgtacata

SEQ ID NO: 1507937 - DNA, 16 bp, Homo sapiens
tgtacatgtatgaaat

SEQ ID NO: 1507938 - DNA, 13 bp, Homo sapiens
tgtacatgtatta

SEQ ID NO: 1507939 - DNA, 20 bp, Homo sapiens
tgtacatgtattaaattaca

SEQ ID NO: 1507940 - DNA, 11 bp, Homo sapiens
tgtacatgtgt

SEQ ID NO: 1507941 - DNA, 22 bp, Homo sapiens
tgtacatgtgtagggaaagtta

SEQ ID NO: 1507942 - DNA, 15 bp, Homo sapiens
tgtacattctgccta

SEQ ID NO: 1507943 - DNA, 21 bp, Homo sapiens
tgtacattctgcctagagtgt

SEQ ID NO: 1507944 - DNA, 15 bp, Homo sapiens
tgtacatttaaaatt

SEQ ID NO: 1507945 - DNA, 20 bp, Homo sapiens
tgtacatttaaaattgctat

SEQ ID NO: 1507946 - DNA, 18 bp, Homo sapiens
tgtacatttccaaattca

SEQ ID NO: 1507947 - DNA, 21 bp, Homo sapiens
tgtacatttccaaattcacaa

SEQ ID NO: 1507948 - DNA, 15 bp, Homo sapiens
tgtacatttctaagt

SEQ ID NO: 1507949 - DNA, 16 bp, Homo sapiens
tgtacatttctataaa

SEQ ID NO: 1507950 - DNA, 17 bp, Homo sapiens
tgtacatttctataaat

SEQ ID NO: 1507951 - DNA, 16 bp, Homo sapiens
tgtacatttgggagtt

SEQ ID NO: 1507952 - DNA, 19 bp, Homo sapiens
tgtacatttttaaattctt

SEQ ID NO: 1507953 - DNA, 17 bp, Homo sapiens
tgtaccaaaattttaaa

SEQ ID NO: 1507954 - DNA, 14 bp, Homo sapiens
tgtaccactactta

SEQ ID NO: 1507955 - DNA, 18 bp, Homo sapiens
tgtaccacttcctgaggc

SEQ ID NO: 1507956 - DNA, 20 bp, Homo sapiens
tgtaccacttcctgaggcct

SEQ ID NO: 1507957 - DNA, 18 bp, Homo sapiens
tgtaccatagaaaaatgt

SEQ ID NO: 1507958 - DNA, 19 bp, Homo sapiens
tgtaccatagaaaaatgta

SEQ ID NO: 1507959 - DNA, 15 bp, Homo sapiens
tgtaccatcaataaa

SEQ ID NO: 1507960 - DNA, 21 bp, Homo sapiens
tgtaccatgaaacaaagctgc

SEQ ID NO: 1507961 - DNA, 16 bp, Homo sapiens
tgtaccatgaatattt

SEQ ID NO: 1507962 - DNA, 17 bp, Homo sapiens
tgtaccatggtttgata

SEQ ID NO: 1507963 - DNA, 17 bp, Homo sapiens
tgtaccatgtacatgaa

SEQ ID NO: 1507964 - DNA, 13 bp, Homo sapiens
tgtacccagctcc

SEQ ID NO: 1507965 - DNA, 23 bp, Homo sapiens
tgtaccctttaagatatccatct

SEQ ID NO: 1507966 - DNA, 20 bp, Homo sapiens
tgtaccgatgcagctctctt

SEQ ID NO: 1507967 - DNA, 19 bp, Homo sapiens
tgtacctatggctgcctgc

SEQ ID NO: 1507968 - DNA, 14 bp, Homo sapiens
tgtacctctagaat

SEQ ID NO: 1507969 - DNA, 18 bp, Homo sapiens
tgtacctctagaatccca

SEQ ID NO: 1507970 - DNA, 17 bp, Homo sapiens
tgtacctgttccttaga

SEQ ID NO: 1507971 - DNA, 18 bp, Homo sapiens
tgtaccttctttcactct

SEQ ID NO: 1507972 - DNA, 22 bp, Homo sapiens
tgtacgaagagtatttttgaca

SEQ ID NO: 1507973 - DNA, 14 bp, Homo sapiens
tgtacgtccagcct

SEQ ID NO: 1507974 - DNA, 16 bp, Homo sapiens
tgtactaactagcatt

SEQ ID NO: 1507975 - DNA, 16 bp, Homo sapiens
tgtactaatctgagat

SEQ ID NO: 1507976 - DNA, 12 bp, Homo sapiens
tgtactacagct

SEQ ID NO: 1507977 - DNA, 15 bp, Homo sapiens
tgtgcacagtggctt

SEQ ID NO: 1507978 - DNA, 21 bp, Homo sapiens
tgtgcacatccgcgtgtgcct

SEQ ID NO: 1507979 - DNA, 22 bp, Homo sapiens
tgtgcacatccgcgtgtgcctg

SEQ ID NO: 1507980 - DNA, 22 bp, Homo sapiens
tgtgcacctaccccttggaaat

SEQ ID NO: 1507981 - DNA, 23 bp, Homo sapiens
tgtgcacctaccccttggaaatg

SEQ ID NO: 1507982 - DNA, 13 bp, Homo sapiens
tgtgcagaatctc

SEQ ID NO: 1507983 - DNA, 13 bp, Homo sapiens
tgtgcagcagccc

SEQ ID NO: 1507984 - DNA, 15 bp, Homo sapiens
tgtgcagcagcccag

SEQ ID NO: 1507985 - DNA, 15 bp, Homo sapiens
tgtgcagggatattg

SEQ ID NO: 1507986 - DNA, 20 bp, Homo sapiens
tgtgcagggatattgcctta

SEQ ID NO: 1507987 - DNA, 15 bp, Homo sapiens
tgtgcaggtgctgcc

SEQ ID NO: 1507988 - DNA, 18 bp, Homo sapiens
tgtgcaggtgctgccttg

SEQ ID NO: 1507989 - DNA, 18 bp, Homo sapiens
tgtgcagtcactggaggt

SEQ ID NO: 1507990 - DNA, 19 bp, Homo sapiens
tgtgcagttctagtttgca

SEQ ID NO: 1507991 - DNA, 19 bp, Homo sapiens
tgtgcatagcgtcctgccc

SEQ ID NO: 1507992 - DNA, 20 bp, Homo sapiens
tgtgcatatctgcctcccct

SEQ ID NO: 1507993 - DNA, 15 bp, Homo sapiens
tgtgcatctggtgta

SEQ ID NO: 1507994 - DNA, 14 bp, Homo sapiens
tgtgcatgtgagca

SEQ ID NO: 1507995 - DNA, 17 bp, Homo sapiens
tgtgcatgtgtgtgtct

SEQ ID NO: 1507996 - DNA, 19 bp, Homo sapiens
tgtgcatgtgtgtgtctgt

SEQ ID NO: 1507997 - DNA, 20 bp, Homo sapiens
tgtgcatttcacctgtgaca

SEQ ID NO: 1507998 - DNA, 20 bp, Homo sapiens
tgtgccaagattctactctt

SEQ ID NO: 1507999 - DNA, 16 bp, Homo sapiens
tgtgccacccaccagg

SEQ ID NO: 1508000 - DNA, 21 bp, Homo sapiens
tgtgccagaggaaggaaaagg

SEQ ID NO: 1508001 - DNA, 20 bp, Homo sapiens
tgtgccagaggaatcctggc

SEQ ID NO: 1508002 - DNA, 21 bp, Homo sapiens
tgtgccagaggaatcctggca

SEQ ID NO: 1508003 - DNA, 13 bp, Homo sapiens
tgtgccagcacct

SEQ ID NO: 1508004 - DNA, 15 bp, Homo sapiens
tgtgccagttcctgt

SEQ ID NO: 1508005 - DNA, 15 bp, Homo sapiens
tgtggactgtgatgc

SEQ ID NO: 1508006 - DNA, 15 bp, Homo sapiens
tgtggacttaggaag

SEQ ID NO: 1508007 - DNA, 16 bp, Homo sapiens
tgtggacttggcaggt

SEQ ID NO: 1508008 - DNA, 19 bp, Homo sapiens
tgtggagaagccacaggcc

SEQ ID NO: 1508009 - DNA, 19 bp, Homo sapiens
tgtggagaggggtgcaccc

SEQ ID NO: 1508010 - DNA, 21 bp, Homo sapiens
tgtggagaggggtgcacccac

SEQ ID NO: 1508011 - DNA, 23 bp, Homo sapiens
tgtggagaggggtgcacccactc

SEQ ID NO: 1508012 - DNA, 16 bp, Homo sapiens
tgtggagccgaggcct

SEQ ID NO: 1508013 - DNA, 19 bp, Homo sapiens
tgtggagctactgatgaaa

SEQ ID NO: 1508014 - DNA, 15 bp, Homo sapiens
tgtggagctgccaca

SEQ ID NO: 1508015 - DNA, 15 bp, Homo sapiens
tgtggaggaagagcc

SEQ ID NO: 1508016 - DNA, 16 bp, Homo sapiens
tgtggaggaagagcca

SEQ ID NO: 1508017 - DNA, 17 bp, Homo sapiens
tgtggaggaagagccac

SEQ ID NO: 1508018 - DNA, 19 bp, Homo sapiens
tgtggaggaagagccacct

SEQ ID NO: 1508019 - DNA, 17 bp, Homo sapiens
tgtggagtccagctcta

SEQ ID NO: 1508020 - DNA, 14 bp, Homo sapiens
tgtggagttcctgc

SEQ ID NO: 1508021 - DNA, 15 bp, Homo sapiens
tgtggagttcctgct

SEQ ID NO: 1508022 - DNA, 18 bp, Homo sapiens
tgtggagttcctgctccg

SEQ ID NO: 1508023 - DNA, 22 bp, Homo sapiens
tgtggatatcagttaccaaaca

SEQ ID NO: 1508024 - DNA, 19 bp, Homo sapiens
tgtggatgctccagggcag

SEQ ID NO: 1508025 - DNA, 14 bp, Homo sapiens
tgtgtgtgtgtgta

SEQ ID NO: 1508026 - DNA, 12 bp, Homo sapiens
tgtgtgttcacc

SEQ ID NO: 1508027 - DNA, 18 bp, Homo sapiens
tgtgtgttgcttatgttg

SEQ ID NO: 1508028 - DNA, 10 bp, Homo sapiens
tgtgtgtttg

SEQ ID NO: 1508029 - DNA, 19 bp, Homo sapiens
tgtgtgttttcccaaagca

SEQ ID NO: 1508030 - DNA, 23 bp, Homo sapiens
tgtgttaaaaggaaaaataacaa

SEQ ID NO: 1508031 - DNA, 16 bp, Homo sapiens
tgtgttaaacatgcta

SEQ ID NO: 1508032 - DNA, 19 bp, Homo sapiens
tgtgttaccctcctgtaaa

SEQ ID NO: 1508033 - DNA, 14 bp, Homo sapiens
tgtgttactgcttt

SEQ ID NO: 1508034 - DNA, 22 bp, Homo sapiens
tgtgttatagacggtgctcact

SEQ ID NO: 1508035 - DNA, 13 bp, Homo sapiens
tgtgttatttaaa

SEQ ID NO: 1508036 - DNA, 16 bp, Homo sapiens
tgtgttatttaaatga

SEQ ID NO: 1508037 - DNA, 21 bp, Homo sapiens
tgtgttcaccttcaaaatgtt

SEQ ID NO: 1508038 - DNA, 22 bp, Homo sapiens
tgtgttcaccttcaaaatgttc

SEQ ID NO: 1508039 - DNA, 14 bp, Homo sapiens
tgtgttcagttttg

SEQ ID NO: 1508040 - DNA, 14 bp, Homo sapiens
tgtgttcattcaag

SEQ ID NO: 1508041 - DNA, 12 bp, Homo sapiens
tgtgttcctggc

SEQ ID NO: 1508042 - DNA, 18 bp, Homo sapiens
tgtgttctcggagtgtgt

SEQ ID NO: 1508043 - DNA, 14 bp, Homo sapiens
tgtgttcttttctc

SEQ ID NO: 1508044 - DNA, 22 bp, Homo sapiens
tgtgttcttttctcctttacca

SEQ ID NO: 1508045 - DNA, 18 bp, Homo sapiens
tgtgttgatttctttcct

SEQ ID NO: 1508046 - DNA, 18 bp, Homo sapiens
tgtgttgcaaattattct

SEQ ID NO: 1508047 - DNA, 21 bp, Homo sapiens
tgtgttgcaaattattctagt

SEQ ID NO: 1508048 - DNA, 20 bp, Homo sapiens
tgtgttgtgtttgtagtctt

SEQ ID NO: 1508049 - DNA, 14 bp, Homo sapiens
tgtgtttataaaat

SEQ ID NO: 1508050 - DNA, 22 bp, Homo sapiens
tgtgtttattcaaactgaaaag

SEQ ID NO: 1508051 - DNA, 22 bp, Homo sapiens
tgtgtttcaaaaccatgcctgg

SEQ ID NO: 1508052 - DNA, 22 bp, Homo sapiens
tgtgtttcgcattaagcacaca

SEQ ID NO: 1508053 - DNA, 10 bp, Homo sapiens
tgtgtttcta

SEQ ID NO: 1508054 - DNA, 13 bp, Homo sapiens
tgtgtttctggag

SEQ ID NO: 1508055 - DNA, 15 bp, Homo sapiens
tgtgtttctgtataa

SEQ ID NO: 1508056 - DNA, 20 bp, Homo sapiens
tgtgtttggatcaaaaagaa

SEQ ID NO: 1508057 - DNA, 19 bp, Homo sapiens
tgtgttttcccaaagcact

SEQ ID NO: 1508058 - DNA, 16 bp, Homo sapiens
tgtgttttcttgtaaa

SEQ ID NO: 1508059 - DNA, 20 bp, Homo sapiens
tgtgttttcttgtaaatgtt

SEQ ID NO: 1508060 - DNA, 16 bp, Homo sapiens
tgtgttttgaaagaat

SEQ ID NO: 1508061 - DNA, 23 bp, Homo sapiens
tgtgttttgcacgtcttgctatt

SEQ ID NO: 1508062 - DNA, 16 bp, Homo sapiens
tgtgttttggttaata

SEQ ID NO: 1508063 - DNA, 18 bp, Homo sapiens
tgtgttttgtctgagcct

SEQ ID NO: 1508064 - DNA, 19 bp, Homo sapiens
tgttaaaaaatttttgaaa

SEQ ID NO: 1508065 - DNA, 14 bp, Homo sapiens
tgttaaaataacta

SEQ ID NO: 1508066 - DNA, 23 bp, Homo sapiens
tgttaaaatgcatgattgcagaa

SEQ ID NO: 1508067 - DNA, 20 bp, Homo sapiens
tgttaaaatggggataataa

SEQ ID NO: 1508068 - DNA, 15 bp, Homo sapiens
tgttaaaatgtacac

SEQ ID NO: 1508069 - DNA, 23 bp, Homo sapiens
tgttaaaattatcaatatctaat

SEQ ID NO: 1508070 - DNA, 15 bp, Homo sapiens
tgttaaacaaatgat

SEQ ID NO: 1508071 - DNA, 18 bp, Homo sapiens
tgttaaagatttcaaata

SEQ ID NO: 1508072 - DNA, 20 bp, Homo sapiens
tgttaacattccaagactct

SEQ ID NO: 1508073 - DNA, 16 bp, Homo sapiens
tgttaaccagaataaa

SEQ ID NO: 1508074 - DNA, 18 bp, Homo sapiens
tgttaacccattccagta

SEQ ID NO: 1508075 - DNA, 17 bp, Homo sapiens
tgttaacctcagtgtca

SEQ ID NO: 1508076 - DNA, 21 bp, Homo sapiens
tgttaacgtgatgtgccacta

SEQ ID NO: 1508077 - DNA, 19 bp, Homo sapiens
tgttaactcttgtctattt

SEQ ID NO: 1508078 - DNA, 15 bp, Homo sapiens
tgttaagataactta

SEQ ID NO: 1508079 - DNA, 19 bp, Homo sapiens
tgttaagataacttactgt

SEQ ID NO: 1508080 - DNA, 21 bp, Homo sapiens
tgttaagataacttactgtat

SEQ ID NO: 1508081 - DNA, 20 bp, Homo sapiens
tgttaagggaagaattccag

SEQ ID NO: 1508082 - DNA, 17 bp, Homo sapiens
tgttaagggaccaggga

SEQ ID NO: 1508083 - DNA, 13 bp, Homo sapiens
tgttaatacacag

SEQ ID NO: 1508084 - DNA, 21 bp, Homo sapiens
tgttaatactggatagcatga

SEQ ID NO: 1508085 - DNA, 23 bp, Homo sapiens
tgttaatcttaggggagagcttt

SEQ ID NO: 1508086 - DNA, 15 bp, Homo sapiens
tgttaatgaacagtg

SEQ ID NO: 1508087 - DNA, 22 bp, Homo sapiens
tgttaatggctaacctgttaca

SEQ ID NO: 1508088 - DNA, 18 bp, Homo sapiens
tgttaattataggagcct

SEQ ID NO: 1508089 - DNA, 15 bp, Homo sapiens
tgttaattcagcact

SEQ ID NO: 1508090 - DNA, 22 bp, Homo sapiens
tgttaattcagcactgatttca

SEQ ID NO: 1508091 - DNA, 19 bp, Homo sapiens
tgttaattgtaattgcatg

SEQ ID NO: 1508092 - DNA, 17 bp, Homo sapiens
tgttacaatagaattta

SEQ ID NO: 1508093 - DNA, 20 bp, Homo sapiens
tgttacacagcccaagagga

SEQ ID NO: 1508094 - DNA, 21 bp, Homo sapiens
tgttacactaatttgaataaa

SEQ ID NO: 1508095 - DNA, 14 bp, Homo sapiens
tgttacactgggct

SEQ ID NO: 1508096 - DNA, 19 bp, Homo sapiens
tgttacataaggatgactt

SEQ ID NO: 1508097 - DNA, 22 bp, Homo sapiens
tgttacatgtaatatatttcag

SEQ ID NO: 1508098 - DNA, 15 bp, Homo sapiens
tgttacattattatc

SEQ ID NO: 1508099 - DNA, 19 bp, Homo sapiens
tgttaccaaaaataaatat

SEQ ID NO: 1508100 - DNA, 13 bp, Homo sapiens
tgttacccagggc

SEQ ID NO: 1508101 - DNA, 19 bp, Homo sapiens
tgttacctgtcattttgca

SEQ ID NO: 1508102 - DNA, 23 bp, Homo sapiens
tgttacctgtcattttgcactgt

SEQ ID NO: 1508103 - DNA, 13 bp, Homo sapiens
tgttaccttttat

SEQ ID NO: 1508104 - DNA, 16 bp, Homo sapiens
tgttacgtagcctaag

SEQ ID NO: 1508105 - DNA, 17 bp, Homo sapiens
tgttactaaagaaaata

SEQ ID NO: 1508106 - DNA, 17 bp, Homo sapiens
tgttactaaattttcta

SEQ ID NO: 1508107 - DNA, 20 bp, Homo sapiens
tgttactcagtgttagagaa

SEQ ID NO: 1508108 - DNA, 14 bp, Homo sapiens
tgttactccacagc

SEQ ID NO: 1508109 - DNA, 19 bp, Homo sapiens
tgttactccattactgtga

SEQ ID NO: 1508110 - DNA, 15 bp, Homo sapiens
tgttactctgtccca

SEQ ID NO: 1508111 - DNA, 22 bp, Homo sapiens
tgttactgctgattcttgtaaa

SEQ ID NO: 1508112 - DNA, 18 bp, Homo sapiens
tgttactgctttgcaaag

SEQ ID NO: 1508113 - DNA, 17 bp, Homo sapiens
tgttactgtccaccctc

SEQ ID NO: 1508114 - DNA, 17 bp, Homo sapiens
tgttactgttgcactga

SEQ ID NO: 1508115 - DNA, 18 bp, Homo sapiens
tgttacttacctaaacag

SEQ ID NO: 1508116 - DNA, 14 bp, Homo sapiens
tgttacttgcaggt

SEQ ID NO: 1508117 - DNA, 19 bp, Homo sapiens
tgttactttggcaatttcc

SEQ ID NO: 1508118 - DNA, 18 bp, Homo sapiens
tgttagaaaatgacttat

SEQ ID NO: 1508119 - DNA, 20 bp, Homo sapiens
tgttagaaaatgacttattt

SEQ ID NO: 1508120 - DNA, 23 bp, Homo sapiens
tgttagaaaatgacttatttctg

SEQ ID NO: 1508121 - DNA, 15 bp, Homo sapiens
tgttagaatcaaata

SEQ ID NO: 1508122 - DNA, 13 bp, Homo sapiens
tgttagaatgtaa

SEQ ID NO: 1508123 - DNA, 21 bp, Homo sapiens
tgttagaggttttaaagtgat

SEQ ID NO: 1508124 - DNA, 15 bp, Homo sapiens
tgttagcaaagatta

SEQ ID NO: 1508125 - DNA, 20 bp, Homo sapiens
tgttagcagacccagcttag

SEQ ID NO: 1508126 - DNA, 22 bp, Homo sapiens
tgttagctccctgtggggcagg

SEQ ID NO: 1508127 - DNA, 21 bp, Homo sapiens
tgttaggaggctgcatgctct

SEQ ID NO: 1508128 - DNA, 18 bp, Homo sapiens
tgttaggcatgtcccacc

SEQ ID NO: 1508129 - DNA, 18 bp, Homo sapiens
tgttaggcttttctgcct

SEQ ID NO: 1508130 - DNA, 16 bp, Homo sapiens
tgttagggctgctttt

SEQ ID NO: 1508131 - DNA, 21 bp, Homo sapiens
tgttagggtcagccattttta

SEQ ID NO: 1508132 - DNA, 23 bp, Homo sapiens
tgttagtaaataaaattaacaaa

SEQ ID NO: 1508133 - DNA, 18 bp, Homo sapiens
tgttagtgacagagccca

SEQ ID NO: 1508134 - DNA, 21 bp, Homo sapiens
tgttagtgctggtcagagaga

SEQ ID NO: 1508135 - DNA, 17 bp, Homo sapiens
tgttagtgtgtgtgcat

SEQ ID NO: 1508136 - DNA, 20 bp, Homo sapiens
tgttagtgtgtgtgcatgtg

SEQ ID NO: 1508137 - DNA, 21 bp, Homo sapiens
tgttagtgtgtgtgcatgtgt

SEQ ID NO: 1508138 - DNA, 23 bp, Homo sapiens
tgttagttaccttatagttactg

SEQ ID NO: 1508139 - DNA, 12 bp, Homo sapiens
tgttagttccca

SEQ ID NO: 1508140 - DNA, 13 bp, Homo sapiens
tgttagttcccaa

SEQ ID NO: 1508141 - DNA, 14 bp, Homo sapiens
tgttagttcccaac

SEQ ID NO: 1508142 - DNA, 15 bp, Homo sapiens
tgttagttcccaaca

SEQ ID NO: 1508143 - DNA, 18 bp, Homo sapiens
tgtttctcaaaagaggtt

SEQ ID NO: 1508144 - DNA, 15 bp, Homo sapiens
tgtttctccccctgg

SEQ ID NO: 1508145 - DNA, 17 bp, Homo sapiens
tgtttctccccctgggc

SEQ ID NO: 1508146 - DNA, 13 bp, Homo sapiens
tgtttctctgaaa

SEQ ID NO: 1508147 - DNA, 14 bp, Homo sapiens
tgtttctctttcct

SEQ ID NO: 1508148 - DNA, 14 bp, Homo sapiens
tgtttctggacatt

SEQ ID NO: 1508149 - DNA, 18 bp, Homo sapiens
tgtttctggacattctct

SEQ ID NO: 1508150 - DNA, 24 bp, Homo sapiens
tgtttctggacattctctttgata

SEQ ID NO: 1508151 - DNA, 23 bp, Homo sapiens
tgtttctggacccttataaaatc

SEQ ID NO: 1508152 - DNA, 17 bp, Homo sapiens
tgtttctggatttcata

SEQ ID NO: 1508153 - DNA, 21 bp, Homo sapiens
tgtttctgtgaaattctcaga

SEQ ID NO: 1508154 - DNA, 19 bp, Homo sapiens
tgtttctgttgttcccgtg

SEQ ID NO: 1508155 - DNA, 16 bp, Homo sapiens
tgtttcttaaatggaa

SEQ ID NO: 1508156 - DNA, 18 bp, Homo sapiens
tgtttcttccaaagcaca

SEQ ID NO: 1508157 - DNA, 17 bp, Homo sapiens
tgtttctttcttcctct

SEQ ID NO: 1508158 - DNA, 15 bp, Homo sapiens
tgtttctttgatcat

SEQ ID NO: 1508159 - DNA, 15 bp, Homo sapiens
tgtttcttttgtttg

SEQ ID NO: 1508160 - DNA, 17 bp, Homo sapiens
tgtttgaaaattagaga

SEQ ID NO: 1508161 - DNA, 16 bp, Homo sapiens
tgtttgaaatatcatg

SEQ ID NO: 1508162 - DNA, 22 bp, Homo sapiens
tgtttgaattcctcctctattt

SEQ ID NO: 1508163 - DNA, 22 bp, Homo sapiens
tgtttgacaaagttactgattc

SEQ ID NO: 1508164 - DNA, 21 bp, Homo sapiens
tgtttgaccttcagagccagc

SEQ ID NO: 1508165 - DNA, 14 bp, Homo sapiens
tgtttgagctcaga

SEQ ID NO: 1508166 - DNA, 12 bp, Homo sapiens
tgtttgattggc

SEQ ID NO: 1508167 - DNA, 14 bp, Homo sapiens
tgtttgattggctt

SEQ ID NO: 1508168 - DNA, 13 bp, Homo sapiens
tgtttgatttcaa

SEQ ID NO: 1508169 - DNA, 13 bp, Homo sapiens
tgtttgcactgtg

SEQ ID NO: 1508170 - DNA, 16 bp, Homo sapiens
tgtttgcactgtgtgc

SEQ ID NO: 1508171 - DNA, 18 bp, Homo sapiens
tgtttgcactgtgtgctg

SEQ ID NO: 1508172 - DNA, 22 bp, Homo sapiens
tgtttgcatgtgaaaatcaaat

SEQ ID NO: 1508173 - DNA, 13 bp, Homo sapiens
tgtttgccaggac

SEQ ID NO: 1508174 - DNA, 18 bp, Homo sapiens
tgtttgccaggacatgca

SEQ ID NO: 1508175 - DNA, 10 bp, Homo sapiens
tgtttgcctc

SEQ ID NO: 1508176 - DNA, 19 bp, Homo sapiens
tgtttgcgtacttgtaata

SEQ ID NO: 1508177 - DNA, 20 bp, Homo sapiens
tgtttgctatgactacattt

SEQ ID NO: 1508178 - DNA, 19 bp, Homo sapiens
tgtttgctcaaaattgctt

SEQ ID NO: 1508179 - DNA, 22 bp, Homo sapiens
tgtttgctcaaaattgcttcta

SEQ ID NO: 1508180 - DNA, 24 bp, Homo sapiens
tgtttgctctcccggttcttccag

SEQ ID NO: 1508181 - DNA, 18 bp, Homo sapiens
tgtttgcttcataaatga

SEQ ID NO: 1508182 - DNA, 16 bp, Homo sapiens
tgtttgcttcttgcca

SEQ ID NO: 1508183 - DNA, 23 bp, Homo sapiens
tgtttgcttcttgccatcactgg

SEQ ID NO: 1508184 - DNA, 17 bp, Homo sapiens
tgtttggaaaccacagt

SEQ ID NO: 1508185 - DNA, 15 bp, Homo sapiens
tgtttggcaaggaaa

SEQ ID NO: 1508186 - DNA, 16 bp, Homo sapiens
tgtttggcaaggaaag

SEQ ID NO: 1508187 - DNA, 17 bp, Homo sapiens
tgtttggcaatgcactg

SEQ ID NO: 1508188 - DNA, 17 bp, Homo sapiens
tgtttggcacttgtatt

SEQ ID NO: 1508189 - DNA, 18 bp, Homo sapiens
tgtttggcacttgtattt

SEQ ID NO: 1508190 - DNA, 22 bp, Homo sapiens
tgtttggcgtagcagagttaaa

SEQ ID NO: 1508191 - DNA, 23 bp, Homo sapiens
tgtttggggatcgatgtgctcag

SEQ ID NO: 1508192 - DNA, 15 bp, Homo sapiens
tgtttgggtatcctg

SEQ ID NO: 1508193 - DNA, 18 bp, Homo sapiens
tgtttgggtttttttcct

SEQ ID NO: 1508194 - DNA, 15 bp, Homo sapiens
tgtttggtaaatgtt

SEQ ID NO: 1508195 - DNA, 18 bp, Homo sapiens
tgtttggttgtaaatgct

SEQ ID NO: 1508196 - DNA, 14 bp, Homo sapiens
tgtttgtaaaacca

SEQ ID NO: 1508197 - DNA, 18 bp, Homo sapiens
tgtttgtaaataagagat

SEQ ID NO: 1508198 - DNA, 19 bp, Homo sapiens
tgtttgtaaataagagatt

SEQ ID NO: 1508199 - DNA, 15 bp, Homo sapiens
tgtttgtaaatgcct

SEQ ID NO: 1508200 - DNA, 20 bp, Homo sapiens
tgtttgtacacaacaatcct

SEQ ID NO: 1508201 - DNA, 13 bp, Homo sapiens
tgtttgtatgaaa

SEQ ID NO: 1508202 - DNA, 11 bp, Homo sapiens
tgtttgtattc

SEQ ID NO: 1508203 - DNA, 21 bp, Homo sapiens
tgtttgtattttttatttaca

SEQ ID NO: 1508204 - DNA, 22 bp, Homo sapiens
tgtttgtattttttatttacat

SEQ ID NO: 1508205 - DNA, 23 bp, Homo sapiens
tgtttgtattttttatttacatt

SEQ ID NO: 1508206 - DNA, 15 bp, Homo sapiens
tgtttgtcagcatct

SEQ ID NO: 1508207 - DNA, 19 bp, Homo sapiens
tgtttgtcagcatctgacc

SEQ ID NO: 1508208 - DNA, 21 bp, Homo sapiens
tgtttgtcagcatctgaccat

SEQ ID NO: 1508209 - DNA, 16 bp, Homo sapiens
tgtttgtctgaacaaa

SEQ ID NO: 1508210 - DNA, 17 bp, Homo sapiens
tgtttgtctgtcttcat

SEQ ID NO: 1508211 - DNA, 19 bp, Homo sapiens
tgtttgtcttttaatgctt

SEQ ID NO: 1508212 - DNA, 16 bp, Homo sapiens
tgtttgtgagaagctt

SEQ ID NO: 1508213 - DNA, 18 bp, Homo sapiens
tgtttgtgctctgttcca

SEQ ID NO: 1508214 - DNA, 12 bp, Homo sapiens
tgtttgtggcct

SEQ ID NO: 1508215 - DNA, 13 bp, Homo sapiens
tgtttgtggcctc

SEQ ID NO: 1508216 - DNA, 19 bp, Homo sapiens
tgtttgttatttacactgg

SEQ ID NO: 1508217 - DNA, 12 bp, Homo sapiens
tgtttgtttatt

SEQ ID NO: 1508218 - DNA, 19 bp, Homo sapiens
tgtttgtttcaagaacctg

SEQ ID NO: 1508219 - DNA, 17 bp, Homo sapiens
tgtttgtttcctttgtt

SEQ ID NO: 1508220 - DNA, 20 bp, Homo sapiens
tgttttaaacatagaaagtt

SEQ ID NO: 1508221 - DNA, 12 bp, Homo sapiens
tgttttaaagaa

SEQ ID NO: 1508222 - DNA, 20 bp, Homo sapiens
tgttttaataaaagatttac

SEQ ID NO: 1508223 - DNA, 17 bp, Homo sapiens
tgttttaataaacagta

SEQ ID NO: 1508224 - DNA, 13 bp, Homo sapiens
tgttttaattgta

SEQ ID NO: 1508225 - DNA, 17 bp, Homo sapiens
tgttttacattccattt

SEQ ID NO: 1508226 - DNA, 16 bp, Homo sapiens
tgttttaccagctccc

SEQ ID NO: 1508227 - DNA, 15 bp, Homo sapiens
tgttttactgtgaaa

SEQ ID NO: 1508228 - DNA, 17 bp, Homo sapiens
tgttttagtgtaaaatt

SEQ ID NO: 1508229 - DNA, 14 bp, Homo sapiens
tgttttagtttctg

SEQ ID NO: 1508230 - DNA, 13 bp, Homo sapiens
tgttttataaaat

SEQ ID NO: 1508231 - DNA, 14 bp, Homo sapiens
tgttttcaagatgg

SEQ ID NO: 1508232 - DNA, 14 bp, Homo sapiens
tgttttcacttgta

SEQ ID NO: 1508233 - DNA, 17 bp, Homo sapiens
tgttttcacttgtattg

SEQ ID NO: 1508234 - DNA, 15 bp, Homo sapiens
tgttttcagactcag

SEQ ID NO: 1508235 - DNA, 17 bp, Homo sapiens
tgttttcagtgtacatg

SEQ ID NO: 1508236 - DNA, 15 bp, Homo sapiens
tgttttcattaaatt

SEQ ID NO: 1508237 - DNA, 20 bp, Homo sapiens
tgttttcccaagtgtaatta

SEQ ID NO: 1508238 - DNA, 16 bp, Homo sapiens
tgttttccctgacctc

SEQ ID NO: 1508239 - DNA, 16 bp, Homo sapiens
tgttttccgtgaaaac

SEQ ID NO: 1508240 - DNA, 14 bp, Homo sapiens
tgttttctcagaac

SEQ ID NO: 1508241 - DNA, 17 bp, Homo sapiens
tgttttctgaaacacac

SEQ ID NO: 1508242 - DNA, 17 bp, Homo sapiens
tgttttctgactaatta

SEQ ID NO: 1508243 - DNA, 14 bp, Homo sapiens
tgttttctgtaaat

SEQ ID NO: 1508244 - DNA, 21 bp, Homo sapiens
tgttttcttgtaaatgtttct

SEQ ID NO: 1508245 - DNA, 14 bp, Homo sapiens
tgttttctttgagg

SEQ ID NO: 1508246 - DNA, 22 bp, Homo sapiens
tgttttgaaatcaatgcaagag

SEQ ID NO: 1508247 - DNA, 19 bp, Homo sapiens
tgttttgaatggtgttgta

SEQ ID NO: 1508248 - DNA, 20 bp, Homo sapiens
tgttttgatgtttgtggcct

SEQ ID NO: 1508249 - DNA, 18 bp, Homo sapiens
tgttttgcacagccaaat

SEQ ID NO: 1508250 - DNA, 20 bp, Homo sapiens
tgttttgcacgtcttgctat

SEQ ID NO: 1508251 - DNA, 12 bp, Homo sapiens
tgttttgcactt

SEQ ID NO: 1508252 - DNA, 20 bp, Homo sapiens
tgttttgcacttctgtaaac

SEQ ID NO: 1508253 - DNA, 17 bp, Homo sapiens
tgttttggaataaagag

SEQ ID NO: 1508254 - DNA, 23 bp, Homo sapiens
tgttttgggcctccatgccccag

SEQ ID NO: 1508255 - DNA, 19 bp, Homo sapiens
tgttttggggctttcccag

SEQ ID NO: 1508256 - DNA, 15 bp, Homo sapiens
tgttttgtacaatta

SEQ ID NO: 1508257 - DNA, 22 bp, Homo sapiens
tgttttgtacaattactaaatt

SEQ ID NO: 1508258 - DNA, 17 bp, Homo sapiens
tgttttgtgaattttct

SEQ ID NO: 1508259 - DNA, 15 bp, Homo sapiens
tgttttgtgttgtgt

SEQ ID NO: 1508260 - DNA, 12 bp, Homo sapiens
tgttttgttaat

SEQ ID NO: 1508261 - DNA, 19 bp, Homo sapiens
tgtttttaacatgtcaatc

SEQ ID NO: 1508262 - DNA, 20 bp, Homo sapiens
tgtttttaagaaaaacatgt

SEQ ID NO: 1508263 - DNA, 12 bp, Homo sapiens
tgtttttaagat

SEQ ID NO: 1508264 - DNA, 21 bp, Homo sapiens
tgtttttagagcttccaaatg

SEQ ID NO: 1508265 - DNA, 22 bp, Homo sapiens
tgtttttagagcttccaaatgt

SEQ ID NO: 1508266 - DNA, 23 bp, Homo sapiens
tgtttttctatagaaaaagtaaa

SEQ ID NO: 1508267 - DNA, 13 bp, Homo sapiens
tgtttttgaaata

SEQ ID NO: 1508268 - DNA, 16 bp, Homo sapiens
tgtttttgcacatgtt

SEQ ID NO: 1508269 - DNA, 16 bp, Homo sapiens
tgtttttgcatgaaat

SEQ ID NO: 1508270 - DNA, 20 bp, Homo sapiens
tgtttttgcttgttatatta

SEQ ID NO: 1508271 - DNA, 16 bp, Homo sapiens
tgtttttgtaaagaaa

SEQ ID NO: 1508272 - DNA, 17 bp, Homo sapiens
tgtttttgtaaagaaaa

SEQ ID NO: 1508273 - DNA, 11 bp, Homo sapiens
tgtttttgtag

SEQ ID NO: 1508274 - DNA, 19 bp, Homo sapiens
tgtttttgtatttttaatg

SEQ ID NO: 1508275 - DNA, 12 bp, Homo sapiens
tgtttttgtgaa

SEQ ID NO: 1508276 - DNA, 13 bp, Homo sapiens
tgtttttgttctt

SEQ ID NO: 1508277 - DNA, 14 bp, Homo sapiens
tgtttttgttgtgt

SEQ ID NO: 1508278 - DNA, 15 bp, Homo sapiens
tgtttttgttgtgtg

SEQ ID NO: 1508279 - DNA, 15 bp, Homo sapiens
tgttttttaaagcaa

SEQ ID NO: 1508280 - DNA, 14 bp, Homo sapiens
tgttttttaagata

SEQ ID NO: 1508281 - DNA, 20 bp, Homo sapiens
tgttttttaagatagtgtaa

SEQ ID NO: 1508282 - DNA, 16 bp, Homo sapiens
tgttttttcctttata

SEQ ID NO: 1508283 - DNA, 23 bp, Homo sapiens
tgttttttcggacatgcttttct

SEQ ID NO: 1508284 - DNA, 14 bp, Homo sapiens
tgttttttctgtaa

SEQ ID NO: 1508285 - DNA, 16 bp, Homo sapiens
tgttttttgaaaacat

SEQ ID NO: 1508286 - DNA, 15 bp, Homo sapiens
tgttttttgccacag

SEQ ID NO: 1508287 - DNA, 23 bp, Homo sapiens
ttaaaaaaaaaagcctgtattta

SEQ ID NO: 1508288 - DNA, 12 bp, Homo sapiens
ttaaaaaaaaga

SEQ ID NO: 1508289 - DNA, 17 bp, Homo sapiens
ttaaaaaaacaaattgg

SEQ ID NO: 1508290 - DNA, 11 bp, Homo sapiens
ttaaaaaaact

SEQ ID NO: 1508291 - DNA, 18 bp, Homo sapiens
ttaaaaaaactggatatt

SEQ ID NO: 1508292 - DNA, 15 bp, Homo sapiens
ttaaaaaaataaaat

SEQ ID NO: 1508293 - DNA, 14 bp, Homo sapiens
ttaaaaaaataaca

SEQ ID NO: 1508294 - DNA, 15 bp, Homo sapiens
ttaaaaaaataacat

SEQ ID NO: 1508295 - DNA, 14 bp, Homo sapiens
ttaaaaaaatgaca

SEQ ID NO: 1508296 - DNA, 17 bp, Homo sapiens
ttaaaaaacaaatgttc

SEQ ID NO: 1508297 - DNA, 11 bp, Homo sapiens
ttaaaaaacag

SEQ ID NO: 1508298 - DNA, 12 bp, Homo sapiens
ttaaaaaacagc

SEQ ID NO: 1508299 - DNA, 14 bp, Homo sapiens
ttaaaaaactcttt

SEQ ID NO: 1508300 - DNA, 15 bp, Homo sapiens
ttaaaaaactctttg

SEQ ID NO: 1508301 - DNA, 13 bp, Homo sapiens
ttaaaaaacttca

SEQ ID NO: 1508302 - DNA, 20 bp, Homo sapiens
ttaaaaaacttcatgtaatt

SEQ ID NO: 1508303 - DNA, 18 bp, Homo sapiens
ttaaaaaagcaaggcaca

SEQ ID NO: 1508304 - DNA, 11 bp, Homo sapiens
ttaaaaaataa

SEQ ID NO: 1508305 - DNA, 14 bp, Homo sapiens
ttaaaaaataaata

SEQ ID NO: 1508306 - DNA, 16 bp, Homo sapiens
ttaaaaaatattttct

SEQ ID NO: 1508307 - DNA, 16 bp, Homo sapiens
ttaaaaaatcttaatg

SEQ ID NO: 1508308 - DNA, 16 bp, Homo sapiens
ttaaaaaatgtatatt

SEQ ID NO: 1508309 - DNA, 18 bp, Homo sapiens
ttaaaaaatgttttctgg

SEQ ID NO: 1508310 - DNA, 13 bp, Homo sapiens
ttaaaaaattctt

SEQ ID NO: 1508311 - DNA, 16 bp, Homo sapiens
ttaaaaacctgtatct

SEQ ID NO: 1508312 - DNA, 13 bp, Homo sapiens
ttaaaaactggaa

SEQ ID NO: 1508313 - DNA, 16 bp, Homo sapiens
ttaaaaagcagtcctc

SEQ ID NO: 1508314 - DNA, 16 bp, Homo sapiens
ttaaaaaggaattttg

SEQ ID NO: 1508315 - DNA, 17 bp, Homo sapiens
ttaaaaagtatgttcta

SEQ ID NO: 1508316 - DNA, 13 bp, Homo sapiens
ttaaaaataaaat

SEQ ID NO: 1508317 - DNA, 15 bp, Homo sapiens
ttaaaaataagtcaa

SEQ ID NO: 1508318 - DNA, 22 bp, Homo sapiens
ttaaaaataagtcaacagtaaa

SEQ ID NO: 1508319 - DNA, 13 bp, Homo sapiens
ttaaaaatatttc

SEQ ID NO: 1508320 - DNA, 21 bp, Homo sapiens
ttaaaaatggctcaagtagaa

SEQ ID NO: 1508321 - DNA, 13 bp, Homo sapiens
ttaaaaatgtttg

SEQ ID NO: 1508322 - DNA, 18 bp, Homo sapiens
ttaaaaattacttttaaa

SEQ ID NO: 1508323 - DNA, 16 bp, Homo sapiens
ttaaaaattgtttctt

SEQ ID NO: 1508324 - DNA, 22 bp, Homo sapiens
ttaaaacaaaagggtgtatagt

SEQ ID NO: 1508325 - DNA, 14 bp, Homo sapiens
ttaaaacaaccagt

SEQ ID NO: 1508326 - DNA, 21 bp, Homo sapiens
ttaaaacagctgcattagaaa

SEQ ID NO: 1508327 - DNA, 17 bp, Homo sapiens
ttaaaacaggcaaagtt

SEQ ID NO: 1508328 - DNA, 18 bp, Homo sapiens
ttaaaacatggtgcctat

SEQ ID NO: 1508329 - DNA, 12 bp, Homo sapiens
ttaaaacatttt

SEQ ID NO: 1508330 - DNA, 14 bp, Homo sapiens
ttaaaaccaaagag

SEQ ID NO: 1508331 - DNA, 15 bp, Homo sapiens
ttaaaaccacagctg

SEQ ID NO: 1508332 - DNA, 16 bp, Homo sapiens
ttaaaactaaatttca

SEQ ID NO: 1508333 - DNA, 21 bp, Homo sapiens
ttaaaactcagaatataacat

SEQ ID NO: 1508334 - DNA, 13 bp, Homo sapiens
ttaaaactgcttt

SEQ ID NO: 1508335 - DNA, 15 bp, Homo sapiens
ttaaaactgttattt

SEQ ID NO: 1508336 - DNA, 14 bp, Homo sapiens
ttaaaagacatttt

SEQ ID NO: 1508337 - DNA, 23 bp, Homo sapiens
ttaaaagacatttttatttagtt

SEQ ID NO: 1508338 - DNA, 14 bp, Homo sapiens
ttaaaagcaaatca

SEQ ID NO: 1508339 - DNA, 18 bp, Homo sapiens
ttaaaagcaaatcatttg

SEQ ID NO: 1508340 - DNA, 20 bp, Homo sapiens
ttaaaaggatgtataaattt

SEQ ID NO: 1508341 - DNA, 20 bp, Homo sapiens
ttaaaaggatttttatcttt

SEQ ID NO: 1508342 - DNA, 12 bp, Homo sapiens
ttaaaagtactt

SEQ ID NO: 1508343 - DNA, 21 bp, Homo sapiens
ttaaaagtactttaaaaagga

SEQ ID NO: 1508344 - DNA, 15 bp, Homo sapiens
ttaaaagtctatttt

SEQ ID NO: 1508345 - DNA, 17 bp, Homo sapiens
ttaaaagtctattttat

SEQ ID NO: 1508346 - DNA, 12 bp, Homo sapiens
ttaaaataatat

SEQ ID NO: 1508347 - DNA, 19 bp, Homo sapiens
ttaaaatacacactcaaat

SEQ ID NO: 1508348 - DNA, 15 bp, Homo sapiens
ttaaaataccactgt

SEQ ID NO: 1508349 - DNA, 22 bp, Homo sapiens
ttaaaatagcaacactctatat

SEQ ID NO: 1508350 - DNA, 19 bp, Homo sapiens
ttaaaatatctctaaaata

SEQ ID NO: 1508351 - DNA, 22 bp, Homo sapiens
ttaaaatcatttctgcatcagc

SEQ ID NO: 1508352 - DNA, 14 bp, Homo sapiens
ttaaaatctacaga

SEQ ID NO: 1508353 - DNA, 11 bp, Homo sapiens
ttaaaatctta

SEQ ID NO: 1508354 - DNA, 14 bp, Homo sapiens
ttaaaatcttaaac

SEQ ID NO: 1508355 - DNA, 19 bp, Homo sapiens
ttaaaatgcaggtgaactt

SEQ ID NO: 1508356 - DNA, 21 bp, Homo sapiens
ttaaaatgcaggtgaactttt

SEQ ID NO: 1508357 - DNA, 21 bp, Homo sapiens
ttaaaatgcatgattgcagaa

SEQ ID NO: 1508358 - DNA, 11 bp, Homo sapiens
ttaaaatgtaa

SEQ ID NO: 1508359 - DNA, 24 bp, Homo sapiens
ttaaaatgtaagattatagattct

SEQ ID NO: 1508360 - DNA, 13 bp, Homo sapiens
ttaaaatgtacac

SEQ ID NO: 1508361 - DNA, 14 bp, Homo sapiens
ttaaaatgtacatg

SEQ ID NO: 1508362 - DNA, 20 bp, Homo sapiens
ttaaaatgtgtatttttcaa

SEQ ID NO: 1508363 - DNA, 22 bp, Homo sapiens
ttaaaatgtttactgtaaattt

SEQ ID NO: 1508364 - DNA, 19 bp, Homo sapiens
ttaaaattatatagctgct

SEQ ID NO: 1508365 - DNA, 20 bp, Homo sapiens
ttaaaattcaagaaaataaa

SEQ ID NO: 1508366 - DNA, 14 bp, Homo sapiens
ttaaaattctgatg

SEQ ID NO: 1508367 - DNA, 13 bp, Homo sapiens
ttaaaatttcata

SEQ ID NO: 1508368 - DNA, 13 bp, Homo sapiens
ttaaaatttcgtt

SEQ ID NO: 1508369 - DNA, 12 bp, Homo sapiens
ttaaaatttgtt

SEQ ID NO: 1508370 - DNA, 19 bp, Homo sapiens
ttaaaatttgttcttgtat

SEQ ID NO: 1508371 - DNA, 20 bp, Homo sapiens
ttaaaattttgtatgttaaa

SEQ ID NO: 1508372 - DNA, 14 bp, Homo sapiens
ttaaacaaagtttc

SEQ ID NO: 1508373 - DNA, 13 bp, Homo sapiens
ttaaacaaatgat

SEQ ID NO: 1508374 - DNA, 16 bp, Homo sapiens
ttaaacaatgtataaa

SEQ ID NO: 1508375 - DNA, 16 bp, Homo sapiens
ttaaacacaggctgtc

SEQ ID NO: 1508376 - DNA, 14 bp, Homo sapiens
ttaaacacattgtc

SEQ ID NO: 1508377 - DNA, 16 bp, Homo sapiens
ttaaacacgtgtctat

SEQ ID NO: 1508378 - DNA, 14 bp, Homo sapiens
ttaaacactacaca

SEQ ID NO: 1508379 - DNA, 20 bp, Homo sapiens
ttaaacagcagcacttttta

SEQ ID NO: 1508380 - DNA, 21 bp, Homo sapiens
ttaaacatgaaactgaataag

SEQ ID NO: 1508381 - DNA, 22 bp, Homo sapiens
ttaaacatgctaaatagttcta

SEQ ID NO: 1508382 - DNA, 19 bp, Homo sapiens
ttaaacattaatagcagcc

SEQ ID NO: 1508383 - DNA, 23 bp, Homo sapiens
ttaaacattaatagcagcctttc

SEQ ID NO: 1508384 - DNA, 22 bp, Homo sapiens
ttaaacattaatatttaccaaa

SEQ ID NO: 1508385 - DNA, 19 bp, Homo sapiens
ttaaacatttgttcctgga

SEQ ID NO: 1508386 - DNA, 14 bp, Homo sapiens
ttaaaccacttaaa

SEQ ID NO: 1508387 - DNA, 13 bp, Homo sapiens
ttaaaccattttt

SEQ ID NO: 1508388 - DNA, 21 bp, Homo sapiens
ttaaaccatttttgctgaatt

SEQ ID NO: 1508389 - DNA, 23 bp, Homo sapiens
ttaaaccatttttgctgaattca

SEQ ID NO: 1508390 - DNA, 18 bp, Homo sapiens
ttaaacctctcttctacc

SEQ ID NO: 1508391 - DNA, 22 bp, Homo sapiens
ttaaacctgtttttttttcatt

SEQ ID NO: 1508392 - DNA, 14 bp, Homo sapiens
ttaaacgtgcagac

SEQ ID NO: 1508393 - DNA, 22 bp, Homo sapiens
ttaaactaaaaaaaaaaaggcc

SEQ ID NO: 1508394 - DNA, 14 bp, Homo sapiens
ttaaactatcttgt

SEQ ID NO: 1508395 - DNA, 16 bp, Homo sapiens
ttaaactatgttccta

SEQ ID NO: 1508396 - DNA, 18 bp, Homo sapiens
ttaaactatgttcctaac

SEQ ID NO: 1508397 - DNA, 21 bp, Homo sapiens
ttaaactatgttcctaacaaa

SEQ ID NO: 1508398 - DNA, 20 bp, Homo sapiens
ttaaactattagagtatttc

SEQ ID NO: 1508399 - DNA, 22 bp, Homo sapiens
ttaaactctgttgcaagtgcaa

SEQ ID NO: 1508400 - DNA, 22 bp, Homo sapiens
ttaaactggtattttatctttg

SEQ ID NO: 1508401 - DNA, 20 bp, Homo sapiens
ttaaactgtgtggactgtga

SEQ ID NO: 1508402 - DNA, 14 bp, Homo sapiens
ttaaacttgaaata

SEQ ID NO: 1508403 - DNA, 17 bp, Homo sapiens
ttaaacttgcatcactt

SEQ ID NO: 1508404 - DNA, 22 bp, Homo sapiens
ttaaacttggaagggggagaca

SEQ ID NO: 1508405 - DNA, 16 bp, Homo sapiens
ttaaacttgtcagaat

SEQ ID NO: 1508406 - DNA, 17 bp, Homo sapiens
ttaaacttttaattcat

SEQ ID NO: 1508407 - DNA, 17 bp, Homo sapiens
ttaaagaaaggaaaaga

SEQ ID NO: 1508408 - DNA, 17 bp, Homo sapiens
ttaaagaaagtgtattt

SEQ ID NO: 1508409 - DNA, 17 bp, Homo sapiens
ttaaagaagctctccag

SEQ ID NO: 1508410 - DNA, 12 bp, Homo sapiens
ttaaagacagag

SEQ ID NO: 1508411 - DNA, 20 bp, Homo sapiens
ttaaagaccctcctattcta

SEQ ID NO: 1508412 - DNA, 16 bp, Homo sapiens
ttaaagactacctggg

SEQ ID NO: 1508413 - DNA, 23 bp, Homo sapiens
ttaaagagcatggaaaaatactg

SEQ ID NO: 1508414 - DNA, 12 bp, Homo sapiens
ttaaagagtcta

SEQ ID NO: 1508415 - DNA, 16 bp, Homo sapiens
ttaaagagtctagatt

SEQ ID NO: 1508416 - DNA, 17 bp, Homo sapiens
ttaaagagtctagattc

SEQ ID NO: 1508417 - DNA, 18 bp, Homo sapiens
ttaaagagtctagattca

SEQ ID NO: 1508418 - DNA, 23 bp, Homo sapiens
ttaaagagtctagattcaaaggt

SEQ ID NO: 1508419 - DNA, 18 bp, Homo sapiens
ttaaagatcatgacatat

SEQ ID NO: 1508420 - DNA, 23 bp, Homo sapiens
ttaaagatgctatggaacataaa

SEQ ID NO: 1508421 - DNA, 13 bp, Homo sapiens
ttaaagatgttcc

SEQ ID NO: 1508422 - DNA, 22 bp, Homo sapiens
ttaaagattattgtgacttcac

SEQ ID NO: 1508423 - DNA, 15 bp, Homo sapiens
ttaaagcatttccta

SEQ ID NO: 1508424 - DNA, 11 bp, Homo sapiens
ttaaagccttc

SEQ ID NO: 1508425 - DNA, 14 bp, Homo sapiens
ttaaagctaaattt

SEQ ID NO: 1508426 - DNA, 19 bp, Homo sapiens
ttaaagctggaacatttga

SEQ ID NO: 1508427 - DNA, 21 bp, Homo sapiens
ttaaagcttatttttctgtga

SEQ ID NO: 1508428 - DNA, 23 bp, Homo sapiens
ttaaagcttccctctcagctgct

SEQ ID NO: 1508429 - DNA, 13 bp, Homo sapiens
ttaaagggaagaa

SEQ ID NO: 1508430 - DNA, 16 bp, Homo sapiens
ttaaagggaagaaaac

SEQ ID NO: 1508431 - DNA, 21 bp, Homo sapiens
ttaaaggggcagaaaaactct

SEQ ID NO: 1508432 - DNA, 16 bp, Homo sapiens
ttaaagtaaaggcctc

SEQ ID NO: 1508433 - DNA, 17 bp, Homo sapiens
ttaaagtaaaggcctca

SEQ ID NO: 1508434 - DNA, 15 bp, Homo sapiens
ttaaagtacctgtag

SEQ ID NO: 1508435 - DNA, 22 bp, Homo sapiens
ttaaagtacctgtagtgagaaa

SEQ ID NO: 1508436 - DNA, 18 bp, Homo sapiens
ttaaagtatgaatctatg

SEQ ID NO: 1508437 - DNA, 19 bp, Homo sapiens
ttaaagtgctaaggttcta

SEQ ID NO: 1508438 - DNA, 20 bp, Homo sapiens
ttaaagttagtatcttttga

SEQ ID NO: 1508439 - DNA, 23 bp, Homo sapiens
ttaaagttagtatcttttgatat

SEQ ID NO: 1508440 - DNA, 15 bp, Homo sapiens
ttaaagttctgtaaa

SEQ ID NO: 1508441 - DNA, 15 bp, Homo sapiens
ttaaagttcttattt

SEQ ID NO: 1508442 - DNA, 19 bp, Homo sapiens
ttaaagttttgtcagaaaa

SEQ ID NO: 1508443 - DNA, 11 bp, Homo sapiens
ttaaataaaag

SEQ ID NO: 1508444 - DNA, 16 bp, Homo sapiens
ttaaataaaagcacaa

SEQ ID NO: 1508445 - DNA, 14 bp, Homo sapiens
ttaaataaaattta

SEQ ID NO: 1508446 - DNA, 17 bp, Homo sapiens
ttaaataaaatttaatt

SEQ ID NO: 1508447 - DNA, 13 bp, Homo sapiens
ttaaataaagtta

SEQ ID NO: 1508448 - DNA, 13 bp, Homo sapiens
ttaaataaatcat

SEQ ID NO: 1508449 - DNA, 16 bp, Homo sapiens
ttaaataaatttgact

SEQ ID NO: 1508450 - DNA, 17 bp, Homo sapiens
ttaaataaatttgactt

SEQ ID NO: 1508451 - DNA, 13 bp, Homo sapiens
ttaaataagattc

SEQ ID NO: 1508452 - DNA, 14 bp, Homo sapiens
ttaaataagattct

SEQ ID NO: 1508453 - DNA, 16 bp, Homo sapiens
ttaaataagattctaa

SEQ ID NO: 1508454 - DNA, 17 bp, Homo sapiens
ttaaataataaagtatg

SEQ ID NO: 1508455 - DNA, 19 bp, Homo sapiens
ttaaatacagacactaagt

SEQ ID NO: 1508456 - DNA, 18 bp, Homo sapiens
ttaaatacagataattca

SEQ ID NO: 1508457 - DNA, 19 bp, Homo sapiens
ttaaatacagataattcat

SEQ ID NO: 1508458 - DNA, 17 bp, Homo sapiens
ttaaatacaggaaacag

SEQ ID NO: 1508459 - DNA, 19 bp, Homo sapiens
ttaaatacccatcttcatt

SEQ ID NO: 1508460 - DNA, 18 bp, Homo sapiens
ttaaataggatattaaca

SEQ ID NO: 1508461 - DNA, 13 bp, Homo sapiens
ttaaatataaata

SEQ ID NO: 1508462 - DNA, 19 bp, Homo sapiens
ttaaatataaatgtttgtc

SEQ ID NO: 1508463 - DNA, 15 bp, Homo sapiens
ttaaatataatatgc

SEQ ID NO: 1508464 - DNA, 14 bp, Homo sapiens
ttaaatataattct

SEQ ID NO: 1508465 - DNA, 17 bp, Homo sapiens
ttaaatataattctgta

SEQ ID NO: 1508466 - DNA, 19 bp, Homo sapiens
ttaaatatagatgtaattt

SEQ ID NO: 1508467 - DNA, 19 bp, Homo sapiens
ttaaatatccatttatctt

SEQ ID NO: 1508468 - DNA, 14 bp, Homo sapiens
ttaaatatgaatga

SEQ ID NO: 1508469 - DNA, 15 bp, Homo sapiens
ttaaatatttgaaga

SEQ ID NO: 1508470 - DNA, 13 bp, Homo sapiens
ttaaatcaaggaa

SEQ ID NO: 1508471 - DNA, 18 bp, Homo sapiens
ttaaatcctttgcttcat

SEQ ID NO: 1508472 - DNA, 20 bp, Homo sapiens
ttaaatctaaatctatttat

SEQ ID NO: 1508473 - DNA, 16 bp, Homo sapiens
ttaaatctatgaagta

SEQ ID NO: 1508474 - DNA, 15 bp, Homo sapiens
ttaaatctgtgatga

SEQ ID NO: 1508475 - DNA, 22 bp, Homo sapiens
ttaaatcttaaacaatgtataa

SEQ ID NO: 1508476 - DNA, 19 bp, Homo sapiens
ttaaatcttgaccaacaga

SEQ ID NO: 1508477 - DNA, 12 bp, Homo sapiens
ttaaatgaaaga

SEQ ID NO: 1508478 - DNA, 11 bp, Homo sapiens
ttaaatgattg

SEQ ID NO: 1508479 - DNA, 20 bp, Homo sapiens
ttaaatgcaagtgcctagat

SEQ ID NO: 1508480 - DNA, 16 bp, Homo sapiens
ttaaatgcatcaatat

SEQ ID NO: 1508481 - DNA, 16 bp, Homo sapiens
ttaaatgccttgtata

SEQ ID NO: 1508482 - DNA, 16 bp, Homo sapiens
ttaaatgcttcatttg

SEQ ID NO: 1508483 - DNA, 20 bp, Homo sapiens
ttaaatggaaaaaatgatgt

SEQ ID NO: 1508484 - DNA, 13 bp, Homo sapiens
ttaaatgtaaaga

SEQ ID NO: 1508485 - DNA, 18 bp, Homo sapiens
ttaaatgtagacagatat

SEQ ID NO: 1508486 - DNA, 11 bp, Homo sapiens
ttaaatgtgaa

SEQ ID NO: 1508487 - DNA, 13 bp, Homo sapiens
ttaaatgttatgt

SEQ ID NO: 1508488 - DNA, 14 bp, Homo sapiens
ttaaatgttatgta

SEQ ID NO: 1508489 - DNA, 16 bp, Homo sapiens
ttaaatgttttcctgc

SEQ ID NO: 1508490 - DNA, 12 bp, Homo sapiens
ttaaattacaat

SEQ ID NO: 1508491 - DNA, 17 bp, Homo sapiens
ttaaattacaattttat

SEQ ID NO: 1508492 - DNA, 17 bp, Homo sapiens
ttaaattacatttgtaa

SEQ ID NO: 1508493 - DNA, 21 bp, Homo sapiens
ttaaattataacttaaaatat

SEQ ID NO: 1508494 - DNA, 22 bp, Homo sapiens
ttaaattcatttctagactcaa

SEQ ID NO: 1508495 - DNA, 16 bp, Homo sapiens
ttaaattcttactctg

SEQ ID NO: 1508496 - DNA, 16 bp, Homo sapiens
ttaaattgcttttgtt

SEQ ID NO: 1508497 - DNA, 21 bp, Homo sapiens
ttaaattgggcttcaatcact

SEQ ID NO: 1508498 - DNA, 23 bp, Homo sapiens
ttaaattgggcttcaatcactgt

SEQ ID NO: 1508499 - DNA, 14 bp, Homo sapiens
ttaaatttcaaatg

SEQ ID NO: 1508500 - DNA, 18 bp, Homo sapiens
ttaaatttcttatgtgac

SEQ ID NO: 1508501 - DNA, 14 bp, Homo sapiens
ttaaatttgttctt

SEQ ID NO: 1508502 - DNA, 21 bp, Homo sapiens
aggtctccaagggagggtgca

SEQ ID NO: 1508503 - DNA, 17 bp, Homo sapiens
aggtctccaggggcctg

SEQ ID NO: 1508504 - DNA, 21 bp, Homo sapiens
aggtctccagttggctttact

SEQ ID NO: 1508505 - DNA, 13 bp, Homo sapiens
aggtctcctctta

SEQ ID NO: 1508506 - DNA, 14 bp, Homo sapiens
aggtctcctcttaa

SEQ ID NO: 1508507 - DNA, 17 bp, Homo sapiens
aggtctcctcttaaaaa

SEQ ID NO: 1508508 - DNA, 20 bp, Homo sapiens
aggtctccttactctgagcc

SEQ ID NO: 1508509 - DNA, 21 bp, Homo sapiens
aggtctccttactctgagccc

SEQ ID NO: 1508510 - DNA, 20 bp, Homo sapiens
aggtctctccactgctctca

SEQ ID NO: 1508511 - DNA, 22 bp, Homo sapiens
aggtctgagccctggtgtgttt

SEQ ID NO: 1508512 - DNA, 23 bp, Homo sapiens
aggtctgagccctggtgtgtttc

SEQ ID NO: 1508513 - DNA, 18 bp, Homo sapiens
aggtctgattggctgctt

SEQ ID NO: 1508514 - DNA, 18 bp, Homo sapiens
aggtctgcaagggcccag

SEQ ID NO: 1508515 - DNA, 19 bp, Homo sapiens
aggtctgcaagggcccaga

SEQ ID NO: 1508516 - DNA, 22 bp, Homo sapiens
aggtctgcaagggcccagagtg

SEQ ID NO: 1508517 - DNA, 12 bp, Homo sapiens
aggtctggctga

SEQ ID NO: 1508518 - DNA, 15 bp, Homo sapiens
aggtctggctgagcc

SEQ ID NO: 1508519 - DNA, 23 bp, Homo sapiens
aggtctggctgagcccctgggga

SEQ ID NO: 1508520 - DNA, 14 bp, Homo sapiens
aggtctgtttgctg

SEQ ID NO: 1508521 - DNA, 15 bp, Homo sapiens
aggtctgtttgctgt

SEQ ID NO: 1508522 - DNA, 16 bp, Homo sapiens
aggtctgtttgctgtt

SEQ ID NO: 1508523 - DNA, 20 bp, Homo sapiens
aggtcttgactcatggcagc

SEQ ID NO: 1508524 - DNA, 23 bp, Homo sapiens
aggtcttgactcatggcagctgt

SEQ ID NO: 1508525 - DNA, 18 bp, Homo sapiens
aggtcttggtgcctctgc

SEQ ID NO: 1508526 - DNA, 18 bp, Homo sapiens
aggtcttttctagtctga

SEQ ID NO: 1508527 - DNA, 14 bp, Homo sapiens
aggtgaaagggagc

SEQ ID NO: 1508528 - DNA, 20 bp, Homo sapiens
aggtgttctacactcatctt

SEQ ID NO: 1508529 - DNA, 21 bp, Homo sapiens
aggtgttgccaaatatgtcct

SEQ ID NO: 1508530 - DNA, 18 bp, Homo sapiens
aggtgtttccatttctca

SEQ ID NO: 1508531 - DNA, 15 bp, Homo sapiens
aggtgtttgaacaga

SEQ ID NO: 1508532 - DNA, 15 bp, Homo sapiens
aggttaataaagtaa

SEQ ID NO: 1508533 - DNA, 14 bp, Homo sapiens
aggttaatgttcat

SEQ ID NO: 1508534 - DNA, 23 bp, Homo sapiens
aggttactacctatacaatgtat

SEQ ID NO: 1508535 - DNA, 16 bp, Homo sapiens
aggttactgggagtgt

SEQ ID NO: 1508536 - DNA, 17 bp, Homo sapiens
aggttactgggagtgtg

SEQ ID NO: 1508537 - DNA, 13 bp, Homo sapiens
aggttactttagt

SEQ ID NO: 1508538 - DNA, 21 bp, Homo sapiens
aggttagcctttgccctgtca

SEQ ID NO: 1508539 - DNA, 21 bp, Homo sapiens
aggttaggagttcgagaccag

SEQ ID NO: 1508540 - DNA, 19 bp, Homo sapiens
aggttataggtcactcctg

SEQ ID NO: 1508541 - DNA, 16 bp, Homo sapiens
aggttatcaaaactgt

SEQ ID NO: 1508542 - DNA, 16 bp, Homo sapiens
aggttatctgcctggc

SEQ ID NO: 1508543 - DNA, 18 bp, Homo sapiens
aggttatctgcctggcct

SEQ ID NO: 1508544 - DNA, 23 bp, Homo sapiens
aggttatctgcctggcctggctc

SEQ ID NO: 1508545 - DNA, 23 bp, Homo sapiens
aggttattttctttatcattgct

SEQ ID NO: 1508546 - DNA, 15 bp, Homo sapiens
aggttattttgcttt

SEQ ID NO: 1508547 - DNA, 16 bp, Homo sapiens
aggttcactaaagcag

SEQ ID NO: 1508548 - DNA, 13 bp, Homo sapiens
aggttcagatttt

SEQ ID NO: 1508549 - DNA, 19 bp, Homo sapiens
aggttcagccaaggtttta

SEQ ID NO: 1508550 - DNA, 20 bp, Homo sapiens
aggttcagtattatgtagtt

SEQ ID NO: 1508551 - DNA, 18 bp, Homo sapiens
aggttccaactgtatata

SEQ ID NO: 1508552 - DNA, 11 bp, Homo sapiens
aggttccagaa

SEQ ID NO: 1508553 - DNA, 18 bp, Homo sapiens
aggttccagaacagccct

SEQ ID NO: 1508554 - DNA, 17 bp, Homo sapiens
aggttccatccaccacc

SEQ ID NO: 1508555 - DNA, 18 bp, Homo sapiens
aggttccccaagggccct

SEQ ID NO: 1508556 - DNA, 21 bp, Homo sapiens
aggttccccaagggccctggc

SEQ ID NO: 1508557 - DNA, 22 bp, Homo sapiens
aggttccccaagggccctggca

SEQ ID NO: 1508558 - DNA, 16 bp, Homo sapiens
aggttcctctgcctgc

SEQ ID NO: 1508559 - DNA, 18 bp, Homo sapiens
aggttcctgtactactgc

SEQ ID NO: 1508560 - DNA, 16 bp, Homo sapiens
aggttctaaagttcta

SEQ ID NO: 1508561 - DNA, 20 bp, Homo sapiens
aggttctaaagttctaagat

SEQ ID NO: 1508562 - DNA, 23 bp, Homo sapiens
aggttctaaagttctaagattct

SEQ ID NO: 1508563 - DNA, 19 bp, Homo sapiens
aggttctaggtttcaaaga

SEQ ID NO: 1508564 - DNA, 23 bp, Homo sapiens
aggttctcattaggttttgcttg

SEQ ID NO: 1508565 - DNA, 19 bp, Homo sapiens
aggttctccgttagctcct

SEQ ID NO: 1508566 - DNA, 21 bp, Homo sapiens
aggttctccgttagctcctgt

SEQ ID NO: 1508567 - DNA, 17 bp, Homo sapiens
aggttctgcctgctttg

SEQ ID NO: 1508568 - DNA, 15 bp, Homo sapiens
aggttctgggcctct

SEQ ID NO: 1508569 - DNA, 17 bp, Homo sapiens
aggttctgggcctctga

SEQ ID NO: 1508570 - DNA, 18 bp, Homo sapiens
aggttctgggcctctgaa

SEQ ID NO: 1508571 - DNA, 22 bp, Homo sapiens
aggttctgtttatggccacatt

SEQ ID NO: 1508572 - DNA, 15 bp, Homo sapiens
aggttctgttttgtt

SEQ ID NO: 1508573 - DNA, 17 bp, Homo sapiens
aggttcttaaaaaggaa

SEQ ID NO: 1508574 - DNA, 12 bp, Homo sapiens
aggttgaagcca

SEQ ID NO: 1508575 - DNA, 13 bp, Homo sapiens
aggttgaagccaa

SEQ ID NO: 1508576 - DNA, 20 bp, Homo sapiens
aggttgaagctaaaaggaaa

SEQ ID NO: 1508577 - DNA, 15 bp, Homo sapiens
aggttgaataatata

SEQ ID NO: 1508578 - DNA, 23 bp, Homo sapiens
aggttgacaccattctcctgcct

SEQ ID NO: 1508579 - DNA, 17 bp, Homo sapiens
aggttgaggggctcctg

SEQ ID NO: 1508580 - DNA, 14 bp, Homo sapiens
aggttgcacacagt

SEQ ID NO: 1508581 - DNA, 15 bp, Homo sapiens
aggttgcagctgctc

SEQ ID NO: 1508582 - DNA, 15 bp, Homo sapiens
aggttgccaaattgc

SEQ ID NO: 1508583 - DNA, 20 bp, Homo sapiens
aggttggacagcccccttcg

SEQ ID NO: 1508584 - DNA, 18 bp, Homo sapiens
aggttgggctagagaaat

SEQ ID NO: 1508585 - DNA, 18 bp, Homo sapiens
aggttgggtgctgctaat

SEQ ID NO: 1508586 - DNA, 14 bp, Homo sapiens
aggttggtgactga

SEQ ID NO: 1508587 - DNA, 14 bp, Homo sapiens
aggttggtgggggg

SEQ ID NO: 1508588 - DNA, 14 bp, Homo sapiens
aggttgtctccagg

SEQ ID NO: 1508589 - DNA, 14 bp, Homo sapiens
aggtttaaagagtc

SEQ ID NO: 1508590 - DNA, 16 bp, Homo sapiens
aggtttaaagagtcta

SEQ ID NO: 1508591 - DNA, 22 bp, Homo sapiens
aggtttactgtgaagagaatgt

SEQ ID NO: 1508592 - DNA, 22 bp, Homo sapiens
aggtttcagcaacaagactgcc

SEQ ID NO: 1508593 - DNA, 23 bp, Homo sapiens
aggtttccttttggaacatttct

SEQ ID NO: 1508594 - DNA, 12 bp, Homo sapiens
aggtttcttgaa

SEQ ID NO: 1508595 - DNA, 20 bp, Homo sapiens
aggtttctttttttttcctt

SEQ ID NO: 1508596 - DNA, 22 bp, Homo sapiens
aggtttgaagacacagcctccc

SEQ ID NO: 1508597 - DNA, 11 bp, Homo sapiens
aggtttgcaaa

SEQ ID NO: 1508598 - DNA, 17 bp, Homo sapiens
aggtttgcaaattaaaa

SEQ ID NO: 1508599 - DNA, 13 bp, Homo sapiens
aggtttggaagag

SEQ ID NO: 1508600 - DNA, 23 bp, Homo sapiens
aggtttggggagggggaagagaa

SEQ ID NO: 1508601 - DNA, 12 bp, Homo sapiens
agtcaaatccag

SEQ ID NO: 1508602 - DNA, 20 bp, Homo sapiens
agtcaaatccagtggtgggt

SEQ ID NO: 1508603 - DNA, 15 bp, Homo sapiens
agtcaaatgccaaac

SEQ ID NO: 1508604 - DNA, 16 bp, Homo sapiens
agtcaacaaactattt

SEQ ID NO: 1508605 - DNA, 16 bp, Homo sapiens
agtcaacagtaaacca

SEQ ID NO: 1508606 - DNA, 16 bp, Homo sapiens
agtcaactgctgtttt

SEQ ID NO: 1508607 - DNA, 21 bp, Homo sapiens
agtcaactgctgttttatgtc

SEQ ID NO: 1508608 - DNA, 14 bp, Homo sapiens
agtcaagaagaaaa

SEQ ID NO: 1508609 - DNA, 16 bp, Homo sapiens
agtcaagcacatgtaa

SEQ ID NO: 1508610 - DNA, 10 bp, Homo sapiens
agtcaataca

SEQ ID NO: 1508611 - DNA, 12 bp, Homo sapiens
agtcacaaagac

SEQ ID NO: 1508612 - DNA, 15 bp, Homo sapiens
agtcacactgtggcc

SEQ ID NO: 1508613 - DNA, 12 bp, Homo sapiens
agtcacagctgc

SEQ ID NO: 1508614 - DNA, 18 bp, Homo sapiens
agtcacagctgcagctgg

SEQ ID NO: 1508615 - DNA, 23 bp, Homo sapiens
agtcacaggaagaaagcagaaag

SEQ ID NO: 1508616 - DNA, 23 bp, Homo sapiens
agtcacataaatggattaattac

SEQ ID NO: 1508617 - DNA, 14 bp, Homo sapiens
agtcacatcacagg

SEQ ID NO: 1508618 - DNA, 15 bp, Homo sapiens
agtcacatcacagga

SEQ ID NO: 1508619 - DNA, 11 bp, Homo sapiens
agtcacattcc

SEQ ID NO: 1508620 - DNA, 21 bp, Homo sapiens
agtcacattgatgtaaggact

SEQ ID NO: 1508621 - DNA, 15 bp, Homo sapiens
agtcaccacttattt

SEQ ID NO: 1508622 - DNA, 16 bp, Homo sapiens
agtcacccaaacactt

SEQ ID NO: 1508623 - DNA, 21 bp, Homo sapiens
agtcacccaaacacttctgct

SEQ ID NO: 1508624 - DNA, 16 bp, Homo sapiens
agtcacccatgaagac

SEQ ID NO: 1508625 - DNA, 19 bp, Homo sapiens
agtcaccctacctgtgcct

SEQ ID NO: 1508626 - DNA, 12 bp, Homo sapiens
agtcacctcctc

SEQ ID NO: 1508627 - DNA, 14 bp, Homo sapiens
agtcacctgcaagc

SEQ ID NO: 1508628 - DNA, 16 bp, Homo sapiens
agtcacctgcaagccc

SEQ ID NO: 1508629 - DNA, 17 bp, Homo sapiens
agtcacctgcaagcccc

SEQ ID NO: 1508630 - DNA, 18 bp, Homo sapiens
agtcacctgcaagcccca

SEQ ID NO: 1508631 - DNA, 11 bp, Homo sapiens
agtcacctgct

SEQ ID NO: 1508632 - DNA, 14 bp, Homo sapiens
agtcacctgctcca

SEQ ID NO: 1508633 - DNA, 18 bp, Homo sapiens
agtcacctgctccagaag

SEQ ID NO: 1508634 - DNA, 20 bp, Homo sapiens
agtcacggctgcgcactgtg

SEQ ID NO: 1508635 - DNA, 19 bp, Homo sapiens
agtcactagaagtcctgct

SEQ ID NO: 1508636 - DNA, 20 bp, Homo sapiens
agtcactagaagtcctgctg

SEQ ID NO: 1508637 - DNA, 19 bp, Homo sapiens
agtcactaggatgcagatg

SEQ ID NO: 1508638 - DNA, 13 bp, Homo sapiens
agtcactcctctc

SEQ ID NO: 1508639 - DNA, 14 bp, Homo sapiens
agtcactgaacaaa

SEQ ID NO: 1508640 - DNA, 12 bp, Homo sapiens
agtcactgagca

SEQ ID NO: 1508641 - DNA, 23 bp, Homo sapiens
agtcactgatgtacaattaaaaa

SEQ ID NO: 1508642 - DNA, 11 bp, Homo sapiens
agtcactgcct

SEQ ID NO: 1508643 - DNA, 14 bp, Homo sapiens
agtcactgcctctc

SEQ ID NO: 1508644 - DNA, 17 bp, Homo sapiens
agtcactgcctctccct

SEQ ID NO: 1508645 - DNA, 20 bp, Homo sapiens
agtcactgcctctccctggc

SEQ ID NO: 1508646 - DNA, 12 bp, Homo sapiens
agtcactgctct

SEQ ID NO: 1508647 - DNA, 21 bp, Homo sapiens
agtcactggaggttgaagcca

SEQ ID NO: 1508648 - DNA, 22 bp, Homo sapiens
agtcactggaggttgaagccaa

SEQ ID NO: 1508649 - DNA, 17 bp, Homo sapiens
agtcactggcagcctgc

SEQ ID NO: 1508650 - DNA, 22 bp, Homo sapiens
agtcactggcagcctgcacctg

SEQ ID NO: 1508651 - DNA, 16 bp, Homo sapiens
agtcacttatttcata

SEQ ID NO: 1508652 - DNA, 15 bp, Homo sapiens
agtcacttccagtgt

SEQ ID NO: 1508653 - DNA, 14 bp, Homo sapiens
agtcacttctccat

SEQ ID NO: 1508654 - DNA, 19 bp, Homo sapiens
agtcagaaggacggcagga

SEQ ID NO: 1508655 - DNA, 23 bp, Homo sapiens
agtcagagcccctacagcattgt

SEQ ID NO: 1508656 - DNA, 13 bp, Homo sapiens
agtcagaggagaa

SEQ ID NO: 1508657 - DNA, 15 bp, Homo sapiens
agtcagaggagaaga

SEQ ID NO: 1508658 - DNA, 16 bp, Homo sapiens
agtcagaggagaagag

SEQ ID NO: 1508659 - DNA, 20 bp, Homo sapiens
agtcagatgaggcaaacagc

SEQ ID NO: 1508660 - DNA, 23 bp, Homo sapiens
agtcagatgcccagagggcccag

SEQ ID NO: 1508661 - DNA, 22 bp, Homo sapiens
agtcagatggaaaattcatttt

SEQ ID NO: 1508662 - DNA, 23 bp, Homo sapiens
agtcagcaccttggcccaggagc

SEQ ID NO: 1508663 - DNA, 19 bp, Homo sapiens
agtcagccacactgggcct

SEQ ID NO: 1508664 - DNA, 21 bp, Homo sapiens
agtcagccacactgggcctgg

SEQ ID NO: 1508665 - DNA, 17 bp, Homo sapiens
agtcagctaattggact

SEQ ID NO: 1508666 - DNA, 18 bp, Homo sapiens
agtcagctctctgccctg

SEQ ID NO: 1508667 - DNA, 17 bp, Homo sapiens
agtcaggcccaggcact

SEQ ID NO: 1508668 - DNA, 14 bp, Homo sapiens
agtcgaggctgcag

SEQ ID NO: 1508669 - DNA, 23 bp, Homo sapiens
agtcgaggctgcagtcagccctg

SEQ ID NO: 1508670 - DNA, 17 bp, Homo sapiens
agtcgcagaccagagct

SEQ ID NO: 1508671 - DNA, 18 bp, Homo sapiens
agtcgccagtcactgctg

SEQ ID NO: 1508672 - DNA, 15 bp, Homo sapiens
agtcggcatgccagg

SEQ ID NO: 1508673 - DNA, 16 bp, Homo sapiens
agtcggcatgccagga

SEQ ID NO: 1508674 - DNA, 15 bp, Homo sapiens
agtcggccccatctc

SEQ ID NO: 1508675 - DNA, 15 bp, Homo sapiens
agtcgggggctggcc

SEQ ID NO: 1508676 - DNA, 20 bp, Homo sapiens
agtcgggggctggcctagga

SEQ ID NO: 1508677 - DNA, 14 bp, Homo sapiens
agtcggtcctcttt

SEQ ID NO: 1508678 - DNA, 15 bp, Homo sapiens
agtcggtctgctttg

SEQ ID NO: 1508679 - DNA, 17 bp, Homo sapiens
agtcggtctgctttgga

SEQ ID NO: 1508680 - DNA, 13 bp, Homo sapiens
agtcgtgcctgtg

SEQ ID NO: 1508681 - DNA, 14 bp, Homo sapiens
agtcgtgcctgtgt

SEQ ID NO: 1508682 - DNA, 15 bp, Homo sapiens
agtcgtgcctgtgtc

SEQ ID NO: 1508683 - DNA, 17 bp, Homo sapiens
agtcgttttagtgtctg

SEQ ID NO: 1508684 - DNA, 20 bp, Homo sapiens
agtctaaaaacttcttttta

SEQ ID NO: 1508685 - DNA, 20 bp, Homo sapiens
agtctaaagatggagtttct

SEQ ID NO: 1508686 - DNA, 15 bp, Homo sapiens
agtctaagcaagatg

SEQ ID NO: 1508687 - DNA, 19 bp, Homo sapiens
agtctaagcaagatgtttt

SEQ ID NO: 1508688 - DNA, 19 bp, Homo sapiens
agtctagacacaatttcat

SEQ ID NO: 1508689 - DNA, 15 bp, Homo sapiens
agtctagattcaaag

SEQ ID NO: 1508690 - DNA, 20 bp, Homo sapiens
agtctagattcaaaggttct

SEQ ID NO: 1508691 - DNA, 14 bp, Homo sapiens
agtctagattctct

SEQ ID NO: 1508692 - DNA, 17 bp, Homo sapiens
agtctagttcctgatga

SEQ ID NO: 1508693 - DNA, 18 bp, Homo sapiens
agtctatatgaaaaacaa

SEQ ID NO: 1508694 - DNA, 16 bp, Homo sapiens
agtctatgttcaaaga

SEQ ID NO: 1508695 - DNA, 20 bp, Homo sapiens
agtctatttccactgaacaa

SEQ ID NO: 1508696 - DNA, 22 bp, Homo sapiens
agtctatttccactgaacaaaa

SEQ ID NO: 1508697 - DNA, 23 bp, Homo sapiens
agtctatttccactgaacaaaac

SEQ ID NO: 1508698 - DNA, 18 bp, Homo sapiens
agtctatttccattcttt

SEQ ID NO: 1508699 - DNA, 18 bp, Homo sapiens
agtctcaagggtggcagg

SEQ ID NO: 1508700 - DNA, 22 bp, Homo sapiens
agtctcacagagaagctcctgc

SEQ ID NO: 1508701 - DNA, 21 bp, Homo sapiens
agtctcactttgacacccagg

SEQ ID NO: 1508702 - DNA, 16 bp, Homo sapiens
agtctcagagaccagc

SEQ ID NO: 1508703 - DNA, 20 bp, Homo sapiens
agtctcagagaccagcactc

SEQ ID NO: 1508704 - DNA, 21 bp, Homo sapiens
agtctcagagaccagcactca

SEQ ID NO: 1508705 - DNA, 15 bp, Homo sapiens
agtctcagagcacag

SEQ ID NO: 1508706 - DNA, 17 bp, Homo sapiens
agtctcagagcacagag

SEQ ID NO: 1508707 - DNA, 13 bp, Homo sapiens
agtctcaggaaat

SEQ ID NO: 1508708 - DNA, 16 bp, Homo sapiens
agtctcaggaaatcaa

SEQ ID NO: 1508709 - DNA, 16 bp, Homo sapiens
agtctcattacagatt

SEQ ID NO: 1508710 - DNA, 21 bp, Homo sapiens
agtctcattcgcctttgtctt

SEQ ID NO: 1508711 - DNA, 15 bp, Homo sapiens
agtctcatttctcat

SEQ ID NO: 1508712 - DNA, 18 bp, Homo sapiens
agtctccagcccacgttc

SEQ ID NO: 1508713 - DNA, 22 bp, Homo sapiens
agtctccagggccccccaactg

SEQ ID NO: 1508714 - DNA, 19 bp, Homo sapiens
agtctccatgaagagcttg

SEQ ID NO: 1508715 - DNA, 11 bp, Homo sapiens
agtctcctctc

SEQ ID NO: 1508716 - DNA, 19 bp, Homo sapiens
agtctcgctctgttgccca

SEQ ID NO: 1508717 - DNA, 19 bp, Homo sapiens
agtctctataccaataaag

SEQ ID NO: 1508718 - DNA, 20 bp, Homo sapiens
agtctctataccaataaagt

SEQ ID NO: 1508719 - DNA, 19 bp, Homo sapiens
agtctctatattatgtctt

SEQ ID NO: 1508720 - DNA, 17 bp, Homo sapiens
agtaccaatgctgttgt

SEQ ID NO: 1508721 - DNA, 19 bp, Homo sapiens
agtaccaatgctgttgtaa

SEQ ID NO: 1508722 - DNA, 15 bp, Homo sapiens
agtaccactcttggt

SEQ ID NO: 1508723 - DNA, 14 bp, Homo sapiens
agtaccagactaga

SEQ ID NO: 1508724 - DNA, 18 bp, Homo sapiens
agtacccatctagtactt

SEQ ID NO: 1508725 - DNA, 23 bp, Homo sapiens
agtaccccctcaaaccctgccct

SEQ ID NO: 1508726 - DNA, 18 bp, Homo sapiens
agtacccctaaaatccca

SEQ ID NO: 1508727 - DNA, 21 bp, Homo sapiens
agtacctagctggctctgtga

SEQ ID NO: 1508728 - DNA, 14 bp, Homo sapiens
agtacctgaaaagt

SEQ ID NO: 1508729 - DNA, 18 bp, Homo sapiens
agtacctgattgtatttt

SEQ ID NO: 1508730 - DNA, 15 bp, Homo sapiens
agtacctgcaaaaat

SEQ ID NO: 1508731 - DNA, 19 bp, Homo sapiens
agtacctgcaaaaatgagt

SEQ ID NO: 1508732 - DNA, 12 bp, Homo sapiens
agtacctgctgc

SEQ ID NO: 1508733 - DNA, 20 bp, Homo sapiens
agtacctgggaaaggaccca

SEQ ID NO: 1508734 - DNA, 18 bp, Homo sapiens
agtacgaacctacagttt

SEQ ID NO: 1508735 - DNA, 12 bp, Homo sapiens
agtactatgtat

SEQ ID NO: 1508736 - DNA, 16 bp, Homo sapiens
agtactcaatgtttct

SEQ ID NO: 1508737 - DNA, 20 bp, Homo sapiens
agtactcaatgtttctggac

SEQ ID NO: 1508738 - DNA, 18 bp, Homo sapiens
agtactcctgcaaaattt

SEQ ID NO: 1508739 - DNA, 21 bp, Homo sapiens
agtactcctgcaaaattttat

SEQ ID NO: 1508740 - DNA, 15 bp, Homo sapiens
agtactccttaagaa

SEQ ID NO: 1508741 - DNA, 17 bp, Homo sapiens
agtactccttaagaaca

SEQ ID NO: 1508742 - DNA, 19 bp, Homo sapiens
agtactccttaagaacaca

SEQ ID NO: 1508743 - DNA, 17 bp, Homo sapiens
agtactctctgctctag

SEQ ID NO: 1508744 - DNA, 22 bp, Homo sapiens
agtactctctgctctagccagg

SEQ ID NO: 1508745 - DNA, 12 bp, Homo sapiens
agtactctttaa

SEQ ID NO: 1508746 - DNA, 13 bp, Homo sapiens
agtactgtactat

SEQ ID NO: 1508747 - DNA, 18 bp, Homo sapiens
agtactgttttgaagctg

SEQ ID NO: 1508748 - DNA, 22 bp, Homo sapiens
agtactgttttgaagctgggct

SEQ ID NO: 1508749 - DNA, 18 bp, Homo sapiens
agtactttaaaaaggaaa

SEQ ID NO: 1508750 - DNA, 15 bp, Homo sapiens
agtactttattgtac

SEQ ID NO: 1508751 - DNA, 15 bp, Homo sapiens
agtactttgtgcatt

SEQ ID NO: 1508752 - DNA, 17 bp, Homo sapiens
agtactttgtgctcata

SEQ ID NO: 1508753 - DNA, 13 bp, Homo sapiens
agtacttttttaa

SEQ ID NO: 1508754 - DNA, 15 bp, Homo sapiens
agtacttttttaaat

SEQ ID NO: 1508755 - DNA, 23 bp, Homo sapiens
agtacttttttaaatattttcta

SEQ ID NO: 1508756 - DNA, 17 bp, Homo sapiens
agtagaaattttacaat

SEQ ID NO: 1508757 - DNA, 19 bp, Homo sapiens
agtagaacagataatcagt

SEQ ID NO: 1508758 - DNA, 14 bp, Homo sapiens
agtagaactggatc

SEQ ID NO: 1508759 - DNA, 21 bp, Homo sapiens
agtagaagtcttagatgtata

SEQ ID NO: 1508760 - DNA, 14 bp, Homo sapiens
agtagaattaccat

SEQ ID NO: 1508761 - DNA, 22 bp, Homo sapiens
agtagaattaccattaattaca

SEQ ID NO: 1508762 - DNA, 14 bp, Homo sapiens
agtagacatttgtg

SEQ ID NO: 1508763 - DNA, 23 bp, Homo sapiens
agtagagaaatggattcagtata

SEQ ID NO: 1508764 - DNA, 22 bp, Homo sapiens
agtagagacgaggtttcactgt

SEQ ID NO: 1508765 - DNA, 18 bp, Homo sapiens
agtgagcagaacaggtag

SEQ ID NO: 1508766 - DNA, 14 bp, Homo sapiens
agtgagcagggttc

SEQ ID NO: 1508767 - DNA, 15 bp, Homo sapiens
agtgagccacagacc

SEQ ID NO: 1508768 - DNA, 21 bp, Homo sapiens
agtgagccacagaccacctgc

SEQ ID NO: 1508769 - DNA, 21 bp, Homo sapiens
agtgagcctgaattttgttgc

SEQ ID NO: 1508770 - DNA, 14 bp, Homo sapiens
agtgagctgagaca

SEQ ID NO: 1508771 - DNA, 20 bp, Homo sapiens
agtgaggaatagttgagccc

SEQ ID NO: 1508772 - DNA, 14 bp, Homo sapiens
agtgaggagaatga

SEQ ID NO: 1508773 - DNA, 12 bp, Homo sapiens
agtgaggagggt

SEQ ID NO: 1508774 - DNA, 17 bp, Homo sapiens
agtgaggatgctgcagt

SEQ ID NO: 1508775 - DNA, 18 bp, Homo sapiens
agtgaggatgctgcagtg

SEQ ID NO: 1508776 - DNA, 14 bp, Homo sapiens
agtgaggatgtctg

SEQ ID NO: 1508777 - DNA, 18 bp, Homo sapiens
agtgaggcccaaggagct

SEQ ID NO: 1508778 - DNA, 14 bp, Homo sapiens
agtgaggcttccag

SEQ ID NO: 1508779 - DNA, 20 bp, Homo sapiens
agtgagggcttgtcattacc

SEQ ID NO: 1508780 - DNA, 23 bp, Homo sapiens
agtgagtacctgcaaaaatgagt

SEQ ID NO: 1508781 - DNA, 15 bp, Homo sapiens
agtgagtcacctgct

SEQ ID NO: 1508782 - DNA, 15 bp, Homo sapiens
agtgagtcagcacct

SEQ ID NO: 1508783 - DNA, 16 bp, Homo sapiens
agtgagtctcttcaga

SEQ ID NO: 1508784 - DNA, 16 bp, Homo sapiens
agtgagtttgtaaata

SEQ ID NO: 1508785 - DNA, 22 bp, Homo sapiens
agtgataatattgtttccctcg

SEQ ID NO: 1508786 - DNA, 17 bp, Homo sapiens
agtgatacaacttcaag

SEQ ID NO: 1508787 - DNA, 21 bp, Homo sapiens
agtgatacactgtatctaaaa

SEQ ID NO: 1508788 - DNA, 20 bp, Homo sapiens
agtgatactatccagttact

SEQ ID NO: 1508789 - DNA, 20 bp, Homo sapiens
agtgatagtcttttgctttt

SEQ ID NO: 1508790 - DNA, 21 bp, Homo sapiens
agtgatagtcttttgcttttg

SEQ ID NO: 1508791 - DNA, 15 bp, Homo sapiens
agtgatatcacctct

SEQ ID NO: 1508792 - DNA, 16 bp, Homo sapiens
agtgatatggtgaagg

SEQ ID NO: 1508793 - DNA, 17 bp, Homo sapiens
agtgatatggtgaaggg

SEQ ID NO: 1508794 - DNA, 19 bp, Homo sapiens
agtgatcaataaaatgtga

SEQ ID NO: 1508795 - DNA, 16 bp, Homo sapiens
agtgatccttacaagt

SEQ ID NO: 1508796 - DNA, 18 bp, Homo sapiens
agtgatccttccacctca

SEQ ID NO: 1508797 - DNA, 22 bp, Homo sapiens
agtgatctacatgaggaactgt

SEQ ID NO: 1508798 - DNA, 21 bp, Homo sapiens
agtgatctatgtttgtgtgat

SEQ ID NO: 1508799 - DNA, 22 bp, Homo sapiens
agtgatctatgtttgtgtgatt

SEQ ID NO: 1508800 - DNA, 13 bp, Homo sapiens
agtgatctccata

SEQ ID NO: 1508801 - DNA, 14 bp, Homo sapiens
agtgatctccatat

SEQ ID NO: 1508802 - DNA, 19 bp, Homo sapiens
agtgatcttggctgtttca

SEQ ID NO: 1508803 - DNA, 13 bp, Homo sapiens
agtgatgaatgta

SEQ ID NO: 1508804 - DNA, 15 bp, Homo sapiens
agtgatgacttgctg

SEQ ID NO: 1508805 - DNA, 19 bp, Homo sapiens
agtgatgagacagtgaagt

SEQ ID NO: 1508806 - DNA, 22 bp, Homo sapiens
agtgatgcctgcccgcaccctg

SEQ ID NO: 1508807 - DNA, 19 bp, Homo sapiens
agtgatggcgcgggaggca

SEQ ID NO: 1508808 - DNA, 21 bp, Homo sapiens
agtgatggcgcgggaggcacc

SEQ ID NO: 1508809 - DNA, 17 bp, Homo sapiens
agtgatgggaaggtttt

SEQ ID NO: 1508810 - DNA, 17 bp, Homo sapiens
agtgatgttagcagacc

SEQ ID NO: 1508811 - DNA, 15 bp, Homo sapiens
agtgattatctcttt

SEQ ID NO: 1508812 - DNA, 17 bp, Homo sapiens
agtgattcccaactcct

SEQ ID NO: 1508813 - DNA, 13 bp, Homo sapiens
agtgattctagag

SEQ ID NO: 1508814 - DNA, 16 bp, Homo sapiens
agtgattctgatttca

SEQ ID NO: 1508815 - DNA, 13 bp, Homo sapiens
agtgattgcagct

SEQ ID NO: 1508816 - DNA, 19 bp, Homo sapiens
agtgattttcaaacctcaa

SEQ ID NO: 1508817 - DNA, 20 bp, Homo sapiens
agtgatttttggtcttctgt

SEQ ID NO: 1508818 - DNA, 18 bp, Homo sapiens
agtgcaaaccacttctcc

SEQ ID NO: 1508819 - DNA, 17 bp, Homo sapiens
agtgcaacatctctgaa

SEQ ID NO: 1508820 - DNA, 21 bp, Homo sapiens
agtgcaataaatctgacccag

SEQ ID NO: 1508821 - DNA, 16 bp, Homo sapiens
agtgcaatgacacagt

SEQ ID NO: 1508822 - DNA, 17 bp, Homo sapiens
agtgcaatgcttgtaga

SEQ ID NO: 1508823 - DNA, 19 bp, Homo sapiens
agtgcactccggcctgggt

SEQ ID NO: 1508824 - DNA, 23 bp, Homo sapiens
agtgcttttaagtgaaaatggtc

SEQ ID NO: 1508825 - DNA, 16 bp, Homo sapiens
agtgcttttctgttta

SEQ ID NO: 1508826 - DNA, 14 bp, Homo sapiens
agtggaagagcagc

SEQ ID NO: 1508827 - DNA, 24 bp, Homo sapiens
agtggaagagcagcctgatggcca

SEQ ID NO: 1508828 - DNA, 22 bp, Homo sapiens
agtggaatagatgtctcaaaaa

SEQ ID NO: 1508829 - DNA, 16 bp, Homo sapiens
agtggaatgcagggaa

SEQ ID NO: 1508830 - DNA, 22 bp, Homo sapiens
agtggaatgcttcctagaagtt

SEQ ID NO: 1508831 - DNA, 13 bp, Homo sapiens
agtggaccaggac

SEQ ID NO: 1508832 - DNA, 16 bp, Homo sapiens
agtggaccaggacagg

SEQ ID NO: 1508833 - DNA, 19 bp, Homo sapiens
agtggaccttgagaccaca

SEQ ID NO: 1508834 - DNA, 14 bp, Homo sapiens
agtggactcagcag

SEQ ID NO: 1508835 - DNA, 15 bp, Homo sapiens
agtggactcttccct

SEQ ID NO: 1508836 - DNA, 15 bp, Homo sapiens
agtggactgcattta

SEQ ID NO: 1508837 - DNA, 13 bp, Homo sapiens
agtggacttgttt

SEQ ID NO: 1508838 - DNA, 15 bp, Homo sapiens
agtggagacagtcct

SEQ ID NO: 1508839 - DNA, 16 bp, Homo sapiens
agtggagagatgtttg

SEQ ID NO: 1508840 - DNA, 12 bp, Homo sapiens
agtggagccagg

SEQ ID NO: 1508841 - DNA, 12 bp, Homo sapiens
agtggagctggg

SEQ ID NO: 1508842 - DNA, 13 bp, Homo sapiens
agtggagctggga

SEQ ID NO: 1508843 - DNA, 14 bp, Homo sapiens
agtggaggctgctg

SEQ ID NO: 1508844 - DNA, 17 bp, Homo sapiens
agtggaggctgctgtga

SEQ ID NO: 1508845 - DNA, 14 bp, Homo sapiens
agtggagtctgagt

SEQ ID NO: 1508846 - DNA, 23 bp, Homo sapiens
agtggagtctgagtctgagtcct

SEQ ID NO: 1508847 - DNA, 15 bp, Homo sapiens
agtggatcacaaagt

SEQ ID NO: 1508848 - DNA, 18 bp, Homo sapiens
agtggatcactcaccatt

SEQ ID NO: 1508849 - DNA, 13 bp, Homo sapiens
agtggatgatgtt

SEQ ID NO: 1508850 - DNA, 14 bp, Homo sapiens
agtggatggaatat

SEQ ID NO: 1508851 - DNA, 17 bp, Homo sapiens
agtggcagatttcttta

SEQ ID NO: 1508852 - DNA, 13 bp, Homo sapiens
agtggcagcagcc

SEQ ID NO: 1508853 - DNA, 14 bp, Homo sapiens
agtggcagcagccc

SEQ ID NO: 1508854 - DNA, 12 bp, Homo sapiens
agtggcagccat

SEQ ID NO: 1508855 - DNA, 14 bp, Homo sapiens
agtggcagccatgc

SEQ ID NO: 1508856 - DNA, 15 bp, Homo sapiens
agtggcagccatgcc

SEQ ID NO: 1508857 - DNA, 23 bp, Homo sapiens
agtggcagccatgcctcatgcca

SEQ ID NO: 1508858 - DNA, 19 bp, Homo sapiens
agtggcaggtgggctgcct

SEQ ID NO: 1508859 - DNA, 19 bp, Homo sapiens
agtggcatcatctcagctc

SEQ ID NO: 1508860 - DNA, 19 bp, Homo sapiens
agtggccaaataggaggga

SEQ ID NO: 1508861 - DNA, 12 bp, Homo sapiens
agtggccaggca

SEQ ID NO: 1508862 - DNA, 16 bp, Homo sapiens
agtggccatcatttct

SEQ ID NO: 1508863 - DNA, 15 bp, Homo sapiens
agtggccccacctgt

SEQ ID NO: 1508864 - DNA, 20 bp, Homo sapiens
agtggccccacctgtgtccc

SEQ ID NO: 1508865 - DNA, 14 bp, Homo sapiens
agtggccccctcct

SEQ ID NO: 1508866 - DNA, 16 bp, Homo sapiens
agtggcccctattgag

SEQ ID NO: 1508867 - DNA, 14 bp, Homo sapiens
agtggcctccctgc

SEQ ID NO: 1508868 - DNA, 18 bp, Homo sapiens
agtggcctccctgctgtg

SEQ ID NO: 1508869 - DNA, 23 bp, Homo sapiens
agtggcctgctaaggctcctcct

SEQ ID NO: 1508870 - DNA, 12 bp, Homo sapiens
agtggcctggcc

SEQ ID NO: 1508871 - DNA, 22 bp, Homo sapiens
agtggcctggccgttcagcctg

SEQ ID NO: 1508872 - DNA, 19 bp, Homo sapiens
agtggcgcgatctcagctc

SEQ ID NO: 1508873 - DNA, 18 bp, Homo sapiens
agtggcgtgatcttggct

SEQ ID NO: 1508874 - DNA, 14 bp, Homo sapiens
agtggctcaacatt

SEQ ID NO: 1508875 - DNA, 15 bp, Homo sapiens
agtggctgccttctt

SEQ ID NO: 1508876 - DNA, 19 bp, Homo sapiens
agtggctgccttctttcca

SEQ ID NO: 1508877 - DNA, 12 bp, Homo sapiens
agtggctgcggt

SEQ ID NO: 1508878 - DNA, 18 bp, Homo sapiens
agtggctgcggtgtttgg

SEQ ID NO: 1508879 - DNA, 18 bp, Homo sapiens
agtggctggtccagggct

SEQ ID NO: 1508880 - DNA, 19 bp, Homo sapiens
agtggctggtccagggcta

SEQ ID NO: 1508881 - DNA, 16 bp, Homo sapiens
agtggctgtcatcagc

SEQ ID NO: 1508882 - DNA, 17 bp, Homo sapiens
agtggctgtcatcagcc

SEQ ID NO: 1508883 - DNA, 15 bp, Homo sapiens
agtggcttcccagct

SEQ ID NO: 1508884 - DNA, 15 bp, Homo sapiens
agtgggaagtgaatc

SEQ ID NO: 1508885 - DNA, 21 bp, Homo sapiens
agtgggacagggcatggccag

SEQ ID NO: 1508886 - DNA, 16 bp, Homo sapiens
agtgttggctgtgtga

SEQ ID NO: 1508887 - DNA, 19 bp, Homo sapiens
agtgttggctgtgtgacag

SEQ ID NO: 1508888 - DNA, 13 bp, Homo sapiens
agtgttgtttgta

SEQ ID NO: 1508889 - DNA, 17 bp, Homo sapiens
agtgtttaacttgtcaa

SEQ ID NO: 1508890 - DNA, 17 bp, Homo sapiens
agtgtttcaaaaaatta

SEQ ID NO: 1508891 - DNA, 20 bp, Homo sapiens
agtgtttcaaaaaattatat

SEQ ID NO: 1508892 - DNA, 16 bp, Homo sapiens
agtgttttctcagaac

SEQ ID NO: 1508893 - DNA, 11 bp, Homo sapiens
agtgttttctt

SEQ ID NO: 1508894 - DNA, 16 bp, Homo sapiens
agtgttttctttgagg

SEQ ID NO: 1508895 - DNA, 17 bp, Homo sapiens
agtgttttctttgagga

SEQ ID NO: 1508896 - DNA, 21 bp, Homo sapiens
agtgttttggactccatctct

SEQ ID NO: 1508897 - DNA, 22 bp, Homo sapiens
agtgttttggactccatctctc

SEQ ID NO: 1508898 - DNA, 15 bp, Homo sapiens
agtgtttttgtgaat

SEQ ID NO: 1508899 - DNA, 16 bp, Homo sapiens
agtgtttttgtgaatt

SEQ ID NO: 1508900 - DNA, 20 bp, Homo sapiens
agttaaaatgtttactgtaa

SEQ ID NO: 1508901 - DNA, 15 bp, Homo sapiens
agttaaactaaaaaa

SEQ ID NO: 1508902 - DNA, 13 bp, Homo sapiens
agttaaagaaagg

SEQ ID NO: 1508903 - DNA, 14 bp, Homo sapiens
agttaaagaaagga

SEQ ID NO: 1508904 - DNA, 13 bp, Homo sapiens
agttaaagggaag

SEQ ID NO: 1508905 - DNA, 18 bp, Homo sapiens
agttaaagggaagaaaac

SEQ ID NO: 1508906 - DNA, 21 bp, Homo sapiens
agttaaatagagtatatgcac

SEQ ID NO: 1508907 - DNA, 20 bp, Homo sapiens
agttaacaaggaatgcctgt

SEQ ID NO: 1508908 - DNA, 13 bp, Homo sapiens
agttaacaatgat

SEQ ID NO: 1508909 - DNA, 16 bp, Homo sapiens
agttaacaggatatta

SEQ ID NO: 1508910 - DNA, 18 bp, Homo sapiens
agttaacaggcaaacatt

SEQ ID NO: 1508911 - DNA, 13 bp, Homo sapiens
agttaacgggtga

SEQ ID NO: 1508912 - DNA, 17 bp, Homo sapiens
agttaacgggtgaataa

SEQ ID NO: 1508913 - DNA, 21 bp, Homo sapiens
agttaacgggtgaataataaa

SEQ ID NO: 1508914 - DNA, 14 bp, Homo sapiens
agttaactttcaga

SEQ ID NO: 1508915 - DNA, 13 bp, Homo sapiens
agttaagacctgg

SEQ ID NO: 1508916 - DNA, 16 bp, Homo sapiens
agttaagacctggcag

SEQ ID NO: 1508917 - DNA, 21 bp, Homo sapiens
agttaaggtgtgcaaagatct

SEQ ID NO: 1508918 - DNA, 21 bp, Homo sapiens
agttaattttttttgtattct

SEQ ID NO: 1508919 - DNA, 22 bp, Homo sapiens
agttacaaattataatgtattc

SEQ ID NO: 1508920 - DNA, 21 bp, Homo sapiens
agttacaattgttacagtact

SEQ ID NO: 1508921 - DNA, 18 bp, Homo sapiens
agttacactaaaaggtga

SEQ ID NO: 1508922 - DNA, 16 bp, Homo sapiens
agttacagttgatgtt

SEQ ID NO: 1508923 - DNA, 17 bp, Homo sapiens
agttacagttgatgttt

SEQ ID NO: 1508924 - DNA, 22 bp, Homo sapiens
agttaccttatagttactgtgt

SEQ ID NO: 1508925 - DNA, 14 bp, Homo sapiens
agttactcagccct

SEQ ID NO: 1508926 - DNA, 18 bp, Homo sapiens
agttactgtgtaattagt

SEQ ID NO: 1508927 - DNA, 16 bp, Homo sapiens
agttacttatgattta

SEQ ID NO: 1508928 - DNA, 13 bp, Homo sapiens
agttacttgataa

SEQ ID NO: 1508929 - DNA, 17 bp, Homo sapiens
agttacttgtctgaggc

SEQ ID NO: 1508930 - DNA, 19 bp, Homo sapiens
agttacttgtctgaggcct

SEQ ID NO: 1508931 - DNA, 14 bp, Homo sapiens
agttagagaatctg

SEQ ID NO: 1508932 - DNA, 19 bp, Homo sapiens
agttagaggccagcctggc

SEQ ID NO: 1508933 - DNA, 16 bp, Homo sapiens
agttagatctttgtaa

SEQ ID NO: 1508934 - DNA, 16 bp, Homo sapiens
agttagcaaactttgt

SEQ ID NO: 1508935 - DNA, 19 bp, Homo sapiens
agttagcatccaggctggc

SEQ ID NO: 1508936 - DNA, 21 bp, Homo sapiens
agttagcatgcgcgctgtggg

SEQ ID NO: 1508937 - DNA, 23 bp, Homo sapiens
agttagcatgcgcgctgtgggca

SEQ ID NO: 1508938 - DNA, 17 bp, Homo sapiens
agttagccccagaaaat

SEQ ID NO: 1508939 - DNA, 14 bp, Homo sapiens
agttagccctcagt

SEQ ID NO: 1508940 - DNA, 14 bp, Homo sapiens
agttagctcaggag

SEQ ID NO: 1508941 - DNA, 17 bp, Homo sapiens
agttagctccataaagt

SEQ ID NO: 1508942 - DNA, 23 bp, Homo sapiens
agttagctccataaagtacaaat

SEQ ID NO: 1508943 - DNA, 16 bp, Homo sapiens
agttaggattcagatc

SEQ ID NO: 1508944 - DNA, 21 bp, Homo sapiens
agttaggattcagatcgaaat

SEQ ID NO: 1508945 - DNA, 16 bp, Homo sapiens
agttaggctttctctt

SEQ ID NO: 1508946 - DNA, 15 bp, Homo sapiens
agttagggagagaga

SEQ ID NO: 1508947 - DNA, 20 bp, Homo sapiens
agttagggagagagaagcag

SEQ ID NO: 1508948 - DNA, 18 bp, Homo sapiens
agttagtattaaaatcta

SEQ ID NO: 1508949 - DNA, 15 bp, Homo sapiens
agttagtgatcctgt

SEQ ID NO: 1508950 - DNA, 16 bp, Homo sapiens
agttagttaagttggg

SEQ ID NO: 1508951 - DNA, 17 bp, Homo sapiens
agttagtttctttggga

SEQ ID NO: 1508952 - DNA, 15 bp, Homo sapiens
agttagtttgtatat

SEQ ID NO: 1508953 - DNA, 17 bp, Homo sapiens
agttatagatgtctagg

SEQ ID NO: 1508954 - DNA, 23 bp, Homo sapiens
agttatagtgaatactgctacag

SEQ ID NO: 1508955 - DNA, 23 bp, Homo sapiens
agttatattggaattataaatat

SEQ ID NO: 1508956 - DNA, 16 bp, Homo sapiens
agttatcaaaaagtat

SEQ ID NO: 1508957 - DNA, 16 bp, Homo sapiens
agttatcacactttgt

SEQ ID NO: 1508958 - DNA, 15 bp, Homo sapiens
agttatcatgaattt

SEQ ID NO: 1508959 - DNA, 16 bp, Homo sapiens
agttatgtatttaaag

SEQ ID NO: 1508960 - DNA, 14 bp, Homo sapiens
agttatgtgaatga

SEQ ID NO: 1508961 - DNA, 23 bp, Homo sapiens
agttatgtgggtggcttctagtt

SEQ ID NO: 1508962 - DNA, 15 bp, Homo sapiens
agttattaaaatcat

SEQ ID NO: 1508963 - DNA, 16 bp, Homo sapiens
agttattaaaattgtt

SEQ ID NO: 1508964 - DNA, 20 bp, Homo sapiens
agttattacatgtaatttga

SEQ ID NO: 1508965 - DNA, 11 bp, Homo sapiens
agttattcaaa

SEQ ID NO: 1508966 - DNA, 17 bp, Homo sapiens
agttattcaaatttgta

SEQ ID NO: 1508967 - DNA, 19 bp, Homo sapiens
agttattgaatcttaattt

SEQ ID NO: 1508968 - DNA, 20 bp, Homo sapiens
agttgacaacctagaatgtc

SEQ ID NO: 1508969 - DNA, 21 bp, Homo sapiens
agttgagccccaagtcctgaa

SEQ ID NO: 1508970 - DNA, 20 bp, Homo sapiens
agttgatctggaacccagac

SEQ ID NO: 1508971 - DNA, 16 bp, Homo sapiens
agttgattatttcaac

SEQ ID NO: 1508972 - DNA, 19 bp, Homo sapiens
agttgattcagccctcaga

SEQ ID NO: 1508973 - DNA, 14 bp, Homo sapiens
agttgcaataatac

SEQ ID NO: 1508974 - DNA, 18 bp, Homo sapiens
agttgcaattgaattaaa

SEQ ID NO: 1508975 - DNA, 16 bp, Homo sapiens
agttgcactaactgct

SEQ ID NO: 1508976 - DNA, 16 bp, Homo sapiens
agttgcagattcattt

SEQ ID NO: 1508977 - DNA, 22 bp, Homo sapiens
agttgcatgctagcatgggtat

SEQ ID NO: 1508978 - DNA, 20 bp, Homo sapiens
agttgccaaagttttgctgt

SEQ ID NO: 1508979 - DNA, 14 bp, Homo sapiens
agttgccaacagtt

SEQ ID NO: 1508980 - DNA, 20 bp, Homo sapiens
agttgccatgtagacccctt

SEQ ID NO: 1508981 - DNA, 13 bp, Homo sapiens
agttgccttttat

SEQ ID NO: 1508982 - DNA, 22 bp, Homo sapiens
atacacacacacagacatatat

SEQ ID NO: 1508983 - DNA, 19 bp, Homo sapiens
atacacacatgccctcctg

SEQ ID NO: 1508984 - DNA, 18 bp, Homo sapiens
atacacactcaaatcaag

SEQ ID NO: 1508985 - DNA, 20 bp, Homo sapiens
atacacactcaaatcaagaa

SEQ ID NO: 1508986 - DNA, 15 bp, Homo sapiens
atacacagtacttta

SEQ ID NO: 1508987 - DNA, 16 bp, Homo sapiens
atacacagtactttat

SEQ ID NO: 1508988 - DNA, 19 bp, Homo sapiens
atacaccagagataatatg

SEQ ID NO: 1508989 - DNA, 24 bp, Homo sapiens
atacacccaagatgggcatctttt

SEQ ID NO: 1508990 - DNA, 16 bp, Homo sapiens
atacaccgtttagaaa

SEQ ID NO: 1508991 - DNA, 21 bp, Homo sapiens
atacactatgaagatgtttca

SEQ ID NO: 1508992 - DNA, 17 bp, Homo sapiens
atacactgaaaggaaaa

SEQ ID NO: 1508993 - DNA, 11 bp, Homo sapiens
atacactgtgt

SEQ ID NO: 1508994 - DNA, 17 bp, Homo sapiens
atacactgtgtaaatac

SEQ ID NO: 1508995 - DNA, 22 bp, Homo sapiens
atacacttattggaactctgct

SEQ ID NO: 1508996 - DNA, 23 bp, Homo sapiens
atacactttgttgcaagatgtga

SEQ ID NO: 1508997 - DNA, 23 bp, Homo sapiens
atacagaaagatggatgtgcttt

SEQ ID NO: 1508998 - DNA, 13 bp, Homo sapiens
atacagaaatgca

SEQ ID NO: 1508999 - DNA, 14 bp, Homo sapiens
atacagacactaag

SEQ ID NO: 1509000 - DNA, 18 bp, Homo sapiens
atacagacactaagttat

SEQ ID NO: 1509001 - DNA, 12 bp, Homo sapiens
atacagaggaga

SEQ ID NO: 1509002 - DNA, 15 bp, Homo sapiens
atacagaggatgcct

SEQ ID NO: 1509003 - DNA, 21 bp, Homo sapiens
atacagaggatgccttttctg

SEQ ID NO: 1509004 - DNA, 23 bp, Homo sapiens
atacagaggatgccttttctgtg

SEQ ID NO: 1509005 - DNA, 17 bp, Homo sapiens
atacagataaatgattc

SEQ ID NO: 1509006 - DNA, 23 bp, Homo sapiens
atacagatagatatatgctctgc

SEQ ID NO: 1509007 - DNA, 22 bp, Homo sapiens
atacagcctctacagccgtccc

SEQ ID NO: 1509008 - DNA, 17 bp, Homo sapiens
atacaggaatgaagcct

SEQ ID NO: 1509009 - DNA, 18 bp, Homo sapiens
atacagtaactttatgtg

SEQ ID NO: 1509010 - DNA, 13 bp, Homo sapiens
atacagtaagcat

SEQ ID NO: 1509011 - DNA, 17 bp, Homo sapiens
atacagtgaagagtaag

SEQ ID NO: 1509012 - DNA, 19 bp, Homo sapiens
atacagtgagctctagcaa

SEQ ID NO: 1509013 - DNA, 23 bp, Homo sapiens
atacagtgcagagccttctcaga

SEQ ID NO: 1509014 - DNA, 16 bp, Homo sapiens
atacagtgtacatgta

SEQ ID NO: 1509015 - DNA, 14 bp, Homo sapiens
atacagtgttattt

SEQ ID NO: 1509016 - DNA, 15 bp, Homo sapiens
atacagtgttatttt

SEQ ID NO: 1509017 - DNA, 16 bp, Homo sapiens
atacagttgttggcct

SEQ ID NO: 1509018 - DNA, 21 bp, Homo sapiens
atacagtttatttttaaagat

SEQ ID NO: 1509019 - DNA, 17 bp, Homo sapiens
atacataagcagcattt

SEQ ID NO: 1509020 - DNA, 13 bp, Homo sapiens
atacataataaaa

SEQ ID NO: 1509021 - DNA, 19 bp, Homo sapiens
atacataatatatgacttc

SEQ ID NO: 1509022 - DNA, 22 bp, Homo sapiens
atacataatatatgacttccta

SEQ ID NO: 1509023 - DNA, 16 bp, Homo sapiens
atacatagatcttcat

SEQ ID NO: 1509024 - DNA, 18 bp, Homo sapiens
atacatagtgaaaattgt

SEQ ID NO: 1509025 - DNA, 15 bp, Homo sapiens
atacatatgagaata

SEQ ID NO: 1509026 - DNA, 22 bp, Homo sapiens
atacatattgtatatatattca

SEQ ID NO: 1509027 - DNA, 16 bp, Homo sapiens
atacatcagaaaataa

SEQ ID NO: 1509028 - DNA, 19 bp, Homo sapiens
atacatcagaaaataaaat

SEQ ID NO: 1509029 - DNA, 23 bp, Homo sapiens
atacatctaagtcagtttcacat

SEQ ID NO: 1509030 - DNA, 10 bp, Homo sapiens
atacatgcca

SEQ ID NO: 1509031 - DNA, 21 bp, Homo sapiens
atacatgccacatcaaacctt

SEQ ID NO: 1509032 - DNA, 15 bp, Homo sapiens
atacatgctgctaat

SEQ ID NO: 1509033 - DNA, 14 bp, Homo sapiens
atacatggttgtga

SEQ ID NO: 1509034 - DNA, 21 bp, Homo sapiens
atacatgtactccagagggac

SEQ ID NO: 1509035 - DNA, 16 bp, Homo sapiens
atacatgtgatacatt

SEQ ID NO: 1509036 - DNA, 19 bp, Homo sapiens
atacatgtgatacattttt

SEQ ID NO: 1509037 - DNA, 22 bp, Homo sapiens
atacatgtgtacatatatgtat

SEQ ID NO: 1509038 - DNA, 16 bp, Homo sapiens
atacatgtttatgtaa

SEQ ID NO: 1509039 - DNA, 19 bp, Homo sapiens
atacatgtttatgtaaaca

SEQ ID NO: 1509040 - DNA, 17 bp, Homo sapiens
atacattataacaacta

SEQ ID NO: 1509041 - DNA, 16 bp, Homo sapiens
atacattccattgttt

SEQ ID NO: 1509042 - DNA, 22 bp, Homo sapiens
atacattccattgttttagtaa

SEQ ID NO: 1509043 - DNA, 14 bp, Homo sapiens
atacattctttgct

SEQ ID NO: 1509044 - DNA, 12 bp, Homo sapiens
atacattctttt

SEQ ID NO: 1509045 - DNA, 22 bp, Homo sapiens
atacattgtacgaagagtattt

SEQ ID NO: 1509046 - DNA, 14 bp, Homo sapiens
atacattgtgtgaa

SEQ ID NO: 1509047 - DNA, 13 bp, Homo sapiens
atacatttaataa

SEQ ID NO: 1509048 - DNA, 18 bp, Homo sapiens
atacatttaataaaactg

SEQ ID NO: 1509049 - DNA, 21 bp, Homo sapiens
atacatttataatgtttgcta

SEQ ID NO: 1509050 - DNA, 21 bp, Homo sapiens
atacatttctcctttgataaa

SEQ ID NO: 1509051 - DNA, 18 bp, Homo sapiens
atagccctgccctcccaa

SEQ ID NO: 1509052 - DNA, 14 bp, Homo sapiens
atagccgggcatgg

SEQ ID NO: 1509053 - DNA, 18 bp, Homo sapiens
atagccgggcatggtggc

SEQ ID NO: 1509054 - DNA, 21 bp, Homo sapiens
atagcgctgtttttgttgtgt

SEQ ID NO: 1509055 - DNA, 17 bp, Homo sapiens
atagctaactgtaaatc

SEQ ID NO: 1509056 - DNA, 16 bp, Homo sapiens
atagctacaggaagca

SEQ ID NO: 1509057 - DNA, 16 bp, Homo sapiens
atagctacatgttctt

SEQ ID NO: 1509058 - DNA, 17 bp, Homo sapiens
atagctacatgttcttt

SEQ ID NO: 1509059 - DNA, 21 bp, Homo sapiens
atagctacatgttctttgtac

SEQ ID NO: 1509060 - DNA, 14 bp, Homo sapiens
atagctcaagaatt

SEQ ID NO: 1509061 - DNA, 17 bp, Homo sapiens
atagctgagattcctgg

SEQ ID NO: 1509062 - DNA, 15 bp, Homo sapiens
atagctgtacttctt

SEQ ID NO: 1509063 - DNA, 22 bp, Homo sapiens
atagctgtacttcttgaatata

SEQ ID NO: 1509064 - DNA, 15 bp, Homo sapiens
atagcttacactgag

SEQ ID NO: 1509065 - DNA, 16 bp, Homo sapiens
atagcttacctgaaca

SEQ ID NO: 1509066 - DNA, 14 bp, Homo sapiens
atagcttctgtgtg

SEQ ID NO: 1509067 - DNA, 20 bp, Homo sapiens
atagcttctgtgtgtgagct

SEQ ID NO: 1509068 - DNA, 17 bp, Homo sapiens
atagcttgcagaactgt

SEQ ID NO: 1509069 - DNA, 17 bp, Homo sapiens
atagctttaaaagggaa

SEQ ID NO: 1509070 - DNA, 18 bp, Homo sapiens
atagctttattttttaag

SEQ ID NO: 1509071 - DNA, 22 bp, Homo sapiens
ataggaaaacattgcaataaat

SEQ ID NO: 1509072 - DNA, 19 bp, Homo sapiens
ataggaaaagtacatttaa

SEQ ID NO: 1509073 - DNA, 21 bp, Homo sapiens
ataggaaagtatttttttaag

SEQ ID NO: 1509074 - DNA, 15 bp, Homo sapiens
ataggaacatatgaa

SEQ ID NO: 1509075 - DNA, 19 bp, Homo sapiens
ataggaagcgtctggcaga

SEQ ID NO: 1509076 - DNA, 17 bp, Homo sapiens
ataggacgtatttataa

SEQ ID NO: 1509077 - DNA, 19 bp, Homo sapiens
ataggactaccgcaggccc

SEQ ID NO: 1509078 - DNA, 20 bp, Homo sapiens
ataggactaccgcaggcccg

SEQ ID NO: 1509079 - DNA, 20 bp, Homo sapiens
ataggagaaagcaaaataca

SEQ ID NO: 1509080 - DNA, 14 bp, Homo sapiens
ataggagactgcgt

SEQ ID NO: 1509081 - DNA, 23 bp, Homo sapiens
ataggaggagctctcaattttat

SEQ ID NO: 1509082 - DNA, 22 bp, Homo sapiens
ataggataatatacttccaatg

SEQ ID NO: 1509083 - DNA, 14 bp, Homo sapiens
ataggcagaatgga

SEQ ID NO: 1509084 - DNA, 17 bp, Homo sapiens
ataggcagactgggttt

SEQ ID NO: 1509085 - DNA, 18 bp, Homo sapiens
ataggcagcttctaagag

SEQ ID NO: 1509086 - DNA, 13 bp, Homo sapiens
ataggcaggaagc

SEQ ID NO: 1509087 - DNA, 20 bp, Homo sapiens
ataggcaggaagcccaattg

SEQ ID NO: 1509088 - DNA, 11 bp, Homo sapiens
ataggcagggg

SEQ ID NO: 1509089 - DNA, 14 bp, Homo sapiens
ataggcagggggcc

SEQ ID NO: 1509090 - DNA, 20 bp, Homo sapiens
ataggcagggggccctgccc

SEQ ID NO: 1509091 - DNA, 14 bp, Homo sapiens
ataggcctgggtgc

SEQ ID NO: 1509092 - DNA, 20 bp, Homo sapiens
ataggcctgtcccttgcctc

SEQ ID NO: 1509093 - DNA, 22 bp, Homo sapiens
ataggcctgtcccttgcctctg

SEQ ID NO: 1509094 - DNA, 23 bp, Homo sapiens
ataggcctgtcccttgcctctgc

SEQ ID NO: 1509095 - DNA, 11 bp, Homo sapiens
ataggctctgc

SEQ ID NO: 1509096 - DNA, 15 bp, Homo sapiens
ataggctctgcacag

SEQ ID NO: 1509097 - DNA, 22 bp, Homo sapiens
ataggctctgcacagatggatt

SEQ ID NO: 1509098 - DNA, 22 bp, Homo sapiens
atagggaaaattctaacccagg

SEQ ID NO: 1509099 - DNA, 17 bp, Homo sapiens
atagggaatatatctct

SEQ ID NO: 1509100 - DNA, 20 bp, Homo sapiens
atagggagaatatttactaa

SEQ ID NO: 1509101 - DNA, 23 bp, Homo sapiens
atagggatgaactttttcctggc

SEQ ID NO: 1509102 - DNA, 22 bp, Homo sapiens
atagggcctggtccctgggagg

SEQ ID NO: 1509103 - DNA, 18 bp, Homo sapiens
ataggggatatttaaggt

SEQ ID NO: 1509104 - DNA, 15 bp, Homo sapiens
atagggtatttgacc

SEQ ID NO: 1509105 - DNA, 16 bp, Homo sapiens
atagggtctcttcagg

SEQ ID NO: 1509106 - DNA, 21 bp, Homo sapiens
atagggtctcttcaggttctt

SEQ ID NO: 1509107 - DNA, 16 bp, Homo sapiens
ataggtatatagaaca

SEQ ID NO: 1509108 - DNA, 15 bp, Homo sapiens
ataggtcactcctgg

SEQ ID NO: 1509109 - DNA, 16 bp, Homo sapiens
ataggtcactcctggg

SEQ ID NO: 1509110 - DNA, 16 bp, Homo sapiens
ataggtcactggctct

SEQ ID NO: 1509111 - DNA, 20 bp, Homo sapiens
ataggtcctgtgttaaacac

SEQ ID NO: 1509112 - DNA, 16 bp, Homo sapiens
ataggtcctttagaaa

SEQ ID NO: 1509113 - DNA, 17 bp, Homo sapiens
ataggtcctttagaaac

SEQ ID NO: 1509114 - DNA, 14 bp, Homo sapiens
ataggtctcatctc

SEQ ID NO: 1509115 - DNA, 18 bp, Homo sapiens
ataggtctcatctcttca

SEQ ID NO: 1509116 - DNA, 18 bp, Homo sapiens
atattattataatcttat

SEQ ID NO: 1509117 - DNA, 13 bp, Homo sapiens
atattatttcttc

SEQ ID NO: 1509118 - DNA, 14 bp, Homo sapiens
atattatttcttct

SEQ ID NO: 1509119 - DNA, 15 bp, Homo sapiens
atattatttcttctc

SEQ ID NO: 1509120 - DNA, 17 bp, Homo sapiens
atattcaatgcatttaa

SEQ ID NO: 1509121 - DNA, 16 bp, Homo sapiens
atattcacacttgaac

SEQ ID NO: 1509122 - DNA, 12 bp, Homo sapiens
atattcagaaat

SEQ ID NO: 1509123 - DNA, 14 bp, Homo sapiens
atattcagcatttg

SEQ ID NO: 1509124 - DNA, 17 bp, Homo sapiens
atattcagccagcttaa

SEQ ID NO: 1509125 - DNA, 19 bp, Homo sapiens
atattcagccagcttaaac

SEQ ID NO: 1509126 - DNA, 18 bp, Homo sapiens
atattcaggctactcatt

SEQ ID NO: 1509127 - DNA, 21 bp, Homo sapiens
atattcaggctactcattcag

SEQ ID NO: 1509128 - DNA, 22 bp, Homo sapiens
atattcaggctactcattcagt

SEQ ID NO: 1509129 - DNA, 17 bp, Homo sapiens
atattcaggtggccaga

SEQ ID NO: 1509130 - DNA, 22 bp, Homo sapiens
atattcagtgctgtggcctggg

SEQ ID NO: 1509131 - DNA, 23 bp, Homo sapiens
atattcagtgctgtggcctgggc

SEQ ID NO: 1509132 - DNA, 19 bp, Homo sapiens
atattcatgaaatgtggaa

SEQ ID NO: 1509133 - DNA, 19 bp, Homo sapiens
atattccaacccagccacg

SEQ ID NO: 1509134 - DNA, 18 bp, Homo sapiens
atattccaccattcacat

SEQ ID NO: 1509135 - DNA, 19 bp, Homo sapiens
atattccaccattcacatt

SEQ ID NO: 1509136 - DNA, 17 bp, Homo sapiens
atattccagttttctct

SEQ ID NO: 1509137 - DNA, 19 bp, Homo sapiens
atattccagttttctctgc

SEQ ID NO: 1509138 - DNA, 21 bp, Homo sapiens
atattccatttacataaggat

SEQ ID NO: 1509139 - DNA, 19 bp, Homo sapiens
atattccgtatttaaagtt

SEQ ID NO: 1509140 - DNA, 15 bp, Homo sapiens
atattcctgaatgaa

SEQ ID NO: 1509141 - DNA, 20 bp, Homo sapiens
atattcctggacttacaaaa

SEQ ID NO: 1509142 - DNA, 13 bp, Homo sapiens
atattctaagact

SEQ ID NO: 1509143 - DNA, 23 bp, Homo sapiens
atattctaagacttactctaaga

SEQ ID NO: 1509144 - DNA, 21 bp, Homo sapiens
atattctacacatgtaaaata

SEQ ID NO: 1509145 - DNA, 19 bp, Homo sapiens
atattctactggcctgtaa

SEQ ID NO: 1509146 - DNA, 22 bp, Homo sapiens
atattctcacgggcagtagctg

SEQ ID NO: 1509147 - DNA, 13 bp, Homo sapiens
atattctccctga

SEQ ID NO: 1509148 - DNA, 14 bp, Homo sapiens
atattctgttgctt

SEQ ID NO: 1509149 - DNA, 16 bp, Homo sapiens
atattctgttgcttta

SEQ ID NO: 1509150 - DNA, 19 bp, Homo sapiens
atattcttgctttcacaaa

SEQ ID NO: 1509151 - DNA, 13 bp, Homo sapiens
atattctttgaaa

SEQ ID NO: 1509152 - DNA, 14 bp, Homo sapiens
atattgaaaattga

SEQ ID NO: 1509153 - DNA, 16 bp, Homo sapiens
atattgaaaattgaaa

SEQ ID NO: 1509154 - DNA, 20 bp, Homo sapiens
atattgaaaattgaaaagta

SEQ ID NO: 1509155 - DNA, 21 bp, Homo sapiens
atattgaaaattgaaaagtac

SEQ ID NO: 1509156 - DNA, 15 bp, Homo sapiens
atattgaagacaatt

SEQ ID NO: 1509157 - DNA, 17 bp, Homo sapiens
atattgaagacaatttg

SEQ ID NO: 1509158 - DNA, 13 bp, Homo sapiens
atattgaatgtta

SEQ ID NO: 1509159 - DNA, 22 bp, Homo sapiens
atattgagatcagcattcaaaa

SEQ ID NO: 1509160 - DNA, 16 bp, Homo sapiens
atattgatgttaacaa

SEQ ID NO: 1509161 - DNA, 21 bp, Homo sapiens
atattgattgggaaaacattt

SEQ ID NO: 1509162 - DNA, 16 bp, Homo sapiens
atattgattgtccttt

SEQ ID NO: 1509163 - DNA, 18 bp, Homo sapiens
atattgcagattgaatat

SEQ ID NO: 1509164 - DNA, 21 bp, Homo sapiens
atattgccttatttgtctgta

SEQ ID NO: 1509165 - DNA, 16 bp, Homo sapiens
atattgctaattgtgt

SEQ ID NO: 1509166 - DNA, 23 bp, Homo sapiens
atattgctgtgtcttcattttca

SEQ ID NO: 1509167 - DNA, 24 bp, Homo sapiens
atattgctgtgtcttcattttcat

SEQ ID NO: 1509168 - DNA, 15 bp, Homo sapiens
atattggtgcgtttt

SEQ ID NO: 1509169 - DNA, 22 bp, Homo sapiens
atattggtgcgtttttacagtt

SEQ ID NO: 1509170 - DNA, 16 bp, Homo sapiens
atattgtaaatactgg

SEQ ID NO: 1509171 - DNA, 15 bp, Homo sapiens
atattgtacaaatgt

SEQ ID NO: 1509172 - DNA, 17 bp, Homo sapiens
atattgtacataaaaga

SEQ ID NO: 1509173 - DNA, 22 bp, Homo sapiens
atattgtagcagttacagctct

SEQ ID NO: 1509174 - DNA, 24 bp, Homo sapiens
atattgtagcagttacagctctgt

SEQ ID NO: 1509175 - DNA, 15 bp, Homo sapiens
atattgtcagatatt

SEQ ID NO: 1509176 - DNA, 17 bp, Homo sapiens
atattgtgattctgcct

SEQ ID NO: 1509177 - DNA, 19 bp, Homo sapiens
atattgtgattctgccttt

SEQ ID NO: 1509178 - DNA, 18 bp, Homo sapiens
atattgtggatgtgttca

SEQ ID NO: 1509179 - DNA, 11 bp, Homo sapiens
atattgtgtaa

SEQ ID NO: 1509180 - DNA, 21 bp, Homo sapiens
atattgtgtaatttaagtgac

SEQ ID NO: 1509181 - DNA, 15 bp, Homo sapiens
atattgttaaatcct

SEQ ID NO: 1509182 - DNA, 13 bp, Homo sapiens
atattgttgacaa

SEQ ID NO: 1509183 - DNA, 14 bp, Homo sapiens
atattgtttggtaa

SEQ ID NO: 1509184 - DNA, 18 bp, Homo sapiens
atattgtttggtaaatgt

SEQ ID NO: 1509185 - DNA, 17 bp, Homo sapiens
atattgttttcagtgta

SEQ ID NO: 1509186 - DNA, 19 bp, Homo sapiens
atattgttttctgtaaata

SEQ ID NO: 1509187 - DNA, 16 bp, Homo sapiens
atatttaaaaattgtt

SEQ ID NO: 1509188 - DNA, 20 bp, Homo sapiens
atatttaaaaattgtttctt

SEQ ID NO: 1509189 - DNA, 15 bp, Homo sapiens
atatttaacaatgac

SEQ ID NO: 1509190 - DNA, 19 bp, Homo sapiens
atatttaacattatttata

SEQ ID NO: 1509191 - DNA, 15 bp, Homo sapiens
atatttaagtgtatt

SEQ ID NO: 1509192 - DNA, 15 bp, Homo sapiens
atatttaatatcaaa

SEQ ID NO: 1509193 - DNA, 15 bp, Homo sapiens
atatttaatgttgaa

SEQ ID NO: 1509194 - DNA, 21 bp, Homo sapiens
atatttaatgttgaacaaaat

SEQ ID NO: 1509195 - DNA, 16 bp, Homo sapiens
atatttaccaaagtag

SEQ ID NO: 1509196 - DNA, 15 bp, Homo sapiens
atatttactgttaga

SEQ ID NO: 1509197 - DNA, 18 bp, Homo sapiens
atatttagcatccctgga

SEQ ID NO: 1509198 - DNA, 21 bp, Homo sapiens
atatttaggcctcttgaattt

SEQ ID NO: 1509199 - DNA, 20 bp, Homo sapiens
atatttagtaaagcttttct

SEQ ID NO: 1509200 - DNA, 16 bp, Homo sapiens
atatttataacagcat

SEQ ID NO: 1509201 - DNA, 14 bp, Homo sapiens
atcagacaagtgtt

SEQ ID NO: 1509202 - DNA, 19 bp, Homo sapiens
atcctcagttggaatcatt

SEQ ID NO: 1509203 - DNA, 16 bp, Homo sapiens
atcctcatatggccca

SEQ ID NO: 1509204 - DNA, 23 bp, Homo sapiens
atcctcatcgggctttgtccctc

SEQ ID NO: 1509205 - DNA, 14 bp, Homo sapiens
atcctccacagaga

SEQ ID NO: 1509206 - DNA, 15 bp, Homo sapiens
atcctccacagagag

SEQ ID NO: 1509207 - DNA, 16 bp, Homo sapiens
atcctccacagagagg

SEQ ID NO: 1509208 - DNA, 22 bp, Homo sapiens
atcctccctacttccaagaaaa

SEQ ID NO: 1509209 - DNA, 19 bp, Homo sapiens
atcctccctggcagacaca

SEQ ID NO: 1509210 - DNA, 19 bp, Homo sapiens
atcctcctccccagctctt

SEQ ID NO: 1509211 - DNA, 16 bp, Homo sapiens
atcctctaaagcagag

SEQ ID NO: 1509212 - DNA, 13 bp, Homo sapiens
atcctctctcccc

SEQ ID NO: 1509213 - DNA, 14 bp, Homo sapiens
atcctctctctctt

SEQ ID NO: 1509214 - DNA, 15 bp, Homo sapiens
atcctctcttcctct

SEQ ID NO: 1509215 - DNA, 16 bp, Homo sapiens
atcctctcttcctctt

SEQ ID NO: 1509216 - DNA, 21 bp, Homo sapiens
atcctgagagacctgccctct

SEQ ID NO: 1509217 - DNA, 24 bp, Homo sapiens
atcctgagccatcggtgaaactaa

SEQ ID NO: 1509218 - DNA, 21 bp, Homo sapiens
atcctgagctcaaatctctgt

SEQ ID NO: 1509219 - DNA, 19 bp, Homo sapiens
atcctgataaacattaaac

SEQ ID NO: 1509220 - DNA, 15 bp, Homo sapiens
atcctgattccaaat

SEQ ID NO: 1509221 - DNA, 15 bp, Homo sapiens
atcctgattcctctc

SEQ ID NO: 1509222 - DNA, 17 bp, Homo sapiens
atcctgcaatgaaaggt

SEQ ID NO: 1509223 - DNA, 13 bp, Homo sapiens
atcctgcacccca

SEQ ID NO: 1509224 - DNA, 16 bp, Homo sapiens
atcctgcagcctcctc

SEQ ID NO: 1509225 - DNA, 20 bp, Homo sapiens
atcctgcagcctcctcctga

SEQ ID NO: 1509226 - DNA, 21 bp, Homo sapiens
atcctgcaggaacgagcactg

SEQ ID NO: 1509227 - DNA, 22 bp, Homo sapiens
atcctgcaggaacgagcactgg

SEQ ID NO: 1509228 - DNA, 21 bp, Homo sapiens
atcctgcccagtgttgtttgt

SEQ ID NO: 1509229 - DNA, 15 bp, Homo sapiens
atcctgctcttttgt

SEQ ID NO: 1509230 - DNA, 21 bp, Homo sapiens
atcctgcttctgatatgcagt

SEQ ID NO: 1509231 - DNA, 18 bp, Homo sapiens
atcctggaaggacacagt

SEQ ID NO: 1509232 - DNA, 20 bp, Homo sapiens
atcctggaaggacacagtga

SEQ ID NO: 1509233 - DNA, 23 bp, Homo sapiens
atcctggaaggacacagtgatga

SEQ ID NO: 1509234 - DNA, 17 bp, Homo sapiens
atcctggaggcccagtt

SEQ ID NO: 1509235 - DNA, 12 bp, Homo sapiens
atcctggcagcc

SEQ ID NO: 1509236 - DNA, 13 bp, Homo sapiens
atcctggcagccc

SEQ ID NO: 1509237 - DNA, 24 bp, Homo sapiens
atcctggcagcccagagactttgt

SEQ ID NO: 1509238 - DNA, 11 bp, Homo sapiens
atcctggcccc

SEQ ID NO: 1509239 - DNA, 14 bp, Homo sapiens
atcctggcccctcc

SEQ ID NO: 1509240 - DNA, 16 bp, Homo sapiens
atcctgggatgtaaac

SEQ ID NO: 1509241 - DNA, 12 bp, Homo sapiens
atcctgggctgg

SEQ ID NO: 1509242 - DNA, 19 bp, Homo sapiens
atcctggggcagcactccc

SEQ ID NO: 1509243 - DNA, 19 bp, Homo sapiens
atcctggttaccactcttt

SEQ ID NO: 1509244 - DNA, 19 bp, Homo sapiens
atcctgtctctaaaaagaa

SEQ ID NO: 1509245 - DNA, 21 bp, Homo sapiens
atcctgtgactgtctcactta

SEQ ID NO: 1509246 - DNA, 23 bp, Homo sapiens
atcctgtgccagaggaaggaaaa

SEQ ID NO: 1509247 - DNA, 21 bp, Homo sapiens
atcctgtgtggagagggaatg

SEQ ID NO: 1509248 - DNA, 18 bp, Homo sapiens
atcctgtgtttctaggga

SEQ ID NO: 1509249 - DNA, 18 bp, Homo sapiens
atcctgttactctgtccc

SEQ ID NO: 1509250 - DNA, 16 bp, Homo sapiens
atccttaaatatgtga

SEQ ID NO: 1509251 - DNA, 15 bp, Homo sapiens
atccttaacatttct

SEQ ID NO: 1509252 - DNA, 13 bp, Homo sapiens
atccttagaggtc

SEQ ID NO: 1509253 - DNA, 19 bp, Homo sapiens
atccttagaggtcctctgg

SEQ ID NO: 1509254 - DNA, 18 bp, Homo sapiens
atccttcaaaataaaaag

SEQ ID NO: 1509255 - DNA, 20 bp, Homo sapiens
atccttcaaaataaaaagta

SEQ ID NO: 1509256 - DNA, 20 bp, Homo sapiens
atccttcaccagagcccatg

SEQ ID NO: 1509257 - DNA, 15 bp, Homo sapiens
atccttcagcacagg

SEQ ID NO: 1509258 - DNA, 14 bp, Homo sapiens
atccttccatcttg

SEQ ID NO: 1509259 - DNA, 14 bp, Homo sapiens
atccttcccagcag

SEQ ID NO: 1509260 - DNA, 14 bp, Homo sapiens
atccttccccaact

SEQ ID NO: 1509261 - DNA, 21 bp, Homo sapiens
atccttccccaacttccctag

SEQ ID NO: 1509262 - DNA, 16 bp, Homo sapiens
atccttcccctctttt

SEQ ID NO: 1509263 - DNA, 18 bp, Homo sapiens
atccttcccctcttttgg

SEQ ID NO: 1509264 - DNA, 15 bp, Homo sapiens
atccttcctaaaccc

SEQ ID NO: 1509265 - DNA, 11 bp, Homo sapiens
atccttccttc

SEQ ID NO: 1509266 - DNA, 12 bp, Homo sapiens
atccttccttca

SEQ ID NO: 1509267 - DNA, 14 bp, Homo sapiens
atccttccttccca

SEQ ID NO: 1509268 - DNA, 17 bp, Homo sapiens
atccttctagtttccca

SEQ ID NO: 1509269 - DNA, 14 bp, Homo sapiens
atccttctgagctc

SEQ ID NO: 1509270 - DNA, 22 bp, Homo sapiens
atccttgatgcaagtgcaacct

SEQ ID NO: 1509271 - DNA, 20 bp, Homo sapiens
atccttggagtcccaggggc

SEQ ID NO: 1509272 - DNA, 17 bp, Homo sapiens
atccttgggggctccca

SEQ ID NO: 1509273 - DNA, 22 bp, Homo sapiens
atccttgggggctcccagggca

SEQ ID NO: 1509274 - DNA, 16 bp, Homo sapiens
atccttggtgctgtgt

SEQ ID NO: 1509275 - DNA, 12 bp, Homo sapiens
atccttgtaata

SEQ ID NO: 1509276 - DNA, 13 bp, Homo sapiens
atccttgtaatac

SEQ ID NO: 1509277 - DNA, 23 bp, Homo sapiens
atccttgtctttactgacaagaa

SEQ ID NO: 1509278 - DNA, 20 bp, Homo sapiens
atccttgtgttcagctcttt

SEQ ID NO: 1509279 - DNA, 14 bp, Homo sapiens
atccttgtttcaaa

SEQ ID NO: 1509280 - DNA, 21 bp, Homo sapiens
atcctttgcttcattccaaat

SEQ ID NO: 1509281 - DNA, 23 bp, Homo sapiens
atcctttgttttctgactaatta

SEQ ID NO: 1509282 - DNA, 14 bp, Homo sapiens
atccttttccttat

SEQ ID NO: 1509283 - DNA, 21 bp, Homo sapiens
atccttttccttatttgcctt

SEQ ID NO: 1509284 - DNA, 19 bp, Homo sapiens
atctatggcagtccagcca

SEQ ID NO: 1509285 - DNA, 17 bp, Homo sapiens
atctatggtcgggagac

SEQ ID NO: 1509286 - DNA, 16 bp, Homo sapiens
atctatgtttgtgtga

SEQ ID NO: 1509287 - DNA, 17 bp, Homo sapiens
atctatgtttgtgtgat

SEQ ID NO: 1509288 - DNA, 21 bp, Homo sapiens
atctatgtttgtgtgatttcc

SEQ ID NO: 1509289 - DNA, 22 bp, Homo sapiens
atctatgtttgtgtgatttcct

SEQ ID NO: 1509290 - DNA, 14 bp, Homo sapiens
atctattaatatat

SEQ ID NO: 1509291 - DNA, 15 bp, Homo sapiens
atctattaatatatg

SEQ ID NO: 1509292 - DNA, 14 bp, Homo sapiens
atctattatactgt

SEQ ID NO: 1509293 - DNA, 18 bp, Homo sapiens
atctattctgagaaaaca

SEQ ID NO: 1509294 - DNA, 12 bp, Homo sapiens
atctattgctca

SEQ ID NO: 1509295 - DNA, 16 bp, Homo sapiens
atctatttcgagtgtt

SEQ ID NO: 1509296 - DNA, 15 bp, Homo sapiens
atctatttctatgag

SEQ ID NO: 1509297 - DNA, 18 bp, Homo sapiens
atctatttgtacaatttt

SEQ ID NO: 1509298 - DNA, 23 bp, Homo sapiens
atctatttttggcagtctgaatt

SEQ ID NO: 1509299 - DNA, 15 bp, Homo sapiens
atctcaaaactgcac

SEQ ID NO: 1509300 - DNA, 12 bp, Homo sapiens
atctcaaaatta

SEQ ID NO: 1509301 - DNA, 16 bp, Homo sapiens
atctcaaaggagaaaa

SEQ ID NO: 1509302 - DNA, 14 bp, Homo sapiens
atctcaaataacta

SEQ ID NO: 1509303 - DNA, 20 bp, Homo sapiens
atctcaaataggctattaaa

SEQ ID NO: 1509304 - DNA, 23 bp, Homo sapiens
atctcaaataggctattaaaaaa

SEQ ID NO: 1509305 - DNA, 18 bp, Homo sapiens
atctcaagatattcaggt

SEQ ID NO: 1509306 - DNA, 23 bp, Homo sapiens
atctcaagatgggggcagggctg

SEQ ID NO: 1509307 - DNA, 14 bp, Homo sapiens
atctcaagccagcc

SEQ ID NO: 1509308 - DNA, 15 bp, Homo sapiens
atctcaagccagccc

SEQ ID NO: 1509309 - DNA, 18 bp, Homo sapiens
atctcaagtatatgtcat

SEQ ID NO: 1509310 - DNA, 14 bp, Homo sapiens
atctcacaggctga

SEQ ID NO: 1509311 - DNA, 13 bp, Homo sapiens
atctcaccccatc

SEQ ID NO: 1509312 - DNA, 12 bp, Homo sapiens
atctcagaaagt

SEQ ID NO: 1509313 - DNA, 16 bp, Homo sapiens
atctcagaaagtgcct

SEQ ID NO: 1509314 - DNA, 18 bp, Homo sapiens
atctcagaaagtgcctga

SEQ ID NO: 1509315 - DNA, 19 bp, Homo sapiens
atctcagaaagtgcctgac

SEQ ID NO: 1509316 - DNA, 12 bp, Homo sapiens
atctcagagaca

SEQ ID NO: 1509317 - DNA, 19 bp, Homo sapiens
atctcagagacaggtggcc

SEQ ID NO: 1509318 - DNA, 14 bp, Homo sapiens
atctcagatatttg

SEQ ID NO: 1509319 - DNA, 15 bp, Homo sapiens
atctcagatatttgc

SEQ ID NO: 1509320 - DNA, 15 bp, Homo sapiens
atctcagctcactac

SEQ ID NO: 1509321 - DNA, 18 bp, Homo sapiens
atctcagcttttctgtcc

SEQ ID NO: 1509322 - DNA, 14 bp, Homo sapiens
atctcaggagatgg

SEQ ID NO: 1509323 - DNA, 18 bp, Homo sapiens
atctcaggagatttcatg

SEQ ID NO: 1509324 - DNA, 16 bp, Homo sapiens
atctcaggagcttgca

SEQ ID NO: 1509325 - DNA, 17 bp, Homo sapiens
atctcagggaagcccag

SEQ ID NO: 1509326 - DNA, 20 bp, Homo sapiens
atctcagggaagcccagctc

SEQ ID NO: 1509327 - DNA, 20 bp, Homo sapiens
atctcaggggctgtttgagg

SEQ ID NO: 1509328 - DNA, 21 bp, Homo sapiens
atctcaggggctgtttgagga

SEQ ID NO: 1509329 - DNA, 16 bp, Homo sapiens
atctcaggtgccactc

SEQ ID NO: 1509330 - DNA, 17 bp, Homo sapiens
atctcataatttataca

SEQ ID NO: 1509331 - DNA, 15 bp, Homo sapiens
atctcatacctctga

SEQ ID NO: 1509332 - DNA, 15 bp, Homo sapiens
atctcatcctggcac

SEQ ID NO: 1509333 - DNA, 16 bp, Homo sapiens
atctcattcagtatta

SEQ ID NO: 1509334 - DNA, 16 bp, Homo sapiens
atctccagcggccctg

SEQ ID NO: 1509335 - DNA, 20 bp, Homo sapiens
atctccaggcaaaaggagtg

SEQ ID NO: 1509336 - DNA, 16 bp, Homo sapiens
atctccagggagcaag

SEQ ID NO: 1509337 - DNA, 21 bp, Homo sapiens
atctccagggagtcccctccc

SEQ ID NO: 1509338 - DNA, 16 bp, Homo sapiens
atctccagggctccaa

SEQ ID NO: 1509339 - DNA, 12 bp, Homo sapiens
atctccccaggc

SEQ ID NO: 1509340 - DNA, 15 bp, Homo sapiens
atctccccaggcctc

SEQ ID NO: 1509341 - DNA, 16 bp, Homo sapiens
atctccccaggcctcc

SEQ ID NO: 1509342 - DNA, 22 bp, Homo sapiens
atctccccaggcctccagcctc

SEQ ID NO: 1509343 - DNA, 23 bp, Homo sapiens
atctcccccatcccccactgcca

SEQ ID NO: 1509344 - DNA, 13 bp, Homo sapiens
atctcccctcctc

SEQ ID NO: 1509345 - DNA, 16 bp, Homo sapiens
atctcccctcctcaca

SEQ ID NO: 1509346 - DNA, 15 bp, Homo sapiens
atctcccgctgctgc

SEQ ID NO: 1509347 - DNA, 21 bp, Homo sapiens
atctccctcactgaaaccagg

SEQ ID NO: 1509348 - DNA, 13 bp, Homo sapiens
atctccctgcctg

SEQ ID NO: 1509349 - DNA, 14 bp, Homo sapiens
atctccctgcctgg

SEQ ID NO: 1509350 - DNA, 15 bp, Homo sapiens
atctccctgcctggc

SEQ ID NO: 1509351 - DNA, 13 bp, Homo sapiens
atctccctggctc

SEQ ID NO: 1509352 - DNA, 19 bp, Homo sapiens
atctccgcctccacactga

SEQ ID NO: 1509353 - DNA, 16 bp, Homo sapiens
atctcctaacaaaaga

SEQ ID NO: 1509354 - DNA, 17 bp, Homo sapiens
atctcctaacaaaagaa

SEQ ID NO: 1509355 - DNA, 17 bp, Homo sapiens
atctcctgacagaaggt

SEQ ID NO: 1509356 - DNA, 18 bp, Homo sapiens
atctcctgacagaaggtg

SEQ ID NO: 1509357 - DNA, 17 bp, Homo sapiens
atctcctggtgttctgc

SEQ ID NO: 1509358 - DNA, 16 bp, Homo sapiens
atctccttcccccagc

SEQ ID NO: 1509359 - DNA, 20 bp, Homo sapiens
atctccttcccccagcccaa

SEQ ID NO: 1509360 - DNA, 18 bp, Homo sapiens
atctccttcccttctctt

SEQ ID NO: 1509361 - DNA, 19 bp, Homo sapiens
atctccttcccttctcttg

SEQ ID NO: 1509362 - DNA, 20 bp, Homo sapiens
atctccttcccttctcttgg

SEQ ID NO: 1509363 - DNA, 21 bp, Homo sapiens
atctccttcccttctcttggg

SEQ ID NO: 1509364 - DNA, 15 bp, Homo sapiens
atctcctttcaggga

SEQ ID NO: 1509365 - DNA, 18 bp, Homo sapiens
atctcctttgtattctgt

SEQ ID NO: 1509366 - DNA, 17 bp, Homo sapiens
atctcgagccccctgga

SEQ ID NO: 1509367 - DNA, 20 bp, Homo sapiens
atctcgccacccctccttcc

SEQ ID NO: 1509368 - DNA, 18 bp, Homo sapiens
atctctaaaataggtaaa

SEQ ID NO: 1509369 - DNA, 17 bp, Homo sapiens
atctctaaaattctagt

SEQ ID NO: 1509370 - DNA, 18 bp, Homo sapiens
atctctaaaattctagtc

SEQ ID NO: 1509371 - DNA, 20 bp, Homo sapiens
atctctacaaaaataaagaa

SEQ ID NO: 1509372 - DNA, 18 bp, Homo sapiens
atctctactaaaaataca

SEQ ID NO: 1509373 - DNA, 19 bp, Homo sapiens
atctctactaccacaagga

SEQ ID NO: 1509374 - DNA, 16 bp, Homo sapiens
atctctagaattttaa

SEQ ID NO: 1509375 - DNA, 21 bp, Homo sapiens
atctctagaattttaagtgct

SEQ ID NO: 1509376 - DNA, 22 bp, Homo sapiens
atctctatcagaaatacaaaaa

SEQ ID NO: 1509377 - DNA, 14 bp, Homo sapiens
atctctcaggagca

SEQ ID NO: 1509378 - DNA, 16 bp, Homo sapiens
atctctcaggagcaca

SEQ ID NO: 1509379 - DNA, 12 bp, Homo sapiens
atctctcatcct

SEQ ID NO: 1509380 - DNA, 16 bp, Homo sapiens
atctctcatcctccag

SEQ ID NO: 1509381 - DNA, 21 bp, Homo sapiens
atctctcatcctccagtacct

SEQ ID NO: 1509382 - DNA, 11 bp, Homo sapiens
atctctccctc

SEQ ID NO: 1509383 - DNA, 14 bp, Homo sapiens
atctctccctcccc

SEQ ID NO: 1509384 - DNA, 14 bp, Homo sapiens
atctctcctggcct

SEQ ID NO: 1509385 - DNA, 22 bp, Homo sapiens
atctctcctggcctatccgctg

SEQ ID NO: 1509386 - DNA, 20 bp, Homo sapiens
atctctctacctccaccctg

SEQ ID NO: 1509387 - DNA, 23 bp, Homo sapiens
atctctctactcctacctcagcc

SEQ ID NO: 1509388 - DNA, 20 bp, Homo sapiens
atctctctactgctggactg

SEQ ID NO: 1509389 - DNA, 22 bp, Homo sapiens
atctctctgaatcctaagggct

SEQ ID NO: 1509390 - DNA, 17 bp, Homo sapiens
atctctctgcagctgcc

SEQ ID NO: 1509391 - DNA, 14 bp, Homo sapiens
atgaaaggtactat

SEQ ID NO: 1509392 - DNA, 15 bp, Homo sapiens
atgaaaggtactata

SEQ ID NO: 1509393 - DNA, 20 bp, Homo sapiens
atgaaaggtactatatttgc

SEQ ID NO: 1509394 - DNA, 16 bp, Homo sapiens
atgaaaggtttacatt

SEQ ID NO: 1509395 - DNA, 21 bp, Homo sapiens
atgaaaggtttacattgtcaa

SEQ ID NO: 1509396 - DNA, 23 bp, Homo sapiens
atgaaataaaaaaaaaaggatga

SEQ ID NO: 1509397 - DNA, 22 bp, Homo sapiens
atgaaataaagacccaggggga

SEQ ID NO: 1509398 - DNA, 13 bp, Homo sapiens
atgaaatatgcat

SEQ ID NO: 1509399 - DNA, 13 bp, Homo sapiens
atgaaatcaaatg

SEQ ID NO: 1509400 - DNA, 16 bp, Homo sapiens
atgaaatcaaatgtat

SEQ ID NO: 1509401 - DNA, 18 bp, Homo sapiens
atgaaatcaagttccagt

SEQ ID NO: 1509402 - DNA, 20 bp, Homo sapiens
atgaaatccgtgaagtcaca

SEQ ID NO: 1509403 - DNA, 13 bp, Homo sapiens
atgaaatgtatgt

SEQ ID NO: 1509404 - DNA, 15 bp, Homo sapiens
atgaaattcttccta

SEQ ID NO: 1509405 - DNA, 23 bp, Homo sapiens
atgaaattgtctagcagagcagg

SEQ ID NO: 1509406 - DNA, 13 bp, Homo sapiens
atgaacaaactat

SEQ ID NO: 1509407 - DNA, 13 bp, Homo sapiens
atgaacaaattct

SEQ ID NO: 1509408 - DNA, 17 bp, Homo sapiens
atgaacaaattctttag

SEQ ID NO: 1509409 - DNA, 14 bp, Homo sapiens
atgaacatattcat

SEQ ID NO: 1509410 - DNA, 17 bp, Homo sapiens
atgaacatcatggactg

SEQ ID NO: 1509411 - DNA, 18 bp, Homo sapiens
atgaacatctcttgaaac

SEQ ID NO: 1509412 - DNA, 19 bp, Homo sapiens
atgaacatctcttgaaacc

SEQ ID NO: 1509413 - DNA, 12 bp, Homo sapiens
atgaacattgta

SEQ ID NO: 1509414 - DNA, 22 bp, Homo sapiens
atgaacattgtactgttgcttt

SEQ ID NO: 1509415 - DNA, 15 bp, Homo sapiens
atgaaccataaattc

SEQ ID NO: 1509416 - DNA, 18 bp, Homo sapiens
atgaacctattttcattt

SEQ ID NO: 1509417 - DNA, 20 bp, Homo sapiens
atgaacctattttcatttgt

SEQ ID NO: 1509418 - DNA, 23 bp, Homo sapiens
atgaacctattttcatttgtaca

SEQ ID NO: 1509419 - DNA, 15 bp, Homo sapiens
atgaacggccttgct

SEQ ID NO: 1509420 - DNA, 20 bp, Homo sapiens
atgaactaccatctgatgtt

SEQ ID NO: 1509421 - DNA, 16 bp, Homo sapiens
atgaactgcttttcct

SEQ ID NO: 1509422 - DNA, 12 bp, Homo sapiens
atgaactggctt

SEQ ID NO: 1509423 - DNA, 18 bp, Homo sapiens
atgaactggcttgtacat

SEQ ID NO: 1509424 - DNA, 18 bp, Homo sapiens
atgaacttccatttgtat

SEQ ID NO: 1509425 - DNA, 19 bp, Homo sapiens
atgaagaaaatacttaaat

SEQ ID NO: 1509426 - DNA, 19 bp, Homo sapiens
atgaagaacacagcatgtg

SEQ ID NO: 1509427 - DNA, 15 bp, Homo sapiens
atgaagaattatgta

SEQ ID NO: 1509428 - DNA, 21 bp, Homo sapiens
atgaagacaggacagtgcttc

SEQ ID NO: 1509429 - DNA, 17 bp, Homo sapiens
atgaagaccaaatgata

SEQ ID NO: 1509430 - DNA, 22 bp, Homo sapiens
atgaagacttaaaagagctcag

SEQ ID NO: 1509431 - DNA, 19 bp, Homo sapiens
atgaagagtgagagggcat

SEQ ID NO: 1509432 - DNA, 21 bp, Homo sapiens
atgaagatgtctaatagttat

SEQ ID NO: 1509433 - DNA, 19 bp, Homo sapiens
atgaagattctcctgtgct

SEQ ID NO: 1509434 - DNA, 23 bp, Homo sapiens
atgaagcaattagtctgaaactg

SEQ ID NO: 1509435 - DNA, 13 bp, Homo sapiens
atgaagcagcttt

SEQ ID NO: 1509436 - DNA, 14 bp, Homo sapiens
atgaagcaggaggc

SEQ ID NO: 1509437 - DNA, 12 bp, Homo sapiens
atgaagctgcca

SEQ ID NO: 1509438 - DNA, 14 bp, Homo sapiens
atgaagctgccatc

SEQ ID NO: 1509439 - DNA, 14 bp, Homo sapiens
atgaagctgtataa

SEQ ID NO: 1509440 - DNA, 22 bp, Homo sapiens
atgaaggcaaaaactgtactgt

SEQ ID NO: 1509441 - DNA, 19 bp, Homo sapiens
atgaagggaaattgtttat

SEQ ID NO: 1509442 - DNA, 15 bp, Homo sapiens
atgaaggtaaataaa

SEQ ID NO: 1509443 - DNA, 21 bp, Homo sapiens
atgaaggtttttgtaaagatt

SEQ ID NO: 1509444 - DNA, 15 bp, Homo sapiens
atgaagtaaattatg

SEQ ID NO: 1509445 - DNA, 19 bp, Homo sapiens
atgaagtaaattatgtaac

SEQ ID NO: 1509446 - DNA, 16 bp, Homo sapiens
atgaagttgctgttta

SEQ ID NO: 1509447 - DNA, 17 bp, Homo sapiens
atgaagttgctgtttat

SEQ ID NO: 1509448 - DNA, 21 bp, Homo sapiens
atgaataaaacaataaatgaa

SEQ ID NO: 1509449 - DNA, 15 bp, Homo sapiens
atgaataaaacactc

SEQ ID NO: 1509450 - DNA, 16 bp, Homo sapiens
atgaataatgaaaata

SEQ ID NO: 1509451 - DNA, 13 bp, Homo sapiens
atgaataatggaa

SEQ ID NO: 1509452 - DNA, 14 bp, Homo sapiens
atgaataatggaaa

SEQ ID NO: 1509453 - DNA, 14 bp, Homo sapiens
atgaataatttcac

SEQ ID NO: 1509454 - DNA, 15 bp, Homo sapiens
atgaataatttccca

SEQ ID NO: 1509455 - DNA, 16 bp, Homo sapiens
atgaatactgaatttt

SEQ ID NO: 1509456 - DNA, 22 bp, Homo sapiens
atgaatagactatctagaactt

SEQ ID NO: 1509457 - DNA, 17 bp, Homo sapiens
atgaatatctattaata

SEQ ID NO: 1509458 - DNA, 18 bp, Homo sapiens
atgaatatctattaatat

SEQ ID NO: 1509459 - DNA, 19 bp, Homo sapiens
atgaatatctattaatata

SEQ ID NO: 1509460 - DNA, 20 bp, Homo sapiens
atgaatatctattaatatat

SEQ ID NO: 1509461 - DNA, 12 bp, Homo sapiens
atgaatatttat

SEQ ID NO: 1509462 - DNA, 15 bp, Homo sapiens
atgaatatttataac

SEQ ID NO: 1509463 - DNA, 21 bp, Homo sapiens
atgaatcactgtgctcagcca

SEQ ID NO: 1509464 - DNA, 22 bp, Homo sapiens
atgaatcactgtgctcagccac

SEQ ID NO: 1509465 - DNA, 17 bp, Homo sapiens
atgaatccattggagaa

SEQ ID NO: 1509466 - DNA, 20 bp, Homo sapiens
atgaatccattggagaagcg

SEQ ID NO: 1509467 - DNA, 13 bp, Homo sapiens
atgaatctacatt

SEQ ID NO: 1509468 - DNA, 16 bp, Homo sapiens
atgaatctacatttgt

SEQ ID NO: 1509469 - DNA, 14 bp, Homo sapiens
atgaatctatgcca

SEQ ID NO: 1509470 - DNA, 18 bp, Homo sapiens
atgaatctattatactgt

SEQ ID NO: 1509471 - DNA, 19 bp, Homo sapiens
atgaatgaggtcccaggca

SEQ ID NO: 1509472 - DNA, 18 bp, Homo sapiens
atgaatgcaaaattgttt

SEQ ID NO: 1509473 - DNA, 21 bp, Homo sapiens
atgaatgcaaaattgttttca

SEQ ID NO: 1509474 - DNA, 15 bp, Homo sapiens
atgaatgtaaatttg

SEQ ID NO: 1509475 - DNA, 19 bp, Homo sapiens
atgaatgtaaatttgtact

SEQ ID NO: 1509476 - DNA, 22 bp, Homo sapiens
atgaatgtaaggatgagggaag

SEQ ID NO: 1509477 - DNA, 19 bp, Homo sapiens
atgaatgtactatgtctga

SEQ ID NO: 1509478 - DNA, 15 bp, Homo sapiens
atgaatgtgctggtg

SEQ ID NO: 1509479 - DNA, 12 bp, Homo sapiens
atgaatgtgtaa

SEQ ID NO: 1509480 - DNA, 22 bp, Homo sapiens
atgaatgtttacactctttgta

SEQ ID NO: 1509481 - DNA, 13 bp, Homo sapiens
atgaattaaattt

SEQ ID NO: 1509482 - DNA, 21 bp, Homo sapiens
atgaattactgtatataaact

SEQ ID NO: 1509483 - DNA, 15 bp, Homo sapiens
atgaattatataatt

SEQ ID NO: 1509484 - DNA, 17 bp, Homo sapiens
atgaattcaagaaagga

SEQ ID NO: 1509485 - DNA, 16 bp, Homo sapiens
atgaattgaaaaacaa

SEQ ID NO: 1509486 - DNA, 17 bp, Homo sapiens
atgaattgataaaagag

SEQ ID NO: 1509487 - DNA, 14 bp, Homo sapiens
atgaatttaaatat

SEQ ID NO: 1509488 - DNA, 16 bp, Homo sapiens
atgaatttaaatataa

SEQ ID NO: 1509489 - DNA, 14 bp, Homo sapiens
atgaattttaaagt

SEQ ID NO: 1509490 - DNA, 19 bp, Homo sapiens
atgaattttctgcagctgt

SEQ ID NO: 1509491 - DNA, 15 bp, Homo sapiens
atgacaaatgtttct

SEQ ID NO: 1509492 - DNA, 16 bp, Homo sapiens
atgacaacagaaaaac

SEQ ID NO: 1509493 - DNA, 18 bp, Homo sapiens
atgacaagatgggacagc

SEQ ID NO: 1509494 - DNA, 12 bp, Homo sapiens
atgacaagatgt

SEQ ID NO: 1509495 - DNA, 22 bp, Homo sapiens
atgacaatctaccaactgtccc

SEQ ID NO: 1509496 - DNA, 15 bp, Homo sapiens
atgacacaccttgga

SEQ ID NO: 1509497 - DNA, 22 bp, Homo sapiens
atgacacataaatctgtctgat

SEQ ID NO: 1509498 - DNA, 20 bp, Homo sapiens
atgacacccatgccagagag

SEQ ID NO: 1509499 - DNA, 14 bp, Homo sapiens
atgacaccctggcc

SEQ ID NO: 1509500 - DNA, 17 bp, Homo sapiens
atgacaccctggcctga

SEQ ID NO: 1509501 - DNA, 17 bp, Homo sapiens
atgacacctccatttct

SEQ ID NO: 1509502 - DNA, 16 bp, Homo sapiens
atgacactagaaaact

SEQ ID NO: 1509503 - DNA, 13 bp, Homo sapiens
atgacagagccag

SEQ ID NO: 1509504 - DNA, 22 bp, Homo sapiens
atgacagataaatccttaacat

SEQ ID NO: 1509505 - DNA, 15 bp, Homo sapiens
atgagccactgtgcc

SEQ ID NO: 1509506 - DNA, 15 bp, Homo sapiens
atgagccagtgatta

SEQ ID NO: 1509507 - DNA, 19 bp, Homo sapiens
atgagccatcactagaaga

SEQ ID NO: 1509508 - DNA, 20 bp, Homo sapiens
atgagccatcactagaagaa

SEQ ID NO: 1509509 - DNA, 22 bp, Homo sapiens
atgagccatcactagaagaaaa

SEQ ID NO: 1509510 - DNA, 19 bp, Homo sapiens
atgagccatgatttcccac

SEQ ID NO: 1509511 - DNA, 17 bp, Homo sapiens
atgagctacaacaaaag

SEQ ID NO: 1509512 - DNA, 16 bp, Homo sapiens
atgagctatgtattaa

SEQ ID NO: 1509513 - DNA, 13 bp, Homo sapiens
atgagctccctcg

SEQ ID NO: 1509514 - DNA, 16 bp, Homo sapiens
atgagctcctgcggga

SEQ ID NO: 1509515 - DNA, 22 bp, Homo sapiens
atgagctctgaaatcttcccat

SEQ ID NO: 1509516 - DNA, 22 bp, Homo sapiens
atgagctgctcattacagttct

SEQ ID NO: 1509517 - DNA, 20 bp, Homo sapiens
atgagctggcaaccagccag

SEQ ID NO: 1509518 - DNA, 22 bp, Homo sapiens
atgagctgttggaagaaaagaa

SEQ ID NO: 1509519 - DNA, 14 bp, Homo sapiens
atgagcttcaatat

SEQ ID NO: 1509520 - DNA, 13 bp, Homo sapiens
atgagctttcttt

SEQ ID NO: 1509521 - DNA, 23 bp, Homo sapiens
atgagctttctttgcacttaaaa

SEQ ID NO: 1509522 - DNA, 23 bp, Homo sapiens
atgaggaaaaaatggtataaaag

SEQ ID NO: 1509523 - DNA, 15 bp, Homo sapiens
atgaggaaaattctt

SEQ ID NO: 1509524 - DNA, 22 bp, Homo sapiens
atgaggaaatgccacaaattgt

SEQ ID NO: 1509525 - DNA, 23 bp, Homo sapiens
atgaggaaatgccacaaattgta

SEQ ID NO: 1509526 - DNA, 13 bp, Homo sapiens
atgaggaaatgtg

SEQ ID NO: 1509527 - DNA, 16 bp, Homo sapiens
atgaggaactgtagat

SEQ ID NO: 1509528 - DNA, 21 bp, Homo sapiens
atgaggaatccaaaagacaaa

SEQ ID NO: 1509529 - DNA, 17 bp, Homo sapiens
atgaggagcgtggactc

SEQ ID NO: 1509530 - DNA, 19 bp, Homo sapiens
atgaggagtaaaattcagt

SEQ ID NO: 1509531 - DNA, 14 bp, Homo sapiens
atgaggagttgctg

SEQ ID NO: 1509532 - DNA, 18 bp, Homo sapiens
atgaggcaatgtcaggaa

SEQ ID NO: 1509533 - DNA, 16 bp, Homo sapiens
atgaggccatctcagg

SEQ ID NO: 1509534 - DNA, 20 bp, Homo sapiens
atgaggccatctcaggagat

SEQ ID NO: 1509535 - DNA, 19 bp, Homo sapiens
atgaggggatatttaggcc

SEQ ID NO: 1509536 - DNA, 23 bp, Homo sapiens
atgagggggtggttattggactc

SEQ ID NO: 1509537 - DNA, 14 bp, Homo sapiens
atgagggtgactgt

SEQ ID NO: 1509538 - DNA, 14 bp, Homo sapiens
atgaggtgggaggt

SEQ ID NO: 1509539 - DNA, 22 bp, Homo sapiens
atgaggtgggaggtggaagaag

SEQ ID NO: 1509540 - DNA, 15 bp, Homo sapiens
atgagtaaaggagta

SEQ ID NO: 1509541 - DNA, 13 bp, Homo sapiens
atgagtagccagg

SEQ ID NO: 1509542 - DNA, 19 bp, Homo sapiens
atggcagctagactggagt

SEQ ID NO: 1509543 - DNA, 15 bp, Homo sapiens
atggcagctagtgcc

SEQ ID NO: 1509544 - DNA, 18 bp, Homo sapiens
atggcagctgtttctcat

SEQ ID NO: 1509545 - DNA, 21 bp, Homo sapiens
atggcagctgtttctcatgaa

SEQ ID NO: 1509546 - DNA, 22 bp, Homo sapiens
atggcagctgtttctcatgaag

SEQ ID NO: 1509547 - DNA, 13 bp, Homo sapiens
atggcaggctggg

SEQ ID NO: 1509548 - DNA, 17 bp, Homo sapiens
atggcagggggtggaat

SEQ ID NO: 1509549 - DNA, 20 bp, Homo sapiens
atggcagtccagccagctcc

SEQ ID NO: 1509550 - DNA, 16 bp, Homo sapiens
atggcagtcctggagg

SEQ ID NO: 1509551 - DNA, 16 bp, Homo sapiens
atggcataacctgtct

SEQ ID NO: 1509552 - DNA, 17 bp, Homo sapiens
atggcatcttcaatatg

SEQ ID NO: 1509553 - DNA, 22 bp, Homo sapiens
atggcatgattagattgcaaag

SEQ ID NO: 1509554 - DNA, 23 bp, Homo sapiens
atggcatggagtatagtgcaaat

SEQ ID NO: 1509555 - DNA, 13 bp, Homo sapiens
atggcatttctct

SEQ ID NO: 1509556 - DNA, 16 bp, Homo sapiens
atggcatttctcttta

SEQ ID NO: 1509557 - DNA, 13 bp, Homo sapiens
atggccaagagca

SEQ ID NO: 1509558 - DNA, 14 bp, Homo sapiens
atggccacatttaa

SEQ ID NO: 1509559 - DNA, 21 bp, Homo sapiens
atggccaccccgtgccacccg

SEQ ID NO: 1509560 - DNA, 14 bp, Homo sapiens
atggccaggccagg

SEQ ID NO: 1509561 - DNA, 20 bp, Homo sapiens
atggccaggtggttgtctta

SEQ ID NO: 1509562 - DNA, 15 bp, Homo sapiens
atggccatagaggcc

SEQ ID NO: 1509563 - DNA, 17 bp, Homo sapiens
atggccatagaggccca

SEQ ID NO: 1509564 - DNA, 19 bp, Homo sapiens
atggccatagaggcccagg

SEQ ID NO: 1509565 - DNA, 20 bp, Homo sapiens
atggccatagaggcccaggc

SEQ ID NO: 1509566 - DNA, 21 bp, Homo sapiens
atggccatagaggcccaggca

SEQ ID NO: 1509567 - DNA, 17 bp, Homo sapiens
atggccatgcaggaggt

SEQ ID NO: 1509568 - DNA, 20 bp, Homo sapiens
atggccatgcaggaggtgga

SEQ ID NO: 1509569 - DNA, 17 bp, Homo sapiens
atggccccagcacagct

SEQ ID NO: 1509570 - DNA, 18 bp, Homo sapiens
atggccccagcacagctt

SEQ ID NO: 1509571 - DNA, 20 bp, Homo sapiens
atggccccagcacagcttga

SEQ ID NO: 1509572 - DNA, 14 bp, Homo sapiens
atggcccccaataa

SEQ ID NO: 1509573 - DNA, 23 bp, Homo sapiens
atggcccccaataaaggcagctg

SEQ ID NO: 1509574 - DNA, 14 bp, Homo sapiens
atggcccccagggg

SEQ ID NO: 1509575 - DNA, 16 bp, Homo sapiens
atggcccccaggggca

SEQ ID NO: 1509576 - DNA, 17 bp, Homo sapiens
atggcccctccagcaca

SEQ ID NO: 1509577 - DNA, 21 bp, Homo sapiens
atggcccctccagcacacaca

SEQ ID NO: 1509578 - DNA, 18 bp, Homo sapiens
atggcccctctgacctgc

SEQ ID NO: 1509579 - DNA, 19 bp, Homo sapiens
atggccctagaactgtgcc

SEQ ID NO: 1509580 - DNA, 13 bp, Homo sapiens
atggccctgggcg

SEQ ID NO: 1509581 - DNA, 16 bp, Homo sapiens
atggccgggccctgct

SEQ ID NO: 1509582 - DNA, 15 bp, Homo sapiens
atggccgggctgctg

SEQ ID NO: 1509583 - DNA, 20 bp, Homo sapiens
atggccgggctgctgctgat

SEQ ID NO: 1509584 - DNA, 16 bp, Homo sapiens
atggccgtggatggcc

SEQ ID NO: 1509585 - DNA, 21 bp, Homo sapiens
atggcctattatattaaaata

SEQ ID NO: 1509586 - DNA, 19 bp, Homo sapiens
atggcctcagctgcctcac

SEQ ID NO: 1509587 - DNA, 16 bp, Homo sapiens
atggcctgggggatgt

SEQ ID NO: 1509588 - DNA, 13 bp, Homo sapiens
atggcctgtgctg

SEQ ID NO: 1509589 - DNA, 22 bp, Homo sapiens
atggcctgtgctgggccagtgg

SEQ ID NO: 1509590 - DNA, 22 bp, Homo sapiens
atggccttccacgtcttcctcc

SEQ ID NO: 1509591 - DNA, 18 bp, Homo sapiens
atggcgcgggaggcacca

SEQ ID NO: 1509592 - DNA, 20 bp, Homo sapiens
atggcgtaatgggcctgccc

SEQ ID NO: 1509593 - DNA, 14 bp, Homo sapiens
atggcgtctgctct

SEQ ID NO: 1509594 - DNA, 20 bp, Homo sapiens
atggcgtgtccctctcggaa

SEQ ID NO: 1509595 - DNA, 18 bp, Homo sapiens
atggctaataaactgtat

SEQ ID NO: 1509596 - DNA, 22 bp, Homo sapiens
atggctaataaactgtattaaa

SEQ ID NO: 1509597 - DNA, 18 bp, Homo sapiens
atggctaatgtactgcat

SEQ ID NO: 1509598 - DNA, 16 bp, Homo sapiens
atggctataaatatat

SEQ ID NO: 1509599 - DNA, 16 bp, Homo sapiens
atggctataggtgcta

SEQ ID NO: 1509600 - DNA, 14 bp, Homo sapiens
atggctcaagtaga

SEQ ID NO: 1509601 - DNA, 20 bp, Homo sapiens
atggctcaggcaagcccctc

SEQ ID NO: 1509602 - DNA, 14 bp, Homo sapiens
atggctcctgtctg

SEQ ID NO: 1509603 - DNA, 17 bp, Homo sapiens
atggctcctgtctggct

SEQ ID NO: 1509604 - DNA, 15 bp, Homo sapiens
atggctgaagctgga

SEQ ID NO: 1509605 - DNA, 13 bp, Homo sapiens
atggctgcccagg

SEQ ID NO: 1509606 - DNA, 14 bp, Homo sapiens
atggctgcccagga

SEQ ID NO: 1509607 - DNA, 11 bp, Homo sapiens
atggctgcctg

SEQ ID NO: 1509608 - DNA, 13 bp, Homo sapiens
atggctgctgcct

SEQ ID NO: 1509609 - DNA, 16 bp, Homo sapiens
atggctgctgcctgct

SEQ ID NO: 1509610 - DNA, 19 bp, Homo sapiens
atggctgcttgattttgta

SEQ ID NO: 1509611 - DNA, 16 bp, Homo sapiens
atggctggggccgctg

SEQ ID NO: 1509612 - DNA, 18 bp, Homo sapiens
atggctggggccgctggg

SEQ ID NO: 1509613 - DNA, 13 bp, Homo sapiens
atggctgggtcct

SEQ ID NO: 1509614 - DNA, 15 bp, Homo sapiens
atggctgggtccttg

SEQ ID NO: 1509615 - DNA, 23 bp, Homo sapiens
atggctgggtccttgggcctggc

SEQ ID NO: 1509616 - DNA, 16 bp, Homo sapiens
atggctgtatttgctg

SEQ ID NO: 1509617 - DNA, 21 bp, Homo sapiens
atggctgtgtttgcagcctgc

SEQ ID NO: 1509618 - DNA, 14 bp, Homo sapiens
atggcttatttcta

SEQ ID NO: 1509619 - DNA, 20 bp, Homo sapiens
atggctttatttgttttttt

SEQ ID NO: 1509620 - DNA, 23 bp, Homo sapiens
atggctttatttgttttttttgt

SEQ ID NO: 1509621 - DNA, 14 bp, Homo sapiens
atgggaaagcattg

SEQ ID NO: 1509622 - DNA, 13 bp, Homo sapiens
atgggaaagtatt

SEQ ID NO: 1509623 - DNA, 11 bp, Homo sapiens
atgggaaatag

SEQ ID NO: 1509624 - DNA, 15 bp, Homo sapiens
atgggaaatagtctg

SEQ ID NO: 1509625 - DNA, 23 bp, Homo sapiens
atgggcttgttttcttgccaatg

SEQ ID NO: 1509626 - DNA, 22 bp, Homo sapiens
atggggaaaccctggagccatc

SEQ ID NO: 1509627 - DNA, 23 bp, Homo sapiens
atggggaaggagtacaaaacaat

SEQ ID NO: 1509628 - DNA, 11 bp, Homo sapiens
atggggagaaa

SEQ ID NO: 1509629 - DNA, 17 bp, Homo sapiens
atggggaggcaagtgtg

SEQ ID NO: 1509630 - DNA, 15 bp, Homo sapiens
atggggatagaggaa

SEQ ID NO: 1509631 - DNA, 20 bp, Homo sapiens
atggggatagatgtgtggac

SEQ ID NO: 1509632 - DNA, 15 bp, Homo sapiens
atggggcaagacaga

SEQ ID NO: 1509633 - DNA, 14 bp, Homo sapiens
atggggcagaagag

SEQ ID NO: 1509634 - DNA, 15 bp, Homo sapiens
atggggcagaagaga

SEQ ID NO: 1509635 - DNA, 13 bp, Homo sapiens
atggggccagatc

SEQ ID NO: 1509636 - DNA, 21 bp, Homo sapiens
atggggccagatccagcctgg

SEQ ID NO: 1509637 - DNA, 17 bp, Homo sapiens
atggggctcccgcccgt

SEQ ID NO: 1509638 - DNA, 21 bp, Homo sapiens
atgggggaactcagatccagg

SEQ ID NO: 1509639 - DNA, 15 bp, Homo sapiens
atgggggagagaagg

SEQ ID NO: 1509640 - DNA, 15 bp, Homo sapiens
atgggggcctggatt

SEQ ID NO: 1509641 - DNA, 18 bp, Homo sapiens
atgggggtagcagctgga

SEQ ID NO: 1509642 - DNA, 22 bp, Homo sapiens
atgggggtgcaggcagccttga

SEQ ID NO: 1509643 - DNA, 17 bp, Homo sapiens
atgggtagtacctgtac

SEQ ID NO: 1509644 - DNA, 13 bp, Homo sapiens
atgggtcacagga

SEQ ID NO: 1509645 - DNA, 22 bp, Homo sapiens
atgggtcccttgaaggaagagg

SEQ ID NO: 1509646 - DNA, 21 bp, Homo sapiens
atgggtccttgatgccagagg

SEQ ID NO: 1509647 - DNA, 22 bp, Homo sapiens
atgggtgaagggagagccagct

SEQ ID NO: 1509648 - DNA, 16 bp, Homo sapiens
atgggtgcaaggaaaa

SEQ ID NO: 1509649 - DNA, 20 bp, Homo sapiens
atgggtgcccgtatccagag

SEQ ID NO: 1509650 - DNA, 18 bp, Homo sapiens
atggtaaaaaatttataa

SEQ ID NO: 1509651 - DNA, 17 bp, Homo sapiens
atggtaaccagccacag

SEQ ID NO: 1509652 - DNA, 16 bp, Homo sapiens
atggtaagagaaaaga

SEQ ID NO: 1509653 - DNA, 13 bp, Homo sapiens
atggtaataagca

SEQ ID NO: 1509654 - DNA, 20 bp, Homo sapiens
atggtaataagcactgtaaa

SEQ ID NO: 1509655 - DNA, 17 bp, Homo sapiens
atggtaatctacagctc

SEQ ID NO: 1509656 - DNA, 20 bp, Homo sapiens
atggtaatctttacctgtat

SEQ ID NO: 1509657 - DNA, 21 bp, Homo sapiens
atggtaattcacttcagttta

SEQ ID NO: 1509658 - DNA, 14 bp, Homo sapiens
atggtaattgttgc

SEQ ID NO: 1509659 - DNA, 19 bp, Homo sapiens
atggtacagcttctggagc

SEQ ID NO: 1509660 - DNA, 18 bp, Homo sapiens
atggtacatgtcttccat

SEQ ID NO: 1509661 - DNA, 19 bp, Homo sapiens
atggtacatttatcactga

SEQ ID NO: 1509662 - DNA, 13 bp, Homo sapiens
atggtactattta

SEQ ID NO: 1509663 - DNA, 23 bp, Homo sapiens
atggtagattcgctgtcccctca

SEQ ID NO: 1509664 - DNA, 18 bp, Homo sapiens
atggtaggggagggcagg

SEQ ID NO: 1509665 - DNA, 19 bp, Homo sapiens
atggtaggggcttaaaaga

SEQ ID NO: 1509666 - DNA, 17 bp, Homo sapiens
atggtatatatacatat

SEQ ID NO: 1509667 - DNA, 21 bp, Homo sapiens
atggtatatttggtactgtat

SEQ ID NO: 1509668 - DNA, 18 bp, Homo sapiens
atggtatgatcaataaag

SEQ ID NO: 1509669 - DNA, 18 bp, Homo sapiens
atggtatgcacaattcca

SEQ ID NO: 1509670 - DNA, 20 bp, Homo sapiens
atggtcaacacttaagggtt

SEQ ID NO: 1509671 - DNA, 21 bp, Homo sapiens
atggtcaatgcagtttttatc

SEQ ID NO: 1509672 - DNA, 19 bp, Homo sapiens
atggtcaccaaatcagctg

SEQ ID NO: 1509673 - DNA, 17 bp, Homo sapiens
atggtcatcaccaccct

SEQ ID NO: 1509674 - DNA, 22 bp, Homo sapiens
atggtcatcttggagggaccaa

SEQ ID NO: 1509675 - DNA, 17 bp, Homo sapiens
atggtcattgcagttta

SEQ ID NO: 1509676 - DNA, 19 bp, Homo sapiens
atggtccatttgttcctgc

SEQ ID NO: 1509677 - DNA, 15 bp, Homo sapiens
atggtccggtgtcct

SEQ ID NO: 1509678 - DNA, 20 bp, Homo sapiens
atggtccgtgcccaggccct

SEQ ID NO: 1509679 - DNA, 12 bp, Homo sapiens
atggtcctgggg

SEQ ID NO: 1509680 - DNA, 19 bp, Homo sapiens
atggtctcgatctcctgac

SEQ ID NO: 1509681 - DNA, 19 bp, Homo sapiens
atggtctctgcacccagtg

SEQ ID NO: 1509682 - DNA, 17 bp, Homo sapiens
atggtctttgctccaga

SEQ ID NO: 1509683 - DNA, 19 bp, Homo sapiens
atggtgaaaccccgtctct

SEQ ID NO: 1509684 - DNA, 12 bp, Homo sapiens
atggtgatttta

SEQ ID NO: 1509685 - DNA, 16 bp, Homo sapiens
atggtgccccaggacc

SEQ ID NO: 1509686 - DNA, 21 bp, Homo sapiens
atggtgccccaggaccagctc

SEQ ID NO: 1509687 - DNA, 23 bp, Homo sapiens
atggtggaagggggtgtgcgtgc

SEQ ID NO: 1509688 - DNA, 16 bp, Homo sapiens
atggtggacccagcgg

SEQ ID NO: 1509689 - DNA, 17 bp, Homo sapiens
atggtggactaagcaat

SEQ ID NO: 1509690 - DNA, 19 bp, Homo sapiens
atggtggggatatttttaa

SEQ ID NO: 1509691 - DNA, 18 bp, Homo sapiens
atggtgtacataatgtat

SEQ ID NO: 1509692 - DNA, 18 bp, Homo sapiens
atggtgtagaacactaat

SEQ ID NO: 1509693 - DNA, 18 bp, Homo sapiens
atggtgtctcttctttag

SEQ ID NO: 1509694 - DNA, 16 bp, Homo sapiens
atggtgtgtggtgcta

SEQ ID NO: 1509695 - DNA, 23 bp, Homo sapiens
atggttaaaaaggccaaagataa

SEQ ID NO: 1509696 - DNA, 13 bp, Homo sapiens
atggttaaacatt

SEQ ID NO: 1509697 - DNA, 15 bp, Homo sapiens
atggttaatactatt

SEQ ID NO: 1509698 - DNA, 15 bp, Homo sapiens
atggttcaagattgt

SEQ ID NO: 1509699 - DNA, 16 bp, Homo sapiens
atggttcaagattgtt

SEQ ID NO: 1509700 - DNA, 20 bp, Homo sapiens
atggttcagaattaaacttt

SEQ ID NO: 1509701 - DNA, 19 bp, Homo sapiens
atggttcccctgttcactc

SEQ ID NO: 1509702 - DNA, 13 bp, Homo sapiens
atggttccttccc

SEQ ID NO: 1509703 - DNA, 21 bp, Homo sapiens
atgtagcacttacgtaaaaca

SEQ ID NO: 1509704 - DNA, 14 bp, Homo sapiens
atgtagccagctgt

SEQ ID NO: 1509705 - DNA, 20 bp, Homo sapiens
atgtagcccatccttccctt

SEQ ID NO: 1509706 - DNA, 18 bp, Homo sapiens
atgtagccccctggcctc

SEQ ID NO: 1509707 - DNA, 19 bp, Homo sapiens
atgtagccccctggcctct

SEQ ID NO: 1509708 - DNA, 22 bp, Homo sapiens
atgtagcctttactgtttgata

SEQ ID NO: 1509709 - DNA, 15 bp, Homo sapiens
atgtagcgacagcat

SEQ ID NO: 1509710 - DNA, 13 bp, Homo sapiens
atgtaggagctgg

SEQ ID NO: 1509711 - DNA, 17 bp, Homo sapiens
atgtaggcattctggag

SEQ ID NO: 1509712 - DNA, 18 bp, Homo sapiens
atgtaggtaagactgtag

SEQ ID NO: 1509713 - DNA, 21 bp, Homo sapiens
atgtaggtcctcagaaagtgt

SEQ ID NO: 1509714 - DNA, 12 bp, Homo sapiens
atgtagtatttt

SEQ ID NO: 1509715 - DNA, 18 bp, Homo sapiens
atgtagtcagttgcattc

SEQ ID NO: 1509716 - DNA, 20 bp, Homo sapiens
atgtagtgcatttttaaact

SEQ ID NO: 1509717 - DNA, 14 bp, Homo sapiens
atgtagtttgagga

SEQ ID NO: 1509718 - DNA, 24 bp, Homo sapiens
atgtagtttgaggaaatttgcagc

SEQ ID NO: 1509719 - DNA, 21 bp, Homo sapiens
atgtataaaaattatcaaaaa

SEQ ID NO: 1509720 - DNA, 22 bp, Homo sapiens
atgtataaaaattatcaaaaag

SEQ ID NO: 1509721 - DNA, 19 bp, Homo sapiens
atgtataaagattgtactt

SEQ ID NO: 1509722 - DNA, 20 bp, Homo sapiens
atgtataaagattgtactta

SEQ ID NO: 1509723 - DNA, 17 bp, Homo sapiens
atgtataaatatacagt

SEQ ID NO: 1509724 - DNA, 16 bp, Homo sapiens
atgtataatatatatc

SEQ ID NO: 1509725 - DNA, 20 bp, Homo sapiens
atgtatatatctattattca

SEQ ID NO: 1509726 - DNA, 13 bp, Homo sapiens
atgtatatgtata

SEQ ID NO: 1509727 - DNA, 19 bp, Homo sapiens
atgtatatttttgctagga

SEQ ID NO: 1509728 - DNA, 18 bp, Homo sapiens
atgtatatttttttaatt

SEQ ID NO: 1509729 - DNA, 12 bp, Homo sapiens
atgtatcaatga

SEQ ID NO: 1509730 - DNA, 18 bp, Homo sapiens
atgtatcagtgtcctttc

SEQ ID NO: 1509731 - DNA, 20 bp, Homo sapiens
atgtatcagtgtcctttcca

SEQ ID NO: 1509732 - DNA, 21 bp, Homo sapiens
atgtatcagtgtcctttccag

SEQ ID NO: 1509733 - DNA, 17 bp, Homo sapiens
atgtatcatagaaatgt

SEQ ID NO: 1509734 - DNA, 14 bp, Homo sapiens
atgtatctatttgt

SEQ ID NO: 1509735 - DNA, 21 bp, Homo sapiens
atgtatctatttgtacaattt

SEQ ID NO: 1509736 - DNA, 16 bp, Homo sapiens
atgtatctttattaaa

SEQ ID NO: 1509737 - DNA, 17 bp, Homo sapiens
atgtatctttattaaaa

SEQ ID NO: 1509738 - DNA, 18 bp, Homo sapiens
atgtatctttattaaaac

SEQ ID NO: 1509739 - DNA, 13 bp, Homo sapiens
atgtatgaaggct

SEQ ID NO: 1509740 - DNA, 14 bp, Homo sapiens
atgtatgaaggctt

SEQ ID NO: 1509741 - DNA, 13 bp, Homo sapiens
atgtatgcctgca

SEQ ID NO: 1509742 - DNA, 14 bp, Homo sapiens
atgtatggatatat

SEQ ID NO: 1509743 - DNA, 16 bp, Homo sapiens
atgtatggatatattt

SEQ ID NO: 1509744 - DNA, 13 bp, Homo sapiens
atgtatgtaaagt

SEQ ID NO: 1509745 - DNA, 18 bp, Homo sapiens
atgtatgtacaatacaat

SEQ ID NO: 1509746 - DNA, 17 bp, Homo sapiens
atgtatgtatcatcagt

SEQ ID NO: 1509747 - DNA, 15 bp, Homo sapiens
atgtatgtgtaagta

SEQ ID NO: 1509748 - DNA, 20 bp, Homo sapiens
atgtatgtgtgaaacaatgt

SEQ ID NO: 1509749 - DNA, 14 bp, Homo sapiens
atgtatgtgtggct

SEQ ID NO: 1509750 - DNA, 12 bp, Homo sapiens
atgtatgttaat

SEQ ID NO: 1509751 - DNA, 14 bp, Homo sapiens
atgtatgttaccaa

SEQ ID NO: 1509752 - DNA, 19 bp, Homo sapiens
atgtatgttcagaagaaat

SEQ ID NO: 1509753 - DNA, 20 bp, Homo sapiens
atgtatgttcagaagaaatt

SEQ ID NO: 1509754 - DNA, 13 bp, Homo sapiens
atgtatgtttaca

SEQ ID NO: 1509755 - DNA, 16 bp, Homo sapiens
atgtatgtttacatat

SEQ ID NO: 1509756 - DNA, 17 bp, Homo sapiens
atgtatgtttacatatc

SEQ ID NO: 1509757 - DNA, 19 bp, Homo sapiens
atgtatgtttggctctgct

SEQ ID NO: 1509758 - DNA, 18 bp, Homo sapiens
atgtattagtatggttca

SEQ ID NO: 1509759 - DNA, 17 bp, Homo sapiens
atgtattattctgcagc

SEQ ID NO: 1509760 - DNA, 20 bp, Homo sapiens
atgtattattctgcagcatg

SEQ ID NO: 1509761 - DNA, 17 bp, Homo sapiens
atgtattatttataatt

SEQ ID NO: 1509762 - DNA, 17 bp, Homo sapiens
atgtattcacacacccc

SEQ ID NO: 1509763 - DNA, 21 bp, Homo sapiens
atgtattcatatttgtacttt

SEQ ID NO: 1509764 - DNA, 15 bp, Homo sapiens
atgtattcccttgta

SEQ ID NO: 1509765 - DNA, 12 bp, Homo sapiens
atgtattctgta

SEQ ID NO: 1509766 - DNA, 17 bp, Homo sapiens
atgtattcttttctcag

SEQ ID NO: 1509767 - DNA, 16 bp, Homo sapiens
atgtattggcctggag

SEQ ID NO: 1509768 - DNA, 15 bp, Homo sapiens
atgtatttaaagttg

SEQ ID NO: 1509769 - DNA, 16 bp, Homo sapiens
atgtatttagctacag

SEQ ID NO: 1509770 - DNA, 17 bp, Homo sapiens
atgtatttataaatata

SEQ ID NO: 1509771 - DNA, 18 bp, Homo sapiens
atgtatttgttatatata

SEQ ID NO: 1509772 - DNA, 20 bp, Homo sapiens
atgtatttgttatatataat

SEQ ID NO: 1509773 - DNA, 19 bp, Homo sapiens
atgtatttttgatgtatat

SEQ ID NO: 1509774 - DNA, 20 bp, Homo sapiens
atgtatttttgatgtatata

SEQ ID NO: 1509775 - DNA, 23 bp, Homo sapiens
atgtcaataaacaacagctgaag

SEQ ID NO: 1509776 - DNA, 16 bp, Homo sapiens
atgtcaatttgtatat

SEQ ID NO: 1509777 - DNA, 18 bp, Homo sapiens
atgtcacaaattgatcaa

SEQ ID NO: 1509778 - DNA, 16 bp, Homo sapiens
atgtcaccaccttccc

SEQ ID NO: 1509779 - DNA, 18 bp, Homo sapiens
atgtcaccaccttcccag

SEQ ID NO: 1509780 - DNA, 20 bp, Homo sapiens
atgtcaccaccttcccagct

SEQ ID NO: 1509781 - DNA, 16 bp, Homo sapiens
atgtcacctacatatg

SEQ ID NO: 1509782 - DNA, 21 bp, Homo sapiens
atgtcacctcagctgatatta

SEQ ID NO: 1509783 - DNA, 16 bp, Homo sapiens
atgtcagaacagagtg

SEQ ID NO: 1509784 - DNA, 14 bp, Homo sapiens
atgtcagatttctg

SEQ ID NO: 1509785 - DNA, 15 bp, Homo sapiens
atgtcagatttctgg

SEQ ID NO: 1509786 - DNA, 17 bp, Homo sapiens
atgtcagatttctggtt

SEQ ID NO: 1509787 - DNA, 19 bp, Homo sapiens
atgtcagatttctggttga

SEQ ID NO: 1509788 - DNA, 17 bp, Homo sapiens
atgtcaggaacagaagg

SEQ ID NO: 1509789 - DNA, 13 bp, Homo sapiens
atgtcagtatgtg

SEQ ID NO: 1509790 - DNA, 16 bp, Homo sapiens
atgtcagtatgtggaa

SEQ ID NO: 1509791 - DNA, 22 bp, Homo sapiens
atgtcagtgctataaatgccag

SEQ ID NO: 1509792 - DNA, 23 bp, Homo sapiens
atgtcagtgctataaatgccaga

SEQ ID NO: 1509793 - DNA, 18 bp, Homo sapiens
atgtcataaattactgtt

SEQ ID NO: 1509794 - DNA, 21 bp, Homo sapiens
atgtcatgtaggttgtctaaa

SEQ ID NO: 1509795 - DNA, 15 bp, Homo sapiens
atgtcatttttaatg

SEQ ID NO: 1509796 - DNA, 17 bp, Homo sapiens
atgtcatttttaatgta

SEQ ID NO: 1509797 - DNA, 18 bp, Homo sapiens
atgtcatttttaatgtat

SEQ ID NO: 1509798 - DNA, 19 bp, Homo sapiens
atgtcatttttaatgtatc

SEQ ID NO: 1509799 - DNA, 21 bp, Homo sapiens
atgtcatttttaatgtatcta

SEQ ID NO: 1509800 - DNA, 16 bp, Homo sapiens
atgtccaaagaggctg

SEQ ID NO: 1509801 - DNA, 18 bp, Homo sapiens
atgtccaaagaggctgcc

SEQ ID NO: 1509802 - DNA, 21 bp, Homo sapiens
atgtccaaagaggctgcccct

SEQ ID NO: 1509803 - DNA, 16 bp, Homo sapiens
atgtccaacccgtctg

SEQ ID NO: 1509804 - DNA, 13 bp, Homo sapiens
atgtccaatcttt

SEQ ID NO: 1509805 - DNA, 16 bp, Homo sapiens
atgtccactgtgtata

SEQ ID NO: 1509806 - DNA, 17 bp, Homo sapiens
atgtccactgtgtatag

SEQ ID NO: 1509807 - DNA, 21 bp, Homo sapiens
atgtccagcaccttgtgcctg

SEQ ID NO: 1509808 - DNA, 12 bp, Homo sapiens
atgtccaggaaa

SEQ ID NO: 1509809 - DNA, 13 bp, Homo sapiens
atgtccatacact

SEQ ID NO: 1509810 - DNA, 19 bp, Homo sapiens
atgtcccaccctccctaga

SEQ ID NO: 1509811 - DNA, 24 bp, Homo sapiens
atgtccctaccgagtctcttctcc

SEQ ID NO: 1509812 - DNA, 19 bp, Homo sapiens
atgtccctctcttggctat

SEQ ID NO: 1509813 - DNA, 24 bp, Homo sapiens
atgtgccttgattgattagataaa

SEQ ID NO: 1509814 - DNA, 13 bp, Homo sapiens
atgtgcctttctt

SEQ ID NO: 1509815 - DNA, 21 bp, Homo sapiens
atgtgctagtcactggcagcc

SEQ ID NO: 1509816 - DNA, 15 bp, Homo sapiens
atgtgctatacacac

SEQ ID NO: 1509817 - DNA, 16 bp, Homo sapiens
atgtgctatacacaca

SEQ ID NO: 1509818 - DNA, 16 bp, Homo sapiens
atgtgctcagccaaat

SEQ ID NO: 1509819 - DNA, 17 bp, Homo sapiens
atgtgctggtgaacact

SEQ ID NO: 1509820 - DNA, 18 bp, Homo sapiens
atgtgctgtgaccattta

SEQ ID NO: 1509821 - DNA, 13 bp, Homo sapiens
atgtgctgtgtga

SEQ ID NO: 1509822 - DNA, 20 bp, Homo sapiens
atgtgctgtgtgagtgagca

SEQ ID NO: 1509823 - DNA, 13 bp, Homo sapiens
atgtgcttttctc

SEQ ID NO: 1509824 - DNA, 13 bp, Homo sapiens
atgtggaagtgtg

SEQ ID NO: 1509825 - DNA, 15 bp, Homo sapiens
atgtggaagtgtggg

SEQ ID NO: 1509826 - DNA, 16 bp, Homo sapiens
atgtggaagtgtgggt

SEQ ID NO: 1509827 - DNA, 22 bp, Homo sapiens
atgtggaagtgtgggtctgtgt

SEQ ID NO: 1509828 - DNA, 23 bp, Homo sapiens
atgtggaagtgtgggtctgtgtg

SEQ ID NO: 1509829 - DNA, 18 bp, Homo sapiens
atgtggaccttagaatac

SEQ ID NO: 1509830 - DNA, 17 bp, Homo sapiens
atgtggacttgtatgct

SEQ ID NO: 1509831 - DNA, 16 bp, Homo sapiens
atgtggaggaagagcc

SEQ ID NO: 1509832 - DNA, 18 bp, Homo sapiens
atgtggaggaagagccac

SEQ ID NO: 1509833 - DNA, 19 bp, Homo sapiens
atgtggaggaagagccacc

SEQ ID NO: 1509834 - DNA, 20 bp, Homo sapiens
atgtggaggaagagccacct

SEQ ID NO: 1509835 - DNA, 20 bp, Homo sapiens
atgtggcaaagtgctgtacc

SEQ ID NO: 1509836 - DNA, 13 bp, Homo sapiens
atgtggcagctgg

SEQ ID NO: 1509837 - DNA, 20 bp, Homo sapiens
atgtggcccctgaacaagaa

SEQ ID NO: 1509838 - DNA, 16 bp, Homo sapiens
atgtggccctggcctg

SEQ ID NO: 1509839 - DNA, 20 bp, Homo sapiens
atgtggccctggcctgctgg

SEQ ID NO: 1509840 - DNA, 17 bp, Homo sapiens
atgtggccgaggacttt

SEQ ID NO: 1509841 - DNA, 23 bp, Homo sapiens
atgtggctcagtgccttcctctc

SEQ ID NO: 1509842 - DNA, 10 bp, Homo sapiens
atgtggctga

SEQ ID NO: 1509843 - DNA, 11 bp, Homo sapiens
atgtggctgaa

SEQ ID NO: 1509844 - DNA, 14 bp, Homo sapiens
atgtggctgaagac

SEQ ID NO: 1509845 - DNA, 18 bp, Homo sapiens
atgtgggcagtgatgtca

SEQ ID NO: 1509846 - DNA, 21 bp, Homo sapiens
atgtgggcgcccaccctgggc

SEQ ID NO: 1509847 - DNA, 16 bp, Homo sapiens
atgtgggggtctgtgt

SEQ ID NO: 1509848 - DNA, 17 bp, Homo sapiens
atgtgggggtctgtgtg

SEQ ID NO: 1509849 - DNA, 18 bp, Homo sapiens
atgtggtgacacctcccc

SEQ ID NO: 1509850 - DNA, 19 bp, Homo sapiens
atgtggtgacacctccccc

SEQ ID NO: 1509851 - DNA, 18 bp, Homo sapiens
atgtggtggcacaggccc

SEQ ID NO: 1509852 - DNA, 17 bp, Homo sapiens
atgtggtgtggggcgtg

SEQ ID NO: 1509853 - DNA, 21 bp, Homo sapiens
atgtggttacttcctactgta

SEQ ID NO: 1509854 - DNA, 23 bp, Homo sapiens
atgtggttcagtgccttcctctc

SEQ ID NO: 1509855 - DNA, 20 bp, Homo sapiens
atgtggttgcaaggccgctg

SEQ ID NO: 1509856 - DNA, 16 bp, Homo sapiens
atgtggttttagattt

SEQ ID NO: 1509857 - DNA, 21 bp, Homo sapiens
atgtgtaaacaattttatata

SEQ ID NO: 1509858 - DNA, 16 bp, Homo sapiens
atgtgtaaacaggtat

SEQ ID NO: 1509859 - DNA, 14 bp, Homo sapiens
atgtgtaagtattc

SEQ ID NO: 1509860 - DNA, 20 bp, Homo sapiens
atgtgtaattgttttggaat

SEQ ID NO: 1509861 - DNA, 14 bp, Homo sapiens
atgtgtacagtgaa

SEQ ID NO: 1509862 - DNA, 16 bp, Homo sapiens
atgtgtacatatatgt

SEQ ID NO: 1509863 - DNA, 16 bp, Homo sapiens
atgttcagaagaaatt

SEQ ID NO: 1509864 - DNA, 17 bp, Homo sapiens
atgttcatatgtacttg

SEQ ID NO: 1509865 - DNA, 18 bp, Homo sapiens
atgttcatatgtacttgt

SEQ ID NO: 1509866 - DNA, 18 bp, Homo sapiens
atgttcatatttattgat

SEQ ID NO: 1509867 - DNA, 20 bp, Homo sapiens
atgttcatatttattgatta

SEQ ID NO: 1509868 - DNA, 21 bp, Homo sapiens
atgttcatcatcctaagctat

SEQ ID NO: 1509869 - DNA, 18 bp, Homo sapiens
atgttcatttgtttgttt

SEQ ID NO: 1509870 - DNA, 19 bp, Homo sapiens
atgttccaaaccctcctgg

SEQ ID NO: 1509871 - DNA, 19 bp, Homo sapiens
atgttccaccattgctgga

SEQ ID NO: 1509872 - DNA, 18 bp, Homo sapiens
atgttccctgcaccctgg

SEQ ID NO: 1509873 - DNA, 22 bp, Homo sapiens
atgttccggcgtttatttctgc

SEQ ID NO: 1509874 - DNA, 18 bp, Homo sapiens
atgttcctgctgtatttc

SEQ ID NO: 1509875 - DNA, 22 bp, Homo sapiens
atgttcctgctgtatttcctgc

SEQ ID NO: 1509876 - DNA, 13 bp, Homo sapiens
atgttctaaggct

SEQ ID NO: 1509877 - DNA, 18 bp, Homo sapiens
atgttctaaggctctgag

SEQ ID NO: 1509878 - DNA, 19 bp, Homo sapiens
atgttctaaggctctgaga

SEQ ID NO: 1509879 - DNA, 22 bp, Homo sapiens
atgttctaaggctctgagagtc

SEQ ID NO: 1509880 - DNA, 21 bp, Homo sapiens
atgttctaagtttctaagatt

SEQ ID NO: 1509881 - DNA, 23 bp, Homo sapiens
atgttctaagtttctaagattct

SEQ ID NO: 1509882 - DNA, 21 bp, Homo sapiens
atgttctgtcacgtgaaatat

SEQ ID NO: 1509883 - DNA, 15 bp, Homo sapiens
atgttctgtcttccc

SEQ ID NO: 1509884 - DNA, 23 bp, Homo sapiens
atgttctgtcttcccaaacccag

SEQ ID NO: 1509885 - DNA, 21 bp, Homo sapiens
atgttcttagcaataaatgct

SEQ ID NO: 1509886 - DNA, 20 bp, Homo sapiens
atgttcttttaaatgattga

SEQ ID NO: 1509887 - DNA, 14 bp, Homo sapiens
atgttcttttctat

SEQ ID NO: 1509888 - DNA, 15 bp, Homo sapiens
atgttgaaaatactt

SEQ ID NO: 1509889 - DNA, 12 bp, Homo sapiens
atgttgaaagat

SEQ ID NO: 1509890 - DNA, 20 bp, Homo sapiens
atgttgagggaacagacagg

SEQ ID NO: 1509891 - DNA, 16 bp, Homo sapiens
atgttgatttttactg

SEQ ID NO: 1509892 - DNA, 21 bp, Homo sapiens
atgttgatttttactgtgttt

SEQ ID NO: 1509893 - DNA, 18 bp, Homo sapiens
atgttgctgatggcccct

SEQ ID NO: 1509894 - DNA, 15 bp, Homo sapiens
atgttgctggactgt

SEQ ID NO: 1509895 - DNA, 19 bp, Homo sapiens
atgttgctggactgtcata

SEQ ID NO: 1509896 - DNA, 19 bp, Homo sapiens
atgttgctgttattatatt

SEQ ID NO: 1509897 - DNA, 22 bp, Homo sapiens
atgttgctttaacctgaacctt

SEQ ID NO: 1509898 - DNA, 20 bp, Homo sapiens
atgttgggaaacttggctcg

SEQ ID NO: 1509899 - DNA, 18 bp, Homo sapiens
atgttggtcattttatgt

SEQ ID NO: 1509900 - DNA, 19 bp, Homo sapiens
atgttggtttaattaataa

SEQ ID NO: 1509901 - DNA, 14 bp, Homo sapiens
atgttgtaatattt

SEQ ID NO: 1509902 - DNA, 19 bp, Homo sapiens
atgttgtaatatttcttca

SEQ ID NO: 1509903 - DNA, 16 bp, Homo sapiens
atgttgtaatgctgca

SEQ ID NO: 1509904 - DNA, 21 bp, Homo sapiens
atgttgtacttgaaaatgcta

SEQ ID NO: 1509905 - DNA, 22 bp, Homo sapiens
atgttgtccaattgttgacagt

SEQ ID NO: 1509906 - DNA, 17 bp, Homo sapiens
atgttgtgaataattac

SEQ ID NO: 1509907 - DNA, 15 bp, Homo sapiens
atgttgtgtttttaa

SEQ ID NO: 1509908 - DNA, 13 bp, Homo sapiens
atgttgttaaaca

SEQ ID NO: 1509909 - DNA, 15 bp, Homo sapiens
atgttgttatttaaa

SEQ ID NO: 1509910 - DNA, 17 bp, Homo sapiens
atgttgttatttaaaga

SEQ ID NO: 1509911 - DNA, 20 bp, Homo sapiens
atgttgttgaggctgtcaca

SEQ ID NO: 1509912 - DNA, 17 bp, Homo sapiens
atgttgttttgtacaga

SEQ ID NO: 1509913 - DNA, 18 bp, Homo sapiens
atgtttaaatagcctaaa

SEQ ID NO: 1509914 - DNA, 16 bp, Homo sapiens
atgtttaacaaatcta

SEQ ID NO: 1509915 - DNA, 18 bp, Homo sapiens
atgtttaacatcattgca

SEQ ID NO: 1509916 - DNA, 19 bp, Homo sapiens
atgtttaacatcattgcat

SEQ ID NO: 1509917 - DNA, 14 bp, Homo sapiens
atgtttaatctgtt

SEQ ID NO: 1509918 - DNA, 16 bp, Homo sapiens
atgtttacactctttg

SEQ ID NO: 1509919 - DNA, 14 bp, Homo sapiens
attaagatgtatat

SEQ ID NO: 1509920 - DNA, 11 bp, Homo sapiens
attaagatgtt

SEQ ID NO: 1509921 - DNA, 18 bp, Homo sapiens
attaagattataattgtt

SEQ ID NO: 1509922 - DNA, 21 bp, Homo sapiens
attaagattctctgcccagcc

SEQ ID NO: 1509923 - DNA, 11 bp, Homo sapiens
attaagatttc

SEQ ID NO: 1509924 - DNA, 18 bp, Homo sapiens
attaaggaagtaactttt

SEQ ID NO: 1509925 - DNA, 15 bp, Homo sapiens
attaaggggaagaat

SEQ ID NO: 1509926 - DNA, 15 bp, Homo sapiens
attaagtaaatgctg

SEQ ID NO: 1509927 - DNA, 19 bp, Homo sapiens
attaagtactatgtatcaa

SEQ ID NO: 1509928 - DNA, 14 bp, Homo sapiens
attaagtatatata

SEQ ID NO: 1509929 - DNA, 16 bp, Homo sapiens
attaagtcaagaatat

SEQ ID NO: 1509930 - DNA, 12 bp, Homo sapiens
attaagttgaaa

SEQ ID NO: 1509931 - DNA, 16 bp, Homo sapiens
attaagttttaaataa

SEQ ID NO: 1509932 - DNA, 19 bp, Homo sapiens
attaataaaaaatggaaag

SEQ ID NO: 1509933 - DNA, 15 bp, Homo sapiens
attaataaagcattc

SEQ ID NO: 1509934 - DNA, 16 bp, Homo sapiens
attaataaagcattct

SEQ ID NO: 1509935 - DNA, 17 bp, Homo sapiens
attaataaagcattctt

SEQ ID NO: 1509936 - DNA, 17 bp, Homo sapiens
attaataaagttgcttt

SEQ ID NO: 1509937 - DNA, 19 bp, Homo sapiens
attaataagtgaagaatac

SEQ ID NO: 1509938 - DNA, 16 bp, Homo sapiens
attaataatatgtact

SEQ ID NO: 1509939 - DNA, 18 bp, Homo sapiens
attaataatatgtactaa

SEQ ID NO: 1509940 - DNA, 18 bp, Homo sapiens
attaatagcagcctttct

SEQ ID NO: 1509941 - DNA, 13 bp, Homo sapiens
attaatagtttta

SEQ ID NO: 1509942 - DNA, 16 bp, Homo sapiens
attaatatatagtcca

SEQ ID NO: 1509943 - DNA, 22 bp, Homo sapiens
attaatatatagtccagacact

SEQ ID NO: 1509944 - DNA, 20 bp, Homo sapiens
attaatatatgtattattta

SEQ ID NO: 1509945 - DNA, 14 bp, Homo sapiens
attaatatattaaa

SEQ ID NO: 1509946 - DNA, 13 bp, Homo sapiens
attaatatgagtt

SEQ ID NO: 1509947 - DNA, 13 bp, Homo sapiens
attaatattatta

SEQ ID NO: 1509948 - DNA, 11 bp, Homo sapiens
attaatcaaaa

SEQ ID NO: 1509949 - DNA, 17 bp, Homo sapiens
attaatcaagagaaact

SEQ ID NO: 1509950 - DNA, 22 bp, Homo sapiens
attaatcaagagaaacttcaaa

SEQ ID NO: 1509951 - DNA, 18 bp, Homo sapiens
attaatcacctctctgta

SEQ ID NO: 1509952 - DNA, 19 bp, Homo sapiens
attaatcatctataaagaa

SEQ ID NO: 1509953 - DNA, 19 bp, Homo sapiens
attaatcatgaatgtgtaa

SEQ ID NO: 1509954 - DNA, 19 bp, Homo sapiens
attaatccccatcattact

SEQ ID NO: 1509955 - DNA, 19 bp, Homo sapiens
attaatctaccttgcagtg

SEQ ID NO: 1509956 - DNA, 13 bp, Homo sapiens
attaatctcaaag

SEQ ID NO: 1509957 - DNA, 13 bp, Homo sapiens
attaatctctaaa

SEQ ID NO: 1509958 - DNA, 22 bp, Homo sapiens
attaatctctaaaattctagtc

SEQ ID NO: 1509959 - DNA, 19 bp, Homo sapiens
attaatcttagtgtatgat

SEQ ID NO: 1509960 - DNA, 17 bp, Homo sapiens
attaatcttattgttta

SEQ ID NO: 1509961 - DNA, 20 bp, Homo sapiens
attaatcttgcttcattgtt

SEQ ID NO: 1509962 - DNA, 23 bp, Homo sapiens
attaatctttctttacctgagac

SEQ ID NO: 1509963 - DNA, 17 bp, Homo sapiens
attaatgaaatatctgt

SEQ ID NO: 1509964 - DNA, 19 bp, Homo sapiens
attaatgaaatatctgtat

SEQ ID NO: 1509965 - DNA, 12 bp, Homo sapiens
attaatgactta

SEQ ID NO: 1509966 - DNA, 15 bp, Homo sapiens
attaatgacttactt

SEQ ID NO: 1509967 - DNA, 18 bp, Homo sapiens
attaatgataaactcaga

SEQ ID NO: 1509968 - DNA, 18 bp, Homo sapiens
attaatgcagatttctct

SEQ ID NO: 1509969 - DNA, 13 bp, Homo sapiens
attaatgcctctc

SEQ ID NO: 1509970 - DNA, 19 bp, Homo sapiens
attaatgcctctcccgcac

SEQ ID NO: 1509971 - DNA, 12 bp, Homo sapiens
attacctgccaa

SEQ ID NO: 1509972 - DNA, 19 bp, Homo sapiens
attacctgccaattgctac

SEQ ID NO: 1509973 - DNA, 20 bp, Homo sapiens
attacctgccaattgctacc

SEQ ID NO: 1509974 - DNA, 20 bp, Homo sapiens
attaccttttttgataaagt

SEQ ID NO: 1509975 - DNA, 15 bp, Homo sapiens
attactaacctccct

SEQ ID NO: 1509976 - DNA, 13 bp, Homo sapiens
attactaatgtac

SEQ ID NO: 1509977 - DNA, 12 bp, Homo sapiens
attactaatttt

SEQ ID NO: 1509978 - DNA, 15 bp, Homo sapiens
attactacaaaattt

SEQ ID NO: 1509979 - DNA, 20 bp, Homo sapiens
attactacaaaatttgaaat

SEQ ID NO: 1509980 - DNA, 22 bp, Homo sapiens
attactcgatcaaaaccttcct

SEQ ID NO: 1509981 - DNA, 13 bp, Homo sapiens
attactctttctc

SEQ ID NO: 1509982 - DNA, 16 bp, Homo sapiens
attactgaataatatc

SEQ ID NO: 1509983 - DNA, 15 bp, Homo sapiens
attactgatgtgata

SEQ ID NO: 1509984 - DNA, 12 bp, Homo sapiens
attactgctaag

SEQ ID NO: 1509985 - DNA, 16 bp, Homo sapiens
attactgctaagtatt

SEQ ID NO: 1509986 - DNA, 17 bp, Homo sapiens
attactggaattcttct

SEQ ID NO: 1509987 - DNA, 19 bp, Homo sapiens
attactggaattcttctgc

SEQ ID NO: 1509988 - DNA, 22 bp, Homo sapiens
attactggcctttttcatttat

SEQ ID NO: 1509989 - DNA, 15 bp, Homo sapiens
attactggtccaaaa

SEQ ID NO: 1509990 - DNA, 15 bp, Homo sapiens
attactgtcaataaa

SEQ ID NO: 1509991 - DNA, 20 bp, Homo sapiens
attactgtctttattcttat

SEQ ID NO: 1509992 - DNA, 13 bp, Homo sapiens
attactgtgattt

SEQ ID NO: 1509993 - DNA, 17 bp, Homo sapiens
attactgtgatttctgg

SEQ ID NO: 1509994 - DNA, 23 bp, Homo sapiens
attacttatcatccacattgttt

SEQ ID NO: 1509995 - DNA, 16 bp, Homo sapiens
attacttatttttgac

SEQ ID NO: 1509996 - DNA, 17 bp, Homo sapiens
attacttatttttgaca

SEQ ID NO: 1509997 - DNA, 13 bp, Homo sapiens
attactttatagc

SEQ ID NO: 1509998 - DNA, 17 bp, Homo sapiens
attactttgtcttttca

SEQ ID NO: 1509999 - DNA, 16 bp, Homo sapiens
attagaaaaaaattac

SEQ ID NO: 1510000 - DNA, 23 bp, Homo sapiens
attagaaaattttgtaaaacaat

SEQ ID NO: 1510001 - DNA, 15 bp, Homo sapiens
attagaaatatttta

SEQ ID NO: 1510002 - DNA, 15 bp, Homo sapiens
attagaaattagaaa

SEQ ID NO: 1510003 - DNA, 23 bp, Homo sapiens
attagaaattagctgtgtgaaat

SEQ ID NO: 1510004 - DNA, 14 bp, Homo sapiens
attagaacccttgc

SEQ ID NO: 1510005 - DNA, 13 bp, Homo sapiens
attagaagacatt

SEQ ID NO: 1510006 - DNA, 21 bp, Homo sapiens
attagaattagtgccagaatt

SEQ ID NO: 1510007 - DNA, 17 bp, Homo sapiens
attagacagaacaccta

SEQ ID NO: 1510008 - DNA, 17 bp, Homo sapiens
attagactgaatttaac

SEQ ID NO: 1510009 - DNA, 22 bp, Homo sapiens
attagacttatagtcctcctgg

SEQ ID NO: 1510010 - DNA, 14 bp, Homo sapiens
attagagaacatcc

SEQ ID NO: 1510011 - DNA, 23 bp, Homo sapiens
attagagtatttcccttccaaag

SEQ ID NO: 1510012 - DNA, 15 bp, Homo sapiens
attagagtcagcctt

SEQ ID NO: 1510013 - DNA, 17 bp, Homo sapiens
attagagtgcaaaagtg

SEQ ID NO: 1510014 - DNA, 22 bp, Homo sapiens
attagatcaattacttatttta

SEQ ID NO: 1510015 - DNA, 16 bp, Homo sapiens
attagattttatttta

SEQ ID NO: 1510016 - DNA, 18 bp, Homo sapiens
attagattttattttact

SEQ ID NO: 1510017 - DNA, 20 bp, Homo sapiens
attagattttattttactat

SEQ ID NO: 1510018 - DNA, 15 bp, Homo sapiens
attagcatgctgctt

SEQ ID NO: 1510019 - DNA, 16 bp, Homo sapiens
attagctaattagaaa

SEQ ID NO: 1510020 - DNA, 17 bp, Homo sapiens
attagctatttctgctc

SEQ ID NO: 1510021 - DNA, 23 bp, Homo sapiens
attagctttgggtgcctttgcca

SEQ ID NO: 1510022 - DNA, 15 bp, Homo sapiens
attaggaaaatatgg

SEQ ID NO: 1510023 - DNA, 20 bp, Homo sapiens
attaggaagtgtaacagctg

SEQ ID NO: 1510024 - DNA, 13 bp, Homo sapiens
attaggaataaat

SEQ ID NO: 1510025 - DNA, 16 bp, Homo sapiens
attaggaataaataaa

SEQ ID NO: 1510026 - DNA, 19 bp, Homo sapiens
attaggatttgccccttcc

SEQ ID NO: 1510027 - DNA, 18 bp, Homo sapiens
attaggccagcaacgctt

SEQ ID NO: 1510028 - DNA, 15 bp, Homo sapiens
attaggctgtaacta

SEQ ID NO: 1510029 - DNA, 11 bp, Homo sapiens
attaggctgtt

SEQ ID NO: 1510030 - DNA, 15 bp, Homo sapiens
attagggatgcctcc

SEQ ID NO: 1510031 - DNA, 15 bp, Homo sapiens
attaggtatatctcc

SEQ ID NO: 1510032 - DNA, 17 bp, Homo sapiens
attagtagttaccacag

SEQ ID NO: 1510033 - DNA, 22 bp, Homo sapiens
attagtatgtctgtttttgtat

SEQ ID NO: 1510034 - DNA, 22 bp, Homo sapiens
attagtcgttatatttgacttg

SEQ ID NO: 1510035 - DNA, 24 bp, Homo sapiens
attagtctatatggttctccaaga

SEQ ID NO: 1510036 - DNA, 15 bp, Homo sapiens
attagtctgaaactg

SEQ ID NO: 1510037 - DNA, 15 bp, Homo sapiens
attagtgattctgat

SEQ ID NO: 1510038 - DNA, 18 bp, Homo sapiens
attagtgattctgatttc

SEQ ID NO: 1510039 - DNA, 16 bp, Homo sapiens
attagtgccacttaat

SEQ ID NO: 1510040 - DNA, 22 bp, Homo sapiens
attagtgccacttaatgtatgt

SEQ ID NO: 1510041 - DNA, 21 bp, Homo sapiens
attagtgtgacagtttccaaa

SEQ ID NO: 1510042 - DNA, 23 bp, Homo sapiens
attagtgtgacagtttccaaatt

SEQ ID NO: 1510043 - DNA, 18 bp, Homo sapiens
attagtttatattactct

SEQ ID NO: 1510044 - DNA, 18 bp, Homo sapiens
attataaacaagaatgaa

SEQ ID NO: 1510045 - DNA, 13 bp, Homo sapiens
attataaactata

SEQ ID NO: 1510046 - DNA, 18 bp, Homo sapiens
attataaactataaactt

SEQ ID NO: 1510047 - DNA, 20 bp, Homo sapiens
attataaactataaacttaa

SEQ ID NO: 1510048 - DNA, 16 bp, Homo sapiens
attataaatattttcc

SEQ ID NO: 1510049 - DNA, 15 bp, Homo sapiens
attataacaactatt

SEQ ID NO: 1510050 - DNA, 17 bp, Homo sapiens
attataacagttatatt

SEQ ID NO: 1510051 - DNA, 22 bp, Homo sapiens
attataagggagagctgagcca

SEQ ID NO: 1510052 - DNA, 16 bp, Homo sapiens
attataagttctattt

SEQ ID NO: 1510053 - DNA, 22 bp, Homo sapiens
attataatatactatatttatg

SEQ ID NO: 1510054 - DNA, 18 bp, Homo sapiens
attataatatgtgcctta

SEQ ID NO: 1510055 - DNA, 19 bp, Homo sapiens
attataatctcaaaggaga

SEQ ID NO: 1510056 - DNA, 14 bp, Homo sapiens
attataatcttata

SEQ ID NO: 1510057 - DNA, 21 bp, Homo sapiens
attataatgtattcatatttg

SEQ ID NO: 1510058 - DNA, 15 bp, Homo sapiens
attataattgttgca

SEQ ID NO: 1510059 - DNA, 16 bp, Homo sapiens
attataattgttgcat

SEQ ID NO: 1510060 - DNA, 15 bp, Homo sapiens
attataatttaatgc

SEQ ID NO: 1510061 - DNA, 22 bp, Homo sapiens
attataatttttttcaatattt

SEQ ID NO: 1510062 - DNA, 20 bp, Homo sapiens
attatacatgtgatacattt

SEQ ID NO: 1510063 - DNA, 21 bp, Homo sapiens
attatacatgtgatacatttt

SEQ ID NO: 1510064 - DNA, 18 bp, Homo sapiens
attatactgtattaagag

SEQ ID NO: 1510065 - DNA, 11 bp, Homo sapiens
attatagaaaa

SEQ ID NO: 1510066 - DNA, 16 bp, Homo sapiens
attatagacaaaagaa

SEQ ID NO: 1510067 - DNA, 16 bp, Homo sapiens
attatagagcagaaat

SEQ ID NO: 1510068 - DNA, 19 bp, Homo sapiens
attatagagcagaaattct

SEQ ID NO: 1510069 - DNA, 21 bp, Homo sapiens
attatagagcagaaattctgt

SEQ ID NO: 1510070 - DNA, 17 bp, Homo sapiens
attatagattctaaaga

SEQ ID NO: 1510071 - DNA, 16 bp, Homo sapiens
attatagcaaccattt

SEQ ID NO: 1510072 - DNA, 19 bp, Homo sapiens
attatagtttctgaggctt

SEQ ID NO: 1510073 - DNA, 17 bp, Homo sapiens
attatataactgtattt

SEQ ID NO: 1510074 - DNA, 13 bp, Homo sapiens
attatatatatat

SEQ ID NO: 1510075 - DNA, 14 bp, Homo sapiens
attatatatatcta

SEQ ID NO: 1510076 - DNA, 16 bp, Homo sapiens
attatatctaattatt

SEQ ID NO: 1510077 - DNA, 20 bp, Homo sapiens
attatatgaccatatttact

SEQ ID NO: 1510078 - DNA, 21 bp, Homo sapiens
attatatgcctgattcatagt

SEQ ID NO: 1510079 - DNA, 18 bp, Homo sapiens
attatatgttcagattat

SEQ ID NO: 1510080 - DNA, 23 bp, Homo sapiens
attatattggtgcgtttttacag

SEQ ID NO: 1510081 - DNA, 15 bp, Homo sapiens
attatatttgacatg

SEQ ID NO: 1510082 - DNA, 20 bp, Homo sapiens
attatcaaagggataaagaa

SEQ ID NO: 1510083 - DNA, 19 bp, Homo sapiens
attatcaatatctaatata

SEQ ID NO: 1510084 - DNA, 23 bp, Homo sapiens
attatcacattaatctcaaagag

SEQ ID NO: 1510085 - DNA, 16 bp, Homo sapiens
attatcagcaaagaaa

SEQ ID NO: 1510086 - DNA, 20 bp, Homo sapiens
attatcatgcgttttatatc

SEQ ID NO: 1510087 - DNA, 21 bp, Homo sapiens
attatcattgctcccctgata

SEQ ID NO: 1510088 - DNA, 23 bp, Homo sapiens
attatcgctttatgtttttggtt

SEQ ID NO: 1510089 - DNA, 21 bp, Homo sapiens
attatcggaagcagtgccttc

SEQ ID NO: 1510090 - DNA, 21 bp, Homo sapiens
attatcgggagcagtgtcttc

SEQ ID NO: 1510091 - DNA, 13 bp, Homo sapiens
attatctaattta

SEQ ID NO: 1510092 - DNA, 19 bp, Homo sapiens
attatctctttgatctact

SEQ ID NO: 1510093 - DNA, 20 bp, Homo sapiens
attatctctttgatctactt

SEQ ID NO: 1510094 - DNA, 21 bp, Homo sapiens
attatctctttgatctacttg

SEQ ID NO: 1510095 - DNA, 12 bp, Homo sapiens
attatcttcata

SEQ ID NO: 1510096 - DNA, 18 bp, Homo sapiens
attatcttgttcaggaaa

SEQ ID NO: 1510097 - DNA, 13 bp, Homo sapiens
attatgaaaacta

SEQ ID NO: 1510098 - DNA, 15 bp, Homo sapiens
attatgacagttata

SEQ ID NO: 1510099 - DNA, 19 bp, Homo sapiens
attatgacagttatactgt

SEQ ID NO: 1510100 - DNA, 17 bp, Homo sapiens
attatgatcctctattt

SEQ ID NO: 1510101 - DNA, 12 bp, Homo sapiens
attatgatctaa

SEQ ID NO: 1510102 - DNA, 14 bp, Homo sapiens
attatgatctaata

SEQ ID NO: 1510103 - DNA, 22 bp, Homo sapiens
attatgatctaataaactttat

SEQ ID NO: 1510104 - DNA, 17 bp, Homo sapiens
attatgatgcatacagt

SEQ ID NO: 1510105 - DNA, 21 bp, Homo sapiens
attatgatgcatacagttttc

SEQ ID NO: 1510106 - DNA, 18 bp, Homo sapiens
attatgcaaaagcagcta

SEQ ID NO: 1510107 - DNA, 22 bp, Homo sapiens
attatgccacttccttttaact

SEQ ID NO: 1510108 - DNA, 14 bp, Homo sapiens
attatggcatttct

SEQ ID NO: 1510109 - DNA, 16 bp, Homo sapiens
attatgggtcctgcaa

SEQ ID NO: 1510110 - DNA, 22 bp, Homo sapiens
attatgtaaaatgttttagcaa

SEQ ID NO: 1510111 - DNA, 16 bp, Homo sapiens
attatgtatgtttaca

SEQ ID NO: 1510112 - DNA, 17 bp, Homo sapiens
attatgtccactgtgta

SEQ ID NO: 1510113 - DNA, 14 bp, Homo sapiens
attatgtcttcttt

SEQ ID NO: 1510114 - DNA, 19 bp, Homo sapiens
attatgtgcctaattttct

SEQ ID NO: 1510115 - DNA, 20 bp, Homo sapiens
attatgttatacaaggcaag

SEQ ID NO: 1510116 - DNA, 21 bp, Homo sapiens
attatgttcctgctgtatttc

SEQ ID NO: 1510117 - DNA, 13 bp, Homo sapiens
attattaaacgat

SEQ ID NO: 1510118 - DNA, 17 bp, Homo sapiens
attattagataatattt

SEQ ID NO: 1510119 - DNA, 13 bp, Homo sapiens
attattataaact

SEQ ID NO: 1510120 - DNA, 13 bp, Homo sapiens
attattatgttct

SEQ ID NO: 1510121 - DNA, 14 bp, Homo sapiens
attattattatttg

SEQ ID NO: 1510122 - DNA, 13 bp, Homo sapiens
attattatttctg

SEQ ID NO: 1510123 - DNA, 14 bp, Homo sapiens
attattatttgctt

SEQ ID NO: 1510124 - DNA, 19 bp, Homo sapiens
attattcaaaaaatcatgt

SEQ ID NO: 1510125 - DNA, 12 bp, Homo sapiens
attattcaagaa

SEQ ID NO: 1510126 - DNA, 18 bp, Homo sapiens
attattcaagaatgaaaa

SEQ ID NO: 1510127 - DNA, 17 bp, Homo sapiens
attattcaagtgcctct

SEQ ID NO: 1510128 - DNA, 15 bp, Homo sapiens
attattcatttaaaa

SEQ ID NO: 1510129 - DNA, 16 bp, Homo sapiens
attattcatttaaaat

SEQ ID NO: 1510130 - DNA, 18 bp, Homo sapiens
attattcatttaaaatga

SEQ ID NO: 1510131 - DNA, 21 bp, Homo sapiens
attattcatttaaaatgatta

SEQ ID NO: 1510132 - DNA, 22 bp, Homo sapiens
attctattgcagttatagaaaa

SEQ ID NO: 1510133 - DNA, 23 bp, Homo sapiens
attctatttcccctcttctgcta

SEQ ID NO: 1510134 - DNA, 13 bp, Homo sapiens
attctcaaagcag

SEQ ID NO: 1510135 - DNA, 14 bp, Homo sapiens
attgtaatgtaata

SEQ ID NO: 1510136 - DNA, 15 bp, Homo sapiens
attgtaatgtaataa

SEQ ID NO: 1510137 - DNA, 23 bp, Homo sapiens
attgtaatgtaataaaaatagtt

SEQ ID NO: 1510138 - DNA, 17 bp, Homo sapiens
attgtaatgttgtgaat

SEQ ID NO: 1510139 - DNA, 15 bp, Homo sapiens
attgtacaaaattaa

SEQ ID NO: 1510140 - DNA, 20 bp, Homo sapiens
attgtacaaatgtaagcaaa

SEQ ID NO: 1510141 - DNA, 15 bp, Homo sapiens
attgtacaataaatt

SEQ ID NO: 1510142 - DNA, 17 bp, Homo sapiens
attgtacgaagagtatt

SEQ ID NO: 1510143 - DNA, 16 bp, Homo sapiens
attgtactaatctgag

SEQ ID NO: 1510144 - DNA, 14 bp, Homo sapiens
attgtactctgctt

SEQ ID NO: 1510145 - DNA, 16 bp, Homo sapiens
attgtactctgcttta

SEQ ID NO: 1510146 - DNA, 19 bp, Homo sapiens
attgtactctgctttatca

SEQ ID NO: 1510147 - DNA, 18 bp, Homo sapiens
attgtagcagttacagct

SEQ ID NO: 1510148 - DNA, 15 bp, Homo sapiens
attgtagcatttctt

SEQ ID NO: 1510149 - DNA, 16 bp, Homo sapiens
attgtagttctgtgta

SEQ ID NO: 1510150 - DNA, 19 bp, Homo sapiens
attgtataagtcaagcaca

SEQ ID NO: 1510151 - DNA, 17 bp, Homo sapiens
attgtatcaatttgttt

SEQ ID NO: 1510152 - DNA, 12 bp, Homo sapiens
attgtatgaaaa

SEQ ID NO: 1510153 - DNA, 16 bp, Homo sapiens
attgtattaggaaaat

SEQ ID NO: 1510154 - DNA, 21 bp, Homo sapiens
attgtattagtattgtgaata

SEQ ID NO: 1510155 - DNA, 18 bp, Homo sapiens
attgtattgaaaacactt

SEQ ID NO: 1510156 - DNA, 15 bp, Homo sapiens
attgtatttatgtgt

SEQ ID NO: 1510157 - DNA, 23 bp, Homo sapiens
attgtcagatattttttcagaaa

SEQ ID NO: 1510158 - DNA, 13 bp, Homo sapiens
attgtcagctact

SEQ ID NO: 1510159 - DNA, 13 bp, Homo sapiens
attgtccaaagtt

SEQ ID NO: 1510160 - DNA, 14 bp, Homo sapiens
attgtccaaagttt

SEQ ID NO: 1510161 - DNA, 19 bp, Homo sapiens
attgtcctccttttcactt

SEQ ID NO: 1510162 - DNA, 20 bp, Homo sapiens
attgtcctccttttcacttt

SEQ ID NO: 1510163 - DNA, 14 bp, Homo sapiens
attgtccttcagag

SEQ ID NO: 1510164 - DNA, 16 bp, Homo sapiens
attgtccttcagagct

SEQ ID NO: 1510165 - DNA, 17 bp, Homo sapiens
attgtcgctatgtgact

SEQ ID NO: 1510166 - DNA, 18 bp, Homo sapiens
attgtcgctatgtgactt

SEQ ID NO: 1510167 - DNA, 20 bp, Homo sapiens
attgtctactcctagaagaa

SEQ ID NO: 1510168 - DNA, 12 bp, Homo sapiens
attgtctattta

SEQ ID NO: 1510169 - DNA, 14 bp, Homo sapiens
attgtctatttatc

SEQ ID NO: 1510170 - DNA, 22 bp, Homo sapiens
attgtctcctatatatttctat

SEQ ID NO: 1510171 - DNA, 14 bp, Homo sapiens
attgtctttgctgt

SEQ ID NO: 1510172 - DNA, 15 bp, Homo sapiens
attgtcttttagaca

SEQ ID NO: 1510173 - DNA, 19 bp, Homo sapiens
attgtcttttttttccttt

SEQ ID NO: 1510174 - DNA, 14 bp, Homo sapiens
attgtgaagattga

SEQ ID NO: 1510175 - DNA, 15 bp, Homo sapiens
attgtgaccaagtta

SEQ ID NO: 1510176 - DNA, 21 bp, Homo sapiens
attgtgaccaatacatttgta

SEQ ID NO: 1510177 - DNA, 17 bp, Homo sapiens
attgtgaccactgaatt

SEQ ID NO: 1510178 - DNA, 19 bp, Homo sapiens
attgtgactgtgtttgcat

SEQ ID NO: 1510179 - DNA, 22 bp, Homo sapiens
attgtgacttcactgtatataa

SEQ ID NO: 1510180 - DNA, 23 bp, Homo sapiens
attgtgacttcactgtatataaa

SEQ ID NO: 1510181 - DNA, 14 bp, Homo sapiens
attgtgagctctgg

SEQ ID NO: 1510182 - DNA, 19 bp, Homo sapiens
attgtgagctctggttatt

SEQ ID NO: 1510183 - DNA, 15 bp, Homo sapiens
attgtgatgtgtcct

SEQ ID NO: 1510184 - DNA, 23 bp, Homo sapiens
attgtgattagacagaacaccta

SEQ ID NO: 1510185 - DNA, 15 bp, Homo sapiens
attgtgattctgttt

SEQ ID NO: 1510186 - DNA, 12 bp, Homo sapiens
attgtgctgcca

SEQ ID NO: 1510187 - DNA, 11 bp, Homo sapiens
attgtggaaaa

SEQ ID NO: 1510188 - DNA, 15 bp, Homo sapiens
attgtggaaaaccag

SEQ ID NO: 1510189 - DNA, 17 bp, Homo sapiens
attgtggaaaaccagga

SEQ ID NO: 1510190 - DNA, 22 bp, Homo sapiens
attgtggatgtgttcattcaag

SEQ ID NO: 1510191 - DNA, 22 bp, Homo sapiens
attgtggattataaaaaatgta

SEQ ID NO: 1510192 - DNA, 12 bp, Homo sapiens
attgtggctcct

SEQ ID NO: 1510193 - DNA, 12 bp, Homo sapiens
atttaaggtatt

SEQ ID NO: 1510194 - DNA, 19 bp, Homo sapiens
atttaagtgacacagacat

SEQ ID NO: 1510195 - DNA, 23 bp, Homo sapiens
atttaagtgacacagacattttg

SEQ ID NO: 1510196 - DNA, 15 bp, Homo sapiens
atttaataaaaagga

SEQ ID NO: 1510197 - DNA, 18 bp, Homo sapiens
atttaataaaaaggaata

SEQ ID NO: 1510198 - DNA, 13 bp, Homo sapiens
atttaataaagat

SEQ ID NO: 1510199 - DNA, 14 bp, Homo sapiens
atttaataaagatg

SEQ ID NO: 1510200 - DNA, 15 bp, Homo sapiens
atttaataaagatga

SEQ ID NO: 1510201 - DNA, 17 bp, Homo sapiens
atttaataaagatgagt

SEQ ID NO: 1510202 - DNA, 22 bp, Homo sapiens
atttaataatgctttaaaataa

SEQ ID NO: 1510203 - DNA, 12 bp, Homo sapiens
atttaatacagc

SEQ ID NO: 1510204 - DNA, 13 bp, Homo sapiens
atttaatacagca

SEQ ID NO: 1510205 - DNA, 18 bp, Homo sapiens
atttaatagctgtgatca

SEQ ID NO: 1510206 - DNA, 21 bp, Homo sapiens
atttaatatactgcatatcct

SEQ ID NO: 1510207 - DNA, 12 bp, Homo sapiens
atttaatatcaa

SEQ ID NO: 1510208 - DNA, 15 bp, Homo sapiens
atttaatatcttcag

SEQ ID NO: 1510209 - DNA, 19 bp, Homo sapiens
atttaatcttttcttattt

SEQ ID NO: 1510210 - DNA, 14 bp, Homo sapiens
atttaatgctgtgg

SEQ ID NO: 1510211 - DNA, 23 bp, Homo sapiens
atttaatggaagtgtatttattt

SEQ ID NO: 1510212 - DNA, 22 bp, Homo sapiens
atttaatggcagctagtgcctt

SEQ ID NO: 1510213 - DNA, 19 bp, Homo sapiens
atttaattaatcatgaatg

SEQ ID NO: 1510214 - DNA, 18 bp, Homo sapiens
atttaattcctcttttta

SEQ ID NO: 1510215 - DNA, 21 bp, Homo sapiens
atttaattcttcacctttgta

SEQ ID NO: 1510216 - DNA, 18 bp, Homo sapiens
atttaatttaggacacat

SEQ ID NO: 1510217 - DNA, 13 bp, Homo sapiens
atttaattttgac

SEQ ID NO: 1510218 - DNA, 16 bp, Homo sapiens
atttaattttgacact

SEQ ID NO: 1510219 - DNA, 19 bp, Homo sapiens
atttaattttgacactata

SEQ ID NO: 1510220 - DNA, 16 bp, Homo sapiens
atttacaaaagattta

SEQ ID NO: 1510221 - DNA, 14 bp, Homo sapiens
atttacaataaata

SEQ ID NO: 1510222 - DNA, 17 bp, Homo sapiens
atttacaataaatattc

SEQ ID NO: 1510223 - DNA, 15 bp, Homo sapiens
atttacactggtcta

SEQ ID NO: 1510224 - DNA, 20 bp, Homo sapiens
atttacatgaattgcatttt

SEQ ID NO: 1510225 - DNA, 18 bp, Homo sapiens
atttacatttaatacaga

SEQ ID NO: 1510226 - DNA, 15 bp, Homo sapiens
atttacatttaatag

SEQ ID NO: 1510227 - DNA, 13 bp, Homo sapiens
atttacattttat

SEQ ID NO: 1510228 - DNA, 14 bp, Homo sapiens
atttaccaaagtag

SEQ ID NO: 1510229 - DNA, 16 bp, Homo sapiens
atttactcctcctgct

SEQ ID NO: 1510230 - DNA, 16 bp, Homo sapiens
atttactcttcttcat

SEQ ID NO: 1510231 - DNA, 19 bp, Homo sapiens
atttacttcttatacattt

SEQ ID NO: 1510232 - DNA, 15 bp, Homo sapiens
atttacttgttttgg

SEQ ID NO: 1510233 - DNA, 15 bp, Homo sapiens
atttacttttaataa

SEQ ID NO: 1510234 - DNA, 13 bp, Homo sapiens
atttagaaaaaag

SEQ ID NO: 1510235 - DNA, 18 bp, Homo sapiens
atttagaagaaagatgtt

SEQ ID NO: 1510236 - DNA, 21 bp, Homo sapiens
atttagaagccaactatgatt

SEQ ID NO: 1510237 - DNA, 12 bp, Homo sapiens
atttagaatcta

SEQ ID NO: 1510238 - DNA, 14 bp, Homo sapiens
atttagaatctaga

SEQ ID NO: 1510239 - DNA, 17 bp, Homo sapiens
atttagaatggtgattt

SEQ ID NO: 1510240 - DNA, 20 bp, Homo sapiens
atttagacaagagatgggaa

SEQ ID NO: 1510241 - DNA, 17 bp, Homo sapiens
atttagagatgaattaa

SEQ ID NO: 1510242 - DNA, 22 bp, Homo sapiens
atttagagatgaattaaattta

SEQ ID NO: 1510243 - DNA, 14 bp, Homo sapiens
atttagagttctag

SEQ ID NO: 1510244 - DNA, 16 bp, Homo sapiens
atttagatctcctgta

SEQ ID NO: 1510245 - DNA, 18 bp, Homo sapiens
atttagatttgttttgca

SEQ ID NO: 1510246 - DNA, 22 bp, Homo sapiens
atttagctgtggctccctcctc

SEQ ID NO: 1510247 - DNA, 17 bp, Homo sapiens
atttagggccttttctg

SEQ ID NO: 1510248 - DNA, 16 bp, Homo sapiens
atttagtattatcaaa

SEQ ID NO: 1510249 - DNA, 16 bp, Homo sapiens
atttagtgctaaacaa

SEQ ID NO: 1510250 - DNA, 18 bp, Homo sapiens
atttagtggatggaatat

SEQ ID NO: 1510251 - DNA, 16 bp, Homo sapiens
atttagttgtaaacca

SEQ ID NO: 1510252 - DNA, 17 bp, Homo sapiens
atttagtttttaacaat

SEQ ID NO: 1510253 - DNA, 19 bp, Homo sapiens
atttagtttttgtaattta

SEQ ID NO: 1510254 - DNA, 20 bp, Homo sapiens
atttagtttttgtaatttat

SEQ ID NO: 1510255 - DNA, 16 bp, Homo sapiens
atttataaaaaggtgt

SEQ ID NO: 1510256 - DNA, 20 bp, Homo sapiens
atttgtaatatttttgtcat

SEQ ID NO: 1510257 - DNA, 19 bp, Homo sapiens
atttgtaattaaaagcaaa

SEQ ID NO: 1510258 - DNA, 21 bp, Homo sapiens
atttgtaattaaaagcaaatc

SEQ ID NO: 1510259 - DNA, 13 bp, Homo sapiens
atttgtacaaaaa

SEQ ID NO: 1510260 - DNA, 15 bp, Homo sapiens
atttgtacaaataaa

SEQ ID NO: 1510261 - DNA, 19 bp, Homo sapiens
atttgtacaaataaacctg

SEQ ID NO: 1510262 - DNA, 16 bp, Homo sapiens
atttgtacaattttaa

SEQ ID NO: 1510263 - DNA, 18 bp, Homo sapiens
atttgtacaggactgtaa

SEQ ID NO: 1510264 - DNA, 22 bp, Homo sapiens
atttgtacaggactgtaaagat

SEQ ID NO: 1510265 - DNA, 16 bp, Homo sapiens
atttgtacatatgtaa

SEQ ID NO: 1510266 - DNA, 18 bp, Homo sapiens
atttgtacatatgtaaaa

SEQ ID NO: 1510267 - DNA, 23 bp, Homo sapiens
atttgtactgaaaaatggtaatt

SEQ ID NO: 1510268 - DNA, 13 bp, Homo sapiens
atttgtacttctt

SEQ ID NO: 1510269 - DNA, 20 bp, Homo sapiens
atttgtacttcttattgcaa

SEQ ID NO: 1510270 - DNA, 15 bp, Homo sapiens
atttgtactttctgt

SEQ ID NO: 1510271 - DNA, 18 bp, Homo sapiens
atttgtactttctgttaa

SEQ ID NO: 1510272 - DNA, 20 bp, Homo sapiens
atttgtactttctgttaaaa

SEQ ID NO: 1510273 - DNA, 15 bp, Homo sapiens
atttgtagcactgag

SEQ ID NO: 1510274 - DNA, 15 bp, Homo sapiens
atttgtataaagaaa

SEQ ID NO: 1510275 - DNA, 22 bp, Homo sapiens
atttgtataaagaaactggtcc

SEQ ID NO: 1510276 - DNA, 18 bp, Homo sapiens
atttgtatagttgcttgc

SEQ ID NO: 1510277 - DNA, 23 bp, Homo sapiens
atttgtatgaataatgaaaataa

SEQ ID NO: 1510278 - DNA, 17 bp, Homo sapiens
atttgtattaataaagc

SEQ ID NO: 1510279 - DNA, 16 bp, Homo sapiens
atttgtatttattctt

SEQ ID NO: 1510280 - DNA, 21 bp, Homo sapiens
atttgtatttctcttgtcctt

SEQ ID NO: 1510281 - DNA, 14 bp, Homo sapiens
atttgtcaatgaca

SEQ ID NO: 1510282 - DNA, 15 bp, Homo sapiens
atttgtcccagcctg

SEQ ID NO: 1510283 - DNA, 19 bp, Homo sapiens
atttgtctgtaaaaaatgg

SEQ ID NO: 1510284 - DNA, 15 bp, Homo sapiens
atttgtcttccgatc

SEQ ID NO: 1510285 - DNA, 15 bp, Homo sapiens
atttgtcttgcctta

SEQ ID NO: 1510286 - DNA, 23 bp, Homo sapiens
atttgtctttgtaatattttcca

SEQ ID NO: 1510287 - DNA, 20 bp, Homo sapiens
atttgtgaactggaagaaag

SEQ ID NO: 1510288 - DNA, 22 bp, Homo sapiens
atttgtgcaaacatggagaaat

SEQ ID NO: 1510289 - DNA, 14 bp, Homo sapiens
atttgtgccagagg

SEQ ID NO: 1510290 - DNA, 20 bp, Homo sapiens
atttgtgctagaaattttca

SEQ ID NO: 1510291 - DNA, 18 bp, Homo sapiens
atttgtgtaatatgaaat

SEQ ID NO: 1510292 - DNA, 14 bp, Homo sapiens
atttgtgtggaaat

SEQ ID NO: 1510293 - DNA, 17 bp, Homo sapiens
atttgtgtggaaatcat

SEQ ID NO: 1510294 - DNA, 18 bp, Homo sapiens
atttgtgtggaaatcata

SEQ ID NO: 1510295 - DNA, 20 bp, Homo sapiens
atttgtgttttaatttaaac

SEQ ID NO: 1510296 - DNA, 12 bp, Homo sapiens
atttgtgttttg

SEQ ID NO: 1510297 - DNA, 13 bp, Homo sapiens
atttgtgtttttc

SEQ ID NO: 1510298 - DNA, 16 bp, Homo sapiens
atttgttatatataat

SEQ ID NO: 1510299 - DNA, 18 bp, Homo sapiens
atttgttatatataataa

SEQ ID NO: 1510300 - DNA, 12 bp, Homo sapiens
atttgttcaagt

SEQ ID NO: 1510301 - DNA, 18 bp, Homo sapiens
atttgttcactgaaggtg

SEQ ID NO: 1510302 - DNA, 23 bp, Homo sapiens
atttgttcactgaaggtgattca

SEQ ID NO: 1510303 - DNA, 21 bp, Homo sapiens
atttgttcctgcttccgagat

SEQ ID NO: 1510304 - DNA, 16 bp, Homo sapiens
atttgttgaaattatg

SEQ ID NO: 1510305 - DNA, 18 bp, Homo sapiens
atttgttgaaattatgta

SEQ ID NO: 1510306 - DNA, 20 bp, Homo sapiens
atttgttgaaattatgtatg

SEQ ID NO: 1510307 - DNA, 22 bp, Homo sapiens
atttgtttaaagaataaagtcc

SEQ ID NO: 1510308 - DNA, 16 bp, Homo sapiens
atttgtttattttttg

SEQ ID NO: 1510309 - DNA, 20 bp, Homo sapiens
atttgtttcatttctgcaga

SEQ ID NO: 1510310 - DNA, 21 bp, Homo sapiens
atttgtttcccccacagtttt

SEQ ID NO: 1510311 - DNA, 14 bp, Homo sapiens
atttgtttgtattc

SEQ ID NO: 1510312 - DNA, 19 bp, Homo sapiens
atttgtttgtattcatgtt

SEQ ID NO: 1510313 - DNA, 14 bp, Homo sapiens
atttgtttgtattt

SEQ ID NO: 1510314 - DNA, 16 bp, Homo sapiens
atttgttttagcatta

SEQ ID NO: 1510315 - DNA, 20 bp, Homo sapiens
atttgttttagcattaccta

SEQ ID NO: 1510316 - DNA, 23 bp, Homo sapiens
atttgttttagcattacctaatt

SEQ ID NO: 1510317 - DNA, 15 bp, Homo sapiens
atttgttttgaattt

SEQ ID NO: 1510318 - DNA, 17 bp, Homo sapiens
atttgttttgaattttg

SEQ ID NO: 1510319 - DNA, 18 bp, Homo sapiens
atttgttttgacggatga

SEQ ID NO: 1510320 - DNA, 12 bp, Homo sapiens
atttgttttgct

SEQ ID NO: 1510321 - DNA, 15 bp, Homo sapiens
atttgttttgctttt

SEQ ID NO: 1510322 - DNA, 12 bp, Homo sapiens
attttaaaaaag

SEQ ID NO: 1510323 - DNA, 14 bp, Homo sapiens
attttaaaaaataa

SEQ ID NO: 1510324 - DNA, 15 bp, Homo sapiens
attttaaaaaataac

SEQ ID NO: 1510325 - DNA, 22 bp, Homo sapiens
attttaaaaaataacatattct

SEQ ID NO: 1510326 - DNA, 22 bp, Homo sapiens
attttaaaaaggaattttgtaa

SEQ ID NO: 1510327 - DNA, 19 bp, Homo sapiens
attttaaaagtctatttta

SEQ ID NO: 1510328 - DNA, 22 bp, Homo sapiens
attttaaaagtctattttatta

SEQ ID NO: 1510329 - DNA, 14 bp, Homo sapiens
attttaaaatatat

SEQ ID NO: 1510330 - DNA, 16 bp, Homo sapiens
attttaaaatatatga

SEQ ID NO: 1510331 - DNA, 17 bp, Homo sapiens
attttaaaatatatgaa

SEQ ID NO: 1510332 - DNA, 12 bp, Homo sapiens
attttaaaatgt

SEQ ID NO: 1510333 - DNA, 13 bp, Homo sapiens
attttaaaatgta

SEQ ID NO: 1510334 - DNA, 15 bp, Homo sapiens
attttaaaatttcat

SEQ ID NO: 1510335 - DNA, 16 bp, Homo sapiens
attttaaaatttcata

SEQ ID NO: 1510336 - DNA, 14 bp, Homo sapiens
attttaaaatttgt

SEQ ID NO: 1510337 - DNA, 13 bp, Homo sapiens
attttaaacaaag

SEQ ID NO: 1510338 - DNA, 22 bp, Homo sapiens
attttaaacaaaggttgagatg

SEQ ID NO: 1510339 - DNA, 14 bp, Homo sapiens
attttaaagacatg

SEQ ID NO: 1510340 - DNA, 19 bp, Homo sapiens
attttaaagtatgcattat

SEQ ID NO: 1510341 - DNA, 21 bp, Homo sapiens
attttaaagttcttattttag

SEQ ID NO: 1510342 - DNA, 14 bp, Homo sapiens
attttaaataaaat

SEQ ID NO: 1510343 - DNA, 19 bp, Homo sapiens
attttaaatataaatagct

SEQ ID NO: 1510344 - DNA, 20 bp, Homo sapiens
attttaaatatccatttatc

SEQ ID NO: 1510345 - DNA, 21 bp, Homo sapiens
attttaaatctaaatctattt

SEQ ID NO: 1510346 - DNA, 12 bp, Homo sapiens
attttaaatgtg

SEQ ID NO: 1510347 - DNA, 18 bp, Homo sapiens
attttaaatgtgtgagtg

SEQ ID NO: 1510348 - DNA, 23 bp, Homo sapiens
attttaaatgtgtgagtgcatgt

SEQ ID NO: 1510349 - DNA, 19 bp, Homo sapiens
attttaaattttatgtcat

SEQ ID NO: 1510350 - DNA, 16 bp, Homo sapiens
attttaacaaaagcaa

SEQ ID NO: 1510351 - DNA, 17 bp, Homo sapiens
attttaacactttgtat

SEQ ID NO: 1510352 - DNA, 20 bp, Homo sapiens
attttaacctagatgtttaa

SEQ ID NO: 1510353 - DNA, 22 bp, Homo sapiens
attttaacctatgatattttct

SEQ ID NO: 1510354 - DNA, 21 bp, Homo sapiens
attttaactaaattttaaagc

SEQ ID NO: 1510355 - DNA, 17 bp, Homo sapiens
attttaactttatcaca

SEQ ID NO: 1510356 - DNA, 19 bp, Homo sapiens
attttaagatccagaaata

SEQ ID NO: 1510357 - DNA, 18 bp, Homo sapiens
attttaagcctttgttga

SEQ ID NO: 1510358 - DNA, 15 bp, Homo sapiens
caaaccctagccttg

SEQ ID NO: 1510359 - DNA, 13 bp, Homo sapiens
caaaccctcctgg

SEQ ID NO: 1510360 - DNA, 15 bp, Homo sapiens
caaaccctgcttctg

SEQ ID NO: 1510361 - DNA, 23 bp, Homo sapiens
caaaccctgcttctgctgccctg

SEQ ID NO: 1510362 - DNA, 16 bp, Homo sapiens
caaacccttgctttcc

SEQ ID NO: 1510363 - DNA, 22 bp, Homo sapiens
caaacccttgctttcctgggcc

SEQ ID NO: 1510364 - DNA, 23 bp, Homo sapiens
caaaccgccagcgaacttgacaa

SEQ ID NO: 1510365 - DNA, 21 bp, Homo sapiens
caaacctgtttaaatatttca

SEQ ID NO: 1510366 - DNA, 20 bp, Homo sapiens
caaacctttattttagaatt

SEQ ID NO: 1510367 - DNA, 17 bp, Homo sapiens
caaacgaataaagatag

SEQ ID NO: 1510368 - DNA, 22 bp, Homo sapiens
caaacgatgtgcaatacatttt

SEQ ID NO: 1510369 - DNA, 21 bp, Homo sapiens
caaacgctaaagagcccttgc

SEQ ID NO: 1510370 - DNA, 13 bp, Homo sapiens
caaacggagcccc

SEQ ID NO: 1510371 - DNA, 17 bp, Homo sapiens
caaacggagcccctgaa

SEQ ID NO: 1510372 - DNA, 18 bp, Homo sapiens
caaacggagcccctgaaa

SEQ ID NO: 1510373 - DNA, 22 bp, Homo sapiens
caaacggagcccctgaaagcct

SEQ ID NO: 1510374 - DNA, 16 bp, Homo sapiens
caaacgggtgcctggt

SEQ ID NO: 1510375 - DNA, 18 bp, Homo sapiens
caaacgtctattttgtat

SEQ ID NO: 1510376 - DNA, 14 bp, Homo sapiens
caaacgtgaaattc

SEQ ID NO: 1510377 - DNA, 22 bp, Homo sapiens
caaactactgaatgaagcagta

SEQ ID NO: 1510378 - DNA, 14 bp, Homo sapiens
caaactatttctta

SEQ ID NO: 1510379 - DNA, 18 bp, Homo sapiens
caaactcactgctcaaga

SEQ ID NO: 1510380 - DNA, 15 bp, Homo sapiens
caaactcaggcccag

SEQ ID NO: 1510381 - DNA, 20 bp, Homo sapiens
caaactcagttcaaaccatt

SEQ ID NO: 1510382 - DNA, 23 bp, Homo sapiens
caaactcataacagtcttactgc

SEQ ID NO: 1510383 - DNA, 12 bp, Homo sapiens
caaactcttcag

SEQ ID NO: 1510384 - DNA, 14 bp, Homo sapiens
caaactgaagccag

SEQ ID NO: 1510385 - DNA, 15 bp, Homo sapiens
caaactgaagccaga

SEQ ID NO: 1510386 - DNA, 16 bp, Homo sapiens
caaactgaatttgttc

SEQ ID NO: 1510387 - DNA, 19 bp, Homo sapiens
caaactgatggaccgggtg

SEQ ID NO: 1510388 - DNA, 15 bp, Homo sapiens
caaactgcaatagag

SEQ ID NO: 1510389 - DNA, 19 bp, Homo sapiens
caaagcgcccacccaggtc

SEQ ID NO: 1510390 - DNA, 13 bp, Homo sapiens
caaagcgggggga

SEQ ID NO: 1510391 - DNA, 22 bp, Homo sapiens
caaagctagggtggcccttgca

SEQ ID NO: 1510392 - DNA, 18 bp, Homo sapiens
caaagctcaaataaaaat

SEQ ID NO: 1510393 - DNA, 21 bp, Homo sapiens
caaagctcaagatgacagctc

SEQ ID NO: 1510394 - DNA, 22 bp, Homo sapiens
caaagctgagcctgcagggaag

SEQ ID NO: 1510395 - DNA, 14 bp, Homo sapiens
caaagctgcccact

SEQ ID NO: 1510396 - DNA, 20 bp, Homo sapiens
caaagctgcccactgtttct

SEQ ID NO: 1510397 - DNA, 12 bp, Homo sapiens
caaagctgcctg

SEQ ID NO: 1510398 - DNA, 18 bp, Homo sapiens
caaagcttctatcccagg

SEQ ID NO: 1510399 - DNA, 19 bp, Homo sapiens
caaagcttgaagatcgtta

SEQ ID NO: 1510400 - DNA, 18 bp, Homo sapiens
caaagcttgtcaaagatg

SEQ ID NO: 1510401 - DNA, 20 bp, Homo sapiens
caaagcttgtcaaagatgcc

SEQ ID NO: 1510402 - DNA, 13 bp, Homo sapiens
caaagctttacta

SEQ ID NO: 1510403 - DNA, 18 bp, Homo sapiens
caaagctttcctgcccca

SEQ ID NO: 1510404 - DNA, 22 bp, Homo sapiens
caaagctttcctgccccaggcc

SEQ ID NO: 1510405 - DNA, 18 bp, Homo sapiens
caaagctttgctacaaat

SEQ ID NO: 1510406 - DNA, 19 bp, Homo sapiens
caaagctttgctacaaatt

SEQ ID NO: 1510407 - DNA, 16 bp, Homo sapiens
caaaggaagtctagga

SEQ ID NO: 1510408 - DNA, 21 bp, Homo sapiens
caaaggaataacctttctgga

SEQ ID NO: 1510409 - DNA, 22 bp, Homo sapiens
caaaggacagtgggcaggaggc

SEQ ID NO: 1510410 - DNA, 12 bp, Homo sapiens
caaaggagaaaa

SEQ ID NO: 1510411 - DNA, 22 bp, Homo sapiens
caaaggagaaaaaaaaccttgt

SEQ ID NO: 1510412 - DNA, 18 bp, Homo sapiens
caaaggagaagcacagct

SEQ ID NO: 1510413 - DNA, 20 bp, Homo sapiens
caaaggagagtcacagaaca

SEQ ID NO: 1510414 - DNA, 18 bp, Homo sapiens
caaaggagcgagcatgtc

SEQ ID NO: 1510415 - DNA, 22 bp, Homo sapiens
caaaggagctttctcaatgtct

SEQ ID NO: 1510416 - DNA, 14 bp, Homo sapiens
caaaggatgaagaa

SEQ ID NO: 1510417 - DNA, 16 bp, Homo sapiens
caaaggatgggggaaa

SEQ ID NO: 1510418 - DNA, 11 bp, Homo sapiens
caaaggcagct

SEQ ID NO: 1510419 - DNA, 23 bp, Homo sapiens
caaaggcgcagtgcttctctaca

SEQ ID NO: 1510420 - DNA, 14 bp, Homo sapiens
caaaggcggggtgg

SEQ ID NO: 1510421 - DNA, 18 bp, Homo sapiens
caaagggaaatatcattt

SEQ ID NO: 1510422 - DNA, 20 bp, Homo sapiens
caaagggaagtaacagacac

SEQ ID NO: 1510423 - DNA, 23 bp, Homo sapiens
caaagggaagtgaggcccaagga

SEQ ID NO: 1510424 - DNA, 15 bp, Homo sapiens
caaagggagagaaaa

SEQ ID NO: 1510425 - DNA, 15 bp, Homo sapiens
caaagggagcagaac

SEQ ID NO: 1510426 - DNA, 21 bp, Homo sapiens
caaagggcagccctccacttc

SEQ ID NO: 1510427 - DNA, 11 bp, Homo sapiens
caaaggggctg

SEQ ID NO: 1510428 - DNA, 11 bp, Homo sapiens
caaagggtgtg

SEQ ID NO: 1510429 - DNA, 23 bp, Homo sapiens
caaatattgaagttgtttatcaa

SEQ ID NO: 1510430 - DNA, 12 bp, Homo sapiens
caaatatttatt

SEQ ID NO: 1510431 - DNA, 20 bp, Homo sapiens
caaatatttattttctttct

SEQ ID NO: 1510432 - DNA, 17 bp, Homo sapiens
caaatcaacttttatgc

SEQ ID NO: 1510433 - DNA, 19 bp, Homo sapiens
caaatcaagagcattgctt

SEQ ID NO: 1510434 - DNA, 17 bp, Homo sapiens
caaatcaatacactagt

SEQ ID NO: 1510435 - DNA, 15 bp, Homo sapiens
caaatcacatatttt

SEQ ID NO: 1510436 - DNA, 19 bp, Homo sapiens
caaatcacatattttaaaa

SEQ ID NO: 1510437 - DNA, 13 bp, Homo sapiens
caaatcagtcagt

SEQ ID NO: 1510438 - DNA, 21 bp, Homo sapiens
caaatcagttactaagaagaa

SEQ ID NO: 1510439 - DNA, 16 bp, Homo sapiens
caaatcatttgtttaa

SEQ ID NO: 1510440 - DNA, 17 bp, Homo sapiens
caaatcatttgtttaaa

SEQ ID NO: 1510441 - DNA, 22 bp, Homo sapiens
caaatcctccctacttccaaga

SEQ ID NO: 1510442 - DNA, 13 bp, Homo sapiens
caaatcctggaag

SEQ ID NO: 1510443 - DNA, 14 bp, Homo sapiens
caaatccttcaaaa

SEQ ID NO: 1510444 - DNA, 14 bp, Homo sapiens
caaatccttggagt

SEQ ID NO: 1510445 - DNA, 19 bp, Homo sapiens
caaatcgtccagcgacctt

SEQ ID NO: 1510446 - DNA, 22 bp, Homo sapiens
caaatctaatctcttattctaa

SEQ ID NO: 1510447 - DNA, 14 bp, Homo sapiens
caaatctaccactg

SEQ ID NO: 1510448 - DNA, 15 bp, Homo sapiens
caaatctattacttt

SEQ ID NO: 1510449 - DNA, 14 bp, Homo sapiens
caaatctgaagatt

SEQ ID NO: 1510450 - DNA, 18 bp, Homo sapiens
caaatctgcaaagcatgt

SEQ ID NO: 1510451 - DNA, 13 bp, Homo sapiens
caaatctgggctc

SEQ ID NO: 1510452 - DNA, 18 bp, Homo sapiens
caaatctgtcagcatctg

SEQ ID NO: 1510453 - DNA, 15 bp, Homo sapiens
caaatctgtcctctg

SEQ ID NO: 1510454 - DNA, 23 bp, Homo sapiens
caaatcttgtttacaaaatattc

SEQ ID NO: 1510455 - DNA, 15 bp, Homo sapiens
caaatgaagaaagtc

SEQ ID NO: 1510456 - DNA, 18 bp, Homo sapiens
caaatgacatgcactgac

SEQ ID NO: 1510457 - DNA, 19 bp, Homo sapiens
caaatgacatgcactgacc

SEQ ID NO: 1510458 - DNA, 14 bp, Homo sapiens
caaatgagtaacat

SEQ ID NO: 1510459 - DNA, 15 bp, Homo sapiens
caaatgatcctagta

SEQ ID NO: 1510460 - DNA, 15 bp, Homo sapiens
caaatgatcctccca

SEQ ID NO: 1510461 - DNA, 20 bp, Homo sapiens
caaatgatgattatgagttc

SEQ ID NO: 1510462 - DNA, 22 bp, Homo sapiens
caaatgcagggattgctgccac

SEQ ID NO: 1510463 - DNA, 17 bp, Homo sapiens
caaatgcgcgtgtgcac

SEQ ID NO: 1510464 - DNA, 15 bp, Homo sapiens
caaatgctgtattct

SEQ ID NO: 1510465 - DNA, 22 bp, Homo sapiens
caaatggaaagtaactcatttg

SEQ ID NO: 1510466 - DNA, 20 bp, Homo sapiens
caaatggagctttctgtata

SEQ ID NO: 1510467 - DNA, 14 bp, Homo sapiens
caaatggaggaata

SEQ ID NO: 1510468 - DNA, 24 bp, Homo sapiens
caaatggccagttttctggtagga

SEQ ID NO: 1510469 - DNA, 15 bp, Homo sapiens
caaatggggccagat

SEQ ID NO: 1510470 - DNA, 20 bp, Homo sapiens
caaatggggccagatccagc

SEQ ID NO: 1510471 - DNA, 23 bp, Homo sapiens
caaatggttaccttgttatttaa

SEQ ID NO: 1510472 - DNA, 13 bp, Homo sapiens
caaatgtaaatca

SEQ ID NO: 1510473 - DNA, 18 bp, Homo sapiens
caacaccacagacacaca

SEQ ID NO: 1510474 - DNA, 22 bp, Homo sapiens
caacaccaggacttaagacaaa

SEQ ID NO: 1510475 - DNA, 22 bp, Homo sapiens
caacaccccgcctgcctcctgg

SEQ ID NO: 1510476 - DNA, 23 bp, Homo sapiens
caacaccttcagaggctgaggtg

SEQ ID NO: 1510477 - DNA, 18 bp, Homo sapiens
caacactacttccctgcc

SEQ ID NO: 1510478 - DNA, 19 bp, Homo sapiens
caacactgtccttccctgc

SEQ ID NO: 1510479 - DNA, 21 bp, Homo sapiens
caacactgtccttccctgcca

SEQ ID NO: 1510480 - DNA, 23 bp, Homo sapiens
caacactgtccttccctgccact

SEQ ID NO: 1510481 - DNA, 14 bp, Homo sapiens
caacactgtgccct

SEQ ID NO: 1510482 - DNA, 16 bp, Homo sapiens
caacactgtgccctgg

SEQ ID NO: 1510483 - DNA, 18 bp, Homo sapiens
caacactgtgccctggtg

SEQ ID NO: 1510484 - DNA, 19 bp, Homo sapiens
caacactgtgccctggtgg

SEQ ID NO: 1510485 - DNA, 10 bp, Homo sapiens
caacagaaaa

SEQ ID NO: 1510486 - DNA, 14 bp, Homo sapiens
caacagaaaaacaa

SEQ ID NO: 1510487 - DNA, 14 bp, Homo sapiens
caacagaaaaatgg

SEQ ID NO: 1510488 - DNA, 12 bp, Homo sapiens
caacagaaagag

SEQ ID NO: 1510489 - DNA, 23 bp, Homo sapiens
caacagaagtcatgaagcccaag

SEQ ID NO: 1510490 - DNA, 16 bp, Homo sapiens
caacagaatttttccc

SEQ ID NO: 1510491 - DNA, 17 bp, Homo sapiens
caacagagaaggcagga

SEQ ID NO: 1510492 - DNA, 20 bp, Homo sapiens
caacagagactgaatagata

SEQ ID NO: 1510493 - DNA, 17 bp, Homo sapiens
caacagatactggaagt

SEQ ID NO: 1510494 - DNA, 13 bp, Homo sapiens
caacagattcaga

SEQ ID NO: 1510495 - DNA, 19 bp, Homo sapiens
caacagattcagaatgaga

SEQ ID NO: 1510496 - DNA, 16 bp, Homo sapiens
caacagcaaaggaact

SEQ ID NO: 1510497 - DNA, 17 bp, Homo sapiens
caacagcacctccccgc

SEQ ID NO: 1510498 - DNA, 12 bp, Homo sapiens
caacagcacttt

SEQ ID NO: 1510499 - DNA, 20 bp, Homo sapiens
caacagcagtctccttcagc

SEQ ID NO: 1510500 - DNA, 21 bp, Homo sapiens
caacagcagtctccttcagca

SEQ ID NO: 1510501 - DNA, 23 bp, Homo sapiens
caacagcagtgatctcagggcag

SEQ ID NO: 1510502 - DNA, 20 bp, Homo sapiens
caacaggaatctcagagaca

SEQ ID NO: 1510503 - DNA, 22 bp, Homo sapiens
caacagggaagaaactttctgg

SEQ ID NO: 1510504 - DNA, 22 bp, Homo sapiens
caacagggagcacctgtctgga

SEQ ID NO: 1510505 - DNA, 23 bp, Homo sapiens
caacaggtaaaacagggccacat

SEQ ID NO: 1510506 - DNA, 21 bp, Homo sapiens
caacaggtgctgaactgtgca

SEQ ID NO: 1510507 - DNA, 14 bp, Homo sapiens
caacagtcaaaaca

SEQ ID NO: 1510508 - DNA, 18 bp, Homo sapiens
caacagtcaaaacagaga

SEQ ID NO: 1510509 - DNA, 20 bp, Homo sapiens
caacagttgtatgtttgctg

SEQ ID NO: 1510510 - DNA, 22 bp, Homo sapiens
caacagttttttatgctaatca

SEQ ID NO: 1510511 - DNA, 22 bp, Homo sapiens
caacataaaacaaaaccaagcc

SEQ ID NO: 1510512 - DNA, 22 bp, Homo sapiens
caacatagtgagatcccatttc

SEQ ID NO: 1510513 - DNA, 12 bp, Homo sapiens
caacatatacaa

SEQ ID NO: 1510514 - DNA, 21 bp, Homo sapiens
caacatatatttattgagtac

SEQ ID NO: 1510515 - DNA, 16 bp, Homo sapiens
caacatcacagcccag

SEQ ID NO: 1510516 - DNA, 17 bp, Homo sapiens
caacatcacagcccagc

SEQ ID NO: 1510517 - DNA, 19 bp, Homo sapiens
caacatcccattgccctgg

SEQ ID NO: 1510518 - DNA, 13 bp, Homo sapiens
caacatctagcaa

SEQ ID NO: 1510519 - DNA, 14 bp, Homo sapiens
caacatctgagtgc

SEQ ID NO: 1510520 - DNA, 16 bp, Homo sapiens
caacatcttttttatt

SEQ ID NO: 1510521 - DNA, 15 bp, Homo sapiens
caacatgaggacaga

SEQ ID NO: 1510522 - DNA, 18 bp, Homo sapiens
caacatgagtgtattttt

SEQ ID NO: 1510523 - DNA, 15 bp, Homo sapiens
caacatgcactgatg

SEQ ID NO: 1510524 - DNA, 23 bp, Homo sapiens
caacatgcctgccccaaacaaat

SEQ ID NO: 1510525 - DNA, 22 bp, Homo sapiens
caacatggagaaaccctgtctc

SEQ ID NO: 1510526 - DNA, 13 bp, Homo sapiens
caattagtttcct

SEQ ID NO: 1510527 - DNA, 15 bp, Homo sapiens
caattataattgtaa

SEQ ID NO: 1510528 - DNA, 14 bp, Homo sapiens
caattatagtttct

SEQ ID NO: 1510529 - DNA, 18 bp, Homo sapiens
caattatagtttctgagg

SEQ ID NO: 1510530 - DNA, 15 bp, Homo sapiens
caattatgtctcttg

SEQ ID NO: 1510531 - DNA, 16 bp, Homo sapiens
caattatgtctcttga

SEQ ID NO: 1510532 - DNA, 17 bp, Homo sapiens
caattatgtctcttgag

SEQ ID NO: 1510533 - DNA, 18 bp, Homo sapiens
caattatttgcatatttt

SEQ ID NO: 1510534 - DNA, 20 bp, Homo sapiens
caattatttgcatattttga

SEQ ID NO: 1510535 - DNA, 23 bp, Homo sapiens
caattattttggatctatcacct

SEQ ID NO: 1510536 - DNA, 13 bp, Homo sapiens
caattatttttac

SEQ ID NO: 1510537 - DNA, 14 bp, Homo sapiens
caattcaacccttt

SEQ ID NO: 1510538 - DNA, 16 bp, Homo sapiens
caattcataaaaacaa

SEQ ID NO: 1510539 - DNA, 15 bp, Homo sapiens
caattccaaaggaat

SEQ ID NO: 1510540 - DNA, 13 bp, Homo sapiens
caattccacctgc

SEQ ID NO: 1510541 - DNA, 12 bp, Homo sapiens
caattccaggct

SEQ ID NO: 1510542 - DNA, 18 bp, Homo sapiens
caattccaggctgagcca

SEQ ID NO: 1510543 - DNA, 20 bp, Homo sapiens
caattccaggctgagccatg

SEQ ID NO: 1510544 - DNA, 12 bp, Homo sapiens
caattcccctct

SEQ ID NO: 1510545 - DNA, 13 bp, Homo sapiens
caattcctctggg

SEQ ID NO: 1510546 - DNA, 15 bp, Homo sapiens
caattcctctgggaa

SEQ ID NO: 1510547 - DNA, 14 bp, Homo sapiens
caattcctggccct

SEQ ID NO: 1510548 - DNA, 19 bp, Homo sapiens
caattctacagtttcttac

SEQ ID NO: 1510549 - DNA, 16 bp, Homo sapiens
caattctagtcatata

SEQ ID NO: 1510550 - DNA, 21 bp, Homo sapiens
caattctcctgcctcagcctc

SEQ ID NO: 1510551 - DNA, 22 bp, Homo sapiens
caattctgttttaggttaaaaa

SEQ ID NO: 1510552 - DNA, 16 bp, Homo sapiens
caattgaaaagtgttc

SEQ ID NO: 1510553 - DNA, 21 bp, Homo sapiens
caattgaattaaattaggaat

SEQ ID NO: 1510554 - DNA, 19 bp, Homo sapiens
caattgactgtcactgttc

SEQ ID NO: 1510555 - DNA, 21 bp, Homo sapiens
caattggattggaatgcagag

SEQ ID NO: 1510556 - DNA, 16 bp, Homo sapiens
caattggcccaacact

SEQ ID NO: 1510557 - DNA, 17 bp, Homo sapiens
caattgggagctgccaa

SEQ ID NO: 1510558 - DNA, 21 bp, Homo sapiens
caattgggagctgccaagagt

SEQ ID NO: 1510559 - DNA, 14 bp, Homo sapiens
caattgtcatttat

SEQ ID NO: 1510560 - DNA, 15 bp, Homo sapiens
caattgtcatttata

SEQ ID NO: 1510561 - DNA, 17 bp, Homo sapiens
caattgtcatttataaa

SEQ ID NO: 1510562 - DNA, 21 bp, Homo sapiens
caattgtcgaaaagagtcttc

SEQ ID NO: 1510563 - DNA, 13 bp, Homo sapiens
caattgtcttttt

SEQ ID NO: 1510564 - DNA, 19 bp, Homo sapiens
caattgtcttttttttcct

SEQ ID NO: 1510565 - DNA, 18 bp, Homo sapiens
caattgtgagccaccacg

SEQ ID NO: 1510566 - DNA, 21 bp, Homo sapiens
caattgtgagccaccacgtcc

SEQ ID NO: 1510567 - DNA, 20 bp, Homo sapiens
caattgtgtgaattaatttc

SEQ ID NO: 1510568 - DNA, 18 bp, Homo sapiens
caattgttacaagtgttc

SEQ ID NO: 1510569 - DNA, 21 bp, Homo sapiens
caattgttacaagtgttctta

SEQ ID NO: 1510570 - DNA, 22 bp, Homo sapiens
caattgttacaagtgttcttag

SEQ ID NO: 1510571 - DNA, 16 bp, Homo sapiens
caatttaaaatatttc

SEQ ID NO: 1510572 - DNA, 15 bp, Homo sapiens
caatttacaagagct

SEQ ID NO: 1510573 - DNA, 20 bp, Homo sapiens
caatttatccattcaatcat

SEQ ID NO: 1510574 - DNA, 21 bp, Homo sapiens
caatttcaaaaaaataaaata

SEQ ID NO: 1510575 - DNA, 15 bp, Homo sapiens
caatttcctctccac

SEQ ID NO: 1510576 - DNA, 16 bp, Homo sapiens
caatttcctctccact

SEQ ID NO: 1510577 - DNA, 12 bp, Homo sapiens
caatttcctggc

SEQ ID NO: 1510578 - DNA, 17 bp, Homo sapiens
caatttcttttatgtta

SEQ ID NO: 1510579 - DNA, 20 bp, Homo sapiens
caatttgaagtaacttattt

SEQ ID NO: 1510580 - DNA, 17 bp, Homo sapiens
caatttgacaaaaccca

SEQ ID NO: 1510581 - DNA, 15 bp, Homo sapiens
caatttgatacataa

SEQ ID NO: 1510582 - DNA, 22 bp, Homo sapiens
caatttgatacataataaaaaa

SEQ ID NO: 1510583 - DNA, 13 bp, Homo sapiens
caatttggtaaaa

SEQ ID NO: 1510584 - DNA, 23 bp, Homo sapiens
caatttgtaaaaacagcattgct

SEQ ID NO: 1510585 - DNA, 21 bp, Homo sapiens
caatttgtacttttttcttaa

SEQ ID NO: 1510586 - DNA, 22 bp, Homo sapiens
caatttgtacttttttcttaag

SEQ ID NO: 1510587 - DNA, 19 bp, Homo sapiens
caatttgtatatcatgaaa

SEQ ID NO: 1510588 - DNA, 17 bp, Homo sapiens
caatttgtttaaagaat

SEQ ID NO: 1510589 - DNA, 18 bp, Homo sapiens
caatttgtttaaagaata

SEQ ID NO: 1510590 - DNA, 22 bp, Homo sapiens
caattttaaaaaataacatatt

SEQ ID NO: 1510591 - DNA, 12 bp, Homo sapiens
caattttaaagt

SEQ ID NO: 1510592 - DNA, 15 bp, Homo sapiens
caattttatctgttt

SEQ ID NO: 1510593 - DNA, 20 bp, Homo sapiens
caattttatgtattctttct

SEQ ID NO: 1510594 - DNA, 14 bp, Homo sapiens
caattttctgtaag

SEQ ID NO: 1510595 - DNA, 15 bp, Homo sapiens
caattttctgtaaga

SEQ ID NO: 1510596 - DNA, 19 bp, Homo sapiens
caattttctgtaatctttt

SEQ ID NO: 1510597 - DNA, 15 bp, Homo sapiens
caattttctttgttt

SEQ ID NO: 1510598 - DNA, 12 bp, Homo sapiens
caattttgaaaa

SEQ ID NO: 1510599 - DNA, 13 bp, Homo sapiens
caattttgatctt

SEQ ID NO: 1510600 - DNA, 17 bp, Homo sapiens
caattttgtcttaagtg

SEQ ID NO: 1510601 - DNA, 15 bp, Homo sapiens
caatttttaataaat

SEQ ID NO: 1510602 - DNA, 15 bp, Homo sapiens
caatttttgccttca

SEQ ID NO: 1510603 - DNA, 23 bp, Homo sapiens
cacaaaaaatgaggaatagcaaa

SEQ ID NO: 1510604 - DNA, 20 bp, Homo sapiens
cacaaaaaggcaaatattga

SEQ ID NO: 1510605 - DNA, 15 bp, Homo sapiens
cacaaaatatttcta

SEQ ID NO: 1510606 - DNA, 21 bp, Homo sapiens
cacaaaatccatgggcagtat

SEQ ID NO: 1510607 - DNA, 16 bp, Homo sapiens
cacaaaccctgctgaa

SEQ ID NO: 1510608 - DNA, 13 bp, Homo sapiens
cacaaactgtgaa

SEQ ID NO: 1510609 - DNA, 20 bp, Homo sapiens
cacaaagaacttgctgctgc

SEQ ID NO: 1510610 - DNA, 18 bp, Homo sapiens
cacaaagcacagtttgaa

SEQ ID NO: 1510611 - DNA, 18 bp, Homo sapiens
cacaaagctcaagatgac

SEQ ID NO: 1510612 - DNA, 21 bp, Homo sapiens
cacaaagctcaagatgacagc

SEQ ID NO: 1510613 - DNA, 13 bp, Homo sapiens
cacaaagcttcta

SEQ ID NO: 1510614 - DNA, 16 bp, Homo sapiens
cacaaagcttctaaag

SEQ ID NO: 1510615 - DNA, 20 bp, Homo sapiens
cacaaagcttctaaagcagg

SEQ ID NO: 1510616 - DNA, 11 bp, Homo sapiens
cacaaaggaag

SEQ ID NO: 1510617 - DNA, 16 bp, Homo sapiens
cacaaatccttcaaaa

SEQ ID NO: 1510618 - DNA, 13 bp, Homo sapiens
cacaaatgtcatt

SEQ ID NO: 1510619 - DNA, 13 bp, Homo sapiens
cacaacaccagga

SEQ ID NO: 1510620 - DNA, 12 bp, Homo sapiens
cacaacagcagt

SEQ ID NO: 1510621 - DNA, 17 bp, Homo sapiens
cacaacagcagtctcct

SEQ ID NO: 1510622 - DNA, 19 bp, Homo sapiens
cacaacagcgtggcttaga

SEQ ID NO: 1510623 - DNA, 18 bp, Homo sapiens
cacaacctctctgatctt

SEQ ID NO: 1510624 - DNA, 17 bp, Homo sapiens
cacaaccttctgtggct

SEQ ID NO: 1510625 - DNA, 23 bp, Homo sapiens
cacaagaatggatcacaagatgg

SEQ ID NO: 1510626 - DNA, 19 bp, Homo sapiens
cacaagactggcagtccaa

SEQ ID NO: 1510627 - DNA, 20 bp, Homo sapiens
cacaagagcccagcagggcc

SEQ ID NO: 1510628 - DNA, 17 bp, Homo sapiens
cacaagaggaagagaga

SEQ ID NO: 1510629 - DNA, 14 bp, Homo sapiens
cacaagagtgaatt

SEQ ID NO: 1510630 - DNA, 18 bp, Homo sapiens
cacaagatggaatttatc

SEQ ID NO: 1510631 - DNA, 22 bp, Homo sapiens
cacaagatggaatttatcaaac

SEQ ID NO: 1510632 - DNA, 15 bp, Homo sapiens
cacaagattcccaga

SEQ ID NO: 1510633 - DNA, 19 bp, Homo sapiens
cacaagattcccagagaca

SEQ ID NO: 1510634 - DNA, 22 bp, Homo sapiens
cacaagattcccagagacagga

SEQ ID NO: 1510635 - DNA, 21 bp, Homo sapiens
cacaagcagagtgcacagctg

SEQ ID NO: 1510636 - DNA, 23 bp, Homo sapiens
cacaagcagagtgcacagctgtc

SEQ ID NO: 1510637 - DNA, 15 bp, Homo sapiens
cacaagccagggtgt

SEQ ID NO: 1510638 - DNA, 12 bp, Homo sapiens
cacaagctgcac

SEQ ID NO: 1510639 - DNA, 18 bp, Homo sapiens
cacaagctgcactgtgaa

SEQ ID NO: 1510640 - DNA, 18 bp, Homo sapiens
cacaaggaaaaggaggag

SEQ ID NO: 1510641 - DNA, 20 bp, Homo sapiens
cacaaggaaaatagtttagg

SEQ ID NO: 1510642 - DNA, 21 bp, Homo sapiens
cacaaggatagatgctggccc

SEQ ID NO: 1510643 - DNA, 14 bp, Homo sapiens
cacaaggcccagga

SEQ ID NO: 1510644 - DNA, 14 bp, Homo sapiens
cacaaggctgacca

SEQ ID NO: 1510645 - DNA, 18 bp, Homo sapiens
cacaataaaaatgtttaa

SEQ ID NO: 1510646 - DNA, 13 bp, Homo sapiens
cacaatacagtat

SEQ ID NO: 1510647 - DNA, 16 bp, Homo sapiens
cacaatcttggggctg

SEQ ID NO: 1510648 - DNA, 22 bp, Homo sapiens
cacaatgagaatgatgcacact

SEQ ID NO: 1510649 - DNA, 22 bp, Homo sapiens
cacaatgttccttttttgtata

SEQ ID NO: 1510650 - DNA, 11 bp, Homo sapiens
cacaattccat

SEQ ID NO: 1510651 - DNA, 22 bp, Homo sapiens
cacaattccatttccagttcat

SEQ ID NO: 1510652 - DNA, 23 bp, Homo sapiens
cacaattccatttccagttcatc

SEQ ID NO: 1510653 - DNA, 12 bp, Homo sapiens
cacaatttaaaa

SEQ ID NO: 1510654 - DNA, 23 bp, Homo sapiens
cacaatttcatttccagcatttt

SEQ ID NO: 1510655 - DNA, 22 bp, Homo sapiens
cacacaaaaaccttggcataag

SEQ ID NO: 1510656 - DNA, 20 bp, Homo sapiens
cacacaaacctactgcccac

SEQ ID NO: 1510657 - DNA, 18 bp, Homo sapiens
cacacaaaccttctgcct

SEQ ID NO: 1510658 - DNA, 20 bp, Homo sapiens
cacacaaagactccttgtgg

SEQ ID NO: 1510659 - DNA, 22 bp, Homo sapiens
cacacacaaacctactgcccac

SEQ ID NO: 1510660 - DNA, 9 bp, Homo sapiens
cacacacac

SEQ ID NO: 1510661 - DNA, 16 bp, Homo sapiens
cacacacacacacaca

SEQ ID NO: 1510662 - DNA, 16 bp, Homo sapiens
cacacacacgatgcat

SEQ ID NO: 1510663 - DNA, 14 bp, Homo sapiens
cacacacacgcacg

SEQ ID NO: 1510664 - DNA, 14 bp, Homo sapiens
cacacacagaggaa

SEQ ID NO: 1510665 - DNA, 23 bp, Homo sapiens
cacacacagaggaagagcaggca

SEQ ID NO: 1510666 - DNA, 14 bp, Homo sapiens
cacacacccctcaa

SEQ ID NO: 1510667 - DNA, 15 bp, Homo sapiens
cacacacctgtagtc

SEQ ID NO: 1510668 - DNA, 21 bp, Homo sapiens
cacacacgatgcatttaataa

SEQ ID NO: 1510669 - DNA, 14 bp, Homo sapiens
cacacacgcacgca

SEQ ID NO: 1510670 - DNA, 23 bp, Homo sapiens
cacacacgcacgcacacacacaa

SEQ ID NO: 1510671 - DNA, 20 bp, Homo sapiens
cacacacgctccctggaagc

SEQ ID NO: 1510672 - DNA, 22 bp, Homo sapiens
cacacactttccatctctgcct

SEQ ID NO: 1510673 - DNA, 18 bp, Homo sapiens
cacacagagattctggat

SEQ ID NO: 1510674 - DNA, 22 bp, Homo sapiens
cacacagaggaagagcaggcac

SEQ ID NO: 1510675 - DNA, 19 bp, Homo sapiens
cacacagaggctgcctctc

SEQ ID NO: 1510676 - DNA, 20 bp, Homo sapiens
cacacagagtggtctttctg

SEQ ID NO: 1510677 - DNA, 18 bp, Homo sapiens
cacacagcactctctaaa

SEQ ID NO: 1510678 - DNA, 12 bp, Homo sapiens
cacacagcagtg

SEQ ID NO: 1510679 - DNA, 19 bp, Homo sapiens
cacacagcagtgtcccctg

SEQ ID NO: 1510680 - DNA, 14 bp, Homo sapiens
cacacagctgagca

SEQ ID NO: 1510681 - DNA, 12 bp, Homo sapiens
cacacagctgcc

SEQ ID NO: 1510682 - DNA, 14 bp, Homo sapiens
cacacagctgccct

SEQ ID NO: 1510683 - DNA, 18 bp, Homo sapiens
cacacaggtacagcaaca

SEQ ID NO: 1510684 - DNA, 18 bp, Homo sapiens
cacacagtgttagtgctg

SEQ ID NO: 1510685 - DNA, 22 bp, Homo sapiens
cacacatagattaatggcactg

SEQ ID NO: 1510686 - DNA, 23 bp, Homo sapiens
cacacatagattaatggcactga

SEQ ID NO: 1510687 - DNA, 21 bp, Homo sapiens
cacacatataaacatcacaca

SEQ ID NO: 1510688 - DNA, 18 bp, Homo sapiens
cacacatatataggcagt

SEQ ID NO: 1510689 - DNA, 15 bp, Homo sapiens
cacacatgccctcct

SEQ ID NO: 1510690 - DNA, 17 bp, Homo sapiens
cacacatgccctcctgg

SEQ ID NO: 1510691 - DNA, 17 bp, Homo sapiens
cacaccaaccaggcctt

SEQ ID NO: 1510692 - DNA, 13 bp, Homo sapiens
cacaccaagtggc

SEQ ID NO: 1510693 - DNA, 15 bp, Homo sapiens
cacaccactgccctg

SEQ ID NO: 1510694 - DNA, 16 bp, Homo sapiens
cacaccactgccctgc

SEQ ID NO: 1510695 - DNA, 17 bp, Homo sapiens
cacaccactgccctgcc

SEQ ID NO: 1510696 - DNA, 20 bp, Homo sapiens
cacaccactgccctgcctgc

SEQ ID NO: 1510697 - DNA, 14 bp, Homo sapiens
cacaccagccgctg

SEQ ID NO: 1510698 - DNA, 17 bp, Homo sapiens
cacaccagccgctgcag

SEQ ID NO: 1510699 - DNA, 14 bp, Homo sapiens
cacaccagcctcct

SEQ ID NO: 1510700 - DNA, 23 bp, Homo sapiens
cacaccaggccgtcctcccgggc

SEQ ID NO: 1510701 - DNA, 14 bp, Homo sapiens
cacacccaccgtcc

SEQ ID NO: 1510702 - DNA, 22 bp, Homo sapiens
cacacccaccgtccgccctgct

SEQ ID NO: 1510703 - DNA, 14 bp, Homo sapiens
cacacccagctact

SEQ ID NO: 1510704 - DNA, 18 bp, Homo sapiens
cacaccctctcccaggac

SEQ ID NO: 1510705 - DNA, 13 bp, Homo sapiens
cacaccgcggcca

SEQ ID NO: 1510706 - DNA, 14 bp, Homo sapiens
cacaccgcggccag

SEQ ID NO: 1510707 - DNA, 21 bp, Homo sapiens
cacaccgcggccaggcaccca

SEQ ID NO: 1510708 - DNA, 15 bp, Homo sapiens
cacacctcagcccca

SEQ ID NO: 1510709 - DNA, 17 bp, Homo sapiens
cacacctcagttccctt

SEQ ID NO: 1510710 - DNA, 14 bp, Homo sapiens
cacacctccctgaa

SEQ ID NO: 1510711 - DNA, 16 bp, Homo sapiens
cacacctccctgaacc

SEQ ID NO: 1510712 - DNA, 14 bp, Homo sapiens
cacacctcctgcct

SEQ ID NO: 1510713 - DNA, 13 bp, Homo sapiens
cacacctgagcgc

SEQ ID NO: 1510714 - DNA, 20 bp, Homo sapiens
cacacctgagcgctgtggac

SEQ ID NO: 1510715 - DNA, 12 bp, Homo sapiens
cacacctggcct

SEQ ID NO: 1510716 - DNA, 20 bp, Homo sapiens
cacacctggccttaaagagg

SEQ ID NO: 1510717 - DNA, 16 bp, Homo sapiens
cacacctgtagtccca

SEQ ID NO: 1510718 - DNA, 12 bp, Homo sapiens
cacacctgtgtc

SEQ ID NO: 1510719 - DNA, 16 bp, Homo sapiens
cacaccttccagggcc

SEQ ID NO: 1510720 - DNA, 20 bp, Homo sapiens
cacaccttccagggccctag

SEQ ID NO: 1510721 - DNA, 21 bp, Homo sapiens
cacaccttccagggccctagg

SEQ ID NO: 1510722 - DNA, 20 bp, Homo sapiens
cacaccttttatgaatcaaa

SEQ ID NO: 1510723 - DNA, 19 bp, Homo sapiens
cacaccttttccccaggag

SEQ ID NO: 1510724 - DNA, 13 bp, Homo sapiens
cacacgatgcatt

SEQ ID NO: 1510725 - DNA, 18 bp, Homo sapiens
cacacgatgcatttaata

SEQ ID NO: 1510726 - DNA, 21 bp, Homo sapiens
cacacgatgcatttaataaag

SEQ ID NO: 1510727 - DNA, 13 bp, Homo sapiens
cacacgcacgcac

SEQ ID NO: 1510728 - DNA, 14 bp, Homo sapiens
cacacgcacgcaca

SEQ ID NO: 1510729 - DNA, 14 bp, Homo sapiens
cacacgcctgtagt

SEQ ID NO: 1510730 - DNA, 18 bp, Homo sapiens
cacacgctccctggaagc

SEQ ID NO: 1510731 - DNA, 20 bp, Homo sapiens
cacacgctccctggaagctg

SEQ ID NO: 1510732 - DNA, 18 bp, Homo sapiens
cacacggaggcatctgca

SEQ ID NO: 1510733 - DNA, 19 bp, Homo sapiens
cacacggctggtcactctg

SEQ ID NO: 1510734 - DNA, 21 bp, Homo sapiens
cacacggctggtcactctgcc

SEQ ID NO: 1510735 - DNA, 21 bp, Homo sapiens
cacacgggcgagctttctctc

SEQ ID NO: 1510736 - DNA, 17 bp, Homo sapiens
cacacgtacttaaatga

SEQ ID NO: 1510737 - DNA, 22 bp, Homo sapiens
cacacgtaggacgcatgaaggt

SEQ ID NO: 1510738 - DNA, 18 bp, Homo sapiens
cacacgtgctgtgggcct

SEQ ID NO: 1510739 - DNA, 14 bp, Homo sapiens
cacacgtggctggc

SEQ ID NO: 1510740 - DNA, 20 bp, Homo sapiens
cacacgtttaatcccagcac

SEQ ID NO: 1510741 - DNA, 21 bp, Homo sapiens
cacacgtttaatcccagcact

SEQ ID NO: 1510742 - DNA, 21 bp, Homo sapiens
cacactaacctgggttccctt

SEQ ID NO: 1510743 - DNA, 17 bp, Homo sapiens
cacactattaccatgag

SEQ ID NO: 1510744 - DNA, 19 bp, Homo sapiens
cacactcaaatcaagaaac

SEQ ID NO: 1510745 - DNA, 19 bp, Homo sapiens
cacactcacaatttaaaat

SEQ ID NO: 1510746 - DNA, 14 bp, Homo sapiens
cacactccactctg

SEQ ID NO: 1510747 - DNA, 16 bp, Homo sapiens
cacactccactctgat

SEQ ID NO: 1510748 - DNA, 13 bp, Homo sapiens
cacactccactga

SEQ ID NO: 1510749 - DNA, 14 bp, Homo sapiens
cacactccactgac

SEQ ID NO: 1510750 - DNA, 14 bp, Homo sapiens
cacactcccaaggt

SEQ ID NO: 1510751 - DNA, 21 bp, Homo sapiens
cacactcccaaggttggagcc

SEQ ID NO: 1510752 - DNA, 23 bp, Homo sapiens
cacactcttcagtgactcctgct

SEQ ID NO: 1510753 - DNA, 21 bp, Homo sapiens
cacactgaggcttaggcctct

SEQ ID NO: 1510754 - DNA, 20 bp, Homo sapiens
cacactgcgcaggtctcttc

SEQ ID NO: 1510755 - DNA, 15 bp, Homo sapiens
cacactgggcctgga

SEQ ID NO: 1510756 - DNA, 22 bp, Homo sapiens
cacactgggtggtggcctggtc

SEQ ID NO: 1510757 - DNA, 23 bp, Homo sapiens
cacactgtgtcctggtgctctct

SEQ ID NO: 1510758 - DNA, 18 bp, Homo sapiens
cacactgttactccacag

SEQ ID NO: 1510759 - DNA, 14 bp, Homo sapiens
cacagcgtctgctc

SEQ ID NO: 1510760 - DNA, 16 bp, Homo sapiens
cacagctacaacccta

SEQ ID NO: 1510761 - DNA, 22 bp, Homo sapiens
cacagctactcagtggggctgg

SEQ ID NO: 1510762 - DNA, 16 bp, Homo sapiens
cacagctactctcccc

SEQ ID NO: 1510763 - DNA, 12 bp, Homo sapiens
cacagctcagct

SEQ ID NO: 1510764 - DNA, 13 bp, Homo sapiens
cacagctcagctg

SEQ ID NO: 1510765 - DNA, 18 bp, Homo sapiens
cacagctcagctgcccat

SEQ ID NO: 1510766 - DNA, 15 bp, Homo sapiens
cacagctcaggaggc

SEQ ID NO: 1510767 - DNA, 14 bp, Homo sapiens
cacagctcccaccc

SEQ ID NO: 1510768 - DNA, 16 bp, Homo sapiens
cacagctcccacccca

SEQ ID NO: 1510769 - DNA, 17 bp, Homo sapiens
cacagctcccaccccac

SEQ ID NO: 1510770 - DNA, 19 bp, Homo sapiens
cacagctcccaccccaccc

SEQ ID NO: 1510771 - DNA, 22 bp, Homo sapiens
cacagctcccaccccaccccct

SEQ ID NO: 1510772 - DNA, 17 bp, Homo sapiens
cacagctccgagctgta

SEQ ID NO: 1510773 - DNA, 10 bp, Homo sapiens
cacagctcct

SEQ ID NO: 1510774 - DNA, 13 bp, Homo sapiens
cacagctcctgcc

SEQ ID NO: 1510775 - DNA, 15 bp, Homo sapiens
cacagctcctgccag

SEQ ID NO: 1510776 - DNA, 16 bp, Homo sapiens
cacagctcctgccagg

SEQ ID NO: 1510777 - DNA, 12 bp, Homo sapiens
cacagctcttca

SEQ ID NO: 1510778 - DNA, 12 bp, Homo sapiens
cacagctgcagc

SEQ ID NO: 1510779 - DNA, 13 bp, Homo sapiens
cacagctgcagct

SEQ ID NO: 1510780 - DNA, 16 bp, Homo sapiens
cacagctgcagctggg

SEQ ID NO: 1510781 - DNA, 17 bp, Homo sapiens
cacagctgcagctgggc

SEQ ID NO: 1510782 - DNA, 19 bp, Homo sapiens
cacagctgcagctgggccc

SEQ ID NO: 1510783 - DNA, 15 bp, Homo sapiens
cacagctgccctagc

SEQ ID NO: 1510784 - DNA, 18 bp, Homo sapiens
cacagctgccctagctga

SEQ ID NO: 1510785 - DNA, 13 bp, Homo sapiens
cacagctgctgga

SEQ ID NO: 1510786 - DNA, 17 bp, Homo sapiens
cacagctgctggccagg

SEQ ID NO: 1510787 - DNA, 12 bp, Homo sapiens
cacagctgcttg

SEQ ID NO: 1510788 - DNA, 18 bp, Homo sapiens
cacagctgggcagggtga

SEQ ID NO: 1510789 - DNA, 19 bp, Homo sapiens
cacagctgggcatgccatg

SEQ ID NO: 1510790 - DNA, 22 bp, Homo sapiens
cacagctgttcttctgttctgc

SEQ ID NO: 1510791 - DNA, 17 bp, Homo sapiens
cacagcttcagccagga

SEQ ID NO: 1510792 - DNA, 21 bp, Homo sapiens
cacagcttgacctgaggctgt

SEQ ID NO: 1510793 - DNA, 14 bp, Homo sapiens
cacaggaagagaag

SEQ ID NO: 1510794 - DNA, 15 bp, Homo sapiens
cacaggaagagaaga

SEQ ID NO: 1510795 - DNA, 15 bp, Homo sapiens
cacaggaagctcagc

SEQ ID NO: 1510796 - DNA, 18 bp, Homo sapiens
cacaggaagctcagcctt

SEQ ID NO: 1510797 - DNA, 23 bp, Homo sapiens
cacaggacacctggccgcctcca

SEQ ID NO: 1510798 - DNA, 21 bp, Homo sapiens
cacaggactgattctgggatg

SEQ ID NO: 1510799 - DNA, 19 bp, Homo sapiens
cacaggagactccaaggag

SEQ ID NO: 1510800 - DNA, 14 bp, Homo sapiens
cacaggaggcaggc

SEQ ID NO: 1510801 - DNA, 15 bp, Homo sapiens
cacaggaggcaggca

SEQ ID NO: 1510802 - DNA, 19 bp, Homo sapiens
cacaggaggcaggcatggc

SEQ ID NO: 1510803 - DNA, 13 bp, Homo sapiens
cacaggagggcca

SEQ ID NO: 1510804 - DNA, 14 bp, Homo sapiens
cacaggagggccag

SEQ ID NO: 1510805 - DNA, 18 bp, Homo sapiens
cacaggagtgggaaaaca

SEQ ID NO: 1510806 - DNA, 16 bp, Homo sapiens
cacaggagtgtcctct

SEQ ID NO: 1510807 - DNA, 22 bp, Homo sapiens
cacaggagtgtcctcttccctc

SEQ ID NO: 1510808 - DNA, 20 bp, Homo sapiens
cacaggcaaaatccttgctt

SEQ ID NO: 1510809 - DNA, 17 bp, Homo sapiens
cacaggcaactgaggca

SEQ ID NO: 1510810 - DNA, 19 bp, Homo sapiens
cacaggcaactgaggcaga

SEQ ID NO: 1510811 - DNA, 17 bp, Homo sapiens
cacaggcacacagggcc

SEQ ID NO: 1510812 - DNA, 18 bp, Homo sapiens
cacaggcacacagggccc

SEQ ID NO: 1510813 - DNA, 12 bp, Homo sapiens
cacaggcaggta

SEQ ID NO: 1510814 - DNA, 16 bp, Homo sapiens
cacaggcaggtactgt

SEQ ID NO: 1510815 - DNA, 20 bp, Homo sapiens
cacaggcatctacacagcct

SEQ ID NO: 1510816 - DNA, 22 bp, Homo sapiens
cacaggcatctacacagcctgg

SEQ ID NO: 1510817 - DNA, 21 bp, Homo sapiens
cacaggccattatgcctggct

SEQ ID NO: 1510818 - DNA, 12 bp, Homo sapiens
cacaggccccct

SEQ ID NO: 1510819 - DNA, 13 bp, Homo sapiens
cacaggccctggg

SEQ ID NO: 1510820 - DNA, 16 bp, Homo sapiens
cacaggcccttcctct

SEQ ID NO: 1510821 - DNA, 18 bp, Homo sapiens
cacaggcccttcctctcc

SEQ ID NO: 1510822 - DNA, 21 bp, Homo sapiens
cacaggcccttcctctccact

SEQ ID NO: 1510823 - DNA, 11 bp, Homo sapiens
cacaggcctct

SEQ ID NO: 1510824 - DNA, 23 bp, Homo sapiens
cacaggcctgagatttcatctgc

SEQ ID NO: 1510825 - DNA, 17 bp, Homo sapiens
cacaggctgagaactcg

SEQ ID NO: 1510826 - DNA, 20 bp, Homo sapiens
cacagggaaaattgccccat

SEQ ID NO: 1510827 - DNA, 23 bp, Homo sapiens
cacagggaaagcatttaggagaa

SEQ ID NO: 1510828 - DNA, 16 bp, Homo sapiens
cacagggaccagggcc

SEQ ID NO: 1510829 - DNA, 23 bp, Homo sapiens
cacagggaccagggccaccgcag

SEQ ID NO: 1510830 - DNA, 13 bp, Homo sapiens
cacagggcaccag

SEQ ID NO: 1510831 - DNA, 14 bp, Homo sapiens
cacagggcaccaga

SEQ ID NO: 1510832 - DNA, 15 bp, Homo sapiens
cacagggcaccagag

SEQ ID NO: 1510833 - DNA, 16 bp, Homo sapiens
cacagggcaccagagg

SEQ ID NO: 1510834 - DNA, 17 bp, Homo sapiens
cacagggcaccagaggc

SEQ ID NO: 1510835 - DNA, 13 bp, Homo sapiens
cacagggcagagc

SEQ ID NO: 1510836 - DNA, 14 bp, Homo sapiens
cacagggcagagcc

SEQ ID NO: 1510837 - DNA, 22 bp, Homo sapiens
cacagggccccagaaggcaggg

SEQ ID NO: 1510838 - DNA, 17 bp, Homo sapiens
cacaggggacagggctg

SEQ ID NO: 1510839 - DNA, 17 bp, Homo sapiens
cacaggggaggtgatag

SEQ ID NO: 1510840 - DNA, 16 bp, Homo sapiens
cacaggggccaccacc

SEQ ID NO: 1510841 - DNA, 18 bp, Homo sapiens
cacaggggccccagatct

SEQ ID NO: 1510842 - DNA, 14 bp, Homo sapiens
cacaggggcggggc

SEQ ID NO: 1510843 - DNA, 22 bp, Homo sapiens
cacagggtccccgagtgcctag

SEQ ID NO: 1510844 - DNA, 16 bp, Homo sapiens
cacagggtgggcctcg

SEQ ID NO: 1510845 - DNA, 14 bp, Homo sapiens
cacagggttgggcc

SEQ ID NO: 1510846 - DNA, 16 bp, Homo sapiens
cacaggtacagcaaca

SEQ ID NO: 1510847 - DNA, 18 bp, Homo sapiens
cacaggtacagcaacagg

SEQ ID NO: 1510848 - DNA, 13 bp, Homo sapiens
cacatctttactc

SEQ ID NO: 1510849 - DNA, 12 bp, Homo sapiens
cacatctttcac

SEQ ID NO: 1510850 - DNA, 18 bp, Homo sapiens
cacatctttcacacttcc

SEQ ID NO: 1510851 - DNA, 18 bp, Homo sapiens
cacatgaaaccttatttt

SEQ ID NO: 1510852 - DNA, 14 bp, Homo sapiens
cacatgacctccat

SEQ ID NO: 1510853 - DNA, 23 bp, Homo sapiens
cacatgaggccatctcaggagat

SEQ ID NO: 1510854 - DNA, 17 bp, Homo sapiens
cacatgagtcaaaacaa

SEQ ID NO: 1510855 - DNA, 16 bp, Homo sapiens
cacatgccacctggca

SEQ ID NO: 1510856 - DNA, 17 bp, Homo sapiens
cacatgccctcctggac

SEQ ID NO: 1510857 - DNA, 22 bp, Homo sapiens
cacatgccgcgggcggccaggc

SEQ ID NO: 1510858 - DNA, 18 bp, Homo sapiens
cacatgcgggctcgccca

SEQ ID NO: 1510859 - DNA, 16 bp, Homo sapiens
cacatgctaaagccag

SEQ ID NO: 1510860 - DNA, 18 bp, Homo sapiens
cacatgctaaagccagga

SEQ ID NO: 1510861 - DNA, 21 bp, Homo sapiens
cacatgctgtctggccctggg

SEQ ID NO: 1510862 - DNA, 23 bp, Homo sapiens
cacatggacagacttcacagcgt

SEQ ID NO: 1510863 - DNA, 20 bp, Homo sapiens
cacatggagccccctctgcc

SEQ ID NO: 1510864 - DNA, 15 bp, Homo sapiens
cacatggccatagag

SEQ ID NO: 1510865 - DNA, 23 bp, Homo sapiens
cacatggccatagaggcccaggc

SEQ ID NO: 1510866 - DNA, 19 bp, Homo sapiens
cacatgggcttgtgacatt

SEQ ID NO: 1510867 - DNA, 20 bp, Homo sapiens
cacatggggcctggcccacg

SEQ ID NO: 1510868 - DNA, 16 bp, Homo sapiens
cacatgtccagcacct

SEQ ID NO: 1510869 - DNA, 15 bp, Homo sapiens
cacatgtcttgtaca

SEQ ID NO: 1510870 - DNA, 13 bp, Homo sapiens
cacatgtgacaca

SEQ ID NO: 1510871 - DNA, 15 bp, Homo sapiens
cacatgtgacacata

SEQ ID NO: 1510872 - DNA, 19 bp, Homo sapiens
cacatgtgccacacagtga

SEQ ID NO: 1510873 - DNA, 16 bp, Homo sapiens
cacatgtgtccatccc

SEQ ID NO: 1510874 - DNA, 15 bp, Homo sapiens
cacatgtttcctcta

SEQ ID NO: 1510875 - DNA, 14 bp, Homo sapiens
cacattaaacagga

SEQ ID NO: 1510876 - DNA, 14 bp, Homo sapiens
cacattaactccct

SEQ ID NO: 1510877 - DNA, 23 bp, Homo sapiens
cacattaactccctccaccagcc

SEQ ID NO: 1510878 - DNA, 16 bp, Homo sapiens
cacattaatctcaaag

SEQ ID NO: 1510879 - DNA, 17 bp, Homo sapiens
cacattaatctcaaaga

SEQ ID NO: 1510880 - DNA, 13 bp, Homo sapiens
cacattaatgata

SEQ ID NO: 1510881 - DNA, 17 bp, Homo sapiens
cacattagactatccat

SEQ ID NO: 1510882 - DNA, 16 bp, Homo sapiens
cacattagataaatta

SEQ ID NO: 1510883 - DNA, 19 bp, Homo sapiens
cacattagataaattacta

SEQ ID NO: 1510884 - DNA, 21 bp, Homo sapiens
cacattagattttattttact

SEQ ID NO: 1510885 - DNA, 17 bp, Homo sapiens
cacctcctccactcact

SEQ ID NO: 1510886 - DNA, 20 bp, Homo sapiens
cacctcctccactcactcca

SEQ ID NO: 1510887 - DNA, 14 bp, Homo sapiens
cacctcggcctccc

SEQ ID NO: 1510888 - DNA, 15 bp, Homo sapiens
cacctcgtctccctg

SEQ ID NO: 1510889 - DNA, 15 bp, Homo sapiens
cacctctccaagggc

SEQ ID NO: 1510890 - DNA, 17 bp, Homo sapiens
cacctctcctgccctgt

SEQ ID NO: 1510891 - DNA, 11 bp, Homo sapiens
cacctctctgg

SEQ ID NO: 1510892 - DNA, 14 bp, Homo sapiens
cacctctctggaag

SEQ ID NO: 1510893 - DNA, 13 bp, Homo sapiens
cacctctgaggac

SEQ ID NO: 1510894 - DNA, 12 bp, Homo sapiens
cacctctgccac

SEQ ID NO: 1510895 - DNA, 18 bp, Homo sapiens
cacctctggactggctag

SEQ ID NO: 1510896 - DNA, 19 bp, Homo sapiens
cacctctggctagagccga

SEQ ID NO: 1510897 - DNA, 24 bp, Homo sapiens
cacctctggtggctcctcctagga

SEQ ID NO: 1510898 - DNA, 12 bp, Homo sapiens
cacctcttccac

SEQ ID NO: 1510899 - DNA, 15 bp, Homo sapiens
cacctcttcctctgg

SEQ ID NO: 1510900 - DNA, 16 bp, Homo sapiens
cacctctttgcccccg

SEQ ID NO: 1510901 - DNA, 15 bp, Homo sapiens
cacctgaaccccatg

SEQ ID NO: 1510902 - DNA, 17 bp, Homo sapiens
cacctgaactgaacacc

SEQ ID NO: 1510903 - DNA, 17 bp, Homo sapiens
cacctgacaatggcagc

SEQ ID NO: 1510904 - DNA, 18 bp, Homo sapiens
cacctgacaatggcagct

SEQ ID NO: 1510905 - DNA, 16 bp, Homo sapiens
cacctgacacaccagg

SEQ ID NO: 1510906 - DNA, 14 bp, Homo sapiens
cacctgagacccta

SEQ ID NO: 1510907 - DNA, 16 bp, Homo sapiens
cacctgagaccctact

SEQ ID NO: 1510908 - DNA, 13 bp, Homo sapiens
cacctgaggtcag

SEQ ID NO: 1510909 - DNA, 18 bp, Homo sapiens
cacctgaggtgggcccag

SEQ ID NO: 1510910 - DNA, 19 bp, Homo sapiens
cacctgaggtgggcccagg

SEQ ID NO: 1510911 - DNA, 19 bp, Homo sapiens
cacctgagtcaccctacct

SEQ ID NO: 1510912 - DNA, 23 bp, Homo sapiens
cacctgagtcaccctacctgtgc

SEQ ID NO: 1510913 - DNA, 12 bp, Homo sapiens
cacctgcaagat

SEQ ID NO: 1510914 - DNA, 15 bp, Homo sapiens
cacctgcaagcccca

SEQ ID NO: 1510915 - DNA, 16 bp, Homo sapiens
cacctgcaagccccag

SEQ ID NO: 1510916 - DNA, 11 bp, Homo sapiens
cacctgcacct

SEQ ID NO: 1510917 - DNA, 13 bp, Homo sapiens
cacctgcacctcc

SEQ ID NO: 1510918 - DNA, 19 bp, Homo sapiens
cacctgcacctccccccac

SEQ ID NO: 1510919 - DNA, 14 bp, Homo sapiens
cacctgcaggctta

SEQ ID NO: 1510920 - DNA, 16 bp, Homo sapiens
cacctgcatctggggc

SEQ ID NO: 1510921 - DNA, 11 bp, Homo sapiens
cacctgccaca

SEQ ID NO: 1510922 - DNA, 20 bp, Homo sapiens
cacctgccagcctggcttct

SEQ ID NO: 1510923 - DNA, 17 bp, Homo sapiens
cacctgccatttgcacc

SEQ ID NO: 1510924 - DNA, 21 bp, Homo sapiens
cacctgccccctggtggacag

SEQ ID NO: 1510925 - DNA, 22 bp, Homo sapiens
cacctgcctaggtttttcctac

SEQ ID NO: 1510926 - DNA, 16 bp, Homo sapiens
cacctgcctccaccag

SEQ ID NO: 1510927 - DNA, 17 bp, Homo sapiens
cacctgcctccaccagc

SEQ ID NO: 1510928 - DNA, 14 bp, Homo sapiens
cacctgcctgcaga

SEQ ID NO: 1510929 - DNA, 15 bp, Homo sapiens
cacctgcctgcagag

SEQ ID NO: 1510930 - DNA, 14 bp, Homo sapiens
cacctgcctggtgc

SEQ ID NO: 1510931 - DNA, 18 bp, Homo sapiens
cacctgcggggccaccca

SEQ ID NO: 1510932 - DNA, 14 bp, Homo sapiens
cacctgctcccagt

SEQ ID NO: 1510933 - DNA, 18 bp, Homo sapiens
cacctgctgagagaccca

SEQ ID NO: 1510934 - DNA, 14 bp, Homo sapiens
cacctgctgcgtcc

SEQ ID NO: 1510935 - DNA, 21 bp, Homo sapiens
cacctgctggttgttgccagg

SEQ ID NO: 1510936 - DNA, 22 bp, Homo sapiens
cacctgctggttgttgccaggt

SEQ ID NO: 1510937 - DNA, 20 bp, Homo sapiens
cacctggaggggcaccaggt

SEQ ID NO: 1510938 - DNA, 15 bp, Homo sapiens
cacgcacttgcctgt

SEQ ID NO: 1510939 - DNA, 18 bp, Homo sapiens
cacgcacttgcctgttgg

SEQ ID NO: 1510940 - DNA, 16 bp, Homo sapiens
cacgcagccaggacac

SEQ ID NO: 1510941 - DNA, 21 bp, Homo sapiens
cacgcagccaggacaccgggc

SEQ ID NO: 1510942 - DNA, 19 bp, Homo sapiens
cacgcaggctgagtccaga

SEQ ID NO: 1510943 - DNA, 20 bp, Homo sapiens
cacgccattgtactccagcc

SEQ ID NO: 1510944 - DNA, 23 bp, Homo sapiens
cacgccattgtactccagcctgg

SEQ ID NO: 1510945 - DNA, 16 bp, Homo sapiens
cacgccccgtgtctgg

SEQ ID NO: 1510946 - DNA, 15 bp, Homo sapiens
cacgcccgtcctgcc

SEQ ID NO: 1510947 - DNA, 18 bp, Homo sapiens
cacgccctccctctccca

SEQ ID NO: 1510948 - DNA, 18 bp, Homo sapiens
cacgccgtaattctttct

SEQ ID NO: 1510949 - DNA, 23 bp, Homo sapiens
cacgccgtaattctttctgtctc

SEQ ID NO: 1510950 - DNA, 18 bp, Homo sapiens
cacgcctcaccagccccc

SEQ ID NO: 1510951 - DNA, 14 bp, Homo sapiens
cacgcctgccatct

SEQ ID NO: 1510952 - DNA, 17 bp, Homo sapiens
cacgcctgtaatcccag

SEQ ID NO: 1510953 - DNA, 19 bp, Homo sapiens
cacgcctgtaatcccagca

SEQ ID NO: 1510954 - DNA, 22 bp, Homo sapiens
cacgcctgtaatcccagcactt

SEQ ID NO: 1510955 - DNA, 20 bp, Homo sapiens
cacgccttgttcctgctctt

SEQ ID NO: 1510956 - DNA, 18 bp, Homo sapiens
cacgcgctctccaccacc

SEQ ID NO: 1510957 - DNA, 13 bp, Homo sapiens
cacgcgcttccct

SEQ ID NO: 1510958 - DNA, 15 bp, Homo sapiens
cacgcgcttccctgg

SEQ ID NO: 1510959 - DNA, 15 bp, Homo sapiens
cacgcgggggccttg

SEQ ID NO: 1510960 - DNA, 16 bp, Homo sapiens
cacgcggtggcatgca

SEQ ID NO: 1510961 - DNA, 13 bp, Homo sapiens
cacgctccagctg

SEQ ID NO: 1510962 - DNA, 14 bp, Homo sapiens
cacgctccagctgc

SEQ ID NO: 1510963 - DNA, 17 bp, Homo sapiens
cacgctcccccgcagtc

SEQ ID NO: 1510964 - DNA, 12 bp, Homo sapiens
cacgctgcctgg

SEQ ID NO: 1510965 - DNA, 16 bp, Homo sapiens
cacgctgcctggtctg

SEQ ID NO: 1510966 - DNA, 19 bp, Homo sapiens
cacggacgctggctcccca

SEQ ID NO: 1510967 - DNA, 23 bp, Homo sapiens
cacggacgctggctccccaaagg

SEQ ID NO: 1510968 - DNA, 17 bp, Homo sapiens
cacggacgtttccatca

SEQ ID NO: 1510969 - DNA, 18 bp, Homo sapiens
cacggacgtttccatcag

SEQ ID NO: 1510970 - DNA, 14 bp, Homo sapiens
cacggagagaaggc

SEQ ID NO: 1510971 - DNA, 15 bp, Homo sapiens
cacggagagaaggcc

SEQ ID NO: 1510972 - DNA, 19 bp, Homo sapiens
cacggagcccagccctccc

SEQ ID NO: 1510973 - DNA, 18 bp, Homo sapiens
cacggaggagggatgctg

SEQ ID NO: 1510974 - DNA, 23 bp, Homo sapiens
cacggaggcatcctacccttttc

SEQ ID NO: 1510975 - DNA, 22 bp, Homo sapiens
cacggagggggacggggctcag

SEQ ID NO: 1510976 - DNA, 23 bp, Homo sapiens
cacggagtcgtggggtgtgctgg

SEQ ID NO: 1510977 - DNA, 16 bp, Homo sapiens
cacggatggtgcatgg

SEQ ID NO: 1510978 - DNA, 18 bp, Homo sapiens
cacggatggtgcatgggc

SEQ ID NO: 1510979 - DNA, 17 bp, Homo sapiens
cacggcagaccagaacg

SEQ ID NO: 1510980 - DNA, 17 bp, Homo sapiens
cacggccaccctccttc

SEQ ID NO: 1510981 - DNA, 15 bp, Homo sapiens
cacggccccgggtcc

SEQ ID NO: 1510982 - DNA, 23 bp, Homo sapiens
cacggcctgcccagtcgacccca

SEQ ID NO: 1510983 - DNA, 17 bp, Homo sapiens
cacggctgcgcactgtg

SEQ ID NO: 1510984 - DNA, 13 bp, Homo sapiens
cacggctggtcac

SEQ ID NO: 1510985 - DNA, 23 bp, Homo sapiens
cacggcttcactgaccagcggct

SEQ ID NO: 1510986 - DNA, 16 bp, Homo sapiens
cacgggaatcacaggt

SEQ ID NO: 1510987 - DNA, 18 bp, Homo sapiens
cacgggacatcacagggt

SEQ ID NO: 1510988 - DNA, 18 bp, Homo sapiens
cacgggcagcctggctcc

SEQ ID NO: 1510989 - DNA, 18 bp, Homo sapiens
cacgggcatgcacacggc

SEQ ID NO: 1510990 - DNA, 18 bp, Homo sapiens
cacgggcgagctttctct

SEQ ID NO: 1510991 - DNA, 14 bp, Homo sapiens
cacggtctggaggc

SEQ ID NO: 1510992 - DNA, 18 bp, Homo sapiens
cacggtctggaggccgag

SEQ ID NO: 1510993 - DNA, 20 bp, Homo sapiens
cacggtgactctgtccagct

SEQ ID NO: 1510994 - DNA, 17 bp, Homo sapiens
cacggtgcgtggctgtg

SEQ ID NO: 1510995 - DNA, 23 bp, Homo sapiens
cacggtgcgtggctgtggcacag

SEQ ID NO: 1510996 - DNA, 13 bp, Homo sapiens
cacggttcaatgg

SEQ ID NO: 1510997 - DNA, 20 bp, Homo sapiens
cacgtacaaaactctgtata

SEQ ID NO: 1510998 - DNA, 14 bp, Homo sapiens
cacgtattgctgtg

SEQ ID NO: 1510999 - DNA, 12 bp, Homo sapiens
cacgtcccagca

SEQ ID NO: 1511000 - DNA, 15 bp, Homo sapiens
cacgtccccctgggg

SEQ ID NO: 1511001 - DNA, 16 bp, Homo sapiens
cacgtccccctggggc

SEQ ID NO: 1511002 - DNA, 13 bp, Homo sapiens
cacgtctctgccg

SEQ ID NO: 1511003 - DNA, 17 bp, Homo sapiens
cacgtctctgccgcctg

SEQ ID NO: 1511004 - DNA, 20 bp, Homo sapiens
cacgtctctgccgcctgcgt

SEQ ID NO: 1511005 - DNA, 12 bp, Homo sapiens
cacgtctgccag

SEQ ID NO: 1511006 - DNA, 14 bp, Homo sapiens
cacgtctgccaggc

SEQ ID NO: 1511007 - DNA, 15 bp, Homo sapiens
cacgtctgccaggcc

SEQ ID NO: 1511008 - DNA, 17 bp, Homo sapiens
cacgtctgccaggccca

SEQ ID NO: 1511009 - DNA, 20 bp, Homo sapiens
cacgtctgccaggcccatct

SEQ ID NO: 1511010 - DNA, 15 bp, Homo sapiens
cacgtctggaccccg

SEQ ID NO: 1511011 - DNA, 20 bp, Homo sapiens
cacgtctggctccctgcccc

SEQ ID NO: 1511012 - DNA, 14 bp, Homo sapiens
cacgtctgtcctcc

SEQ ID NO: 1511013 - DNA, 12 bp, Homo sapiens
cacgtgaatggc

SEQ ID NO: 1511014 - DNA, 15 bp, Homo sapiens
cacgtgcaggacagc

SEQ ID NO: 1511015 - DNA, 20 bp, Homo sapiens
cacgtgcaggacagctcttg

SEQ ID NO: 1511016 - DNA, 20 bp, Homo sapiens
cacgtggcatgtggcctgtg

SEQ ID NO: 1511017 - DNA, 18 bp, Homo sapiens
cacgtggcctcttgagca

SEQ ID NO: 1511018 - DNA, 20 bp, Homo sapiens
cacgtggggcccactgctcg

SEQ ID NO: 1511019 - DNA, 19 bp, Homo sapiens
cacgtgtatagtatctgta

SEQ ID NO: 1511020 - DNA, 21 bp, Homo sapiens
cacgtgtccgtccacccttcc

SEQ ID NO: 1511021 - DNA, 22 bp, Homo sapiens
cacgtgtccgtccacccttcca

SEQ ID NO: 1511022 - DNA, 19 bp, Homo sapiens
cacgttctcacacccaccg

SEQ ID NO: 1511023 - DNA, 22 bp, Homo sapiens
cacgttgacagtacctagctgt

SEQ ID NO: 1511024 - DNA, 17 bp, Homo sapiens
cacgttggggtgattta

SEQ ID NO: 1511025 - DNA, 20 bp, Homo sapiens
cacgttggggtgatttaatc

SEQ ID NO: 1511026 - DNA, 16 bp, Homo sapiens
cacgtttaatcccagc

SEQ ID NO: 1511027 - DNA, 19 bp, Homo sapiens
cacgtttaatcccagcact

SEQ ID NO: 1511028 - DNA, 16 bp, Homo sapiens
cactaaagcatgaaat

SEQ ID NO: 1511029 - DNA, 15 bp, Homo sapiens
cactaaagcttcaga

SEQ ID NO: 1511030 - DNA, 13 bp, Homo sapiens
cactaaatgtaaa

SEQ ID NO: 1511031 - DNA, 19 bp, Homo sapiens
cactaaattattagcattt

SEQ ID NO: 1511032 - DNA, 22 bp, Homo sapiens
cactaaattattagcatttgtt

SEQ ID NO: 1511033 - DNA, 14 bp, Homo sapiens
cactaacagagtgg

SEQ ID NO: 1511034 - DNA, 19 bp, Homo sapiens
cactaacgacttcagggca

SEQ ID NO: 1511035 - DNA, 15 bp, Homo sapiens
cactaagagggcaga

SEQ ID NO: 1511036 - DNA, 19 bp, Homo sapiens
cactaagagggcagactgt

SEQ ID NO: 1511037 - DNA, 22 bp, Homo sapiens
cactaagttatagtatatctgg

SEQ ID NO: 1511038 - DNA, 20 bp, Homo sapiens
cactaatatatttaaaaata

SEQ ID NO: 1511039 - DNA, 23 bp, Homo sapiens
cactaattggtacttttaaaaac

SEQ ID NO: 1511040 - DNA, 19 bp, Homo sapiens
cactaatttttgtattatt

SEQ ID NO: 1511041 - DNA, 13 bp, Homo sapiens
cactacaacctcc

SEQ ID NO: 1511042 - DNA, 14 bp, Homo sapiens
cactacaacctccg

SEQ ID NO: 1511043 - DNA, 15 bp, Homo sapiens
cactacacctggctg

SEQ ID NO: 1511044 - DNA, 17 bp, Homo sapiens
cactacactccagcctg

SEQ ID NO: 1511045 - DNA, 18 bp, Homo sapiens
cactacactccagcctga

SEQ ID NO: 1511046 - DNA, 21 bp, Homo sapiens
cactacaggtgaaggctctca

SEQ ID NO: 1511047 - DNA, 17 bp, Homo sapiens
cactacatatctaaagc

SEQ ID NO: 1511048 - DNA, 15 bp, Homo sapiens
cactacatctggctt

SEQ ID NO: 1511049 - DNA, 14 bp, Homo sapiens
cactaccagccagc

SEQ ID NO: 1511050 - DNA, 18 bp, Homo sapiens
cactaccagccagcctca

SEQ ID NO: 1511051 - DNA, 13 bp, Homo sapiens
cactaccctgaga

SEQ ID NO: 1511052 - DNA, 16 bp, Homo sapiens
cactacccttctcctt

SEQ ID NO: 1511053 - DNA, 20 bp, Homo sapiens
cactacccttctcctttcct

SEQ ID NO: 1511054 - DNA, 17 bp, Homo sapiens
cactactcacagtctct

SEQ ID NO: 1511055 - DNA, 14 bp, Homo sapiens
cactactctgtgcc

SEQ ID NO: 1511056 - DNA, 13 bp, Homo sapiens
cactactgacatg

SEQ ID NO: 1511057 - DNA, 12 bp, Homo sapiens
cactactgcagc

SEQ ID NO: 1511058 - DNA, 13 bp, Homo sapiens
cactactgcagca

SEQ ID NO: 1511059 - DNA, 17 bp, Homo sapiens
cactactgcagcacctc

SEQ ID NO: 1511060 - DNA, 21 bp, Homo sapiens
cactactgctaccacaactat

SEQ ID NO: 1511061 - DNA, 13 bp, Homo sapiens
cactacttgacca

SEQ ID NO: 1511062 - DNA, 12 bp, Homo sapiens
cactagaaaact

SEQ ID NO: 1511063 - DNA, 14 bp, Homo sapiens
cactagagggccca

SEQ ID NO: 1511064 - DNA, 15 bp, Homo sapiens
cactagcagctgcag

SEQ ID NO: 1511065 - DNA, 20 bp, Homo sapiens
cactagccagacactctgct

SEQ ID NO: 1511066 - DNA, 16 bp, Homo sapiens
cactagcccaatgaaa

SEQ ID NO: 1511067 - DNA, 23 bp, Homo sapiens
cactagcccaatgaaatgaatta

SEQ ID NO: 1511068 - DNA, 16 bp, Homo sapiens
cactaggactctgagg

SEQ ID NO: 1511069 - DNA, 17 bp, Homo sapiens
cactagggccttggaaa

SEQ ID NO: 1511070 - DNA, 22 bp, Homo sapiens
cactagtcaccgacagcggcct

SEQ ID NO: 1511071 - DNA, 12 bp, Homo sapiens
cactataaatgg

SEQ ID NO: 1511072 - DNA, 18 bp, Homo sapiens
cactatctcacactaatc

SEQ ID NO: 1511073 - DNA, 20 bp, Homo sapiens
cactattaatctttcttttg

SEQ ID NO: 1511074 - DNA, 19 bp, Homo sapiens
cactatttatctgtgcaaa

SEQ ID NO: 1511075 - DNA, 14 bp, Homo sapiens
cactattttcaaag

SEQ ID NO: 1511076 - DNA, 16 bp, Homo sapiens
cactcaaatcttaaga

SEQ ID NO: 1511077 - DNA, 16 bp, Homo sapiens
cactcaaatgaatttg

SEQ ID NO: 1511078 - DNA, 17 bp, Homo sapiens
cactcaaatgaatttgc

SEQ ID NO: 1511079 - DNA, 18 bp, Homo sapiens
cactcaactaatttttgt

SEQ ID NO: 1511080 - DNA, 16 bp, Homo sapiens
cactcaactctgagcc

SEQ ID NO: 1511081 - DNA, 14 bp, Homo sapiens
cactcacactggcc

SEQ ID NO: 1511082 - DNA, 19 bp, Homo sapiens
cactcacagacctggagcc

SEQ ID NO: 1511083 - DNA, 15 bp, Homo sapiens
cactcacagagtcaa

SEQ ID NO: 1511084 - DNA, 22 bp, Homo sapiens
cactcacagagtcaaggcctgc

SEQ ID NO: 1511085 - DNA, 21 bp, Homo sapiens
cactcacatagccaactctcc

SEQ ID NO: 1511086 - DNA, 20 bp, Homo sapiens
cactcaccactaccagccag

SEQ ID NO: 1511087 - DNA, 24 bp, Homo sapiens
cactcaccagggtccgcaccagct

SEQ ID NO: 1511088 - DNA, 22 bp, Homo sapiens
cactcacctttctccactgggt

SEQ ID NO: 1511089 - DNA, 15 bp, Homo sapiens
cactcactccagccc

SEQ ID NO: 1511090 - DNA, 12 bp, Homo sapiens
cactcagacctg

SEQ ID NO: 1511091 - DNA, 22 bp, Homo sapiens
cactcagccatttccccctcct

SEQ ID NO: 1511092 - DNA, 13 bp, Homo sapiens
cactcagcctcat

SEQ ID NO: 1511093 - DNA, 20 bp, Homo sapiens
cactcagctgtcctgcagca

SEQ ID NO: 1511094 - DNA, 20 bp, Homo sapiens
cactcaggaggctgaggcag

SEQ ID NO: 1511095 - DNA, 17 bp, Homo sapiens
cactcaggcctctgcag

SEQ ID NO: 1511096 - DNA, 21 bp, Homo sapiens
cactcaggcctctgcagaagc

SEQ ID NO: 1511097 - DNA, 23 bp, Homo sapiens
cactcagtcccccaccacactga

SEQ ID NO: 1511098 - DNA, 22 bp, Homo sapiens
cactcatcacacttcattgtaa

SEQ ID NO: 1511099 - DNA, 18 bp, Homo sapiens
cactcatggaacactcat

SEQ ID NO: 1511100 - DNA, 16 bp, Homo sapiens
cactcattgctgagcc

SEQ ID NO: 1511101 - DNA, 18 bp, Homo sapiens
cactccaccacccaaaag

SEQ ID NO: 1511102 - DNA, 19 bp, Homo sapiens
cactccaccacccaaaagt

SEQ ID NO: 1511103 - DNA, 13 bp, Homo sapiens
cactccaccatcc

SEQ ID NO: 1511104 - DNA, 18 bp, Homo sapiens
cactccaccctccacctt

SEQ ID NO: 1511105 - DNA, 21 bp, Homo sapiens
cactccaccctccaccttcca

SEQ ID NO: 1511106 - DNA, 23 bp, Homo sapiens
cactccactctgattcacctctt

SEQ ID NO: 1511107 - DNA, 14 bp, Homo sapiens
cactccactgacaa

SEQ ID NO: 1511108 - DNA, 14 bp, Homo sapiens
cactccagacccct

SEQ ID NO: 1511109 - DNA, 13 bp, Homo sapiens
cactccagcccaa

SEQ ID NO: 1511110 - DNA, 14 bp, Homo sapiens
cactccagccctgt

SEQ ID NO: 1511111 - DNA, 21 bp, Homo sapiens
cactccagcctgagcaacaga

SEQ ID NO: 1511112 - DNA, 14 bp, Homo sapiens
cactccagcctggg

SEQ ID NO: 1511113 - DNA, 15 bp, Homo sapiens
cactccagcctgggg

SEQ ID NO: 1511114 - DNA, 22 bp, Homo sapiens
cactccagcctgggtcacagag

SEQ ID NO: 1511115 - DNA, 16 bp, Homo sapiens
cactccagtcaacaga

SEQ ID NO: 1511116 - DNA, 12 bp, Homo sapiens
cactccagtgct

SEQ ID NO: 1511117 - DNA, 18 bp, Homo sapiens
cactccagtgctcagctg

SEQ ID NO: 1511118 - DNA, 19 bp, Homo sapiens
cactcccaaggttggagcc

SEQ ID NO: 1511119 - DNA, 20 bp, Homo sapiens
cactcccaaggttggagccc

SEQ ID NO: 1511120 - DNA, 22 bp, Homo sapiens
cactcccacctgcatctggggc

SEQ ID NO: 1511121 - DNA, 19 bp, Homo sapiens
cactcccagcagctcaacc

SEQ ID NO: 1511122 - DNA, 19 bp, Homo sapiens
cactccccagagctgtgcc

SEQ ID NO: 1511123 - DNA, 14 bp, Homo sapiens
cactccccagggag

SEQ ID NO: 1511124 - DNA, 21 bp, Homo sapiens
cactccccagggagctctggg

SEQ ID NO: 1511125 - DNA, 16 bp, Homo sapiens
cagaaatagacaaaaa

SEQ ID NO: 1511126 - DNA, 21 bp, Homo sapiens
cagaaatataacacatttttt

SEQ ID NO: 1511127 - DNA, 16 bp, Homo sapiens
cagaaatgctgcctgc

SEQ ID NO: 1511128 - DNA, 18 bp, Homo sapiens
cagaaatgctgctggcca

SEQ ID NO: 1511129 - DNA, 23 bp, Homo sapiens
cagaaatggtgagatgtatgttt

SEQ ID NO: 1511130 - DNA, 23 bp, Homo sapiens
cagaaatgtcatgagattgctgt

SEQ ID NO: 1511131 - DNA, 14 bp, Homo sapiens
cagaaattctgttt

SEQ ID NO: 1511132 - DNA, 19 bp, Homo sapiens
cagaaattctgtttttaaa

SEQ ID NO: 1511133 - DNA, 20 bp, Homo sapiens
cagaaattctgtttttaaaa

SEQ ID NO: 1511134 - DNA, 22 bp, Homo sapiens
cagaaattctgtttttaaaaat

SEQ ID NO: 1511135 - DNA, 13 bp, Homo sapiens
cagaaattgtata

SEQ ID NO: 1511136 - DNA, 14 bp, Homo sapiens
cagaaattgtatat

SEQ ID NO: 1511137 - DNA, 22 bp, Homo sapiens
cagaaattgtatattgtaattt

SEQ ID NO: 1511138 - DNA, 23 bp, Homo sapiens
cagaaatttaattcatgtttctt

SEQ ID NO: 1511139 - DNA, 22 bp, Homo sapiens
cagaacaaatgtgtttttctat

SEQ ID NO: 1511140 - DNA, 23 bp, Homo sapiens
cagaacaccccgctctggcagta

SEQ ID NO: 1511141 - DNA, 14 bp, Homo sapiens
cagaacagcagagg

SEQ ID NO: 1511142 - DNA, 13 bp, Homo sapiens
cagaacaggtagt

SEQ ID NO: 1511143 - DNA, 17 bp, Homo sapiens
cagaacagtggtggcaa

SEQ ID NO: 1511144 - DNA, 15 bp, Homo sapiens
cagaacatcattaga

SEQ ID NO: 1511145 - DNA, 16 bp, Homo sapiens
cagaacatcattagaa

SEQ ID NO: 1511146 - DNA, 19 bp, Homo sapiens
cagaacattcagctctgga

SEQ ID NO: 1511147 - DNA, 22 bp, Homo sapiens
cagaacattcagctctggagaa

SEQ ID NO: 1511148 - DNA, 16 bp, Homo sapiens
cagaaccaaagctcaa

SEQ ID NO: 1511149 - DNA, 16 bp, Homo sapiens
cagaaccacacttgaa

SEQ ID NO: 1511150 - DNA, 22 bp, Homo sapiens
cagaaccacacttgaaaccttt

SEQ ID NO: 1511151 - DNA, 10 bp, Homo sapiens
cagaaccagg

SEQ ID NO: 1511152 - DNA, 22 bp, Homo sapiens
cagaacccacataaaagcccca

SEQ ID NO: 1511153 - DNA, 20 bp, Homo sapiens
cagaacccccaggtggcctg

SEQ ID NO: 1511154 - DNA, 22 bp, Homo sapiens
cagaacccttggagccaatgga

SEQ ID NO: 1511155 - DNA, 19 bp, Homo sapiens
cagaactaaactcatttat

SEQ ID NO: 1511156 - DNA, 20 bp, Homo sapiens
cagaactaaactcatttata

SEQ ID NO: 1511157 - DNA, 20 bp, Homo sapiens
cagaactcaaatggggccag

SEQ ID NO: 1511158 - DNA, 17 bp, Homo sapiens
cagaactgcttactagc

SEQ ID NO: 1511159 - DNA, 18 bp, Homo sapiens
cagaactggactcaggat

SEQ ID NO: 1511160 - DNA, 16 bp, Homo sapiens
cagaactgtgccacaa

SEQ ID NO: 1511161 - DNA, 17 bp, Homo sapiens
cagaactgtgccacaat

SEQ ID NO: 1511162 - DNA, 17 bp, Homo sapiens
cagaactgttggctgct

SEQ ID NO: 1511163 - DNA, 20 bp, Homo sapiens
cagaacttcagaaagacttg

SEQ ID NO: 1511164 - DNA, 19 bp, Homo sapiens
cagaacttcaggtgtgact

SEQ ID NO: 1511165 - DNA, 16 bp, Homo sapiens
cagaacttccaaagag

SEQ ID NO: 1511166 - DNA, 15 bp, Homo sapiens
cagaacttgaatgtg

SEQ ID NO: 1511167 - DNA, 17 bp, Homo sapiens
cagaagaaaacttttgt

SEQ ID NO: 1511168 - DNA, 17 bp, Homo sapiens
cagaagaaaggccaagg

SEQ ID NO: 1511169 - DNA, 20 bp, Homo sapiens
cagaagaagagaagctgctg

SEQ ID NO: 1511170 - DNA, 21 bp, Homo sapiens
cagaagaagagaagctgctga

SEQ ID NO: 1511171 - DNA, 18 bp, Homo sapiens
cagaagaatatgacagct

SEQ ID NO: 1511172 - DNA, 12 bp, Homo sapiens
cagaagaatatt

SEQ ID NO: 1511173 - DNA, 14 bp, Homo sapiens
cagaagaatattca

SEQ ID NO: 1511174 - DNA, 17 bp, Homo sapiens
cagaagaatattcagga

SEQ ID NO: 1511175 - DNA, 20 bp, Homo sapiens
cagaagaatattcaggactt

SEQ ID NO: 1511176 - DNA, 22 bp, Homo sapiens
cagaagaattgaacccaggagg

SEQ ID NO: 1511177 - DNA, 18 bp, Homo sapiens
cagaagactagaggccag

SEQ ID NO: 1511178 - DNA, 24 bp, Homo sapiens
cagaagactagaggccagggcagc

SEQ ID NO: 1511179 - DNA, 18 bp, Homo sapiens
cagaagagaattcagtat

SEQ ID NO: 1511180 - DNA, 14 bp, Homo sapiens
cagaagagcttgtc

SEQ ID NO: 1511181 - DNA, 22 bp, Homo sapiens
cagaagaggttgggcttccatg

SEQ ID NO: 1511182 - DNA, 19 bp, Homo sapiens
cagaagatgccagcttctc

SEQ ID NO: 1511183 - DNA, 14 bp, Homo sapiens
cagaagcagaggct

SEQ ID NO: 1511184 - DNA, 23 bp, Homo sapiens
cagaagcagtgtgagcagggctg

SEQ ID NO: 1511185 - DNA, 20 bp, Homo sapiens
cagaagcatattttgctggt

SEQ ID NO: 1511186 - DNA, 14 bp, Homo sapiens
cagaagcattgcct

SEQ ID NO: 1511187 - DNA, 17 bp, Homo sapiens
cagaagccaagggaaga

SEQ ID NO: 1511188 - DNA, 19 bp, Homo sapiens
cagaagccaagggaagaca

SEQ ID NO: 1511189 - DNA, 20 bp, Homo sapiens
cagaagccaagggaagacag

SEQ ID NO: 1511190 - DNA, 13 bp, Homo sapiens
cagaagcctctgg

SEQ ID NO: 1511191 - DNA, 14 bp, Homo sapiens
cagaagcctctggc

SEQ ID NO: 1511192 - DNA, 17 bp, Homo sapiens
cagaagctaagctgcag

SEQ ID NO: 1511193 - DNA, 22 bp, Homo sapiens
cagaagctcttactctttccta

SEQ ID NO: 1511194 - DNA, 12 bp, Homo sapiens
cagaagcttcca

SEQ ID NO: 1511195 - DNA, 15 bp, Homo sapiens
cagaaggaaggagga

SEQ ID NO: 1511196 - DNA, 19 bp, Homo sapiens
cagaaggagagtgagtgcc

SEQ ID NO: 1511197 - DNA, 18 bp, Homo sapiens
cagaaggagggcagagcc

SEQ ID NO: 1511198 - DNA, 19 bp, Homo sapiens
cagaaggagggcagagcca

SEQ ID NO: 1511199 - DNA, 17 bp, Homo sapiens
cagaaggatgaatgagg

SEQ ID NO: 1511200 - DNA, 12 bp, Homo sapiens
cagaaggcccca

SEQ ID NO: 1511201 - DNA, 14 bp, Homo sapiens
cagaaggccccaga

SEQ ID NO: 1511202 - DNA, 18 bp, Homo sapiens
cagaagggaattgctcag

SEQ ID NO: 1511203 - DNA, 21 bp, Homo sapiens
cagaagggggtggtgtctcca

SEQ ID NO: 1511204 - DNA, 22 bp, Homo sapiens
cagaaggtgccactttacccac

SEQ ID NO: 1511205 - DNA, 23 bp, Homo sapiens
cagaaggttgctctagattgaga

SEQ ID NO: 1511206 - DNA, 16 bp, Homo sapiens
cagaagtaccagacta

SEQ ID NO: 1511207 - DNA, 20 bp, Homo sapiens
cagaagtaccagactagatg

SEQ ID NO: 1511208 - DNA, 18 bp, Homo sapiens
cagaagtattcttttcaa

SEQ ID NO: 1511209 - DNA, 22 bp, Homo sapiens
cagaagtattcttttcaattat

SEQ ID NO: 1511210 - DNA, 15 bp, Homo sapiens
cagaagtcaataggc

SEQ ID NO: 1511211 - DNA, 18 bp, Homo sapiens
cagaagtcctccctcctg

SEQ ID NO: 1511212 - DNA, 22 bp, Homo sapiens
cagaagtgagctttgctgctac

SEQ ID NO: 1511213 - DNA, 14 bp, Homo sapiens
cagaagtgctcttt

SEQ ID NO: 1511214 - DNA, 14 bp, Homo sapiens
cagaagtggagctg

SEQ ID NO: 1511215 - DNA, 15 bp, Homo sapiens
cagaagtggagctgg

SEQ ID NO: 1511216 - DNA, 16 bp, Homo sapiens
cagaagtggagctggg

SEQ ID NO: 1511217 - DNA, 14 bp, Homo sapiens
cagaagtttaaata

SEQ ID NO: 1511218 - DNA, 14 bp, Homo sapiens
cagaataatgaatg

SEQ ID NO: 1511219 - DNA, 15 bp, Homo sapiens
cagaatataacatgt

SEQ ID NO: 1511220 - DNA, 14 bp, Homo sapiens
cagaatatgtttca

SEQ ID NO: 1511221 - DNA, 20 bp, Homo sapiens
cagaatatgtttcaaacttt

SEQ ID NO: 1511222 - DNA, 22 bp, Homo sapiens
cagaatatttttatatttcctt

SEQ ID NO: 1511223 - DNA, 16 bp, Homo sapiens
cagaatcatatgattc

SEQ ID NO: 1511224 - DNA, 14 bp, Homo sapiens
cagaatccaaagat

SEQ ID NO: 1511225 - DNA, 19 bp, Homo sapiens
cagaatccataaatgtgtt

SEQ ID NO: 1511226 - DNA, 21 bp, Homo sapiens
cagaatccataaatgtgttcc

SEQ ID NO: 1511227 - DNA, 13 bp, Homo sapiens
cagaatcccttaa

SEQ ID NO: 1511228 - DNA, 23 bp, Homo sapiens
cagaatccctttgcacctgagac

SEQ ID NO: 1511229 - DNA, 23 bp, Homo sapiens
cagaatcctcagttggaatcatt

SEQ ID NO: 1511230 - DNA, 22 bp, Homo sapiens
cagaatctaaacgtggtcacct

SEQ ID NO: 1511231 - DNA, 15 bp, Homo sapiens
cagaatctaaagcca

SEQ ID NO: 1511232 - DNA, 16 bp, Homo sapiens
cagaatctaaagccag

SEQ ID NO: 1511233 - DNA, 15 bp, Homo sapiens
cagaatctctatgta

SEQ ID NO: 1511234 - DNA, 21 bp, Homo sapiens
cagaatctctatgtatattct

SEQ ID NO: 1511235 - DNA, 14 bp, Homo sapiens
cagaatctgctgtt

SEQ ID NO: 1511236 - DNA, 22 bp, Homo sapiens
cagaatctgctgttgccatagc

SEQ ID NO: 1511237 - DNA, 23 bp, Homo sapiens
cagaatctgctgttgccatagcc

SEQ ID NO: 1511238 - DNA, 14 bp, Homo sapiens
cagaatcttctggg

SEQ ID NO: 1511239 - DNA, 13 bp, Homo sapiens
cagaatcttgttt

SEQ ID NO: 1511240 - DNA, 13 bp, Homo sapiens
cagaatgctcagg

SEQ ID NO: 1511241 - DNA, 18 bp, Homo sapiens
cagcagcccaagcttccc

SEQ ID NO: 1511242 - DNA, 19 bp, Homo sapiens
cagcagcccaagcttccct

SEQ ID NO: 1511243 - DNA, 13 bp, Homo sapiens
cagcagcccagct

SEQ ID NO: 1511244 - DNA, 19 bp, Homo sapiens
cagcagcccagcttcctgg

SEQ ID NO: 1511245 - DNA, 16 bp, Homo sapiens
cagcagccccccttgc

SEQ ID NO: 1511246 - DNA, 23 bp, Homo sapiens
cagcagccccccttgccccacct

SEQ ID NO: 1511247 - DNA, 17 bp, Homo sapiens
cagcagccctcctcacc

SEQ ID NO: 1511248 - DNA, 24 bp, Homo sapiens
cagcagcctccctgtcactcagct

SEQ ID NO: 1511249 - DNA, 21 bp, Homo sapiens
cagcagcctcgcacaggccct

SEQ ID NO: 1511250 - DNA, 19 bp, Homo sapiens
cagcagcgcgcaggcctgc

SEQ ID NO: 1511251 - DNA, 16 bp, Homo sapiens
cagcagctaggactga

SEQ ID NO: 1511252 - DNA, 23 bp, Homo sapiens
cagcagctaggactgaggagtgg

SEQ ID NO: 1511253 - DNA, 18 bp, Homo sapiens
cagcagctcaacctaccc

SEQ ID NO: 1511254 - DNA, 20 bp, Homo sapiens
cagcagctcacaccctacct

SEQ ID NO: 1511255 - DNA, 12 bp, Homo sapiens
cagcagctcagg

SEQ ID NO: 1511256 - DNA, 14 bp, Homo sapiens
cagcagctcaggca

SEQ ID NO: 1511257 - DNA, 15 bp, Homo sapiens
cagcagctcaggcac

SEQ ID NO: 1511258 - DNA, 11 bp, Homo sapiens
cagcagctcat

SEQ ID NO: 1511259 - DNA, 13 bp, Homo sapiens
cagcagctctgag

SEQ ID NO: 1511260 - DNA, 13 bp, Homo sapiens
cagcagctgcagg

SEQ ID NO: 1511261 - DNA, 11 bp, Homo sapiens
cagcagctggt

SEQ ID NO: 1511262 - DNA, 14 bp, Homo sapiens
cagcagctggtgcc

SEQ ID NO: 1511263 - DNA, 23 bp, Homo sapiens
cagcagctggtgccccacctgcc

SEQ ID NO: 1511264 - DNA, 17 bp, Homo sapiens
cagcagcttcaccagag

SEQ ID NO: 1511265 - DNA, 15 bp, Homo sapiens
cagcaggaagccagg

SEQ ID NO: 1511266 - DNA, 23 bp, Homo sapiens
cagcaggacttgctaaagcactt

SEQ ID NO: 1511267 - DNA, 19 bp, Homo sapiens
cagcaggagagactgagca

SEQ ID NO: 1511268 - DNA, 20 bp, Homo sapiens
cagcaggagagactgagcag

SEQ ID NO: 1511269 - DNA, 22 bp, Homo sapiens
cagcaggatcgaagggttttta

SEQ ID NO: 1511270 - DNA, 18 bp, Homo sapiens
cagcaggcaggtggactg

SEQ ID NO: 1511271 - DNA, 24 bp, Homo sapiens
cagcaggcaggtggactgactgtg

SEQ ID NO: 1511272 - DNA, 14 bp, Homo sapiens
cagcaggcccagca

SEQ ID NO: 1511273 - DNA, 21 bp, Homo sapiens
cagcaggcccttcccattctg

SEQ ID NO: 1511274 - DNA, 11 bp, Homo sapiens
cagcaggctca

SEQ ID NO: 1511275 - DNA, 14 bp, Homo sapiens
cagcaggctcaggc

SEQ ID NO: 1511276 - DNA, 14 bp, Homo sapiens
cagcaggctggcct

SEQ ID NO: 1511277 - DNA, 14 bp, Homo sapiens
cagcagggaagctc

SEQ ID NO: 1511278 - DNA, 16 bp, Homo sapiens
cagcagggaagctctt

SEQ ID NO: 1511279 - DNA, 16 bp, Homo sapiens
cagcagggccactccc

SEQ ID NO: 1511280 - DNA, 14 bp, Homo sapiens
cagcagggcctcaa

SEQ ID NO: 1511281 - DNA, 15 bp, Homo sapiens
cagcagggcctcaaa

SEQ ID NO: 1511282 - DNA, 17 bp, Homo sapiens
cagcaggggccctcact

SEQ ID NO: 1511283 - DNA, 19 bp, Homo sapiens
cagcaggggccctcactct

SEQ ID NO: 1511284 - DNA, 17 bp, Homo sapiens
cagcaggggggctgtgc

SEQ ID NO: 1511285 - DNA, 15 bp, Homo sapiens
cagcaggtgctgggc

SEQ ID NO: 1511286 - DNA, 16 bp, Homo sapiens
cagcaggtgctgggct

SEQ ID NO: 1511287 - DNA, 22 bp, Homo sapiens
cagcaggtgctgggctggactg

SEQ ID NO: 1511288 - DNA, 18 bp, Homo sapiens
cagcaggtgtggtggctc

SEQ ID NO: 1511289 - DNA, 19 bp, Homo sapiens
cagcagtacgtggcttcag

SEQ ID NO: 1511290 - DNA, 19 bp, Homo sapiens
cagcagtcctttgtaaaca

SEQ ID NO: 1511291 - DNA, 15 bp, Homo sapiens
cagcagtctccttca

SEQ ID NO: 1511292 - DNA, 19 bp, Homo sapiens
cagcagtctccttcagcac

SEQ ID NO: 1511293 - DNA, 22 bp, Homo sapiens
cagcagtctccttcagcacggc

SEQ ID NO: 1511294 - DNA, 15 bp, Homo sapiens
cagcagtgaccacac

SEQ ID NO: 1511295 - DNA, 21 bp, Homo sapiens
cagcagtgagtctcttcagaa

SEQ ID NO: 1511296 - DNA, 17 bp, Homo sapiens
cagcagtgggggtcaga

SEQ ID NO: 1511297 - DNA, 16 bp, Homo sapiens
cagcagtgtcatcaga

SEQ ID NO: 1511298 - DNA, 17 bp, Homo sapiens
cagcagtgtcccctgcc

SEQ ID NO: 1511299 - DNA, 21 bp, Homo sapiens
cagcagtgtcccctgccccag

SEQ ID NO: 1511300 - DNA, 17 bp, Homo sapiens
cagcagttgaaaagact

SEQ ID NO: 1511301 - DNA, 22 bp, Homo sapiens
cagcagttgaaaagactccaaa

SEQ ID NO: 1511302 - DNA, 15 bp, Homo sapiens
cagcagttgttccag

SEQ ID NO: 1511303 - DNA, 17 bp, Homo sapiens
cagcagtttgggaggtc

SEQ ID NO: 1511304 - DNA, 21 bp, Homo sapiens
cagcatacttcaaaactgttt

SEQ ID NO: 1511305 - DNA, 19 bp, Homo sapiens
cagcatagcaagacacatc

SEQ ID NO: 1511306 - DNA, 15 bp, Homo sapiens
cagcatagcctgcct

SEQ ID NO: 1511307 - DNA, 14 bp, Homo sapiens
cagcatcacctgcc

SEQ ID NO: 1511308 - DNA, 14 bp, Homo sapiens
cagcatccagcctg

SEQ ID NO: 1511309 - DNA, 15 bp, Homo sapiens
cagcatccagcctgt

SEQ ID NO: 1511310 - DNA, 12 bp, Homo sapiens
cagcatccctgg

SEQ ID NO: 1511311 - DNA, 13 bp, Homo sapiens
cagcatccctgga

SEQ ID NO: 1511312 - DNA, 16 bp, Homo sapiens
cagcatccctggagca

SEQ ID NO: 1511313 - DNA, 17 bp, Homo sapiens
cagcatccgcaggtgct

SEQ ID NO: 1511314 - DNA, 19 bp, Homo sapiens
cagcatcgggagcacccag

SEQ ID NO: 1511315 - DNA, 22 bp, Homo sapiens
cagcatcgggagcacccagagc

SEQ ID NO: 1511316 - DNA, 23 bp, Homo sapiens
cagcatcgggagcacccagagca

SEQ ID NO: 1511317 - DNA, 14 bp, Homo sapiens
cagcatctgaccat

SEQ ID NO: 1511318 - DNA, 20 bp, Homo sapiens
cagcatctgaccatctgtga

SEQ ID NO: 1511319 - DNA, 14 bp, Homo sapiens
cagcatcttctggt

SEQ ID NO: 1511320 - DNA, 16 bp, Homo sapiens
cagcatggaaaaatgg

SEQ ID NO: 1511321 - DNA, 13 bp, Homo sapiens
cagcatggaggag

SEQ ID NO: 1511322 - DNA, 12 bp, Homo sapiens
cagcatgtctac

SEQ ID NO: 1511323 - DNA, 13 bp, Homo sapiens
cagccaagggtcc

SEQ ID NO: 1511324 - DNA, 22 bp, Homo sapiens
cagccaagggtcctcacccctc

SEQ ID NO: 1511325 - DNA, 13 bp, Homo sapiens
cagccacaccact

SEQ ID NO: 1511326 - DNA, 15 bp, Homo sapiens
cagccacacccaggc

SEQ ID NO: 1511327 - DNA, 12 bp, Homo sapiens
cagccacactgt

SEQ ID NO: 1511328 - DNA, 15 bp, Homo sapiens
cagccacagacccct

SEQ ID NO: 1511329 - DNA, 21 bp, Homo sapiens
cagccacagacccctgggagc

SEQ ID NO: 1511330 - DNA, 14 bp, Homo sapiens
cagccacaggccaa

SEQ ID NO: 1511331 - DNA, 19 bp, Homo sapiens
cagccacccaagcctgctg

SEQ ID NO: 1511332 - DNA, 20 bp, Homo sapiens
cagccacccaagcctgctgg

SEQ ID NO: 1511333 - DNA, 22 bp, Homo sapiens
cagccacccaagcctgctggct

SEQ ID NO: 1511334 - DNA, 14 bp, Homo sapiens
cagccaccctgagt

SEQ ID NO: 1511335 - DNA, 21 bp, Homo sapiens
cagccaccgaagccgcctgtg

SEQ ID NO: 1511336 - DNA, 17 bp, Homo sapiens
cagccaccgtttcttcc

SEQ ID NO: 1511337 - DNA, 12 bp, Homo sapiens
cagccacgcagg

SEQ ID NO: 1511338 - DNA, 21 bp, Homo sapiens
cagccacggccccgggtccag

SEQ ID NO: 1511339 - DNA, 15 bp, Homo sapiens
cagccactgcacagg

SEQ ID NO: 1511340 - DNA, 18 bp, Homo sapiens
cagccacttccccctctt

SEQ ID NO: 1511341 - DNA, 23 bp, Homo sapiens
cagccagaaagcactacaatcat

SEQ ID NO: 1511342 - DNA, 22 bp, Homo sapiens
cagccagaccccacgctgacca

SEQ ID NO: 1511343 - DNA, 15 bp, Homo sapiens
cagccagactggcac

SEQ ID NO: 1511344 - DNA, 11 bp, Homo sapiens
cagccagagct

SEQ ID NO: 1511345 - DNA, 12 bp, Homo sapiens
cagccagagctg

SEQ ID NO: 1511346 - DNA, 14 bp, Homo sapiens
cagccagagctgtg

SEQ ID NO: 1511347 - DNA, 16 bp, Homo sapiens
cagccagagctgtgcc

SEQ ID NO: 1511348 - DNA, 24 bp, Homo sapiens
cagccagagctgtgcctgctcagc

SEQ ID NO: 1511349 - DNA, 18 bp, Homo sapiens
cagccagaggtggagcca

SEQ ID NO: 1511350 - DNA, 22 bp, Homo sapiens
cagccagaggtggagccaagtg

SEQ ID NO: 1511351 - DNA, 20 bp, Homo sapiens
cagccagagttcctgcggag

SEQ ID NO: 1511352 - DNA, 21 bp, Homo sapiens
cagccagagttcctgcggagt

SEQ ID NO: 1511353 - DNA, 13 bp, Homo sapiens
cagccagcaatga

SEQ ID NO: 1511354 - DNA, 12 bp, Homo sapiens
cagccagcacca

SEQ ID NO: 1511355 - DNA, 15 bp, Homo sapiens
cagccagcaccacct

SEQ ID NO: 1511356 - DNA, 16 bp, Homo sapiens
cagccagcacctggca

SEQ ID NO: 1511357 - DNA, 15 bp, Homo sapiens
cagccagcagagggg

SEQ ID NO: 1511358 - DNA, 17 bp, Homo sapiens
cagccagcagcagccca

SEQ ID NO: 1511359 - DNA, 17 bp, Homo sapiens
cagccagcagccagctc

SEQ ID NO: 1511360 - DNA, 18 bp, Homo sapiens
cagccagcagccagctct

SEQ ID NO: 1511361 - DNA, 21 bp, Homo sapiens
cagccagcagccagctctcag

SEQ ID NO: 1511362 - DNA, 11 bp, Homo sapiens
cagccagccca

SEQ ID NO: 1511363 - DNA, 15 bp, Homo sapiens
cagccagcccagccc

SEQ ID NO: 1511364 - DNA, 19 bp, Homo sapiens
cagccagcccagcccagct

SEQ ID NO: 1511365 - DNA, 13 bp, Homo sapiens
cagccagcctcag

SEQ ID NO: 1511366 - DNA, 21 bp, Homo sapiens
cagccagcgtcccttggtgag

SEQ ID NO: 1511367 - DNA, 20 bp, Homo sapiens
cagccagctcctgggcagct

SEQ ID NO: 1511368 - DNA, 16 bp, Homo sapiens
cagccagctctcagcc

SEQ ID NO: 1511369 - DNA, 17 bp, Homo sapiens
cagccagctctcagcca

SEQ ID NO: 1511370 - DNA, 21 bp, Homo sapiens
cagccagctctcagccaacga

SEQ ID NO: 1511371 - DNA, 12 bp, Homo sapiens
cagccaggacac

SEQ ID NO: 1511372 - DNA, 22 bp, Homo sapiens
cagccaggaccataccgggtct

SEQ ID NO: 1511373 - DNA, 11 bp, Homo sapiens
cagccaggagc

SEQ ID NO: 1511374 - DNA, 14 bp, Homo sapiens
cagccaggcgggct

SEQ ID NO: 1511375 - DNA, 16 bp, Homo sapiens
cagccaggcgggctca

SEQ ID NO: 1511376 - DNA, 18 bp, Homo sapiens
cagccaggcgggctcaag

SEQ ID NO: 1511377 - DNA, 19 bp, Homo sapiens
cagccaggcgggctcaagg

SEQ ID NO: 1511378 - DNA, 13 bp, Homo sapiens
cagccaggctgcc

SEQ ID NO: 1511379 - DNA, 20 bp, Homo sapiens
cagccagggacccccagaac

SEQ ID NO: 1511380 - DNA, 23 bp, Homo sapiens
cagccaggttagcctttgccctg

SEQ ID NO: 1511381 - DNA, 17 bp, Homo sapiens
cagccagtctcagagac

SEQ ID NO: 1511382 - DNA, 21 bp, Homo sapiens
cagccagtctcagagaccagc

SEQ ID NO: 1511383 - DNA, 15 bp, Homo sapiens
cagccagtcttgcct

SEQ ID NO: 1511384 - DNA, 20 bp, Homo sapiens
cagccagtcttgcctaggcc

SEQ ID NO: 1511385 - DNA, 21 bp, Homo sapiens
cagccatagacctacagacct

SEQ ID NO: 1511386 - DNA, 19 bp, Homo sapiens
cagccatcataggaaggga

SEQ ID NO: 1511387 - DNA, 19 bp, Homo sapiens
cagccatctcatgagggga

SEQ ID NO: 1511388 - DNA, 16 bp, Homo sapiens
cagccatctgcccagg

SEQ ID NO: 1511389 - DNA, 16 bp, Homo sapiens
cagccatgaagtcacc

SEQ ID NO: 1511390 - DNA, 18 bp, Homo sapiens
cagccatgaggagttgct

SEQ ID NO: 1511391 - DNA, 12 bp, Homo sapiens
cagccatgcctc

SEQ ID NO: 1511392 - DNA, 20 bp, Homo sapiens
cagccatgcctcatgccaca

SEQ ID NO: 1511393 - DNA, 14 bp, Homo sapiens
cagccatgcgtggc

SEQ ID NO: 1511394 - DNA, 15 bp, Homo sapiens
cagccatttccccct

SEQ ID NO: 1511395 - DNA, 17 bp, Homo sapiens
cagccatttccccctcc

SEQ ID NO: 1511396 - DNA, 18 bp, Homo sapiens
cagccatttccccctcct

SEQ ID NO: 1511397 - DNA, 20 bp, Homo sapiens
cagccatttccccctcctca

SEQ ID NO: 1511398 - DNA, 21 bp, Homo sapiens
cagccattttacatagcacat

SEQ ID NO: 1511399 - DNA, 13 bp, Homo sapiens
cagccatttttaa

SEQ ID NO: 1511400 - DNA, 17 bp, Homo sapiens
cagcccaacagaaggaa

SEQ ID NO: 1511401 - DNA, 14 bp, Homo sapiens
cagcccaacagcac

SEQ ID NO: 1511402 - DNA, 19 bp, Homo sapiens
cagcccacatagtgatggt

SEQ ID NO: 1511403 - DNA, 14 bp, Homo sapiens
cagcccaccaccct

SEQ ID NO: 1511404 - DNA, 14 bp, Homo sapiens
cagcccactgagaa

SEQ ID NO: 1511405 - DNA, 12 bp, Homo sapiens
cagcccagagac

SEQ ID NO: 1511406 - DNA, 13 bp, Homo sapiens
cagcccagagaca

SEQ ID NO: 1511407 - DNA, 14 bp, Homo sapiens
cagcccagagactt

SEQ ID NO: 1511408 - DNA, 21 bp, Homo sapiens
cagcccagagactttgtagat

SEQ ID NO: 1511409 - DNA, 16 bp, Homo sapiens
cagcccagagcccggt

SEQ ID NO: 1511410 - DNA, 16 bp, Homo sapiens
cagcccagcacctgct

SEQ ID NO: 1511411 - DNA, 18 bp, Homo sapiens
cagcccagcacctgctcc

SEQ ID NO: 1511412 - DNA, 19 bp, Homo sapiens
cagcccagcacctgctccc

SEQ ID NO: 1511413 - DNA, 16 bp, Homo sapiens
cagccggcctctctgg

SEQ ID NO: 1511414 - DNA, 17 bp, Homo sapiens
cagccggcctctctggc

SEQ ID NO: 1511415 - DNA, 20 bp, Homo sapiens
cagccggcctctctggcctc

SEQ ID NO: 1511416 - DNA, 21 bp, Homo sapiens
caggaaactccacatctgcct

SEQ ID NO: 1511417 - DNA, 23 bp, Homo sapiens
caggaaactccacatctgcctta

SEQ ID NO: 1511418 - DNA, 18 bp, Homo sapiens
caggaaaggcccagccac

SEQ ID NO: 1511419 - DNA, 21 bp, Homo sapiens
caggaaaggcttggctggtgt

SEQ ID NO: 1511420 - DNA, 13 bp, Homo sapiens
caggaaataaagt

SEQ ID NO: 1511421 - DNA, 15 bp, Homo sapiens
caggaaatatatatg

SEQ ID NO: 1511422 - DNA, 19 bp, Homo sapiens
caggaaatcaaatatgcaa

SEQ ID NO: 1511423 - DNA, 17 bp, Homo sapiens
caggaacaacagcatct

SEQ ID NO: 1511424 - DNA, 21 bp, Homo sapiens
caggaacaagtaatgtattag

SEQ ID NO: 1511425 - DNA, 12 bp, Homo sapiens
caggaacagaag

SEQ ID NO: 1511426 - DNA, 20 bp, Homo sapiens
caggaacagctatgggagcc

SEQ ID NO: 1511427 - DNA, 20 bp, Homo sapiens
caggaacccttgcatccatt

SEQ ID NO: 1511428 - DNA, 13 bp, Homo sapiens
caggaacgagcac

SEQ ID NO: 1511429 - DNA, 14 bp, Homo sapiens
caggaacgagcact

SEQ ID NO: 1511430 - DNA, 16 bp, Homo sapiens
caggaacgagcactgg

SEQ ID NO: 1511431 - DNA, 13 bp, Homo sapiens
caggaactgggcc

SEQ ID NO: 1511432 - DNA, 22 bp, Homo sapiens
caggaagaaatcacagaatcat

SEQ ID NO: 1511433 - DNA, 14 bp, Homo sapiens
caggaagaggccca

SEQ ID NO: 1511434 - DNA, 19 bp, Homo sapiens
caggaagccaggctgagtg

SEQ ID NO: 1511435 - DNA, 13 bp, Homo sapiens
caggaagcctgtg

SEQ ID NO: 1511436 - DNA, 12 bp, Homo sapiens
caggaagctcag

SEQ ID NO: 1511437 - DNA, 23 bp, Homo sapiens
caggaagctcagccttctcctcc

SEQ ID NO: 1511438 - DNA, 16 bp, Homo sapiens
caggaagctctcttaa

SEQ ID NO: 1511439 - DNA, 15 bp, Homo sapiens
caggaagctggcaga

SEQ ID NO: 1511440 - DNA, 19 bp, Homo sapiens
caggaagctttttgtatta

SEQ ID NO: 1511441 - DNA, 12 bp, Homo sapiens
caggaaggaaca

SEQ ID NO: 1511442 - DNA, 19 bp, Homo sapiens
caggaaggccacagtgctg

SEQ ID NO: 1511443 - DNA, 20 bp, Homo sapiens
caggaaggtagcccagcact

SEQ ID NO: 1511444 - DNA, 18 bp, Homo sapiens
caggaaggtgaggcagaa

SEQ ID NO: 1511445 - DNA, 15 bp, Homo sapiens
caggaagtacttcca

SEQ ID NO: 1511446 - DNA, 17 bp, Homo sapiens
caggaatatatgtgtgc

SEQ ID NO: 1511447 - DNA, 17 bp, Homo sapiens
caggaatccttactgat

SEQ ID NO: 1511448 - DNA, 16 bp, Homo sapiens
caggaatctcagagac

SEQ ID NO: 1511449 - DNA, 17 bp, Homo sapiens
caggaatctcagagaca

SEQ ID NO: 1511450 - DNA, 14 bp, Homo sapiens
caggaatgatctct

SEQ ID NO: 1511451 - DNA, 19 bp, Homo sapiens
caggaatggggggcgggcc

SEQ ID NO: 1511452 - DNA, 23 bp, Homo sapiens
caggaatgtgtggcctgcacagt

SEQ ID NO: 1511453 - DNA, 18 bp, Homo sapiens
caggaatgttaaagtcag

SEQ ID NO: 1511454 - DNA, 21 bp, Homo sapiens
caggaattagagaagctgaaa

SEQ ID NO: 1511455 - DNA, 15 bp, Homo sapiens
caggaattcagtgcc

SEQ ID NO: 1511456 - DNA, 23 bp, Homo sapiens
caggaatttagaccttttccctg

SEQ ID NO: 1511457 - DNA, 19 bp, Homo sapiens
caggaatttcccaggaccc

SEQ ID NO: 1511458 - DNA, 21 bp, Homo sapiens
caggaatttcccaggaccctg

SEQ ID NO: 1511459 - DNA, 20 bp, Homo sapiens
caggaatttgaagctgcagt

SEQ ID NO: 1511460 - DNA, 14 bp, Homo sapiens
caggaattttattt

SEQ ID NO: 1511461 - DNA, 21 bp, Homo sapiens
caggaattttattttgctgag

SEQ ID NO: 1511462 - DNA, 15 bp, Homo sapiens
caggacaccgggcag

SEQ ID NO: 1511463 - DNA, 13 bp, Homo sapiens
caggacagatgcc

SEQ ID NO: 1511464 - DNA, 17 bp, Homo sapiens
caggacagcgggaaaaa

SEQ ID NO: 1511465 - DNA, 17 bp, Homo sapiens
caggacaggaggcggcc

SEQ ID NO: 1511466 - DNA, 21 bp, Homo sapiens
caggacaggaggcggcccggc

SEQ ID NO: 1511467 - DNA, 20 bp, Homo sapiens
caggacagtgcttcagcctg

SEQ ID NO: 1511468 - DNA, 15 bp, Homo sapiens
caggacatgcaataa

SEQ ID NO: 1511469 - DNA, 19 bp, Homo sapiens
caggacatgcaataaaatt

SEQ ID NO: 1511470 - DNA, 21 bp, Homo sapiens
caggacatgcaataaaattta

SEQ ID NO: 1511471 - DNA, 23 bp, Homo sapiens
caggaccacctcgtcctcgtggc

SEQ ID NO: 1511472 - DNA, 10 bp, Homo sapiens
caggaccagc

SEQ ID NO: 1511473 - DNA, 12 bp, Homo sapiens
caggaccagctc

SEQ ID NO: 1511474 - DNA, 15 bp, Homo sapiens
caggaccagctcagg

SEQ ID NO: 1511475 - DNA, 16 bp, Homo sapiens
caggaccagctcagga

SEQ ID NO: 1511476 - DNA, 19 bp, Homo sapiens
caggaccagctcaggacag

SEQ ID NO: 1511477 - DNA, 17 bp, Homo sapiens
caggaccatcctggagg

SEQ ID NO: 1511478 - DNA, 18 bp, Homo sapiens
caggaccatcctggaggg

SEQ ID NO: 1511479 - DNA, 12 bp, Homo sapiens
caggacccaggc

SEQ ID NO: 1511480 - DNA, 14 bp, Homo sapiens
caggacccaggccc

SEQ ID NO: 1511481 - DNA, 16 bp, Homo sapiens
caggacccaggccctc

SEQ ID NO: 1511482 - DNA, 21 bp, Homo sapiens
caggacccaggccctccatgg

SEQ ID NO: 1511483 - DNA, 21 bp, Homo sapiens
caggacccgccagccccgctc

SEQ ID NO: 1511484 - DNA, 18 bp, Homo sapiens
caggaccctgaaggggcc

SEQ ID NO: 1511485 - DNA, 20 bp, Homo sapiens
caggaccctgacctccgccc

SEQ ID NO: 1511486 - DNA, 22 bp, Homo sapiens
caggacctctgtaggcagcaga

SEQ ID NO: 1511487 - DNA, 20 bp, Homo sapiens
caggaccttcgggctgtgcc

SEQ ID NO: 1511488 - DNA, 14 bp, Homo sapiens
caggactcaccctc

SEQ ID NO: 1511489 - DNA, 15 bp, Homo sapiens
caggactcaccctca

SEQ ID NO: 1511490 - DNA, 16 bp, Homo sapiens
caggactcaccctcat

SEQ ID NO: 1511491 - DNA, 13 bp, Homo sapiens
caggactccctcc

SEQ ID NO: 1511492 - DNA, 21 bp, Homo sapiens
caggactccctcctcacctct

SEQ ID NO: 1511493 - DNA, 22 bp, Homo sapiens
caggactccctcctcacctctg

SEQ ID NO: 1511494 - DNA, 19 bp, Homo sapiens
caggactgaattgtcccca

SEQ ID NO: 1511495 - DNA, 20 bp, Homo sapiens
caggactgggtctgacctgg

SEQ ID NO: 1511496 - DNA, 23 bp, Homo sapiens
caggactgggtctgacctggtgg

SEQ ID NO: 1511497 - DNA, 15 bp, Homo sapiens
caggacttaaaatga

SEQ ID NO: 1511498 - DNA, 21 bp, Homo sapiens
caggacttaagacaaatggga

SEQ ID NO: 1511499 - DNA, 23 bp, Homo sapiens
caggacttaagacaaatgggact

SEQ ID NO: 1511500 - DNA, 20 bp, Homo sapiens
caggacttgctaaagcactt

SEQ ID NO: 1511501 - DNA, 21 bp, Homo sapiens
caggacttgctaaagcacttt

SEQ ID NO: 1511502 - DNA, 20 bp, Homo sapiens
caggacttggtctgatttca

SEQ ID NO: 1511503 - DNA, 19 bp, Homo sapiens
caggactttgaggcaagtg

SEQ ID NO: 1511504 - DNA, 20 bp, Homo sapiens
caggagaaagatgaaactga

SEQ ID NO: 1511505 - DNA, 23 bp, Homo sapiens
caggagaaatgcatccattcctc

SEQ ID NO: 1511506 - DNA, 17 bp, Homo sapiens
caggagaaccactacat

SEQ ID NO: 1511507 - DNA, 21 bp, Homo sapiens
caggagaagaacaagaaatgg

SEQ ID NO: 1511508 - DNA, 21 bp, Homo sapiens
caggagaagggggctctgccc

SEQ ID NO: 1511509 - DNA, 14 bp, Homo sapiens
caggagaagtgctc

SEQ ID NO: 1511510 - DNA, 12 bp, Homo sapiens
caggagacatcc

SEQ ID NO: 1511511 - DNA, 15 bp, Homo sapiens
caggagactgggctc

SEQ ID NO: 1511512 - DNA, 16 bp, Homo sapiens
caggagactgggctct

SEQ ID NO: 1511513 - DNA, 22 bp, Homo sapiens
caggagactgggctctggctct

SEQ ID NO: 1511514 - DNA, 12 bp, Homo sapiens
caggagagaccc

SEQ ID NO: 1511515 - DNA, 14 bp, Homo sapiens
caggagagacccct

SEQ ID NO: 1511516 - DNA, 16 bp, Homo sapiens
caggagagacccctcc

SEQ ID NO: 1511517 - DNA, 15 bp, Homo sapiens
caggagagagccagg

SEQ ID NO: 1511518 - DNA, 13 bp, Homo sapiens
caggagagccagc

SEQ ID NO: 1511519 - DNA, 15 bp, Homo sapiens
caggagagccagccc

SEQ ID NO: 1511520 - DNA, 16 bp, Homo sapiens
caggagagccagccct

SEQ ID NO: 1511521 - DNA, 17 bp, Homo sapiens
caggagagccagccctc

SEQ ID NO: 1511522 - DNA, 18 bp, Homo sapiens
caggagagccagccctcc

SEQ ID NO: 1511523 - DNA, 21 bp, Homo sapiens
caggagagccagccctccctg

SEQ ID NO: 1511524 - DNA, 23 bp, Homo sapiens
caggagagccagccctccctgtc

SEQ ID NO: 1511525 - DNA, 14 bp, Homo sapiens
caggagaggcagca

SEQ ID NO: 1511526 - DNA, 21 bp, Homo sapiens
caggagaggcagcatgcttgg

SEQ ID NO: 1511527 - DNA, 17 bp, Homo sapiens
caggagatcgagaccat

SEQ ID NO: 1511528 - DNA, 16 bp, Homo sapiens
caggagcacaggcagc

SEQ ID NO: 1511529 - DNA, 17 bp, Homo sapiens
caggagcacaggcagct

SEQ ID NO: 1511530 - DNA, 14 bp, Homo sapiens
caggagcagaagag

SEQ ID NO: 1511531 - DNA, 19 bp, Homo sapiens
caggagcagcagccagcac

SEQ ID NO: 1511532 - DNA, 19 bp, Homo sapiens
cagctgcgggtctgaagga

SEQ ID NO: 1511533 - DNA, 17 bp, Homo sapiens
cagctgctactactcct

SEQ ID NO: 1511534 - DNA, 20 bp, Homo sapiens
cagctgctccccaggccacc

SEQ ID NO: 1511535 - DNA, 15 bp, Homo sapiens
cagctgctctgcccc

SEQ ID NO: 1511536 - DNA, 20 bp, Homo sapiens
cagctgctgaagttctgagc

SEQ ID NO: 1511537 - DNA, 13 bp, Homo sapiens
cagctgctggaga

SEQ ID NO: 1511538 - DNA, 14 bp, Homo sapiens
cagctgctggagaa

SEQ ID NO: 1511539 - DNA, 22 bp, Homo sapiens
cagctgctggagaataaatttg

SEQ ID NO: 1511540 - DNA, 16 bp, Homo sapiens
cagctgctggccaggg

SEQ ID NO: 1511541 - DNA, 16 bp, Homo sapiens
cagctgctgggaccca

SEQ ID NO: 1511542 - DNA, 22 bp, Homo sapiens
cagctgcttgacctagctcttt

SEQ ID NO: 1511543 - DNA, 21 bp, Homo sapiens
cagctgcttgtcctgctctct

SEQ ID NO: 1511544 - DNA, 16 bp, Homo sapiens
cagctgcttgtgggcc

SEQ ID NO: 1511545 - DNA, 14 bp, Homo sapiens
cagctgctttttgt

SEQ ID NO: 1511546 - DNA, 15 bp, Homo sapiens
cagctggccacctag

SEQ ID NO: 1511547 - DNA, 12 bp, Homo sapiens
cagctggcccac

SEQ ID NO: 1511548 - DNA, 17 bp, Homo sapiens
cagctggcctggacagt

SEQ ID NO: 1511549 - DNA, 11 bp, Homo sapiens
cagctggctgg

SEQ ID NO: 1511550 - DNA, 16 bp, Homo sapiens
cagctgggacccctcc

SEQ ID NO: 1511551 - DNA, 13 bp, Homo sapiens
cagctgggaggca

SEQ ID NO: 1511552 - DNA, 13 bp, Homo sapiens
cagctgggcaggg

SEQ ID NO: 1511553 - DNA, 16 bp, Homo sapiens
cagctgggcagggtga

SEQ ID NO: 1511554 - DNA, 16 bp, Homo sapiens
cagctgggcatgccat

SEQ ID NO: 1511555 - DNA, 14 bp, Homo sapiens
cagctgggcccagc

SEQ ID NO: 1511556 - DNA, 19 bp, Homo sapiens
cagctgggccccacctact

SEQ ID NO: 1511557 - DNA, 15 bp, Homo sapiens
cagctgggccccatg

SEQ ID NO: 1511558 - DNA, 21 bp, Homo sapiens
cagctgggccccatgctctgc

SEQ ID NO: 1511559 - DNA, 23 bp, Homo sapiens
cagctgggccccatgctctgccc

SEQ ID NO: 1511560 - DNA, 18 bp, Homo sapiens
cagctgggcctcctgcct

SEQ ID NO: 1511561 - DNA, 21 bp, Homo sapiens
cagctgggcctcctgcctccg

SEQ ID NO: 1511562 - DNA, 23 bp, Homo sapiens
cagctgggcctcctgcctccggg

SEQ ID NO: 1511563 - DNA, 14 bp, Homo sapiens
cagctgggctctgc

SEQ ID NO: 1511564 - DNA, 16 bp, Homo sapiens
cagctgggctctgcca

SEQ ID NO: 1511565 - DNA, 18 bp, Homo sapiens
cagctgggctctgccacc

SEQ ID NO: 1511566 - DNA, 14 bp, Homo sapiens
cagctggggagcag

SEQ ID NO: 1511567 - DNA, 19 bp, Homo sapiens
cagctggggagcagctgag

SEQ ID NO: 1511568 - DNA, 18 bp, Homo sapiens
cagctggggggctgtcct

SEQ ID NO: 1511569 - DNA, 19 bp, Homo sapiens
cagctggggggctgtcctg

SEQ ID NO: 1511570 - DNA, 20 bp, Homo sapiens
cagctggggggctgtcctga

SEQ ID NO: 1511571 - DNA, 14 bp, Homo sapiens
cagctggggtcctg

SEQ ID NO: 1511572 - DNA, 16 bp, Homo sapiens
cagctggggtcctgtc

SEQ ID NO: 1511573 - DNA, 13 bp, Homo sapiens
cagctggtgccaa

SEQ ID NO: 1511574 - DNA, 21 bp, Homo sapiens
cagctgtaagaagagactggg

SEQ ID NO: 1511575 - DNA, 22 bp, Homo sapiens
cagctgtaagaagagactggga

SEQ ID NO: 1511576 - DNA, 18 bp, Homo sapiens
cagctgtagccatggctc

SEQ ID NO: 1511577 - DNA, 22 bp, Homo sapiens
cagctgtagccatggctcaggc

SEQ ID NO: 1511578 - DNA, 12 bp, Homo sapiens
cagctgtccctg

SEQ ID NO: 1511579 - DNA, 13 bp, Homo sapiens
cagctgtccctgt

SEQ ID NO: 1511580 - DNA, 16 bp, Homo sapiens
cagctgtccctgtcac

SEQ ID NO: 1511581 - DNA, 16 bp, Homo sapiens
cagctgtcctgcagca

SEQ ID NO: 1511582 - DNA, 13 bp, Homo sapiens
cagctgtgctgca

SEQ ID NO: 1511583 - DNA, 19 bp, Homo sapiens
cagctgtggcagagttaca

SEQ ID NO: 1511584 - DNA, 23 bp, Homo sapiens
cagctgtggggaacatggctggc

SEQ ID NO: 1511585 - DNA, 15 bp, Homo sapiens
cagctgtgtctgaca

SEQ ID NO: 1511586 - DNA, 23 bp, Homo sapiens
cagctgtgtgacatttggagagg

SEQ ID NO: 1511587 - DNA, 13 bp, Homo sapiens
cagctgtttctca

SEQ ID NO: 1511588 - DNA, 13 bp, Homo sapiens
cagcttaaaccca

SEQ ID NO: 1511589 - DNA, 22 bp, Homo sapiens
cagcttaaacccatacaatgta

SEQ ID NO: 1511590 - DNA, 15 bp, Homo sapiens
cagcttatctctttt

SEQ ID NO: 1511591 - DNA, 16 bp, Homo sapiens
cagcttatctctttta

SEQ ID NO: 1511592 - DNA, 19 bp, Homo sapiens
cagcttatctcttttatat

SEQ ID NO: 1511593 - DNA, 22 bp, Homo sapiens
cagcttatctcttttatatttg

SEQ ID NO: 1511594 - DNA, 23 bp, Homo sapiens
cagcttatctcttttatatttgt

SEQ ID NO: 1511595 - DNA, 18 bp, Homo sapiens
cagggatgattcccaccc

SEQ ID NO: 1511596 - DNA, 18 bp, Homo sapiens
cagggatggagatgggaa

SEQ ID NO: 1511597 - DNA, 21 bp, Homo sapiens
cagggatgggcagcccaacag

SEQ ID NO: 1511598 - DNA, 20 bp, Homo sapiens
cagggattaacctctgcact

SEQ ID NO: 1511599 - DNA, 23 bp, Homo sapiens
cagggattctgggcttggggtgt

SEQ ID NO: 1511600 - DNA, 16 bp, Homo sapiens
cagggattgattttaa

SEQ ID NO: 1511601 - DNA, 16 bp, Homo sapiens
cagggcaccagaggcc

SEQ ID NO: 1511602 - DNA, 16 bp, Homo sapiens
cagggcacgcaggacc

SEQ ID NO: 1511603 - DNA, 18 bp, Homo sapiens
cagggcacgcaggaccag

SEQ ID NO: 1511604 - DNA, 16 bp, Homo sapiens
cagggcagaggaatgt

SEQ ID NO: 1511605 - DNA, 13 bp, Homo sapiens
cagggcagaggga

SEQ ID NO: 1511606 - DNA, 15 bp, Homo sapiens
cagggcagcagatct

SEQ ID NO: 1511607 - DNA, 14 bp, Homo sapiens
cagggcagcagccg

SEQ ID NO: 1511608 - DNA, 12 bp, Homo sapiens
cagggcagcctc

SEQ ID NO: 1511609 - DNA, 17 bp, Homo sapiens
cagggcagcctccacct

SEQ ID NO: 1511610 - DNA, 11 bp, Homo sapiens
cagggcagggc

SEQ ID NO: 1511611 - DNA, 16 bp, Homo sapiens
cagggcagggctctga

SEQ ID NO: 1511612 - DNA, 19 bp, Homo sapiens
cagggcagggctctgatat

SEQ ID NO: 1511613 - DNA, 14 bp, Homo sapiens
cagggcatctcctg

SEQ ID NO: 1511614 - DNA, 15 bp, Homo sapiens
cagggcatctcctgt

SEQ ID NO: 1511615 - DNA, 19 bp, Homo sapiens
cagggcatgcattttgcag

SEQ ID NO: 1511616 - DNA, 14 bp, Homo sapiens
cagggcattgctca

SEQ ID NO: 1511617 - DNA, 15 bp, Homo sapiens
cagggcattgctcag

SEQ ID NO: 1511618 - DNA, 18 bp, Homo sapiens
cagggcattgctcagccc

SEQ ID NO: 1511619 - DNA, 22 bp, Homo sapiens
cagggcattgctcagcccgctt

SEQ ID NO: 1511620 - DNA, 16 bp, Homo sapiens
cagggccaaagcacag

SEQ ID NO: 1511621 - DNA, 15 bp, Homo sapiens
cagggccaccgcagg

SEQ ID NO: 1511622 - DNA, 17 bp, Homo sapiens
cagggccacgtgccagg

SEQ ID NO: 1511623 - DNA, 18 bp, Homo sapiens
cagggccacgtgccaggc

SEQ ID NO: 1511624 - DNA, 21 bp, Homo sapiens
cagggccacgtgccaggcccg

SEQ ID NO: 1511625 - DNA, 23 bp, Homo sapiens
cagggccactcaacagagaggac

SEQ ID NO: 1511626 - DNA, 13 bp, Homo sapiens
cagggccactccc

SEQ ID NO: 1511627 - DNA, 18 bp, Homo sapiens
cagggccactctgcctct

SEQ ID NO: 1511628 - DNA, 20 bp, Homo sapiens
cagggccactctgcctctgc

SEQ ID NO: 1511629 - DNA, 14 bp, Homo sapiens
cagggccagaagga

SEQ ID NO: 1511630 - DNA, 23 bp, Homo sapiens
cagggccagaaggagggcagagc

SEQ ID NO: 1511631 - DNA, 15 bp, Homo sapiens
cagggccagggccct

SEQ ID NO: 1511632 - DNA, 20 bp, Homo sapiens
cagggccaggtgcagacctt

SEQ ID NO: 1511633 - DNA, 18 bp, Homo sapiens
cagggccatctgactgcc

SEQ ID NO: 1511634 - DNA, 21 bp, Homo sapiens
cagggccatctgactgccaag

SEQ ID NO: 1511635 - DNA, 22 bp, Homo sapiens
cagggccatggctcagggtggt

SEQ ID NO: 1511636 - DNA, 19 bp, Homo sapiens
cagggcccaagtccctgtt

SEQ ID NO: 1511637 - DNA, 12 bp, Homo sapiens
cagggcccagag

SEQ ID NO: 1511638 - DNA, 16 bp, Homo sapiens
cagggcccagagccca

SEQ ID NO: 1511639 - DNA, 22 bp, Homo sapiens
cagggcccagagcccagctcca

SEQ ID NO: 1511640 - DNA, 13 bp, Homo sapiens
cagggccccagaa

SEQ ID NO: 1511641 - DNA, 22 bp, Homo sapiens
cagggccccagcactaaagcag

SEQ ID NO: 1511642 - DNA, 17 bp, Homo sapiens
cagggcccccacaggcc

SEQ ID NO: 1511643 - DNA, 21 bp, Homo sapiens
cagggcccccggccacgctcc

SEQ ID NO: 1511644 - DNA, 18 bp, Homo sapiens
cagggcccctcaccctgc

SEQ ID NO: 1511645 - DNA, 22 bp, Homo sapiens
cagggcccctcaccctgcctta

SEQ ID NO: 1511646 - DNA, 19 bp, Homo sapiens
cagggcccctccctctgcc

SEQ ID NO: 1511647 - DNA, 21 bp, Homo sapiens
cagggcccgcagtgctgggac

SEQ ID NO: 1511648 - DNA, 17 bp, Homo sapiens
cagggcccggccacacc

SEQ ID NO: 1511649 - DNA, 20 bp, Homo sapiens
cagggcccggccacacccag

SEQ ID NO: 1511650 - DNA, 17 bp, Homo sapiens
cagggccctcccagccc

SEQ ID NO: 1511651 - DNA, 23 bp, Homo sapiens
cagggccctcccagcccattgct

SEQ ID NO: 1511652 - DNA, 20 bp, Homo sapiens
cagggccgcccgggcccaga

SEQ ID NO: 1511653 - DNA, 20 bp, Homo sapiens
cagggccgcgagaggccgag

SEQ ID NO: 1511654 - DNA, 18 bp, Homo sapiens
cagggccgcggccgcccg

SEQ ID NO: 1511655 - DNA, 17 bp, Homo sapiens
cagggcctgagcagctg

SEQ ID NO: 1511656 - DNA, 16 bp, Homo sapiens
cagggcctggagcccc

SEQ ID NO: 1511657 - DNA, 11 bp, Homo sapiens
cagggcctggg

SEQ ID NO: 1511658 - DNA, 12 bp, Homo sapiens
cagggcctgggg

SEQ ID NO: 1511659 - DNA, 22 bp, Homo sapiens
cagggcctggggagatggagga

SEQ ID NO: 1511660 - DNA, 16 bp, Homo sapiens
cagggcctgggggcag

SEQ ID NO: 1511661 - DNA, 20 bp, Homo sapiens
cagggcctgggggcagtgac

SEQ ID NO: 1511662 - DNA, 20 bp, Homo sapiens
cagggccttgcccagagatg

SEQ ID NO: 1511663 - DNA, 19 bp, Homo sapiens
cagggcgctcagacggcgg

SEQ ID NO: 1511664 - DNA, 20 bp, Homo sapiens
cagggcgctcagacggcggc

SEQ ID NO: 1511665 - DNA, 22 bp, Homo sapiens
cagggcggtaccttgtgcccag

SEQ ID NO: 1511666 - DNA, 14 bp, Homo sapiens
cagggctagtgact

SEQ ID NO: 1511667 - DNA, 15 bp, Homo sapiens
cagggctagtgactt

SEQ ID NO: 1511668 - DNA, 18 bp, Homo sapiens
cagggctagtgacttgtg

SEQ ID NO: 1511669 - DNA, 12 bp, Homo sapiens
cagggctcagcc

SEQ ID NO: 1511670 - DNA, 13 bp, Homo sapiens
cagggctcagcct

SEQ ID NO: 1511671 - DNA, 14 bp, Homo sapiens
cagggctcagcctg

SEQ ID NO: 1511672 - DNA, 16 bp, Homo sapiens
cagggctccagcccct

SEQ ID NO: 1511673 - DNA, 19 bp, Homo sapiens
cagggctcccacagagaca

SEQ ID NO: 1511674 - DNA, 12 bp, Homo sapiens
cagggctcccag

SEQ ID NO: 1511675 - DNA, 21 bp, Homo sapiens
cagggctcccaggggtctccc

SEQ ID NO: 1511676 - DNA, 11 bp, Homo sapiens
cagggctcctg

SEQ ID NO: 1511677 - DNA, 12 bp, Homo sapiens
cagggctcctgc

SEQ ID NO: 1511678 - DNA, 14 bp, Homo sapiens
cagggctcctgcac

SEQ ID NO: 1511679 - DNA, 16 bp, Homo sapiens
cagggctcctgtggca

SEQ ID NO: 1511680 - DNA, 17 bp, Homo sapiens
cagggctcctgtggcag

SEQ ID NO: 1511681 - DNA, 13 bp, Homo sapiens
cagggctctgcag

SEQ ID NO: 1511682 - DNA, 16 bp, Homo sapiens
cagggctctgcagcac

SEQ ID NO: 1511683 - DNA, 14 bp, Homo sapiens
cagggctggactga

SEQ ID NO: 1511684 - DNA, 20 bp, Homo sapiens
cagggctggactgaggcctg

SEQ ID NO: 1511685 - DNA, 13 bp, Homo sapiens
cagggctgggagg

SEQ ID NO: 1511686 - DNA, 13 bp, Homo sapiens
cagggctgggcca

SEQ ID NO: 1511687 - DNA, 15 bp, Homo sapiens
cagggctggggacag

SEQ ID NO: 1511688 - DNA, 17 bp, Homo sapiens
cagggctggggacagag

SEQ ID NO: 1511689 - DNA, 19 bp, Homo sapiens
cagggctgtgcttgaaggc

SEQ ID NO: 1511690 - DNA, 23 bp, Homo sapiens
cagggctgtgcttgaaggccctg

SEQ ID NO: 1511691 - DNA, 17 bp, Homo sapiens
cagggcttctcctcctc

SEQ ID NO: 1511692 - DNA, 13 bp, Homo sapiens
cagggctttaaaa

SEQ ID NO: 1511693 - DNA, 18 bp, Homo sapiens
cagggcttttcccaggaa

SEQ ID NO: 1511694 - DNA, 16 bp, Homo sapiens
caggggaaaatgaagg

SEQ ID NO: 1511695 - DNA, 16 bp, Homo sapiens
caggggaacctgccat

SEQ ID NO: 1511696 - DNA, 16 bp, Homo sapiens
caggggaaggaaggag

SEQ ID NO: 1511697 - DNA, 23 bp, Homo sapiens
caggggaattccctccccctcct

SEQ ID NO: 1511698 - DNA, 17 bp, Homo sapiens
caggggacaagggaggc

SEQ ID NO: 1511699 - DNA, 14 bp, Homo sapiens
caggggacagctgg

SEQ ID NO: 1511700 - DNA, 15 bp, Homo sapiens
caggggactcagccc

SEQ ID NO: 1511701 - DNA, 17 bp, Homo sapiens
caggggactcagccctg

SEQ ID NO: 1511702 - DNA, 18 bp, Homo sapiens
caggggactcagccctga

SEQ ID NO: 1511703 - DNA, 16 bp, Homo sapiens
caggggagacaggagc

SEQ ID NO: 1511704 - DNA, 15 bp, Homo sapiens
caggggagccagctg

SEQ ID NO: 1511705 - DNA, 18 bp, Homo sapiens
caggggagccagctgctt

SEQ ID NO: 1511706 - DNA, 13 bp, Homo sapiens
caggggaggaaaa

SEQ ID NO: 1511707 - DNA, 14 bp, Homo sapiens
caggggaggaaaaa

SEQ ID NO: 1511708 - DNA, 18 bp, Homo sapiens
caggggaggaaaaaagaa

SEQ ID NO: 1511709 - DNA, 19 bp, Homo sapiens
caggggaggaaaaaagaac

SEQ ID NO: 1511710 - DNA, 20 bp, Homo sapiens
caggggcaaggggctggctg

SEQ ID NO: 1511711 - DNA, 21 bp, Homo sapiens
caggggcaaggggctggctgg

SEQ ID NO: 1511712 - DNA, 12 bp, Homo sapiens
cagtacaataat

SEQ ID NO: 1511713 - DNA, 19 bp, Homo sapiens
cagtacaataatgtactca

SEQ ID NO: 1511714 - DNA, 12 bp, Homo sapiens
cagtacacacaa

SEQ ID NO: 1511715 - DNA, 13 bp, Homo sapiens
cagtacagaattg

SEQ ID NO: 1511716 - DNA, 12 bp, Homo sapiens
cagtacatatgt

SEQ ID NO: 1511717 - DNA, 17 bp, Homo sapiens
cagtacatatgtaattc

SEQ ID NO: 1511718 - DNA, 14 bp, Homo sapiens
cagtacatgggaaa

SEQ ID NO: 1511719 - DNA, 16 bp, Homo sapiens
cagtacatttaaattt

SEQ ID NO: 1511720 - DNA, 15 bp, Homo sapiens
cagtacctccaagca

SEQ ID NO: 1511721 - DNA, 14 bp, Homo sapiens
cagtactaaaatta

SEQ ID NO: 1511722 - DNA, 15 bp, Homo sapiens
cagtactttattgta

SEQ ID NO: 1511723 - DNA, 18 bp, Homo sapiens
cagtactttgtgcattct

SEQ ID NO: 1511724 - DNA, 13 bp, Homo sapiens
cagtagaaaatat

SEQ ID NO: 1511725 - DNA, 18 bp, Homo sapiens
cagtagcagcagaggcca

SEQ ID NO: 1511726 - DNA, 13 bp, Homo sapiens
cagtagccaaggc

SEQ ID NO: 1511727 - DNA, 13 bp, Homo sapiens
cagtagctgctac

SEQ ID NO: 1511728 - DNA, 20 bp, Homo sapiens
cagtagctgtggtgaggtgg

SEQ ID NO: 1511729 - DNA, 17 bp, Homo sapiens
cagtaggtccaagggcc

SEQ ID NO: 1511730 - DNA, 19 bp, Homo sapiens
cagtaggtccaagggccat

SEQ ID NO: 1511731 - DNA, 21 bp, Homo sapiens
cagtaggtcccggccagctct

SEQ ID NO: 1511732 - DNA, 22 bp, Homo sapiens
cagtaggtcccggccagctctg

SEQ ID NO: 1511733 - DNA, 15 bp, Homo sapiens
cagtagtcagaagca

SEQ ID NO: 1511734 - DNA, 16 bp, Homo sapiens
cagtagtttgagacca

SEQ ID NO: 1511735 - DNA, 17 bp, Homo sapiens
cagtagtttgagaccag

SEQ ID NO: 1511736 - DNA, 18 bp, Homo sapiens
cagtagtttgagaccagc

SEQ ID NO: 1511737 - DNA, 22 bp, Homo sapiens
cagtagtttgagaccagcctgg

SEQ ID NO: 1511738 - DNA, 19 bp, Homo sapiens
cagtagtttgcatttcaga

SEQ ID NO: 1511739 - DNA, 13 bp, Homo sapiens
cagtatactgtgt

SEQ ID NO: 1511740 - DNA, 23 bp, Homo sapiens
cagtatatgttaatttgtgtgtt

SEQ ID NO: 1511741 - DNA, 22 bp, Homo sapiens
cagtatatttatagtcacaaga

SEQ ID NO: 1511742 - DNA, 14 bp, Homo sapiens
cagtatatttgaaa

SEQ ID NO: 1511743 - DNA, 18 bp, Homo sapiens
cagtatatttgaaactgt

SEQ ID NO: 1511744 - DNA, 16 bp, Homo sapiens
cagtatcacagatgta

SEQ ID NO: 1511745 - DNA, 17 bp, Homo sapiens
cagtatccaatgtcttt

SEQ ID NO: 1511746 - DNA, 13 bp, Homo sapiens
cagtatcccacat

SEQ ID NO: 1511747 - DNA, 21 bp, Homo sapiens
cagtatctatatatgtgtatg

SEQ ID NO: 1511748 - DNA, 18 bp, Homo sapiens
cagtatctcaagatattc

SEQ ID NO: 1511749 - DNA, 17 bp, Homo sapiens
cagtatctcttcagtct

SEQ ID NO: 1511750 - DNA, 23 bp, Homo sapiens
cagtatgagaagaaaaatggaaa

SEQ ID NO: 1511751 - DNA, 14 bp, Homo sapiens
cagtatgatgaaaa

SEQ ID NO: 1511752 - DNA, 18 bp, Homo sapiens
cagtatgatgaaaataat

SEQ ID NO: 1511753 - DNA, 16 bp, Homo sapiens
cagtatgctgcccctg

SEQ ID NO: 1511754 - DNA, 21 bp, Homo sapiens
cagtatgctttccctgaggaa

SEQ ID NO: 1511755 - DNA, 21 bp, Homo sapiens
cagtatggtctaacactggca

SEQ ID NO: 1511756 - DNA, 23 bp, Homo sapiens
cagtatgttccaaaccctcctgg

SEQ ID NO: 1511757 - DNA, 20 bp, Homo sapiens
cagtattaaaggggggaggg

SEQ ID NO: 1511758 - DNA, 21 bp, Homo sapiens
cagtattaaaggggggagggg

SEQ ID NO: 1511759 - DNA, 14 bp, Homo sapiens
cagtattaaggttt

SEQ ID NO: 1511760 - DNA, 14 bp, Homo sapiens
cagtattctgacat

SEQ ID NO: 1511761 - DNA, 17 bp, Homo sapiens
cagtattctgacatgta

SEQ ID NO: 1511762 - DNA, 18 bp, Homo sapiens
cagtattctgacatgtaa

SEQ ID NO: 1511763 - DNA, 21 bp, Homo sapiens
cagtattctgacatgtaagaa

SEQ ID NO: 1511764 - DNA, 15 bp, Homo sapiens
cagtattcttttaaa

SEQ ID NO: 1511765 - DNA, 15 bp, Homo sapiens
cagtatttgtaatta

SEQ ID NO: 1511766 - DNA, 19 bp, Homo sapiens
cagtattttaaatgaagtg

SEQ ID NO: 1511767 - DNA, 16 bp, Homo sapiens
cagtattttgtgtcct

SEQ ID NO: 1511768 - DNA, 14 bp, Homo sapiens
cagtatttttaaag

SEQ ID NO: 1511769 - DNA, 15 bp, Homo sapiens
cagtatttttaaagg

SEQ ID NO: 1511770 - DNA, 19 bp, Homo sapiens
cagtatttttaaaggcatt

SEQ ID NO: 1511771 - DNA, 15 bp, Homo sapiens
cagtcaaaacagaga

SEQ ID NO: 1511772 - DNA, 21 bp, Homo sapiens
cagtcaacagattcagaatga

SEQ ID NO: 1511773 - DNA, 20 bp, Homo sapiens
cagtcaagaagaaaaaggtt

SEQ ID NO: 1511774 - DNA, 23 bp, Homo sapiens
cagtcacactgttactccacagc

SEQ ID NO: 1511775 - DNA, 20 bp, Homo sapiens
cagtcacctcgtctccctgg

SEQ ID NO: 1511776 - DNA, 14 bp, Homo sapiens
cagtcactcctctc

SEQ ID NO: 1511777 - DNA, 22 bp, Homo sapiens
cagtcactcctctctagggcag

SEQ ID NO: 1511778 - DNA, 23 bp, Homo sapiens
cagtcactcctctctagggcaga

SEQ ID NO: 1511779 - DNA, 12 bp, Homo sapiens
cagtcactgctc

SEQ ID NO: 1511780 - DNA, 16 bp, Homo sapiens
cagtcactgctgcaag

SEQ ID NO: 1511781 - DNA, 17 bp, Homo sapiens
cagtcactgctgcaagg

SEQ ID NO: 1511782 - DNA, 14 bp, Homo sapiens
cagtcactggaggt

SEQ ID NO: 1511783 - DNA, 13 bp, Homo sapiens
cagtcagaaggac

SEQ ID NO: 1511784 - DNA, 14 bp, Homo sapiens
cagtcaggcccagg

SEQ ID NO: 1511785 - DNA, 16 bp, Homo sapiens
cagtcagggacagcag

SEQ ID NO: 1511786 - DNA, 21 bp, Homo sapiens
cagtcaggtagttgcaattga

SEQ ID NO: 1511787 - DNA, 20 bp, Homo sapiens
cagtcagtggagagatgttt

SEQ ID NO: 1511788 - DNA, 16 bp, Homo sapiens
cagtcagtggagcctg

SEQ ID NO: 1511789 - DNA, 18 bp, Homo sapiens
cagtcagttcccggagca

SEQ ID NO: 1511790 - DNA, 15 bp, Homo sapiens
cagtcataaatactg

SEQ ID NO: 1511791 - DNA, 11 bp, Homo sapiens
cagtcatttaa

SEQ ID NO: 1511792 - DNA, 12 bp, Homo sapiens
cagtcatttaaa

SEQ ID NO: 1511793 - DNA, 18 bp, Homo sapiens
cagtccaaatgtcctcca

SEQ ID NO: 1511794 - DNA, 21 bp, Homo sapiens
cagtccaaatgtcctccagaa

SEQ ID NO: 1511795 - DNA, 23 bp, Homo sapiens
cagtccaaatgtcctccagaagc

SEQ ID NO: 1511796 - DNA, 13 bp, Homo sapiens
cagtccacagggg

SEQ ID NO: 1511797 - DNA, 18 bp, Homo sapiens
cagtccacaggggccacc

SEQ ID NO: 1511798 - DNA, 21 bp, Homo sapiens
cagtccactgttgagccccag

SEQ ID NO: 1511799 - DNA, 17 bp, Homo sapiens
cagtccagccagctcct

SEQ ID NO: 1511800 - DNA, 19 bp, Homo sapiens
cagtccagctctttagaat

SEQ ID NO: 1511801 - DNA, 21 bp, Homo sapiens
cagtccaggtggtgaattttc

SEQ ID NO: 1511802 - DNA, 15 bp, Homo sapiens
cagtccatgctccag

SEQ ID NO: 1511803 - DNA, 23 bp, Homo sapiens
cagtccatgctccagggtcaggc

SEQ ID NO: 1511804 - DNA, 19 bp, Homo sapiens
cagtcccacaccgctggtc

SEQ ID NO: 1511805 - DNA, 21 bp, Homo sapiens
cagtcccagacaattccattc

SEQ ID NO: 1511806 - DNA, 15 bp, Homo sapiens
cagtccccacccctg

SEQ ID NO: 1511807 - DNA, 17 bp, Homo sapiens
cagtccccacccctgcc

SEQ ID NO: 1511808 - DNA, 15 bp, Homo sapiens
cagtccccacccgcc

SEQ ID NO: 1511809 - DNA, 22 bp, Homo sapiens
cagtccccacccgcctgcagag

SEQ ID NO: 1511810 - DNA, 17 bp, Homo sapiens
cagtccccagcccttct

SEQ ID NO: 1511811 - DNA, 19 bp, Homo sapiens
cagtccccagcccttctgc

SEQ ID NO: 1511812 - DNA, 20 bp, Homo sapiens
cagtcccccaccacactgaa

SEQ ID NO: 1511813 - DNA, 19 bp, Homo sapiens
cagtcccctcccatctggg

SEQ ID NO: 1511814 - DNA, 16 bp, Homo sapiens
cagtccctggagctgt

SEQ ID NO: 1511815 - DNA, 15 bp, Homo sapiens
cagtcctaagaaaga

SEQ ID NO: 1511816 - DNA, 14 bp, Homo sapiens
cagtcctcaggaag

SEQ ID NO: 1511817 - DNA, 20 bp, Homo sapiens
cagtcctccactcgacccag

SEQ ID NO: 1511818 - DNA, 19 bp, Homo sapiens
cagtcctgcctcagcctcc

SEQ ID NO: 1511819 - DNA, 12 bp, Homo sapiens
cagtcctgcctg

SEQ ID NO: 1511820 - DNA, 17 bp, Homo sapiens
cagtcctggaagccagc

SEQ ID NO: 1511821 - DNA, 13 bp, Homo sapiens
cagtcctggaggc

SEQ ID NO: 1511822 - DNA, 21 bp, Homo sapiens
cagtcctggaggcagggggtg

SEQ ID NO: 1511823 - DNA, 12 bp, Homo sapiens
cagtcctgggag

SEQ ID NO: 1511824 - DNA, 13 bp, Homo sapiens
cagtcctgggaga

SEQ ID NO: 1511825 - DNA, 21 bp, Homo sapiens
cagtcctgggagaacctcagg

SEQ ID NO: 1511826 - DNA, 13 bp, Homo sapiens
cagtcctggtcct

SEQ ID NO: 1511827 - DNA, 17 bp, Homo sapiens
cagtcctggtcctggct

SEQ ID NO: 1511828 - DNA, 22 bp, Homo sapiens
cagtcctggtcctggctgcact

SEQ ID NO: 1511829 - DNA, 23 bp, Homo sapiens
cagtcctggtcctggctgcactc

SEQ ID NO: 1511830 - DNA, 21 bp, Homo sapiens
cagtcctttgtaaacagtgtt

SEQ ID NO: 1511831 - DNA, 14 bp, Homo sapiens
cagtcgcaggatcc

SEQ ID NO: 1511832 - DNA, 14 bp, Homo sapiens
cagtcgggaggagc

SEQ ID NO: 1511833 - DNA, 19 bp, Homo sapiens
cagtcgggggaactgaggc

SEQ ID NO: 1511834 - DNA, 19 bp, Homo sapiens
cagtcgtgatgtggaggaa

SEQ ID NO: 1511835 - DNA, 21 bp, Homo sapiens
cagtcgtggctttggcagtgt

SEQ ID NO: 1511836 - DNA, 14 bp, Homo sapiens
cagtcgttcccagt

SEQ ID NO: 1511837 - DNA, 16 bp, Homo sapiens
cagtcgttcccagtgt

SEQ ID NO: 1511838 - DNA, 17 bp, Homo sapiens
cagtctattcacagaag

SEQ ID NO: 1511839 - DNA, 15 bp, Homo sapiens
cagtctatttccact

SEQ ID NO: 1511840 - DNA, 16 bp, Homo sapiens
cagtctcacagagaag

SEQ ID NO: 1511841 - DNA, 21 bp, Homo sapiens
cagtctcacagagaagctcct

SEQ ID NO: 1511842 - DNA, 15 bp, Homo sapiens
cagtctcagagacca

SEQ ID NO: 1511843 - DNA, 19 bp, Homo sapiens
cagtctcagagaccagcac

SEQ ID NO: 1511844 - DNA, 13 bp, Homo sapiens
cagtctcaggagc

SEQ ID NO: 1511845 - DNA, 14 bp, Homo sapiens
cagtctcccaggcc

SEQ ID NO: 1511846 - DNA, 20 bp, Homo sapiens
cagtctcccaggccccctgc

SEQ ID NO: 1511847 - DNA, 13 bp, Homo sapiens
cagtctcctctcc

SEQ ID NO: 1511848 - DNA, 15 bp, Homo sapiens
cagtctcgggtggct

SEQ ID NO: 1511849 - DNA, 22 bp, Homo sapiens
cagtctctataccaataaagtg

SEQ ID NO: 1511850 - DNA, 15 bp, Homo sapiens
cagtctctttaatct

SEQ ID NO: 1511851 - DNA, 20 bp, Homo sapiens
cagtctctttaatcttcagt

SEQ ID NO: 1511852 - DNA, 22 bp, Homo sapiens
cagtctctttaatcttcagttt

SEQ ID NO: 1511853 - DNA, 19 bp, Homo sapiens
cagtctgaacccttgtgct

SEQ ID NO: 1511854 - DNA, 18 bp, Homo sapiens
cagtctgaatgctgccac

SEQ ID NO: 1511855 - DNA, 14 bp, Homo sapiens
cagtctgctccacc

SEQ ID NO: 1511856 - DNA, 15 bp, Homo sapiens
cagtctgctccacca

SEQ ID NO: 1511857 - DNA, 18 bp, Homo sapiens
cagtctgctccaccaagg

SEQ ID NO: 1511858 - DNA, 15 bp, Homo sapiens
cagtctggcctgggc

SEQ ID NO: 1511859 - DNA, 15 bp, Homo sapiens
cagtctgtctactgt

SEQ ID NO: 1511860 - DNA, 17 bp, Homo sapiens
cagtctgtctactgtgg

SEQ ID NO: 1511861 - DNA, 18 bp, Homo sapiens
cagtctgtctactgtggt

SEQ ID NO: 1511862 - DNA, 16 bp, Homo sapiens
cagtctgttatgcact

SEQ ID NO: 1511863 - DNA, 13 bp, Homo sapiens
cagtcttcctctt

SEQ ID NO: 1511864 - DNA, 19 bp, Homo sapiens
cagtcttcctcttagcctc

SEQ ID NO: 1511865 - DNA, 20 bp, Homo sapiens
cagtcttcctcttagcctct

SEQ ID NO: 1511866 - DNA, 17 bp, Homo sapiens
cagtcttcctgacactt

SEQ ID NO: 1511867 - DNA, 21 bp, Homo sapiens
cagtcttcctgacactttaat

SEQ ID NO: 1511868 - DNA, 18 bp, Homo sapiens
cagtcttctctctggctc

SEQ ID NO: 1511869 - DNA, 19 bp, Homo sapiens
cagtcttctctctggctca

SEQ ID NO: 1511870 - DNA, 20 bp, Homo sapiens
cagtcttctctctggctcag

SEQ ID NO: 1511871 - DNA, 11 bp, Homo sapiens
cagtcttctgg

SEQ ID NO: 1511872 - DNA, 22 bp, Homo sapiens
cagtcttgaatttctaaaaaac

SEQ ID NO: 1511873 - DNA, 23 bp, Homo sapiens
cagtcttgaatttctaaaaaaca

SEQ ID NO: 1511874 - DNA, 14 bp, Homo sapiens
cagtcttgcctagg

SEQ ID NO: 1511875 - DNA, 15 bp, Homo sapiens
cagtcttgcctaggc

SEQ ID NO: 1511876 - DNA, 22 bp, Homo sapiens
cagtgaaaaatatgttgagtgt

SEQ ID NO: 1511877 - DNA, 13 bp, Homo sapiens
cagtgaaagaagc

SEQ ID NO: 1511878 - DNA, 13 bp, Homo sapiens
cagtgaacacatt

SEQ ID NO: 1511879 - DNA, 14 bp, Homo sapiens
cagtgaacattccc

SEQ ID NO: 1511880 - DNA, 17 bp, Homo sapiens
cagtgaacattcccagc

SEQ ID NO: 1511881 - DNA, 18 bp, Homo sapiens
cagtgaacattcccagcc

SEQ ID NO: 1511882 - DNA, 20 bp, Homo sapiens
cagtgaacattcccagccca

SEQ ID NO: 1511883 - DNA, 23 bp, Homo sapiens
cagtgaacattcccagcccagcc

SEQ ID NO: 1511884 - DNA, 20 bp, Homo sapiens
cagtgaacttacacttggag

SEQ ID NO: 1511885 - DNA, 19 bp, Homo sapiens
cagtgaagaaccctattta

SEQ ID NO: 1511886 - DNA, 18 bp, Homo sapiens
cagtgaagcagcactgtg

SEQ ID NO: 1511887 - DNA, 19 bp, Homo sapiens
cagtgaagcagcactgtga

SEQ ID NO: 1511888 - DNA, 20 bp, Homo sapiens
cagtgaagtgcctttttcct

SEQ ID NO: 1511889 - DNA, 21 bp, Homo sapiens
cagtgaagtgcctttttccta

SEQ ID NO: 1511890 - DNA, 15 bp, Homo sapiens
cagtgaatatttttg

SEQ ID NO: 1511891 - DNA, 23 bp, Homo sapiens
cagtgaatccctgggagcgcctg

SEQ ID NO: 1511892 - DNA, 12 bp, Homo sapiens
cagtgaattgtc

SEQ ID NO: 1511893 - DNA, 17 bp, Homo sapiens
cagtgacagacaggctc

SEQ ID NO: 1511894 - DNA, 18 bp, Homo sapiens
cagtgacagacaggctct

SEQ ID NO: 1511895 - DNA, 21 bp, Homo sapiens
cagtgacatcaaagcctggcc

SEQ ID NO: 1511896 - DNA, 24 bp, Homo sapiens
cagtgacccttcccaatcagcact

SEQ ID NO: 1511897 - DNA, 17 bp, Homo sapiens
cagtgacgtgcacctgt

SEQ ID NO: 1511898 - DNA, 15 bp, Homo sapiens
cagtgactcctgctg

SEQ ID NO: 1511899 - DNA, 17 bp, Homo sapiens
cagtgactcctgctggt

SEQ ID NO: 1511900 - DNA, 18 bp, Homo sapiens
cagtgactgaaaccattt

SEQ ID NO: 1511901 - DNA, 16 bp, Homo sapiens
cagtgacttctgagat

SEQ ID NO: 1511902 - DNA, 17 bp, Homo sapiens
cagtgacttctgagatc

SEQ ID NO: 1511903 - DNA, 17 bp, Homo sapiens
cagtgactttacaggag

SEQ ID NO: 1511904 - DNA, 20 bp, Homo sapiens
cagtgactttttctgagctt

SEQ ID NO: 1511905 - DNA, 14 bp, Homo sapiens
cagtgagatagaat

SEQ ID NO: 1511906 - DNA, 22 bp, Homo sapiens
cagtgagccagaaattgattaa

SEQ ID NO: 1511907 - DNA, 16 bp, Homo sapiens
cagtgagctctagcaa

SEQ ID NO: 1511908 - DNA, 15 bp, Homo sapiens
cagtgaggagggatg

SEQ ID NO: 1511909 - DNA, 16 bp, Homo sapiens
cagtgaggagggatgt

SEQ ID NO: 1511910 - DNA, 13 bp, Homo sapiens
cagtgaggagggt

SEQ ID NO: 1511911 - DNA, 14 bp, Homo sapiens
cagtgaggagggtg

SEQ ID NO: 1511912 - DNA, 15 bp, Homo sapiens
cagtgaggagggtgg

SEQ ID NO: 1511913 - DNA, 16 bp, Homo sapiens
cagtgagggtcttctt

SEQ ID NO: 1511914 - DNA, 20 bp, Homo sapiens
cagtgagtaatcaatacaga

SEQ ID NO: 1511915 - DNA, 18 bp, Homo sapiens
cagtgagtacctgcaaaa

SEQ ID NO: 1511916 - DNA, 15 bp, Homo sapiens
cagtgagtctcttca

SEQ ID NO: 1511917 - DNA, 18 bp, Homo sapiens
cagtgagtctcttcagaa

SEQ ID NO: 1511918 - DNA, 14 bp, Homo sapiens
cagtgagtggcccc

SEQ ID NO: 1511919 - DNA, 15 bp, Homo sapiens
cagtgagtggcccca

SEQ ID NO: 1511920 - DNA, 13 bp, Homo sapiens
cagtgatctccat

SEQ ID NO: 1511921 - DNA, 17 bp, Homo sapiens
cagtgatgacttgctgt

SEQ ID NO: 1511922 - DNA, 18 bp, Homo sapiens
cagtgatgacttgctgtc

SEQ ID NO: 1511923 - DNA, 19 bp, Homo sapiens
cagtgatgacttgctgtcc

SEQ ID NO: 1511924 - DNA, 15 bp, Homo sapiens
cagtgatgcctgccc

SEQ ID NO: 1511925 - DNA, 23 bp, Homo sapiens
cagtgatgtaccatgaaacaaag

SEQ ID NO: 1511926 - DNA, 15 bp, Homo sapiens
cagtgattcagcagg

SEQ ID NO: 1511927 - DNA, 17 bp, Homo sapiens
cagtgattcagcaggcc

SEQ ID NO: 1511928 - DNA, 22 bp, Homo sapiens
cagtgatttttttcttgtaatt

SEQ ID NO: 1511929 - DNA, 17 bp, Homo sapiens
cagtgcaaaccacttct

SEQ ID NO: 1511930 - DNA, 18 bp, Homo sapiens
cagtgcaaaccacttctc

SEQ ID NO: 1511931 - DNA, 18 bp, Homo sapiens
cagtgcaaatgcatgctt

SEQ ID NO: 1511932 - DNA, 19 bp, Homo sapiens
cagtgcaatgcttgtagaa

SEQ ID NO: 1511933 - DNA, 12 bp, Homo sapiens
cagtgcagaatg

SEQ ID NO: 1511934 - DNA, 15 bp, Homo sapiens
cagtgcagaatgtaa

SEQ ID NO: 1511935 - DNA, 22 bp, Homo sapiens
cagtgcagaatgtaagtgggcc

SEQ ID NO: 1511936 - DNA, 14 bp, Homo sapiens
cagtgcagacaggc

SEQ ID NO: 1511937 - DNA, 14 bp, Homo sapiens
cagtgcagcagagg

SEQ ID NO: 1511938 - DNA, 13 bp, Homo sapiens
cagtgcagccact

SEQ ID NO: 1511939 - DNA, 22 bp, Homo sapiens
cagtgcagtgatacatgtactc

SEQ ID NO: 1511940 - DNA, 18 bp, Homo sapiens
cagtgcagtttcttttca

SEQ ID NO: 1511941 - DNA, 21 bp, Homo sapiens
cagtgcatagttgtagacaaa

SEQ ID NO: 1511942 - DNA, 16 bp, Homo sapiens
cagtgcatctcagccc

SEQ ID NO: 1511943 - DNA, 18 bp, Homo sapiens
cagtgcatggggaggcac

SEQ ID NO: 1511944 - DNA, 21 bp, Homo sapiens
cagtgcatggtggccagaggt

SEQ ID NO: 1511945 - DNA, 19 bp, Homo sapiens
cagtgcattttgtttctgt

SEQ ID NO: 1511946 - DNA, 15 bp, Homo sapiens
cagtgccaagcacag

SEQ ID NO: 1511947 - DNA, 21 bp, Homo sapiens
cagtgccacccatgcagctgc

SEQ ID NO: 1511948 - DNA, 19 bp, Homo sapiens
cagtgccacttgacattcc

SEQ ID NO: 1511949 - DNA, 20 bp, Homo sapiens
cagtgccacttgacattcct

SEQ ID NO: 1511950 - DNA, 15 bp, Homo sapiens
cagtgccagctccct

SEQ ID NO: 1511951 - DNA, 13 bp, Homo sapiens
cagtgccatcccc

SEQ ID NO: 1511952 - DNA, 18 bp, Homo sapiens
cagtgccatccccacctt

SEQ ID NO: 1511953 - DNA, 20 bp, Homo sapiens
cagtgccatccccaccttca

SEQ ID NO: 1511954 - DNA, 21 bp, Homo sapiens
cagtgcccaccaacatcccat

SEQ ID NO: 1511955 - DNA, 12 bp, Homo sapiens
cagtgcccccac

SEQ ID NO: 1511956 - DNA, 21 bp, Homo sapiens
cagtgcccccactgaccagaa

SEQ ID NO: 1511957 - DNA, 19 bp, Homo sapiens
cagtgccctcattttatgt

SEQ ID NO: 1511958 - DNA, 14 bp, Homo sapiens
cagtgccctggggc

SEQ ID NO: 1511959 - DNA, 15 bp, Homo sapiens
cagtgccgaggacat

SEQ ID NO: 1511960 - DNA, 20 bp, Homo sapiens
cagtgcctcgaggcaccggc

SEQ ID NO: 1511961 - DNA, 14 bp, Homo sapiens
cagtgcctcttcca

SEQ ID NO: 1511962 - DNA, 15 bp, Homo sapiens
cagtgcctcttccag

SEQ ID NO: 1511963 - DNA, 20 bp, Homo sapiens
cagtgcctcttccagtgaac

SEQ ID NO: 1511964 - DNA, 12 bp, Homo sapiens
cagtgcctgcca

SEQ ID NO: 1511965 - DNA, 13 bp, Homo sapiens
cagtgcctgccac

SEQ ID NO: 1511966 - DNA, 16 bp, Homo sapiens
cagtgcctgccactct

SEQ ID NO: 1511967 - DNA, 12 bp, Homo sapiens
cagtgcctgcct

SEQ ID NO: 1511968 - DNA, 14 bp, Homo sapiens
cagtgcctgggaat

SEQ ID NO: 1511969 - DNA, 18 bp, Homo sapiens
cagtgccttacctcctgc

SEQ ID NO: 1511970 - DNA, 22 bp, Homo sapiens
cagtgccttcaacaacgtgaga

SEQ ID NO: 1511971 - DNA, 18 bp, Homo sapiens
cagtgccttcaataaatg

SEQ ID NO: 1511972 - DNA, 11 bp, Homo sapiens
cagtgccttct

SEQ ID NO: 1511973 - DNA, 13 bp, Homo sapiens
cagtgccttctct

SEQ ID NO: 1511974 - DNA, 22 bp, Homo sapiens
cagtgccttctctcagctccca

SEQ ID NO: 1511975 - DNA, 14 bp, Homo sapiens
cagtgccttgggga

SEQ ID NO: 1511976 - DNA, 24 bp, Homo sapiens
cagtgcgcgtgcacgtggagagct

SEQ ID NO: 1511977 - DNA, 14 bp, Homo sapiens
cagtgctacatttt

SEQ ID NO: 1511978 - DNA, 15 bp, Homo sapiens
cagtgctactgaaag

SEQ ID NO: 1511979 - DNA, 17 bp, Homo sapiens
cagtgctataaatgcca

SEQ ID NO: 1511980 - DNA, 20 bp, Homo sapiens
cagtgctataaatgccagag

SEQ ID NO: 1511981 - DNA, 20 bp, Homo sapiens
cagtgctcagctgtggctgg

SEQ ID NO: 1511982 - DNA, 23 bp, Homo sapiens
cagtgctcatacgtatctgctca

SEQ ID NO: 1511983 - DNA, 18 bp, Homo sapiens
cagtgctctaggctgccc

SEQ ID NO: 1511984 - DNA, 16 bp, Homo sapiens
cagtgctctcagctgg

SEQ ID NO: 1511985 - DNA, 19 bp, Homo sapiens
cagtgctctcagctggcag

SEQ ID NO: 1511986 - DNA, 23 bp, Homo sapiens
cagtgctcttttctcctcactgt

SEQ ID NO: 1511987 - DNA, 17 bp, Homo sapiens
cagtgctgccatgccac

SEQ ID NO: 1511988 - DNA, 21 bp, Homo sapiens
cagtgctgccatgccactgcc

SEQ ID NO: 1511989 - DNA, 22 bp, Homo sapiens
cagtgctgccatgccactgcca

SEQ ID NO: 1511990 - DNA, 13 bp, Homo sapiens
cagtgctgcccat

SEQ ID NO: 1511991 - DNA, 18 bp, Homo sapiens
cagtgctgcccatgagca

SEQ ID NO: 1511992 - DNA, 11 bp, Homo sapiens
cagtgctgctt

SEQ ID NO: 1511993 - DNA, 12 bp, Homo sapiens
cagtgctggaag

SEQ ID NO: 1511994 - DNA, 21 bp, Homo sapiens
cagtgctggatttgatgagtt

SEQ ID NO: 1511995 - DNA, 16 bp, Homo sapiens
cagtgctgggaccaga

SEQ ID NO: 1511996 - DNA, 17 bp, Homo sapiens
cagtgctgggaccagag

SEQ ID NO: 1511997 - DNA, 18 bp, Homo sapiens
cagtgctgggaccagagc

SEQ ID NO: 1511998 - DNA, 23 bp, Homo sapiens
cagtgctgggaccagagccagat

SEQ ID NO: 1511999 - DNA, 17 bp, Homo sapiens
cagtgctgtggcctggg

SEQ ID NO: 1512000 - DNA, 12 bp, Homo sapiens
cagtgctgtgtg

SEQ ID NO: 1512001 - DNA, 20 bp, Homo sapiens
cagtgcttcagcctgaggct

SEQ ID NO: 1512002 - DNA, 21 bp, Homo sapiens
cagtggaagtttttttttcct

SEQ ID NO: 1512003 - DNA, 13 bp, Homo sapiens
cagtggacaccag

SEQ ID NO: 1512004 - DNA, 22 bp, Homo sapiens
cagtggacaccaggagtccctg

SEQ ID NO: 1512005 - DNA, 22 bp, Homo sapiens
cagtggacatcgtaggcagcca

SEQ ID NO: 1512006 - DNA, 20 bp, Homo sapiens
cagtggactcagcagtgacc

SEQ ID NO: 1512007 - DNA, 15 bp, Homo sapiens
cagtggagagatgtt

SEQ ID NO: 1512008 - DNA, 23 bp, Homo sapiens
cagtggagcctgccgcccccgcc

SEQ ID NO: 1512009 - DNA, 16 bp, Homo sapiens
cagtggagcctgggtg

SEQ ID NO: 1512010 - DNA, 15 bp, Homo sapiens
cagtggaggaagagg

SEQ ID NO: 1512011 - DNA, 17 bp, Homo sapiens
cagtggaggctgctgtg

SEQ ID NO: 1512012 - DNA, 17 bp, Homo sapiens
cagtggatatgacccac

SEQ ID NO: 1512013 - DNA, 13 bp, Homo sapiens
cagtggatttgga

SEQ ID NO: 1512014 - DNA, 23 bp, Homo sapiens
cagtggcacaaaaaaatatcaga

SEQ ID NO: 1512015 - DNA, 18 bp, Homo sapiens
cagtggcacggagagaag

SEQ ID NO: 1512016 - DNA, 18 bp, Homo sapiens
cagtggcagacaaacaga

SEQ ID NO: 1512017 - DNA, 15 bp, Homo sapiens
cagtggcaggggagc

SEQ ID NO: 1512018 - DNA, 16 bp, Homo sapiens
cagtggcaggggagca

SEQ ID NO: 1512019 - DNA, 17 bp, Homo sapiens
cagtggcaggggagcag

SEQ ID NO: 1512020 - DNA, 18 bp, Homo sapiens
cagtggcaggggagcagg

SEQ ID NO: 1512021 - DNA, 13 bp, Homo sapiens
cagtggccaggca

SEQ ID NO: 1512022 - DNA, 13 bp, Homo sapiens
cagtggcctggcc

SEQ ID NO: 1512023 - DNA, 21 bp, Homo sapiens
cagtggcgcaatctcggctca

SEQ ID NO: 1512024 - DNA, 14 bp, Homo sapiens
cagtggcgcatgcc

SEQ ID NO: 1512025 - DNA, 21 bp, Homo sapiens
cagtggctagtggggtgaaca

SEQ ID NO: 1512026 - DNA, 18 bp, Homo sapiens
cagtggctcgctccctgt

SEQ ID NO: 1512027 - DNA, 20 bp, Homo sapiens
cagtggctcgctccctgtag

SEQ ID NO: 1512028 - DNA, 22 bp, Homo sapiens
cagtggctggaagaaccactgt

SEQ ID NO: 1512029 - DNA, 16 bp, Homo sapiens
cagtggctggatctgt

SEQ ID NO: 1512030 - DNA, 18 bp, Homo sapiens
cagtggctggatctgtga

SEQ ID NO: 1512031 - DNA, 19 bp, Homo sapiens
cagtggctgggggtgctag

SEQ ID NO: 1512032 - DNA, 18 bp, Homo sapiens
cagtggctggtccagggc

SEQ ID NO: 1512033 - DNA, 15 bp, Homo sapiens
cagtggctggtctca

SEQ ID NO: 1512034 - DNA, 12 bp, Homo sapiens
cagtggcttttc

SEQ ID NO: 1512035 - DNA, 14 bp, Homo sapiens
cagtggcttttcat

SEQ ID NO: 1512036 - DNA, 19 bp, Homo sapiens
cagtgggaacgtgactgcc

SEQ ID NO: 1512037 - DNA, 22 bp, Homo sapiens
cagtgggaacgtgactgcccca

SEQ ID NO: 1512038 - DNA, 17 bp, Homo sapiens
cagtgggaactctgaca

SEQ ID NO: 1512039 - DNA, 13 bp, Homo sapiens
cagtgggagaaaa

SEQ ID NO: 1512040 - DNA, 13 bp, Homo sapiens
cagtgggagccag

SEQ ID NO: 1512041 - DNA, 13 bp, Homo sapiens
cagtgggagctga

SEQ ID NO: 1512042 - DNA, 14 bp, Homo sapiens
cagtgggaggggca

SEQ ID NO: 1512043 - DNA, 16 bp, Homo sapiens
cagtgggaggggcagg

SEQ ID NO: 1512044 - DNA, 18 bp, Homo sapiens
cagtgggaggggcaggct

SEQ ID NO: 1512045 - DNA, 20 bp, Homo sapiens
cagtgggaggggcaggctga

SEQ ID NO: 1512046 - DNA, 18 bp, Homo sapiens
cagtgggcaggaggcccc

SEQ ID NO: 1512047 - DNA, 17 bp, Homo sapiens
cagtgggcctgtgtgtg

SEQ ID NO: 1512048 - DNA, 18 bp, Homo sapiens
cagtgggcctgtgtgtgt

SEQ ID NO: 1512049 - DNA, 14 bp, Homo sapiens
cagtggggcagcct

SEQ ID NO: 1512050 - DNA, 20 bp, Homo sapiens
cagtggggtcccccctgagt

SEQ ID NO: 1512051 - DNA, 22 bp, Homo sapiens
cagtggggtcccccctgagtgg

SEQ ID NO: 1512052 - DNA, 15 bp, Homo sapiens
cagtgggtggcacct

SEQ ID NO: 1512053 - DNA, 16 bp, Homo sapiens
cagtgggtggcacctc

SEQ ID NO: 1512054 - DNA, 14 bp, Homo sapiens
cagtggtgccatca

SEQ ID NO: 1512055 - DNA, 17 bp, Homo sapiens
cagtggtgctcaatgca

SEQ ID NO: 1512056 - DNA, 22 bp, Homo sapiens
cagtggtggcaacattcattgc

SEQ ID NO: 1512057 - DNA, 12 bp, Homo sapiens
cagtggtgggta

SEQ ID NO: 1512058 - DNA, 17 bp, Homo sapiens
cagtggttgcctggggg

SEQ ID NO: 1512059 - DNA, 22 bp, Homo sapiens
cagtggtttgagacactggttt

SEQ ID NO: 1512060 - DNA, 17 bp, Homo sapiens
cagtgtacaaaactgta

SEQ ID NO: 1512061 - DNA, 20 bp, Homo sapiens
cagtgtacaaaactgtaaat

SEQ ID NO: 1512062 - DNA, 19 bp, Homo sapiens
cagtgtacacgtctggacc

SEQ ID NO: 1512063 - DNA, 20 bp, Homo sapiens
cagtttaagagcagaacaga

SEQ ID NO: 1512064 - DNA, 18 bp, Homo sapiens
cagtttaccagttgcctt

SEQ ID NO: 1512065 - DNA, 23 bp, Homo sapiens
cagtttaccagttgccttttatc

SEQ ID NO: 1512066 - DNA, 13 bp, Homo sapiens
cagtttagtgctt

SEQ ID NO: 1512067 - DNA, 20 bp, Homo sapiens
cagtttatatactgctattt

SEQ ID NO: 1512068 - DNA, 14 bp, Homo sapiens
cagtttatatggaa

SEQ ID NO: 1512069 - DNA, 21 bp, Homo sapiens
cagtttatggatatgctgctt

SEQ ID NO: 1512070 - DNA, 20 bp, Homo sapiens
cagtttatttccactatttt

SEQ ID NO: 1512071 - DNA, 21 bp, Homo sapiens
cagtttatttccactattttc

SEQ ID NO: 1512072 - DNA, 17 bp, Homo sapiens
cagtttctccatcagct

SEQ ID NO: 1512073 - DNA, 11 bp, Homo sapiens
cagtttctcct

SEQ ID NO: 1512074 - DNA, 20 bp, Homo sapiens
cagtttgattgaggagctgc

SEQ ID NO: 1512075 - DNA, 11 bp, Homo sapiens
cagtttgcaaa

SEQ ID NO: 1512076 - DNA, 18 bp, Homo sapiens
cagtttgcacctgtcccc

SEQ ID NO: 1512077 - DNA, 22 bp, Homo sapiens
cagtttgcagaaaagcacctgc

SEQ ID NO: 1512078 - DNA, 21 bp, Homo sapiens
cagtttgctttgtatgcactt

SEQ ID NO: 1512079 - DNA, 17 bp, Homo sapiens
cagtttggccctggagc

SEQ ID NO: 1512080 - DNA, 19 bp, Homo sapiens
cagtttggggactcaggac

SEQ ID NO: 1512081 - DNA, 20 bp, Homo sapiens
cagtttggggactcaggacc

SEQ ID NO: 1512082 - DNA, 12 bp, Homo sapiens
cagtttggtttt

SEQ ID NO: 1512083 - DNA, 13 bp, Homo sapiens
cagtttgtaaagt

SEQ ID NO: 1512084 - DNA, 18 bp, Homo sapiens
cagtttgtagtgccactg

SEQ ID NO: 1512085 - DNA, 13 bp, Homo sapiens
cagtttgtcagac

SEQ ID NO: 1512086 - DNA, 23 bp, Homo sapiens
cagtttgtgtgtcttaattatta

SEQ ID NO: 1512087 - DNA, 15 bp, Homo sapiens
cagttttaactgtgg

SEQ ID NO: 1512088 - DNA, 20 bp, Homo sapiens
cagttttaactgtggatatt

SEQ ID NO: 1512089 - DNA, 15 bp, Homo sapiens
cagttttatcatttt

SEQ ID NO: 1512090 - DNA, 13 bp, Homo sapiens
cagttttcccctg

SEQ ID NO: 1512091 - DNA, 14 bp, Homo sapiens
cagttttcccctgg

SEQ ID NO: 1512092 - DNA, 20 bp, Homo sapiens
cagttttcccctggcctcag

SEQ ID NO: 1512093 - DNA, 13 bp, Homo sapiens
cagttttccctgg

SEQ ID NO: 1512094 - DNA, 22 bp, Homo sapiens
cagttttccttctcatctgtga

SEQ ID NO: 1512095 - DNA, 16 bp, Homo sapiens
cagttttgaaagaaaa

SEQ ID NO: 1512096 - DNA, 16 bp, Homo sapiens
cagttttgtaaatgta

SEQ ID NO: 1512097 - DNA, 22 bp, Homo sapiens
cagtttttaaaaacctgtatct

SEQ ID NO: 1512098 - DNA, 15 bp, Homo sapiens
cagtttttcaggagc

SEQ ID NO: 1512099 - DNA, 19 bp, Homo sapiens
cagtttttcatttgttttg

SEQ ID NO: 1512100 - DNA, 20 bp, Homo sapiens
cataaaaacaactttatacc

SEQ ID NO: 1512101 - DNA, 19 bp, Homo sapiens
cataaaaagcagaatttta

SEQ ID NO: 1512102 - DNA, 22 bp, Homo sapiens
cataaaaagcagaattttaatg

SEQ ID NO: 1512103 - DNA, 16 bp, Homo sapiens
cataaaaataaccaaa

SEQ ID NO: 1512104 - DNA, 15 bp, Homo sapiens
cataaaacaaaacca

SEQ ID NO: 1512105 - DNA, 22 bp, Homo sapiens
cataaaacaaaaccaagccttg

SEQ ID NO: 1512106 - DNA, 15 bp, Homo sapiens
cataaaagccccagc

SEQ ID NO: 1512107 - DNA, 14 bp, Homo sapiens
cataaaatctgtga

SEQ ID NO: 1512108 - DNA, 17 bp, Homo sapiens
cataaaatctgtgaatt

SEQ ID NO: 1512109 - DNA, 22 bp, Homo sapiens
cataaaattttctactcttttt

SEQ ID NO: 1512110 - DNA, 11 bp, Homo sapiens
cataaacagca

SEQ ID NO: 1512111 - DNA, 13 bp, Homo sapiens
cataaacagcaca

SEQ ID NO: 1512112 - DNA, 20 bp, Homo sapiens
cataaaccttaagtaagcaa

SEQ ID NO: 1512113 - DNA, 18 bp, Homo sapiens
cataaactaagagaaact

SEQ ID NO: 1512114 - DNA, 14 bp, Homo sapiens
cataaacttttgca

SEQ ID NO: 1512115 - DNA, 20 bp, Homo sapiens
cataaagacaatcactgcca

SEQ ID NO: 1512116 - DNA, 21 bp, Homo sapiens
cataaagctcaaatgaaatgt

SEQ ID NO: 1512117 - DNA, 15 bp, Homo sapiens
cataaatactgtcaa

SEQ ID NO: 1512118 - DNA, 21 bp, Homo sapiens
cataaatctgtctgattctat

SEQ ID NO: 1512119 - DNA, 14 bp, Homo sapiens
cataaatgaagcag

SEQ ID NO: 1512120 - DNA, 19 bp, Homo sapiens
cataaatgcataatttatg

SEQ ID NO: 1512121 - DNA, 14 bp, Homo sapiens
cataaatgtgttcc

SEQ ID NO: 1512122 - DNA, 16 bp, Homo sapiens
cataaatgtgttcctg

SEQ ID NO: 1512123 - DNA, 15 bp, Homo sapiens
cataacaacttcata

SEQ ID NO: 1512124 - DNA, 18 bp, Homo sapiens
cataacagccaagaagcc

SEQ ID NO: 1512125 - DNA, 22 bp, Homo sapiens
cataaccatgtgaaaaggcaaa

SEQ ID NO: 1512126 - DNA, 12 bp, Homo sapiens
cataacctgtct

SEQ ID NO: 1512127 - DNA, 20 bp, Homo sapiens
cataactatctttttgaaag

SEQ ID NO: 1512128 - DNA, 16 bp, Homo sapiens
cataactcctgtccct

SEQ ID NO: 1512129 - DNA, 17 bp, Homo sapiens
cataactcctgtccctt

SEQ ID NO: 1512130 - DNA, 22 bp, Homo sapiens
cataactcctgtcccttttccc

SEQ ID NO: 1512131 - DNA, 16 bp, Homo sapiens
cataactgcttcttgg

SEQ ID NO: 1512132 - DNA, 18 bp, Homo sapiens
cataactgcttcttggag

SEQ ID NO: 1512133 - DNA, 15 bp, Homo sapiens
cataactgtgattct

SEQ ID NO: 1512134 - DNA, 15 bp, Homo sapiens
cataacttgctgaat

SEQ ID NO: 1512135 - DNA, 19 bp, Homo sapiens
cataacttgctgaatttca

SEQ ID NO: 1512136 - DNA, 19 bp, Homo sapiens
cataagaaaactaagaaat

SEQ ID NO: 1512137 - DNA, 15 bp, Homo sapiens
cataagacaaacact

SEQ ID NO: 1512138 - DNA, 19 bp, Homo sapiens
cataagacaaacactgcca

SEQ ID NO: 1512139 - DNA, 21 bp, Homo sapiens
cataagaccgtgtcccaagga

SEQ ID NO: 1512140 - DNA, 14 bp, Homo sapiens
cataagataaatgt

SEQ ID NO: 1512141 - DNA, 12 bp, Homo sapiens
cataagattaaa

SEQ ID NO: 1512142 - DNA, 19 bp, Homo sapiens
cataagcttccattttaat

SEQ ID NO: 1512143 - DNA, 17 bp, Homo sapiens
cataaggccagaaactc

SEQ ID NO: 1512144 - DNA, 21 bp, Homo sapiens
cataaggccagaaactccttt

SEQ ID NO: 1512145 - DNA, 22 bp, Homo sapiens
cataaggtttcgtttctgtata

SEQ ID NO: 1512146 - DNA, 22 bp, Homo sapiens
cataagtatttggaattagaac

SEQ ID NO: 1512147 - DNA, 22 bp, Homo sapiens
cataagtgacaccaataaatgt

SEQ ID NO: 1512148 - DNA, 18 bp, Homo sapiens
cataataaatatctgtac

SEQ ID NO: 1512149 - DNA, 21 bp, Homo sapiens
cataataagagaatgttccta

SEQ ID NO: 1512150 - DNA, 18 bp, Homo sapiens
cataatagttagccctca

SEQ ID NO: 1512151 - DNA, 14 bp, Homo sapiens
cataatcagaacac

SEQ ID NO: 1512152 - DNA, 19 bp, Homo sapiens
cataatcagtaaatagtgt

SEQ ID NO: 1512153 - DNA, 22 bp, Homo sapiens
cataatctagtttacagaaaaa

SEQ ID NO: 1512154 - DNA, 21 bp, Homo sapiens
cataatcttctgccttctcat

SEQ ID NO: 1512155 - DNA, 18 bp, Homo sapiens
cataatgaattataacag

SEQ ID NO: 1512156 - DNA, 20 bp, Homo sapiens
cataatgcagaagtattctt

SEQ ID NO: 1512157 - DNA, 20 bp, Homo sapiens
cataatgctaatttaaagag

SEQ ID NO: 1512158 - DNA, 21 bp, Homo sapiens
cataatgctaatttaaagaga

SEQ ID NO: 1512159 - DNA, 14 bp, Homo sapiens
cataatgctactgt

SEQ ID NO: 1512160 - DNA, 15 bp, Homo sapiens
cataatgctactgtc

SEQ ID NO: 1512161 - DNA, 22 bp, Homo sapiens
cataatgctcccatctcctgat

SEQ ID NO: 1512162 - DNA, 12 bp, Homo sapiens
cataatgctttg

SEQ ID NO: 1512163 - DNA, 14 bp, Homo sapiens
cataatgctttgtt

SEQ ID NO: 1512164 - DNA, 15 bp, Homo sapiens
cataatgtccctctc

SEQ ID NO: 1512165 - DNA, 17 bp, Homo sapiens
cataattaaattttaat

SEQ ID NO: 1512166 - DNA, 16 bp, Homo sapiens
cataattacattccta

SEQ ID NO: 1512167 - DNA, 18 bp, Homo sapiens
cataattacattcctaac

SEQ ID NO: 1512168 - DNA, 14 bp, Homo sapiens
cataattatgacag

SEQ ID NO: 1512169 - DNA, 19 bp, Homo sapiens
cataattatgacagttata

SEQ ID NO: 1512170 - DNA, 18 bp, Homo sapiens
cataattcagcacttaac

SEQ ID NO: 1512171 - DNA, 19 bp, Homo sapiens
cataattgctttgccaaaa

SEQ ID NO: 1512172 - DNA, 21 bp, Homo sapiens
cataattgtgaccaatacatt

SEQ ID NO: 1512173 - DNA, 22 bp, Homo sapiens
cataattgtgaccaatacattt

SEQ ID NO: 1512174 - DNA, 22 bp, Homo sapiens
cataatttaaaaatctccatta

SEQ ID NO: 1512175 - DNA, 13 bp, Homo sapiens
cataatttataca

SEQ ID NO: 1512176 - DNA, 20 bp, Homo sapiens
cataatttatacaggtcata

SEQ ID NO: 1512177 - DNA, 19 bp, Homo sapiens
catacaaaaattagccggg

SEQ ID NO: 1512178 - DNA, 17 bp, Homo sapiens
catacaacacaaagaga

SEQ ID NO: 1512179 - DNA, 14 bp, Homo sapiens
catcctccaagaat

SEQ ID NO: 1512180 - DNA, 17 bp, Homo sapiens
catcctccagatagtgt

SEQ ID NO: 1512181 - DNA, 22 bp, Homo sapiens
catcctccccagcgccatctgt

SEQ ID NO: 1512182 - DNA, 16 bp, Homo sapiens
catcctccgtccagcc

SEQ ID NO: 1512183 - DNA, 22 bp, Homo sapiens
catcctgagagacctgccctct

SEQ ID NO: 1512184 - DNA, 16 bp, Homo sapiens
catcctgagccaggga

SEQ ID NO: 1512185 - DNA, 19 bp, Homo sapiens
catcctgagccagggaaca

SEQ ID NO: 1512186 - DNA, 23 bp, Homo sapiens
catcctgagccagggaacagccc

SEQ ID NO: 1512187 - DNA, 19 bp, Homo sapiens
catcctgattattgaatgt

SEQ ID NO: 1512188 - DNA, 20 bp, Homo sapiens
catcctgattattgaatgtt

SEQ ID NO: 1512189 - DNA, 21 bp, Homo sapiens
catcctgcagggcttctcctc

SEQ ID NO: 1512190 - DNA, 12 bp, Homo sapiens
catcctgctctt

SEQ ID NO: 1512191 - DNA, 21 bp, Homo sapiens
catcctgctcttttgtgatga

SEQ ID NO: 1512192 - DNA, 10 bp, Homo sapiens
catcctggat

SEQ ID NO: 1512193 - DNA, 17 bp, Homo sapiens
catcctggcacgcccta

SEQ ID NO: 1512194 - DNA, 21 bp, Homo sapiens
catcctggcacgccctactcc

SEQ ID NO: 1512195 - DNA, 12 bp, Homo sapiens
catcctggcagg

SEQ ID NO: 1512196 - DNA, 13 bp, Homo sapiens
catcctggccaac

SEQ ID NO: 1512197 - DNA, 14 bp, Homo sapiens
catcctggcccctc

SEQ ID NO: 1512198 - DNA, 17 bp, Homo sapiens
catcctggcccctccag

SEQ ID NO: 1512199 - DNA, 21 bp, Homo sapiens
catcctggcctggcacatcag

SEQ ID NO: 1512200 - DNA, 23 bp, Homo sapiens
catcctggcctggcacatcagaa

SEQ ID NO: 1512201 - DNA, 16 bp, Homo sapiens
catcctgggatgtaaa

SEQ ID NO: 1512202 - DNA, 23 bp, Homo sapiens
catcctgtgccactaaactacat

SEQ ID NO: 1512203 - DNA, 22 bp, Homo sapiens
catcctgtgtttctagggaaat

SEQ ID NO: 1512204 - DNA, 12 bp, Homo sapiens
catcctgtttga

SEQ ID NO: 1512205 - DNA, 14 bp, Homo sapiens
catcctgtttgaaa

SEQ ID NO: 1512206 - DNA, 23 bp, Homo sapiens
catcctgtttgtatgaaattata

SEQ ID NO: 1512207 - DNA, 21 bp, Homo sapiens
catccttcaagaactctgggc

SEQ ID NO: 1512208 - DNA, 23 bp, Homo sapiens
catccttcaagaactctgggctg

SEQ ID NO: 1512209 - DNA, 13 bp, Homo sapiens
catccttcaccag

SEQ ID NO: 1512210 - DNA, 21 bp, Homo sapiens
catccttcaccagagcccatg

SEQ ID NO: 1512211 - DNA, 16 bp, Homo sapiens
catccttccaacatat

SEQ ID NO: 1512212 - DNA, 14 bp, Homo sapiens
catccttccatcca

SEQ ID NO: 1512213 - DNA, 16 bp, Homo sapiens
catccttccatccatc

SEQ ID NO: 1512214 - DNA, 15 bp, Homo sapiens
catccttcctgggga

SEQ ID NO: 1512215 - DNA, 16 bp, Homo sapiens
catccttccttcccac

SEQ ID NO: 1512216 - DNA, 19 bp, Homo sapiens
catccttggactgagaaat

SEQ ID NO: 1512217 - DNA, 13 bp, Homo sapiens
catccttgtaata

SEQ ID NO: 1512218 - DNA, 13 bp, Homo sapiens
catcgaatgtgta

SEQ ID NO: 1512219 - DNA, 17 bp, Homo sapiens
catcgacttagcctgag

SEQ ID NO: 1512220 - DNA, 13 bp, Homo sapiens
catcgcactgtgg

SEQ ID NO: 1512221 - DNA, 14 bp, Homo sapiens
catcgcactgtgga

SEQ ID NO: 1512222 - DNA, 17 bp, Homo sapiens
catcgcatcctcttcca

SEQ ID NO: 1512223 - DNA, 20 bp, Homo sapiens
catcgccagaggtgcttcac

SEQ ID NO: 1512224 - DNA, 17 bp, Homo sapiens
catcgccatcttcttcc

SEQ ID NO: 1512225 - DNA, 20 bp, Homo sapiens
catcgccatcttcttccctt

SEQ ID NO: 1512226 - DNA, 12 bp, Homo sapiens
catcatttctgg

SEQ ID NO: 1512227 - DNA, 20 bp, Homo sapiens
catcattttccatatcctgg

SEQ ID NO: 1512228 - DNA, 17 bp, Homo sapiens
catcatttttgtatcta

SEQ ID NO: 1512229 - DNA, 14 bp, Homo sapiens
catccaaagttgcc

SEQ ID NO: 1512230 - DNA, 12 bp, Homo sapiens
catccaaatcta

SEQ ID NO: 1512231 - DNA, 19 bp, Homo sapiens
catccaaccccccacctgc

SEQ ID NO: 1512232 - DNA, 14 bp, Homo sapiens
catccaactccagc

SEQ ID NO: 1512233 - DNA, 16 bp, Homo sapiens
catccaactccagcaa

SEQ ID NO: 1512234 - DNA, 15 bp, Homo sapiens
catccaactccagga

SEQ ID NO: 1512235 - DNA, 14 bp, Homo sapiens
catccaaggagaaa

SEQ ID NO: 1512236 - DNA, 22 bp, Homo sapiens
catccaaggagaaacagagaca

SEQ ID NO: 1512237 - DNA, 18 bp, Homo sapiens
catccaatcctcactggg

SEQ ID NO: 1512238 - DNA, 16 bp, Homo sapiens
catccaatgtgaagtt

SEQ ID NO: 1512239 - DNA, 18 bp, Homo sapiens
catccacattgttttaaa

SEQ ID NO: 1512240 - DNA, 21 bp, Homo sapiens
catccacattgttttaaaaag

SEQ ID NO: 1512241 - DNA, 14 bp, Homo sapiens
catccaccaatctc

SEQ ID NO: 1512242 - DNA, 15 bp, Homo sapiens
catccacccagtgct

SEQ ID NO: 1512243 - DNA, 21 bp, Homo sapiens
catccacccagtgctgccatg

SEQ ID NO: 1512244 - DNA, 22 bp, Homo sapiens
catccacccagtgctgccatgc

SEQ ID NO: 1512245 - DNA, 23 bp, Homo sapiens
catccacccagtgctgccatgcc

SEQ ID NO: 1512246 - DNA, 21 bp, Homo sapiens
catccacccgggggagcccag

SEQ ID NO: 1512247 - DNA, 22 bp, Homo sapiens
catccacccgggggagcccagt

SEQ ID NO: 1512248 - DNA, 17 bp, Homo sapiens
catccacctcatcactg

SEQ ID NO: 1512249 - DNA, 14 bp, Homo sapiens
catccaccttccct

SEQ ID NO: 1512250 - DNA, 16 bp, Homo sapiens
catccaccttcccttc

SEQ ID NO: 1512251 - DNA, 15 bp, Homo sapiens
catccactctaccct

SEQ ID NO: 1512252 - DNA, 21 bp, Homo sapiens
catccagactcagagctctct

SEQ ID NO: 1512253 - DNA, 12 bp, Homo sapiens
catccagcaaga

SEQ ID NO: 1512254 - DNA, 16 bp, Homo sapiens
catccagccagacccc

SEQ ID NO: 1512255 - DNA, 11 bp, Homo sapiens
catccagcctc

SEQ ID NO: 1512256 - DNA, 13 bp, Homo sapiens
catccagcctcca

SEQ ID NO: 1512257 - DNA, 19 bp, Homo sapiens
catccagcctccagggcat

SEQ ID NO: 1512258 - DNA, 16 bp, Homo sapiens
catccagcctgtgtgt

SEQ ID NO: 1512259 - DNA, 20 bp, Homo sapiens
catccagcgagagagtttca

SEQ ID NO: 1512260 - DNA, 15 bp, Homo sapiens
catccagctcactca

SEQ ID NO: 1512261 - DNA, 16 bp, Homo sapiens
catccaggccagggct

SEQ ID NO: 1512262 - DNA, 17 bp, Homo sapiens
catccaggccagggctc

SEQ ID NO: 1512263 - DNA, 20 bp, Homo sapiens
catccaggccagggctcctg

SEQ ID NO: 1512264 - DNA, 15 bp, Homo sapiens
catgaaacagaaaca

SEQ ID NO: 1512265 - DNA, 19 bp, Homo sapiens
catgaaacagaaacaaaaa

SEQ ID NO: 1512266 - DNA, 22 bp, Homo sapiens
catgaaaccttattttttccca

SEQ ID NO: 1512267 - DNA, 16 bp, Homo sapiens
catgaaactgcctatt

SEQ ID NO: 1512268 - DNA, 16 bp, Homo sapiens
catgaaagttttgcaa

SEQ ID NO: 1512269 - DNA, 13 bp, Homo sapiens
catgaaatatgca

SEQ ID NO: 1512270 - DNA, 18 bp, Homo sapiens
catgaaatgaatgtctga

SEQ ID NO: 1512271 - DNA, 17 bp, Homo sapiens
catgaaatgtggaagtc

SEQ ID NO: 1512272 - DNA, 14 bp, Homo sapiens
catgaaattactta

SEQ ID NO: 1512273 - DNA, 18 bp, Homo sapiens
catgaaattgtatctcag

SEQ ID NO: 1512274 - DNA, 16 bp, Homo sapiens
catgaacacactgtgt

SEQ ID NO: 1512275 - DNA, 18 bp, Homo sapiens
catgaacacactgtgtcc

SEQ ID NO: 1512276 - DNA, 13 bp, Homo sapiens
catgaactggctt

SEQ ID NO: 1512277 - DNA, 12 bp, Homo sapiens
catgaagaatgt

SEQ ID NO: 1512278 - DNA, 17 bp, Homo sapiens
catgaagaatgtttctg

SEQ ID NO: 1512279 - DNA, 14 bp, Homo sapiens
catgaagacaggac

SEQ ID NO: 1512280 - DNA, 17 bp, Homo sapiens
catgaagacaggacagt

SEQ ID NO: 1512281 - DNA, 19 bp, Homo sapiens
catgaagcaggaggccctt

SEQ ID NO: 1512282 - DNA, 23 bp, Homo sapiens
catgaagcaggaggcccttgtcg

SEQ ID NO: 1512283 - DNA, 22 bp, Homo sapiens
catgaagcccaagtgaaatcaa

SEQ ID NO: 1512284 - DNA, 12 bp, Homo sapiens
catgaaggaaag

SEQ ID NO: 1512285 - DNA, 17 bp, Homo sapiens
catgaaggtaaataaaa

SEQ ID NO: 1512286 - DNA, 16 bp, Homo sapiens
catgaagtgcacagga

SEQ ID NO: 1512287 - DNA, 19 bp, Homo sapiens
catgaataaagcctttgta

SEQ ID NO: 1512288 - DNA, 22 bp, Homo sapiens
catgaataaagcctttgtatct

SEQ ID NO: 1512289 - DNA, 23 bp, Homo sapiens
catgaataaagcctttgtatctt

SEQ ID NO: 1512290 - DNA, 14 bp, Homo sapiens
catgaatatttatt

SEQ ID NO: 1512291 - DNA, 17 bp, Homo sapiens
catgaatctttgtttca

SEQ ID NO: 1512292 - DNA, 17 bp, Homo sapiens
catgaatgtaaatttgt

SEQ ID NO: 1512293 - DNA, 19 bp, Homo sapiens
catgaatgtaaatttgtac

SEQ ID NO: 1512294 - DNA, 13 bp, Homo sapiens
catgaatgtatca

SEQ ID NO: 1512295 - DNA, 13 bp, Homo sapiens
catgacaactttt

SEQ ID NO: 1512296 - DNA, 16 bp, Homo sapiens
catgacagaaaatatg

SEQ ID NO: 1512297 - DNA, 21 bp, Homo sapiens
catgacagaaaatatgtatta

SEQ ID NO: 1512298 - DNA, 15 bp, Homo sapiens
catgacagccagagc

SEQ ID NO: 1512299 - DNA, 14 bp, Homo sapiens
catgacagcctcca

SEQ ID NO: 1512300 - DNA, 18 bp, Homo sapiens
catgacagcctgcagcag

SEQ ID NO: 1512301 - DNA, 20 bp, Homo sapiens
catgacagcctgcagcagga

SEQ ID NO: 1512302 - DNA, 14 bp, Homo sapiens
catgacaggctgtt

SEQ ID NO: 1512303 - DNA, 13 bp, Homo sapiens
catgacatttctt

SEQ ID NO: 1512304 - DNA, 18 bp, Homo sapiens
catgaccactcttggcta

SEQ ID NO: 1512305 - DNA, 12 bp, Homo sapiens
catgaccagcaa

SEQ ID NO: 1512306 - DNA, 13 bp, Homo sapiens
catgacccacccc

SEQ ID NO: 1512307 - DNA, 18 bp, Homo sapiens
catgacccacccctgtgc

SEQ ID NO: 1512308 - DNA, 16 bp, Homo sapiens
catgacccagcctgaa

SEQ ID NO: 1512309 - DNA, 13 bp, Homo sapiens
catgacctccatt

SEQ ID NO: 1512310 - DNA, 17 bp, Homo sapiens
catgacctgtgaccagc

SEQ ID NO: 1512311 - DNA, 14 bp, Homo sapiens
catgactaatgctt

SEQ ID NO: 1512312 - DNA, 22 bp, Homo sapiens
catgactggctgtctgcctgta

SEQ ID NO: 1512313 - DNA, 23 bp, Homo sapiens
catgacttttccattgaccagct

SEQ ID NO: 1512314 - DNA, 13 bp, Homo sapiens
catgagaaagaat

SEQ ID NO: 1512315 - DNA, 11 bp, Homo sapiens
catgagaagcc

SEQ ID NO: 1512316 - DNA, 21 bp, Homo sapiens
catgagaagccaagcgctcat

SEQ ID NO: 1512317 - DNA, 19 bp, Homo sapiens
catgagaatctatatttaa

SEQ ID NO: 1512318 - DNA, 20 bp, Homo sapiens
catgagaatttgcaacaggg

SEQ ID NO: 1512319 - DNA, 15 bp, Homo sapiens
catgagactcagtgc

SEQ ID NO: 1512320 - DNA, 14 bp, Homo sapiens
catgagactttctg

SEQ ID NO: 1512321 - DNA, 23 bp, Homo sapiens
catgagagaattgtatcatttga

SEQ ID NO: 1512322 - DNA, 18 bp, Homo sapiens
catgagatggagaggctg

SEQ ID NO: 1512323 - DNA, 15 bp, Homo sapiens
catgagatgtgtgga

SEQ ID NO: 1512324 - DNA, 18 bp, Homo sapiens
catgagcctgctggaagc

SEQ ID NO: 1512325 - DNA, 19 bp, Homo sapiens
catgagcctgctggaagcc

SEQ ID NO: 1512326 - DNA, 20 bp, Homo sapiens
catgagcctgctggaagccc

SEQ ID NO: 1512327 - DNA, 23 bp, Homo sapiens
catgagcctgctggaagcccagc

SEQ ID NO: 1512328 - DNA, 16 bp, Homo sapiens
catgagctccctcgct

SEQ ID NO: 1512329 - DNA, 19 bp, Homo sapiens
catgagctgctcattacag

SEQ ID NO: 1512330 - DNA, 14 bp, Homo sapiens
catgagctgggtac

SEQ ID NO: 1512331 - DNA, 17 bp, Homo sapiens
catgagctgggtactga

SEQ ID NO: 1512332 - DNA, 22 bp, Homo sapiens
catgaggaactgtagatgatgt

SEQ ID NO: 1512333 - DNA, 14 bp, Homo sapiens
catgaggacagaag

SEQ ID NO: 1512334 - DNA, 22 bp, Homo sapiens
catgaggacatgatggagcgca

SEQ ID NO: 1512335 - DNA, 17 bp, Homo sapiens
catgaggagcgtggact

SEQ ID NO: 1512336 - DNA, 15 bp, Homo sapiens
catgaggagttgctg

SEQ ID NO: 1512337 - DNA, 22 bp, Homo sapiens
catgaggcaatgtcaggaacag

SEQ ID NO: 1512338 - DNA, 14 bp, Homo sapiens
catgaggccatctc

SEQ ID NO: 1512339 - DNA, 19 bp, Homo sapiens
catgaggccatctcaggag

SEQ ID NO: 1512340 - DNA, 19 bp, Homo sapiens
catgagggatcacagggcc

SEQ ID NO: 1512341 - DNA, 14 bp, Homo sapiens
catgaggggagagg

SEQ ID NO: 1512342 - DNA, 22 bp, Homo sapiens
catgaggtactggtcccttcct

SEQ ID NO: 1512343 - DNA, 20 bp, Homo sapiens
catgagtccttgaaaatatt

SEQ ID NO: 1512344 - DNA, 19 bp, Homo sapiens
catgagttggctgggaata

SEQ ID NO: 1512345 - DNA, 19 bp, Homo sapiens
catgataccacctttactg

SEQ ID NO: 1512346 - DNA, 22 bp, Homo sapiens
catgataccacctttactgtgc

SEQ ID NO: 1512347 - DNA, 14 bp, Homo sapiens
catgatactccact

SEQ ID NO: 1512348 - DNA, 23 bp, Homo sapiens
catgatcagacatacagctgcct

SEQ ID NO: 1512349 - DNA, 21 bp, Homo sapiens
catgatccacactttgggctt

SEQ ID NO: 1512350 - DNA, 20 bp, Homo sapiens
catgatcgagccactgcact

SEQ ID NO: 1512351 - DNA, 13 bp, Homo sapiens
catgatctccctg

SEQ ID NO: 1512352 - DNA, 17 bp, Homo sapiens
catgatctccctgccgc

SEQ ID NO: 1512353 - DNA, 18 bp, Homo sapiens
catgatctccctgccgcc

SEQ ID NO: 1512354 - DNA, 16 bp, Homo sapiens
catgatgggaaaatat

SEQ ID NO: 1512355 - DNA, 23 bp, Homo sapiens
catgatgggaaaatatttcctga

SEQ ID NO: 1512356 - DNA, 15 bp, Homo sapiens
catgatgtgaagagt

SEQ ID NO: 1512357 - DNA, 21 bp, Homo sapiens
catgatgtgaagagtttcaca

SEQ ID NO: 1512358 - DNA, 15 bp, Homo sapiens
catgatgtttgccca

SEQ ID NO: 1512359 - DNA, 17 bp, Homo sapiens
catgatgtttgcccaaa

SEQ ID NO: 1512360 - DNA, 14 bp, Homo sapiens
catgattatagcaa

SEQ ID NO: 1512361 - DNA, 16 bp, Homo sapiens
catgattcatgccaat

SEQ ID NO: 1512362 - DNA, 20 bp, Homo sapiens
catgatttacagagaagtga

SEQ ID NO: 1512363 - DNA, 17 bp, Homo sapiens
catgatttgtcccagcc

SEQ ID NO: 1512364 - DNA, 23 bp, Homo sapiens
catgatttgtcccagcctggggc

SEQ ID NO: 1512365 - DNA, 24 bp, Homo sapiens
catgattttaagtttctctgcaga

SEQ ID NO: 1512366 - DNA, 16 bp, Homo sapiens
catgcaaatgctgtat

SEQ ID NO: 1512367 - DNA, 22 bp, Homo sapiens
catgcaaccgggccctctctct

SEQ ID NO: 1512368 - DNA, 13 bp, Homo sapiens
catgcaagagttt

SEQ ID NO: 1512369 - DNA, 14 bp, Homo sapiens
catgcaagcagagg

SEQ ID NO: 1512370 - DNA, 23 bp, Homo sapiens
catgcaagcagaggaccagggcc

SEQ ID NO: 1512371 - DNA, 19 bp, Homo sapiens
cataggtcactggctctcc

SEQ ID NO: 1512372 - DNA, 16 bp, Homo sapiens
cataggtctgtatggc

SEQ ID NO: 1512373 - DNA, 23 bp, Homo sapiens
cataggttaaaaaaaaaagtcac

SEQ ID NO: 1512374 - DNA, 22 bp, Homo sapiens
cataggttcacaccattttgtt

SEQ ID NO: 1512375 - DNA, 13 bp, Homo sapiens
cataggttttaaa

SEQ ID NO: 1512376 - DNA, 16 bp, Homo sapiens
catagtaaagtatttt

SEQ ID NO: 1512377 - DNA, 20 bp, Homo sapiens
catagtaaagtatttttgat

SEQ ID NO: 1512378 - DNA, 20 bp, Homo sapiens
catagtaagaccccatctct

SEQ ID NO: 1512379 - DNA, 19 bp, Homo sapiens
catagtaataagatggctg

SEQ ID NO: 1512380 - DNA, 16 bp, Homo sapiens
catagtaccaatcatt

SEQ ID NO: 1512381 - DNA, 15 bp, Homo sapiens
catgtcctgtaaagg

SEQ ID NO: 1512382 - DNA, 14 bp, Homo sapiens
catgtcctgtcctg

SEQ ID NO: 1512383 - DNA, 17 bp, Homo sapiens
catgtcctgtcctggtc

SEQ ID NO: 1512384 - DNA, 13 bp, Homo sapiens
catgtcgcttttg

SEQ ID NO: 1512385 - DNA, 22 bp, Homo sapiens
catgtctataatcccagcactt

SEQ ID NO: 1512386 - DNA, 16 bp, Homo sapiens
catgtctcctactgag

SEQ ID NO: 1512387 - DNA, 20 bp, Homo sapiens
catgtctcctactgaggata

SEQ ID NO: 1512388 - DNA, 17 bp, Homo sapiens
catgtctcctatcctgg

SEQ ID NO: 1512389 - DNA, 12 bp, Homo sapiens
catgtctctctg

SEQ ID NO: 1512390 - DNA, 14 bp, Homo sapiens
catgtctctctgcc

SEQ ID NO: 1512391 - DNA, 15 bp, Homo sapiens
catgtctctctgcca

SEQ ID NO: 1512392 - DNA, 17 bp, Homo sapiens
catgtctctctgccaag

SEQ ID NO: 1512393 - DNA, 15 bp, Homo sapiens
catgtctgaaacaga

SEQ ID NO: 1512394 - DNA, 20 bp, Homo sapiens
catgtctgagcggcgcagag

SEQ ID NO: 1512395 - DNA, 22 bp, Homo sapiens
catgtctgagcggcgcagagcc

SEQ ID NO: 1512396 - DNA, 19 bp, Homo sapiens
catgtctgtatactcctgt

SEQ ID NO: 1512397 - DNA, 18 bp, Homo sapiens
catgtcttatcttgtttc

SEQ ID NO: 1512398 - DNA, 15 bp, Homo sapiens
catgtcttgtacatg

SEQ ID NO: 1512399 - DNA, 22 bp, Homo sapiens
catgtgaaaaggcaaaaagcat

SEQ ID NO: 1512400 - DNA, 17 bp, Homo sapiens
catgtgaaaatcaaata

SEQ ID NO: 1512401 - DNA, 21 bp, Homo sapiens
catgtgaagcatgctttgctg

SEQ ID NO: 1512402 - DNA, 22 bp, Homo sapiens
catgtgaagtgtatatgattct

SEQ ID NO: 1512403 - DNA, 15 bp, Homo sapiens
catgtgacacatatg

SEQ ID NO: 1512404 - DNA, 16 bp, Homo sapiens
catgtgacacatatgc

SEQ ID NO: 1512405 - DNA, 21 bp, Homo sapiens
catgtgaccacatacgtgtta

SEQ ID NO: 1512406 - DNA, 20 bp, Homo sapiens
catgtgagcatgtcacttcc

SEQ ID NO: 1512407 - DNA, 18 bp, Homo sapiens
catgtgagccaccgctgc

SEQ ID NO: 1512408 - DNA, 22 bp, Homo sapiens
catgtgagccaccgctgccagc

SEQ ID NO: 1512409 - DNA, 14 bp, Homo sapiens
catgtgagctcttc

SEQ ID NO: 1512410 - DNA, 14 bp, Homo sapiens
catgtgaggaggaa

SEQ ID NO: 1512411 - DNA, 17 bp, Homo sapiens
catgtgaggaggaaaag

SEQ ID NO: 1512412 - DNA, 17 bp, Homo sapiens
catgtgcatctggtgta

SEQ ID NO: 1512413 - DNA, 13 bp, Homo sapiens
catgtgccctcag

SEQ ID NO: 1512414 - DNA, 15 bp, Homo sapiens
catgtgcctgcacca

SEQ ID NO: 1512415 - DNA, 20 bp, Homo sapiens
catgtgcctgcaccaggaga

SEQ ID NO: 1512416 - DNA, 21 bp, Homo sapiens
catgtgcctgcaccaggagac

SEQ ID NO: 1512417 - DNA, 12 bp, Homo sapiens
catgtgcctttc

SEQ ID NO: 1512418 - DNA, 14 bp, Homo sapiens
catgtgcctttctt

SEQ ID NO: 1512419 - DNA, 17 bp, Homo sapiens
catgtgcctttctttgc

SEQ ID NO: 1512420 - DNA, 19 bp, Homo sapiens
catgtgcctttctttgcct

SEQ ID NO: 1512421 - DNA, 23 bp, Homo sapiens
catgtgctgtgaccatttataat

SEQ ID NO: 1512422 - DNA, 23 bp, Homo sapiens
catgtggaaggcaagccaggctc

SEQ ID NO: 1512423 - DNA, 15 bp, Homo sapiens
catgtggagaaagga

SEQ ID NO: 1512424 - DNA, 22 bp, Homo sapiens
catgtggatatcagttaccaaa

SEQ ID NO: 1512425 - DNA, 15 bp, Homo sapiens
catgtggctgaagac

SEQ ID NO: 1512426 - DNA, 16 bp, Homo sapiens
catgtgggcgcccacc

SEQ ID NO: 1512427 - DNA, 18 bp, Homo sapiens
catgtgggcgcccaccct

SEQ ID NO: 1512428 - DNA, 19 bp, Homo sapiens
catgtgggcgcccaccctg

SEQ ID NO: 1512429 - DNA, 15 bp, Homo sapiens
catgtggggccaggt

SEQ ID NO: 1512430 - DNA, 17 bp, Homo sapiens
catgtggggccaggtca

SEQ ID NO: 1512431 - DNA, 23 bp, Homo sapiens
catgtggggccaggtcacccttt

SEQ ID NO: 1512432 - DNA, 17 bp, Homo sapiens
catgtgggtgagccagt

SEQ ID NO: 1512433 - DNA, 23 bp, Homo sapiens
catgtgggtgagccagtggaaca

SEQ ID NO: 1512434 - DNA, 16 bp, Homo sapiens
catgtgggtggagaag

SEQ ID NO: 1512435 - DNA, 17 bp, Homo sapiens
catgtgggtggagaagg

SEQ ID NO: 1512436 - DNA, 22 bp, Homo sapiens
catgtgggtggagaagggaggg

SEQ ID NO: 1512437 - DNA, 23 bp, Homo sapiens
catgtggtggcacaggccccctt

SEQ ID NO: 1512438 - DNA, 11 bp, Homo sapiens
catgtgtacat

SEQ ID NO: 1512439 - DNA, 18 bp, Homo sapiens
catgtgtacatatatgta

SEQ ID NO: 1512440 - DNA, 20 bp, Homo sapiens
catgtgtacatatatgtata

SEQ ID NO: 1512441 - DNA, 14 bp, Homo sapiens
catgtgtagcctgt

SEQ ID NO: 1512442 - DNA, 18 bp, Homo sapiens
catgtgtagcctgtgcat

SEQ ID NO: 1512443 - DNA, 13 bp, Homo sapiens
catgtgtataaaa

SEQ ID NO: 1512444 - DNA, 23 bp, Homo sapiens
catgtgtatccatgcattatata

SEQ ID NO: 1512445 - DNA, 24 bp, Homo sapiens
catgtgtcatgaagaatgtttctg

SEQ ID NO: 1512446 - DNA, 21 bp, Homo sapiens
catgtgtcctggttcccgttt

SEQ ID NO: 1512447 - DNA, 21 bp, Homo sapiens
catgtgtgacccttgtcatct

SEQ ID NO: 1512448 - DNA, 12 bp, Homo sapiens
catgtgtgcatg

SEQ ID NO: 1512449 - DNA, 18 bp, Homo sapiens
catgtgtgcatgtgagca

SEQ ID NO: 1512450 - DNA, 22 bp, Homo sapiens
catgtgtgcatgtgctgtgtga

SEQ ID NO: 1512451 - DNA, 17 bp, Homo sapiens
catgtgtgcctgtggca

SEQ ID NO: 1512452 - DNA, 12 bp, Homo sapiens
catgtgtggaag

SEQ ID NO: 1512453 - DNA, 13 bp, Homo sapiens
catgtgtggaagt

SEQ ID NO: 1512454 - DNA, 21 bp, Homo sapiens
catgtgtggtacatggtgttt

SEQ ID NO: 1512455 - DNA, 15 bp, Homo sapiens
catgtgtgtgtctgt

SEQ ID NO: 1512456 - DNA, 16 bp, Homo sapiens
catgtgtgtgtctgtc

SEQ ID NO: 1512457 - DNA, 19 bp, Homo sapiens
catgtgtgtgtctgtcttt

SEQ ID NO: 1512458 - DNA, 13 bp, Homo sapiens
catgtgtgtgtgt

SEQ ID NO: 1512459 - DNA, 14 bp, Homo sapiens
catgtgttaaaata

SEQ ID NO: 1512460 - DNA, 17 bp, Homo sapiens
catgtgttgcaaattat

SEQ ID NO: 1512461 - DNA, 23 bp, Homo sapiens
catgtgttgcaaattattctagt

SEQ ID NO: 1512462 - DNA, 15 bp, Homo sapiens
catgttactcagtgt

SEQ ID NO: 1512463 - DNA, 18 bp, Homo sapiens
catgttaggaaaatttca

SEQ ID NO: 1512464 - DNA, 22 bp, Homo sapiens
catgttagttaccttatagtta

SEQ ID NO: 1512465 - DNA, 24 bp, Homo sapiens
catgttagttaccttatagttact

SEQ ID NO: 1512466 - DNA, 14 bp, Homo sapiens
catgttattttatt

SEQ ID NO: 1512467 - DNA, 17 bp, Homo sapiens
catgttattttattatt

SEQ ID NO: 1512468 - DNA, 22 bp, Homo sapiens
catgttcaaagccacattattt

SEQ ID NO: 1512469 - DNA, 16 bp, Homo sapiens
catgttcatgtgatta

SEQ ID NO: 1512470 - DNA, 22 bp, Homo sapiens
catgttcatgtgattaactctt

SEQ ID NO: 1512471 - DNA, 24 bp, Homo sapiens
catgttctaccgtggatttgtact

SEQ ID NO: 1512472 - DNA, 14 bp, Homo sapiens
catgttctttgtac

SEQ ID NO: 1512473 - DNA, 13 bp, Homo sapiens
catgttgacgaga

SEQ ID NO: 1512474 - DNA, 21 bp, Homo sapiens
catgttgatcatgtacttttt

SEQ ID NO: 1512475 - DNA, 22 bp, Homo sapiens
catgttgcccccgtgagccaat

SEQ ID NO: 1512476 - DNA, 16 bp, Homo sapiens
catgttgctgaggagt

SEQ ID NO: 1512477 - DNA, 21 bp, Homo sapiens
catgttggccaggctggtctt

SEQ ID NO: 1512478 - DNA, 19 bp, Homo sapiens
catgttgggaaacttggct

SEQ ID NO: 1512479 - DNA, 14 bp, Homo sapiens
catgtttcacagtg

SEQ ID NO: 1512480 - DNA, 21 bp, Homo sapiens
catgtttcagtgaagatgctg

SEQ ID NO: 1512481 - DNA, 14 bp, Homo sapiens
catgtttccagcag

SEQ ID NO: 1512482 - DNA, 20 bp, Homo sapiens
catgtttctttgatcatgaa

SEQ ID NO: 1512483 - DNA, 18 bp, Homo sapiens
catgtttgagctcagacc

SEQ ID NO: 1512484 - DNA, 22 bp, Homo sapiens
catgtttggtgtttgtctgtgt

SEQ ID NO: 1512485 - DNA, 13 bp, Homo sapiens
catgtttgtaaat

SEQ ID NO: 1512486 - DNA, 19 bp, Homo sapiens
catgttttagcatttgtat

SEQ ID NO: 1512487 - DNA, 14 bp, Homo sapiens
catgttttccgtga

SEQ ID NO: 1512488 - DNA, 21 bp, Homo sapiens
catgtttttctattaaaaata

SEQ ID NO: 1512489 - DNA, 22 bp, Homo sapiens
cattaaaaaaaaaaaaaaaagt

SEQ ID NO: 1512490 - DNA, 15 bp, Homo sapiens
cattaaaaagttgtt

SEQ ID NO: 1512491 - DNA, 18 bp, Homo sapiens
cattaaaaagttgttctt

SEQ ID NO: 1512492 - DNA, 13 bp, Homo sapiens
cattaaaactgct

SEQ ID NO: 1512493 - DNA, 16 bp, Homo sapiens
cattaaaatggaagtg

SEQ ID NO: 1512494 - DNA, 19 bp, Homo sapiens
cattaaaatggaagtggat

SEQ ID NO: 1512495 - DNA, 21 bp, Homo sapiens
cattaaaatttcttatttacc

SEQ ID NO: 1512496 - DNA, 16 bp, Homo sapiens
cattaaacactgtaat

SEQ ID NO: 1512497 - DNA, 17 bp, Homo sapiens
cattaaacactgtaatc

SEQ ID NO: 1512498 - DNA, 13 bp, Homo sapiens
cattaaacttgaa

SEQ ID NO: 1512499 - DNA, 15 bp, Homo sapiens
cattaaacttgaagc

SEQ ID NO: 1512500 - DNA, 11 bp, Homo sapiens
cattaaacttt

SEQ ID NO: 1512501 - DNA, 19 bp, Homo sapiens
cattaaacttttttaacca

SEQ ID NO: 1512502 - DNA, 11 bp, Homo sapiens
cattaaataaa

SEQ ID NO: 1512503 - DNA, 15 bp, Homo sapiens
cattaacaaataaaa

SEQ ID NO: 1512504 - DNA, 16 bp, Homo sapiens
cattaacaaataaaaa

SEQ ID NO: 1512505 - DNA, 14 bp, Homo sapiens
cattaactccctcc

SEQ ID NO: 1512506 - DNA, 20 bp, Homo sapiens
cattaagcacacacatctgg

SEQ ID NO: 1512507 - DNA, 23 bp, Homo sapiens
cattaagcacacacatctggccc

SEQ ID NO: 1512508 - DNA, 24 bp, Homo sapiens
cattaagcacacacatctggccct

SEQ ID NO: 1512509 - DNA, 19 bp, Homo sapiens
cattaaggttatgcactgc

SEQ ID NO: 1512510 - DNA, 13 bp, Homo sapiens
cattaagtaaatg

SEQ ID NO: 1512511 - DNA, 17 bp, Homo sapiens
cattaataagtgaagaa

SEQ ID NO: 1512512 - DNA, 17 bp, Homo sapiens
cattaatagcagccttt

SEQ ID NO: 1512513 - DNA, 14 bp, Homo sapiens
cattaatatttacc

SEQ ID NO: 1512514 - DNA, 17 bp, Homo sapiens
cattaatatttgctgac

SEQ ID NO: 1512515 - DNA, 16 bp, Homo sapiens
cattaatctcaaagag

SEQ ID NO: 1512516 - DNA, 13 bp, Homo sapiens
cattaatgacttt

SEQ ID NO: 1512517 - DNA, 22 bp, Homo sapiens
cattaatgataaactcagatct

SEQ ID NO: 1512518 - DNA, 19 bp, Homo sapiens
cattaatgatgatcttcag

SEQ ID NO: 1512519 - DNA, 13 bp, Homo sapiens
cattaatgttaat

SEQ ID NO: 1512520 - DNA, 20 bp, Homo sapiens
cattaattacatacagattt

SEQ ID NO: 1512521 - DNA, 14 bp, Homo sapiens
cattaattttgtgc

SEQ ID NO: 1512522 - DNA, 15 bp, Homo sapiens
cattaattttgtgca

SEQ ID NO: 1512523 - DNA, 18 bp, Homo sapiens
cattaattttgtgcattc

SEQ ID NO: 1512524 - DNA, 19 bp, Homo sapiens
cattaattttgtgcattct

SEQ ID NO: 1512525 - DNA, 20 bp, Homo sapiens
cattaattttgtgcattctt

SEQ ID NO: 1512526 - DNA, 21 bp, Homo sapiens
cattacaagcctggaaaaaaa

SEQ ID NO: 1512527 - DNA, 17 bp, Homo sapiens
cattacactaaattatt

SEQ ID NO: 1512528 - DNA, 16 bp, Homo sapiens
cattacagttctttcc

SEQ ID NO: 1512529 - DNA, 11 bp, Homo sapiens
cattaccaaaa

SEQ ID NO: 1512530 - DNA, 18 bp, Homo sapiens
cattaccagacggttcac

SEQ ID NO: 1512531 - DNA, 16 bp, Homo sapiens
cattaccagcttaaaa

SEQ ID NO: 1512532 - DNA, 21 bp, Homo sapiens
cattacctccatccatccttc

SEQ ID NO: 1512533 - DNA, 24 bp, Homo sapiens
cattacctccatccatccttccaa

SEQ ID NO: 1512534 - DNA, 15 bp, Homo sapiens
cattactgtcccctt

SEQ ID NO: 1512535 - DNA, 21 bp, Homo sapiens
cattagaaaattttgtaaaac

SEQ ID NO: 1512536 - DNA, 17 bp, Homo sapiens
cattagaaatagacagt

SEQ ID NO: 1512537 - DNA, 18 bp, Homo sapiens
cattagaaatattttaaa

SEQ ID NO: 1512538 - DNA, 14 bp, Homo sapiens
cattagaattattt

SEQ ID NO: 1512539 - DNA, 19 bp, Homo sapiens
cattagaattatttaaaca

SEQ ID NO: 1512540 - DNA, 18 bp, Homo sapiens
cattagaccaagcttgtc

SEQ ID NO: 1512541 - DNA, 16 bp, Homo sapiens
cattagactgaattta

SEQ ID NO: 1512542 - DNA, 14 bp, Homo sapiens
cattagcagttgct

SEQ ID NO: 1512543 - DNA, 23 bp, Homo sapiens
cattagcagttgctcacatgtct

SEQ ID NO: 1512544 - DNA, 17 bp, Homo sapiens
cattagcagtttgcttt

SEQ ID NO: 1512545 - DNA, 22 bp, Homo sapiens
cattaggacaatcagtcccctc

SEQ ID NO: 1512546 - DNA, 17 bp, Homo sapiens
cattagggatgcctcct

SEQ ID NO: 1512547 - DNA, 22 bp, Homo sapiens
cattaggtccctcactccacag

SEQ ID NO: 1512548 - DNA, 18 bp, Homo sapiens
cattataactgaaggaga

SEQ ID NO: 1512549 - DNA, 14 bp, Homo sapiens
cattataatttata

SEQ ID NO: 1512550 - DNA, 18 bp, Homo sapiens
cattatcgggagcagtgt

SEQ ID NO: 1512551 - DNA, 23 bp, Homo sapiens
cattatcgggagcagtgtcttcc

SEQ ID NO: 1512552 - DNA, 12 bp, Homo sapiens
cattatctcaaa

SEQ ID NO: 1512553 - DNA, 13 bp, Homo sapiens
cattatctggaat

SEQ ID NO: 1512554 - DNA, 16 bp, Homo sapiens
cattatgatctaataa

SEQ ID NO: 1512555 - DNA, 17 bp, Homo sapiens
cattatgatctaataaa

SEQ ID NO: 1512556 - DNA, 18 bp, Homo sapiens
cattatgatctaataaac

SEQ ID NO: 1512557 - DNA, 19 bp, Homo sapiens
cattatgatctaataaact

SEQ ID NO: 1512558 - DNA, 18 bp, Homo sapiens
cattatgcaaatggagat

SEQ ID NO: 1512559 - DNA, 21 bp, Homo sapiens
cattatgcaaatggagataaa

SEQ ID NO: 1512560 - DNA, 18 bp, Homo sapiens
cattatgccacttccttt

SEQ ID NO: 1512561 - DNA, 18 bp, Homo sapiens
cattatgggttcttcccc

SEQ ID NO: 1512562 - DNA, 13 bp, Homo sapiens
cattattaaattg

SEQ ID NO: 1512563 - DNA, 19 bp, Homo sapiens
cattattagtactgctctt

SEQ ID NO: 1512564 - DNA, 13 bp, Homo sapiens
cattattatcaac

SEQ ID NO: 1512565 - DNA, 22 bp, Homo sapiens
cattattctctgctatatataa

SEQ ID NO: 1512566 - DNA, 14 bp, Homo sapiens
cattatttatatgg

SEQ ID NO: 1512567 - DNA, 13 bp, Homo sapiens
cattatttctagt

SEQ ID NO: 1512568 - DNA, 14 bp, Homo sapiens
cattatttgcatgt

SEQ ID NO: 1512569 - DNA, 19 bp, Homo sapiens
cattatttgcatgttacct

SEQ ID NO: 1512570 - DNA, 23 bp, Homo sapiens
cattatttttgtagttagacaat

SEQ ID NO: 1512571 - DNA, 17 bp, Homo sapiens
cattcaaaaaactctct

SEQ ID NO: 1512572 - DNA, 21 bp, Homo sapiens
cattcaaaaaactctctccca

SEQ ID NO: 1512573 - DNA, 17 bp, Homo sapiens
cattcaaaagttgaaat

SEQ ID NO: 1512574 - DNA, 22 bp, Homo sapiens
cattcaaatcagtgatctatgt

SEQ ID NO: 1512575 - DNA, 15 bp, Homo sapiens
cattcaagcctgtga

SEQ ID NO: 1512576 - DNA, 17 bp, Homo sapiens
cattcaagcctgtgaat

SEQ ID NO: 1512577 - DNA, 12 bp, Homo sapiens
cattcaagctat

SEQ ID NO: 1512578 - DNA, 14 bp, Homo sapiens
cattcaagctattt

SEQ ID NO: 1512579 - DNA, 21 bp, Homo sapiens
cattcaatattgacatttgta

SEQ ID NO: 1512580 - DNA, 17 bp, Homo sapiens
cattcaatctttggagg

SEQ ID NO: 1512581 - DNA, 14 bp, Homo sapiens
cattcaatgaatta

SEQ ID NO: 1512582 - DNA, 22 bp, Homo sapiens
cattcaattagtggtcataaaa

SEQ ID NO: 1512583 - DNA, 13 bp, Homo sapiens
cattcacagagcc

SEQ ID NO: 1512584 - DNA, 23 bp, Homo sapiens
cattcacagttctttgggccaga

SEQ ID NO: 1512585 - DNA, 17 bp, Homo sapiens
cattcacatttgatgta

SEQ ID NO: 1512586 - DNA, 15 bp, Homo sapiens
cattcactagaaaat

SEQ ID NO: 1512587 - DNA, 16 bp, Homo sapiens
cattcactcttccaga

SEQ ID NO: 1512588 - DNA, 20 bp, Homo sapiens
cattcactcttccagaatcc

SEQ ID NO: 1512589 - DNA, 15 bp, Homo sapiens
cattcacttgcattt

SEQ ID NO: 1512590 - DNA, 12 bp, Homo sapiens
cattcagaaatg

SEQ ID NO: 1512591 - DNA, 19 bp, Homo sapiens
cattcagaatatcatcttt

SEQ ID NO: 1512592 - DNA, 15 bp, Homo sapiens
cattcagactaaaaa

SEQ ID NO: 1512593 - DNA, 16 bp, Homo sapiens
cattcagactaaaaat

SEQ ID NO: 1512594 - DNA, 18 bp, Homo sapiens
cattcagagctatggtgc

SEQ ID NO: 1512595 - DNA, 16 bp, Homo sapiens
cattcagatcactgaa

SEQ ID NO: 1512596 - DNA, 19 bp, Homo sapiens
cattcaggaattcttggag

SEQ ID NO: 1512597 - DNA, 18 bp, Homo sapiens
cattcagtatataaaata

SEQ ID NO: 1512598 - DNA, 19 bp, Homo sapiens
cattcatattaagacagtg

SEQ ID NO: 1512599 - DNA, 20 bp, Homo sapiens
cattcatgcaagagtttctt

SEQ ID NO: 1512600 - DNA, 14 bp, Homo sapiens
cattccaagactct

SEQ ID NO: 1512601 - DNA, 20 bp, Homo sapiens
cattccaattctaaatccga

SEQ ID NO: 1512602 - DNA, 21 bp, Homo sapiens
cattccacagctgccctggct

SEQ ID NO: 1512603 - DNA, 18 bp, Homo sapiens
cattccactgttggtatt

SEQ ID NO: 1512604 - DNA, 15 bp, Homo sapiens
cattccagctctgcc

SEQ ID NO: 1512605 - DNA, 17 bp, Homo sapiens
cattccaggcagcctct

SEQ ID NO: 1512606 - DNA, 19 bp, Homo sapiens
cattccaggcagcctctgt

SEQ ID NO: 1512607 - DNA, 17 bp, Homo sapiens
cattccagtacagtatt

SEQ ID NO: 1512608 - DNA, 21 bp, Homo sapiens
cattccagtacagtattcttt

SEQ ID NO: 1512609 - DNA, 16 bp, Homo sapiens
cattccattgttttag

SEQ ID NO: 1512610 - DNA, 12 bp, Homo sapiens
cattcccagcgt

SEQ ID NO: 1512611 - DNA, 13 bp, Homo sapiens
cattccccatggg

SEQ ID NO: 1512612 - DNA, 21 bp, Homo sapiens
cattcccccatgtggctgaag

SEQ ID NO: 1512613 - DNA, 16 bp, Homo sapiens
cattcccctcccacct

SEQ ID NO: 1512614 - DNA, 16 bp, Homo sapiens
cattcccctttgcact

SEQ ID NO: 1512615 - DNA, 23 bp, Homo sapiens
cattcccgtggtctccttgcact

SEQ ID NO: 1512616 - DNA, 16 bp, Homo sapiens
cattccctacagccta

SEQ ID NO: 1512617 - DNA, 21 bp, Homo sapiens
cattccctgagtcaccaggaa

SEQ ID NO: 1512618 - DNA, 20 bp, Homo sapiens
cattcccttggatgtagtct

SEQ ID NO: 1512619 - DNA, 22 bp, Homo sapiens
cattcctaactagaattagtat

SEQ ID NO: 1512620 - DNA, 16 bp, Homo sapiens
cattcctcagctgcca

SEQ ID NO: 1512621 - DNA, 16 bp, Homo sapiens
cattcctcagggacag

SEQ ID NO: 1512622 - DNA, 23 bp, Homo sapiens
cattcctcagggacagagacacc

SEQ ID NO: 1512623 - DNA, 17 bp, Homo sapiens
cattcctcatgaatgta

SEQ ID NO: 1512624 - DNA, 18 bp, Homo sapiens
cattcctcatgaatgtaa

SEQ ID NO: 1512625 - DNA, 19 bp, Homo sapiens
cattcctcatgaatgtaaa

SEQ ID NO: 1512626 - DNA, 21 bp, Homo sapiens
cattcctcatgaatgtaaatt

SEQ ID NO: 1512627 - DNA, 21 bp, Homo sapiens
cattcctgaagaaccagtccc

SEQ ID NO: 1512628 - DNA, 21 bp, Homo sapiens
cattcctgatatgatttaaaa

SEQ ID NO: 1512629 - DNA, 13 bp, Homo sapiens
cattcctgcctgt

SEQ ID NO: 1512630 - DNA, 19 bp, Homo sapiens
cattcctgcctttaagcca

SEQ ID NO: 1512631 - DNA, 22 bp, Homo sapiens
cattcctgcctttaagccaaag

SEQ ID NO: 1512632 - DNA, 16 bp, Homo sapiens
cattcctggagcccga

SEQ ID NO: 1512633 - DNA, 18 bp, Homo sapiens
cattcctggtacccagcc

SEQ ID NO: 1512634 - DNA, 23 bp, Homo sapiens
cattcctggtacccagccatctg

SEQ ID NO: 1512635 - DNA, 24 bp, Homo sapiens
cattcctggtacccagccatctgc

SEQ ID NO: 1512636 - DNA, 21 bp, Homo sapiens
cattcctgttgatgggaaaag

SEQ ID NO: 1512637 - DNA, 15 bp, Homo sapiens
cattccttaattgta

SEQ ID NO: 1512638 - DNA, 16 bp, Homo sapiens
cattccttgtcaccag

SEQ ID NO: 1512639 - DNA, 18 bp, Homo sapiens
cattccttgtcaccagca

SEQ ID NO: 1512640 - DNA, 17 bp, Homo sapiens
cattcgcctttgtcttg

SEQ ID NO: 1512641 - DNA, 19 bp, Homo sapiens
cattcgcgtggctcgggac

SEQ ID NO: 1512642 - DNA, 21 bp, Homo sapiens
cattcgctgtaccctttaaga

SEQ ID NO: 1512643 - DNA, 15 bp, Homo sapiens
cattcgtctgtccca

SEQ ID NO: 1512644 - DNA, 17 bp, Homo sapiens
cattcgtgagctgggga

SEQ ID NO: 1512645 - DNA, 18 bp, Homo sapiens
cattcgtgagctggggac

SEQ ID NO: 1512646 - DNA, 17 bp, Homo sapiens
cattctaaaccaaaaca

SEQ ID NO: 1512647 - DNA, 18 bp, Homo sapiens
cattctaaaccaaaacag

SEQ ID NO: 1512648 - DNA, 22 bp, Homo sapiens
cattctaactcatatgttccca

SEQ ID NO: 1512649 - DNA, 13 bp, Homo sapiens
cattctaatttgc

SEQ ID NO: 1512650 - DNA, 14 bp, Homo sapiens
cattctacctgagg

SEQ ID NO: 1512651 - DNA, 10 bp, Homo sapiens
cattctagat

SEQ ID NO: 1512652 - DNA, 20 bp, Homo sapiens
cattctaggatgtggagcta

SEQ ID NO: 1512653 - DNA, 17 bp, Homo sapiens
cattctaggctcactgc

SEQ ID NO: 1512654 - DNA, 14 bp, Homo sapiens
cattctcactccta

SEQ ID NO: 1512655 - DNA, 17 bp, Homo sapiens
cattctcactcctacct

SEQ ID NO: 1512656 - DNA, 20 bp, Homo sapiens
cattctccagttgattattt

SEQ ID NO: 1512657 - DNA, 12 bp, Homo sapiens
cattctcccagg

SEQ ID NO: 1512658 - DNA, 12 bp, Homo sapiens
cattctccccag

SEQ ID NO: 1512659 - DNA, 15 bp, Homo sapiens
cattctccccagtgt

SEQ ID NO: 1512660 - DNA, 23 bp, Homo sapiens
cattctccccctctttgggcagt

SEQ ID NO: 1512661 - DNA, 15 bp, Homo sapiens
cattctcccgcttcc

SEQ ID NO: 1512662 - DNA, 19 bp, Homo sapiens
cattctcccgcttcctggc

SEQ ID NO: 1512663 - DNA, 21 bp, Homo sapiens
cattctcccgcttcctggcct

SEQ ID NO: 1512664 - DNA, 16 bp, Homo sapiens
cattctcctgcctcac

SEQ ID NO: 1512665 - DNA, 21 bp, Homo sapiens
cattctctagacaaaatcaaa

SEQ ID NO: 1512666 - DNA, 16 bp, Homo sapiens
cattctctcccatcct

SEQ ID NO: 1512667 - DNA, 17 bp, Homo sapiens
cattctctcccatcctg

SEQ ID NO: 1512668 - DNA, 12 bp, Homo sapiens
cattctctctcc

SEQ ID NO: 1512669 - DNA, 16 bp, Homo sapiens
cattctctctcctgta

SEQ ID NO: 1512670 - DNA, 18 bp, Homo sapiens
cattctctctcctgtcca

SEQ ID NO: 1512671 - DNA, 20 bp, Homo sapiens
cattctctctcctgtccaac

SEQ ID NO: 1512672 - DNA, 12 bp, Homo sapiens
cattctctgaag

SEQ ID NO: 1512673 - DNA, 14 bp, Homo sapiens
cattctcttcccag

SEQ ID NO: 1512674 - DNA, 16 bp, Homo sapiens
cattctcttcttgcta

SEQ ID NO: 1512675 - DNA, 20 bp, Homo sapiens
cattctctttgataacaaaa

SEQ ID NO: 1512676 - DNA, 21 bp, Homo sapiens
cattctctttgataacaaaaa

SEQ ID NO: 1512677 - DNA, 12 bp, Homo sapiens
cattctgaatta

SEQ ID NO: 1512678 - DNA, 20 bp, Homo sapiens
cattctgaattaattaattt

SEQ ID NO: 1512679 - DNA, 21 bp, Homo sapiens
cattctgaattaattaatttg

SEQ ID NO: 1512680 - DNA, 19 bp, Homo sapiens
cattctgactcggtttctc

SEQ ID NO: 1512681 - DNA, 23 bp, Homo sapiens
cattctgactcggtttctccaaa

SEQ ID NO: 1512682 - DNA, 23 bp, Homo sapiens
cattctgatgtccatttgtccca

SEQ ID NO: 1512683 - DNA, 20 bp, Homo sapiens
cattctgatttggaaaaaga

SEQ ID NO: 1512684 - DNA, 11 bp, Homo sapiens
cattctgcaag

SEQ ID NO: 1512685 - DNA, 18 bp, Homo sapiens
cattctgcattgctagat

SEQ ID NO: 1512686 - DNA, 19 bp, Homo sapiens
cattctgcattgctagata

SEQ ID NO: 1512687 - DNA, 16 bp, Homo sapiens
cattctgccccagagt

SEQ ID NO: 1512688 - DNA, 23 bp, Homo sapiens
cattctgccgccccctcctgaac

SEQ ID NO: 1512689 - DNA, 22 bp, Homo sapiens
cattctgctacttcactgtcat

SEQ ID NO: 1512690 - DNA, 14 bp, Homo sapiens
cattctggaaactt

SEQ ID NO: 1512691 - DNA, 23 bp, Homo sapiens
cattctggtcaagggctgtcatt

SEQ ID NO: 1512692 - DNA, 16 bp, Homo sapiens
cattctgttttccccc

SEQ ID NO: 1512693 - DNA, 22 bp, Homo sapiens
cattctgttttcccccagcaac

SEQ ID NO: 1512694 - DNA, 18 bp, Homo sapiens
cattcttccatcatcact

SEQ ID NO: 1512695 - DNA, 13 bp, Homo sapiens
cattcttcctagt

SEQ ID NO: 1512696 - DNA, 18 bp, Homo sapiens
cattcttctggtgctact

SEQ ID NO: 1512697 - DNA, 17 bp, Homo sapiens
cattcttgaaagctgtg

SEQ ID NO: 1512698 - DNA, 23 bp, Homo sapiens
cattcttgtgggagacagcagcc

SEQ ID NO: 1512699 - DNA, 20 bp, Homo sapiens
cattctttaacatacatcta

SEQ ID NO: 1512700 - DNA, 13 bp, Homo sapiens
cattctttactgc

SEQ ID NO: 1512701 - DNA, 14 bp, Homo sapiens
cattctttactgca

SEQ ID NO: 1512702 - DNA, 15 bp, Homo sapiens
cattctttgaacatg

SEQ ID NO: 1512703 - DNA, 16 bp, Homo sapiens
cattctttgctagttg

SEQ ID NO: 1512704 - DNA, 14 bp, Homo sapiens
cattctttggtaat

SEQ ID NO: 1512705 - DNA, 17 bp, Homo sapiens
cattctttttgctctaa

SEQ ID NO: 1512706 - DNA, 19 bp, Homo sapiens
cattctttttgctctaaaa

SEQ ID NO: 1512707 - DNA, 12 bp, Homo sapiens
cattgaaagaag

SEQ ID NO: 1512708 - DNA, 17 bp, Homo sapiens
cattgaaagaagagatg

SEQ ID NO: 1512709 - DNA, 22 bp, Homo sapiens
cattgaaagcttcaaagtttat

SEQ ID NO: 1512710 - DNA, 14 bp, Homo sapiens
cattgaacagcaaa

SEQ ID NO: 1512711 - DNA, 15 bp, Homo sapiens
cattgaacagcaaag

SEQ ID NO: 1512712 - DNA, 15 bp, Homo sapiens
cattgaactctgaga

SEQ ID NO: 1512713 - DNA, 16 bp, Homo sapiens
cattgaagccgactct

SEQ ID NO: 1512714 - DNA, 20 bp, Homo sapiens
cattgaagccgactctggcc

SEQ ID NO: 1512715 - DNA, 18 bp, Homo sapiens
cattgaagtaatgaattt

SEQ ID NO: 1512716 - DNA, 13 bp, Homo sapiens
cattgaatcctca

SEQ ID NO: 1512717 - DNA, 17 bp, Homo sapiens
cattgaccaagaactgc

SEQ ID NO: 1512718 - DNA, 18 bp, Homo sapiens
cattgaccaagaactgca

SEQ ID NO: 1512719 - DNA, 15 bp, Homo sapiens
cattgacctatttcc

SEQ ID NO: 1512720 - DNA, 15 bp, Homo sapiens
cattgacctcagctg

SEQ ID NO: 1512721 - DNA, 23 bp, Homo sapiens
cattgacctcagctgcacattcc

SEQ ID NO: 1512722 - DNA, 22 bp, Homo sapiens
cattgactatcaaactgaagcc

SEQ ID NO: 1512723 - DNA, 16 bp, Homo sapiens
cattgacttttataaa

SEQ ID NO: 1512724 - DNA, 16 bp, Homo sapiens
cattgagaaactgaat

SEQ ID NO: 1512725 - DNA, 19 bp, Homo sapiens
cattgagaactgcatatgt

SEQ ID NO: 1512726 - DNA, 16 bp, Homo sapiens
cattgagtattgttta

SEQ ID NO: 1512727 - DNA, 15 bp, Homo sapiens
cattgatcttaaact

SEQ ID NO: 1512728 - DNA, 17 bp, Homo sapiens
cattgatggatgtcttc

SEQ ID NO: 1512729 - DNA, 14 bp, Homo sapiens
cattgatgtaagga

SEQ ID NO: 1512730 - DNA, 19 bp, Homo sapiens
ccacaactgacacaggaaa

SEQ ID NO: 1512731 - DNA, 13 bp, Homo sapiens
ccacaagctgcac

SEQ ID NO: 1512732 - DNA, 20 bp, Homo sapiens
ccacaagctgcactgtgaac

SEQ ID NO: 1512733 - DNA, 16 bp, Homo sapiens
ccacaagctgtccctg

SEQ ID NO: 1512734 - DNA, 17 bp, Homo sapiens
ccacaagctgtccctgc

SEQ ID NO: 1512735 - DNA, 20 bp, Homo sapiens
ccacaagctgtccctgcagg

SEQ ID NO: 1512736 - DNA, 22 bp, Homo sapiens
ccacaagctgtccctgcagggc

SEQ ID NO: 1512737 - DNA, 20 bp, Homo sapiens
ccacaaggaaaaggaggagg

SEQ ID NO: 1512738 - DNA, 21 bp, Homo sapiens
ccacaaggaaaaggaggaggt

SEQ ID NO: 1512739 - DNA, 17 bp, Homo sapiens
ccacaaggacttcctgt

SEQ ID NO: 1512740 - DNA, 15 bp, Homo sapiens
ccacaagtcttccag

SEQ ID NO: 1512741 - DNA, 20 bp, Homo sapiens
ccacaagttaaataaatcat

SEQ ID NO: 1512742 - DNA, 15 bp, Homo sapiens
ccacaatcaccgatg

SEQ ID NO: 1512743 - DNA, 21 bp, Homo sapiens
ccacaatctggcttagtgcca

SEQ ID NO: 1512744 - DNA, 16 bp, Homo sapiens
ccacaatgcagttctg

SEQ ID NO: 1512745 - DNA, 13 bp, Homo sapiens
ccacaattccatt

SEQ ID NO: 1512746 - DNA, 20 bp, Homo sapiens
ccacacaaggatagatgctg

SEQ ID NO: 1512747 - DNA, 22 bp, Homo sapiens
ccacacaaggatagatgctggc

SEQ ID NO: 1512748 - DNA, 16 bp, Homo sapiens
ccacacacacccacac

SEQ ID NO: 1512749 - DNA, 16 bp, Homo sapiens
ccacacacagaggaag

SEQ ID NO: 1512750 - DNA, 16 bp, Homo sapiens
ccacacagctgcccta

SEQ ID NO: 1512751 - DNA, 14 bp, Homo sapiens
ccacacaggctggc

SEQ ID NO: 1512752 - DNA, 15 bp, Homo sapiens
ccacaccaaccaggc

SEQ ID NO: 1512753 - DNA, 17 bp, Homo sapiens
ccacaccaaccaggcct

SEQ ID NO: 1512754 - DNA, 16 bp, Homo sapiens
ccacaccaacgaggtg

SEQ ID NO: 1512755 - DNA, 14 bp, Homo sapiens
ccacaccactgcca

SEQ ID NO: 1512756 - DNA, 13 bp, Homo sapiens
ccacaccagcctc

SEQ ID NO: 1512757 - DNA, 17 bp, Homo sapiens
ccacaccagcctcctgg

SEQ ID NO: 1512758 - DNA, 17 bp, Homo sapiens
ccacaccagctgctgct

SEQ ID NO: 1512759 - DNA, 14 bp, Homo sapiens
ccacaccaggccgt

SEQ ID NO: 1512760 - DNA, 15 bp, Homo sapiens
ccacacccaaagctg

SEQ ID NO: 1512761 - DNA, 16 bp, Homo sapiens
ccacaccctcactgct

SEQ ID NO: 1512762 - DNA, 13 bp, Homo sapiens
ccacaccctcccc

SEQ ID NO: 1512763 - DNA, 23 bp, Homo sapiens
ccacaccctgtactgttctgtgt

SEQ ID NO: 1512764 - DNA, 20 bp, Homo sapiens
ccacacctccccctgctgct

SEQ ID NO: 1512765 - DNA, 14 bp, Homo sapiens
ccacacctccctac

SEQ ID NO: 1512766 - DNA, 19 bp, Homo sapiens
ccacacctgaacttgccta

SEQ ID NO: 1512767 - DNA, 20 bp, Homo sapiens
ccacacctgcagtgccagct

SEQ ID NO: 1512768 - DNA, 14 bp, Homo sapiens
ccacacctgcctct

SEQ ID NO: 1512769 - DNA, 13 bp, Homo sapiens
ccacacctggcct

SEQ ID NO: 1512770 - DNA, 15 bp, Homo sapiens
ccacactacacagca

SEQ ID NO: 1512771 - DNA, 17 bp, Homo sapiens
ccacactattaccatga

SEQ ID NO: 1512772 - DNA, 20 bp, Homo sapiens
ccacactattaccatgagaa

SEQ ID NO: 1512773 - DNA, 16 bp, Homo sapiens
ccacactctccatcac

SEQ ID NO: 1512774 - DNA, 17 bp, Homo sapiens
ccacactgaccaagtgc

SEQ ID NO: 1512775 - DNA, 18 bp, Homo sapiens
ccacactgaccaagtgct

SEQ ID NO: 1512776 - DNA, 12 bp, Homo sapiens
ccacactgaggc

SEQ ID NO: 1512777 - DNA, 14 bp, Homo sapiens
ccacactgatggct

SEQ ID NO: 1512778 - DNA, 20 bp, Homo sapiens
ccacacttcaggctcttctc

SEQ ID NO: 1512779 - DNA, 22 bp, Homo sapiens
ccacacttcaggctcttctcct

SEQ ID NO: 1512780 - DNA, 17 bp, Homo sapiens
ccacacttgaaaccttt

SEQ ID NO: 1512781 - DNA, 17 bp, Homo sapiens
ccacactttgaagcaaa

SEQ ID NO: 1512782 - DNA, 21 bp, Homo sapiens
ccacactttgaagcaaataca

SEQ ID NO: 1512783 - DNA, 12 bp, Homo sapiens
ccacagaacctt

SEQ ID NO: 1512784 - DNA, 20 bp, Homo sapiens
ccacagaagacttcccagct

SEQ ID NO: 1512785 - DNA, 21 bp, Homo sapiens
ccacagaagacttcccagctt

SEQ ID NO: 1512786 - DNA, 11 bp, Homo sapiens
ccacagacaca

SEQ ID NO: 1512787 - DNA, 14 bp, Homo sapiens
ccacagacacacac

SEQ ID NO: 1512788 - DNA, 20 bp, Homo sapiens
ccacagacacacacacgcac

SEQ ID NO: 1512789 - DNA, 14 bp, Homo sapiens
ccacagaccacctg

SEQ ID NO: 1512790 - DNA, 15 bp, Homo sapiens
ccacagaccacctgc

SEQ ID NO: 1512791 - DNA, 17 bp, Homo sapiens
ccacagacccctgggag

SEQ ID NO: 1512792 - DNA, 18 bp, Homo sapiens
ccacagacccctgggagc

SEQ ID NO: 1512793 - DNA, 20 bp, Homo sapiens
ccacagacttgcactgaagc

SEQ ID NO: 1512794 - DNA, 22 bp, Homo sapiens
ccacagagaagtttgtagccag

SEQ ID NO: 1512795 - DNA, 17 bp, Homo sapiens
ccacagagacaaggagg

SEQ ID NO: 1512796 - DNA, 17 bp, Homo sapiens
ccacagagaggagggga

SEQ ID NO: 1512797 - DNA, 15 bp, Homo sapiens
ccacagagtgagcca

SEQ ID NO: 1512798 - DNA, 19 bp, Homo sapiens
ccacagagtgagccagtga

SEQ ID NO: 1512799 - DNA, 20 bp, Homo sapiens
ccacagatggctttcagggc

SEQ ID NO: 1512800 - DNA, 22 bp, Homo sapiens
ccacagcagcacctcctccatg

SEQ ID NO: 1512801 - DNA, 22 bp, Homo sapiens
ccacagcatcgggagcacccag

SEQ ID NO: 1512802 - DNA, 15 bp, Homo sapiens
ccacagccagcacct

SEQ ID NO: 1512803 - DNA, 16 bp, Homo sapiens
ccacagccatagacct

SEQ ID NO: 1512804 - DNA, 19 bp, Homo sapiens
ccacagcccagccacggac

SEQ ID NO: 1512805 - DNA, 16 bp, Homo sapiens
ccacagcccccttgcc

SEQ ID NO: 1512806 - DNA, 21 bp, Homo sapiens
ccacagcccccttgccctccg

SEQ ID NO: 1512807 - DNA, 17 bp, Homo sapiens
ccacagcgagggcagct

SEQ ID NO: 1512808 - DNA, 18 bp, Homo sapiens
ccacagctcagctgccca

SEQ ID NO: 1512809 - DNA, 15 bp, Homo sapiens
ccacagctcccaccc

SEQ ID NO: 1512810 - DNA, 16 bp, Homo sapiens
ccacagctgagaatgt

SEQ ID NO: 1512811 - DNA, 13 bp, Homo sapiens
ccacagctgcagc

SEQ ID NO: 1512812 - DNA, 14 bp, Homo sapiens
ccacagctgcagct

SEQ ID NO: 1512813 - DNA, 21 bp, Homo sapiens
ccacagctgcagctgatccat

SEQ ID NO: 1512814 - DNA, 12 bp, Homo sapiens
ccacagctgctg

SEQ ID NO: 1512815 - DNA, 16 bp, Homo sapiens
ccacagctgctggaga

SEQ ID NO: 1512816 - DNA, 17 bp, Homo sapiens
ccacagctgctggagaa

SEQ ID NO: 1512817 - DNA, 15 bp, Homo sapiens
ccacagctgctggcc

SEQ ID NO: 1512818 - DNA, 23 bp, Homo sapiens
ccacagctggaaagttgggcccc

SEQ ID NO: 1512819 - DNA, 20 bp, Homo sapiens
ccacagctgggcagggtgag

SEQ ID NO: 1512820 - DNA, 15 bp, Homo sapiens
ccacagcttttgcaa

SEQ ID NO: 1512821 - DNA, 20 bp, Homo sapiens
ccacaggaacaacagcatct

SEQ ID NO: 1512822 - DNA, 17 bp, Homo sapiens
ccacaggaagctcagcc

SEQ ID NO: 1512823 - DNA, 21 bp, Homo sapiens
ccacaggaagctcagccttct

SEQ ID NO: 1512824 - DNA, 20 bp, Homo sapiens
ccacaggagtgggaaaacac

SEQ ID NO: 1512825 - DNA, 17 bp, Homo sapiens
ccacaggcaaaactcag

SEQ ID NO: 1512826 - DNA, 19 bp, Homo sapiens
ccacaggcatctacacagc

SEQ ID NO: 1512827 - DNA, 22 bp, Homo sapiens
ccacaggcatctacacagcctg

SEQ ID NO: 1512828 - DNA, 16 bp, Homo sapiens
ccacaggcccttcctc

SEQ ID NO: 1512829 - DNA, 22 bp, Homo sapiens
ccacaggcccttcctctccact

SEQ ID NO: 1512830 - DNA, 19 bp, Homo sapiens
ccacaggcctgagatttca

SEQ ID NO: 1512831 - DNA, 12 bp, Homo sapiens
ccacagggacca

SEQ ID NO: 1512832 - DNA, 14 bp, Homo sapiens
ccacaggggcaggc

SEQ ID NO: 1512833 - DNA, 16 bp, Homo sapiens
ccacaggggcaggcct

SEQ ID NO: 1512834 - DNA, 17 bp, Homo sapiens
ccacaggggcaggcctg

SEQ ID NO: 1512835 - DNA, 17 bp, Homo sapiens
ccacaggtcatcagatg

SEQ ID NO: 1512836 - DNA, 15 bp, Homo sapiens
ccacaggtctagact

SEQ ID NO: 1512837 - DNA, 22 bp, Homo sapiens
ccacaggttcatgccaccatgg

SEQ ID NO: 1512838 - DNA, 16 bp, Homo sapiens
ccacagtaagttccta

SEQ ID NO: 1512839 - DNA, 12 bp, Homo sapiens
ccacagtacata

SEQ ID NO: 1512840 - DNA, 13 bp, Homo sapiens
ccacagtcagtgg

SEQ ID NO: 1512841 - DNA, 15 bp, Homo sapiens
ccacagtcagtggag

SEQ ID NO: 1512842 - DNA, 21 bp, Homo sapiens
ccacagtcagtggagcctggg

SEQ ID NO: 1512843 - DNA, 23 bp, Homo sapiens
ccacagtgggtggcacctcctga

SEQ ID NO: 1512844 - DNA, 18 bp, Homo sapiens
ccacagtgttgtgcccct

SEQ ID NO: 1512845 - DNA, 16 bp, Homo sapiens
ccacagtgtttttcct

SEQ ID NO: 1512846 - DNA, 13 bp, Homo sapiens
ccacagttttaat

SEQ ID NO: 1512847 - DNA, 12 bp, Homo sapiens
ccacatcccagg

SEQ ID NO: 1512848 - DNA, 15 bp, Homo sapiens
ccacatcccaggctt

SEQ ID NO: 1512849 - DNA, 18 bp, Homo sapiens
ccacatcccaggcttcac

SEQ ID NO: 1512850 - DNA, 18 bp, Homo sapiens
ccacatccccagagccca

SEQ ID NO: 1512851 - DNA, 20 bp, Homo sapiens
ccacatccccagagcccagc

SEQ ID NO: 1512852 - DNA, 24 bp, Homo sapiens
ccacatccccagagcccagctctt

SEQ ID NO: 1512853 - DNA, 19 bp, Homo sapiens
ccacatcctccgtccagcc

SEQ ID NO: 1512854 - DNA, 23 bp, Homo sapiens
ccacatctgcatcactcatggaa

SEQ ID NO: 1512855 - DNA, 12 bp, Homo sapiens
ccacatctgcct

SEQ ID NO: 1512856 - DNA, 13 bp, Homo sapiens
ccacatctgcctt

SEQ ID NO: 1512857 - DNA, 14 bp, Homo sapiens
ccacatctgcctta

SEQ ID NO: 1512858 - DNA, 22 bp, Homo sapiens
ccacatctgccttaaaaccaaa

SEQ ID NO: 1512859 - DNA, 23 bp, Homo sapiens
ccacatctgccttaaaaccaaag

SEQ ID NO: 1512860 - DNA, 14 bp, Homo sapiens
ccacatctgtttca

SEQ ID NO: 1512861 - DNA, 17 bp, Homo sapiens
ccacatgccccaggctc

SEQ ID NO: 1512862 - DNA, 21 bp, Homo sapiens
ccacatgccgcgtccctgccc

SEQ ID NO: 1512863 - DNA, 17 bp, Homo sapiens
ccacatgcggctcgggc

SEQ ID NO: 1512864 - DNA, 13 bp, Homo sapiens
ccacatgtccagc

SEQ ID NO: 1512865 - DNA, 20 bp, Homo sapiens
ccacatgtgtccatcccagc

SEQ ID NO: 1512866 - DNA, 16 bp, Homo sapiens
ccacattgttttaaaa

SEQ ID NO: 1512867 - DNA, 16 bp, Homo sapiens
ccaccaaaactgctcc

SEQ ID NO: 1512868 - DNA, 18 bp, Homo sapiens
ccaccaaagctgcccact

SEQ ID NO: 1512869 - DNA, 21 bp, Homo sapiens
ccaccaacccatcagaaggag

SEQ ID NO: 1512870 - DNA, 15 bp, Homo sapiens
ccaccaaccctcaga

SEQ ID NO: 1512871 - DNA, 13 bp, Homo sapiens
ccaccaactctgc

SEQ ID NO: 1512872 - DNA, 15 bp, Homo sapiens
ccaccaactctgcac

SEQ ID NO: 1512873 - DNA, 17 bp, Homo sapiens
ccaccacaccgcagaag

SEQ ID NO: 1512874 - DNA, 13 bp, Homo sapiens
ccaccaccctggc

SEQ ID NO: 1512875 - DNA, 15 bp, Homo sapiens
ccaccaccttgccaa

SEQ ID NO: 1512876 - DNA, 15 bp, Homo sapiens
ccaccacctttggct

SEQ ID NO: 1512877 - DNA, 13 bp, Homo sapiens
ccaccacgtctgc

SEQ ID NO: 1512878 - DNA, 14 bp, Homo sapiens
ccaccacgtctgcc

SEQ ID NO: 1512879 - DNA, 19 bp, Homo sapiens
ccaccacgtctgccaggcc

SEQ ID NO: 1512880 - DNA, 15 bp, Homo sapiens
ccaccacgtctggct

SEQ ID NO: 1512881 - DNA, 23 bp, Homo sapiens
ccaccacgtctggctccctgccc

SEQ ID NO: 1512882 - DNA, 18 bp, Homo sapiens
ccaccactgcctgactgc

SEQ ID NO: 1512883 - DNA, 14 bp, Homo sapiens
ccaccagagccggg

SEQ ID NO: 1512884 - DNA, 20 bp, Homo sapiens
ccaccagcaaggggaccccg

SEQ ID NO: 1512885 - DNA, 15 bp, Homo sapiens
ccaccagcaggcagg

SEQ ID NO: 1512886 - DNA, 18 bp, Homo sapiens
ccaccagcatcacctgcc

SEQ ID NO: 1512887 - DNA, 19 bp, Homo sapiens
ccaccagcatcacctgcct

SEQ ID NO: 1512888 - DNA, 16 bp, Homo sapiens
ccaccagccccagcaa

SEQ ID NO: 1512889 - DNA, 15 bp, Homo sapiens
ccaccagcctaagaa

SEQ ID NO: 1512890 - DNA, 19 bp, Homo sapiens
ccaccagcctaagaagctc

SEQ ID NO: 1512891 - DNA, 11 bp, Homo sapiens
ccaccagcctg

SEQ ID NO: 1512892 - DNA, 14 bp, Homo sapiens
ccaccagcctgctg

SEQ ID NO: 1512893 - DNA, 15 bp, Homo sapiens
ccaccaggactgaaa

SEQ ID NO: 1512894 - DNA, 13 bp, Homo sapiens
ccaccaggagaac

SEQ ID NO: 1512895 - DNA, 19 bp, Homo sapiens
ccaccaggagaaccactac

SEQ ID NO: 1512896 - DNA, 14 bp, Homo sapiens
ccaccaggagcagc

SEQ ID NO: 1512897 - DNA, 16 bp, Homo sapiens
ccaccaggagcagcag

SEQ ID NO: 1512898 - DNA, 21 bp, Homo sapiens
ccaccaggagcagcagccagc

SEQ ID NO: 1512899 - DNA, 22 bp, Homo sapiens
ccaccaggagcagcagccagca

SEQ ID NO: 1512900 - DNA, 23 bp, Homo sapiens
ccaccaggattaatctctaaaat

SEQ ID NO: 1512901 - DNA, 12 bp, Homo sapiens
ccaccaggctgg

SEQ ID NO: 1512902 - DNA, 19 bp, Homo sapiens
ccaccaggctggcgcagcc

SEQ ID NO: 1512903 - DNA, 21 bp, Homo sapiens
ccaccaggctggcgcagccaa

SEQ ID NO: 1512904 - DNA, 12 bp, Homo sapiens
ccaccagtgcct

SEQ ID NO: 1512905 - DNA, 13 bp, Homo sapiens
ccaccatccccac

SEQ ID NO: 1512906 - DNA, 17 bp, Homo sapiens
ccaccatccccagctgg

SEQ ID NO: 1512907 - DNA, 17 bp, Homo sapiens
ccaccatggccagccaa

SEQ ID NO: 1512908 - DNA, 21 bp, Homo sapiens
ccacccaaccccaagccagcc

SEQ ID NO: 1512909 - DNA, 19 bp, Homo sapiens
ccacccaaccctatctcct

SEQ ID NO: 1512910 - DNA, 12 bp, Homo sapiens
ccacccaagcct

SEQ ID NO: 1512911 - DNA, 16 bp, Homo sapiens
ccacccaagcttggca

SEQ ID NO: 1512912 - DNA, 16 bp, Homo sapiens
ccacccacacagctgc

SEQ ID NO: 1512913 - DNA, 17 bp, Homo sapiens
ccacccacacagctgcc

SEQ ID NO: 1512914 - DNA, 19 bp, Homo sapiens
ccacccacacagctgccct

SEQ ID NO: 1512915 - DNA, 24 bp, Homo sapiens
ccacccacacagctgccctagctg

SEQ ID NO: 1512916 - DNA, 13 bp, Homo sapiens
ccacccaccccct

SEQ ID NO: 1512917 - DNA, 11 bp, Homo sapiens
ccacccagagg

SEQ ID NO: 1512918 - DNA, 17 bp, Homo sapiens
ccacccagaggcagcag

SEQ ID NO: 1512919 - DNA, 13 bp, Homo sapiens
ccacccagcccat

SEQ ID NO: 1512920 - DNA, 23 bp, Homo sapiens
ccacccaggagggagggggctat

SEQ ID NO: 1512921 - DNA, 14 bp, Homo sapiens
ccacccaggctgca

SEQ ID NO: 1512922 - DNA, 17 bp, Homo sapiens
ccacccaggctgcactg

SEQ ID NO: 1512923 - DNA, 13 bp, Homo sapiens
ccacccaggtccc

SEQ ID NO: 1512924 - DNA, 18 bp, Homo sapiens
ccacccaggtcccccgac

SEQ ID NO: 1512925 - DNA, 14 bp, Homo sapiens
ccacccagtccatg

SEQ ID NO: 1512926 - DNA, 20 bp, Homo sapiens
ccacccagtgctgccatgcc

SEQ ID NO: 1512927 - DNA, 19 bp, Homo sapiens
ccacccatcttcctgctgc

SEQ ID NO: 1512928 - DNA, 14 bp, Homo sapiens
ccacccatgatact

SEQ ID NO: 1512929 - DNA, 20 bp, Homo sapiens
ccacccatgcagctgctccc

SEQ ID NO: 1512930 - DNA, 18 bp, Homo sapiens
ccaccccaaacttccagg

SEQ ID NO: 1512931 - DNA, 12 bp, Homo sapiens
ccaccccaacat

SEQ ID NO: 1512932 - DNA, 18 bp, Homo sapiens
ccaccccaactctcccca

SEQ ID NO: 1512933 - DNA, 13 bp, Homo sapiens
ccaccccacactt

SEQ ID NO: 1512934 - DNA, 14 bp, Homo sapiens
ccaccccacctcac

SEQ ID NO: 1512935 - DNA, 21 bp, Homo sapiens
ccaccccacctcacagctact

SEQ ID NO: 1512936 - DNA, 15 bp, Homo sapiens
ccaccccactccagc

SEQ ID NO: 1512937 - DNA, 19 bp, Homo sapiens
ccaccccactccagccctg

SEQ ID NO: 1512938 - DNA, 20 bp, Homo sapiens
ccacccccaaagacctgcct

SEQ ID NO: 1512939 - DNA, 21 bp, Homo sapiens
ccacccccaaagacctgcctg

SEQ ID NO: 1512940 - DNA, 15 bp, Homo sapiens
ccacccccagttcct

SEQ ID NO: 1512941 - DNA, 13 bp, Homo sapiens
ccacccccatctt

SEQ ID NO: 1512942 - DNA, 21 bp, Homo sapiens
ccacccccctctctttctctg

SEQ ID NO: 1512943 - DNA, 22 bp, Homo sapiens
ccacccccctctctttctctgg

SEQ ID NO: 1512944 - DNA, 12 bp, Homo sapiens
ccaccccctcaa

SEQ ID NO: 1512945 - DNA, 14 bp, Homo sapiens
ccaccccctcaagc

SEQ ID NO: 1512946 - DNA, 15 bp, Homo sapiens
ccaccccctcaagcc

SEQ ID NO: 1512947 - DNA, 18 bp, Homo sapiens
ccaccccctccccagggg

SEQ ID NO: 1512948 - DNA, 18 bp, Homo sapiens
ccaccccctcctccccca

SEQ ID NO: 1512949 - DNA, 16 bp, Homo sapiens
ccaccccctgccctgc

SEQ ID NO: 1512950 - DNA, 17 bp, Homo sapiens
ccaccccctgccctgca

SEQ ID NO: 1512951 - DNA, 14 bp, Homo sapiens
ccaccccctgtccc

SEQ ID NO: 1512952 - DNA, 15 bp, Homo sapiens
ccaccccctgtccca

SEQ ID NO: 1512953 - DNA, 20 bp, Homo sapiens
ccacctgcccatcacagggt

SEQ ID NO: 1512954 - DNA, 12 bp, Homo sapiens
ccacctgcctgg

SEQ ID NO: 1512955 - DNA, 14 bp, Homo sapiens
ccacctgcctggtg

SEQ ID NO: 1512956 - DNA, 22 bp, Homo sapiens
ccacctgcctggtgcattgctg

SEQ ID NO: 1512957 - DNA, 15 bp, Homo sapiens
ccacctgctgagaga

SEQ ID NO: 1512958 - DNA, 23 bp, Homo sapiens
ccacctgctgagagacccaagga

SEQ ID NO: 1512959 - DNA, 19 bp, Homo sapiens
ccacctggacgaagagcag

SEQ ID NO: 1512960 - DNA, 21 bp, Homo sapiens
ccacctggacgaagagcaggc

SEQ ID NO: 1512961 - DNA, 14 bp, Homo sapiens
ccacctggccacct

SEQ ID NO: 1512962 - DNA, 23 bp, Homo sapiens
ccacctggtactccctctcagga

SEQ ID NO: 1512963 - DNA, 16 bp, Homo sapiens
ccacctgtctcagcct

SEQ ID NO: 1512964 - DNA, 23 bp, Homo sapiens
ccacctgtctcagcctcccagag

SEQ ID NO: 1512965 - DNA, 16 bp, Homo sapiens
ccacctgttttctgaa

SEQ ID NO: 1512966 - DNA, 13 bp, Homo sapiens
ccaccttcccagc

SEQ ID NO: 1512967 - DNA, 15 bp, Homo sapiens
ccaccttcccagctc

SEQ ID NO: 1512968 - DNA, 20 bp, Homo sapiens
ccaccttgacgtttcttctt

SEQ ID NO: 1512969 - DNA, 17 bp, Homo sapiens
ccacctttattaaaatc

SEQ ID NO: 1512970 - DNA, 18 bp, Homo sapiens
ccacgactggccagggcc

SEQ ID NO: 1512971 - DNA, 19 bp, Homo sapiens
ccacgagcacgagctggaa

SEQ ID NO: 1512972 - DNA, 14 bp, Homo sapiens
ccacgagggctggc

SEQ ID NO: 1512973 - DNA, 15 bp, Homo sapiens
ccacgagtcacctgc

SEQ ID NO: 1512974 - DNA, 19 bp, Homo sapiens
ccacgagtcacctgcaagc

SEQ ID NO: 1512975 - DNA, 21 bp, Homo sapiens
ccacgagtcacctgcaagccc

SEQ ID NO: 1512976 - DNA, 17 bp, Homo sapiens
ccacgatcccctccccc

SEQ ID NO: 1512977 - DNA, 18 bp, Homo sapiens
ccacgatgtggccctggc

SEQ ID NO: 1512978 - DNA, 15 bp, Homo sapiens
ccacgcactgggcca

SEQ ID NO: 1512979 - DNA, 19 bp, Homo sapiens
ccacgcactgggccacgga

SEQ ID NO: 1512980 - DNA, 21 bp, Homo sapiens
ccacgcactgggccacggagg

SEQ ID NO: 1512981 - DNA, 14 bp, Homo sapiens
ccacgcagccagga

SEQ ID NO: 1512982 - DNA, 12 bp, Homo sapiens
ccacgcagggcc

SEQ ID NO: 1512983 - DNA, 17 bp, Homo sapiens
ccacgcccgtcctgcct

SEQ ID NO: 1512984 - DNA, 19 bp, Homo sapiens
ccacgcccgtcctgcctgt

SEQ ID NO: 1512985 - DNA, 23 bp, Homo sapiens
ccacgcccgtcctgcctgtggcg

SEQ ID NO: 1512986 - DNA, 18 bp, Homo sapiens
ccacgcctcaccagcccc

SEQ ID NO: 1512987 - DNA, 21 bp, Homo sapiens
ccacgcctcaccagccccccg

SEQ ID NO: 1512988 - DNA, 18 bp, Homo sapiens
ccacgcctcttgaccagg

SEQ ID NO: 1512989 - DNA, 12 bp, Homo sapiens
ccacgctccagc

SEQ ID NO: 1512990 - DNA, 16 bp, Homo sapiens
ccacgctccagctgcc

SEQ ID NO: 1512991 - DNA, 17 bp, Homo sapiens
ccacggacgctggctcc

SEQ ID NO: 1512992 - DNA, 23 bp, Homo sapiens
ccacggaggagggatgctgctcc

SEQ ID NO: 1512993 - DNA, 19 bp, Homo sapiens
ccacggccccgggtccagg

SEQ ID NO: 1512994 - DNA, 22 bp, Homo sapiens
ccacggccctgtcagagccgcc

SEQ ID NO: 1512995 - DNA, 12 bp, Homo sapiens
ccacggccttgt

SEQ ID NO: 1512996 - DNA, 23 bp, Homo sapiens
ccacggctcactgcagcctcagc

SEQ ID NO: 1512997 - DNA, 16 bp, Homo sapiens
ccacggtgcgtggctg

SEQ ID NO: 1512998 - DNA, 15 bp, Homo sapiens
ccacgtctcctcctc

SEQ ID NO: 1512999 - DNA, 23 bp, Homo sapiens
ccacgtctcctcctcgaagccat

SEQ ID NO: 1513000 - DNA, 13 bp, Homo sapiens
ccacgtctgccag

SEQ ID NO: 1513001 - DNA, 18 bp, Homo sapiens
ccacgtctgccaggccca

SEQ ID NO: 1513002 - DNA, 20 bp, Homo sapiens
ccacgtctgctaacttggag

SEQ ID NO: 1513003 - DNA, 14 bp, Homo sapiens
ccacgtctggctcc

SEQ ID NO: 1513004 - DNA, 18 bp, Homo sapiens
ccacgtctggctccctgc

SEQ ID NO: 1513005 - DNA, 15 bp, Homo sapiens
ccacgtctgtcctcc

SEQ ID NO: 1513006 - DNA, 13 bp, Homo sapiens
ccacgtcttcctc

SEQ ID NO: 1513007 - DNA, 17 bp, Homo sapiens
ccacgtgacagtgcctg

SEQ ID NO: 1513008 - DNA, 20 bp, Homo sapiens
ccacgtgagagaatctgcct

SEQ ID NO: 1513009 - DNA, 22 bp, Homo sapiens
ccacgtggatgggcaaagcttg

SEQ ID NO: 1513010 - DNA, 16 bp, Homo sapiens
ccacgtggggctcact

SEQ ID NO: 1513011 - DNA, 22 bp, Homo sapiens
ccacgtgtaactgtcagccggg

SEQ ID NO: 1513012 - DNA, 23 bp, Homo sapiens
ccacgtgtatagtatctgtatat

SEQ ID NO: 1513013 - DNA, 22 bp, Homo sapiens
ccacgtgtccgtccacccttcc

SEQ ID NO: 1513014 - DNA, 20 bp, Homo sapiens
ccacgttccttactgcagaa

SEQ ID NO: 1513015 - DNA, 14 bp, Homo sapiens
ccacgttctctctg

SEQ ID NO: 1513016 - DNA, 15 bp, Homo sapiens
ccactaaagcttcag

SEQ ID NO: 1513017 - DNA, 14 bp, Homo sapiens
ccactaaatgagct

SEQ ID NO: 1513018 - DNA, 19 bp, Homo sapiens
ccactaaatgagctcctgc

SEQ ID NO: 1513019 - DNA, 20 bp, Homo sapiens
ccactaaatgagctcctgcg

SEQ ID NO: 1513020 - DNA, 17 bp, Homo sapiens
ccactaaccatccccaa

SEQ ID NO: 1513021 - DNA, 18 bp, Homo sapiens
ccactaaccatccccaac

SEQ ID NO: 1513022 - DNA, 20 bp, Homo sapiens
ccactaaccatccccaactc

SEQ ID NO: 1513023 - DNA, 13 bp, Homo sapiens
ccactacacctgg

SEQ ID NO: 1513024 - DNA, 14 bp, Homo sapiens
ccactacacctggc

SEQ ID NO: 1513025 - DNA, 22 bp, Homo sapiens
ccactacactccagcctgagca

SEQ ID NO: 1513026 - DNA, 12 bp, Homo sapiens
ccactaccagcc

SEQ ID NO: 1513027 - DNA, 15 bp, Homo sapiens
ccactaccagccagc

SEQ ID NO: 1513028 - DNA, 16 bp, Homo sapiens
ccactaccccttgatt

SEQ ID NO: 1513029 - DNA, 18 bp, Homo sapiens
ccactacccttctccttt

SEQ ID NO: 1513030 - DNA, 22 bp, Homo sapiens
ccactacccttctcctttcctt

SEQ ID NO: 1513031 - DNA, 12 bp, Homo sapiens
ccactactgcag

SEQ ID NO: 1513032 - DNA, 13 bp, Homo sapiens
ccactactgcagc

SEQ ID NO: 1513033 - DNA, 14 bp, Homo sapiens
ccactactgcagca

SEQ ID NO: 1513034 - DNA, 20 bp, Homo sapiens
ccactactgcagcacctcca

SEQ ID NO: 1513035 - DNA, 18 bp, Homo sapiens
ccactagagggcccatca

SEQ ID NO: 1513036 - DNA, 19 bp, Homo sapiens
ccactaggactctgaggct

SEQ ID NO: 1513037 - DNA, 14 bp, Homo sapiens
ccactaggtgtccc

SEQ ID NO: 1513038 - DNA, 16 bp, Homo sapiens
ccactaggtgtcccca

SEQ ID NO: 1513039 - DNA, 17 bp, Homo sapiens
ccactaggtgtccccaa

SEQ ID NO: 1513040 - DNA, 21 bp, Homo sapiens
ccactatcccaatcaaagaat

SEQ ID NO: 1513041 - DNA, 20 bp, Homo sapiens
ccactatctccgttccatct

SEQ ID NO: 1513042 - DNA, 18 bp, Homo sapiens
ccactatgacagaggatt

SEQ ID NO: 1513043 - DNA, 20 bp, Homo sapiens
ccactcaaattaatctttct

SEQ ID NO: 1513044 - DNA, 13 bp, Homo sapiens
ccactcaacagag

SEQ ID NO: 1513045 - DNA, 13 bp, Homo sapiens
ccactcaccagcc

SEQ ID NO: 1513046 - DNA, 14 bp, Homo sapiens
ccactcaccagccc

SEQ ID NO: 1513047 - DNA, 13 bp, Homo sapiens
ccactcaccaggg

SEQ ID NO: 1513048 - DNA, 14 bp, Homo sapiens
ccactcacctttct

SEQ ID NO: 1513049 - DNA, 21 bp, Homo sapiens
ccactcacctttctccactgg

SEQ ID NO: 1513050 - DNA, 18 bp, Homo sapiens
ccactcactaggccccca

SEQ ID NO: 1513051 - DNA, 17 bp, Homo sapiens
ccactcagccatttccc

SEQ ID NO: 1513052 - DNA, 20 bp, Homo sapiens
ccactcagccatttccccct

SEQ ID NO: 1513053 - DNA, 20 bp, Homo sapiens
ccactcaggaggctgaggca

SEQ ID NO: 1513054 - DNA, 17 bp, Homo sapiens
ccactccagacccctgg

SEQ ID NO: 1513055 - DNA, 21 bp, Homo sapiens
ccactccagacccctggcttt

SEQ ID NO: 1513056 - DNA, 11 bp, Homo sapiens
ccactccagcc

SEQ ID NO: 1513057 - DNA, 12 bp, Homo sapiens
ccactccagccc

SEQ ID NO: 1513058 - DNA, 12 bp, Homo sapiens
ccactccagcct

SEQ ID NO: 1513059 - DNA, 19 bp, Homo sapiens
ccactcccatctgatttac

SEQ ID NO: 1513060 - DNA, 16 bp, Homo sapiens
ccactcccccacctga

SEQ ID NO: 1513061 - DNA, 20 bp, Homo sapiens
ccactcccccgtttctcctt

SEQ ID NO: 1513062 - DNA, 21 bp, Homo sapiens
ccactcccccgtttctccttt

SEQ ID NO: 1513063 - DNA, 14 bp, Homo sapiens
ccactccctgagct

SEQ ID NO: 1513064 - DNA, 14 bp, Homo sapiens
ccactccctgccta

SEQ ID NO: 1513065 - DNA, 20 bp, Homo sapiens
ccactcccttgctggcccca

SEQ ID NO: 1513066 - DNA, 16 bp, Homo sapiens
ccactccgagaggtgg

SEQ ID NO: 1513067 - DNA, 14 bp, Homo sapiens
ccactccggttccc

SEQ ID NO: 1513068 - DNA, 12 bp, Homo sapiens
ccactcctccaa

SEQ ID NO: 1513069 - DNA, 14 bp, Homo sapiens
ccactcctctaaga

SEQ ID NO: 1513070 - DNA, 14 bp, Homo sapiens
ccactcctgtacac

SEQ ID NO: 1513071 - DNA, 15 bp, Homo sapiens
ccactcctgtacact

SEQ ID NO: 1513072 - DNA, 14 bp, Homo sapiens
ccactcctgtcccg

SEQ ID NO: 1513073 - DNA, 20 bp, Homo sapiens
ccactcctgtccctgtagct

SEQ ID NO: 1513074 - DNA, 20 bp, Homo sapiens
ccactcgacccagaatggag

SEQ ID NO: 1513075 - DNA, 16 bp, Homo sapiens
ccactcgatgatgctt

SEQ ID NO: 1513076 - DNA, 14 bp, Homo sapiens
ccactcgcagtcgc

SEQ ID NO: 1513077 - DNA, 23 bp, Homo sapiens
ccactcgtccaagggacagccca

SEQ ID NO: 1513078 - DNA, 21 bp, Homo sapiens
ccactctaggggtcaggctcc

SEQ ID NO: 1513079 - DNA, 15 bp, Homo sapiens
ccactctagttctag

SEQ ID NO: 1513080 - DNA, 16 bp, Homo sapiens
ccactctagttctaga

SEQ ID NO: 1513081 - DNA, 17 bp, Homo sapiens
ccactctatgagttgga

SEQ ID NO: 1513082 - DNA, 12 bp, Homo sapiens
ccactctcccca

SEQ ID NO: 1513083 - DNA, 16 bp, Homo sapiens
ccactctccccacact

SEQ ID NO: 1513084 - DNA, 14 bp, Homo sapiens
ccactctctgggac

SEQ ID NO: 1513085 - DNA, 12 bp, Homo sapiens
ccactctttgaa

SEQ ID NO: 1513086 - DNA, 17 bp, Homo sapiens
ccactcttttgctgtgc

SEQ ID NO: 1513087 - DNA, 15 bp, Homo sapiens
ccactgaaaaaatat

SEQ ID NO: 1513088 - DNA, 22 bp, Homo sapiens
ccactgaaaacatttcaaagct

SEQ ID NO: 1513089 - DNA, 16 bp, Homo sapiens
ccactgaagctgggat

SEQ ID NO: 1513090 - DNA, 21 bp, Homo sapiens
ccactgaagtagtgtgcagtt

SEQ ID NO: 1513091 - DNA, 14 bp, Homo sapiens
ccactgaattcact

SEQ ID NO: 1513092 - DNA, 15 bp, Homo sapiens
ccactgaattcactc

SEQ ID NO: 1513093 - DNA, 21 bp, Homo sapiens
ccactgacacccagtgtcctt

SEQ ID NO: 1513094 - DNA, 15 bp, Homo sapiens
ccactgacagcctcc

SEQ ID NO: 1513095 - DNA, 17 bp, Homo sapiens
ccactgacagcctccca

SEQ ID NO: 1513096 - DNA, 22 bp, Homo sapiens
ccactgagactttcccctctcg

SEQ ID NO: 1513097 - DNA, 11 bp, Homo sapiens
ccactgcactc

SEQ ID NO: 1513098 - DNA, 15 bp, Homo sapiens
ccactgcactccagc

SEQ ID NO: 1513099 - DNA, 19 bp, Homo sapiens
ccactgcactccagcctgg

SEQ ID NO: 1513100 - DNA, 13 bp, Homo sapiens
ccactgcaggccc

SEQ ID NO: 1513101 - DNA, 17 bp, Homo sapiens
ccactgccacaccctcc

SEQ ID NO: 1513102 - DNA, 20 bp, Homo sapiens
ccactgccacaccctcccca

SEQ ID NO: 1513103 - DNA, 13 bp, Homo sapiens
ccactgccagcag

SEQ ID NO: 1513104 - DNA, 16 bp, Homo sapiens
ccactgccagcagcag

SEQ ID NO: 1513105 - DNA, 20 bp, Homo sapiens
ccactgccagcagcagcagg

SEQ ID NO: 1513106 - DNA, 18 bp, Homo sapiens
ccactgccaggcacctgg

SEQ ID NO: 1513107 - DNA, 23 bp, Homo sapiens
ccactgccaggcacctggcctgc

SEQ ID NO: 1513108 - DNA, 11 bp, Homo sapiens
ccactgccatg

SEQ ID NO: 1513109 - DNA, 21 bp, Homo sapiens
ccactgccccccgaggctgct

SEQ ID NO: 1513110 - DNA, 17 bp, Homo sapiens
ccactgccccctgctgc

SEQ ID NO: 1513111 - DNA, 12 bp, Homo sapiens
ccactgccctgc

SEQ ID NO: 1513112 - DNA, 16 bp, Homo sapiens
ccactgccctggcagc

SEQ ID NO: 1513113 - DNA, 18 bp, Homo sapiens
ccactgcctgcctcccct

SEQ ID NO: 1513114 - DNA, 21 bp, Homo sapiens
ccactgcctgcctcccctccg

SEQ ID NO: 1513115 - DNA, 21 bp, Homo sapiens
ccactgccttcgatacaccgg

SEQ ID NO: 1513116 - DNA, 14 bp, Homo sapiens
ccactgccttcgct

SEQ ID NO: 1513117 - DNA, 15 bp, Homo sapiens
ccactgctctcagcc

SEQ ID NO: 1513118 - DNA, 19 bp, Homo sapiens
ccactgctctcagcctccc

SEQ ID NO: 1513119 - DNA, 11 bp, Homo sapiens
ccactgctgga

SEQ ID NO: 1513120 - DNA, 14 bp, Homo sapiens
ccactgctggacat

SEQ ID NO: 1513121 - DNA, 13 bp, Homo sapiens
ccactgcttccca

SEQ ID NO: 1513122 - DNA, 15 bp, Homo sapiens
ccactgcttcccact

SEQ ID NO: 1513123 - DNA, 14 bp, Homo sapiens
ccactgcttctctt

SEQ ID NO: 1513124 - DNA, 15 bp, Homo sapiens
ccactgcttctcttt

SEQ ID NO: 1513125 - DNA, 21 bp, Homo sapiens
ccactggacttgagcttggca

SEQ ID NO: 1513126 - DNA, 22 bp, Homo sapiens
ccactggcatagccctcctgag

SEQ ID NO: 1513127 - DNA, 12 bp, Homo sapiens
ccactggccacc

SEQ ID NO: 1513128 - DNA, 14 bp, Homo sapiens
ccactggccaccag

SEQ ID NO: 1513129 - DNA, 16 bp, Homo sapiens
ccactggccaccaggc

SEQ ID NO: 1513130 - DNA, 19 bp, Homo sapiens
ccactggccaccaggctgg

SEQ ID NO: 1513131 - DNA, 16 bp, Homo sapiens
ccactgggacagctgg

SEQ ID NO: 1513132 - DNA, 19 bp, Homo sapiens
ccactgggacagctggctg

SEQ ID NO: 1513133 - DNA, 22 bp, Homo sapiens
ccactgggacagctggctgggc

SEQ ID NO: 1513134 - DNA, 17 bp, Homo sapiens
ccactgggaccaaccct

SEQ ID NO: 1513135 - DNA, 19 bp, Homo sapiens
ccactgggacccgaggatt

SEQ ID NO: 1513136 - DNA, 22 bp, Homo sapiens
ccactgggacccgaggatttct

SEQ ID NO: 1513137 - DNA, 15 bp, Homo sapiens
ccactgggcacctgc

SEQ ID NO: 1513138 - DNA, 22 bp, Homo sapiens
ccactgggccagccctgcagcc

SEQ ID NO: 1513139 - DNA, 22 bp, Homo sapiens
ccactggggccggcggggccca

SEQ ID NO: 1513140 - DNA, 22 bp, Homo sapiens
ccactgggtacaagagatggga

SEQ ID NO: 1513141 - DNA, 20 bp, Homo sapiens
ccactgggtctcactcctga

SEQ ID NO: 1513142 - DNA, 21 bp, Homo sapiens
ccactgggtctcactcctgag

SEQ ID NO: 1513143 - DNA, 17 bp, Homo sapiens
ccactgggtgagagagg

SEQ ID NO: 1513144 - DNA, 21 bp, Homo sapiens
ccactggttaaaataaagcct

SEQ ID NO: 1513145 - DNA, 16 bp, Homo sapiens
ccactggtttctcaga

SEQ ID NO: 1513146 - DNA, 15 bp, Homo sapiens
ccactgtcctgggcc

SEQ ID NO: 1513147 - DNA, 23 bp, Homo sapiens
ccactgtgacgtcggccgaccag

SEQ ID NO: 1513148 - DNA, 12 bp, Homo sapiens
ccactgtggcca

SEQ ID NO: 1513149 - DNA, 14 bp, Homo sapiens
ccactgtggccaga

SEQ ID NO: 1513150 - DNA, 16 bp, Homo sapiens
ccactgtggccagagc

SEQ ID NO: 1513151 - DNA, 18 bp, Homo sapiens
ccactgtggccagagctg

SEQ ID NO: 1513152 - DNA, 17 bp, Homo sapiens
ccactgttgagccccag

SEQ ID NO: 1513153 - DNA, 22 bp, Homo sapiens
ccactgttgagccccagtgctg

SEQ ID NO: 1513154 - DNA, 19 bp, Homo sapiens
ccacttagccgtccatggc

SEQ ID NO: 1513155 - DNA, 20 bp, Homo sapiens
ccacttagccgtccatggca

SEQ ID NO: 1513156 - DNA, 21 bp, Homo sapiens
ccacttagccgtccatggcac

SEQ ID NO: 1513157 - DNA, 22 bp, Homo sapiens
ccacttagccgtccatggcacc

SEQ ID NO: 1513158 - DNA, 13 bp, Homo sapiens
ccacttcaataga

SEQ ID NO: 1513159 - DNA, 14 bp, Homo sapiens
ccacttcaccccca

SEQ ID NO: 1513160 - DNA, 13 bp, Homo sapiens
ccacttcactgcg

SEQ ID NO: 1513161 - DNA, 21 bp, Homo sapiens
ccacttcattcttgaaagctg

SEQ ID NO: 1513162 - DNA, 13 bp, Homo sapiens
ccacttccagggg

SEQ ID NO: 1513163 - DNA, 18 bp, Homo sapiens
ccacttccaggggaacct

SEQ ID NO: 1513164 - DNA, 15 bp, Homo sapiens
ccacttcccaccctg

SEQ ID NO: 1513165 - DNA, 17 bp, Homo sapiens
ccacttcctgaggcctc

SEQ ID NO: 1513166 - DNA, 13 bp, Homo sapiens
ccacttcctttta

SEQ ID NO: 1513167 - DNA, 16 bp, Homo sapiens
ccacttctccatgctg

SEQ ID NO: 1513168 - DNA, 19 bp, Homo sapiens
ccacttctccatgctgcaa

SEQ ID NO: 1513169 - DNA, 11 bp, Homo sapiens
ccacttctccc

SEQ ID NO: 1513170 - DNA, 13 bp, Homo sapiens
ccacttctcccca

SEQ ID NO: 1513171 - DNA, 18 bp, Homo sapiens
ccacttctggcttcagcc

SEQ ID NO: 1513172 - DNA, 22 bp, Homo sapiens
ccacttctggcttcagccccca

SEQ ID NO: 1513173 - DNA, 14 bp, Homo sapiens
ccacttctggtata

SEQ ID NO: 1513174 - DNA, 18 bp, Homo sapiens
ccacttctggtataattg

SEQ ID NO: 1513175 - DNA, 19 bp, Homo sapiens
ccacttcttaaaggcctgg

SEQ ID NO: 1513176 - DNA, 14 bp, Homo sapiens
ccagagacaggaaa

SEQ ID NO: 1513177 - DNA, 15 bp, Homo sapiens
ccagagacaggaaaa

SEQ ID NO: 1513178 - DNA, 18 bp, Homo sapiens
ccagagacatacttgaag

SEQ ID NO: 1513179 - DNA, 16 bp, Homo sapiens
ccagagaccacaccac

SEQ ID NO: 1513180 - DNA, 14 bp, Homo sapiens
ccagagaggagcac

SEQ ID NO: 1513181 - DNA, 19 bp, Homo sapiens
ccagagaggagcacctgaa

SEQ ID NO: 1513182 - DNA, 14 bp, Homo sapiens
ccagagagggccca

SEQ ID NO: 1513183 - DNA, 17 bp, Homo sapiens
ccagagagggcccagct

SEQ ID NO: 1513184 - DNA, 19 bp, Homo sapiens
ccagagaggggctgctctc

SEQ ID NO: 1513185 - DNA, 13 bp, Homo sapiens
ccagagatccaaa

SEQ ID NO: 1513186 - DNA, 15 bp, Homo sapiens
ccagagatgcctcca

SEQ ID NO: 1513187 - DNA, 12 bp, Homo sapiens
ccagagcaggag

SEQ ID NO: 1513188 - DNA, 19 bp, Homo sapiens
ccagagcaggagcccctgg

SEQ ID NO: 1513189 - DNA, 19 bp, Homo sapiens
ccagagcaggaggcccctg

SEQ ID NO: 1513190 - DNA, 18 bp, Homo sapiens
ccagagcatttccaacac

SEQ ID NO: 1513191 - DNA, 21 bp, Homo sapiens
ccagagcatttccaacaccac

SEQ ID NO: 1513192 - DNA, 21 bp, Homo sapiens
ccagagccaacctggacttcc

SEQ ID NO: 1513193 - DNA, 23 bp, Homo sapiens
ccagagccaacctggacttcctg

SEQ ID NO: 1513194 - DNA, 13 bp, Homo sapiens
ccagagccacctg

SEQ ID NO: 1513195 - DNA, 15 bp, Homo sapiens
ccagagccacctgga

SEQ ID NO: 1513196 - DNA, 18 bp, Homo sapiens
ccagagccagatgcagga

SEQ ID NO: 1513197 - DNA, 19 bp, Homo sapiens
ccagagccagatgcaggac

SEQ ID NO: 1513198 - DNA, 14 bp, Homo sapiens
ccagagccagcctg

SEQ ID NO: 1513199 - DNA, 15 bp, Homo sapiens
ccagagccagcctgg

SEQ ID NO: 1513200 - DNA, 17 bp, Homo sapiens
ccagagcccagctcttg

SEQ ID NO: 1513201 - DNA, 16 bp, Homo sapiens
ccagagcccatgctca

SEQ ID NO: 1513202 - DNA, 14 bp, Homo sapiens
ccagagccgggagg

SEQ ID NO: 1513203 - DNA, 21 bp, Homo sapiens
ccagagcgtgcacttgtgatc

SEQ ID NO: 1513204 - DNA, 17 bp, Homo sapiens
ccagagctcatcccccc

SEQ ID NO: 1513205 - DNA, 12 bp, Homo sapiens
ccagagctggaa

SEQ ID NO: 1513206 - DNA, 14 bp, Homo sapiens
ccagagctggaagg

SEQ ID NO: 1513207 - DNA, 15 bp, Homo sapiens
ccagagctggaaggc

SEQ ID NO: 1513208 - DNA, 18 bp, Homo sapiens
ccagagctggaaggcagg

SEQ ID NO: 1513209 - DNA, 12 bp, Homo sapiens
ccagagctgtgc

SEQ ID NO: 1513210 - DNA, 19 bp, Homo sapiens
ccagagctgtgccagcagg

SEQ ID NO: 1513211 - DNA, 21 bp, Homo sapiens
ccagagctgtgcctgctcagc

SEQ ID NO: 1513212 - DNA, 22 bp, Homo sapiens
ccagagctgtgcctgctcagca

SEQ ID NO: 1513213 - DNA, 19 bp, Homo sapiens
ccagagctgtttatggcct

SEQ ID NO: 1513214 - DNA, 20 bp, Homo sapiens
ccagagcttattggccactg

SEQ ID NO: 1513215 - DNA, 22 bp, Homo sapiens
ccagagcttattggccactggg

SEQ ID NO: 1513216 - DNA, 21 bp, Homo sapiens
ccagagcttctctgggctgaa

SEQ ID NO: 1513217 - DNA, 17 bp, Homo sapiens
ccagaggaaggaaaagg

SEQ ID NO: 1513218 - DNA, 18 bp, Homo sapiens
ccagaggaatcctggcag

SEQ ID NO: 1513219 - DNA, 13 bp, Homo sapiens
ccagaggagacat

SEQ ID NO: 1513220 - DNA, 14 bp, Homo sapiens
ccagaggagcagct

SEQ ID NO: 1513221 - DNA, 19 bp, Homo sapiens
ccagaggagccaccagttc

SEQ ID NO: 1513222 - DNA, 13 bp, Homo sapiens
ccagaggagcctt

SEQ ID NO: 1513223 - DNA, 15 bp, Homo sapiens
ccagaggagcctttt

SEQ ID NO: 1513224 - DNA, 17 bp, Homo sapiens
ccagaggagccttttta

SEQ ID NO: 1513225 - DNA, 21 bp, Homo sapiens
ccagaggagctgggagccggg

SEQ ID NO: 1513226 - DNA, 17 bp, Homo sapiens
ccagaggagtttcttaa

SEQ ID NO: 1513227 - DNA, 12 bp, Homo sapiens
ccagaggcagag

SEQ ID NO: 1513228 - DNA, 16 bp, Homo sapiens
ccagaggcagagcctg

SEQ ID NO: 1513229 - DNA, 13 bp, Homo sapiens
ccagaggccctgg

SEQ ID NO: 1513230 - DNA, 14 bp, Homo sapiens
ccagaggccctgga

SEQ ID NO: 1513231 - DNA, 23 bp, Homo sapiens
ccagaggccctggaggtctccag

SEQ ID NO: 1513232 - DNA, 22 bp, Homo sapiens
ccagaggccgaaggtgcctcag

SEQ ID NO: 1513233 - DNA, 13 bp, Homo sapiens
ccagaggctccca

SEQ ID NO: 1513234 - DNA, 22 bp, Homo sapiens
ccagaggctcccaatcagcttt

SEQ ID NO: 1513235 - DNA, 11 bp, Homo sapiens
ccagagggcca

SEQ ID NO: 1513236 - DNA, 17 bp, Homo sapiens
ccagagggcccaggcag

SEQ ID NO: 1513237 - DNA, 11 bp, Homo sapiens
ccagaggtgga

SEQ ID NO: 1513238 - DNA, 18 bp, Homo sapiens
ccagaggtggagccaagt

SEQ ID NO: 1513239 - DNA, 14 bp, Homo sapiens
ccagaggtggatgt

SEQ ID NO: 1513240 - DNA, 21 bp, Homo sapiens
ccagaggtgggatcctccctc

SEQ ID NO: 1513241 - DNA, 15 bp, Homo sapiens
ccagaggtgggcagg

SEQ ID NO: 1513242 - DNA, 22 bp, Homo sapiens
ccagaggttatctgcctggcct

SEQ ID NO: 1513243 - DNA, 23 bp, Homo sapiens
ccagaggttatctgcctggcctg

SEQ ID NO: 1513244 - DNA, 16 bp, Homo sapiens
ccagagtcctttccaa

SEQ ID NO: 1513245 - DNA, 13 bp, Homo sapiens
ccagagtctgagc

SEQ ID NO: 1513246 - DNA, 15 bp, Homo sapiens
ccagagtctgagccc

SEQ ID NO: 1513247 - DNA, 16 bp, Homo sapiens
ccagagtctgagcccc

SEQ ID NO: 1513248 - DNA, 18 bp, Homo sapiens
ccagagtgctgaaggaat

SEQ ID NO: 1513249 - DNA, 20 bp, Homo sapiens
ccagagtggagtctgagtct

SEQ ID NO: 1513250 - DNA, 15 bp, Homo sapiens
ccagagtggcctggc

SEQ ID NO: 1513251 - DNA, 16 bp, Homo sapiens
ccagagtggcctggcc

SEQ ID NO: 1513252 - DNA, 18 bp, Homo sapiens
ccagagtggcctggccag

SEQ ID NO: 1513253 - DNA, 19 bp, Homo sapiens
ccagagtggcctggccagg

SEQ ID NO: 1513254 - DNA, 21 bp, Homo sapiens
ccagagtggcctggccaggag

SEQ ID NO: 1513255 - DNA, 13 bp, Homo sapiens
ccagagttcctgc

SEQ ID NO: 1513256 - DNA, 15 bp, Homo sapiens
ccagagttgctgtgc

SEQ ID NO: 1513257 - DNA, 19 bp, Homo sapiens
ccagagttttggtttttga

SEQ ID NO: 1513258 - DNA, 24 bp, Homo sapiens
ccagataactctctttccttgagc

SEQ ID NO: 1513259 - DNA, 20 bp, Homo sapiens
ccagatagtgtagctgagga

SEQ ID NO: 1513260 - DNA, 14 bp, Homo sapiens
ccagatataactgt

SEQ ID NO: 1513261 - DNA, 20 bp, Homo sapiens
ccagatataactgtcttgtt

SEQ ID NO: 1513262 - DNA, 15 bp, Homo sapiens
ccagatcactgccac

SEQ ID NO: 1513263 - DNA, 16 bp, Homo sapiens
ccagatcactgccaca

SEQ ID NO: 1513264 - DNA, 13 bp, Homo sapiens
ccagatcagtcag

SEQ ID NO: 1513265 - DNA, 18 bp, Homo sapiens
ccagatcgatcctggatt

SEQ ID NO: 1513266 - DNA, 21 bp, Homo sapiens
ccagatctttctcttccctga

SEQ ID NO: 1513267 - DNA, 22 bp, Homo sapiens
ccagatctttctcttccctgaa

SEQ ID NO: 1513268 - DNA, 19 bp, Homo sapiens
ccagatgaggctggccaag

SEQ ID NO: 1513269 - DNA, 13 bp, Homo sapiens
ccagatgcaggac

SEQ ID NO: 1513270 - DNA, 15 bp, Homo sapiens
ccagatgcaggacag

SEQ ID NO: 1513271 - DNA, 16 bp, Homo sapiens
ccagatgcaggacagg

SEQ ID NO: 1513272 - DNA, 17 bp, Homo sapiens
ccagatgcaggacagga

SEQ ID NO: 1513273 - DNA, 19 bp, Homo sapiens
ccagatgcaggacaggagg

SEQ ID NO: 1513274 - DNA, 20 bp, Homo sapiens
ccagatgcaggacaggaggc

SEQ ID NO: 1513275 - DNA, 14 bp, Homo sapiens
ccagatgcctcccc

SEQ ID NO: 1513276 - DNA, 20 bp, Homo sapiens
ccagatgccttctagattca

SEQ ID NO: 1513277 - DNA, 21 bp, Homo sapiens
ccagatgcgtcccaagatgtt

SEQ ID NO: 1513278 - DNA, 17 bp, Homo sapiens
ccagatggcccccagct

SEQ ID NO: 1513279 - DNA, 19 bp, Homo sapiens
ccagatggcccccagctgg

SEQ ID NO: 1513280 - DNA, 22 bp, Homo sapiens
ccagatggctggaaggggtcca

SEQ ID NO: 1513281 - DNA, 13 bp, Homo sapiens
ccagatgttgctt

SEQ ID NO: 1513282 - DNA, 17 bp, Homo sapiens
ccagatgttgttcctgg

SEQ ID NO: 1513283 - DNA, 23 bp, Homo sapiens
ccagatgtttccagacttccttg

SEQ ID NO: 1513284 - DNA, 12 bp, Homo sapiens
ccagattctgat

SEQ ID NO: 1513285 - DNA, 16 bp, Homo sapiens
ccagattggctcacac

SEQ ID NO: 1513286 - DNA, 21 bp, Homo sapiens
ccagattggctcacactgaga

SEQ ID NO: 1513287 - DNA, 14 bp, Homo sapiens
ccagattgtgtaca

SEQ ID NO: 1513288 - DNA, 17 bp, Homo sapiens
ccagcaaattgctagtc

SEQ ID NO: 1513289 - DNA, 16 bp, Homo sapiens
ccagcaacacagcctg

SEQ ID NO: 1513290 - DNA, 12 bp, Homo sapiens
ccagccaggcgg

SEQ ID NO: 1513291 - DNA, 14 bp, Homo sapiens
ccagccagtcttgc

SEQ ID NO: 1513292 - DNA, 22 bp, Homo sapiens
ccagccagtcttgcctaggcca

SEQ ID NO: 1513293 - DNA, 15 bp, Homo sapiens
ccagccatctgccca

SEQ ID NO: 1513294 - DNA, 11 bp, Homo sapiens
ccagcccaata

SEQ ID NO: 1513295 - DNA, 12 bp, Homo sapiens
ccagcccaataa

SEQ ID NO: 1513296 - DNA, 13 bp, Homo sapiens
ccagcccaataaa

SEQ ID NO: 1513297 - DNA, 14 bp, Homo sapiens
ccagcccaataaag

SEQ ID NO: 1513298 - DNA, 13 bp, Homo sapiens
ccagcccagagac

SEQ ID NO: 1513299 - DNA, 14 bp, Homo sapiens
ccagcccagagaca

SEQ ID NO: 1513300 - DNA, 20 bp, Homo sapiens
ccagcccagagccacctgga

SEQ ID NO: 1513301 - DNA, 15 bp, Homo sapiens
ccagcccagagcccg

SEQ ID NO: 1513302 - DNA, 16 bp, Homo sapiens
ccagcccagagcccgg

SEQ ID NO: 1513303 - DNA, 13 bp, Homo sapiens
ccagcccagccag

SEQ ID NO: 1513304 - DNA, 15 bp, Homo sapiens
ccagcccagccaggc

SEQ ID NO: 1513305 - DNA, 12 bp, Homo sapiens
ccagcccagccc

SEQ ID NO: 1513306 - DNA, 12 bp, Homo sapiens
ccagcccaggag

SEQ ID NO: 1513307 - DNA, 22 bp, Homo sapiens
ccagcccaggagtttgaggctg

SEQ ID NO: 1513308 - DNA, 23 bp, Homo sapiens
ccagcccaggagtttgaggctgc

SEQ ID NO: 1513309 - DNA, 14 bp, Homo sapiens
ccagcccagggctc

SEQ ID NO: 1513310 - DNA, 21 bp, Homo sapiens
ccagcccatccattaggccag

SEQ ID NO: 1513311 - DNA, 22 bp, Homo sapiens
ccagcccatccattaggccagc

SEQ ID NO: 1513312 - DNA, 20 bp, Homo sapiens
ccagcccatggcccccaata

SEQ ID NO: 1513313 - DNA, 14 bp, Homo sapiens
ccagcccattgctg

SEQ ID NO: 1513314 - DNA, 16 bp, Homo sapiens
ccagccccaagctggg

SEQ ID NO: 1513315 - DNA, 14 bp, Homo sapiens
ccagccccacccag

SEQ ID NO: 1513316 - DNA, 16 bp, Homo sapiens
ccaggcctgcctccca

SEQ ID NO: 1513317 - DNA, 19 bp, Homo sapiens
ccaggcctggcctctgggc

SEQ ID NO: 1513318 - DNA, 13 bp, Homo sapiens
ccaggcctgttgc

SEQ ID NO: 1513319 - DNA, 16 bp, Homo sapiens
ccaggcgctaattcaa

SEQ ID NO: 1513320 - DNA, 17 bp, Homo sapiens
ccaggcgggctcaagga

SEQ ID NO: 1513321 - DNA, 14 bp, Homo sapiens
ccaggcgtgggacg

SEQ ID NO: 1513322 - DNA, 13 bp, Homo sapiens
ccaggctcactca

SEQ ID NO: 1513323 - DNA, 17 bp, Homo sapiens
ccaggctcactcacaga

SEQ ID NO: 1513324 - DNA, 15 bp, Homo sapiens
ccaggctccttcctg

SEQ ID NO: 1513325 - DNA, 20 bp, Homo sapiens
ccaggctcggaggaccctgg

SEQ ID NO: 1513326 - DNA, 18 bp, Homo sapiens
ccaggctcgtggactgag

SEQ ID NO: 1513327 - DNA, 23 bp, Homo sapiens
ccaggctctcgcacacctctgca

SEQ ID NO: 1513328 - DNA, 21 bp, Homo sapiens
ccaggctctcgctgccctgtg

SEQ ID NO: 1513329 - DNA, 14 bp, Homo sapiens
ccaggctcttcctg

SEQ ID NO: 1513330 - DNA, 14 bp, Homo sapiens
ccaggctgagagcc

SEQ ID NO: 1513331 - DNA, 16 bp, Homo sapiens
ccaggctgagagccag

SEQ ID NO: 1513332 - DNA, 19 bp, Homo sapiens
ccaggctgagagccagatg

SEQ ID NO: 1513333 - DNA, 14 bp, Homo sapiens
ccaggctgagccat

SEQ ID NO: 1513334 - DNA, 15 bp, Homo sapiens
ccaggctgagccatg

SEQ ID NO: 1513335 - DNA, 18 bp, Homo sapiens
ccaggctgagccatgagg

SEQ ID NO: 1513336 - DNA, 20 bp, Homo sapiens
ccaggctgagccatgaggag

SEQ ID NO: 1513337 - DNA, 16 bp, Homo sapiens
ccaggctgcacagcat

SEQ ID NO: 1513338 - DNA, 15 bp, Homo sapiens
ccaggctgcactgca

SEQ ID NO: 1513339 - DNA, 16 bp, Homo sapiens
ccaggctgcactgcag

SEQ ID NO: 1513340 - DNA, 15 bp, Homo sapiens
ccaggctgcagcctc

SEQ ID NO: 1513341 - DNA, 17 bp, Homo sapiens
ccaggctgcagcctcca

SEQ ID NO: 1513342 - DNA, 18 bp, Homo sapiens
ccaggctgcagcctccac

SEQ ID NO: 1513343 - DNA, 20 bp, Homo sapiens
ccaggctgccaaggccagag

SEQ ID NO: 1513344 - DNA, 18 bp, Homo sapiens
ccaggctgccgtggggcc

SEQ ID NO: 1513345 - DNA, 23 bp, Homo sapiens
ccaggctgcctcccttgtggcag

SEQ ID NO: 1513346 - DNA, 20 bp, Homo sapiens
ccaggctgcctcctgccctt

SEQ ID NO: 1513347 - DNA, 20 bp, Homo sapiens
ccaggctgcctcggactcca

SEQ ID NO: 1513348 - DNA, 17 bp, Homo sapiens
ccaggctgctcagggct

SEQ ID NO: 1513349 - DNA, 19 bp, Homo sapiens
ccaggctgctcagggctgg

SEQ ID NO: 1513350 - DNA, 12 bp, Homo sapiens
ccaggctggagc

SEQ ID NO: 1513351 - DNA, 15 bp, Homo sapiens
ccaggctggagctgg

SEQ ID NO: 1513352 - DNA, 17 bp, Homo sapiens
ccaggctggagtgcagt

SEQ ID NO: 1513353 - DNA, 17 bp, Homo sapiens
ccaggctggccagtgct

SEQ ID NO: 1513354 - DNA, 16 bp, Homo sapiens
ccaggctggcgcagcc

SEQ ID NO: 1513355 - DNA, 17 bp, Homo sapiens
ccaggctggcgcagcca

SEQ ID NO: 1513356 - DNA, 19 bp, Homo sapiens
ccaggctgggctctgcctg

SEQ ID NO: 1513357 - DNA, 14 bp, Homo sapiens
ccaggctggtctca

SEQ ID NO: 1513358 - DNA, 23 bp, Homo sapiens
ccaggctgttcttcaactcctgg

SEQ ID NO: 1513359 - DNA, 13 bp, Homo sapiens
ccaggctgtttca

SEQ ID NO: 1513360 - DNA, 18 bp, Homo sapiens
ccaggcttcaccctgaat

SEQ ID NO: 1513361 - DNA, 21 bp, Homo sapiens
ccaggcttcctgggtcctgcc

SEQ ID NO: 1513362 - DNA, 17 bp, Homo sapiens
ccagggaagctgtccct

SEQ ID NO: 1513363 - DNA, 13 bp, Homo sapiens
ccagggaaggaaa

SEQ ID NO: 1513364 - DNA, 17 bp, Homo sapiens
ccagggaaggtggggcc

SEQ ID NO: 1513365 - DNA, 13 bp, Homo sapiens
ccagggacagagg

SEQ ID NO: 1513366 - DNA, 18 bp, Homo sapiens
ccagggacagaggcccca

SEQ ID NO: 1513367 - DNA, 22 bp, Homo sapiens
ccagggacagaggccccagcct

SEQ ID NO: 1513368 - DNA, 23 bp, Homo sapiens
ccagggacagaggccccagcctc

SEQ ID NO: 1513369 - DNA, 12 bp, Homo sapiens
ccagggacccag

SEQ ID NO: 1513370 - DNA, 21 bp, Homo sapiens
ccagggacccaggtgtgcctg

SEQ ID NO: 1513371 - DNA, 17 bp, Homo sapiens
ccagggacccccagaac

SEQ ID NO: 1513372 - DNA, 17 bp, Homo sapiens
ccagggactatctttgc

SEQ ID NO: 1513373 - DNA, 17 bp, Homo sapiens
cccaaacacttctgctt

SEQ ID NO: 1513374 - DNA, 13 bp, Homo sapiens
cccaaaccctgct

SEQ ID NO: 1513375 - DNA, 22 bp, Homo sapiens
cccaaacgccctttcctcctca

SEQ ID NO: 1513376 - DNA, 23 bp, Homo sapiens
cccaaacgccctttcctcctcag

SEQ ID NO: 1513377 - DNA, 23 bp, Homo sapiens
cccaaactgttgattattagcca

SEQ ID NO: 1513378 - DNA, 18 bp, Homo sapiens
cccaaagactctggaggt

SEQ ID NO: 1513379 - DNA, 17 bp, Homo sapiens
cccaaagatagacaggt

SEQ ID NO: 1513380 - DNA, 19 bp, Homo sapiens
cccaaagcggtccctgtcc

SEQ ID NO: 1513381 - DNA, 15 bp, Homo sapiens
cccaaagctcagact

SEQ ID NO: 1513382 - DNA, 16 bp, Homo sapiens
cccaaagctgagcctg

SEQ ID NO: 1513383 - DNA, 14 bp, Homo sapiens
cccaaagctttcct

SEQ ID NO: 1513384 - DNA, 14 bp, Homo sapiens
cccaaagtcctctg

SEQ ID NO: 1513385 - DNA, 15 bp, Homo sapiens
cccaaagtcctctgc

SEQ ID NO: 1513386 - DNA, 23 bp, Homo sapiens
cccaaagttgttgtaacctgctg

SEQ ID NO: 1513387 - DNA, 17 bp, Homo sapiens
cccaaatgatggatcac

SEQ ID NO: 1513388 - DNA, 15 bp, Homo sapiens
cccaaattgccttca

SEQ ID NO: 1513389 - DNA, 17 bp, Homo sapiens
cccaaattgccttcagc

SEQ ID NO: 1513390 - DNA, 12 bp, Homo sapiens
cccaacactgtg

SEQ ID NO: 1513391 - DNA, 19 bp, Homo sapiens
cccaacactgtgccctggt

SEQ ID NO: 1513392 - DNA, 22 bp, Homo sapiens
cccaacactgtgccctggtgga

SEQ ID NO: 1513393 - DNA, 13 bp, Homo sapiens
cccaacagcactt

SEQ ID NO: 1513394 - DNA, 22 bp, Homo sapiens
cccaacaggtgctgaactgtgc

SEQ ID NO: 1513395 - DNA, 19 bp, Homo sapiens
cccaacccccctcctgctc

SEQ ID NO: 1513396 - DNA, 20 bp, Homo sapiens
cccaaccccgcggtgctctg

SEQ ID NO: 1513397 - DNA, 21 bp, Homo sapiens
cccaaccccgcggtgctctgg

SEQ ID NO: 1513398 - DNA, 22 bp, Homo sapiens
cccaaccccgcggtgctctggc

SEQ ID NO: 1513399 - DNA, 13 bp, Homo sapiens
cccaacctcaatg

SEQ ID NO: 1513400 - DNA, 15 bp, Homo sapiens
cccaacctcaatgcc

SEQ ID NO: 1513401 - DNA, 19 bp, Homo sapiens
cccaacctcaatgccctgc

SEQ ID NO: 1513402 - DNA, 20 bp, Homo sapiens
cccaacctcaatgccctgcc

SEQ ID NO: 1513403 - DNA, 16 bp, Homo sapiens
cccaacgcacaggaaa

SEQ ID NO: 1513404 - DNA, 14 bp, Homo sapiens
cccaacgtcccctc

SEQ ID NO: 1513405 - DNA, 19 bp, Homo sapiens
cccaacgtcccctccgccg

SEQ ID NO: 1513406 - DNA, 23 bp, Homo sapiens
cccaacgtcccctccgccgtgcc

SEQ ID NO: 1513407 - DNA, 12 bp, Homo sapiens
cccaactcctgg

SEQ ID NO: 1513408 - DNA, 15 bp, Homo sapiens
cccaactctccccag

SEQ ID NO: 1513409 - DNA, 16 bp, Homo sapiens
cccaactctccccagt

SEQ ID NO: 1513410 - DNA, 17 bp, Homo sapiens
cccaactctccccagtg

SEQ ID NO: 1513411 - DNA, 23 bp, Homo sapiens
cccaactcttgcacagtcactgc

SEQ ID NO: 1513412 - DNA, 19 bp, Homo sapiens
cccaactgtggtagctcca

SEQ ID NO: 1513413 - DNA, 13 bp, Homo sapiens
cccaacttcttcc

SEQ ID NO: 1513414 - DNA, 18 bp, Homo sapiens
cccaacttgcctttgaag

SEQ ID NO: 1513415 - DNA, 20 bp, Homo sapiens
cccaagaatagatgctgact

SEQ ID NO: 1513416 - DNA, 21 bp, Homo sapiens
cccaagaatagatgctgactg

SEQ ID NO: 1513417 - DNA, 20 bp, Homo sapiens
cccaagaatgcaagatttca

SEQ ID NO: 1513418 - DNA, 18 bp, Homo sapiens
cccaagacagatgcccca

SEQ ID NO: 1513419 - DNA, 15 bp, Homo sapiens
cccaagagatgaaga

SEQ ID NO: 1513420 - DNA, 21 bp, Homo sapiens
cccaagagccctgtggccgcc

SEQ ID NO: 1513421 - DNA, 16 bp, Homo sapiens
cccaagaggtctgagc

SEQ ID NO: 1513422 - DNA, 22 bp, Homo sapiens
cccaagatgggcatcttttgta

SEQ ID NO: 1513423 - DNA, 13 bp, Homo sapiens
cccaagcagccag

SEQ ID NO: 1513424 - DNA, 12 bp, Homo sapiens
cccaagcctgat

SEQ ID NO: 1513425 - DNA, 18 bp, Homo sapiens
cccaagcgttcctggcct

SEQ ID NO: 1513426 - DNA, 22 bp, Homo sapiens
cccaagcgttcctggccttctg

SEQ ID NO: 1513427 - DNA, 13 bp, Homo sapiens
cccaagctgtggc

SEQ ID NO: 1513428 - DNA, 16 bp, Homo sapiens
cccaagctgtggcagc

SEQ ID NO: 1513429 - DNA, 21 bp, Homo sapiens
cccaagctgtggcagccgtcc

SEQ ID NO: 1513430 - DNA, 14 bp, Homo sapiens
cccaagcttagaac

SEQ ID NO: 1513431 - DNA, 14 bp, Homo sapiens
cccaagcttggcag

SEQ ID NO: 1513432 - DNA, 15 bp, Homo sapiens
cccaaggactgaggg

SEQ ID NO: 1513433 - DNA, 23 bp, Homo sapiens
cccaaggagctgatttccaggcc

SEQ ID NO: 1513434 - DNA, 15 bp, Homo sapiens
cccaaggagcttacc

SEQ ID NO: 1513435 - DNA, 15 bp, Homo sapiens
cccaaggaggaaaaa

SEQ ID NO: 1513436 - DNA, 13 bp, Homo sapiens
cccaaggcctctc

SEQ ID NO: 1513437 - DNA, 16 bp, Homo sapiens
cccaaggcctctctct

SEQ ID NO: 1513438 - DNA, 16 bp, Homo sapiens
cccaagggcccagacc

SEQ ID NO: 1513439 - DNA, 13 bp, Homo sapiens
cccaagggccctg

SEQ ID NO: 1513440 - DNA, 15 bp, Homo sapiens
cccaagggccctggc

SEQ ID NO: 1513441 - DNA, 19 bp, Homo sapiens
cccaaggttggagcccagg

SEQ ID NO: 1513442 - DNA, 14 bp, Homo sapiens
cccaagtcccaccc

SEQ ID NO: 1513443 - DNA, 19 bp, Homo sapiens
cccaagtgcactttctaat

SEQ ID NO: 1513444 - DNA, 14 bp, Homo sapiens
cccaagtgggggca

SEQ ID NO: 1513445 - DNA, 15 bp, Homo sapiens
cccaagtgtgaacaa

SEQ ID NO: 1513446 - DNA, 16 bp, Homo sapiens
cccaagtgtgaacaaa

SEQ ID NO: 1513447 - DNA, 23 bp, Homo sapiens
cccaagtttccatagcaacagga

SEQ ID NO: 1513448 - DNA, 11 bp, Homo sapiens
cccaataaaag

SEQ ID NO: 1513449 - DNA, 12 bp, Homo sapiens
cccaataaaagt

SEQ ID NO: 1513450 - DNA, 16 bp, Homo sapiens
cccaataaaggcagct

SEQ ID NO: 1513451 - DNA, 18 bp, Homo sapiens
cccaataaaggcagctgc

SEQ ID NO: 1513452 - DNA, 19 bp, Homo sapiens
cccaataaaggcagctgcc

SEQ ID NO: 1513453 - DNA, 21 bp, Homo sapiens
cccaataaaggcagctgcctc

SEQ ID NO: 1513454 - DNA, 23 bp, Homo sapiens
cccaataaaggcagctgcctctg

SEQ ID NO: 1513455 - DNA, 15 bp, Homo sapiens
cccaatagctctact

SEQ ID NO: 1513456 - DNA, 12 bp, Homo sapiens
cccaatatattc

SEQ ID NO: 1513457 - DNA, 20 bp, Homo sapiens
cccaatcagcttttgttcta

SEQ ID NO: 1513458 - DNA, 21 bp, Homo sapiens
cccaatccctttattaccccc

SEQ ID NO: 1513459 - DNA, 12 bp, Homo sapiens
cccaatcctctc

SEQ ID NO: 1513460 - DNA, 15 bp, Homo sapiens
cccaatcctctctcc

SEQ ID NO: 1513461 - DNA, 21 bp, Homo sapiens
cccaatcctctctcccctctg

SEQ ID NO: 1513462 - DNA, 17 bp, Homo sapiens
cccaatcggactgccaa

SEQ ID NO: 1513463 - DNA, 17 bp, Homo sapiens
cccaatcgggtccagag

SEQ ID NO: 1513464 - DNA, 16 bp, Homo sapiens
cccaatgtaggagctg

SEQ ID NO: 1513465 - DNA, 14 bp, Homo sapiens
cccaatgtttaaaa

SEQ ID NO: 1513466 - DNA, 14 bp, Homo sapiens
cccaattagcttgg

SEQ ID NO: 1513467 - DNA, 14 bp, Homo sapiens
cccaattaggaagt

SEQ ID NO: 1513468 - DNA, 21 bp, Homo sapiens
cccacaaccttcggctccggg

SEQ ID NO: 1513469 - DNA, 17 bp, Homo sapiens
cccacaactcctgtcta

SEQ ID NO: 1513470 - DNA, 21 bp, Homo sapiens
cccacaagctgtccctgcagg

SEQ ID NO: 1513471 - DNA, 22 bp, Homo sapiens
cccacaatataaaactgtactt

SEQ ID NO: 1513472 - DNA, 13 bp, Homo sapiens
cccacacactcgc

SEQ ID NO: 1513473 - DNA, 20 bp, Homo sapiens
cccacacactttccatctct

SEQ ID NO: 1513474 - DNA, 16 bp, Homo sapiens
cccacacagctgccct

SEQ ID NO: 1513475 - DNA, 15 bp, Homo sapiens
cccacacagggcact

SEQ ID NO: 1513476 - DNA, 14 bp, Homo sapiens
cccacacccagcta

SEQ ID NO: 1513477 - DNA, 17 bp, Homo sapiens
cccacaccgctggtccc

SEQ ID NO: 1513478 - DNA, 22 bp, Homo sapiens
cccacaccgctggtccctgccc

SEQ ID NO: 1513479 - DNA, 16 bp, Homo sapiens
cccacacctccctact

SEQ ID NO: 1513480 - DNA, 19 bp, Homo sapiens
cccacacctgcagtgccag

SEQ ID NO: 1513481 - DNA, 17 bp, Homo sapiens
cccacaccttccagggc

SEQ ID NO: 1513482 - DNA, 20 bp, Homo sapiens
cccacaccttccagggccct

SEQ ID NO: 1513483 - DNA, 23 bp, Homo sapiens
cccacacggaggcatctgcaccc

SEQ ID NO: 1513484 - DNA, 13 bp, Homo sapiens
cccacactgaggc

SEQ ID NO: 1513485 - DNA, 17 bp, Homo sapiens
cccacacttgttccagc

SEQ ID NO: 1513486 - DNA, 18 bp, Homo sapiens
cccacactttgaagcaaa

SEQ ID NO: 1513487 - DNA, 15 bp, Homo sapiens
cccagatctgcctgg

SEQ ID NO: 1513488 - DNA, 19 bp, Homo sapiens
cccagatctgcctgggcct

SEQ ID NO: 1513489 - DNA, 20 bp, Homo sapiens
cccagatctgcctgggcctg

SEQ ID NO: 1513490 - DNA, 18 bp, Homo sapiens
cccagatctggtcccttg

SEQ ID NO: 1513491 - DNA, 23 bp, Homo sapiens
cccagattgtgtacatagagcaa

SEQ ID NO: 1513492 - DNA, 17 bp, Homo sapiens
cccagcaacgcccctcc

SEQ ID NO: 1513493 - DNA, 15 bp, Homo sapiens
cccagcaagacctca

SEQ ID NO: 1513494 - DNA, 20 bp, Homo sapiens
cccagcaagagcacaagagg

SEQ ID NO: 1513495 - DNA, 19 bp, Homo sapiens
cccagcacagcttgacctg

SEQ ID NO: 1513496 - DNA, 18 bp, Homo sapiens
cccagcacatgaaacctt

SEQ ID NO: 1513497 - DNA, 23 bp, Homo sapiens
cccagcacatggccatagaggcc

SEQ ID NO: 1513498 - DNA, 17 bp, Homo sapiens
cccagcacctcagcctg

SEQ ID NO: 1513499 - DNA, 18 bp, Homo sapiens
cccagcacctcagcctgc

SEQ ID NO: 1513500 - DNA, 16 bp, Homo sapiens
cccagctggtgggaag

SEQ ID NO: 1513501 - DNA, 19 bp, Homo sapiens
cccagctggtgggaagcgt

SEQ ID NO: 1513502 - DNA, 22 bp, Homo sapiens
cccagctggtgggaagcgtctg

SEQ ID NO: 1513503 - DNA, 13 bp, Homo sapiens
cccagctgtagcc

SEQ ID NO: 1513504 - DNA, 14 bp, Homo sapiens
cccagctgtagcca

SEQ ID NO: 1513505 - DNA, 17 bp, Homo sapiens
cccagctgtagccatgg

SEQ ID NO: 1513506 - DNA, 24 bp, Homo sapiens
cccagctgtagccatggctcaggc

SEQ ID NO: 1513507 - DNA, 13 bp, Homo sapiens
cccagcttcctgt

SEQ ID NO: 1513508 - DNA, 13 bp, Homo sapiens
cccagcttggctc

SEQ ID NO: 1513509 - DNA, 23 bp, Homo sapiens
cccagcttggctcacaaggccca

SEQ ID NO: 1513510 - DNA, 19 bp, Homo sapiens
cccagcttgggcccagctg

SEQ ID NO: 1513511 - DNA, 20 bp, Homo sapiens
cccagcttgggcccagctgg

SEQ ID NO: 1513512 - DNA, 19 bp, Homo sapiens
cccaggaaaggcaggattg

SEQ ID NO: 1513513 - DNA, 16 bp, Homo sapiens
cccaggaaaggcccag

SEQ ID NO: 1513514 - DNA, 15 bp, Homo sapiens
cccaggaactgggcc

SEQ ID NO: 1513515 - DNA, 22 bp, Homo sapiens
cccaggaatttgaagctgcagt

SEQ ID NO: 1513516 - DNA, 12 bp, Homo sapiens
cccaggaccagc

SEQ ID NO: 1513517 - DNA, 15 bp, Homo sapiens
cccaggaccagctgg

SEQ ID NO: 1513518 - DNA, 18 bp, Homo sapiens
cccaggaccagctggggc

SEQ ID NO: 1513519 - DNA, 14 bp, Homo sapiens
cccaggaccatcct

SEQ ID NO: 1513520 - DNA, 23 bp, Homo sapiens
cccaggaccctgaaggggccatg

SEQ ID NO: 1513521 - DNA, 19 bp, Homo sapiens
cccaggacggatgggccct

SEQ ID NO: 1513522 - DNA, 21 bp, Homo sapiens
cccaggagacagaccacttgc

SEQ ID NO: 1513523 - DNA, 15 bp, Homo sapiens
cccaggagacagttc

SEQ ID NO: 1513524 - DNA, 15 bp, Homo sapiens
cccaggagagccagc

SEQ ID NO: 1513525 - DNA, 23 bp, Homo sapiens
cccaggagcagcttttggtctcc

SEQ ID NO: 1513526 - DNA, 24 bp, Homo sapiens
cccaggagcagcttttggtctcct

SEQ ID NO: 1513527 - DNA, 21 bp, Homo sapiens
cccaggagctctgcgccaggc

SEQ ID NO: 1513528 - DNA, 22 bp, Homo sapiens
cccaggagctgagtcacctcct

SEQ ID NO: 1513529 - DNA, 14 bp, Homo sapiens
cccaggagggaggg

SEQ ID NO: 1513530 - DNA, 24 bp, Homo sapiens
cccaggagttcgaggctgcagtca

SEQ ID NO: 1513531 - DNA, 23 bp, Homo sapiens
cccaggagtttgagacaagccct

SEQ ID NO: 1513532 - DNA, 20 bp, Homo sapiens
cccaggagtttgaggctgca

SEQ ID NO: 1513533 - DNA, 19 bp, Homo sapiens
cccaggatatctgaaaata

SEQ ID NO: 1513534 - DNA, 15 bp, Homo sapiens
cccaggatcactctc

SEQ ID NO: 1513535 - DNA, 19 bp, Homo sapiens
cccaggatcactctctgct

SEQ ID NO: 1513536 - DNA, 21 bp, Homo sapiens
cccaggatcactctctgctgg

SEQ ID NO: 1513537 - DNA, 17 bp, Homo sapiens
cccaggcaccaccagga

SEQ ID NO: 1513538 - DNA, 18 bp, Homo sapiens
cccaggcaccaccaggag

SEQ ID NO: 1513539 - DNA, 20 bp, Homo sapiens
cccaggcaccaccaggagca

SEQ ID NO: 1513540 - DNA, 22 bp, Homo sapiens
cccaggcaccaccaggagcagc

SEQ ID NO: 1513541 - DNA, 14 bp, Homo sapiens
cccaggcaggccac

SEQ ID NO: 1513542 - DNA, 12 bp, Homo sapiens
cccaggcaggga

SEQ ID NO: 1513543 - DNA, 17 bp, Homo sapiens
cccaggcagggagacgg

SEQ ID NO: 1513544 - DNA, 14 bp, Homo sapiens
cccaggcagtcttt

SEQ ID NO: 1513545 - DNA, 18 bp, Homo sapiens
cccaggcagtctttgctc

SEQ ID NO: 1513546 - DNA, 11 bp, Homo sapiens
cccaggccacc

SEQ ID NO: 1513547 - DNA, 18 bp, Homo sapiens
cccaggccacccccatgg

SEQ ID NO: 1513548 - DNA, 18 bp, Homo sapiens
cccaggccagagtgcagt

SEQ ID NO: 1513549 - DNA, 23 bp, Homo sapiens
cccaggccaggctccttcctgtc

SEQ ID NO: 1513550 - DNA, 23 bp, Homo sapiens
cccaggccaggtccctggaccag

SEQ ID NO: 1513551 - DNA, 13 bp, Homo sapiens
cccaggcccacca

SEQ ID NO: 1513552 - DNA, 12 bp, Homo sapiens
cccaggccccct

SEQ ID NO: 1513553 - DNA, 13 bp, Homo sapiens
cccaggccctcca

SEQ ID NO: 1513554 - DNA, 16 bp, Homo sapiens
cccaggccctccatgg

SEQ ID NO: 1513555 - DNA, 19 bp, Homo sapiens
cccaggccctccatgggct

SEQ ID NO: 1513556 - DNA, 17 bp, Homo sapiens
cccaggcccttggctgc

SEQ ID NO: 1513557 - DNA, 20 bp, Homo sapiens
cccaggcccttggctgcagg

SEQ ID NO: 1513558 - DNA, 13 bp, Homo sapiens
cccaggccctttg

SEQ ID NO: 1513559 - DNA, 16 bp, Homo sapiens
cccaggccctttggct

SEQ ID NO: 1513560 - DNA, 13 bp, Homo sapiens
cccaggccgcagc

SEQ ID NO: 1513561 - DNA, 17 bp, Homo sapiens
cccaggccgcagctctt

SEQ ID NO: 1513562 - DNA, 18 bp, Homo sapiens
cccaggccggagcccaga

SEQ ID NO: 1513563 - DNA, 20 bp, Homo sapiens
cccaggccggagcccagata

SEQ ID NO: 1513564 - DNA, 22 bp, Homo sapiens
cccaggcctccagcctctcccg

SEQ ID NO: 1513565 - DNA, 13 bp, Homo sapiens
cccaggcctccct

SEQ ID NO: 1513566 - DNA, 16 bp, Homo sapiens
cccaggcctccctgca

SEQ ID NO: 1513567 - DNA, 15 bp, Homo sapiens
cccaggcctgcctgc

SEQ ID NO: 1513568 - DNA, 16 bp, Homo sapiens
cccaggcctgtccacc

SEQ ID NO: 1513569 - DNA, 21 bp, Homo sapiens
cccaggcctgtccaccctgcc

SEQ ID NO: 1513570 - DNA, 18 bp, Homo sapiens
cccaggcgccccttcccc

SEQ ID NO: 1513571 - DNA, 22 bp, Homo sapiens
cccaggctcggaggaccctgga

SEQ ID NO: 1513572 - DNA, 17 bp, Homo sapiens
cccaggctcgtggactg

SEQ ID NO: 1513573 - DNA, 15 bp, Homo sapiens
cccaggctgcactgc

SEQ ID NO: 1513574 - DNA, 18 bp, Homo sapiens
cccaggctgcctgagcac

SEQ ID NO: 1513575 - DNA, 13 bp, Homo sapiens
cccaggctggagt

SEQ ID NO: 1513576 - DNA, 14 bp, Homo sapiens
cccaggcttcctgg

SEQ ID NO: 1513577 - DNA, 22 bp, Homo sapiens
cccaggcttcctgggtcctgcc

SEQ ID NO: 1513578 - DNA, 19 bp, Homo sapiens
cccaggcttgtcactagca

SEQ ID NO: 1513579 - DNA, 17 bp, Homo sapiens
cccagggaaggaaaaat

SEQ ID NO: 1513580 - DNA, 23 bp, Homo sapiens
cccagggaaggtggggccctgcc

SEQ ID NO: 1513581 - DNA, 17 bp, Homo sapiens
cccagggcatcttgctg

SEQ ID NO: 1513582 - DNA, 13 bp, Homo sapiens
cccagggccagcc

SEQ ID NO: 1513583 - DNA, 17 bp, Homo sapiens
cccagggccagggccct

SEQ ID NO: 1513584 - DNA, 21 bp, Homo sapiens
cccagggccagggccctgcag

SEQ ID NO: 1513585 - DNA, 22 bp, Homo sapiens
cccagggccagggccctgcaga

SEQ ID NO: 1513586 - DNA, 13 bp, Homo sapiens
cccagggcccaga

SEQ ID NO: 1513587 - DNA, 14 bp, Homo sapiens
cccagggcccagag

SEQ ID NO: 1513588 - DNA, 16 bp, Homo sapiens
cccagggcccagagcc

SEQ ID NO: 1513589 - DNA, 16 bp, Homo sapiens
cccagggcccccacag

SEQ ID NO: 1513590 - DNA, 13 bp, Homo sapiens
cccagggcccctc

SEQ ID NO: 1513591 - DNA, 15 bp, Homo sapiens
cccagggcctccagg

SEQ ID NO: 1513592 - DNA, 17 bp, Homo sapiens
cccagggcctccagggc

SEQ ID NO: 1513593 - DNA, 13 bp, Homo sapiens
cccagggcctggg

SEQ ID NO: 1513594 - DNA, 16 bp, Homo sapiens
cccagggcctgggggc

SEQ ID NO: 1513595 - DNA, 18 bp, Homo sapiens
cccagggctcagcctggt

SEQ ID NO: 1513596 - DNA, 20 bp, Homo sapiens
cccagggctcagcctggtgg

SEQ ID NO: 1513597 - DNA, 16 bp, Homo sapiens
cccagggctgggagga

SEQ ID NO: 1513598 - DNA, 17 bp, Homo sapiens
cccagggctgggaggaa

SEQ ID NO: 1513599 - DNA, 17 bp, Homo sapiens
cccaggggaccacacct

SEQ ID NO: 1513600 - DNA, 22 bp, Homo sapiens
cccaggggagagggtctggaga

SEQ ID NO: 1513601 - DNA, 14 bp, Homo sapiens
cccaggggagccag

SEQ ID NO: 1513602 - DNA, 17 bp, Homo sapiens
cccaggggagccagctg

SEQ ID NO: 1513603 - DNA, 13 bp, Homo sapiens
cccaggggcagca

SEQ ID NO: 1513604 - DNA, 18 bp, Homo sapiens
cccaggggcagcaaggcc

SEQ ID NO: 1513605 - DNA, 14 bp, Homo sapiens
cccaggggcagcca

SEQ ID NO: 1513606 - DNA, 17 bp, Homo sapiens
cccaggggcagccacac

SEQ ID NO: 1513607 - DNA, 19 bp, Homo sapiens
cccagggggcatgaccaga

SEQ ID NO: 1513608 - DNA, 18 bp, Homo sapiens
cccagggggcctggagca

SEQ ID NO: 1513609 - DNA, 16 bp, Homo sapiens
cccaggggtctccctg

SEQ ID NO: 1513610 - DNA, 22 bp, Homo sapiens
cccaggggtctccctggctccc

SEQ ID NO: 1513611 - DNA, 23 bp, Homo sapiens
cccaggggtctccctggctccct

SEQ ID NO: 1513612 - DNA, 18 bp, Homo sapiens
cccaggggtgccccctcc

SEQ ID NO: 1513613 - DNA, 13 bp, Homo sapiens
cccatctccttcc

SEQ ID NO: 1513614 - DNA, 21 bp, Homo sapiens
cccatctccttcccccagccc

SEQ ID NO: 1513615 - DNA, 13 bp, Homo sapiens
cccatctgattta

SEQ ID NO: 1513616 - DNA, 13 bp, Homo sapiens
cccatctgcaccc

SEQ ID NO: 1513617 - DNA, 12 bp, Homo sapiens
cccatctggctt

SEQ ID NO: 1513618 - DNA, 14 bp, Homo sapiens
cccatcttccacct

SEQ ID NO: 1513619 - DNA, 17 bp, Homo sapiens
cccatcttcctgctgct

SEQ ID NO: 1513620 - DNA, 19 bp, Homo sapiens
cccatctttgatccttctg

SEQ ID NO: 1513621 - DNA, 13 bp, Homo sapiens
cccatgacaatca

SEQ ID NO: 1513622 - DNA, 17 bp, Homo sapiens
cccatgacccacccctg

SEQ ID NO: 1513623 - DNA, 19 bp, Homo sapiens
cccatgacccacccctgtg

SEQ ID NO: 1513624 - DNA, 21 bp, Homo sapiens
cccatgacccacccctgtgct

SEQ ID NO: 1513625 - DNA, 23 bp, Homo sapiens
cccatgacccacccctgtgctcc

SEQ ID NO: 1513626 - DNA, 22 bp, Homo sapiens
cccatgatactccactcccagc

SEQ ID NO: 1513627 - DNA, 17 bp, Homo sapiens
cccatgcaagcagagga

SEQ ID NO: 1513628 - DNA, 14 bp, Homo sapiens
cccatgcactgtga

SEQ ID NO: 1513629 - DNA, 16 bp, Homo sapiens
cccatgcactgtgaag

SEQ ID NO: 1513630 - DNA, 19 bp, Homo sapiens
cccatgcactgtgaaggac

SEQ ID NO: 1513631 - DNA, 20 bp, Homo sapiens
cccatgcactgtgaaggacc

SEQ ID NO: 1513632 - DNA, 12 bp, Homo sapiens
cccatgccacca

SEQ ID NO: 1513633 - DNA, 14 bp, Homo sapiens
cccatgcctgtcca

SEQ ID NO: 1513634 - DNA, 22 bp, Homo sapiens
cccatgcgtgccgcctgctcct

SEQ ID NO: 1513635 - DNA, 19 bp, Homo sapiens
cccatgctcaaccactgtg

SEQ ID NO: 1513636 - DNA, 14 bp, Homo sapiens
cccatgctctgccc

SEQ ID NO: 1513637 - DNA, 17 bp, Homo sapiens
cccatggaatatttcca

SEQ ID NO: 1513638 - DNA, 13 bp, Homo sapiens
cccatggagccag

SEQ ID NO: 1513639 - DNA, 17 bp, Homo sapiens
cccatggccccaggccc

SEQ ID NO: 1513640 - DNA, 13 bp, Homo sapiens
cccatggccccca

SEQ ID NO: 1513641 - DNA, 23 bp, Homo sapiens
cccatggcccccaataaaggcag

SEQ ID NO: 1513642 - DNA, 11 bp, Homo sapiens
cccatgggctg

SEQ ID NO: 1513643 - DNA, 21 bp, Homo sapiens
cccatgggctgagtggggagc

SEQ ID NO: 1513644 - DNA, 17 bp, Homo sapiens
cccccacacctcagttc

SEQ ID NO: 1513645 - DNA, 22 bp, Homo sapiens
cccccacaggccccccgcagca

SEQ ID NO: 1513646 - DNA, 15 bp, Homo sapiens
cccccaccactagga

SEQ ID NO: 1513647 - DNA, 17 bp, Homo sapiens
cccccacccccagctca

SEQ ID NO: 1513648 - DNA, 20 bp, Homo sapiens
cccccaccccggggaccctg

SEQ ID NO: 1513649 - DNA, 22 bp, Homo sapiens
cccccacccctacagcctgcac

SEQ ID NO: 1513650 - DNA, 13 bp, Homo sapiens
cccccaccctcca

SEQ ID NO: 1513651 - DNA, 16 bp, Homo sapiens
cccccaccggtccagc

SEQ ID NO: 1513652 - DNA, 20 bp, Homo sapiens
cccccaccggtccagctggc

SEQ ID NO: 1513653 - DNA, 13 bp, Homo sapiens
cccccacctgaca

SEQ ID NO: 1513654 - DNA, 14 bp, Homo sapiens
cccccactgcaggc

SEQ ID NO: 1513655 - DNA, 13 bp, Homo sapiens
cccccactgccac

SEQ ID NO: 1513656 - DNA, 15 bp, Homo sapiens
cccccagaacctgtc

SEQ ID NO: 1513657 - DNA, 23 bp, Homo sapiens
cccccagaccccgcccctgggga

SEQ ID NO: 1513658 - DNA, 15 bp, Homo sapiens
cccccagcactgagg

SEQ ID NO: 1513659 - DNA, 18 bp, Homo sapiens
cccccagcactgaggaag

SEQ ID NO: 1513660 - DNA, 15 bp, Homo sapiens
cccccagccaaactg

SEQ ID NO: 1513661 - DNA, 14 bp, Homo sapiens
cccccagcccaggg

SEQ ID NO: 1513662 - DNA, 13 bp, Homo sapiens
cccccagccccgg

SEQ ID NO: 1513663 - DNA, 16 bp, Homo sapiens
cccccagccctgggaa

SEQ ID NO: 1513664 - DNA, 11 bp, Homo sapiens
cccccaggact

SEQ ID NO: 1513665 - DNA, 12 bp, Homo sapiens
cccccaggactg

SEQ ID NO: 1513666 - DNA, 21 bp, Homo sapiens
cccccagggcctccagggccc

SEQ ID NO: 1513667 - DNA, 18 bp, Homo sapiens
cccccaggtgttgccatt

SEQ ID NO: 1513668 - DNA, 20 bp, Homo sapiens
cccccagtccccacccctgc

SEQ ID NO: 1513669 - DNA, 11 bp, Homo sapiens
cccccagtgtg

SEQ ID NO: 1513670 - DNA, 19 bp, Homo sapiens
cccccatctccccaggcct

SEQ ID NO: 1513671 - DNA, 11 bp, Homo sapiens
cccccatctct

SEQ ID NO: 1513672 - DNA, 14 bp, Homo sapiens
cccccatgcactgt

SEQ ID NO: 1513673 - DNA, 18 bp, Homo sapiens
cccccatgggctgtgtcc

SEQ ID NO: 1513674 - DNA, 14 bp, Homo sapiens
cccccatgtggctg

SEQ ID NO: 1513675 - DNA, 11 bp, Homo sapiens
ccccccactct

SEQ ID NO: 1513676 - DNA, 12 bp, Homo sapiens
ccccccagcact

SEQ ID NO: 1513677 - DNA, 13 bp, Homo sapiens
ccccccagcctct

SEQ ID NO: 1513678 - DNA, 13 bp, Homo sapiens
ccccccgcagcac

SEQ ID NO: 1513679 - DNA, 15 bp, Homo sapiens
cccccctcctgctcc

SEQ ID NO: 1513680 - DNA, 12 bp, Homo sapiens
cccccctgctgc

SEQ ID NO: 1513681 - DNA, 13 bp, Homo sapiens
cccccctgctgcc

SEQ ID NO: 1513682 - DNA, 13 bp, Homo sapiens
cccccgaccctgc

SEQ ID NO: 1513683 - DNA, 16 bp, Homo sapiens
cccccgactgcctgtc

SEQ ID NO: 1513684 - DNA, 13 bp, Homo sapiens
cccccgcctgcca

SEQ ID NO: 1513685 - DNA, 14 bp, Homo sapiens
cccccgcctgggca

SEQ ID NO: 1513686 - DNA, 18 bp, Homo sapiens
cccccgcgctcgcccagc

SEQ ID NO: 1513687 - DNA, 16 bp, Homo sapiens
cccccgcgggttctag

SEQ ID NO: 1513688 - DNA, 13 bp, Homo sapiens
ccccctcctcaga

SEQ ID NO: 1513689 - DNA, 12 bp, Homo sapiens
ccccctcctcca

SEQ ID NO: 1513690 - DNA, 14 bp, Homo sapiens
ccccctcctccagt

SEQ ID NO: 1513691 - DNA, 15 bp, Homo sapiens
ccccctcctccagta

SEQ ID NO: 1513692 - DNA, 13 bp, Homo sapiens
ccccctcctgctg

SEQ ID NO: 1513693 - DNA, 16 bp, Homo sapiens
ccccctcctgctgtgc

SEQ ID NO: 1513694 - DNA, 11 bp, Homo sapiens
ccccctgagtg

SEQ ID NO: 1513695 - DNA, 16 bp, Homo sapiens
ccccctgagtgggctg

SEQ ID NO: 1513696 - DNA, 20 bp, Homo sapiens
ccccctgcaacttccgctga

SEQ ID NO: 1513697 - DNA, 14 bp, Homo sapiens
ccccctgcacccac

SEQ ID NO: 1513698 - DNA, 14 bp, Homo sapiens
ccccctgccagtgc

SEQ ID NO: 1513699 - DNA, 16 bp, Homo sapiens
ccccctgccccccagc

SEQ ID NO: 1513700 - DNA, 20 bp, Homo sapiens
ccccctgccctcgtggccag

SEQ ID NO: 1513701 - DNA, 22 bp, Homo sapiens
ccccctgccctcgtggccagcc

SEQ ID NO: 1513702 - DNA, 16 bp, Homo sapiens
ccccctgcctgccata

SEQ ID NO: 1513703 - DNA, 13 bp, Homo sapiens
ccccctgctgccc

SEQ ID NO: 1513704 - DNA, 22 bp, Homo sapiens
ccccctggatgtcccctgtccc

SEQ ID NO: 1513705 - DNA, 22 bp, Homo sapiens
ccccctggcctctgtgccttct

SEQ ID NO: 1513706 - DNA, 10 bp, Homo sapiens
ccccctgggc

SEQ ID NO: 1513707 - DNA, 11 bp, Homo sapiens
ccccctgggct

SEQ ID NO: 1513708 - DNA, 19 bp, Homo sapiens
ccccctggtggacagtcct

SEQ ID NO: 1513709 - DNA, 20 bp, Homo sapiens
ccccctggtggacagtcctg

SEQ ID NO: 1513710 - DNA, 17 bp, Homo sapiens
ccccctgtcccattcta

SEQ ID NO: 1513711 - DNA, 19 bp, Homo sapiens
ccccctgtcccattctaga

SEQ ID NO: 1513712 - DNA, 16 bp, Homo sapiens
cccccttaaatttaat

SEQ ID NO: 1513713 - DNA, 14 bp, Homo sapiens
cccccttccctggg

SEQ ID NO: 1513714 - DNA, 14 bp, Homo sapiens
cccccttgagtggg

SEQ ID NO: 1513715 - DNA, 18 bp, Homo sapiens
cccccttgccagacatgt

SEQ ID NO: 1513716 - DNA, 22 bp, Homo sapiens
cccccttgccctccgcctggga

SEQ ID NO: 1513717 - DNA, 14 bp, Homo sapiens
ccccgacactgctg

SEQ ID NO: 1513718 - DNA, 16 bp, Homo sapiens
ccccgacactgctgca

SEQ ID NO: 1513719 - DNA, 18 bp, Homo sapiens
ccccgacactgctgcacc

SEQ ID NO: 1513720 - DNA, 18 bp, Homo sapiens
ccccgacgccacagccca

SEQ ID NO: 1513721 - DNA, 16 bp, Homo sapiens
ccccgagaagtgctct

SEQ ID NO: 1513722 - DNA, 21 bp, Homo sapiens
cccctaagtggattggctttg

SEQ ID NO: 1513723 - DNA, 14 bp, Homo sapiens
cccctacagcctgc

SEQ ID NO: 1513724 - DNA, 22 bp, Homo sapiens
cccctaccccacaccaggccgt

SEQ ID NO: 1513725 - DNA, 14 bp, Homo sapiens
cccctactgctgtg

SEQ ID NO: 1513726 - DNA, 13 bp, Homo sapiens
cccctagccctgg

SEQ ID NO: 1513727 - DNA, 17 bp, Homo sapiens
cccctatccacccagcc

SEQ ID NO: 1513728 - DNA, 20 bp, Homo sapiens
cccctatccacccagcccat

SEQ ID NO: 1513729 - DNA, 21 bp, Homo sapiens
cccctatccacccagcccatt

SEQ ID NO: 1513730 - DNA, 12 bp, Homo sapiens
cccctatcctct

SEQ ID NO: 1513731 - DNA, 16 bp, Homo sapiens
cccctatcctctgagt

SEQ ID NO: 1513732 - DNA, 21 bp, Homo sapiens
cccctcaaagggagagaaaag

SEQ ID NO: 1513733 - DNA, 11 bp, Homo sapiens
cccctcaaccc

SEQ ID NO: 1513734 - DNA, 12 bp, Homo sapiens
cccctcaccatc

SEQ ID NO: 1513735 - DNA, 15 bp, Homo sapiens
cccctcaccatccag

SEQ ID NO: 1513736 - DNA, 13 bp, Homo sapiens
cccctcacctcct

SEQ ID NO: 1513737 - DNA, 18 bp, Homo sapiens
cccctcactccccaggga

SEQ ID NO: 1513738 - DNA, 21 bp, Homo sapiens
cccctcactccccagggagct

SEQ ID NO: 1513739 - DNA, 13 bp, Homo sapiens
cccctcagccctt

SEQ ID NO: 1513740 - DNA, 22 bp, Homo sapiens
cccctcagcgggggccttgaag

SEQ ID NO: 1513741 - DNA, 22 bp, Homo sapiens
cccctcatcatagcaataacat

SEQ ID NO: 1513742 - DNA, 20 bp, Homo sapiens
cccctccaaacctccagcct

SEQ ID NO: 1513743 - DNA, 16 bp, Homo sapiens
cccctccagaccctgc

SEQ ID NO: 1513744 - DNA, 11 bp, Homo sapiens
cccctccagca

SEQ ID NO: 1513745 - DNA, 12 bp, Homo sapiens
cccctccagcac

SEQ ID NO: 1513746 - DNA, 14 bp, Homo sapiens
cccctccaggaaga

SEQ ID NO: 1513747 - DNA, 13 bp, Homo sapiens
cccctccaggaga

SEQ ID NO: 1513748 - DNA, 14 bp, Homo sapiens
cccctccaggagag

SEQ ID NO: 1513749 - DNA, 12 bp, Homo sapiens
cccctcccaggg

SEQ ID NO: 1513750 - DNA, 21 bp, Homo sapiens
cccctcccaggggagccagct

SEQ ID NO: 1513751 - DNA, 22 bp, Homo sapiens
cccctcccaggggagccagctg

SEQ ID NO: 1513752 - DNA, 23 bp, Homo sapiens
cccctcccaggggagccagctgc

SEQ ID NO: 1513753 - DNA, 11 bp, Homo sapiens
cccctcccatc

SEQ ID NO: 1513754 - DNA, 14 bp, Homo sapiens
cccctcccatctgg

SEQ ID NO: 1513755 - DNA, 11 bp, Homo sapiens
cccctcccatt

SEQ ID NO: 1513756 - DNA, 13 bp, Homo sapiens
cccctcccattag

SEQ ID NO: 1513757 - DNA, 13 bp, Homo sapiens
cccctccccaaag

SEQ ID NO: 1513758 - DNA, 14 bp, Homo sapiens
cccctccccccaga

SEQ ID NO: 1513759 - DNA, 15 bp, Homo sapiens
cccctccccctcctg

SEQ ID NO: 1513760 - DNA, 20 bp, Homo sapiens
cccctccccctcctgctgtg

SEQ ID NO: 1513761 - DNA, 20 bp, Homo sapiens
cccctccccctgagattcag

SEQ ID NO: 1513762 - DNA, 16 bp, Homo sapiens
cccctccctctgcccc

SEQ ID NO: 1513763 - DNA, 14 bp, Homo sapiens
cccctccctggctc

SEQ ID NO: 1513764 - DNA, 12 bp, Homo sapiens
cccctccctggg

SEQ ID NO: 1513765 - DNA, 13 bp, Homo sapiens
cccctccctgtca

SEQ ID NO: 1513766 - DNA, 22 bp, Homo sapiens
cccctcctcacagttgccatgt

SEQ ID NO: 1513767 - DNA, 13 bp, Homo sapiens
cccctcctcagtg

SEQ ID NO: 1513768 - DNA, 13 bp, Homo sapiens
cccctcctccagc

SEQ ID NO: 1513769 - DNA, 17 bp, Homo sapiens
cccctcctccagcccct

SEQ ID NO: 1513770 - DNA, 22 bp, Homo sapiens
cccctcctccagcccctgtccc

SEQ ID NO: 1513771 - DNA, 13 bp, Homo sapiens
cccctcctccagt

SEQ ID NO: 1513772 - DNA, 11 bp, Homo sapiens
cccctcctctg

SEQ ID NO: 1513773 - DNA, 15 bp, Homo sapiens
cccctcctctgagca

SEQ ID NO: 1513774 - DNA, 20 bp, Homo sapiens
cccctcctgaaccgcacagc

SEQ ID NO: 1513775 - DNA, 11 bp, Homo sapiens
cccctcctgct

SEQ ID NO: 1513776 - DNA, 14 bp, Homo sapiens
cccctcctgctcct

SEQ ID NO: 1513777 - DNA, 15 bp, Homo sapiens
cccctcctgctcctc

SEQ ID NO: 1513778 - DNA, 18 bp, Homo sapiens
cccctcctgctcctccct

SEQ ID NO: 1513779 - DNA, 20 bp, Homo sapiens
cccctcctgctcctccctgc

SEQ ID NO: 1513780 - DNA, 13 bp, Homo sapiens
cccctcctgctgt

SEQ ID NO: 1513781 - DNA, 17 bp, Homo sapiens
cccctcctgctgtgctg

SEQ ID NO: 1513782 - DNA, 13 bp, Homo sapiens
cccctccttcaga

SEQ ID NO: 1513783 - DNA, 13 bp, Homo sapiens
cccctccttctcc

SEQ ID NO: 1513784 - DNA, 16 bp, Homo sapiens
cccctcgaccctgtgc

SEQ ID NO: 1513785 - DNA, 13 bp, Homo sapiens
cccctcgctgctg

SEQ ID NO: 1513786 - DNA, 17 bp, Homo sapiens
cccctcgggggcctgtg

SEQ ID NO: 1513787 - DNA, 17 bp, Homo sapiens
cccctcgtcctgtccca

SEQ ID NO: 1513788 - DNA, 18 bp, Homo sapiens
cccctcgtcctgtcccag

SEQ ID NO: 1513789 - DNA, 18 bp, Homo sapiens
cccctcgtgcgcatctca

SEQ ID NO: 1513790 - DNA, 13 bp, Homo sapiens
cccctctctctgg

SEQ ID NO: 1513791 - DNA, 15 bp, Homo sapiens
cccctctgacctgca

SEQ ID NO: 1513792 - DNA, 18 bp, Homo sapiens
cccctctgcacccagaac

SEQ ID NO: 1513793 - DNA, 18 bp, Homo sapiens
cccctctgcccagcttgg

SEQ ID NO: 1513794 - DNA, 12 bp, Homo sapiens
cccctctgccgg

SEQ ID NO: 1513795 - DNA, 18 bp, Homo sapiens
cccctggctttgcctctt

SEQ ID NO: 1513796 - DNA, 22 bp, Homo sapiens
cccctgggctaccatctgcatg

SEQ ID NO: 1513797 - DNA, 23 bp, Homo sapiens
cccctgggctaccatctgcatgg

SEQ ID NO: 1513798 - DNA, 11 bp, Homo sapiens
cccctgggctc

SEQ ID NO: 1513799 - DNA, 13 bp, Homo sapiens
cccctgggctctc

SEQ ID NO: 1513800 - DNA, 15 bp, Homo sapiens
cccctgggctctgcc

SEQ ID NO: 1513801 - DNA, 21 bp, Homo sapiens
cccctgggctctgccccagct

SEQ ID NO: 1513802 - DNA, 23 bp, Homo sapiens
cccctgggcttggcctgctgtga

SEQ ID NO: 1513803 - DNA, 20 bp, Homo sapiens
cccctggggctgagtctcca

SEQ ID NO: 1513804 - DNA, 23 bp, Homo sapiens
cccctggggctgagtctccaggg

SEQ ID NO: 1513805 - DNA, 18 bp, Homo sapiens
cccctgggtcctccaaag

SEQ ID NO: 1513806 - DNA, 21 bp, Homo sapiens
cccctgggtgggtggtgggga

SEQ ID NO: 1513807 - DNA, 23 bp, Homo sapiens
cccctgggtgggtggtggggagg

SEQ ID NO: 1513808 - DNA, 18 bp, Homo sapiens
cccctggttctcatcttt

SEQ ID NO: 1513809 - DNA, 17 bp, Homo sapiens
cccctgtacccagctcc

SEQ ID NO: 1513810 - DNA, 14 bp, Homo sapiens
cccctgtactccag

SEQ ID NO: 1513811 - DNA, 17 bp, Homo sapiens
cccctgtcccaccaact

SEQ ID NO: 1513812 - DNA, 20 bp, Homo sapiens
cccctgtcccaccaactctg

SEQ ID NO: 1513813 - DNA, 19 bp, Homo sapiens
cccctgtgctccgtgcctc

SEQ ID NO: 1513814 - DNA, 12 bp, Homo sapiens
cccctgtggcca

SEQ ID NO: 1513815 - DNA, 20 bp, Homo sapiens
cccctgtggccaactgcaaa

SEQ ID NO: 1513816 - DNA, 20 bp, Homo sapiens
cccctgtggggatctcaggg

SEQ ID NO: 1513817 - DNA, 20 bp, Homo sapiens
cccctgtgtattcaccacca

SEQ ID NO: 1513818 - DNA, 23 bp, Homo sapiens
ccccttaaacacaggctgtcctt

SEQ ID NO: 1513819 - DNA, 22 bp, Homo sapiens
ccccttaatcttgctttcttta

SEQ ID NO: 1513820 - DNA, 13 bp, Homo sapiens
ccccttacccatc

SEQ ID NO: 1513821 - DNA, 21 bp, Homo sapiens
ccccttactatgatctcagga

SEQ ID NO: 1513822 - DNA, 22 bp, Homo sapiens
ccccttactatgatctcaggag

SEQ ID NO: 1513823 - DNA, 23 bp, Homo sapiens
ccccttactatgatctcaggagc

SEQ ID NO: 1513824 - DNA, 19 bp, Homo sapiens
ccccttattaaggccccag

SEQ ID NO: 1513825 - DNA, 22 bp, Homo sapiens
ccccttccagatcactgccaca

SEQ ID NO: 1513826 - DNA, 17 bp, Homo sapiens
ccccttcccgccttcca

SEQ ID NO: 1513827 - DNA, 20 bp, Homo sapiens
ccccttcctgtttcagaccc

SEQ ID NO: 1513828 - DNA, 21 bp, Homo sapiens
ccccttctacatttcttagac

SEQ ID NO: 1513829 - DNA, 13 bp, Homo sapiens
ccccttctctgct

SEQ ID NO: 1513830 - DNA, 16 bp, Homo sapiens
ccccttctctgctcca

SEQ ID NO: 1513831 - DNA, 17 bp, Homo sapiens
ccccttgcccagggctc

SEQ ID NO: 1513832 - DNA, 21 bp, Homo sapiens
ccccttggaaatgtctgctgg

SEQ ID NO: 1513833 - DNA, 22 bp, Homo sapiens
ccccttggaggagagagacccc

SEQ ID NO: 1513834 - DNA, 18 bp, Homo sapiens
ccccttggattcctgcac

SEQ ID NO: 1513835 - DNA, 13 bp, Homo sapiens
ccccttgggcggc

SEQ ID NO: 1513836 - DNA, 21 bp, Homo sapiens
cccctttactcagcccagctg

SEQ ID NO: 1513837 - DNA, 22 bp, Homo sapiens
cccctttactcagcccagctgg

SEQ ID NO: 1513838 - DNA, 17 bp, Homo sapiens
cccctttcacactggat

SEQ ID NO: 1513839 - DNA, 10 bp, Homo sapiens
cccctttcct

SEQ ID NO: 1513840 - DNA, 22 bp, Homo sapiens
cccctttcctctaactcactgc

SEQ ID NO: 1513841 - DNA, 22 bp, Homo sapiens
cccctttcctggacactcagac

SEQ ID NO: 1513842 - DNA, 18 bp, Homo sapiens
ccccttttacttttttat

SEQ ID NO: 1513843 - DNA, 22 bp, Homo sapiens
ccccttttcgccccctgcctgc

SEQ ID NO: 1513844 - DNA, 20 bp, Homo sapiens
ccccttttcttttctaccct

SEQ ID NO: 1513845 - DNA, 16 bp, Homo sapiens
ccccttttgcctggct

SEQ ID NO: 1513846 - DNA, 23 bp, Homo sapiens
ccccttttgcctggctgtggagg

SEQ ID NO: 1513847 - DNA, 23 bp, Homo sapiens
ccccttttgtgggtttctctgtg

SEQ ID NO: 1513848 - DNA, 17 bp, Homo sapiens
cccgaagagtcagcccc

SEQ ID NO: 1513849 - DNA, 23 bp, Homo sapiens
cccgaagccatcacttctccccg

SEQ ID NO: 1513850 - DNA, 14 bp, Homo sapiens
cccgacactgctgc

SEQ ID NO: 1513851 - DNA, 22 bp, Homo sapiens
cccgacactgctgcaccagagt

SEQ ID NO: 1513852 - DNA, 13 bp, Homo sapiens
cccgacagtgcca

SEQ ID NO: 1513853 - DNA, 17 bp, Homo sapiens
cccgacagtgccatccc

SEQ ID NO: 1513854 - DNA, 19 bp, Homo sapiens
cccgacagtgccatcccca

SEQ ID NO: 1513855 - DNA, 12 bp, Homo sapiens
cccgacatggct

SEQ ID NO: 1513856 - DNA, 13 bp, Homo sapiens
cccgaccctgccc

SEQ ID NO: 1513857 - DNA, 15 bp, Homo sapiens
cccgacgccacagcc

SEQ ID NO: 1513858 - DNA, 13 bp, Homo sapiens
cccgacggctgtg

SEQ ID NO: 1513859 - DNA, 12 bp, Homo sapiens
cccgactcctca

SEQ ID NO: 1513860 - DNA, 16 bp, Homo sapiens
cccgactgcctgtctc

SEQ ID NO: 1513861 - DNA, 17 bp, Homo sapiens
cccgagaaccctgagca

SEQ ID NO: 1513862 - DNA, 18 bp, Homo sapiens
ccctcctcacctctggac

SEQ ID NO: 1513863 - DNA, 12 bp, Homo sapiens
ccctcctccact

SEQ ID NO: 1513864 - DNA, 18 bp, Homo sapiens
ccctcctccagcccctgt

SEQ ID NO: 1513865 - DNA, 15 bp, Homo sapiens
ccctcctccaggcct

SEQ ID NO: 1513866 - DNA, 20 bp, Homo sapiens
ccctcctccaggtcggagtg

SEQ ID NO: 1513867 - DNA, 12 bp, Homo sapiens
ccctcctcccat

SEQ ID NO: 1513868 - DNA, 18 bp, Homo sapiens
ccctcctcgggccgaggc

SEQ ID NO: 1513869 - DNA, 18 bp, Homo sapiens
ccctcctctagctgtggg

SEQ ID NO: 1513870 - DNA, 19 bp, Homo sapiens
ccctcctctagctgtgggg

SEQ ID NO: 1513871 - DNA, 16 bp, Homo sapiens
ccctcctctcccatcc

SEQ ID NO: 1513872 - DNA, 13 bp, Homo sapiens
ccctcctcttccc

SEQ ID NO: 1513873 - DNA, 13 bp, Homo sapiens
ccctcctgagctc

SEQ ID NO: 1513874 - DNA, 13 bp, Homo sapiens
ccctcctgctcct

SEQ ID NO: 1513875 - DNA, 16 bp, Homo sapiens
ccctcctgctcctccc

SEQ ID NO: 1513876 - DNA, 21 bp, Homo sapiens
ccctcctgctcctccctgccc

SEQ ID NO: 1513877 - DNA, 12 bp, Homo sapiens
ccctcctgctgt

SEQ ID NO: 1513878 - DNA, 20 bp, Homo sapiens
ccctcctggagctctgtggg

SEQ ID NO: 1513879 - DNA, 21 bp, Homo sapiens
ccctcctgggaaggccacctc

SEQ ID NO: 1513880 - DNA, 16 bp, Homo sapiens
ccctccttccttgacc

SEQ ID NO: 1513881 - DNA, 18 bp, Homo sapiens
ccctccttccttgaccag

SEQ ID NO: 1513882 - DNA, 15 bp, Homo sapiens
ccctccttctcccct

SEQ ID NO: 1513883 - DNA, 18 bp, Homo sapiens
ccctcctttcccttattg

SEQ ID NO: 1513884 - DNA, 19 bp, Homo sapiens
ccctcgaaccaaggcagcc

SEQ ID NO: 1513885 - DNA, 13 bp, Homo sapiens
ccctcgcagacct

SEQ ID NO: 1513886 - DNA, 21 bp, Homo sapiens
ccctcgcagacctaagccctg

SEQ ID NO: 1513887 - DNA, 22 bp, Homo sapiens
ccctcgcagacctaagccctgc

SEQ ID NO: 1513888 - DNA, 13 bp, Homo sapiens
ccctcgcccccgc

SEQ ID NO: 1513889 - DNA, 17 bp, Homo sapiens
ccctcgctgctgctact

SEQ ID NO: 1513890 - DNA, 23 bp, Homo sapiens
ccctcggaggtccagctgggcct

SEQ ID NO: 1513891 - DNA, 20 bp, Homo sapiens
ccctcgggaagcagccagct

SEQ ID NO: 1513892 - DNA, 15 bp, Homo sapiens
ccctcgggcccacct

SEQ ID NO: 1513893 - DNA, 15 bp, Homo sapiens
ccctcgtccacaggg

SEQ ID NO: 1513894 - DNA, 18 bp, Homo sapiens
ccctcgtcttcagctgca

SEQ ID NO: 1513895 - DNA, 14 bp, Homo sapiens
ccctcgtggccagc

SEQ ID NO: 1513896 - DNA, 16 bp, Homo sapiens
ccctcgtggccagccc

SEQ ID NO: 1513897 - DNA, 17 bp, Homo sapiens
ccctcgtggccagcccg

SEQ ID NO: 1513898 - DNA, 14 bp, Homo sapiens
ccctctagtgcctt

SEQ ID NO: 1513899 - DNA, 13 bp, Homo sapiens
ccctctcaccaaa

SEQ ID NO: 1513900 - DNA, 11 bp, Homo sapiens
ccctctcagaa

SEQ ID NO: 1513901 - DNA, 15 bp, Homo sapiens
ccctctcatctcagg

SEQ ID NO: 1513902 - DNA, 23 bp, Homo sapiens
ccctctccaactgcctaaggccc

SEQ ID NO: 1513903 - DNA, 16 bp, Homo sapiens
ccctctcccaggcccg

SEQ ID NO: 1513904 - DNA, 18 bp, Homo sapiens
ccctctccctctctctgg

SEQ ID NO: 1513905 - DNA, 22 bp, Homo sapiens
ccctctcctatgtggcagctgg

SEQ ID NO: 1513906 - DNA, 17 bp, Homo sapiens
ccctctcctgcctactc

SEQ ID NO: 1513907 - DNA, 14 bp, Homo sapiens
ccctctccttcctg

SEQ ID NO: 1513908 - DNA, 15 bp, Homo sapiens
ccctctcgcgcccag

SEQ ID NO: 1513909 - DNA, 21 bp, Homo sapiens
ccctctcggccaggcattggc

SEQ ID NO: 1513910 - DNA, 13 bp, Homo sapiens
ccctctctctggg

SEQ ID NO: 1513911 - DNA, 15 bp, Homo sapiens
ccctctctctgggtc

SEQ ID NO: 1513912 - DNA, 14 bp, Homo sapiens
ccctctctcttctg

SEQ ID NO: 1513913 - DNA, 20 bp, Homo sapiens
ccctctctgcagacttccca

SEQ ID NO: 1513914 - DNA, 23 bp, Homo sapiens
ccctctcttgcacccgcctctcc

SEQ ID NO: 1513915 - DNA, 16 bp, Homo sapiens
ccctctgaacttgcct

SEQ ID NO: 1513916 - DNA, 17 bp, Homo sapiens
ccctctgcaacccccca

SEQ ID NO: 1513917 - DNA, 13 bp, Homo sapiens
ccctctgcccagc

SEQ ID NO: 1513918 - DNA, 16 bp, Homo sapiens
ccctctgccccaagca

SEQ ID NO: 1513919 - DNA, 15 bp, Homo sapiens
ccctctgccccatca

SEQ ID NO: 1513920 - DNA, 20 bp, Homo sapiens
ccctctgccggtcgggcagc

SEQ ID NO: 1513921 - DNA, 11 bp, Homo sapiens
ccctctgcctg

SEQ ID NO: 1513922 - DNA, 12 bp, Homo sapiens
ccctctgcctgc

SEQ ID NO: 1513923 - DNA, 13 bp, Homo sapiens
ccctctgcctgca

SEQ ID NO: 1513924 - DNA, 19 bp, Homo sapiens
ccctctgcctgcactccct

SEQ ID NO: 1513925 - DNA, 23 bp, Homo sapiens
ccctctgcctgcactccctggcc

SEQ ID NO: 1513926 - DNA, 17 bp, Homo sapiens
ccctctgctctgcctgg

SEQ ID NO: 1513927 - DNA, 12 bp, Homo sapiens
ccctctgctgcc

SEQ ID NO: 1513928 - DNA, 16 bp, Homo sapiens
ccctctgctgctgccc

SEQ ID NO: 1513929 - DNA, 12 bp, Homo sapiens
ccctctgctgtc

SEQ ID NO: 1513930 - DNA, 21 bp, Homo sapiens
ccctctggaggggtgtggctc

SEQ ID NO: 1513931 - DNA, 12 bp, Homo sapiens
ccctctggccag

SEQ ID NO: 1513932 - DNA, 18 bp, Homo sapiens
ccctctggccaggatgga

SEQ ID NO: 1513933 - DNA, 22 bp, Homo sapiens
ccctctggccaggatggagggg

SEQ ID NO: 1513934 - DNA, 14 bp, Homo sapiens
ccctctggccctgc

SEQ ID NO: 1513935 - DNA, 12 bp, Homo sapiens
ccctctgggcct

SEQ ID NO: 1513936 - DNA, 22 bp, Homo sapiens
ccctgttttagtttctgaactc

SEQ ID NO: 1513937 - DNA, 14 bp, Homo sapiens
ccctgttttatact

SEQ ID NO: 1513938 - DNA, 15 bp, Homo sapiens
ccctgttttctgagc

SEQ ID NO: 1513939 - DNA, 16 bp, Homo sapiens
ccctgttttctgagcc

SEQ ID NO: 1513940 - DNA, 18 bp, Homo sapiens
ccctgttttctgagcccg

SEQ ID NO: 1513941 - DNA, 22 bp, Homo sapiens
ccctgttttctgagcccgggct

SEQ ID NO: 1513942 - DNA, 23 bp, Homo sapiens
ccctgttttctgagcccgggctg

SEQ ID NO: 1513943 - DNA, 15 bp, Homo sapiens
ccctgttttttgtag

SEQ ID NO: 1513944 - DNA, 22 bp, Homo sapiens
cccttaaacacaggctgtcctt

SEQ ID NO: 1513945 - DNA, 17 bp, Homo sapiens
cccttaaccccaaggac

SEQ ID NO: 1513946 - DNA, 22 bp, Homo sapiens
cccttaagcagcaacagcctac

SEQ ID NO: 1513947 - DNA, 22 bp, Homo sapiens
cccttaatattgaggctgcagc

SEQ ID NO: 1513948 - DNA, 12 bp, Homo sapiens
cccttacctcaa

SEQ ID NO: 1513949 - DNA, 16 bp, Homo sapiens
cccttagaaaatgtgt

SEQ ID NO: 1513950 - DNA, 14 bp, Homo sapiens
cccttagccccgag

SEQ ID NO: 1513951 - DNA, 14 bp, Homo sapiens
cccttagcctccct

SEQ ID NO: 1513952 - DNA, 13 bp, Homo sapiens
cccttataaaatc

SEQ ID NO: 1513953 - DNA, 14 bp, Homo sapiens
cccttcagactggc

SEQ ID NO: 1513954 - DNA, 17 bp, Homo sapiens
cccttcagactggccct

SEQ ID NO: 1513955 - DNA, 15 bp, Homo sapiens
cccttcagccagaag

SEQ ID NO: 1513956 - DNA, 20 bp, Homo sapiens
cccttcagcccaccaccctg

SEQ ID NO: 1513957 - DNA, 13 bp, Homo sapiens
cccttcagggcca

SEQ ID NO: 1513958 - DNA, 17 bp, Homo sapiens
cccttcagtaccctctc

SEQ ID NO: 1513959 - DNA, 14 bp, Homo sapiens
cccttcagtctgct

SEQ ID NO: 1513960 - DNA, 18 bp, Homo sapiens
cccttcatccgcctgtgg

SEQ ID NO: 1513961 - DNA, 20 bp, Homo sapiens
cccttcatccgcctgtgggc

SEQ ID NO: 1513962 - DNA, 11 bp, Homo sapiens
cccttccaaag

SEQ ID NO: 1513963 - DNA, 12 bp, Homo sapiens
cccttccagaca

SEQ ID NO: 1513964 - DNA, 20 bp, Homo sapiens
cccttccagatcactgccac

SEQ ID NO: 1513965 - DNA, 21 bp, Homo sapiens
cccttccaggtgggtgtggga

SEQ ID NO: 1513966 - DNA, 19 bp, Homo sapiens
cccttccatcagcgggtct

SEQ ID NO: 1513967 - DNA, 15 bp, Homo sapiens
cccttccatgcccca

SEQ ID NO: 1513968 - DNA, 18 bp, Homo sapiens
cccttccatgccccagga

SEQ ID NO: 1513969 - DNA, 21 bp, Homo sapiens
cccttccatgccccaggatca

SEQ ID NO: 1513970 - DNA, 15 bp, Homo sapiens
cccttccatgtgcct

SEQ ID NO: 1513971 - DNA, 17 bp, Homo sapiens
cccttccatgtgccttt

SEQ ID NO: 1513972 - DNA, 20 bp, Homo sapiens
cccttccatgtgcctttctt

SEQ ID NO: 1513973 - DNA, 21 bp, Homo sapiens
cccttccatgtgcctttcttt

SEQ ID NO: 1513974 - DNA, 19 bp, Homo sapiens
cccttcccaatcagcactg

SEQ ID NO: 1513975 - DNA, 14 bp, Homo sapiens
cccttcccagacca

SEQ ID NO: 1513976 - DNA, 16 bp, Homo sapiens
cccttcccagaccagg

SEQ ID NO: 1513977 - DNA, 18 bp, Homo sapiens
cccttcccagaccaggaa

SEQ ID NO: 1513978 - DNA, 17 bp, Homo sapiens
cccttcccatttcttcc

SEQ ID NO: 1513979 - DNA, 13 bp, Homo sapiens
cccttccccaggc

SEQ ID NO: 1513980 - DNA, 16 bp, Homo sapiens
cccttcccccagccca

SEQ ID NO: 1513981 - DNA, 12 bp, Homo sapiens
cccttcccctcc

SEQ ID NO: 1513982 - DNA, 22 bp, Homo sapiens
cccttcccctccctggctccca

SEQ ID NO: 1513983 - DNA, 13 bp, Homo sapiens
cccttccctcttc

SEQ ID NO: 1513984 - DNA, 16 bp, Homo sapiens
cccttccctggcaggt

SEQ ID NO: 1513985 - DNA, 12 bp, Homo sapiens
cccttccctggg

SEQ ID NO: 1513986 - DNA, 14 bp, Homo sapiens
cccttccctgggag

SEQ ID NO: 1513987 - DNA, 15 bp, Homo sapiens
cccttccctgggagg

SEQ ID NO: 1513988 - DNA, 13 bp, Homo sapiens
cccttccctgtcc

SEQ ID NO: 1513989 - DNA, 22 bp, Homo sapiens
cccttcctcccggggccttcct

SEQ ID NO: 1513990 - DNA, 17 bp, Homo sapiens
cccttcctctccactgc

SEQ ID NO: 1513991 - DNA, 12 bp, Homo sapiens
cccttcctgctg

SEQ ID NO: 1513992 - DNA, 18 bp, Homo sapiens
cccttcctggaaacagca

SEQ ID NO: 1513993 - DNA, 13 bp, Homo sapiens
cccttcctggcct

SEQ ID NO: 1513994 - DNA, 14 bp, Homo sapiens
cccttcctggcctc

SEQ ID NO: 1513995 - DNA, 15 bp, Homo sapiens
cccttcctggcctca

SEQ ID NO: 1513996 - DNA, 18 bp, Homo sapiens
cccttcctggcctcactg

SEQ ID NO: 1513997 - DNA, 22 bp, Homo sapiens
cccttcctggcctcactggctg

SEQ ID NO: 1513998 - DNA, 10 bp, Homo sapiens
cccttcctgt

SEQ ID NO: 1513999 - DNA, 21 bp, Homo sapiens
cccttccttttccctgcttcc

SEQ ID NO: 1514000 - DNA, 16 bp, Homo sapiens
cccttcggagccaaca

SEQ ID NO: 1514001 - DNA, 13 bp, Homo sapiens
cccttctataccc

SEQ ID NO: 1514002 - DNA, 15 bp, Homo sapiens
cccttctccccagcc

SEQ ID NO: 1514003 - DNA, 18 bp, Homo sapiens
cccttctcccttgccctc

SEQ ID NO: 1514004 - DNA, 16 bp, Homo sapiens
cccttctcctttcctt

SEQ ID NO: 1514005 - DNA, 23 bp, Homo sapiens
cccttctcctttccttcccaggc

SEQ ID NO: 1514006 - DNA, 21 bp, Homo sapiens
cccttctctcttttcttctca

SEQ ID NO: 1514007 - DNA, 14 bp, Homo sapiens
cccttctctgctcc

SEQ ID NO: 1514008 - DNA, 16 bp, Homo sapiens
cccttctctgctccac

SEQ ID NO: 1514009 - DNA, 17 bp, Homo sapiens
cccttctctgctccacc

SEQ ID NO: 1514010 - DNA, 20 bp, Homo sapiens
cccttctctgctccaccaca

SEQ ID NO: 1514011 - DNA, 15 bp, Homo sapiens
cccttctctggtctc

SEQ ID NO: 1514012 - DNA, 18 bp, Homo sapiens
cccttctctggtctcctt

SEQ ID NO: 1514013 - DNA, 19 bp, Homo sapiens
cccttctctggtctccttg

SEQ ID NO: 1514014 - DNA, 20 bp, Homo sapiens
cccttctctggtctccttga

SEQ ID NO: 1514015 - DNA, 17 bp, Homo sapiens
cccttctgactgtttat

SEQ ID NO: 1514016 - DNA, 12 bp, Homo sapiens
cccttctgcctt

SEQ ID NO: 1514017 - DNA, 18 bp, Homo sapiens
cccttgaaactttgggaa

SEQ ID NO: 1514018 - DNA, 18 bp, Homo sapiens
cccttgaaccccctccct

SEQ ID NO: 1514019 - DNA, 20 bp, Homo sapiens
cccttgaagaggggaggggc

SEQ ID NO: 1514020 - DNA, 14 bp, Homo sapiens
cccttgagaaacct

SEQ ID NO: 1514021 - DNA, 20 bp, Homo sapiens
cccttgaggattgtggaaaa

SEQ ID NO: 1514022 - DNA, 19 bp, Homo sapiens
cccttgatttaaacacaca

SEQ ID NO: 1514023 - DNA, 16 bp, Homo sapiens
cccttgcagctagttt

SEQ ID NO: 1514024 - DNA, 19 bp, Homo sapiens
cccttgcagctagttttct

SEQ ID NO: 1514025 - DNA, 14 bp, Homo sapiens
cccttgcaggggtc

SEQ ID NO: 1514026 - DNA, 19 bp, Homo sapiens
cccttgcagttcagcacca

SEQ ID NO: 1514027 - DNA, 13 bp, Homo sapiens
cccttgccagaca

SEQ ID NO: 1514028 - DNA, 14 bp, Homo sapiens
cccttgcccttgga

SEQ ID NO: 1514029 - DNA, 13 bp, Homo sapiens
cccttgcctcccc

SEQ ID NO: 1514030 - DNA, 19 bp, Homo sapiens
cccttgcctccccatttcc

SEQ ID NO: 1514031 - DNA, 12 bp, Homo sapiens
cccttgcctctg

SEQ ID NO: 1514032 - DNA, 22 bp, Homo sapiens
cccttgccttatgggctgaagt

SEQ ID NO: 1514033 - DNA, 12 bp, Homo sapiens
cccttgctgctt

SEQ ID NO: 1514034 - DNA, 20 bp, Homo sapiens
cccttgctggccccagccct

SEQ ID NO: 1514035 - DNA, 21 bp, Homo sapiens
cccttgctggccccagccctg

SEQ ID NO: 1514036 - DNA, 12 bp, Homo sapiens
cccttgctgtac

SEQ ID NO: 1514037 - DNA, 13 bp, Homo sapiens
cccttgctttcct

SEQ ID NO: 1514038 - DNA, 20 bp, Homo sapiens
cccttgctttcctgggcctt

SEQ ID NO: 1514039 - DNA, 16 bp, Homo sapiens
cccttggaacaccctg

SEQ ID NO: 1514040 - DNA, 20 bp, Homo sapiens
cccttggaacaccctggatg

SEQ ID NO: 1514041 - DNA, 17 bp, Homo sapiens
cccttggagagagaggc

SEQ ID NO: 1514042 - DNA, 18 bp, Homo sapiens
cccttggagctgccgtgc

SEQ ID NO: 1514043 - DNA, 14 bp, Homo sapiens
cccttggaggagag

SEQ ID NO: 1514044 - DNA, 17 bp, Homo sapiens
cccttggaggagagaga

SEQ ID NO: 1514045 - DNA, 14 bp, Homo sapiens
cccttggcctcaga

SEQ ID NO: 1514046 - DNA, 14 bp, Homo sapiens
cccttggcttcctc

SEQ ID NO: 1514047 - DNA, 18 bp, Homo sapiens
cccttggcttctgtgatg

SEQ ID NO: 1514048 - DNA, 20 bp, Homo sapiens
cccttggggtaagccagagc

SEQ ID NO: 1514049 - DNA, 20 bp, Homo sapiens
cccttgtacctatggctgcc

SEQ ID NO: 1514050 - DNA, 21 bp, Homo sapiens
cccttgtattttgttaaagct

SEQ ID NO: 1514051 - DNA, 21 bp, Homo sapiens
cccttgtcctgccagctgcct

SEQ ID NO: 1514052 - DNA, 14 bp, Homo sapiens
cccttgtgtcaaga

SEQ ID NO: 1514053 - DNA, 12 bp, Homo sapiens
cccttgtgtgtg

SEQ ID NO: 1514054 - DNA, 13 bp, Homo sapiens
ccctttaccctct

SEQ ID NO: 1514055 - DNA, 16 bp, Homo sapiens
ccctttactcagccca

SEQ ID NO: 1514056 - DNA, 15 bp, Homo sapiens
ccctttccctacctt

SEQ ID NO: 1514057 - DNA, 14 bp, Homo sapiens
ccctttccttgcct

SEQ ID NO: 1514058 - DNA, 14 bp, Homo sapiens
ccctttcctttgga

SEQ ID NO: 1514059 - DNA, 14 bp, Homo sapiens
ccctttctcttctt

SEQ ID NO: 1514060 - DNA, 17 bp, Homo sapiens
ccctttcttgacaaaac

SEQ ID NO: 1514061 - DNA, 12 bp, Homo sapiens
ccctttgattca

SEQ ID NO: 1514062 - DNA, 17 bp, Homo sapiens
ccctttgcccagaaaga

SEQ ID NO: 1514063 - DNA, 13 bp, Homo sapiens
ccctttgctctgg

SEQ ID NO: 1514064 - DNA, 15 bp, Homo sapiens
ccctttggcttctga

SEQ ID NO: 1514065 - DNA, 17 bp, Homo sapiens
ccctttggtttgacaat

SEQ ID NO: 1514066 - DNA, 21 bp, Homo sapiens
ccctttggtttgacaattttg

SEQ ID NO: 1514067 - DNA, 13 bp, Homo sapiens
ccctttgtttgaa

SEQ ID NO: 1514068 - DNA, 12 bp, Homo sapiens
cccttttacttt

SEQ ID NO: 1514069 - DNA, 15 bp, Homo sapiens
cccttttcccccttc

SEQ ID NO: 1514070 - DNA, 16 bp, Homo sapiens
cccttttcccccttcc

SEQ ID NO: 1514071 - DNA, 13 bp, Homo sapiens
cccttttctttga

SEQ ID NO: 1514072 - DNA, 18 bp, Homo sapiens
cccttttcttttctaccc

SEQ ID NO: 1514073 - DNA, 21 bp, Homo sapiens
cccttttgtgggtttctctgt

SEQ ID NO: 1514074 - DNA, 21 bp, Homo sapiens
ccctttttctccacactccac

SEQ ID NO: 1514075 - DNA, 19 bp, Homo sapiens
cccttttttgtcccccaac

SEQ ID NO: 1514076 - DNA, 21 bp, Homo sapiens
cccttttttgtcccccaactt

SEQ ID NO: 1514077 - DNA, 24 bp, Homo sapiens
ccgaaacaggctactctcctcggc

SEQ ID NO: 1514078 - DNA, 12 bp, Homo sapiens
ccgaacagggac

SEQ ID NO: 1514079 - DNA, 21 bp, Homo sapiens
ccgaagccatcacttctcccc

SEQ ID NO: 1514080 - DNA, 16 bp, Homo sapiens
ccgaagccccttggag

SEQ ID NO: 1514081 - DNA, 18 bp, Homo sapiens
ccgaagccccttggagag

SEQ ID NO: 1514082 - DNA, 19 bp, Homo sapiens
ccgaagccccttggagaga

SEQ ID NO: 1514083 - DNA, 22 bp, Homo sapiens
ccgaagccccttggagagagag

SEQ ID NO: 1514084 - DNA, 19 bp, Homo sapiens
ccgaagctctggctgaacc

SEQ ID NO: 1514085 - DNA, 23 bp, Homo sapiens
ccgaagggaattaaaaagaagat

SEQ ID NO: 1514086 - DNA, 15 bp, Homo sapiens
ccgaaggtgcctcag

SEQ ID NO: 1514087 - DNA, 16 bp, Homo sapiens
ccgaatcccctccctg

SEQ ID NO: 1514088 - DNA, 16 bp, Homo sapiens
ccgaatctctttccct

SEQ ID NO: 1514089 - DNA, 15 bp, Homo sapiens
ccgacagcctggcac

SEQ ID NO: 1514090 - DNA, 12 bp, Homo sapiens
ccgacagtgcca

SEQ ID NO: 1514091 - DNA, 14 bp, Homo sapiens
ccgaccaactgccc

SEQ ID NO: 1514092 - DNA, 15 bp, Homo sapiens
ccgaccaactgccct

SEQ ID NO: 1514093 - DNA, 18 bp, Homo sapiens
ccgaccagaggagccttt

SEQ ID NO: 1514094 - DNA, 22 bp, Homo sapiens
ccgacccgggtctggtgctgag

SEQ ID NO: 1514095 - DNA, 23 bp, Homo sapiens
ccgaccctcatggcccccagggg

SEQ ID NO: 1514096 - DNA, 15 bp, Homo sapiens
ccgaccctgccctgg

SEQ ID NO: 1514097 - DNA, 13 bp, Homo sapiens
ccgacctcagcct

SEQ ID NO: 1514098 - DNA, 23 bp, Homo sapiens
ccgacctcgtcctccccctgcca

SEQ ID NO: 1514099 - DNA, 12 bp, Homo sapiens
ccgactgcctgt

SEQ ID NO: 1514100 - DNA, 16 bp, Homo sapiens
ccgactgcctgtctcc

SEQ ID NO: 1514101 - DNA, 14 bp, Homo sapiens
ccgactgggctcaa

SEQ ID NO: 1514102 - DNA, 13 bp, Homo sapiens
ccgacttgaatat

SEQ ID NO: 1514103 - DNA, 13 bp, Homo sapiens
ccgactttggaat

SEQ ID NO: 1514104 - DNA, 13 bp, Homo sapiens
ccgagaaggttta

SEQ ID NO: 1514105 - DNA, 16 bp, Homo sapiens
ccgagacaccatcctg

SEQ ID NO: 1514106 - DNA, 20 bp, Homo sapiens
ccgagacaccatcctgagcc

SEQ ID NO: 1514107 - DNA, 23 bp, Homo sapiens
ccgagacaccatcctgagccagg

SEQ ID NO: 1514108 - DNA, 23 bp, Homo sapiens
ccgagagagctctggccccgcta

SEQ ID NO: 1514109 - DNA, 20 bp, Homo sapiens
ccgagagcagtgggcaggtg

SEQ ID NO: 1514110 - DNA, 21 bp, Homo sapiens
ccgagagcttggactacacaa

SEQ ID NO: 1514111 - DNA, 19 bp, Homo sapiens
ccgagaggtgggccagtct

SEQ ID NO: 1514112 - DNA, 20 bp, Homo sapiens
ccgagagtagccgagagcct

SEQ ID NO: 1514113 - DNA, 22 bp, Homo sapiens
ccgagagtagccgagagcctgc

SEQ ID NO: 1514114 - DNA, 21 bp, Homo sapiens
ccgagatcacgccactgcact

SEQ ID NO: 1514115 - DNA, 17 bp, Homo sapiens
ccgagattgcgccactg

SEQ ID NO: 1514116 - DNA, 15 bp, Homo sapiens
ccgagcaaagatcaa

SEQ ID NO: 1514117 - DNA, 18 bp, Homo sapiens
ccgagcccagctacattc

SEQ ID NO: 1514118 - DNA, 11 bp, Homo sapiens
ccgagccctgg

SEQ ID NO: 1514119 - DNA, 15 bp, Homo sapiens
ccgagccctggagag

SEQ ID NO: 1514120 - DNA, 16 bp, Homo sapiens
ccgagccgggcctggg

SEQ ID NO: 1514121 - DNA, 19 bp, Homo sapiens
ccgagccgggcctggggct

SEQ ID NO: 1514122 - DNA, 17 bp, Homo sapiens
ccgagctcctcttccat

SEQ ID NO: 1514123 - DNA, 19 bp, Homo sapiens
ccgagctcgtgtatcctgg

SEQ ID NO: 1514124 - DNA, 13 bp, Homo sapiens
ccgagctctggtg

SEQ ID NO: 1514125 - DNA, 14 bp, Homo sapiens
ccgagctctggtgc

SEQ ID NO: 1514126 - DNA, 18 bp, Homo sapiens
ccgaggaactcgcctcag

SEQ ID NO: 1514127 - DNA, 21 bp, Homo sapiens
ccgaggaccaccagcaggcag

SEQ ID NO: 1514128 - DNA, 18 bp, Homo sapiens
ccgaggagctgggcccct

SEQ ID NO: 1514129 - DNA, 14 bp, Homo sapiens
ccgaggcagggtca

SEQ ID NO: 1514130 - DNA, 20 bp, Homo sapiens
ccgaggcagggtcaggagag

SEQ ID NO: 1514131 - DNA, 13 bp, Homo sapiens
ccgaggctccccg

SEQ ID NO: 1514132 - DNA, 17 bp, Homo sapiens
ccgaggctgccccaggc

SEQ ID NO: 1514133 - DNA, 14 bp, Homo sapiens
ccgaggctgctaga

SEQ ID NO: 1514134 - DNA, 17 bp, Homo sapiens
ccgagggatggtgcccc

SEQ ID NO: 1514135 - DNA, 14 bp, Homo sapiens
ccgagggcgtcaga

SEQ ID NO: 1514136 - DNA, 17 bp, Homo sapiens
ccgagggtcctggctcc

SEQ ID NO: 1514137 - DNA, 21 bp, Homo sapiens
ccgagggtcctggctcctgag

SEQ ID NO: 1514138 - DNA, 21 bp, Homo sapiens
ccgagtaatgacgtgtgtggc

SEQ ID NO: 1514139 - DNA, 14 bp, Homo sapiens
ccgagtctccggga

SEQ ID NO: 1514140 - DNA, 14 bp, Homo sapiens
ccgagtctcttctc

SEQ ID NO: 1514141 - DNA, 18 bp, Homo sapiens
ccgagtctcttctccact

SEQ ID NO: 1514142 - DNA, 19 bp, Homo sapiens
ccgagtctcttctccactg

SEQ ID NO: 1514143 - DNA, 21 bp, Homo sapiens
ccgagtctcttctccactgga

SEQ ID NO: 1514144 - DNA, 13 bp, Homo sapiens
ccgagtgcactgc

SEQ ID NO: 1514145 - DNA, 12 bp, Homo sapiens
ccgatcaacatt

SEQ ID NO: 1514146 - DNA, 11 bp, Homo sapiens
ccgatgccacc

SEQ ID NO: 1514147 - DNA, 13 bp, Homo sapiens
ccgatgccaccgg

SEQ ID NO: 1514148 - DNA, 13 bp, Homo sapiens
ccgatgctgacct

SEQ ID NO: 1514149 - DNA, 21 bp, Homo sapiens
ccgatgctgacctcacctggt

SEQ ID NO: 1514150 - DNA, 15 bp, Homo sapiens
ccgatgctgaggcca

SEQ ID NO: 1514151 - DNA, 13 bp, Homo sapiens
ccgatgctgcttt

SEQ ID NO: 1514152 - DNA, 20 bp, Homo sapiens
ccgatgctgctttcccctgt

SEQ ID NO: 1514153 - DNA, 19 bp, Homo sapiens
ccgatgtcgacatgttttt

SEQ ID NO: 1514154 - DNA, 15 bp, Homo sapiens
ccgcaaccacttgct

SEQ ID NO: 1514155 - DNA, 17 bp, Homo sapiens
ccgcaacccacagctca

SEQ ID NO: 1514156 - DNA, 16 bp, Homo sapiens
ccgcacagctcaggag

SEQ ID NO: 1514157 - DNA, 17 bp, Homo sapiens
ccgcaccaggccgggct

SEQ ID NO: 1514158 - DNA, 11 bp, Homo sapiens
ccgcaccccag

SEQ ID NO: 1514159 - DNA, 18 bp, Homo sapiens
ccgcaccccggcctcagg

SEQ ID NO: 1514160 - DNA, 16 bp, Homo sapiens
ccgcacccctccctgc

SEQ ID NO: 1514161 - DNA, 14 bp, Homo sapiens
ccgcaccctgcacc

SEQ ID NO: 1514162 - DNA, 15 bp, Homo sapiens
ccgcaccctgcacct

SEQ ID NO: 1514163 - DNA, 23 bp, Homo sapiens
ccgcaccctgcacctgctgcgtc

SEQ ID NO: 1514164 - DNA, 18 bp, Homo sapiens
ccgcaccctggcctggtc

SEQ ID NO: 1514165 - DNA, 19 bp, Homo sapiens
ccgcacctaaagcagccag

SEQ ID NO: 1514166 - DNA, 20 bp, Homo sapiens
ccgcaccttcctcctccccg

SEQ ID NO: 1514167 - DNA, 23 bp, Homo sapiens
ccgcaccttcctcctccccgctc

SEQ ID NO: 1514168 - DNA, 12 bp, Homo sapiens
ccgcactctgcc

SEQ ID NO: 1514169 - DNA, 15 bp, Homo sapiens
ccgcagacgggcaca

SEQ ID NO: 1514170 - DNA, 17 bp, Homo sapiens
ccgcagacgggcacaga

SEQ ID NO: 1514171 - DNA, 13 bp, Homo sapiens
ccgcagagctggc

SEQ ID NO: 1514172 - DNA, 22 bp, Homo sapiens
ccgcagccagccggtgcctggc

SEQ ID NO: 1514173 - DNA, 17 bp, Homo sapiens
ccgcagcccgcctgccg

SEQ ID NO: 1514174 - DNA, 21 bp, Homo sapiens
ccgcagcccgtgaagcagtgc

SEQ ID NO: 1514175 - DNA, 23 bp, Homo sapiens
ccgcagcccgtgaagcagtgcct

SEQ ID NO: 1514176 - DNA, 17 bp, Homo sapiens
ccgcagctcttgccctt

SEQ ID NO: 1514177 - DNA, 18 bp, Homo sapiens
ccgcaggaactgggctgg

SEQ ID NO: 1514178 - DNA, 18 bp, Homo sapiens
ccgcaggatccctcctga

SEQ ID NO: 1514179 - DNA, 19 bp, Homo sapiens
ccgcaggatccctcctgag

SEQ ID NO: 1514180 - DNA, 21 bp, Homo sapiens
ccgcaggatccctcctgagct

SEQ ID NO: 1514181 - DNA, 11 bp, Homo sapiens
ccgcagggcca

SEQ ID NO: 1514182 - DNA, 18 bp, Homo sapiens
ccgcagtccccagccctt

SEQ ID NO: 1514183 - DNA, 16 bp, Homo sapiens
ccgcagtgctgggacc

SEQ ID NO: 1514184 - DNA, 15 bp, Homo sapiens
ccgcagttgggagga

SEQ ID NO: 1514185 - DNA, 22 bp, Homo sapiens
ccgcatccctgcttctggcgcc

SEQ ID NO: 1514186 - DNA, 15 bp, Homo sapiens
ccgcatcttctccat

SEQ ID NO: 1514187 - DNA, 17 bp, Homo sapiens
ccgcatgcggcccagga

SEQ ID NO: 1514188 - DNA, 13 bp, Homo sapiens
ccgcattccctga

SEQ ID NO: 1514189 - DNA, 15 bp, Homo sapiens
ccgcattccctgagt

SEQ ID NO: 1514190 - DNA, 23 bp, Homo sapiens
ccgcattccctgagtcaccagga

SEQ ID NO: 1514191 - DNA, 16 bp, Homo sapiens
ccgccacccccatctt

SEQ ID NO: 1514192 - DNA, 14 bp, Homo sapiens
ccgccacctcaggg

SEQ ID NO: 1514193 - DNA, 22 bp, Homo sapiens
ccgccacctgaggtgggctggg

SEQ ID NO: 1514194 - DNA, 12 bp, Homo sapiens
ccgccacggcca

SEQ ID NO: 1514195 - DNA, 13 bp, Homo sapiens
ccgccacggccac

SEQ ID NO: 1514196 - DNA, 14 bp, Homo sapiens
ccgccacggccacc

SEQ ID NO: 1514197 - DNA, 16 bp, Homo sapiens
ccgccacgtcccagca

SEQ ID NO: 1514198 - DNA, 20 bp, Homo sapiens
ccgccactaggtgtccccaa

SEQ ID NO: 1514199 - DNA, 22 bp, Homo sapiens
ccgccagccccgctcccaccta

SEQ ID NO: 1514200 - DNA, 16 bp, Homo sapiens
ccgccagcctcagtgc

SEQ ID NO: 1514201 - DNA, 23 bp, Homo sapiens
ccgccagcctcctctggacggca

SEQ ID NO: 1514202 - DNA, 12 bp, Homo sapiens
ccgccagcgtgt

SEQ ID NO: 1514203 - DNA, 16 bp, Homo sapiens
ccgccagcgtgtggag

SEQ ID NO: 1514204 - DNA, 17 bp, Homo sapiens
ccgccagcgtgtggagc

SEQ ID NO: 1514205 - DNA, 13 bp, Homo sapiens
ccgccagggctgg

SEQ ID NO: 1514206 - DNA, 14 bp, Homo sapiens
ccgccatccttcac

SEQ ID NO: 1514207 - DNA, 20 bp, Homo sapiens
ccgccatccttcaccagagc

SEQ ID NO: 1514208 - DNA, 20 bp, Homo sapiens
ccgccattctcaagccctgc

SEQ ID NO: 1514209 - DNA, 15 bp, Homo sapiens
ccgccattgccacca

SEQ ID NO: 1514210 - DNA, 23 bp, Homo sapiens
ccgcccaaagagaaatcacaggg

SEQ ID NO: 1514211 - DNA, 18 bp, Homo sapiens
ccgcccactgtcctgggc

SEQ ID NO: 1514212 - DNA, 19 bp, Homo sapiens
ccgcccactgtcctgggcg

SEQ ID NO: 1514213 - DNA, 17 bp, Homo sapiens
ccgcccagctgcacctg

SEQ ID NO: 1514214 - DNA, 15 bp, Homo sapiens
ccgcccatcaccttg

SEQ ID NO: 1514215 - DNA, 14 bp, Homo sapiens
ccgcccatgcactg

SEQ ID NO: 1514216 - DNA, 19 bp, Homo sapiens
ccgcccccagtccccaccc

SEQ ID NO: 1514217 - DNA, 19 bp, Homo sapiens
ccgcccccgcctgggcacc

SEQ ID NO: 1514218 - DNA, 14 bp, Homo sapiens
ccgccccctcctga

SEQ ID NO: 1514219 - DNA, 18 bp, Homo sapiens
ccgcccctgtggccctgg

SEQ ID NO: 1514220 - DNA, 16 bp, Homo sapiens
ccgcccgggcccagag

SEQ ID NO: 1514221 - DNA, 15 bp, Homo sapiens
ccgccctgctcctcc

SEQ ID NO: 1514222 - DNA, 22 bp, Homo sapiens
ccgccctgctcctccctggctg

SEQ ID NO: 1514223 - DNA, 20 bp, Homo sapiens
ccgcccttccatgtgccttt

SEQ ID NO: 1514224 - DNA, 15 bp, Homo sapiens
ccgccgcctcccacg

SEQ ID NO: 1514225 - DNA, 15 bp, Homo sapiens
ccgccgcgccagtcc

SEQ ID NO: 1514226 - DNA, 23 bp, Homo sapiens
ccgcctcaatgtggttgcaaggc

SEQ ID NO: 1514227 - DNA, 18 bp, Homo sapiens
ccgcctcagcctcccaaa

SEQ ID NO: 1514228 - DNA, 16 bp, Homo sapiens
ccgcctcagcctcctg

SEQ ID NO: 1514229 - DNA, 13 bp, Homo sapiens
ccgcctccactct

SEQ ID NO: 1514230 - DNA, 14 bp, Homo sapiens
ccgcctccactcta

SEQ ID NO: 1514231 - DNA, 16 bp, Homo sapiens
ccgcctcccccgcagg

SEQ ID NO: 1514232 - DNA, 23 bp, Homo sapiens
ccgcctccctagttagcatccag

SEQ ID NO: 1514233 - DNA, 21 bp, Homo sapiens
ccgcctccctctcagaggcct

SEQ ID NO: 1514234 - DNA, 16 bp, Homo sapiens
ccgcctcgtgccagca

SEQ ID NO: 1514235 - DNA, 11 bp, Homo sapiens
ccgcctctggc

SEQ ID NO: 1514236 - DNA, 16 bp, Homo sapiens
ccgcctctgtctggag

SEQ ID NO: 1514237 - DNA, 16 bp, Homo sapiens
ccgcctgaaagccaca

SEQ ID NO: 1514238 - DNA, 18 bp, Homo sapiens
ccgcctgccgtgcatggc

SEQ ID NO: 1514239 - DNA, 13 bp, Homo sapiens
ccgcctgctcctc

SEQ ID NO: 1514240 - DNA, 14 bp, Homo sapiens
ccgcctgctcctca

SEQ ID NO: 1514241 - DNA, 12 bp, Homo sapiens
ccgcctggcagg

SEQ ID NO: 1514242 - DNA, 13 bp, Homo sapiens
ccgcctggccagg

SEQ ID NO: 1514243 - DNA, 16 bp, Homo sapiens
ccgcctggccaggagc

SEQ ID NO: 1514244 - DNA, 13 bp, Homo sapiens
ccgcctggccggc

SEQ ID NO: 1514245 - DNA, 11 bp, Homo sapiens
ccgcctgggat

SEQ ID NO: 1514246 - DNA, 14 bp, Homo sapiens
ccgcctgtgggcgc

SEQ ID NO: 1514247 - DNA, 16 bp, Homo sapiens
ccgccttccaaaacct

SEQ ID NO: 1514248 - DNA, 19 bp, Homo sapiens
ccgccttctcccacatgag

SEQ ID NO: 1514249 - DNA, 21 bp, Homo sapiens
ccgccttggccttgcagctgg

SEQ ID NO: 1514250 - DNA, 17 bp, Homo sapiens
ccgcgcccagcagaggc

SEQ ID NO: 1514251 - DNA, 16 bp, Homo sapiens
ccgcgcctccttcctt

SEQ ID NO: 1514252 - DNA, 17 bp, Homo sapiens
ccgcgcgcccaccctcc

SEQ ID NO: 1514253 - DNA, 19 bp, Homo sapiens
ccgcgctcgcccagcagga

SEQ ID NO: 1514254 - DNA, 14 bp, Homo sapiens
ccgcggccaggcac

SEQ ID NO: 1514255 - DNA, 15 bp, Homo sapiens
ccgcggccgcccgca

SEQ ID NO: 1514256 - DNA, 17 bp, Homo sapiens
ccgcgggacagccaagc

SEQ ID NO: 1514257 - DNA, 18 bp, Homo sapiens
ccgcgggcggccaggcaa

SEQ ID NO: 1514258 - DNA, 16 bp, Homo sapiens
ccgcgggttctagacg

SEQ ID NO: 1514259 - DNA, 21 bp, Homo sapiens
ccgcgggttctagacgcccct

SEQ ID NO: 1514260 - DNA, 19 bp, Homo sapiens
ccgcggtgctgactgaggc

SEQ ID NO: 1514261 - DNA, 23 bp, Homo sapiens
ccgcggtgctgactgaggcctgc

SEQ ID NO: 1514262 - DNA, 17 bp, Homo sapiens
ccgcgtctggtgacaac

SEQ ID NO: 1514263 - DNA, 16 bp, Homo sapiens
ccgctagaggcctgag

SEQ ID NO: 1514264 - DNA, 19 bp, Homo sapiens
ccgctagaggcctgaggat

SEQ ID NO: 1514265 - DNA, 12 bp, Homo sapiens
ccgctcagccct

SEQ ID NO: 1514266 - DNA, 15 bp, Homo sapiens
ccgctcagccctccc

SEQ ID NO: 1514267 - DNA, 19 bp, Homo sapiens
ccgctcagccctccctgcc

SEQ ID NO: 1514268 - DNA, 12 bp, Homo sapiens
ccgctggccctg

SEQ ID NO: 1514269 - DNA, 19 bp, Homo sapiens
ccgctgggctgagccccta

SEQ ID NO: 1514270 - DNA, 12 bp, Homo sapiens
ccgctgtctctg

SEQ ID NO: 1514271 - DNA, 17 bp, Homo sapiens
ccgcttccccacagaac

SEQ ID NO: 1514272 - DNA, 18 bp, Homo sapiens
ccgcttccccacagaact

SEQ ID NO: 1514273 - DNA, 17 bp, Homo sapiens
ccgcttcctggcctccc

SEQ ID NO: 1514274 - DNA, 19 bp, Homo sapiens
ccgcttgaaaagctagtgt

SEQ ID NO: 1514275 - DNA, 13 bp, Homo sapiens
ccgcttggccacc

SEQ ID NO: 1514276 - DNA, 19 bp, Homo sapiens
ccgctttctctgagggggt

SEQ ID NO: 1514277 - DNA, 16 bp, Homo sapiens
ccgctttgtgattcca

SEQ ID NO: 1514278 - DNA, 17 bp, Homo sapiens
ccggaagatcagatgca

SEQ ID NO: 1514279 - DNA, 13 bp, Homo sapiens
ccggacagctgcc

SEQ ID NO: 1514280 - DNA, 15 bp, Homo sapiens
ccggacagctgccca

SEQ ID NO: 1514281 - DNA, 16 bp, Homo sapiens
ccggacagctgcccag

SEQ ID NO: 1514282 - DNA, 17 bp, Homo sapiens
ccggactggcagaagca

SEQ ID NO: 1514283 - DNA, 13 bp, Homo sapiens
ccggactggtgcc

SEQ ID NO: 1514284 - DNA, 16 bp, Homo sapiens
ccggactggtgccctc

SEQ ID NO: 1514285 - DNA, 17 bp, Homo sapiens
ccggactggtgccctcc

SEQ ID NO: 1514286 - DNA, 16 bp, Homo sapiens
ccggacttttctgcaa

SEQ ID NO: 1514287 - DNA, 13 bp, Homo sapiens
ccggagcacagcc

SEQ ID NO: 1514288 - DNA, 15 bp, Homo sapiens
ccggagcacagccct

SEQ ID NO: 1514289 - DNA, 11 bp, Homo sapiens
ccggagcccca

SEQ ID NO: 1514290 - DNA, 15 bp, Homo sapiens
ccggaggggcctggc

SEQ ID NO: 1514291 - DNA, 16 bp, Homo sapiens
ccggaggggcctggca

SEQ ID NO: 1514292 - DNA, 17 bp, Homo sapiens
ccggaggggcctggcag

SEQ ID NO: 1514293 - DNA, 14 bp, Homo sapiens
ccggatgtgctttt

SEQ ID NO: 1514294 - DNA, 18 bp, Homo sapiens
ccggcagccccttctggc

SEQ ID NO: 1514295 - DNA, 17 bp, Homo sapiens
ccggcaggcctgagaat

SEQ ID NO: 1514296 - DNA, 17 bp, Homo sapiens
ccggcatctcccctagc

SEQ ID NO: 1514297 - DNA, 16 bp, Homo sapiens
ccggccagcgggcaca

SEQ ID NO: 1514298 - DNA, 18 bp, Homo sapiens
ccggccagcgggcacagg

SEQ ID NO: 1514299 - DNA, 21 bp, Homo sapiens
ccggccagcgggcacagggca

SEQ ID NO: 1514300 - DNA, 14 bp, Homo sapiens
ccggccagctctgg

SEQ ID NO: 1514301 - DNA, 17 bp, Homo sapiens
ccggccagctctggagt

SEQ ID NO: 1514302 - DNA, 19 bp, Homo sapiens
ccggccaggccgcgcccag

SEQ ID NO: 1514303 - DNA, 15 bp, Homo sapiens
ccggccatactgcct

SEQ ID NO: 1514304 - DNA, 16 bp, Homo sapiens
ccggccatactgcctt

SEQ ID NO: 1514305 - DNA, 16 bp, Homo sapiens
ccggccccagccagag

SEQ ID NO: 1514306 - DNA, 21 bp, Homo sapiens
ccggccccccgcgctcgccca

SEQ ID NO: 1514307 - DNA, 22 bp, Homo sapiens
ccggccccctccccccagactc

SEQ ID NO: 1514308 - DNA, 14 bp, Homo sapiens
ccggccccctgccc

SEQ ID NO: 1514309 - DNA, 19 bp, Homo sapiens
ccggccccggccccagcca

SEQ ID NO: 1514310 - DNA, 13 bp, Homo sapiens
ccggccctgtgtg

SEQ ID NO: 1514311 - DNA, 17 bp, Homo sapiens
ccggccgcgccgccgcc

SEQ ID NO: 1514312 - DNA, 17 bp, Homo sapiens
ccggccgctccaccagc

SEQ ID NO: 1514313 - DNA, 16 bp, Homo sapiens
ccggcctaggcacctc

SEQ ID NO: 1514314 - DNA, 22 bp, Homo sapiens
ccggcctaggcacctccccgct

SEQ ID NO: 1514315 - DNA, 17 bp, Homo sapiens
ccggcctcagggcgctc

SEQ ID NO: 1514316 - DNA, 15 bp, Homo sapiens
ccggcctccactccc

SEQ ID NO: 1514317 - DNA, 16 bp, Homo sapiens
ccggcctctctggcct

SEQ ID NO: 1514318 - DNA, 21 bp, Homo sapiens
ccggcctctctggcctcccac

SEQ ID NO: 1514319 - DNA, 13 bp, Homo sapiens
ccggcctcttcca

SEQ ID NO: 1514320 - DNA, 14 bp, Homo sapiens
ccggcctcttccac

SEQ ID NO: 1514321 - DNA, 22 bp, Homo sapiens
ccggcctgggtgacagagtgag

SEQ ID NO: 1514322 - DNA, 14 bp, Homo sapiens
ccggcgctgcaggt

SEQ ID NO: 1514323 - DNA, 20 bp, Homo sapiens
ccggcggaaagcctctgtcc

SEQ ID NO: 1514324 - DNA, 21 bp, Homo sapiens
ccggcgtcttgcccagcagct

SEQ ID NO: 1514325 - DNA, 22 bp, Homo sapiens
ccggctaattttttttgtattt

SEQ ID NO: 1514326 - DNA, 14 bp, Homo sapiens
ccggctacatcagc

SEQ ID NO: 1514327 - DNA, 13 bp, Homo sapiens
ccggctctgggcc

SEQ ID NO: 1514328 - DNA, 18 bp, Homo sapiens
ccggctgagtggcagcag

SEQ ID NO: 1514329 - DNA, 22 bp, Homo sapiens
ccggctgagtggcagcagcccc

SEQ ID NO: 1514330 - DNA, 13 bp, Homo sapiens
ccggctgcctgcc

SEQ ID NO: 1514331 - DNA, 15 bp, Homo sapiens
ccggctgggcctcct

SEQ ID NO: 1514332 - DNA, 21 bp, Homo sapiens
ccgggaagtgagggctcactc

SEQ ID NO: 1514333 - DNA, 21 bp, Homo sapiens
ccgggaagttttacagcaagg

SEQ ID NO: 1514334 - DNA, 22 bp, Homo sapiens
ccgggacagacctggacactag

SEQ ID NO: 1514335 - DNA, 16 bp, Homo sapiens
ccgggaccacagctgc

SEQ ID NO: 1514336 - DNA, 21 bp, Homo sapiens
ccgggaccacagctgctggcc

SEQ ID NO: 1514337 - DNA, 20 bp, Homo sapiens
ccgggaccaccctgagccgg

SEQ ID NO: 1514338 - DNA, 21 bp, Homo sapiens
ccgggaccattgacctcagct

SEQ ID NO: 1514339 - DNA, 19 bp, Homo sapiens
ccgggactctccccctttc

SEQ ID NO: 1514340 - DNA, 16 bp, Homo sapiens
ccgggagaagccacct

SEQ ID NO: 1514341 - DNA, 17 bp, Homo sapiens
ccgggagaaggcatgag

SEQ ID NO: 1514342 - DNA, 21 bp, Homo sapiens
ccgggagctttgggtgaccag

SEQ ID NO: 1514343 - DNA, 22 bp, Homo sapiens
ccgggagctttgggtgaccagc

SEQ ID NO: 1514344 - DNA, 22 bp, Homo sapiens
ccgggaggtggaggttgcagtg

SEQ ID NO: 1514345 - DNA, 18 bp, Homo sapiens
ccgggataaactgagcct

SEQ ID NO: 1514346 - DNA, 23 bp, Homo sapiens
ccgggataaactgagcctgttca

SEQ ID NO: 1514347 - DNA, 20 bp, Homo sapiens
ccgggcagggctcccacaga

SEQ ID NO: 1514348 - DNA, 14 bp, Homo sapiens
ccgggcatgatggt

SEQ ID NO: 1514349 - DNA, 21 bp, Homo sapiens
ccgggcatggtggcaggcgcc

SEQ ID NO: 1514350 - DNA, 22 bp, Homo sapiens
ccgggcatggtggcgcaagcct

SEQ ID NO: 1514351 - DNA, 14 bp, Homo sapiens
ccgggccagggctg

SEQ ID NO: 1514352 - DNA, 16 bp, Homo sapiens
ccgggcccctgggctt

SEQ ID NO: 1514353 - DNA, 15 bp, Homo sapiens
ccgggccctgagtaa

SEQ ID NO: 1514354 - DNA, 11 bp, Homo sapiens
ccgggcctccc

SEQ ID NO: 1514355 - DNA, 24 bp, Homo sapiens
ccgggcctcccaccgcagcgtccc

SEQ ID NO: 1514356 - DNA, 13 bp, Homo sapiens
ccgggcctggggc

SEQ ID NO: 1514357 - DNA, 14 bp, Homo sapiens
ccgggctctctgct

SEQ ID NO: 1514358 - DNA, 20 bp, Homo sapiens
cctatgtcctaaggacacac

SEQ ID NO: 1514359 - DNA, 24 bp, Homo sapiens
cctatgtcctaaggacacactaat

SEQ ID NO: 1514360 - DNA, 14 bp, Homo sapiens
cctatgtggcagct

SEQ ID NO: 1514361 - DNA, 15 bp, Homo sapiens
cctatgtggcagctg

SEQ ID NO: 1514362 - DNA, 22 bp, Homo sapiens
cctattctattgcagttataga

SEQ ID NO: 1514363 - DNA, 13 bp, Homo sapiens
cctattctgtgtt

SEQ ID NO: 1514364 - DNA, 21 bp, Homo sapiens
cctattgtaatcgtgtgccat

SEQ ID NO: 1514365 - DNA, 17 bp, Homo sapiens
cctattgtgactcttct

SEQ ID NO: 1514366 - DNA, 22 bp, Homo sapiens
cctatttattaatattttacag

SEQ ID NO: 1514367 - DNA, 14 bp, Homo sapiens
cctatttattgact

SEQ ID NO: 1514368 - DNA, 18 bp, Homo sapiens
cctatttctatgtcattt

SEQ ID NO: 1514369 - DNA, 19 bp, Homo sapiens
cctatttctatgtcatttt

SEQ ID NO: 1514370 - DNA, 18 bp, Homo sapiens
cctattttcatttgtaca

SEQ ID NO: 1514371 - DNA, 20 bp, Homo sapiens
cctattttcatttgtacaag

SEQ ID NO: 1514372 - DNA, 22 bp, Homo sapiens
cctattttgaatgcagaaaaca

SEQ ID NO: 1514373 - DNA, 23 bp, Homo sapiens
cctatttttgacatggaaatgaa

SEQ ID NO: 1514374 - DNA, 13 bp, Homo sapiens
cctatttttgtag

SEQ ID NO: 1514375 - DNA, 18 bp, Homo sapiens
cctcaaaaagcagaagga

SEQ ID NO: 1514376 - DNA, 16 bp, Homo sapiens
cctcaaaagcaccctt

SEQ ID NO: 1514377 - DNA, 14 bp, Homo sapiens
cctcaaagggcagt

SEQ ID NO: 1514378 - DNA, 14 bp, Homo sapiens
cctcaactccagga

SEQ ID NO: 1514379 - DNA, 16 bp, Homo sapiens
cctcaactgagggcca

SEQ ID NO: 1514380 - DNA, 17 bp, Homo sapiens
cctcaactgagggccag

SEQ ID NO: 1514381 - DNA, 20 bp, Homo sapiens
cctcaactgagggccaggga

SEQ ID NO: 1514382 - DNA, 21 bp, Homo sapiens
cctcaagcaataattgtttcc

SEQ ID NO: 1514383 - DNA, 23 bp, Homo sapiens
cctcaaggacaaagtctccagcc

SEQ ID NO: 1514384 - DNA, 21 bp, Homo sapiens
cctcaaggtccattattttgt

SEQ ID NO: 1514385 - DNA, 20 bp, Homo sapiens
cctcaaggttttaggttcta

SEQ ID NO: 1514386 - DNA, 15 bp, Homo sapiens
cctcaagtgtcctga

SEQ ID NO: 1514387 - DNA, 15 bp, Homo sapiens
cctcaatgccctgcc

SEQ ID NO: 1514388 - DNA, 15 bp, Homo sapiens
cctcacaagcctctt

SEQ ID NO: 1514389 - DNA, 21 bp, Homo sapiens
cctcacacccctgtcccaccc

SEQ ID NO: 1514390 - DNA, 15 bp, Homo sapiens
cctcacaggccccag

SEQ ID NO: 1514391 - DNA, 13 bp, Homo sapiens
cctcacagtgacc

SEQ ID NO: 1514392 - DNA, 18 bp, Homo sapiens
cctcacagtgacccttcc

SEQ ID NO: 1514393 - DNA, 18 bp, Homo sapiens
cctcaccagccctggcaa

SEQ ID NO: 1514394 - DNA, 16 bp, Homo sapiens
cctcacccaccctgtg

SEQ ID NO: 1514395 - DNA, 16 bp, Homo sapiens
cctcaccccgtctggg

SEQ ID NO: 1514396 - DNA, 14 bp, Homo sapiens
cctcacccctgccc

SEQ ID NO: 1514397 - DNA, 16 bp, Homo sapiens
cctcacccctgccctg

SEQ ID NO: 1514398 - DNA, 20 bp, Homo sapiens
cctcacccctggttctcatc

SEQ ID NO: 1514399 - DNA, 23 bp, Homo sapiens
cctcacccctggttctcatcttt

SEQ ID NO: 1514400 - DNA, 18 bp, Homo sapiens
cctcaccgagtgggggca

SEQ ID NO: 1514401 - DNA, 22 bp, Homo sapiens
cctcacctaataggctgggaga

SEQ ID NO: 1514402 - DNA, 12 bp, Homo sapiens
cctcacctcatg

SEQ ID NO: 1514403 - DNA, 16 bp, Homo sapiens
cctcacctcatgccca

SEQ ID NO: 1514404 - DNA, 13 bp, Homo sapiens
cctcacctcctct

SEQ ID NO: 1514405 - DNA, 14 bp, Homo sapiens
cctcacctctgagg

SEQ ID NO: 1514406 - DNA, 16 bp, Homo sapiens
cctcacctggtacctg

SEQ ID NO: 1514407 - DNA, 14 bp, Homo sapiens
cctcacctggtcct

SEQ ID NO: 1514408 - DNA, 15 bp, Homo sapiens
cctcaccttctgagt

SEQ ID NO: 1514409 - DNA, 22 bp, Homo sapiens
cctcacgtgcaggacagctctt

SEQ ID NO: 1514410 - DNA, 23 bp, Homo sapiens
cctcacgtgcaggacagctcttg

SEQ ID NO: 1514411 - DNA, 16 bp, Homo sapiens
cctcactccacagagt

SEQ ID NO: 1514412 - DNA, 12 bp, Homo sapiens
cctcactcctgt

SEQ ID NO: 1514413 - DNA, 23 bp, Homo sapiens
cctcactcttgaagtccaggact

SEQ ID NO: 1514414 - DNA, 21 bp, Homo sapiens
cctcactgctggggagtccct

SEQ ID NO: 1514415 - DNA, 21 bp, Homo sapiens
cctcactggaggagcagcttc

SEQ ID NO: 1514416 - DNA, 16 bp, Homo sapiens
cctcactggctggggc

SEQ ID NO: 1514417 - DNA, 23 bp, Homo sapiens
cctcactggctggggcagagggg

SEQ ID NO: 1514418 - DNA, 12 bp, Homo sapiens
cctcactgggtg

SEQ ID NO: 1514419 - DNA, 13 bp, Homo sapiens
cctcactgggtgg

SEQ ID NO: 1514420 - DNA, 14 bp, Homo sapiens
cctcactgggtggg

SEQ ID NO: 1514421 - DNA, 16 bp, Homo sapiens
cctcactgttgaattt

SEQ ID NO: 1514422 - DNA, 19 bp, Homo sapiens
cctcacttctgtctcctgt

SEQ ID NO: 1514423 - DNA, 20 bp, Homo sapiens
cctcacttctgtctcctgtc

SEQ ID NO: 1514424 - DNA, 14 bp, Homo sapiens
cctcacttgaatgt

SEQ ID NO: 1514425 - DNA, 20 bp, Homo sapiens
cctcagaagaaaacttttgt

SEQ ID NO: 1514426 - DNA, 18 bp, Homo sapiens
cctcagaaggccccagag

SEQ ID NO: 1514427 - DNA, 16 bp, Homo sapiens
cctcagagaccagggc

SEQ ID NO: 1514428 - DNA, 21 bp, Homo sapiens
cctcagagaccagggctccag

SEQ ID NO: 1514429 - DNA, 16 bp, Homo sapiens
cctcagagcagggcca

SEQ ID NO: 1514430 - DNA, 19 bp, Homo sapiens
cctcagagcagggccaaag

SEQ ID NO: 1514431 - DNA, 19 bp, Homo sapiens
cctcagaggcgtgctggtc

SEQ ID NO: 1514432 - DNA, 20 bp, Homo sapiens
cctcagatccaggcaggagc

SEQ ID NO: 1514433 - DNA, 13 bp, Homo sapiens
cctcagattcttc

SEQ ID NO: 1514434 - DNA, 15 bp, Homo sapiens
cctcagcaccccttc

SEQ ID NO: 1514435 - DNA, 11 bp, Homo sapiens
cctcagcactg

SEQ ID NO: 1514436 - DNA, 19 bp, Homo sapiens
cctcagccacacccaggca

SEQ ID NO: 1514437 - DNA, 16 bp, Homo sapiens
cctcagccatgaggag

SEQ ID NO: 1514438 - DNA, 21 bp, Homo sapiens
cctcagccatgaggagttgct

SEQ ID NO: 1514439 - DNA, 14 bp, Homo sapiens
cctcagccccactg

SEQ ID NO: 1514440 - DNA, 19 bp, Homo sapiens
cctcagccctggccctgcc

SEQ ID NO: 1514441 - DNA, 13 bp, Homo sapiens
cctcagcccttgc

SEQ ID NO: 1514442 - DNA, 14 bp, Homo sapiens
cctcagcctagacc

SEQ ID NO: 1514443 - DNA, 22 bp, Homo sapiens
cctcatgaatgtaaatttgtac

SEQ ID NO: 1514444 - DNA, 17 bp, Homo sapiens
cctcatgacagccagag

SEQ ID NO: 1514445 - DNA, 19 bp, Homo sapiens
cctcatgacagccagagcc

SEQ ID NO: 1514446 - DNA, 19 bp, Homo sapiens
cctcatgccaaccctgggc

SEQ ID NO: 1514447 - DNA, 15 bp, Homo sapiens
cctcatgccacacct

SEQ ID NO: 1514448 - DNA, 17 bp, Homo sapiens
cctcatgccacaccttc

SEQ ID NO: 1514449 - DNA, 22 bp, Homo sapiens
cctcatgcccaccccctgccct

SEQ ID NO: 1514450 - DNA, 16 bp, Homo sapiens
cctcatgcccagctct

SEQ ID NO: 1514451 - DNA, 17 bp, Homo sapiens
cctcatgcccagctctc

SEQ ID NO: 1514452 - DNA, 15 bp, Homo sapiens
cctcatggcccccag

SEQ ID NO: 1514453 - DNA, 19 bp, Homo sapiens
cctcatggcccccaggggc

SEQ ID NO: 1514454 - DNA, 21 bp, Homo sapiens
cctcatggcccccaggggcag

SEQ ID NO: 1514455 - DNA, 13 bp, Homo sapiens
cctcatgtaacat

SEQ ID NO: 1514456 - DNA, 14 bp, Homo sapiens
cctcatgtaacatt

SEQ ID NO: 1514457 - DNA, 23 bp, Homo sapiens
cctcatgtggctggaagatcctg

SEQ ID NO: 1514458 - DNA, 20 bp, Homo sapiens
cctcattaatagctgccttc

SEQ ID NO: 1514459 - DNA, 13 bp, Homo sapiens
cctcattataaaa

SEQ ID NO: 1514460 - DNA, 15 bp, Homo sapiens
cctcattcagcatgg

SEQ ID NO: 1514461 - DNA, 15 bp, Homo sapiens
cctcattcaggaaaa

SEQ ID NO: 1514462 - DNA, 16 bp, Homo sapiens
cctcattcaggaaaac

SEQ ID NO: 1514463 - DNA, 14 bp, Homo sapiens
cctcattgaatcct

SEQ ID NO: 1514464 - DNA, 16 bp, Homo sapiens
cctcattgaatcctca

SEQ ID NO: 1514465 - DNA, 17 bp, Homo sapiens
cctcattgctaccacag

SEQ ID NO: 1514466 - DNA, 21 bp, Homo sapiens
cctcattgctaccacagactt

SEQ ID NO: 1514467 - DNA, 13 bp, Homo sapiens
cctcatttaaaag

SEQ ID NO: 1514468 - DNA, 16 bp, Homo sapiens
cctcatttctgccagc

SEQ ID NO: 1514469 - DNA, 20 bp, Homo sapiens
cctcattttgggggtcatct

SEQ ID NO: 1514470 - DNA, 15 bp, Homo sapiens
cctccaaacctccag

SEQ ID NO: 1514471 - DNA, 16 bp, Homo sapiens
cctccaaacctccagc

SEQ ID NO: 1514472 - DNA, 19 bp, Homo sapiens
cctccaaacctccagcctc

SEQ ID NO: 1514473 - DNA, 20 bp, Homo sapiens
cctccaaacctccagcctcc

SEQ ID NO: 1514474 - DNA, 10 bp, Homo sapiens
cctccaaaga

SEQ ID NO: 1514475 - DNA, 19 bp, Homo sapiens
cctccaaagggcagtgggt

SEQ ID NO: 1514476 - DNA, 21 bp, Homo sapiens
cctccaaccaaataagacttc

SEQ ID NO: 1514477 - DNA, 17 bp, Homo sapiens
cctccaacgcccctgtg

SEQ ID NO: 1514478 - DNA, 18 bp, Homo sapiens
cctccaacgcccctgtgg

SEQ ID NO: 1514479 - DNA, 23 bp, Homo sapiens
cctccaacgcccctgtggccaac

SEQ ID NO: 1514480 - DNA, 21 bp, Homo sapiens
cctccaagggtttcgactggt

SEQ ID NO: 1514481 - DNA, 22 bp, Homo sapiens
cctccaagggtttcgactggtc

SEQ ID NO: 1514482 - DNA, 23 bp, Homo sapiens
cctccaagggtttcgactggtcc

SEQ ID NO: 1514483 - DNA, 23 bp, Homo sapiens
cctccaatcccaccaaccctcag

SEQ ID NO: 1514484 - DNA, 16 bp, Homo sapiens
cctccacacctgaact

SEQ ID NO: 1514485 - DNA, 20 bp, Homo sapiens
cctccacactgaccaagtgc

SEQ ID NO: 1514486 - DNA, 14 bp, Homo sapiens
cctccacagagagg

SEQ ID NO: 1514487 - DNA, 19 bp, Homo sapiens
cctccacagccccaacctc

SEQ ID NO: 1514488 - DNA, 15 bp, Homo sapiens
cctccacagccgcag

SEQ ID NO: 1514489 - DNA, 13 bp, Homo sapiens
cctccacagcgag

SEQ ID NO: 1514490 - DNA, 21 bp, Homo sapiens
cctccacagcgagggcagctg

SEQ ID NO: 1514491 - DNA, 13 bp, Homo sapiens
cctccacagctgc

SEQ ID NO: 1514492 - DNA, 16 bp, Homo sapiens
cctccacagctgcagc

SEQ ID NO: 1514493 - DNA, 16 bp, Homo sapiens
cctccacagtgctgct

SEQ ID NO: 1514494 - DNA, 16 bp, Homo sapiens
cctccacatcctttct

SEQ ID NO: 1514495 - DNA, 18 bp, Homo sapiens
cctccaccaaaccccact

SEQ ID NO: 1514496 - DNA, 18 bp, Homo sapiens
cctccaccaccactggcc

SEQ ID NO: 1514497 - DNA, 21 bp, Homo sapiens
cctccaccaccactggccacc

SEQ ID NO: 1514498 - DNA, 14 bp, Homo sapiens
cctccaccagcaag

SEQ ID NO: 1514499 - DNA, 16 bp, Homo sapiens
cctccaccagcaaggg

SEQ ID NO: 1514500 - DNA, 12 bp, Homo sapiens
cctccaccagcc

SEQ ID NO: 1514501 - DNA, 13 bp, Homo sapiens
cctccaccatgca

SEQ ID NO: 1514502 - DNA, 17 bp, Homo sapiens
cctccacccaccccctt

SEQ ID NO: 1514503 - DNA, 17 bp, Homo sapiens
cctccaccccccagaac

SEQ ID NO: 1514504 - DNA, 21 bp, Homo sapiens
cctccaccctgcattttcctc

SEQ ID NO: 1514505 - DNA, 14 bp, Homo sapiens
cctccaccctgtcc

SEQ ID NO: 1514506 - DNA, 19 bp, Homo sapiens
cctccaccctgtcccccag

SEQ ID NO: 1514507 - DNA, 19 bp, Homo sapiens
cctccaccgagccagcttg

SEQ ID NO: 1514508 - DNA, 12 bp, Homo sapiens
cctccacctcaa

SEQ ID NO: 1514509 - DNA, 14 bp, Homo sapiens
cctccaccttccat

SEQ ID NO: 1514510 - DNA, 17 bp, Homo sapiens
cctccaccttgctcttc

SEQ ID NO: 1514511 - DNA, 23 bp, Homo sapiens
cctccaccttgctcttctttctg

SEQ ID NO: 1514512 - DNA, 23 bp, Homo sapiens
cctccacgtgtccgtccaccctt

SEQ ID NO: 1514513 - DNA, 14 bp, Homo sapiens
cctccactcactcc

SEQ ID NO: 1514514 - DNA, 21 bp, Homo sapiens
cctccactcccccacctgaca

SEQ ID NO: 1514515 - DNA, 14 bp, Homo sapiens
cctccactctcccc

SEQ ID NO: 1514516 - DNA, 17 bp, Homo sapiens
cctccactctcccccac

SEQ ID NO: 1514517 - DNA, 19 bp, Homo sapiens
cctccactctcccccaccc

SEQ ID NO: 1514518 - DNA, 12 bp, Homo sapiens
cctccactgtgt

SEQ ID NO: 1514519 - DNA, 23 bp, Homo sapiens
cctccacttcccgtctcagaatc

SEQ ID NO: 1514520 - DNA, 12 bp, Homo sapiens
cctccagaagcc

SEQ ID NO: 1514521 - DNA, 22 bp, Homo sapiens
cctgctgcgtccccactccctt

SEQ ID NO: 1514522 - DNA, 15 bp, Homo sapiens
cctgctgctccatgg

SEQ ID NO: 1514523 - DNA, 15 bp, Homo sapiens
cctgctgctgctact

SEQ ID NO: 1514524 - DNA, 14 bp, Homo sapiens
cctgctgctggggc

SEQ ID NO: 1514525 - DNA, 21 bp, Homo sapiens
cctgctgctgtaactgctgag

SEQ ID NO: 1514526 - DNA, 14 bp, Homo sapiens
cctgctggaagccc

SEQ ID NO: 1514527 - DNA, 17 bp, Homo sapiens
cctgctggaagcccagc

SEQ ID NO: 1514528 - DNA, 17 bp, Homo sapiens
cctgctggaggcctcag

SEQ ID NO: 1514529 - DNA, 15 bp, Homo sapiens
cctgctggcacccac

SEQ ID NO: 1514530 - DNA, 19 bp, Homo sapiens
cctgctggcacccaccgtg

SEQ ID NO: 1514531 - DNA, 18 bp, Homo sapiens
cctgctggctgcggcccc

SEQ ID NO: 1514532 - DNA, 21 bp, Homo sapiens
cctgctgggaaccccgcagcc

SEQ ID NO: 1514533 - DNA, 16 bp, Homo sapiens
cctgctgggctctcca

SEQ ID NO: 1514534 - DNA, 18 bp, Homo sapiens
cctgctgggctctccacc

SEQ ID NO: 1514535 - DNA, 20 bp, Homo sapiens
cctgctgggctctccacctc

SEQ ID NO: 1514536 - DNA, 23 bp, Homo sapiens
cctgctgggctctccacctcagc

SEQ ID NO: 1514537 - DNA, 13 bp, Homo sapiens
cctgctggggatc

SEQ ID NO: 1514538 - DNA, 17 bp, Homo sapiens
cctgctggtacctgccc

SEQ ID NO: 1514539 - DNA, 19 bp, Homo sapiens
cctgctggtacctgccctc

SEQ ID NO: 1514540 - DNA, 21 bp, Homo sapiens
cctgctggttgttgccaggtt

SEQ ID NO: 1514541 - DNA, 22 bp, Homo sapiens
cctgctgtatttcctgcttccc

SEQ ID NO: 1514542 - DNA, 15 bp, Homo sapiens
cctgctgtctctctg

SEQ ID NO: 1514543 - DNA, 20 bp, Homo sapiens
cctgctgtgttaagaggact

SEQ ID NO: 1514544 - DNA, 21 bp, Homo sapiens
cctgctgtttatcccttaaga

SEQ ID NO: 1514545 - DNA, 14 bp, Homo sapiens
cctgcttccaggaa

SEQ ID NO: 1514546 - DNA, 18 bp, Homo sapiens
cctgcttcctgcttgcca

SEQ ID NO: 1514547 - DNA, 13 bp, Homo sapiens
cctgcttccttca

SEQ ID NO: 1514548 - DNA, 19 bp, Homo sapiens
cctgcttccttcagtttgt

SEQ ID NO: 1514549 - DNA, 17 bp, Homo sapiens
cctgcttctgctgccct

SEQ ID NO: 1514550 - DNA, 15 bp, Homo sapiens
cctgcttctggcgcc

SEQ ID NO: 1514551 - DNA, 23 bp, Homo sapiens
cctgcttcttcccctctgcggct

SEQ ID NO: 1514552 - DNA, 12 bp, Homo sapiens
cctgcttgataa

SEQ ID NO: 1514553 - DNA, 23 bp, Homo sapiens
cctgcttgcacacttccccatct

SEQ ID NO: 1514554 - DNA, 18 bp, Homo sapiens
cctgcttgccaaggcaga

SEQ ID NO: 1514555 - DNA, 20 bp, Homo sapiens
cctgcttggcccggccggcc

SEQ ID NO: 1514556 - DNA, 14 bp, Homo sapiens
cctgctttgcatct

SEQ ID NO: 1514557 - DNA, 18 bp, Homo sapiens
cctgctttgcatctttgt

SEQ ID NO: 1514558 - DNA, 15 bp, Homo sapiens
cctgctttggcgggc

SEQ ID NO: 1514559 - DNA, 18 bp, Homo sapiens
cctgctttgggctgccct

SEQ ID NO: 1514560 - DNA, 19 bp, Homo sapiens
cctgctttgggctgccctg

SEQ ID NO: 1514561 - DNA, 16 bp, Homo sapiens
cctgcttttccaggat

SEQ ID NO: 1514562 - DNA, 12 bp, Homo sapiens
cctgcttttctg

SEQ ID NO: 1514563 - DNA, 14 bp, Homo sapiens
cctgcttttctgtc

SEQ ID NO: 1514564 - DNA, 16 bp, Homo sapiens
cctgcttttctgtcct

SEQ ID NO: 1514565 - DNA, 14 bp, Homo sapiens
cctgctttttttct

SEQ ID NO: 1514566 - DNA, 15 bp, Homo sapiens
cctggaaacagcatg

SEQ ID NO: 1514567 - DNA, 21 bp, Homo sapiens
cctggaaacagcatgaataaa

SEQ ID NO: 1514568 - DNA, 22 bp, Homo sapiens
cctggaaacagcatgaataaaa

SEQ ID NO: 1514569 - DNA, 15 bp, Homo sapiens
cctggaaacccacct

SEQ ID NO: 1514570 - DNA, 21 bp, Homo sapiens
cctggaaacccacctctctgg

SEQ ID NO: 1514571 - DNA, 14 bp, Homo sapiens
cctggaaaccttcc

SEQ ID NO: 1514572 - DNA, 17 bp, Homo sapiens
cctggaaaggctcagtc

SEQ ID NO: 1514573 - DNA, 23 bp, Homo sapiens
cctggaaaggctcagtctcagga

SEQ ID NO: 1514574 - DNA, 14 bp, Homo sapiens
cctggaacaccagc

SEQ ID NO: 1514575 - DNA, 14 bp, Homo sapiens
cctggaaccaggga

SEQ ID NO: 1514576 - DNA, 16 bp, Homo sapiens
cctggaaccagggagg

SEQ ID NO: 1514577 - DNA, 16 bp, Homo sapiens
cctggaagaacaggcc

SEQ ID NO: 1514578 - DNA, 20 bp, Homo sapiens
cctggaagaacaggcctctc

SEQ ID NO: 1514579 - DNA, 14 bp, Homo sapiens
cctggaagagccca

SEQ ID NO: 1514580 - DNA, 15 bp, Homo sapiens
cctggaagagcccag

SEQ ID NO: 1514581 - DNA, 18 bp, Homo sapiens
cctggaagagcccagtct

SEQ ID NO: 1514582 - DNA, 14 bp, Homo sapiens
cctggaagcagagc

SEQ ID NO: 1514583 - DNA, 15 bp, Homo sapiens
cctggaagcagagca

SEQ ID NO: 1514584 - DNA, 22 bp, Homo sapiens
cctggaagcagagcaaaatgct

SEQ ID NO: 1514585 - DNA, 22 bp, Homo sapiens
cctggaagctctccgagctctg

SEQ ID NO: 1514586 - DNA, 16 bp, Homo sapiens
cctggaagctggaaga

SEQ ID NO: 1514587 - DNA, 21 bp, Homo sapiens
cctggaagctggaagactgtg

SEQ ID NO: 1514588 - DNA, 21 bp, Homo sapiens
cctggaagctgtgtccttgca

SEQ ID NO: 1514589 - DNA, 14 bp, Homo sapiens
cctggaaggacaca

SEQ ID NO: 1514590 - DNA, 17 bp, Homo sapiens
cctggaattcagcaccc

SEQ ID NO: 1514591 - DNA, 19 bp, Homo sapiens
ccttttgatggggagaaag

SEQ ID NO: 1514592 - DNA, 14 bp, Homo sapiens
ccttttgcacccct

SEQ ID NO: 1514593 - DNA, 16 bp, Homo sapiens
ccttttgcacccctcc

SEQ ID NO: 1514594 - DNA, 15 bp, Homo sapiens
ccttttgcagaagag

SEQ ID NO: 1514595 - DNA, 14 bp, Homo sapiens
ccttttgctctctg

SEQ ID NO: 1514596 - DNA, 22 bp, Homo sapiens
ccttttggataagtttctattc

SEQ ID NO: 1514597 - DNA, 14 bp, Homo sapiens
ccttttgtccccag

SEQ ID NO: 1514598 - DNA, 17 bp, Homo sapiens
ccttttgtccccagggc

SEQ ID NO: 1514599 - DNA, 21 bp, Homo sapiens
ccttttgtccccagggcccct

SEQ ID NO: 1514600 - DNA, 18 bp, Homo sapiens
ccttttgttttgaagctg

SEQ ID NO: 1514601 - DNA, 15 bp, Homo sapiens
cctttttaaaacaca

SEQ ID NO: 1514602 - DNA, 17 bp, Homo sapiens
cctttttaaaacacatg

SEQ ID NO: 1514603 - DNA, 16 bp, Homo sapiens
cctttttaaatgtgaa

SEQ ID NO: 1514604 - DNA, 21 bp, Homo sapiens
cctttttaaatgtgaattttt

SEQ ID NO: 1514605 - DNA, 11 bp, Homo sapiens
cctttttaagg

SEQ ID NO: 1514606 - DNA, 23 bp, Homo sapiens
cctttttaataaaaatacacatg

SEQ ID NO: 1514607 - DNA, 17 bp, Homo sapiens
cctttttcactttgaaa

SEQ ID NO: 1514608 - DNA, 16 bp, Homo sapiens
cctttttctccacact

SEQ ID NO: 1514609 - DNA, 16 bp, Homo sapiens
cctttttctttataaa

SEQ ID NO: 1514610 - DNA, 22 bp, Homo sapiens
ccttttttaaaaaaatttttgc

SEQ ID NO: 1514611 - DNA, 13 bp, Homo sapiens
ccttttttaaaag

SEQ ID NO: 1514612 - DNA, 18 bp, Homo sapiens
ccttttttctatatcaaa

SEQ ID NO: 1514613 - DNA, 22 bp, Homo sapiens
ccttttttctatatcaaaaaac

SEQ ID NO: 1514614 - DNA, 14 bp, Homo sapiens
ccttttttcttttt

SEQ ID NO: 1514615 - DNA, 23 bp, Homo sapiens
ccttttttgataaagtttctcag

SEQ ID NO: 1514616 - DNA, 16 bp, Homo sapiens
ccttttttttttcttg

SEQ ID NO: 1514617 - DNA, 23 bp, Homo sapiens
cgaaacacaaaccacaactgaca

SEQ ID NO: 1514618 - DNA, 22 bp, Homo sapiens
cgaaacaggctactctcctcgg

SEQ ID NO: 1514619 - DNA, 18 bp, Homo sapiens
cgaaacctgggattcagg

SEQ ID NO: 1514620 - DNA, 23 bp, Homo sapiens
cgaaactccatctcaaaacaaaa

SEQ ID NO: 1514621 - DNA, 14 bp, Homo sapiens
cgaaagctctagaa

SEQ ID NO: 1514622 - DNA, 23 bp, Homo sapiens
cgaaaggatgtaaacagtgcctg

SEQ ID NO: 1514623 - DNA, 20 bp, Homo sapiens
cgaaatctgtattctgtttg

SEQ ID NO: 1514624 - DNA, 15 bp, Homo sapiens
cgaacagggacttgt

SEQ ID NO: 1514625 - DNA, 20 bp, Homo sapiens
cgaacatggaactcattcct

SEQ ID NO: 1514626 - DNA, 15 bp, Homo sapiens
cgaaccaaggcagcc

SEQ ID NO: 1514627 - DNA, 16 bp, Homo sapiens
cgaaccaaggcagcct

SEQ ID NO: 1514628 - DNA, 23 bp, Homo sapiens
cgaacccacctgctgagagaccc

SEQ ID NO: 1514629 - DNA, 13 bp, Homo sapiens
cgaactcctggcc

SEQ ID NO: 1514630 - DNA, 11 bp, Homo sapiens
cgaactggcta

SEQ ID NO: 1514631 - DNA, 14 bp, Homo sapiens
cgaacttcacaact

SEQ ID NO: 1514632 - DNA, 21 bp, Homo sapiens
cgaacttcacataggaaggga

SEQ ID NO: 1514633 - DNA, 14 bp, Homo sapiens
cgaagagcaggcca

SEQ ID NO: 1514634 - DNA, 15 bp, Homo sapiens
cgaagagcaggccag

SEQ ID NO: 1514635 - DNA, 15 bp, Homo sapiens
cgaagagtcagcccc

SEQ ID NO: 1514636 - DNA, 11 bp, Homo sapiens
cgaagccatgt

SEQ ID NO: 1514637 - DNA, 16 bp, Homo sapiens
cgaagccccttggaga

SEQ ID NO: 1514638 - DNA, 20 bp, Homo sapiens
cgaagcggagagagccaaga

SEQ ID NO: 1514639 - DNA, 21 bp, Homo sapiens
cgaagcggagagagccaagac

SEQ ID NO: 1514640 - DNA, 24 bp, Homo sapiens
cgaagctcattcccaacgtgcaaa

SEQ ID NO: 1514641 - DNA, 12 bp, Homo sapiens
cgaagctctggc

SEQ ID NO: 1514642 - DNA, 14 bp, Homo sapiens
cgaagctctggctg

SEQ ID NO: 1514643 - DNA, 15 bp, Homo sapiens
cgaagctctggctga

SEQ ID NO: 1514644 - DNA, 14 bp, Homo sapiens
cgaaggcataataa

SEQ ID NO: 1514645 - DNA, 22 bp, Homo sapiens
cgaaggggccccggggctggca

SEQ ID NO: 1514646 - DNA, 13 bp, Homo sapiens
cgaaggggccctg

SEQ ID NO: 1514647 - DNA, 14 bp, Homo sapiens
cgaaggtgcctcag

SEQ ID NO: 1514648 - DNA, 15 bp, Homo sapiens
cgaaggtgcctcaga

SEQ ID NO: 1514649 - DNA, 19 bp, Homo sapiens
cgaagtctttgccttctct

SEQ ID NO: 1514650 - DNA, 20 bp, Homo sapiens
cgaagtctttgccttctctg

SEQ ID NO: 1514651 - DNA, 17 bp, Homo sapiens
cgaagtgtttatgtaat

SEQ ID NO: 1514652 - DNA, 14 bp, Homo sapiens
cgaagttgatgcaa

SEQ ID NO: 1514653 - DNA, 18 bp, Homo sapiens
cgaatcagctatttactg

SEQ ID NO: 1514654 - DNA, 18 bp, Homo sapiens
cgaatgtaattggaatct

SEQ ID NO: 1514655 - DNA, 20 bp, Homo sapiens
cgacaaaacattttgaagga

SEQ ID NO: 1514656 - DNA, 12 bp, Homo sapiens
cgacaagtgctg

SEQ ID NO: 1514657 - DNA, 16 bp, Homo sapiens
cgacacatatacatat

SEQ ID NO: 1514658 - DNA, 15 bp, Homo sapiens
cgacactgctgcacc

SEQ ID NO: 1514659 - DNA, 14 bp, Homo sapiens
cgacactttggttt

SEQ ID NO: 1514660 - DNA, 16 bp, Homo sapiens
cgacagctgggctgga

SEQ ID NO: 1514661 - DNA, 14 bp, Homo sapiens
cgacagggcctgga

SEQ ID NO: 1514662 - DNA, 16 bp, Homo sapiens
cgacagggcctggagc

SEQ ID NO: 1514663 - DNA, 19 bp, Homo sapiens
cgacatcccagaccagcca

SEQ ID NO: 1514664 - DNA, 20 bp, Homo sapiens
cgacatccctcccccagcag

SEQ ID NO: 1514665 - DNA, 21 bp, Homo sapiens
cgacatccgtcattgctgctg

SEQ ID NO: 1514666 - DNA, 14 bp, Homo sapiens
cgaccaactgccct

SEQ ID NO: 1514667 - DNA, 16 bp, Homo sapiens
cgaccacaccagcctc

SEQ ID NO: 1514668 - DNA, 17 bp, Homo sapiens
cgaccagaggagccttt

SEQ ID NO: 1514669 - DNA, 15 bp, Homo sapiens
cgaccaggctggaca

SEQ ID NO: 1514670 - DNA, 16 bp, Homo sapiens
cgaccaggctggacac

SEQ ID NO: 1514671 - DNA, 18 bp, Homo sapiens
cgaccaggctggacaccc

SEQ ID NO: 1514672 - DNA, 20 bp, Homo sapiens
cgacccagaatggagcctgc

SEQ ID NO: 1514673 - DNA, 20 bp, Homo sapiens
cgaccccaaaggaacactga

SEQ ID NO: 1514674 - DNA, 18 bp, Homo sapiens
cgaccccccgtgggctcc

SEQ ID NO: 1514675 - DNA, 21 bp, Homo sapiens
cgaccctcatggcccccaggg

SEQ ID NO: 1514676 - DNA, 14 bp, Homo sapiens
cgaccctgccctgg

SEQ ID NO: 1514677 - DNA, 21 bp, Homo sapiens
cgaccctgtgcaggagctagt

SEQ ID NO: 1514678 - DNA, 12 bp, Homo sapiens
cgacctcagcct

SEQ ID NO: 1514679 - DNA, 19 bp, Homo sapiens
cgacctcgtcctccccctg

SEQ ID NO: 1514680 - DNA, 23 bp, Homo sapiens
cgacctcgtcctccccctgccag

SEQ ID NO: 1514681 - DNA, 18 bp, Homo sapiens
cgacctggtttttaaata

SEQ ID NO: 1514682 - DNA, 15 bp, Homo sapiens
cgacgccacagccca

SEQ ID NO: 1514683 - DNA, 18 bp, Homo sapiens
cgactctggccctggccc

SEQ ID NO: 1514684 - DNA, 14 bp, Homo sapiens
cgactggccagggc

SEQ ID NO: 1514685 - DNA, 17 bp, Homo sapiens
cgactggccagggccac

SEQ ID NO: 1514686 - DNA, 20 bp, Homo sapiens
cgactggtccagctctgaca

SEQ ID NO: 1514687 - DNA, 22 bp, Homo sapiens
cgactgtcagtggggcagcctc

SEQ ID NO: 1514688 - DNA, 17 bp, Homo sapiens
cgacttcccctgggcaa

SEQ ID NO: 1514689 - DNA, 19 bp, Homo sapiens
cgacttggagactcctggt

SEQ ID NO: 1514690 - DNA, 22 bp, Homo sapiens
cgacttggagactcctggtctg

SEQ ID NO: 1514691 - DNA, 13 bp, Homo sapiens
cgactttctgcct

SEQ ID NO: 1514692 - DNA, 14 bp, Homo sapiens
cgagaaccctgagc

SEQ ID NO: 1514693 - DNA, 24 bp, Homo sapiens
cgagaagggtggatgacagggcag

SEQ ID NO: 1514694 - DNA, 12 bp, Homo sapiens
cgagaagtgctc

SEQ ID NO: 1514695 - DNA, 18 bp, Homo sapiens
cgagaagtgctcttggct

SEQ ID NO: 1514696 - DNA, 14 bp, Homo sapiens
cgcatgcggcccag

SEQ ID NO: 1514697 - DNA, 16 bp, Homo sapiens
cgcatgtaatcccagc

SEQ ID NO: 1514698 - DNA, 11 bp, Homo sapiens
cgcattaagca

SEQ ID NO: 1514699 - DNA, 16 bp, Homo sapiens
cgcattaagcacacac

SEQ ID NO: 1514700 - DNA, 18 bp, Homo sapiens
cgcattctcgtatccaac

SEQ ID NO: 1514701 - DNA, 17 bp, Homo sapiens
cgccaaataatgtctct

SEQ ID NO: 1514702 - DNA, 23 bp, Homo sapiens
cgccaccatcctgcagcctcctc

SEQ ID NO: 1514703 - DNA, 14 bp, Homo sapiens
cgccacccccatct

SEQ ID NO: 1514704 - DNA, 16 bp, Homo sapiens
cgccacccccatcttc

SEQ ID NO: 1514705 - DNA, 19 bp, Homo sapiens
cgccacccccatcttccac

SEQ ID NO: 1514706 - DNA, 20 bp, Homo sapiens
cgccacccccatcttccacc

SEQ ID NO: 1514707 - DNA, 17 bp, Homo sapiens
cgccacccctccttcct

SEQ ID NO: 1514708 - DNA, 13 bp, Homo sapiens
cgccacccgcagc

SEQ ID NO: 1514709 - DNA, 16 bp, Homo sapiens
cgccacctcagggcac

SEQ ID NO: 1514710 - DNA, 16 bp, Homo sapiens
cgccacggccaccctc

SEQ ID NO: 1514711 - DNA, 18 bp, Homo sapiens
cgccacggccaccctcct

SEQ ID NO: 1514712 - DNA, 17 bp, Homo sapiens
cgccatttcctcacgtg

SEQ ID NO: 1514713 - DNA, 18 bp, Homo sapiens
cgcccacaggaagcctgc

SEQ ID NO: 1514714 - DNA, 20 bp, Homo sapiens
cgcccacaggaagcctgcag

SEQ ID NO: 1514715 - DNA, 21 bp, Homo sapiens
cgcccacaggaagcctgcagt

SEQ ID NO: 1514716 - DNA, 22 bp, Homo sapiens
cgcccacaggaagcctgcagtc

SEQ ID NO: 1514717 - DNA, 16 bp, Homo sapiens
cgcccaccctgggctc

SEQ ID NO: 1514718 - DNA, 15 bp, Homo sapiens
cgcccactgtcctgg

SEQ ID NO: 1514719 - DNA, 17 bp, Homo sapiens
cgcccactgtcctgggc

SEQ ID NO: 1514720 - DNA, 12 bp, Homo sapiens
cgcccagacacc

SEQ ID NO: 1514721 - DNA, 16 bp, Homo sapiens
cgcccagacaccatgt

SEQ ID NO: 1514722 - DNA, 21 bp, Homo sapiens
cgcccagacaccatgtgcaat

SEQ ID NO: 1514723 - DNA, 15 bp, Homo sapiens
cgcccagctgcacct

SEQ ID NO: 1514724 - DNA, 18 bp, Homo sapiens
cgcccagctgcacctgcc

SEQ ID NO: 1514725 - DNA, 15 bp, Homo sapiens
cgcccaggagacatc

SEQ ID NO: 1514726 - DNA, 17 bp, Homo sapiens
cgcccattcgtctgtcc

SEQ ID NO: 1514727 - DNA, 13 bp, Homo sapiens
cgccccacagggc

SEQ ID NO: 1514728 - DNA, 21 bp, Homo sapiens
cgccccagatcaccagcccgg

SEQ ID NO: 1514729 - DNA, 14 bp, Homo sapiens
cgccccctcctcta

SEQ ID NO: 1514730 - DNA, 17 bp, Homo sapiens
cgccccctgcctgccat

SEQ ID NO: 1514731 - DNA, 15 bp, Homo sapiens
cgcccctccaaacct

SEQ ID NO: 1514732 - DNA, 18 bp, Homo sapiens
cgcccctccaaacctcca

SEQ ID NO: 1514733 - DNA, 19 bp, Homo sapiens
cgcccctccaaacctccag

SEQ ID NO: 1514734 - DNA, 16 bp, Homo sapiens
cgcccctcccacgcct

SEQ ID NO: 1514735 - DNA, 11 bp, Homo sapiens
cgcccctgagg

SEQ ID NO: 1514736 - DNA, 19 bp, Homo sapiens
cgcccctgggctaccatct

SEQ ID NO: 1514737 - DNA, 20 bp, Homo sapiens
cgcccctgtggccaactgca

SEQ ID NO: 1514738 - DNA, 18 bp, Homo sapiens
cgcccctgtggccctggc

SEQ ID NO: 1514739 - DNA, 19 bp, Homo sapiens
cgcccctgtggccctggcc

SEQ ID NO: 1514740 - DNA, 21 bp, Homo sapiens
cgcccgcacagctcccggcgg

SEQ ID NO: 1514741 - DNA, 12 bp, Homo sapiens
cgcccgcgccct

SEQ ID NO: 1514742 - DNA, 18 bp, Homo sapiens
cgcccgctcccttcctgc

SEQ ID NO: 1514743 - DNA, 17 bp, Homo sapiens
cgcccgctcctgccgca

SEQ ID NO: 1514744 - DNA, 14 bp, Homo sapiens
cgcccgctgggctg

SEQ ID NO: 1514745 - DNA, 15 bp, Homo sapiens
cgcccggcagcccct

SEQ ID NO: 1514746 - DNA, 19 bp, Homo sapiens
cgcccggcagccccttctg

SEQ ID NO: 1514747 - DNA, 14 bp, Homo sapiens
cgcccgggcccaga

SEQ ID NO: 1514748 - DNA, 17 bp, Homo sapiens
cgcccgggcccagagga

SEQ ID NO: 1514749 - DNA, 12 bp, Homo sapiens
cgcccgtcctgc

SEQ ID NO: 1514750 - DNA, 17 bp, Homo sapiens
cgcccgtcctgcctgtg

SEQ ID NO: 1514751 - DNA, 16 bp, Homo sapiens
cgcccgtggggtctgc

SEQ ID NO: 1514752 - DNA, 15 bp, Homo sapiens
cgccctactccactg

SEQ ID NO: 1514753 - DNA, 19 bp, Homo sapiens
cgccctactccactgccct

SEQ ID NO: 1514754 - DNA, 22 bp, Homo sapiens
cgccctactccactgccctggc

SEQ ID NO: 1514755 - DNA, 21 bp, Homo sapiens
cgccctccctctcccaggccc

SEQ ID NO: 1514756 - DNA, 19 bp, Homo sapiens
cgccctcctcgggccgagg

SEQ ID NO: 1514757 - DNA, 11 bp, Homo sapiens
cgccctccttt

SEQ ID NO: 1514758 - DNA, 17 bp, Homo sapiens
cgccctcctttccctta

SEQ ID NO: 1514759 - DNA, 18 bp, Homo sapiens
cgccctgagcatcctggt

SEQ ID NO: 1514760 - DNA, 19 bp, Homo sapiens
cgccctgagcatcctggtt

SEQ ID NO: 1514761 - DNA, 18 bp, Homo sapiens
cgccctgctcctccctgg

SEQ ID NO: 1514762 - DNA, 21 bp, Homo sapiens
cgccctgctcctccctggctg

SEQ ID NO: 1514763 - DNA, 14 bp, Homo sapiens
cgccctttcctcct

SEQ ID NO: 1514764 - DNA, 17 bp, Homo sapiens
cgccctttcctcctcag

SEQ ID NO: 1514765 - DNA, 19 bp, Homo sapiens
cgccctttcctcctcaggc

SEQ ID NO: 1514766 - DNA, 15 bp, Homo sapiens
cgccctttccttgcc

SEQ ID NO: 1514767 - DNA, 18 bp, Homo sapiens
cgccctttccttgccttc

SEQ ID NO: 1514768 - DNA, 16 bp, Homo sapiens
cgccgatgccaccggc

SEQ ID NO: 1514769 - DNA, 13 bp, Homo sapiens
cgccgccaggact

SEQ ID NO: 1514770 - DNA, 15 bp, Homo sapiens
cgccgccgcgcgccc

SEQ ID NO: 1514771 - DNA, 18 bp, Homo sapiens
cgccgcctcccacggcac

SEQ ID NO: 1514772 - DNA, 21 bp, Homo sapiens
cgccgcctgctccctgcaccc

SEQ ID NO: 1514773 - DNA, 19 bp, Homo sapiens
cgccgcgccagtccccgct

SEQ ID NO: 1514774 - DNA, 23 bp, Homo sapiens
cgccgcgcgcccctgcccgagag

SEQ ID NO: 1514775 - DNA, 12 bp, Homo sapiens
cgccgctgaccc

SEQ ID NO: 1514776 - DNA, 14 bp, Homo sapiens
cgccgtaattcttt

SEQ ID NO: 1514777 - DNA, 21 bp, Homo sapiens
cgccgtaattctttctgtctc

SEQ ID NO: 1514778 - DNA, 16 bp, Homo sapiens
cgccgtgtctcagcct

SEQ ID NO: 1514779 - DNA, 14 bp, Homo sapiens
cgcctactgtccct

SEQ ID NO: 1514780 - DNA, 20 bp, Homo sapiens
cgcctagtggggtctccctc

SEQ ID NO: 1514781 - DNA, 20 bp, Homo sapiens
cgcctataatcccagctact

SEQ ID NO: 1514782 - DNA, 17 bp, Homo sapiens
cgcctcaatgtggttgc

SEQ ID NO: 1514783 - DNA, 13 bp, Homo sapiens
cgcctcagcctga

SEQ ID NO: 1514784 - DNA, 21 bp, Homo sapiens
cgcctccactctagttctaga

SEQ ID NO: 1514785 - DNA, 15 bp, Homo sapiens
cgcctccaggagcct

SEQ ID NO: 1514786 - DNA, 16 bp, Homo sapiens
cgcctccatccaaggc

SEQ ID NO: 1514787 - DNA, 18 bp, Homo sapiens
cgcctccatccaaggcca

SEQ ID NO: 1514788 - DNA, 17 bp, Homo sapiens
cgcctccccacctccag

SEQ ID NO: 1514789 - DNA, 19 bp, Homo sapiens
cgcctccccacctccaggc

SEQ ID NO: 1514790 - DNA, 22 bp, Homo sapiens
cgcctccccgaaacaggctact

SEQ ID NO: 1514791 - DNA, 13 bp, Homo sapiens
cgcctctcccgtc

SEQ ID NO: 1514792 - DNA, 17 bp, Homo sapiens
cgcctgaaaagggcgga

SEQ ID NO: 1514793 - DNA, 14 bp, Homo sapiens
cgcctgagctcctg

SEQ ID NO: 1514794 - DNA, 17 bp, Homo sapiens
cgcctgaggcaattaga

SEQ ID NO: 1514795 - DNA, 15 bp, Homo sapiens
cgcctgagtcagtgc

SEQ ID NO: 1514796 - DNA, 19 bp, Homo sapiens
cgcctgcaggctggagact

SEQ ID NO: 1514797 - DNA, 14 bp, Homo sapiens
cgcctgccatcttc

SEQ ID NO: 1514798 - DNA, 21 bp, Homo sapiens
cgcctgccctcccgcaccttc

SEQ ID NO: 1514799 - DNA, 14 bp, Homo sapiens
cgcctgcctcctgg

SEQ ID NO: 1514800 - DNA, 16 bp, Homo sapiens
cggcttcctgtccact

SEQ ID NO: 1514801 - DNA, 17 bp, Homo sapiens
cggcttcttggaccttg

SEQ ID NO: 1514802 - DNA, 18 bp, Homo sapiens
cggcttggatcctgggct

SEQ ID NO: 1514803 - DNA, 15 bp, Homo sapiens
cgggaacagacaaca

SEQ ID NO: 1514804 - DNA, 20 bp, Homo sapiens
cgggaactttgcagcatacc

SEQ ID NO: 1514805 - DNA, 15 bp, Homo sapiens
cgggaagcagccagc

SEQ ID NO: 1514806 - DNA, 23 bp, Homo sapiens
cgggaaggagggttagggagggg

SEQ ID NO: 1514807 - DNA, 12 bp, Homo sapiens
cgggacagacct

SEQ ID NO: 1514808 - DNA, 14 bp, Homo sapiens
cgggacagacctgg

SEQ ID NO: 1514809 - DNA, 15 bp, Homo sapiens
cgggacagacctgga

SEQ ID NO: 1514810 - DNA, 23 bp, Homo sapiens
cgggacatcacagggtgggcctc

SEQ ID NO: 1514811 - DNA, 24 bp, Homo sapiens
cgggaccacagctgctggccaggg

SEQ ID NO: 1514812 - DNA, 17 bp, Homo sapiens
cgggaccaccctgagcc

SEQ ID NO: 1514813 - DNA, 19 bp, Homo sapiens
cgggaccattgacctcagc

SEQ ID NO: 1514814 - DNA, 22 bp, Homo sapiens
cgggaccattgacctcagctgc

SEQ ID NO: 1514815 - DNA, 18 bp, Homo sapiens
cgggacccggcggccctg

SEQ ID NO: 1514816 - DNA, 21 bp, Homo sapiens
cgggacgagaccctacaggag

SEQ ID NO: 1514817 - DNA, 15 bp, Homo sapiens
cgggactcagtgagc

SEQ ID NO: 1514818 - DNA, 12 bp, Homo sapiens
cgggagacagca

SEQ ID NO: 1514819 - DNA, 16 bp, Homo sapiens
cgggagacctgtgcta

SEQ ID NO: 1514820 - DNA, 14 bp, Homo sapiens
cgggagcacccaga

SEQ ID NO: 1514821 - DNA, 16 bp, Homo sapiens
cgggagcacccagagc

SEQ ID NO: 1514822 - DNA, 14 bp, Homo sapiens
cgggagcagtgtct

SEQ ID NO: 1514823 - DNA, 21 bp, Homo sapiens
cgggaggactccgggaccatt

SEQ ID NO: 1514824 - DNA, 21 bp, Homo sapiens
cgggaggcaccagctctgtgg

SEQ ID NO: 1514825 - DNA, 20 bp, Homo sapiens
cgggagtcctctagcaggcc

SEQ ID NO: 1514826 - DNA, 16 bp, Homo sapiens
cgggataaactgagcc

SEQ ID NO: 1514827 - DNA, 16 bp, Homo sapiens
cgggatggttctggct

SEQ ID NO: 1514828 - DNA, 15 bp, Homo sapiens
cgggcaatcatgagc

SEQ ID NO: 1514829 - DNA, 14 bp, Homo sapiens
cgggcacaataaat

SEQ ID NO: 1514830 - DNA, 15 bp, Homo sapiens
cgggcacaataaatc

SEQ ID NO: 1514831 - DNA, 14 bp, Homo sapiens
cgggcacagggcac

SEQ ID NO: 1514832 - DNA, 16 bp, Homo sapiens
cgggcacagggcacca

SEQ ID NO: 1514833 - DNA, 22 bp, Homo sapiens
cgggcacagggcaccagaggcc

SEQ ID NO: 1514834 - DNA, 12 bp, Homo sapiens
cgggcagatggg

SEQ ID NO: 1514835 - DNA, 13 bp, Homo sapiens
cgggcagatgggc

SEQ ID NO: 1514836 - DNA, 20 bp, Homo sapiens
cgggcagatgggcggacggc

SEQ ID NO: 1514837 - DNA, 14 bp, Homo sapiens
cgggcagccaccca

SEQ ID NO: 1514838 - DNA, 15 bp, Homo sapiens
cgggcagccacccaa

SEQ ID NO: 1514839 - DNA, 13 bp, Homo sapiens
cgggcagccagca

SEQ ID NO: 1514840 - DNA, 14 bp, Homo sapiens
cgggcagcctggct

SEQ ID NO: 1514841 - DNA, 16 bp, Homo sapiens
cgggcagcctggctcc

SEQ ID NO: 1514842 - DNA, 18 bp, Homo sapiens
cgggcagcctggctccca

SEQ ID NO: 1514843 - DNA, 22 bp, Homo sapiens
cgggcagcctggctcccaggac

SEQ ID NO: 1514844 - DNA, 23 bp, Homo sapiens
cgggcagcctggctcccaggaca

SEQ ID NO: 1514845 - DNA, 15 bp, Homo sapiens
cgggcagcgggccag

SEQ ID NO: 1514846 - DNA, 17 bp, Homo sapiens
cgggcagcgggccaggc

SEQ ID NO: 1514847 - DNA, 18 bp, Homo sapiens
cgggcagcgggccaggcc

SEQ ID NO: 1514848 - DNA, 18 bp, Homo sapiens
cgggcatgcacacggctg

SEQ ID NO: 1514849 - DNA, 23 bp, Homo sapiens
cgggcatgcacacggctggtcac

SEQ ID NO: 1514850 - DNA, 20 bp, Homo sapiens
cgggcatggtggctcatgcc

SEQ ID NO: 1514851 - DNA, 20 bp, Homo sapiens
cgggccagccaggcgggctc

SEQ ID NO: 1514852 - DNA, 21 bp, Homo sapiens
cgggccagccaggcgggctca

SEQ ID NO: 1514853 - DNA, 15 bp, Homo sapiens
cgggccaggcccgca

SEQ ID NO: 1514854 - DNA, 23 bp, Homo sapiens
cgggccaggcccgcaccccggcc

SEQ ID NO: 1514855 - DNA, 13 bp, Homo sapiens
cgggccagggctg

SEQ ID NO: 1514856 - DNA, 17 bp, Homo sapiens
cgggccagggctgcccc

SEQ ID NO: 1514857 - DNA, 14 bp, Homo sapiens
cgggccagggtggg

SEQ ID NO: 1514858 - DNA, 15 bp, Homo sapiens
cgggccagggtggga

SEQ ID NO: 1514859 - DNA, 17 bp, Homo sapiens
cgggcccacctggccac

SEQ ID NO: 1514860 - DNA, 18 bp, Homo sapiens
cgggcccacctggccacc

SEQ ID NO: 1514861 - DNA, 17 bp, Homo sapiens
cgggcccagaccggctt

SEQ ID NO: 1514862 - DNA, 13 bp, Homo sapiens
cgggcccagctga

SEQ ID NO: 1514863 - DNA, 21 bp, Homo sapiens
cgggccccatcctcatccctg

SEQ ID NO: 1514864 - DNA, 17 bp, Homo sapiens
cgggcccctcacctggt

SEQ ID NO: 1514865 - DNA, 19 bp, Homo sapiens
cgggcccctccatccaccc

SEQ ID NO: 1514866 - DNA, 23 bp, Homo sapiens
cgggcccctgggcttggcctgct

SEQ ID NO: 1514867 - DNA, 22 bp, Homo sapiens
cgggcccgttgaggatgaggcc

SEQ ID NO: 1514868 - DNA, 16 bp, Homo sapiens
cgggccctctgtagct

SEQ ID NO: 1514869 - DNA, 23 bp, Homo sapiens
cgggccgtctcccttggcccaga

SEQ ID NO: 1514870 - DNA, 13 bp, Homo sapiens
cgggcctcccacc

SEQ ID NO: 1514871 - DNA, 15 bp, Homo sapiens
cgggcctcccaccgc

SEQ ID NO: 1514872 - DNA, 18 bp, Homo sapiens
cgggcctcccaccgcagc

SEQ ID NO: 1514873 - DNA, 18 bp, Homo sapiens
cgggcgcgggcagccacc

SEQ ID NO: 1514874 - DNA, 18 bp, Homo sapiens
cgggcgctgcagcctccc

SEQ ID NO: 1514875 - DNA, 19 bp, Homo sapiens
cgggcgctgcagcctccct

SEQ ID NO: 1514876 - DNA, 21 bp, Homo sapiens
cgggcggaggggatccagcca

SEQ ID NO: 1514877 - DNA, 22 bp, Homo sapiens
cgggcggaggggatccagccac

SEQ ID NO: 1514878 - DNA, 23 bp, Homo sapiens
cgggcggaggggatccagccact

SEQ ID NO: 1514879 - DNA, 15 bp, Homo sapiens
cgggcggccaggcaa

SEQ ID NO: 1514880 - DNA, 16 bp, Homo sapiens
cgggctccttcccctg

SEQ ID NO: 1514881 - DNA, 17 bp, Homo sapiens
cgggctccttcccctgc

SEQ ID NO: 1514882 - DNA, 15 bp, Homo sapiens
cgggctctggccacc

SEQ ID NO: 1514883 - DNA, 23 bp, Homo sapiens
cgggctctggccaccctggcccg

SEQ ID NO: 1514884 - DNA, 14 bp, Homo sapiens
cgggctgagggcct

SEQ ID NO: 1514885 - DNA, 15 bp, Homo sapiens
cgggctgagggcctg

SEQ ID NO: 1514886 - DNA, 19 bp, Homo sapiens
cgggctgagggcctgctgg

SEQ ID NO: 1514887 - DNA, 14 bp, Homo sapiens
cgggctgccctgcc

SEQ ID NO: 1514888 - DNA, 14 bp, Homo sapiens
cgggctgcctgggc

SEQ ID NO: 1514889 - DNA, 16 bp, Homo sapiens
cgggctgcctgggctg

SEQ ID NO: 1514890 - DNA, 12 bp, Homo sapiens
cgggctggagaa

SEQ ID NO: 1514891 - DNA, 13 bp, Homo sapiens
cgggctggagaaa

SEQ ID NO: 1514892 - DNA, 19 bp, Homo sapiens
cgggctgggggggctgcct

SEQ ID NO: 1514893 - DNA, 12 bp, Homo sapiens
cgggctgtgccc

SEQ ID NO: 1514894 - DNA, 21 bp, Homo sapiens
cgggcttcccttctccccagc

SEQ ID NO: 1514895 - DNA, 16 bp, Homo sapiens
cgggcttgggccctgc

SEQ ID NO: 1514896 - DNA, 20 bp, Homo sapiens
cgggcttgggccctgcacag

SEQ ID NO: 1514897 - DNA, 15 bp, Homo sapiens
cggggaactcctgga

SEQ ID NO: 1514898 - DNA, 22 bp, Homo sapiens
cggggaccttgtgggaccagtc

SEQ ID NO: 1514899 - DNA, 14 bp, Homo sapiens
cggggactcagccc

SEQ ID NO: 1514900 - DNA, 18 bp, Homo sapiens
cggggagcgcccgcgccc

SEQ ID NO: 1514901 - DNA, 16 bp, Homo sapiens
cggggcatgctggggc

SEQ ID NO: 1514902 - DNA, 21 bp, Homo sapiens
cggggccttccttttgaggag

SEQ ID NO: 1514903 - DNA, 15 bp, Homo sapiens
cggggcttggggctc

SEQ ID NO: 1514904 - DNA, 14 bp, Homo sapiens
cgggggaggaaggg

SEQ ID NO: 1514905 - DNA, 14 bp, Homo sapiens
cgggggcctgtggt

SEQ ID NO: 1514906 - DNA, 15 bp, Homo sapiens
cgggggctgcttctc

SEQ ID NO: 1514907 - DNA, 18 bp, Homo sapiens
cgggggctggcctaggag

SEQ ID NO: 1514908 - DNA, 23 bp, Homo sapiens
cgggggctgtgactctgggcagg

SEQ ID NO: 1514909 - DNA, 11 bp, Homo sapiens
cggggggaggg

SEQ ID NO: 1514910 - DNA, 22 bp, Homo sapiens
cggggggagggttggggagggg

SEQ ID NO: 1514911 - DNA, 14 bp, Homo sapiens
cggggggctctgcc

SEQ ID NO: 1514912 - DNA, 16 bp, Homo sapiens
cgcgatcccacacagg

SEQ ID NO: 1514913 - DNA, 14 bp, Homo sapiens
cgcgatctcagctc

SEQ ID NO: 1514914 - DNA, 18 bp, Homo sapiens
cgcgcatgtaatcccagc

SEQ ID NO: 1514915 - DNA, 16 bp, Homo sapiens
cgcgccagtccccgct

SEQ ID NO: 1514916 - DNA, 12 bp, Homo sapiens
cgcgcccagcag

SEQ ID NO: 1514917 - DNA, 13 bp, Homo sapiens
cgcgcccagcaga

SEQ ID NO: 1514918 - DNA, 18 bp, Homo sapiens
cgcgccgatgccaccggc

SEQ ID NO: 1514919 - DNA, 15 bp, Homo sapiens
cgcgccgccgccgcg

SEQ ID NO: 1514920 - DNA, 14 bp, Homo sapiens
cgcgcgcccctgcc

SEQ ID NO: 1514921 - DNA, 15 bp, Homo sapiens
cgcgctcgcccagca

SEQ ID NO: 1514922 - DNA, 13 bp, Homo sapiens
cgcgctggacagc

SEQ ID NO: 1514923 - DNA, 20 bp, Homo sapiens
cgcggaggaggagggaggcc

SEQ ID NO: 1514924 - DNA, 13 bp, Homo sapiens
cgcggccaggcac

SEQ ID NO: 1514925 - DNA, 15 bp, Homo sapiens
cgcggccaggcaccc

SEQ ID NO: 1514926 - DNA, 16 bp, Homo sapiens
cgcggccaggcaccca

SEQ ID NO: 1514927 - DNA, 19 bp, Homo sapiens
cgcggctcccggggcaggg

SEQ ID NO: 1514928 - DNA, 14 bp, Homo sapiens
cgcgggcagcgggc

SEQ ID NO: 1514929 - DNA, 18 bp, Homo sapiens
cgcgggcagcgggccagg

SEQ ID NO: 1514930 - DNA, 22 bp, Homo sapiens
cgcgggcagcgggccaggcccg

SEQ ID NO: 1514931 - DNA, 15 bp, Homo sapiens
cgcgggcggccaggc

SEQ ID NO: 1514932 - DNA, 17 bp, Homo sapiens
cgcgggcggccaggcaa

SEQ ID NO: 1514933 - DNA, 14 bp, Homo sapiens
cgcgggttctagac

SEQ ID NO: 1514934 - DNA, 22 bp, Homo sapiens
cgcggtgccatgtctgcagtgt

SEQ ID NO: 1514935 - DNA, 14 bp, Homo sapiens
cgcggtgctctggc

SEQ ID NO: 1514936 - DNA, 19 bp, Homo sapiens
cgcggtgctgactgaggcc

SEQ ID NO: 1514937 - DNA, 13 bp, Homo sapiens
cgcgtccctgccc

SEQ ID NO: 1514938 - DNA, 14 bp, Homo sapiens
cgcgtcttcctgag

SEQ ID NO: 1514939 - DNA, 19 bp, Homo sapiens
cgcgtgccctcgctgcttc

SEQ ID NO: 1514940 - DNA, 17 bp, Homo sapiens
cgcgtgtgggtctctgg

SEQ ID NO: 1514941 - DNA, 23 bp, Homo sapiens
cgctaattcaaggaatttcttaa

SEQ ID NO: 1514942 - DNA, 11 bp, Homo sapiens
cgctacccact

SEQ ID NO: 1514943 - DNA, 12 bp, Homo sapiens
cgctacctccct

SEQ ID NO: 1514944 - DNA, 15 bp, Homo sapiens
cgctacctccctccc

SEQ ID NO: 1514945 - DNA, 20 bp, Homo sapiens
cgctagaaaaaaaaaacact

SEQ ID NO: 1514946 - DNA, 15 bp, Homo sapiens
cgctaggagagactg

SEQ ID NO: 1514947 - DNA, 20 bp, Homo sapiens
cgctagtaactcctctgccc

SEQ ID NO: 1514948 - DNA, 13 bp, Homo sapiens
cgctcacctcaga

SEQ ID NO: 1514949 - DNA, 14 bp, Homo sapiens
cgctcacctcagag

SEQ ID NO: 1514950 - DNA, 21 bp, Homo sapiens
cgctcacctcagagcagggcc

SEQ ID NO: 1514951 - DNA, 15 bp, Homo sapiens
cgctcacctgcagcc

SEQ ID NO: 1514952 - DNA, 18 bp, Homo sapiens
cgctcagacggcggccag

SEQ ID NO: 1514953 - DNA, 21 bp, Homo sapiens
cgctcagacggcggccaggca

SEQ ID NO: 1514954 - DNA, 23 bp, Homo sapiens
cgctcagacggcggccaggcaca

SEQ ID NO: 1514955 - DNA, 15 bp, Homo sapiens
cgctcagcccagctg

SEQ ID NO: 1514956 - DNA, 16 bp, Homo sapiens
cgctcagccctccctg

SEQ ID NO: 1514957 - DNA, 21 bp, Homo sapiens
cgctcagccctccctgcccct

SEQ ID NO: 1514958 - DNA, 13 bp, Homo sapiens
cgctcaggaccca

SEQ ID NO: 1514959 - DNA, 16 bp, Homo sapiens
cgctcaggacccaggc

SEQ ID NO: 1514960 - DNA, 21 bp, Homo sapiens
cgctcagggccatgctgaggc

SEQ ID NO: 1514961 - DNA, 17 bp, Homo sapiens
cgctcaggggcctggag

SEQ ID NO: 1514962 - DNA, 19 bp, Homo sapiens
cgctcaggggcctggaggt

SEQ ID NO: 1514963 - DNA, 13 bp, Homo sapiens
cgctccagctgcc

SEQ ID NO: 1514964 - DNA, 22 bp, Homo sapiens
cgctcccaagggtctcactgct

SEQ ID NO: 1514965 - DNA, 20 bp, Homo sapiens
cgctcccaggttcccccagc

SEQ ID NO: 1514966 - DNA, 22 bp, Homo sapiens
cgctcccaggttcccccagcaa

SEQ ID NO: 1514967 - DNA, 23 bp, Homo sapiens
cgctcccaggttcccccagcaag

SEQ ID NO: 1514968 - DNA, 22 bp, Homo sapiens
cgctcccccgcagtccccagcc

SEQ ID NO: 1514969 - DNA, 14 bp, Homo sapiens
cgctcccctctgcc

SEQ ID NO: 1514970 - DNA, 21 bp, Homo sapiens
cgctccctggaagctggaaga

SEQ ID NO: 1514971 - DNA, 23 bp, Homo sapiens
cgctcctgccgcagacgggcaca

SEQ ID NO: 1514972 - DNA, 20 bp, Homo sapiens
cgctcctgtctgccagccag

SEQ ID NO: 1514973 - DNA, 21 bp, Homo sapiens
cgctcgcgggcagcgggccag

SEQ ID NO: 1514974 - DNA, 14 bp, Homo sapiens
cgctcgctcaggtg

SEQ ID NO: 1514975 - DNA, 17 bp, Homo sapiens
cgctcgctcgctctcgc

SEQ ID NO: 1514976 - DNA, 14 bp, Homo sapiens
cgctctccaccacc

SEQ ID NO: 1514977 - DNA, 19 bp, Homo sapiens
cgctctccctaccttgcct

SEQ ID NO: 1514978 - DNA, 20 bp, Homo sapiens
cgctctccctaccttgcctc

SEQ ID NO: 1514979 - DNA, 21 bp, Homo sapiens
cgctctccctaccttgcctcc

SEQ ID NO: 1514980 - DNA, 12 bp, Homo sapiens
cgctctcctgga

SEQ ID NO: 1514981 - DNA, 17 bp, Homo sapiens
cgctctcgctctctctc

SEQ ID NO: 1514982 - DNA, 11 bp, Homo sapiens
cgctctctctc

SEQ ID NO: 1514983 - DNA, 20 bp, Homo sapiens
cgctctgtggatgccagggc

SEQ ID NO: 1514984 - DNA, 22 bp, Homo sapiens
cgctcttgaggaagcccaggct

SEQ ID NO: 1514985 - DNA, 14 bp, Homo sapiens
cgctcttggtccct

SEQ ID NO: 1514986 - DNA, 16 bp, Homo sapiens
cgctgaccctgggcct

SEQ ID NO: 1514987 - DNA, 18 bp, Homo sapiens
cgctgaccctgggcctgg

SEQ ID NO: 1514988 - DNA, 13 bp, Homo sapiens
cgctgagtggcag

SEQ ID NO: 1514989 - DNA, 23 bp, Homo sapiens
cgctgagtggggggtcgtgggcc

SEQ ID NO: 1514990 - DNA, 18 bp, Homo sapiens
cgctgatggagccccacc

SEQ ID NO: 1514991 - DNA, 19 bp, Homo sapiens
cgctgcaacctgttgatag

SEQ ID NO: 1514992 - DNA, 12 bp, Homo sapiens
cgctgcagcctc

SEQ ID NO: 1514993 - DNA, 13 bp, Homo sapiens
cgctgcagcctcc

SEQ ID NO: 1514994 - DNA, 12 bp, Homo sapiens
cgctgcagggcc

SEQ ID NO: 1514995 - DNA, 14 bp, Homo sapiens
cgctgcagggccgc

SEQ ID NO: 1514996 - DNA, 18 bp, Homo sapiens
cgctgccaccacgtctgc

SEQ ID NO: 1514997 - DNA, 21 bp, Homo sapiens
cgctgccagccttgagccctg

SEQ ID NO: 1514998 - DNA, 20 bp, Homo sapiens
cgctgcccgctcagcccagc

SEQ ID NO: 1514999 - DNA, 17 bp, Homo sapiens
cgctgccctgcatgctg

SEQ ID NO: 1515000 - DNA, 13 bp, Homo sapiens
cgctgccgcaccc

SEQ ID NO: 1515001 - DNA, 18 bp, Homo sapiens
cgctgccgcaccccagag

SEQ ID NO: 1515002 - DNA, 20 bp, Homo sapiens
cgctgcctaagtggctgctg

SEQ ID NO: 1515003 - DNA, 10 bp, Homo sapiens
cgctgcctgg

SEQ ID NO: 1515004 - DNA, 15 bp, Homo sapiens
cgctgcctggccagg

SEQ ID NO: 1515005 - DNA, 22 bp, Homo sapiens
cgctgcctggtctgtctggatc

SEQ ID NO: 1515006 - DNA, 18 bp, Homo sapiens
cgctgcgggcccagctga

SEQ ID NO: 1515007 - DNA, 21 bp, Homo sapiens
cgctgcgtcctcatttcccct

SEQ ID NO: 1515008 - DNA, 19 bp, Homo sapiens
cgctgctacatcagactct

SEQ ID NO: 1515009 - DNA, 16 bp, Homo sapiens
cgctgctctagctggc

SEQ ID NO: 1515010 - DNA, 15 bp, Homo sapiens
cgctgctgctgctgc

SEQ ID NO: 1515011 - DNA, 17 bp, Homo sapiens
cgctgcttccaggctgg

SEQ ID NO: 1515012 - DNA, 20 bp, Homo sapiens
cgtacatctgcaatatgaat

SEQ ID NO: 1515013 - DNA, 16 bp, Homo sapiens
cgtacctgtccctcca

SEQ ID NO: 1515014 - DNA, 14 bp, Homo sapiens
cgtacttataaaga

SEQ ID NO: 1515015 - DNA, 11 bp, Homo sapiens
cgtagcctggg

SEQ ID NO: 1515016 - DNA, 23 bp, Homo sapiens
cgtagcctgggctcactgtgctg

SEQ ID NO: 1515017 - DNA, 13 bp, Homo sapiens
cgtagctgccagt

SEQ ID NO: 1515018 - DNA, 13 bp, Homo sapiens
cgtagcttgtctg

SEQ ID NO: 1515019 - DNA, 14 bp, Homo sapiens
cgtaggcagcctct

SEQ ID NO: 1515020 - DNA, 21 bp, Homo sapiens
cgtaggcagcctctctgctat

SEQ ID NO: 1515021 - DNA, 17 bp, Homo sapiens
cgtagggagtacctgct

SEQ ID NO: 1515022 - DNA, 17 bp, Homo sapiens
cgtaggggctcctgagt

SEQ ID NO: 1515023 - DNA, 15 bp, Homo sapiens
cgtagtgtgtttaaa

SEQ ID NO: 1515024 - DNA, 15 bp, Homo sapiens
cgtagttaacttgaa

SEQ ID NO: 1515025 - DNA, 18 bp, Homo sapiens
cgtagttaacttgaagaa

SEQ ID NO: 1515026 - DNA, 13 bp, Homo sapiens
cgtagttccctga

SEQ ID NO: 1515027 - DNA, 15 bp, Homo sapiens
cgtataggcatgtaa

SEQ ID NO: 1515028 - DNA, 13 bp, Homo sapiens
cgtatcacagtgt

SEQ ID NO: 1515029 - DNA, 23 bp, Homo sapiens
cgtatctttaaaaagcagtcctc

SEQ ID NO: 1515030 - DNA, 12 bp, Homo sapiens
cgtattcattca

SEQ ID NO: 1515031 - DNA, 14 bp, Homo sapiens
cgtatttataatag

SEQ ID NO: 1515032 - DNA, 18 bp, Homo sapiens
cgtatttatatttggaaa

SEQ ID NO: 1515033 - DNA, 22 bp, Homo sapiens
gttagtcatttgctgagcatgt

SEQ ID NO: 1515034 - DNA, 17 bp, Homo sapiens
gttagttatagatgtct

SEQ ID NO: 1515035 - DNA, 16 bp, Homo sapiens
catgaatgtgctggtg

SEQ ID NO: 1515036 - DNA, 21 bp, Homo sapiens
catgaattacctggatgttct

SEQ ID NO: 1515037 - DNA, 22 bp, Homo sapiens
catgaattacctggatgttctt

SEQ ID NO: 1515038 - DNA, 18 bp, Homo sapiens
catgaattactgtatata

SEQ ID NO: 1515039 - DNA, 15 bp, Homo sapiens
catgaattatataat

SEQ ID NO: 1515040 - DNA, 17 bp, Homo sapiens
catgaattatataattt

SEQ ID NO: 1515041 - DNA, 15 bp, Homo sapiens
catgaattttaaagt

SEQ ID NO: 1515042 - DNA, 19 bp, Homo sapiens
catgacaacttttaaagaa

SEQ ID NO: 1515043 - DNA, 23 bp, Homo sapiens
catgacaacttttaaagaaaaat

SEQ ID NO: 1515044 - DNA, 16 bp, Homo sapiens
catgacagccagagcc

SEQ ID NO: 1515045 - DNA, 13 bp, Homo sapiens
catgacagcctgc

SEQ ID NO: 1515046 - DNA, 14 bp, Homo sapiens
catgaccactcttg

SEQ ID NO: 1515047 - DNA, 14 bp, Homo sapiens
catgaccagtaaag

SEQ ID NO: 1515048 - DNA, 14 bp, Homo sapiens
catgacccacccct

SEQ ID NO: 1515049 - DNA, 16 bp, Homo sapiens
catgacccacccctgt

SEQ ID NO: 1515050 - DNA, 19 bp, Homo sapiens
catgacccacccctgtgct

SEQ ID NO: 1515051 - DNA, 12 bp, Homo sapiens
catgacccagcc

SEQ ID NO: 1515052 - DNA, 19 bp, Homo sapiens
catgacctagttttccatg

SEQ ID NO: 1515053 - DNA, 13 bp, Homo sapiens
catgactggctgt

SEQ ID NO: 1515054 - DNA, 16 bp, Homo sapiens
catgactggctgtctg

SEQ ID NO: 1515055 - DNA, 14 bp, Homo sapiens
catgacttgtgtgt

SEQ ID NO: 1515056 - DNA, 14 bp, Homo sapiens
catgagaagagggc

SEQ ID NO: 1515057 - DNA, 15 bp, Homo sapiens
catgagaagagggcc

SEQ ID NO: 1515058 - DNA, 16 bp, Homo sapiens
catgagaagagggcct

SEQ ID NO: 1515059 - DNA, 18 bp, Homo sapiens
catgagaagagggcctgt

SEQ ID NO: 1515060 - DNA, 22 bp, Homo sapiens
catgagaagagggcctgtggga

SEQ ID NO: 1515061 - DNA, 14 bp, Homo sapiens
catgagaagccaag

SEQ ID NO: 1515062 - DNA, 22 bp, Homo sapiens
catgagaagccaagcgctcatg

SEQ ID NO: 1515063 - DNA, 20 bp, Homo sapiens
catgagaataagagaaagaa

SEQ ID NO: 1515064 - DNA, 14 bp, Homo sapiens
catgagatgtgtgg

SEQ ID NO: 1515065 - DNA, 23 bp, Homo sapiens
catgagatgtgtggactgtggca

SEQ ID NO: 1515066 - DNA, 16 bp, Homo sapiens
catgagccactgtgcc

SEQ ID NO: 1515067 - DNA, 18 bp, Homo sapiens
catgagctccctcgctgt

SEQ ID NO: 1515068 - DNA, 22 bp, Homo sapiens
catgagctccctcgctgtatga

SEQ ID NO: 1515069 - DNA, 14 bp, Homo sapiens
catgagctgctcat

SEQ ID NO: 1515070 - DNA, 23 bp, Homo sapiens
catgagctgctcattacagttct

SEQ ID NO: 1515071 - DNA, 13 bp, Homo sapiens
catgagctggcaa

SEQ ID NO: 1515072 - DNA, 23 bp, Homo sapiens
catgagctggcaaccagccagcg

SEQ ID NO: 1515073 - DNA, 15 bp, Homo sapiens
catgagctgggtact

SEQ ID NO: 1515074 - DNA, 14 bp, Homo sapiens
catgagcttttata

SEQ ID NO: 1515075 - DNA, 15 bp, Homo sapiens
catgaggaaggaaca

SEQ ID NO: 1515076 - DNA, 15 bp, Homo sapiens
catgaggacagaagg

SEQ ID NO: 1515077 - DNA, 16 bp, Homo sapiens
catgaggacagaagga

SEQ ID NO: 1515078 - DNA, 19 bp, Homo sapiens
catgaggagcgtggactct

SEQ ID NO: 1515079 - DNA, 13 bp, Homo sapiens
catgaggagggtg

SEQ ID NO: 1515080 - DNA, 24 bp, Homo sapiens
catgaggcaatgtcaggaacagaa

SEQ ID NO: 1515081 - DNA, 17 bp, Homo sapiens
catgaggccatctcagg

SEQ ID NO: 1515082 - DNA, 18 bp, Homo sapiens
catgaggccatctcagga

SEQ ID NO: 1515083 - DNA, 20 bp, Homo sapiens
catgaggccatctcaggaga

SEQ ID NO: 1515084 - DNA, 18 bp, Homo sapiens
catgagggatcacagggc

SEQ ID NO: 1515085 - DNA, 23 bp, Homo sapiens
catgagtagtgggctatgcagga

SEQ ID NO: 1515086 - DNA, 15 bp, Homo sapiens
cctgagagtcagctc

SEQ ID NO: 1515087 - DNA, 22 bp, Homo sapiens
cctgagatggtatgcacaattc

SEQ ID NO: 1515088 - DNA, 17 bp, Homo sapiens
cctgagattcagatgtc

SEQ ID NO: 1515089 - DNA, 22 bp, Homo sapiens
cctgagattctttaaggagata

SEQ ID NO: 1515090 - DNA, 15 bp, Homo sapiens
cctgagatttcatct

SEQ ID NO: 1515091 - DNA, 23 bp, Homo sapiens
cctgagcacctcccagcccctgc

SEQ ID NO: 1515092 - DNA, 18 bp, Homo sapiens
cctgagcagaatactggt

SEQ ID NO: 1515093 - DNA, 16 bp, Homo sapiens
cctgagcagggtccac

SEQ ID NO: 1515094 - DNA, 13 bp, Homo sapiens
cctgagccaagga

SEQ ID NO: 1515095 - DNA, 23 bp, Homo sapiens
cctgagccagggaacagccccag

SEQ ID NO: 1515096 - DNA, 12 bp, Homo sapiens
cctgagcccacc

SEQ ID NO: 1515097 - DNA, 14 bp, Homo sapiens
cctgagccccctgc

SEQ ID NO: 1515098 - DNA, 15 bp, Homo sapiens
cctgagccccctgca

SEQ ID NO: 1515099 - DNA, 18 bp, Homo sapiens
cctgagccccctgcaccc

SEQ ID NO: 1515100 - DNA, 23 bp, Homo sapiens
cctgagccccctgcacccacccc

SEQ ID NO: 1515101 - DNA, 22 bp, Homo sapiens
cctgagccctactccctgcaga

SEQ ID NO: 1515102 - DNA, 19 bp, Homo sapiens
cctgagctcaaatctctgt

SEQ ID NO: 1515103 - DNA, 22 bp, Homo sapiens
cctgagctcaaatctctgttac

SEQ ID NO: 1515104 - DNA, 21 bp, Homo sapiens
cctgagctcggggggctctgc

SEQ ID NO: 1515105 - DNA, 22 bp, Homo sapiens
cctgagctcggggggctctgcc

SEQ ID NO: 1515106 - DNA, 19 bp, Homo sapiens
cctgagctcggtggaccca

SEQ ID NO: 1515107 - DNA, 21 bp, Homo sapiens
cctgagctcggtggacccagg

SEQ ID NO: 1515108 - DNA, 14 bp, Homo sapiens
cctgagctggggaa

SEQ ID NO: 1515109 - DNA, 16 bp, Homo sapiens
cctgagctgtcgctgc

SEQ ID NO: 1515110 - DNA, 20 bp, Homo sapiens
cctgagctgtcgctgcctcc

SEQ ID NO: 1515111 - DNA, 16 bp, Homo sapiens
cctgagctttggggac

SEQ ID NO: 1515112 - DNA, 19 bp, Homo sapiens
cctgaggaagagggactgt

SEQ ID NO: 1515113 - DNA, 15 bp, Homo sapiens
cctgaggagccctga

SEQ ID NO: 1515114 - DNA, 17 bp, Homo sapiens
cctgaggagctttgtgt

SEQ ID NO: 1515115 - DNA, 18 bp, Homo sapiens
cctgaggaggaggacaca

SEQ ID NO: 1515116 - DNA, 23 bp, Homo sapiens
cctgaggaggaggacacagcaca

SEQ ID NO: 1515117 - DNA, 13 bp, Homo sapiens
cctgaggatgagc

SEQ ID NO: 1515118 - DNA, 15 bp, Homo sapiens
cctgaggatgagctg

SEQ ID NO: 1515119 - DNA, 19 bp, Homo sapiens
cctgaggatgggtcagagc

SEQ ID NO: 1515120 - DNA, 16 bp, Homo sapiens
cctgaggcaaggagtt

SEQ ID NO: 1515121 - DNA, 15 bp, Homo sapiens
cctgaggcagcccag

SEQ ID NO: 1515122 - DNA, 13 bp, Homo sapiens
cctgaggcctaga

SEQ ID NO: 1515123 - DNA, 18 bp, Homo sapiens
cctgaggcctagactctg

SEQ ID NO: 1515124 - DNA, 17 bp, Homo sapiens
cctgaggctgtggtcac

SEQ ID NO: 1515125 - DNA, 14 bp, Homo sapiens
cctgagggcccctc

SEQ ID NO: 1515126 - DNA, 22 bp, Homo sapiens
cctgaaaaactgatcaaaaata

SEQ ID NO: 1515127 - DNA, 16 bp, Homo sapiens
cctgaaaacccagaga

SEQ ID NO: 1515128 - DNA, 17 bp, Homo sapiens
cctgaaaacccagagag

SEQ ID NO: 1515129 - DNA, 21 bp, Homo sapiens
cctgaaaacgaaggggccccg

SEQ ID NO: 1515130 - DNA, 21 bp, Homo sapiens
cctgaaaatgtttttctgcca

SEQ ID NO: 1515131 - DNA, 19 bp, Homo sapiens
cctgaaagaggctgaggcc

SEQ ID NO: 1515132 - DNA, 13 bp, Homo sapiens
cctgaaagcctca

SEQ ID NO: 1515133 - DNA, 17 bp, Homo sapiens
cctgaaaggaacactgg

SEQ ID NO: 1515134 - DNA, 18 bp, Homo sapiens
cctgaaaggaacactggc

SEQ ID NO: 1515135 - DNA, 18 bp, Homo sapiens
cctgaaagtgacagagac

SEQ ID NO: 1515136 - DNA, 23 bp, Homo sapiens
cctgaaagtgacagagacccaga

SEQ ID NO: 1515137 - DNA, 17 bp, Homo sapiens
cctgaacaagaattgga

SEQ ID NO: 1515138 - DNA, 21 bp, Homo sapiens
cctgaacaagaattggaagct

SEQ ID NO: 1515139 - DNA, 15 bp, Homo sapiens
cctgaacaggaatcc

SEQ ID NO: 1515140 - DNA, 18 bp, Homo sapiens
cctgaaccccagaggcag

SEQ ID NO: 1515141 - DNA, 16 bp, Homo sapiens
cctgaaccccatgggc

SEQ ID NO: 1515142 - DNA, 19 bp, Homo sapiens
cctgaaccccatgggcttg

SEQ ID NO: 1515143 - DNA, 18 bp, Homo sapiens
cctgaacccctggccagc

SEQ ID NO: 1515144 - DNA, 15 bp, Homo sapiens
cctgaaccgcacagc

SEQ ID NO: 1515145 - DNA, 21 bp, Homo sapiens
cctgaaccgcacagctcagga

SEQ ID NO: 1515146 - DNA, 18 bp, Homo sapiens
cctgaaccttgagcaaat

SEQ ID NO: 1515147 - DNA, 22 bp, Homo sapiens
cctgaacgttttcttctttccc

SEQ ID NO: 1515148 - DNA, 23 bp, Homo sapiens
cctgaactatttattaaaaacat

SEQ ID NO: 1515149 - DNA, 16 bp, Homo sapiens
cctgaactcattctct

SEQ ID NO: 1515150 - DNA, 20 bp, Homo sapiens
cctgaactcattctcttctt

SEQ ID NO: 1515151 - DNA, 14 bp, Homo sapiens
cctgaactcccaga

SEQ ID NO: 1515152 - DNA, 16 bp, Homo sapiens
cctgaagaaccagtcc

SEQ ID NO: 1515153 - DNA, 12 bp, Homo sapiens
cctgaagagctt

SEQ ID NO: 1515154 - DNA, 18 bp, Homo sapiens
cctgaagaggcgggccag

SEQ ID NO: 1515155 - DNA, 23 bp, Homo sapiens
cctgaagatttcagaggctgcag

SEQ ID NO: 1515156 - DNA, 14 bp, Homo sapiens
cctgaagccagctg

SEQ ID NO: 1515157 - DNA, 18 bp, Homo sapiens
cctgaagccagctgccct

SEQ ID NO: 1515158 - DNA, 11 bp, Homo sapiens
cctgaagccat

SEQ ID NO: 1515159 - DNA, 13 bp, Homo sapiens
cctgaagcctgga

SEQ ID NO: 1515160 - DNA, 20 bp, Homo sapiens
cctgaaggggccatgatggc

SEQ ID NO: 1515161 - DNA, 19 bp, Homo sapiens
cctgaaggtcccctggcag

SEQ ID NO: 1515162 - DNA, 20 bp, Homo sapiens
cctgaaggtcccctggcagt

SEQ ID NO: 1515163 - DNA, 15 bp, Homo sapiens
cctgaatacaagcct

SEQ ID NO: 1515164 - DNA, 19 bp, Homo sapiens
cctgaatcatgagcctgct

SEQ ID NO: 1515165 - DNA, 21 bp, Homo sapiens
cctgaatcatgagcctgctgg

SEQ ID NO: 1515166 - DNA, 22 bp, Homo sapiens
cctgaatctgtgcctgcactga

SEQ ID NO: 1515167 - DNA, 21 bp, Homo sapiens
ccaggagctctgcgccaggca

SEQ ID NO: 1515168 - DNA, 18 bp, Homo sapiens
ccaggagctcttcaggcc

SEQ ID NO: 1515169 - DNA, 23 bp, Homo sapiens
ccaggagctcttcaggcctccct

SEQ ID NO: 1515170 - DNA, 17 bp, Homo sapiens
ccaggagctgagtcacc

SEQ ID NO: 1515171 - DNA, 20 bp, Homo sapiens
ccaggagctgagtcacctcc

SEQ ID NO: 1515172 - DNA, 23 bp, Homo sapiens
ccaggagctgagtcacctcctcc

SEQ ID NO: 1515173 - DNA, 21 bp, Homo sapiens
ccaggagctgggcagaaggcc

SEQ ID NO: 1515174 - DNA, 15 bp, Homo sapiens
ccaggagctgtcacc

SEQ ID NO: 1515175 - DNA, 22 bp, Homo sapiens
ccaggagcttcttgtttccttg

SEQ ID NO: 1515176 - DNA, 12 bp, Homo sapiens
ccaggaggcagt

SEQ ID NO: 1515177 - DNA, 14 bp, Homo sapiens
ccaggaggcagtgg

SEQ ID NO: 1515178 - DNA, 23 bp, Homo sapiens
ccaggaggccctggtcctggcct

SEQ ID NO: 1515179 - DNA, 15 bp, Homo sapiens
ccaggaggtgcttga

SEQ ID NO: 1515180 - DNA, 16 bp, Homo sapiens
ccaggagtctgtgctc

SEQ ID NO: 1515181 - DNA, 21 bp, Homo sapiens
ccaggagtttgagacaagccc

SEQ ID NO: 1515182 - DNA, 22 bp, Homo sapiens
ccaggagtttgagacaagccct

SEQ ID NO: 1515183 - DNA, 17 bp, Homo sapiens
ccaggagtttgagacca

SEQ ID NO: 1515184 - DNA, 18 bp, Homo sapiens
ccaggagtttgagaccag

SEQ ID NO: 1515185 - DNA, 20 bp, Homo sapiens
ccaggagtttgaggctgcag

SEQ ID NO: 1515186 - DNA, 21 bp, Homo sapiens
ccaggagtttgaggctgcagc

SEQ ID NO: 1515187 - DNA, 23 bp, Homo sapiens
ccaggatagtgggcaccccactg

SEQ ID NO: 1515188 - DNA, 16 bp, Homo sapiens
ccaggatcactctctg

SEQ ID NO: 1515189 - DNA, 18 bp, Homo sapiens
ccaggatcctgcaggaac

SEQ ID NO: 1515190 - DNA, 18 bp, Homo sapiens
ccaggatcgttttttccc

SEQ ID NO: 1515191 - DNA, 21 bp, Homo sapiens
ccaggatctgctccaacagaa

SEQ ID NO: 1515192 - DNA, 13 bp, Homo sapiens
ccaggatctttga

SEQ ID NO: 1515193 - DNA, 17 bp, Homo sapiens
ccaggatctttgactga

SEQ ID NO: 1515194 - DNA, 21 bp, Homo sapiens
ccaggatgataagttcctttc

SEQ ID NO: 1515195 - DNA, 22 bp, Homo sapiens
ccaggatggaggggtggtcctg

SEQ ID NO: 1515196 - DNA, 23 bp, Homo sapiens
ccaggatggtctcgatctcctga

SEQ ID NO: 1515197 - DNA, 23 bp, Homo sapiens
ccaggattaatctctaaaattct

SEQ ID NO: 1515198 - DNA, 15 bp, Homo sapiens
ccaggattcccccag

SEQ ID NO: 1515199 - DNA, 20 bp, Homo sapiens
ccaggatttaggccttaaca

SEQ ID NO: 1515200 - DNA, 12 bp, Homo sapiens
ccaggcaaatca

SEQ ID NO: 1515201 - DNA, 19 bp, Homo sapiens
ccaggcaaatcagttacta

SEQ ID NO: 1515202 - DNA, 13 bp, Homo sapiens
ccaggcaacctcc

SEQ ID NO: 1515203 - DNA, 15 bp, Homo sapiens
ccaggcaagcagctg

SEQ ID NO: 1515204 - DNA, 20 bp, Homo sapiens
ccaggcaagcagctggtcag

SEQ ID NO: 1515205 - DNA, 14 bp, Homo sapiens
ccaggcacagctga

SEQ ID NO: 1515206 - DNA, 23 bp, Homo sapiens
ccaggcacagctgagttatgatg

SEQ ID NO: 1515207 - DNA, 11 bp, Homo sapiens
ccaggcacagg

SEQ ID NO: 1515208 - DNA, 16 bp, Homo sapiens
ccaggcacagggcccg

SEQ ID NO: 1515209 - DNA, 17 bp, Homo sapiens
ccaggcacagggcccgc

SEQ ID NO: 1515210 - DNA, 16 bp, Homo sapiens
ccaggcaccaccagga

SEQ ID NO: 1515211 - DNA, 13 bp, Homo sapiens
ccaggcacccatg

SEQ ID NO: 1515212 - DNA, 17 bp, Homo sapiens
ccaggcacccatgtggg

SEQ ID NO: 1515213 - DNA, 19 bp, Homo sapiens
ccaggcacccatgtgggcg

SEQ ID NO: 1515214 - DNA, 12 bp, Homo sapiens
ccaggcacctgg

SEQ ID NO: 1515215 - DNA, 19 bp, Homo sapiens
ccaggcacctggcctgctg

SEQ ID NO: 1515216 - DNA, 20 bp, Homo sapiens
ccaggcacgaacccacctgc

SEQ ID NO: 1515217 - DNA, 14 bp, Homo sapiens
ccaggcagagctga

SEQ ID NO: 1515218 - DNA, 22 bp, Homo sapiens
ccaggcagaggttttaatgtct

SEQ ID NO: 1515219 - DNA, 16 bp, Homo sapiens
ccaggcagatccagga

SEQ ID NO: 1515220 - DNA, 19 bp, Homo sapiens
ccaggcagatccaggacta

SEQ ID NO: 1515221 - DNA, 13 bp, Homo sapiens
ccaggcagatctg

SEQ ID NO: 1515222 - DNA, 18 bp, Homo sapiens
ccaggcagatctgtgccc

SEQ ID NO: 1515223 - DNA, 21 bp, Homo sapiens
ccaggcagatctgtgccccat

SEQ ID NO: 1515224 - DNA, 15 bp, Homo sapiens
ccaggcaggccaggc

SEQ ID NO: 1515225 - DNA, 21 bp, Homo sapiens
ccaggcaggccaggctgcctc

SEQ ID NO: 1515226 - DNA, 11 bp, Homo sapiens
ccaggcaggga

SEQ ID NO: 1515227 - DNA, 13 bp, Homo sapiens
ccaggcagggaga

SEQ ID NO: 1515228 - DNA, 22 bp, Homo sapiens
ccaggcagggagtgtctgcagt

SEQ ID NO: 1515229 - DNA, 23 bp, Homo sapiens
ccaggcagggagtgtctgcagtc

SEQ ID NO: 1515230 - DNA, 20 bp, Homo sapiens
aagaggccagtaggagacac

SEQ ID NO: 1515231 - DNA, 19 bp, Homo sapiens
aagaggccatttaagtatc

SEQ ID NO: 1515232 - DNA, 11 bp, Homo sapiens
aagaggcccac

SEQ ID NO: 1515233 - DNA, 16 bp, Homo sapiens
aagaggcccagccctc

SEQ ID NO: 1515234 - DNA, 17 bp, Homo sapiens
aagaggcgggccagcca

SEQ ID NO: 1515235 - DNA, 18 bp, Homo sapiens
aagaggctgaaagaggcc

SEQ ID NO: 1515236 - DNA, 20 bp, Homo sapiens
aagaggctgaggcctggact

SEQ ID NO: 1515237 - DNA, 22 bp, Homo sapiens
aagagggaccagggtgggagag

SEQ ID NO: 1515238 - DNA, 13 bp, Homo sapiens
aagagggcaagtg

SEQ ID NO: 1515239 - DNA, 21 bp, Homo sapiens
aagagggcccagcccagagcc

SEQ ID NO: 1515240 - DNA, 14 bp, Homo sapiens
aagagggcctgtgg

SEQ ID NO: 1515241 - DNA, 19 bp, Homo sapiens
aagaggggaggggcctagg

SEQ ID NO: 1515242 - DNA, 15 bp, Homo sapiens
aagaggggctggggc

SEQ ID NO: 1515243 - DNA, 16 bp, Homo sapiens
aagaggggctggggca

SEQ ID NO: 1515244 - DNA, 15 bp, Homo sapiens
aagagggtaacaata

SEQ ID NO: 1515245 - DNA, 21 bp, Homo sapiens
aagagggttcacacagcccag

SEQ ID NO: 1515246 - DNA, 17 bp, Homo sapiens
aagagggtttattttca

SEQ ID NO: 1515247 - DNA, 18 bp, Homo sapiens
aagaggtctgattggctg

SEQ ID NO: 1515248 - DNA, 17 bp, Homo sapiens
aagaggtgaacattaaa

SEQ ID NO: 1515249 - DNA, 15 bp, Homo sapiens
aagaggtgttatttg

SEQ ID NO: 1515250 - DNA, 22 bp, Homo sapiens
aagaggttgggcttccatgcct

SEQ ID NO: 1515251 - DNA, 22 bp, Homo sapiens
aagagtagttgatgttgcattt

SEQ ID NO: 1515252 - DNA, 23 bp, Homo sapiens
aagagtagttgatgttgcatttt

SEQ ID NO: 1515253 - DNA, 19 bp, Homo sapiens
aagagtccggatttctaac

SEQ ID NO: 1515254 - DNA, 19 bp, Homo sapiens
aagagtgaagcgtttttct

SEQ ID NO: 1515255 - DNA, 14 bp, Homo sapiens
aagagtgattgcag

SEQ ID NO: 1515256 - DNA, 15 bp, Homo sapiens
aagagtggaggagga

SEQ ID NO: 1515257 - DNA, 20 bp, Homo sapiens
aagagtgtgagagagactga

SEQ ID NO: 1515258 - DNA, 19 bp, Homo sapiens
aagagttacaataaagttt

SEQ ID NO: 1515259 - DNA, 16 bp, Homo sapiens
aagagttccctgcaac

SEQ ID NO: 1515260 - DNA, 23 bp, Homo sapiens
aagagttctagatttttaagaga

SEQ ID NO: 1515261 - DNA, 20 bp, Homo sapiens
aagagttctatccccaagct

SEQ ID NO: 1515262 - DNA, 21 bp, Homo sapiens
aagagttgctttgccagagca

SEQ ID NO: 1515263 - DNA, 19 bp, Homo sapiens
aagagtttcagtttgttgg

SEQ ID NO: 1515264 - DNA, 12 bp, Homo sapiens
aagataaagatg

SEQ ID NO: 1515265 - DNA, 17 bp, Homo sapiens
aagataaagatgatcta

SEQ ID NO: 1515266 - DNA, 17 bp, Homo sapiens
aagataaagccagaagc

SEQ ID NO: 1515267 - DNA, 19 bp, Homo sapiens
aagataacccttattccat

SEQ ID NO: 1515268 - DNA, 15 bp, Homo sapiens
aagataacttactgt

SEQ ID NO: 1515269 - DNA, 23 bp, Homo sapiens
aagataatgttctttaatgttgt

SEQ ID NO: 1515270 - DNA, 12 bp, Homo sapiens
aagataattata

SEQ ID NO: 1515271 - DNA, 15 bp, Homo sapiens
aagatacaagtttca

SEQ ID NO: 1515272 - DNA, 14 bp, Homo sapiens
aagatacacagctc

SEQ ID NO: 1515273 - DNA, 13 bp, Homo sapiens
aagatacctaaaa

SEQ ID NO: 1515274 - DNA, 20 bp, Homo sapiens
aagatacctttttttttctt

SEQ ID NO: 1515275 - DNA, 23 bp, Homo sapiens
aagatacttttaaagttttgtca

SEQ ID NO: 1515276 - DNA, 22 bp, Homo sapiens
aagatagaaagctggactgacc

SEQ ID NO: 1515277 - DNA, 13 bp, Homo sapiens
aagatagaacaca

SEQ ID NO: 1515278 - DNA, 15 bp, Homo sapiens
aagatagaacacaaa

SEQ ID NO: 1515279 - DNA, 13 bp, Homo sapiens
aagatagacaggt

SEQ ID NO: 1515280 - DNA, 19 bp, Homo sapiens
aagatagacaggtcctgat

SEQ ID NO: 1515281 - DNA, 17 bp, Homo sapiens
aagatagagtaaaaaga

SEQ ID NO: 1515282 - DNA, 15 bp, Homo sapiens
aagatagcagggcat

SEQ ID NO: 1515283 - DNA, 13 bp, Homo sapiens
aagataggctctg

SEQ ID NO: 1515284 - DNA, 16 bp, Homo sapiens
aagataggctctgcac

SEQ ID NO: 1515285 - DNA, 17 bp, Homo sapiens
aagataggctctgcaca

SEQ ID NO: 1515286 - DNA, 14 bp, Homo sapiens
aagatagtgtaact

SEQ ID NO: 1515287 - DNA, 19 bp, Homo sapiens
aagatatacttgtttttgt

SEQ ID NO: 1515288 - DNA, 17 bp, Homo sapiens
aagatatcagagctctt

SEQ ID NO: 1515289 - DNA, 22 bp, Homo sapiens
aagatatcagagctcttaatgt

SEQ ID NO: 1515290 - DNA, 15 bp, Homo sapiens
aagatatccatcttt

SEQ ID NO: 1515291 - DNA, 13 bp, Homo sapiens
aagatattgtaca

SEQ ID NO: 1515292 - DNA, 15 bp, Homo sapiens
aagatatttatatat

SEQ ID NO: 1515293 - DNA, 13 bp, Homo sapiens
aagatatttccaa

SEQ ID NO: 1515294 - DNA, 13 bp, Homo sapiens
aagatatttttga

SEQ ID NO: 1515295 - DNA, 23 bp, Homo sapiens
aagatcaaaaggttaataaagta

SEQ ID NO: 1515296 - DNA, 15 bp, Homo sapiens
aagatcaaaataaaa

SEQ ID NO: 1515297 - DNA, 17 bp, Homo sapiens
aagatcaaaataaaaag

SEQ ID NO: 1515298 - DNA, 21 bp, Homo sapiens
aagatcaaaataaaaagtgac

SEQ ID NO: 1515299 - DNA, 14 bp, Homo sapiens
aagatcaccttgta

SEQ ID NO: 1515300 - DNA, 15 bp, Homo sapiens
aagatcaccttgtat

SEQ ID NO: 1515301 - DNA, 12 bp, Homo sapiens
aagatcactgta

SEQ ID NO: 1515302 - DNA, 17 bp, Homo sapiens
aagatcactttctcagt

SEQ ID NO: 1515303 - DNA, 23 bp, Homo sapiens
aagatcactttctcagttttcat

SEQ ID NO: 1515304 - DNA, 22 bp, Homo sapiens
aagatcagaacattcagctctg

SEQ ID NO: 1515305 - DNA, 22 bp, Homo sapiens
aagatcctagatcctaagggtc

SEQ ID NO: 1515306 - DNA, 14 bp, Homo sapiens
aagatcctgaagca

SEQ ID NO: 1515307 - DNA, 21 bp, Homo sapiens
aagatcctgtctttaaggaaa

SEQ ID NO: 1515308 - DNA, 19 bp, Homo sapiens
aagatcgcaccactgcact

SEQ ID NO: 1515309 - DNA, 15 bp, Homo sapiens
aagatcggaacagct

SEQ ID NO: 1515310 - DNA, 15 bp, Homo sapiens
aagatctctagagtt

SEQ ID NO: 1515311 - DNA, 23 bp, Homo sapiens
aagatctgcagggggtgtgtctg

SEQ ID NO: 1515312 - DNA, 16 bp, Homo sapiens
aagatctgtgttttag

SEQ ID NO: 1515313 - DNA, 16 bp, Homo sapiens
aagatcttagattctc

SEQ ID NO: 1515314 - DNA, 22 bp, Homo sapiens
aagatgaacccgaggctgagaa

SEQ ID NO: 1515315 - DNA, 23 bp, Homo sapiens
aagatgaacccgaggctgagaat

SEQ ID NO: 1515316 - DNA, 14 bp, Homo sapiens
aagatgaagtttta

SEQ ID NO: 1515317 - DNA, 15 bp, Homo sapiens
aagatgaatcaatgg

SEQ ID NO: 1515318 - DNA, 14 bp, Homo sapiens
aagatgacagctct

SEQ ID NO: 1515319 - DNA, 20 bp, Homo sapiens
aagatgagaacagataaaga

SEQ ID NO: 1515320 - DNA, 22 bp, Homo sapiens
aagatgagattggcatggcttt

SEQ ID NO: 1515321 - DNA, 19 bp, Homo sapiens
aagatgagatttgccagca

SEQ ID NO: 1515322 - DNA, 22 bp, Homo sapiens
aagatgagccttgcagatatct

SEQ ID NO: 1515323 - DNA, 18 bp, Homo sapiens
aagatgatctactcagaa

SEQ ID NO: 1515324 - DNA, 20 bp, Homo sapiens
aagatgcaaggaccaggact

SEQ ID NO: 1515325 - DNA, 12 bp, Homo sapiens
aagatgcactga

SEQ ID NO: 1515326 - DNA, 15 bp, Homo sapiens
aagatgcattttgag

SEQ ID NO: 1515327 - DNA, 15 bp, Homo sapiens
aagatgccagcttct

SEQ ID NO: 1515328 - DNA, 15 bp, Homo sapiens
aagatgctcttttaa

SEQ ID NO: 1515329 - DNA, 10 bp, Homo sapiens
aagatgctgg

SEQ ID NO: 1515330 - DNA, 22 bp, Homo sapiens
aagatgctggatgtctgccaat

SEQ ID NO: 1515331 - DNA, 12 bp, Homo sapiens
aagatgcttggt

SEQ ID NO: 1515332 - DNA, 15 bp, Homo sapiens
aagatggaaatacag

SEQ ID NO: 1515333 - DNA, 16 bp, Homo sapiens
aagatggaaatacagt

SEQ ID NO: 1515334 - DNA, 15 bp, Homo sapiens
aagatggaaattctg

SEQ ID NO: 1515335 - DNA, 20 bp, Homo sapiens
aagatggaatttatcaaacc

SEQ ID NO: 1515336 - DNA, 17 bp, Homo sapiens
aagatggagtttctaag

SEQ ID NO: 1515337 - DNA, 21 bp, Homo sapiens
aagatggataaactgagcctc

SEQ ID NO: 1515338 - DNA, 20 bp, Homo sapiens
aagatggatgtaaagtgtgg

SEQ ID NO: 1515339 - DNA, 19 bp, Homo sapiens
aagatggcataacctgtct

SEQ ID NO: 1515340 - DNA, 20 bp, Homo sapiens
aagatggctgctgcctgctc

SEQ ID NO: 1515341 - DNA, 21 bp, Homo sapiens
aagatggctgtggcatttcca

SEQ ID NO: 1515342 - DNA, 17 bp, Homo sapiens
aagatgggaaactgctt

SEQ ID NO: 1515343 - DNA, 20 bp, Homo sapiens
aagatgggcatcttttgtat

SEQ ID NO: 1515344 - DNA, 18 bp, Homo sapiens
aagatgggggcagggctg

SEQ ID NO: 1515345 - DNA, 21 bp, Homo sapiens
aagatggtccatttgttcctg

SEQ ID NO: 1515346 - DNA, 17 bp, Homo sapiens
cctggccgctaagttgc

SEQ ID NO: 1515347 - DNA, 14 bp, Homo sapiens
cctggccggctcca

SEQ ID NO: 1515348 - DNA, 16 bp, Homo sapiens
cctggccgttcagcct

SEQ ID NO: 1515349 - DNA, 18 bp, Homo sapiens
cctggccgttcagcctgt

SEQ ID NO: 1515350 - DNA, 19 bp, Homo sapiens
cctggccgttcagcctgtc

SEQ ID NO: 1515351 - DNA, 17 bp, Homo sapiens
cctggcctagaccagca

SEQ ID NO: 1515352 - DNA, 20 bp, Homo sapiens
cctggcctagaccagcagac

SEQ ID NO: 1515353 - DNA, 19 bp, Homo sapiens
cctggcctcactggctggg

SEQ ID NO: 1515354 - DNA, 21 bp, Homo sapiens
cctggcctcactggctggggc

SEQ ID NO: 1515355 - DNA, 23 bp, Homo sapiens
cctggcctcactggctggggcag

SEQ ID NO: 1515356 - DNA, 20 bp, Homo sapiens
cctggcctcagttcccagct

SEQ ID NO: 1515357 - DNA, 21 bp, Homo sapiens
cctggcctcagttcccagctc

SEQ ID NO: 1515358 - DNA, 12 bp, Homo sapiens
cctggcctccag

SEQ ID NO: 1515359 - DNA, 15 bp, Homo sapiens
cctggcctcccctgc

SEQ ID NO: 1515360 - DNA, 18 bp, Homo sapiens
cctggcctcccctgccac

SEQ ID NO: 1515361 - DNA, 17 bp, Homo sapiens
cctggcctcccttctcc

SEQ ID NO: 1515362 - DNA, 13 bp, Homo sapiens
cctggcctctggg

SEQ ID NO: 1515363 - DNA, 14 bp, Homo sapiens
cctggcctctgggc

SEQ ID NO: 1515364 - DNA, 18 bp, Homo sapiens
cctggcctctgggcagtg

SEQ ID NO: 1515365 - DNA, 14 bp, Homo sapiens
cctggcctctgtgc

SEQ ID NO: 1515366 - DNA, 18 bp, Homo sapiens
cctggcctgaactgagga

SEQ ID NO: 1515367 - DNA, 14 bp, Homo sapiens
cctggcctgagctg

SEQ ID NO: 1515368 - DNA, 19 bp, Homo sapiens
cctggcctgagctggggcc

SEQ ID NO: 1515369 - DNA, 13 bp, Homo sapiens
cctggcctgctgg

SEQ ID NO: 1515370 - DNA, 13 bp, Homo sapiens
cctggcctggcac

SEQ ID NO: 1515371 - DNA, 16 bp, Homo sapiens
cctggcctggcacaca

SEQ ID NO: 1515372 - DNA, 19 bp, Homo sapiens
cctggcctggcacacatca

SEQ ID NO: 1515373 - DNA, 13 bp, Homo sapiens
cctggcctggctc

SEQ ID NO: 1515374 - DNA, 14 bp, Homo sapiens
cctggcctggctcc

SEQ ID NO: 1515375 - DNA, 23 bp, Homo sapiens
cctggccttgcccgtcgtgtgct

SEQ ID NO: 1515376 - DNA, 18 bp, Homo sapiens
cctggcgacaagagtgag

SEQ ID NO: 1515377 - DNA, 18 bp, Homo sapiens
cctgctccagcagcacac

SEQ ID NO: 1515378 - DNA, 20 bp, Homo sapiens
cctgctccatgactggctgt

SEQ ID NO: 1515379 - DNA, 23 bp, Homo sapiens
cctgctcccagcagccctaagga

SEQ ID NO: 1515380 - DNA, 19 bp, Homo sapiens
cctgctcccattcctccct

SEQ ID NO: 1515381 - DNA, 22 bp, Homo sapiens
cctgctcccattcctccctccg

SEQ ID NO: 1515382 - DNA, 14 bp, Homo sapiens
cctgctcccccacc

SEQ ID NO: 1515383 - DNA, 23 bp, Homo sapiens
cctgctcccccaccccctcccca

SEQ ID NO: 1515384 - DNA, 16 bp, Homo sapiens
cctgctccctgtctgt

SEQ ID NO: 1515385 - DNA, 17 bp, Homo sapiens
cctgctccctgtctgtg

SEQ ID NO: 1515386 - DNA, 18 bp, Homo sapiens
cctgctccctgtctgtgt

SEQ ID NO: 1515387 - DNA, 23 bp, Homo sapiens
cctgctccctgtctgtgtcccag

SEQ ID NO: 1515388 - DNA, 16 bp, Homo sapiens
cctgctccgctgcctg

SEQ ID NO: 1515389 - DNA, 17 bp, Homo sapiens
cctgctccgctgcctgg

SEQ ID NO: 1515390 - DNA, 18 bp, Homo sapiens
cctgctccgctgcctgga

SEQ ID NO: 1515391 - DNA, 19 bp, Homo sapiens
cctgctcctcactggagga

SEQ ID NO: 1515392 - DNA, 20 bp, Homo sapiens
cctgctcctcactggaggag

SEQ ID NO: 1515393 - DNA, 12 bp, Homo sapiens
cctgctcctccc

SEQ ID NO: 1515394 - DNA, 20 bp, Homo sapiens
cctgctcctccctggctgcc

SEQ ID NO: 1515395 - DNA, 15 bp, Homo sapiens
cctgctctcttcagg

SEQ ID NO: 1515396 - DNA, 20 bp, Homo sapiens
cctgctctcttcaggaggcc

SEQ ID NO: 1515397 - DNA, 21 bp, Homo sapiens
cctgctgaacacagtgtctgt

SEQ ID NO: 1515398 - DNA, 22 bp, Homo sapiens
cctgctgaacacagtgtctgtt

SEQ ID NO: 1515399 - DNA, 23 bp, Homo sapiens
cctgctgaatgatttccaaagag

SEQ ID NO: 1515400 - DNA, 12 bp, Homo sapiens
cctgctgaatgc

SEQ ID NO: 1515401 - DNA, 13 bp, Homo sapiens
cctgctgacagac

SEQ ID NO: 1515402 - DNA, 15 bp, Homo sapiens
cctgctgacctcact

SEQ ID NO: 1515403 - DNA, 16 bp, Homo sapiens
cctgctgacctcactg

SEQ ID NO: 1515404 - DNA, 20 bp, Homo sapiens
cctgctgacctcactgtcct

SEQ ID NO: 1515405 - DNA, 21 bp, Homo sapiens
cctgctgacctcactgtcctg

SEQ ID NO: 1515406 - DNA, 22 bp, Homo sapiens
cctgctgaggaggggcctgggc

SEQ ID NO: 1515407 - DNA, 14 bp, Homo sapiens
cctgctgaggcagt

SEQ ID NO: 1515408 - DNA, 14 bp, Homo sapiens
cctgctgcacaggc

SEQ ID NO: 1515409 - DNA, 10 bp, Homo sapiens
cctgctgcat

SEQ ID NO: 1515410 - DNA, 19 bp, Homo sapiens
cctgctgccagtgcagcca

SEQ ID NO: 1515411 - DNA, 13 bp, Homo sapiens
cctgctgccccag

SEQ ID NO: 1515412 - DNA, 13 bp, Homo sapiens
cctggaggcaggg

SEQ ID NO: 1515413 - DNA, 15 bp, Homo sapiens
cctggaggtctggct

SEQ ID NO: 1515414 - DNA, 20 bp, Homo sapiens
cctggaggtctggctgagcc

SEQ ID NO: 1515415 - DNA, 21 bp, Homo sapiens
cctggaggtctggctgagccc

SEQ ID NO: 1515416 - DNA, 20 bp, Homo sapiens
cctggaggtggggttgggat

SEQ ID NO: 1515417 - DNA, 22 bp, Homo sapiens
cctggagtgtatgactgcacat

SEQ ID NO: 1515418 - DNA, 23 bp, Homo sapiens
cctggagtgtcggatcctgtgag

SEQ ID NO: 1515419 - DNA, 18 bp, Homo sapiens
cctggatattattcttgt

SEQ ID NO: 1515420 - DNA, 22 bp, Homo sapiens
cctggatattattcttgtagtt

SEQ ID NO: 1515421 - DNA, 15 bp, Homo sapiens
cctggatccagcact

SEQ ID NO: 1515422 - DNA, 18 bp, Homo sapiens
cctggatccagcactggt

SEQ ID NO: 1515423 - DNA, 17 bp, Homo sapiens
cctggatctatccctgc

SEQ ID NO: 1515424 - DNA, 21 bp, Homo sapiens
cctggatgagaaacagctcag

SEQ ID NO: 1515425 - DNA, 21 bp, Homo sapiens
cctggatgatttcatcttctg

SEQ ID NO: 1515426 - DNA, 18 bp, Homo sapiens
cctggatgccaaggagcc

SEQ ID NO: 1515427 - DNA, 20 bp, Homo sapiens
cctggatgggcattgggctg

SEQ ID NO: 1515428 - DNA, 22 bp, Homo sapiens
cctggatgggggtgcaggcagc

SEQ ID NO: 1515429 - DNA, 23 bp, Homo sapiens
cctggatgggggtgcaggcagcc

SEQ ID NO: 1515430 - DNA, 15 bp, Homo sapiens
cctggatgtcccctg

SEQ ID NO: 1515431 - DNA, 23 bp, Homo sapiens
cctggatgtcccctgtcccacca

SEQ ID NO: 1515432 - DNA, 17 bp, Homo sapiens
cctggatgttgtgtgta

SEQ ID NO: 1515433 - DNA, 18 bp, Homo sapiens
cctggattaccagggact

SEQ ID NO: 1515434 - DNA, 14 bp, Homo sapiens
cctggattcatttc

SEQ ID NO: 1515435 - DNA, 20 bp, Homo sapiens
cctggatttgagtcttggtg

SEQ ID NO: 1515436 - DNA, 21 bp, Homo sapiens
cctggattttctttctatgta

SEQ ID NO: 1515437 - DNA, 24 bp, Homo sapiens
cctggcacaggactgattctggga

SEQ ID NO: 1515438 - DNA, 18 bp, Homo sapiens
cctggcacagggcagtgg

SEQ ID NO: 1515439 - DNA, 18 bp, Homo sapiens
cctggcacccccacaagc

SEQ ID NO: 1515440 - DNA, 12 bp, Homo sapiens
cctggcacctgt

SEQ ID NO: 1515441 - DNA, 22 bp, Homo sapiens
cctggcacggtggctcaggcct

SEQ ID NO: 1515442 - DNA, 22 bp, Homo sapiens
cctggcactataatgtaagctc

SEQ ID NO: 1515443 - DNA, 19 bp, Homo sapiens
cctggcagacacaacccaa

SEQ ID NO: 1515444 - DNA, 11 bp, Homo sapiens
cctggcagccc

SEQ ID NO: 1515445 - DNA, 13 bp, Homo sapiens
cctggcagcccag

SEQ ID NO: 1515446 - DNA, 15 bp, Homo sapiens
cctggcagcccagag

SEQ ID NO: 1515447 - DNA, 17 bp, Homo sapiens
cctggcagcccagagac

SEQ ID NO: 1515448 - DNA, 18 bp, Homo sapiens
cctggcagccgtgccttc

SEQ ID NO: 1515449 - DNA, 22 bp, Homo sapiens
cctggcagccgtgccttcagct

SEQ ID NO: 1515450 - DNA, 12 bp, Homo sapiens
cctggcagcctg

SEQ ID NO: 1515451 - DNA, 17 bp, Homo sapiens
cctggcagctctggaca

SEQ ID NO: 1515452 - DNA, 19 bp, Homo sapiens
cctggcagctctggacagc

SEQ ID NO: 1515453 - DNA, 23 bp, Homo sapiens
cctggcagctctggacagcccca

SEQ ID NO: 1515454 - DNA, 22 bp, Homo sapiens
cctggcaggatgaccctgcgaa

SEQ ID NO: 1515455 - DNA, 23 bp, Homo sapiens
cctggcagggtcatcctgtgctc

SEQ ID NO: 1515456 - DNA, 12 bp, Homo sapiens
cctggcagtgct

SEQ ID NO: 1515457 - DNA, 24 bp, Homo sapiens
cctggcagtgctgagggaccgagc

SEQ ID NO: 1515458 - DNA, 17 bp, Homo sapiens
cctggcatcttctggag

SEQ ID NO: 1515459 - DNA, 19 bp, Homo sapiens
cctggcatcttctggagaa

SEQ ID NO: 1515460 - DNA, 22 bp, Homo sapiens
cctggcatggacaccttgtgtt

SEQ ID NO: 1515461 - DNA, 18 bp, Homo sapiens
cctggcatggcacctgtc

SEQ ID NO: 1515462 - DNA, 18 bp, Homo sapiens
cctggccaatgcggccca

SEQ ID NO: 1515463 - DNA, 22 bp, Homo sapiens
cctggccaccatggtcatcacc

SEQ ID NO: 1515464 - DNA, 15 bp, Homo sapiens
cctggccacgcagcc

SEQ ID NO: 1515465 - DNA, 20 bp, Homo sapiens
cctggccacgcagccaggac

SEQ ID NO: 1515466 - DNA, 13 bp, Homo sapiens
cctggccagacac

SEQ ID NO: 1515467 - DNA, 19 bp, Homo sapiens
cctggccagacacaggccc

SEQ ID NO: 1515468 - DNA, 23 bp, Homo sapiens
cctggccagacacaggccctccc

SEQ ID NO: 1515469 - DNA, 12 bp, Homo sapiens
cctggccaggag

SEQ ID NO: 1515470 - DNA, 18 bp, Homo sapiens
cctggccaggagctcttc

SEQ ID NO: 1515471 - DNA, 19 bp, Homo sapiens
cctggccaggagctcttca

SEQ ID NO: 1515472 - DNA, 20 bp, Homo sapiens
cctggccaggagctcttcag

SEQ ID NO: 1515473 - DNA, 12 bp, Homo sapiens
cctggccagtct

SEQ ID NO: 1515474 - DNA, 15 bp, Homo sapiens
cctggccagtcttcc

SEQ ID NO: 1515475 - DNA, 16 bp, Homo sapiens
cctggccagtcttcct

SEQ ID NO: 1515476 - DNA, 17 bp, Homo sapiens
cctggccagtcttcctc

SEQ ID NO: 1515477 - DNA, 14 bp, Homo sapiens
cctggccatttcca

SEQ ID NO: 1515478 - DNA, 23 bp, Homo sapiens
cctggccatttccaagaggctgt

SEQ ID NO: 1515479 - DNA, 18 bp, Homo sapiens
cctggcccactctgtaat

SEQ ID NO: 1515480 - DNA, 17 bp, Homo sapiens
cctggccccatgtctct

SEQ ID NO: 1515481 - DNA, 21 bp, Homo sapiens
cctggccccatgtctctcaga

SEQ ID NO: 1515482 - DNA, 16 bp, Homo sapiens
cctggcccccaacctc

SEQ ID NO: 1515483 - DNA, 19 bp, Homo sapiens
cctggcccccaacctcagg

SEQ ID NO: 1515484 - DNA, 18 bp, Homo sapiens
cctggccccgcctgcctg

SEQ ID NO: 1515485 - DNA, 22 bp, Homo sapiens
cctggccccgcctgcctgccac

SEQ ID NO: 1515486 - DNA, 12 bp, Homo sapiens
cctggcccctcc

SEQ ID NO: 1515487 - DNA, 22 bp, Homo sapiens
cctggcccctccagaccctgcc

SEQ ID NO: 1515488 - DNA, 15 bp, Homo sapiens
cctggccctgaggtg

SEQ ID NO: 1515489 - DNA, 12 bp, Homo sapiens
cctggccctgcc

SEQ ID NO: 1515490 - DNA, 16 bp, Homo sapiens
cctggccctgcttcct

SEQ ID NO: 1515491 - DNA, 18 bp, Homo sapiens
cctggcccttacttgctt

SEQ ID NO: 1515492 - DNA, 12 bp, Homo sapiens
cctggccgcccc

SEQ ID NO: 1515493 - DNA, 21 bp, Homo sapiens
cctggccgccccctgcccccc

SEQ ID NO: 1515494 - DNA, 16 bp, Homo sapiens
cctgccccctggtgga

SEQ ID NO: 1515495 - DNA, 16 bp, Homo sapiens
cctgcccctcagagac

SEQ ID NO: 1515496 - DNA, 16 bp, Homo sapiens
cctgcccctcccttca

SEQ ID NO: 1515497 - DNA, 15 bp, Homo sapiens
cctgcccgcaccctg

SEQ ID NO: 1515498 - DNA, 18 bp, Homo sapiens
cctgcccgcaccctggcc

SEQ ID NO: 1515499 - DNA, 14 bp, Homo sapiens
cctgcccgttcttg

SEQ ID NO: 1515500 - DNA, 18 bp, Homo sapiens
cctgccctagagcacact

SEQ ID NO: 1515501 - DNA, 19 bp, Homo sapiens
cctgccctagagcacactg

SEQ ID NO: 1515502 - DNA, 22 bp, Homo sapiens
cctgccctagagcacactgtag

SEQ ID NO: 1515503 - DNA, 14 bp, Homo sapiens
cctgccctcaaggg

SEQ ID NO: 1515504 - DNA, 21 bp, Homo sapiens
cctgccctcactccctctgca

SEQ ID NO: 1515505 - DNA, 21 bp, Homo sapiens
cctgccctcatggcccctctg

SEQ ID NO: 1515506 - DNA, 13 bp, Homo sapiens
cctgccctcccaa

SEQ ID NO: 1515507 - DNA, 18 bp, Homo sapiens
cctgccctcccctgctcc

SEQ ID NO: 1515508 - DNA, 13 bp, Homo sapiens
cctgccctcgtgg

SEQ ID NO: 1515509 - DNA, 14 bp, Homo sapiens
cctgccctcgtggc

SEQ ID NO: 1515510 - DNA, 16 bp, Homo sapiens
cctgccctcgtggcca

SEQ ID NO: 1515511 - DNA, 15 bp, Homo sapiens
cctgccctctctgcg

SEQ ID NO: 1515512 - DNA, 12 bp, Homo sapiens
cctgccctctgc

SEQ ID NO: 1515513 - DNA, 15 bp, Homo sapiens
cctgccctctgcccc

SEQ ID NO: 1515514 - DNA, 13 bp, Homo sapiens
cctgccctctgct

SEQ ID NO: 1515515 - DNA, 21 bp, Homo sapiens
cctgccctctgctctgcctgg

SEQ ID NO: 1515516 - DNA, 13 bp, Homo sapiens
cctgccctgcacg

SEQ ID NO: 1515517 - DNA, 16 bp, Homo sapiens
cctgccctgggcgagc

SEQ ID NO: 1515518 - DNA, 15 bp, Homo sapiens
cctgccctggtccag

SEQ ID NO: 1515519 - DNA, 17 bp, Homo sapiens
cctgcccttcctcctga

SEQ ID NO: 1515520 - DNA, 20 bp, Homo sapiens
cctgccgcagacgggcacag

SEQ ID NO: 1515521 - DNA, 21 bp, Homo sapiens
cctgccgcagacgggcacaga

SEQ ID NO: 1515522 - DNA, 15 bp, Homo sapiens
cctgccgcagagctg

SEQ ID NO: 1515523 - DNA, 15 bp, Homo sapiens
cctgccgcatgctcc

SEQ ID NO: 1515524 - DNA, 14 bp, Homo sapiens
cctgccgcccaaag

SEQ ID NO: 1515525 - DNA, 14 bp, Homo sapiens
cctgccgcctcaat

SEQ ID NO: 1515526 - DNA, 16 bp, Homo sapiens
cctgccgggctgaggg

SEQ ID NO: 1515527 - DNA, 23 bp, Homo sapiens
cctgccgggctgagggcctgctg

SEQ ID NO: 1515528 - DNA, 19 bp, Homo sapiens
cctgccggtgcacaggcct

SEQ ID NO: 1515529 - DNA, 22 bp, Homo sapiens
cctgccgtttcccctccttggc

SEQ ID NO: 1515530 - DNA, 17 bp, Homo sapiens
cctgcctaaattaaatt

SEQ ID NO: 1515531 - DNA, 22 bp, Homo sapiens
cctgcctcaccagccctggcaa

SEQ ID NO: 1515532 - DNA, 13 bp, Homo sapiens
cctgcctcagcct

SEQ ID NO: 1515533 - DNA, 16 bp, Homo sapiens
cctgcctcatccacca

SEQ ID NO: 1515534 - DNA, 15 bp, Homo sapiens
cctgcctccaccagc

SEQ ID NO: 1515535 - DNA, 22 bp, Homo sapiens
cctgcctcccgcccccttggct

SEQ ID NO: 1515536 - DNA, 13 bp, Homo sapiens
cctgcctccgggc

SEQ ID NO: 1515537 - DNA, 12 bp, Homo sapiens
cctgcctcctgc

SEQ ID NO: 1515538 - DNA, 13 bp, Homo sapiens
cctgcctcctgcc

SEQ ID NO: 1515539 - DNA, 14 bp, Homo sapiens
cctgcctcctgcca

SEQ ID NO: 1515540 - DNA, 15 bp, Homo sapiens
cctgcctcctgccac

SEQ ID NO: 1515541 - DNA, 20 bp, Homo sapiens
cctgcctcctgcctgcccct

SEQ ID NO: 1515542 - DNA, 14 bp, Homo sapiens
cctgcctcctggct

SEQ ID NO: 1515543 - DNA, 15 bp, Homo sapiens
cctgcctcctggctc

SEQ ID NO: 1515544 - DNA, 16 bp, Homo sapiens
cctgcctcctggctca

SEQ ID NO: 1515545 - DNA, 17 bp, Homo sapiens
cctgcctccttgatatt

SEQ ID NO: 1515546 - DNA, 17 bp, Homo sapiens
cctgcctctcacacaca

SEQ ID NO: 1515547 - DNA, 13 bp, Homo sapiens
cctgcctctgtgt

SEQ ID NO: 1515548 - DNA, 14 bp, Homo sapiens
cctgcctgagccca

SEQ ID NO: 1515549 - DNA, 22 bp, Homo sapiens
cctgcctgaggaggaggacaca

SEQ ID NO: 1515550 - DNA, 22 bp, Homo sapiens
cctgcctgagggcccctctgcc

SEQ ID NO: 1515551 - DNA, 13 bp, Homo sapiens
cctgcctgccacc

SEQ ID NO: 1515552 - DNA, 12 bp, Homo sapiens
cctgcctggcca

SEQ ID NO: 1515553 - DNA, 15 bp, Homo sapiens
cctgcctggccccca

SEQ ID NO: 1515554 - DNA, 12 bp, Homo sapiens
cctgcctggtcc

SEQ ID NO: 1515555 - DNA, 12 bp, Homo sapiens
cctgcctggtgc

SEQ ID NO: 1515556 - DNA, 21 bp, Homo sapiens
cctgcctggtgcattgctgtg

SEQ ID NO: 1515557 - DNA, 15 bp, Homo sapiens
cctgcctgtctcctt

SEQ ID NO: 1515558 - DNA, 15 bp, Homo sapiens
cctgcctgtctgccc

SEQ ID NO: 1515559 - DNA, 13 bp, Homo sapiens
cctgcctgtctgt

SEQ ID NO: 1515560 - DNA, 12 bp, Homo sapiens
cctgcctgtgct

SEQ ID NO: 1515561 - DNA, 23 bp, Homo sapiens
cctgcctgtggcgccgtctccag

SEQ ID NO: 1515562 - DNA, 20 bp, Homo sapiens
cctgcctgttggcaggccca

SEQ ID NO: 1515563 - DNA, 21 bp, Homo sapiens
cctgcctgttggcaggcccac

SEQ ID NO: 1515564 - DNA, 22 bp, Homo sapiens
cctgcctgttggcaggcccact

SEQ ID NO: 1515565 - DNA, 22 bp, Homo sapiens
cctgccttgaagccactgaagc

SEQ ID NO: 1515566 - DNA, 19 bp, Homo sapiens
cctgccttggcctcccaag

SEQ ID NO: 1515567 - DNA, 22 bp, Homo sapiens
cctgccttggggaaggtctccc

SEQ ID NO: 1515568 - DNA, 16 bp, Homo sapiens
cctgcctttaagccaa

SEQ ID NO: 1515569 - DNA, 14 bp, Homo sapiens
cctgcgaccctggg

SEQ ID NO: 1515570 - DNA, 15 bp, Homo sapiens
cctgcgaccctgggg

SEQ ID NO: 1515571 - DNA, 23 bp, Homo sapiens
cctgcgagacgcacacagctgag

SEQ ID NO: 1515572 - DNA, 22 bp, Homo sapiens
cctgcgagggccgcccgctccc

SEQ ID NO: 1515573 - DNA, 16 bp, Homo sapiens
cctgcgcacaggtggg

SEQ ID NO: 1515574 - DNA, 16 bp, Homo sapiens
cctgcgccagtcctgc

SEQ ID NO: 1515575 - DNA, 17 bp, Homo sapiens
cctgcgccagtcctgct

SEQ ID NO: 1515576 - DNA, 13 bp, Homo sapiens
cctgcgcctccag

SEQ ID NO: 1515577 - DNA, 15 bp, Homo sapiens
cctgcgcctccagag

SEQ ID NO: 1515578 - DNA, 17 bp, Homo sapiens
cctgcgcctccagaggt

SEQ ID NO: 1515579 - DNA, 18 bp, Homo sapiens
cctgcggagccggcacct

SEQ ID NO: 1515580 - DNA, 23 bp, Homo sapiens
cctgcggagtgaagaggggcagc

SEQ ID NO: 1515581 - DNA, 15 bp, Homo sapiens
cctgcgggagtagtt

SEQ ID NO: 1515582 - DNA, 17 bp, Homo sapiens
cctgcgggccaggcact

SEQ ID NO: 1515583 - DNA, 20 bp, Homo sapiens
cctgcgggcgcgggcagcca

SEQ ID NO: 1515584 - DNA, 21 bp, Homo sapiens
cctgcgggcgcgggcagccac

SEQ ID NO: 1515585 - DNA, 23 bp, Homo sapiens
cctgcgggcgcgggcagccaccc

SEQ ID NO: 1515586 - DNA, 21 bp, Homo sapiens
cctgcgggcttttccccggtc

SEQ ID NO: 1515587 - DNA, 16 bp, Homo sapiens
cctgcgtcctcctcac

SEQ ID NO: 1515588 - DNA, 21 bp, Homo sapiens
cctgcgtcctgacgccctgcg

SEQ ID NO: 1515589 - DNA, 19 bp, Homo sapiens
cctgcgtttggaggcccct

SEQ ID NO: 1515590 - DNA, 15 bp, Homo sapiens
cctgctactcctgtg

SEQ ID NO: 1515591 - DNA, 13 bp, Homo sapiens
cctgctactctgt

SEQ ID NO: 1515592 - DNA, 20 bp, Homo sapiens
cctgctagagcaacccctgt

SEQ ID NO: 1515593 - DNA, 17 bp, Homo sapiens
cctgctagctgtagaaa

SEQ ID NO: 1515594 - DNA, 21 bp, Homo sapiens
cctgctcaactctacccctgc

SEQ ID NO: 1515595 - DNA, 22 bp, Homo sapiens
cctgctcaactctacccctgct

SEQ ID NO: 1515596 - DNA, 23 bp, Homo sapiens
cctgctcaactctacccctgctc

SEQ ID NO: 1515597 - DNA, 18 bp, Homo sapiens
cctgctcacctgtgtgcc

SEQ ID NO: 1515598 - DNA, 14 bp, Homo sapiens
cctgctcagcagcc

SEQ ID NO: 1515599 - DNA, 21 bp, Homo sapiens
cctgctcagcagccagtctca

SEQ ID NO: 1515600 - DNA, 20 bp, Homo sapiens
cctgctcagccctgcaccat

SEQ ID NO: 1515601 - DNA, 19 bp, Homo sapiens
cctgctcatggccctcgga

SEQ ID NO: 1515602 - DNA, 23 bp, Homo sapiens
cctgctcattatgccacttcctt

SEQ ID NO: 1515603 - DNA, 13 bp, Homo sapiens
cctgctccaccag

SEQ ID NO: 1515604 - DNA, 15 bp, Homo sapiens
cctgctccaccagca

SEQ ID NO: 1515605 - DNA, 17 bp, Homo sapiens
cctgctccaccagcagc

SEQ ID NO: 1515606 - DNA, 22 bp, Homo sapiens
cctgctccaccagcagcatggc

SEQ ID NO: 1515607 - DNA, 11 bp, Homo sapiens
cctgctccaga

SEQ ID NO: 1515608 - DNA, 18 bp, Homo sapiens
cctgctccagaagatgcc

SEQ ID NO: 1515609 - DNA, 12 bp, Homo sapiens
cctgctccagac

SEQ ID NO: 1515610 - DNA, 14 bp, Homo sapiens
cctgctccagacct

SEQ ID NO: 1515611 - DNA, 15 bp, Homo sapiens
cctgcaccactctct

SEQ ID NO: 1515612 - DNA, 12 bp, Homo sapiens
cctgcaccagga

SEQ ID NO: 1515613 - DNA, 16 bp, Homo sapiens
cctgcacccacccctg

SEQ ID NO: 1515614 - DNA, 17 bp, Homo sapiens
cctgcacccacccctgc

SEQ ID NO: 1515615 - DNA, 14 bp, Homo sapiens
cctgcacctccccc

SEQ ID NO: 1515616 - DNA, 22 bp, Homo sapiens
cctgcacctccccccactgcag

SEQ ID NO: 1515617 - DNA, 15 bp, Homo sapiens
cctgcacctgctgcg

SEQ ID NO: 1515618 - DNA, 23 bp, Homo sapiens
cctgcacctgctgcgtccccact

SEQ ID NO: 1515619 - DNA, 14 bp, Homo sapiens
cctgcacctggcct

SEQ ID NO: 1515620 - DNA, 19 bp, Homo sapiens
cctgcacctggcctgggcc

SEQ ID NO: 1515621 - DNA, 14 bp, Homo sapiens
cctgcacctgtgca

SEQ ID NO: 1515622 - DNA, 19 bp, Homo sapiens
cctgcacgtcatgggaggg

SEQ ID NO: 1515623 - DNA, 21 bp, Homo sapiens
cctgcactccctggccttgcc

SEQ ID NO: 1515624 - DNA, 12 bp, Homo sapiens
cctgcactcctc

SEQ ID NO: 1515625 - DNA, 17 bp, Homo sapiens
cctgcactggagtccag

SEQ ID NO: 1515626 - DNA, 23 bp, Homo sapiens
cctgcactggagtccagtctctt

SEQ ID NO: 1515627 - DNA, 14 bp, Homo sapiens
cctgcactggggag

SEQ ID NO: 1515628 - DNA, 21 bp, Homo sapiens
cctgcactggggagcccgtct

SEQ ID NO: 1515629 - DNA, 16 bp, Homo sapiens
cctgcactgtaaaatg

SEQ ID NO: 1515630 - DNA, 17 bp, Homo sapiens
cctgcacttacttgctt

SEQ ID NO: 1515631 - DNA, 16 bp, Homo sapiens
cctgcagaatttgggt

SEQ ID NO: 1515632 - DNA, 14 bp, Homo sapiens
cctgcagagcacac

SEQ ID NO: 1515633 - DNA, 16 bp, Homo sapiens
cctgcagaggaccaca

SEQ ID NO: 1515634 - DNA, 21 bp, Homo sapiens
cctgcagaggaccacagtggg

SEQ ID NO: 1515635 - DNA, 20 bp, Homo sapiens
cctgcagaggtctgtgctga

SEQ ID NO: 1515636 - DNA, 22 bp, Homo sapiens
cctgcagcacatgcgggctcgc

SEQ ID NO: 1515637 - DNA, 15 bp, Homo sapiens
cctgcagcctcctcc

SEQ ID NO: 1515638 - DNA, 19 bp, Homo sapiens
cctgcagcctcctcctgac

SEQ ID NO: 1515639 - DNA, 19 bp, Homo sapiens
cctgcaggaacgagcactg

SEQ ID NO: 1515640 - DNA, 20 bp, Homo sapiens
cctgcaggaacgagcactgg

SEQ ID NO: 1515641 - DNA, 21 bp, Homo sapiens
cctgcaggaacgagcactggc

SEQ ID NO: 1515642 - DNA, 17 bp, Homo sapiens
cctgcaggctccatgca

SEQ ID NO: 1515643 - DNA, 21 bp, Homo sapiens
cctgcaggctccatgcacctc

SEQ ID NO: 1515644 - DNA, 23 bp, Homo sapiens
cctgcaggctccatgcacctccc

SEQ ID NO: 1515645 - DNA, 12 bp, Homo sapiens
cctgcaggctgg

SEQ ID NO: 1515646 - DNA, 19 bp, Homo sapiens
cctgcaggctggagactgg

SEQ ID NO: 1515647 - DNA, 20 bp, Homo sapiens
cctgcaggcttaggtcctca

SEQ ID NO: 1515648 - DNA, 19 bp, Homo sapiens
cctgcagggccatggctca

SEQ ID NO: 1515649 - DNA, 20 bp, Homo sapiens
cctgcagggccatggctcag

SEQ ID NO: 1515650 - DNA, 18 bp, Homo sapiens
cctgcagggcccttatgg

SEQ ID NO: 1515651 - DNA, 14 bp, Homo sapiens
cctgcaggggagca

SEQ ID NO: 1515652 - DNA, 23 bp, Homo sapiens
cctgcaggggagcacggagccgc

SEQ ID NO: 1515653 - DNA, 21 bp, Homo sapiens
cctgcagggtggtgctgggac

SEQ ID NO: 1515654 - DNA, 22 bp, Homo sapiens
cctgcagggtggtgctgggact

SEQ ID NO: 1515655 - DNA, 20 bp, Homo sapiens
cctgcaggtcagttgtaata

SEQ ID NO: 1515656 - DNA, 18 bp, Homo sapiens
cctgcagtagaaggtgcc

SEQ ID NO: 1515657 - DNA, 20 bp, Homo sapiens
cctgcagtgattcagcaggc

SEQ ID NO: 1515658 - DNA, 15 bp, Homo sapiens
cctgcagtgccagct

SEQ ID NO: 1515659 - DNA, 21 bp, Homo sapiens
cctgcagtttggccctggagc

SEQ ID NO: 1515660 - DNA, 24 bp, Homo sapiens
cctgcagtttggccctggagccag

SEQ ID NO: 1515661 - DNA, 20 bp, Homo sapiens
cctgcatcccgatacctcag

SEQ ID NO: 1515662 - DNA, 21 bp, Homo sapiens
cctgcatcccgatacctcagc

SEQ ID NO: 1515663 - DNA, 15 bp, Homo sapiens
cctgcatgagctggc

SEQ ID NO: 1515664 - DNA, 17 bp, Homo sapiens
cctgcatgagctggcaa

SEQ ID NO: 1515665 - DNA, 13 bp, Homo sapiens
cctgcatgctgaa

SEQ ID NO: 1515666 - DNA, 14 bp, Homo sapiens
cctgcatgctgaaa

SEQ ID NO: 1515667 - DNA, 14 bp, Homo sapiens
cctgcatgctgccc

SEQ ID NO: 1515668 - DNA, 20 bp, Homo sapiens
cctgcatgctgcccagccac

SEQ ID NO: 1515669 - DNA, 14 bp, Homo sapiens
cctgcatggagaag

SEQ ID NO: 1515670 - DNA, 17 bp, Homo sapiens
cctgcatggtagggaga

SEQ ID NO: 1515671 - DNA, 15 bp, Homo sapiens
cctgcatgttctgtg

SEQ ID NO: 1515672 - DNA, 15 bp, Homo sapiens
cctgcattcacccag

SEQ ID NO: 1515673 - DNA, 16 bp, Homo sapiens
cctgcattcacccaga

SEQ ID NO: 1515674 - DNA, 14 bp, Homo sapiens
cctgcattcatgta

SEQ ID NO: 1515675 - DNA, 22 bp, Homo sapiens
cctgcattctgccgtgtgccct

SEQ ID NO: 1515676 - DNA, 20 bp, Homo sapiens
cctgcattggcctggcctcc

SEQ ID NO: 1515677 - DNA, 19 bp, Homo sapiens
cctgccaagactcctcagg

SEQ ID NO: 1515678 - DNA, 23 bp, Homo sapiens
cctgccacaaaccaccaggactg

SEQ ID NO: 1515679 - DNA, 20 bp, Homo sapiens
cctgccacactcagtccccc

SEQ ID NO: 1515680 - DNA, 15 bp, Homo sapiens
cctgccaccaggcca

SEQ ID NO: 1515681 - DNA, 22 bp, Homo sapiens
cctgccacccccttccctggga

SEQ ID NO: 1515682 - DNA, 23 bp, Homo sapiens
cctgccacccccttccctgggag

SEQ ID NO: 1515683 - DNA, 15 bp, Homo sapiens
cctgccaccccttcc

SEQ ID NO: 1515684 - DNA, 22 bp, Homo sapiens
cctgccaccggaggtcactcca

SEQ ID NO: 1515685 - DNA, 13 bp, Homo sapiens
cctgccactcact

SEQ ID NO: 1515686 - DNA, 16 bp, Homo sapiens
cctgccactcactagg

SEQ ID NO: 1515687 - DNA, 17 bp, Homo sapiens
cctgccactctctggga

SEQ ID NO: 1515688 - DNA, 23 bp, Homo sapiens
cctgccactttggtacatggcca

SEQ ID NO: 1515689 - DNA, 18 bp, Homo sapiens
cctgccagaggatgctct

SEQ ID NO: 1515690 - DNA, 18 bp, Homo sapiens
cctgccagcacgcctggc

SEQ ID NO: 1515691 - DNA, 14 bp, Homo sapiens
cctgccagcctggc

SEQ ID NO: 1515692 - DNA, 15 bp, Homo sapiens
cctgccagcctggct

SEQ ID NO: 1515693 - DNA, 15 bp, Homo sapiens
cctgccagctgcctt

SEQ ID NO: 1515694 - DNA, 17 bp, Homo sapiens
cctgccagctgccttcc

SEQ ID NO: 1515695 - DNA, 15 bp, Homo sapiens
cctgccaggcagggg

SEQ ID NO: 1515696 - DNA, 19 bp, Homo sapiens
cctgccagggtgagcaggg

SEQ ID NO: 1515697 - DNA, 20 bp, Homo sapiens
cctgccagtgccttacctcc

SEQ ID NO: 1515698 - DNA, 21 bp, Homo sapiens
cctgccagtgccttacctcct

SEQ ID NO: 1515699 - DNA, 17 bp, Homo sapiens
cctgccagttctctgtg

SEQ ID NO: 1515700 - DNA, 19 bp, Homo sapiens
cctgccagttgaaaatgga

SEQ ID NO: 1515701 - DNA, 18 bp, Homo sapiens
cctgccatcatgtttaca

SEQ ID NO: 1515702 - DNA, 20 bp, Homo sapiens
cctgccatcatgtttacaga

SEQ ID NO: 1515703 - DNA, 17 bp, Homo sapiens
cctgccatcttcccagc

SEQ ID NO: 1515704 - DNA, 18 bp, Homo sapiens
cctgccatcttcccagca

SEQ ID NO: 1515705 - DNA, 15 bp, Homo sapiens
cctgccatgccagga

SEQ ID NO: 1515706 - DNA, 17 bp, Homo sapiens
cctgccattcttctggt

SEQ ID NO: 1515707 - DNA, 23 bp, Homo sapiens
cctgccattcttctggtgctact

SEQ ID NO: 1515708 - DNA, 22 bp, Homo sapiens
cctgcccaatgctttgggaggc

SEQ ID NO: 1515709 - DNA, 23 bp, Homo sapiens
cctgcccaggagagccagccctc

SEQ ID NO: 1515710 - DNA, 12 bp, Homo sapiens
cctgcccagtgt

SEQ ID NO: 1515711 - DNA, 23 bp, Homo sapiens
cctgcccagtgttgtttgtaaat

SEQ ID NO: 1515712 - DNA, 19 bp, Homo sapiens
cctgccccaagggcccaga

SEQ ID NO: 1515713 - DNA, 20 bp, Homo sapiens
cctgccccaatccctttatt

SEQ ID NO: 1515714 - DNA, 21 bp, Homo sapiens
cctgccccaccccatccagcc

SEQ ID NO: 1515715 - DNA, 14 bp, Homo sapiens
cctgcccccagccc

SEQ ID NO: 1515716 - DNA, 16 bp, Homo sapiens
cctgcccccaggactg

SEQ ID NO: 1515717 - DNA, 17 bp, Homo sapiens
cctgcccccaggactgg

SEQ ID NO: 1515718 - DNA, 19 bp, Homo sapiens
cctgcccccaggactgggc

SEQ ID NO: 1515719 - DNA, 14 bp, Homo sapiens
cctgcccccatctc

SEQ ID NO: 1515720 - DNA, 21 bp, Homo sapiens
cctgcccccatctccccaggc

SEQ ID NO: 1515721 - DNA, 22 bp, Homo sapiens
cctgcccccatctccccaggcc

SEQ ID NO: 1515722 - DNA, 14 bp, Homo sapiens
cctgccccccaagg

SEQ ID NO: 1515723 - DNA, 22 bp, Homo sapiens
cctgccccccagcctctggcat

SEQ ID NO: 1515724 - DNA, 22 bp, Homo sapiens
cctgccccccctaagagacaca

SEQ ID NO: 1515725 - DNA, 14 bp, Homo sapiens
cctgccccctggtg

SEQ ID NO: 1515726 - DNA, 13 bp, Homo sapiens
aattattgtaatg

SEQ ID NO: 1515727 - DNA, 18 bp, Homo sapiens
aattattgtaatgtaata

SEQ ID NO: 1515728 - DNA, 14 bp, Homo sapiens
aattatttgaatga

SEQ ID NO: 1515729 - DNA, 12 bp, Homo sapiens
aattatttgcta

SEQ ID NO: 1515730 - DNA, 12 bp, Homo sapiens
aattattttaaa

SEQ ID NO: 1515731 - DNA, 21 bp, Homo sapiens
aattattttaaaatatttaaa

SEQ ID NO: 1515732 - DNA, 20 bp, Homo sapiens
aattattttaatattttgta

SEQ ID NO: 1515733 - DNA, 16 bp, Homo sapiens
aattattttgaatgtc

SEQ ID NO: 1515734 - DNA, 20 bp, Homo sapiens
aattattttgaatgtcacaa

SEQ ID NO: 1515735 - DNA, 17 bp, Homo sapiens
aattatttttacagttc

SEQ ID NO: 1515736 - DNA, 15 bp, Homo sapiens
aattattttttagat

SEQ ID NO: 1515737 - DNA, 16 bp, Homo sapiens
aattcaaaagttccaa

SEQ ID NO: 1515738 - DNA, 23 bp, Homo sapiens
aattcaaaagttccaagagtcta

SEQ ID NO: 1515739 - DNA, 13 bp, Homo sapiens
aattcaaagcatg

SEQ ID NO: 1515740 - DNA, 16 bp, Homo sapiens
aattcaacaaatgatg

SEQ ID NO: 1515741 - DNA, 17 bp, Homo sapiens
aattcaacacttatttt

SEQ ID NO: 1515742 - DNA, 21 bp, Homo sapiens
aattcaaccactgtaaaatga

SEQ ID NO: 1515743 - DNA, 19 bp, Homo sapiens
aattcaagaaaataaaact

SEQ ID NO: 1515744 - DNA, 16 bp, Homo sapiens
aattcaaggaatttct

SEQ ID NO: 1515745 - DNA, 16 bp, Homo sapiens
aattcaatagtaatat

SEQ ID NO: 1515746 - DNA, 21 bp, Homo sapiens
aattcaatgccgcaacatata

SEQ ID NO: 1515747 - DNA, 22 bp, Homo sapiens
aattcaatgccgcaacatatag

SEQ ID NO: 1515748 - DNA, 20 bp, Homo sapiens
aattcacagcacagtacaca

SEQ ID NO: 1515749 - DNA, 20 bp, Homo sapiens
aattcacagtgctcttttct

SEQ ID NO: 1515750 - DNA, 22 bp, Homo sapiens
aattcactaatcttgaatgttt

SEQ ID NO: 1515751 - DNA, 10 bp, Homo sapiens
aattcactcc

SEQ ID NO: 1515752 - DNA, 14 bp, Homo sapiens
aattcactccagtc

SEQ ID NO: 1515753 - DNA, 24 bp, Homo sapiens
aattcactccagtcaacagattca

SEQ ID NO: 1515754 - DNA, 19 bp, Homo sapiens
aattcacttaagtttttcc

SEQ ID NO: 1515755 - DNA, 14 bp, Homo sapiens
aattcacttcagtt

SEQ ID NO: 1515756 - DNA, 15 bp, Homo sapiens
aattcagaaggatct

SEQ ID NO: 1515757 - DNA, 11 bp, Homo sapiens
aattcagacaa

SEQ ID NO: 1515758 - DNA, 15 bp, Homo sapiens
aattcagacaacatt

SEQ ID NO: 1515759 - DNA, 17 bp, Homo sapiens
aattcagacaacattat

SEQ ID NO: 1515760 - DNA, 12 bp, Homo sapiens
aattcagcaccc

SEQ ID NO: 1515761 - DNA, 15 bp, Homo sapiens
aattcagcaccctgg

SEQ ID NO: 1515762 - DNA, 23 bp, Homo sapiens
aattcagcactgatttcacaaca

SEQ ID NO: 1515763 - DNA, 19 bp, Homo sapiens
aattcaggtttttcctttt

SEQ ID NO: 1515764 - DNA, 17 bp, Homo sapiens
aattcataaaaataacc

SEQ ID NO: 1515765 - DNA, 17 bp, Homo sapiens
aattcataatcactcta

SEQ ID NO: 1515766 - DNA, 22 bp, Homo sapiens
aattcattgagcagttagctca

SEQ ID NO: 1515767 - DNA, 19 bp, Homo sapiens
aattcattgttttgcaaaa

SEQ ID NO: 1515768 - DNA, 15 bp, Homo sapiens
aattcatttctagac

SEQ ID NO: 1515769 - DNA, 13 bp, Homo sapiens
aattcatttgtat

SEQ ID NO: 1515770 - DNA, 16 bp, Homo sapiens
aattccacaccctcac

SEQ ID NO: 1515771 - DNA, 14 bp, Homo sapiens
aattccactggact

SEQ ID NO: 1515772 - DNA, 11 bp, Homo sapiens
aattccactgt

SEQ ID NO: 1515773 - DNA, 17 bp, Homo sapiens
aattccaggctgagcca

SEQ ID NO: 1515774 - DNA, 21 bp, Homo sapiens
aattccaggctgagccatgag

SEQ ID NO: 1515775 - DNA, 17 bp, Homo sapiens
aattccatacttctctc

SEQ ID NO: 1515776 - DNA, 17 bp, Homo sapiens
aattccatatgctccag

SEQ ID NO: 1515777 - DNA, 16 bp, Homo sapiens
aattccatcttgtaaa

SEQ ID NO: 1515778 - DNA, 17 bp, Homo sapiens
aattcccattttgcaaa

SEQ ID NO: 1515779 - DNA, 22 bp, Homo sapiens
aattcccattttgcaaaatttc

SEQ ID NO: 1515780 - DNA, 17 bp, Homo sapiens
aattccctccccctcct

SEQ ID NO: 1515781 - DNA, 18 bp, Homo sapiens
aattcctacaacttaatg

SEQ ID NO: 1515782 - DNA, 16 bp, Homo sapiens
aattcctcctctattt

SEQ ID NO: 1515783 - DNA, 23 bp, Homo sapiens
aattcctcttcattgtctacata

SEQ ID NO: 1515784 - DNA, 12 bp, Homo sapiens
aattcctcttta

SEQ ID NO: 1515785 - DNA, 13 bp, Homo sapiens
aattcctctttaa

SEQ ID NO: 1515786 - DNA, 23 bp, Homo sapiens
aattccttagcttagacctcagc

SEQ ID NO: 1515787 - DNA, 19 bp, Homo sapiens
aattccttcgaaaggcctt

SEQ ID NO: 1515788 - DNA, 23 bp, Homo sapiens
aattccttcgaaaggccttcaga

SEQ ID NO: 1515789 - DNA, 17 bp, Homo sapiens
aattcggtgtgctgcca

SEQ ID NO: 1515790 - DNA, 18 bp, Homo sapiens
aattctaacattaaatca

SEQ ID NO: 1515791 - DNA, 15 bp, Homo sapiens
aattctacattgtca

SEQ ID NO: 1515792 - DNA, 23 bp, Homo sapiens
aattctaccaaggtcttcttaat

SEQ ID NO: 1515793 - DNA, 15 bp, Homo sapiens
aattctactggaaaa

SEQ ID NO: 1515794 - DNA, 16 bp, Homo sapiens
aattctagtctctgat

SEQ ID NO: 1515795 - DNA, 12 bp, Homo sapiens
aattctagtgct

SEQ ID NO: 1515796 - DNA, 16 bp, Homo sapiens
aattctattgaaaaca

SEQ ID NO: 1515797 - DNA, 16 bp, Homo sapiens
aattctcaagacctga

SEQ ID NO: 1515798 - DNA, 22 bp, Homo sapiens
aattctcaagacctgagtattt

SEQ ID NO: 1515799 - DNA, 18 bp, Homo sapiens
aattctcattaaaagaat

SEQ ID NO: 1515800 - DNA, 14 bp, Homo sapiens
aattctcatttgtt

SEQ ID NO: 1515801 - DNA, 14 bp, Homo sapiens
aattctccactgtg

SEQ ID NO: 1515802 - DNA, 18 bp, Homo sapiens
aattctccaggattttaa

SEQ ID NO: 1515803 - DNA, 21 bp, Homo sapiens
aattctcccctccctccagta

SEQ ID NO: 1515804 - DNA, 19 bp, Homo sapiens
aattctcctgcctcagcct

SEQ ID NO: 1515805 - DNA, 13 bp, Homo sapiens
aattctcctggag

SEQ ID NO: 1515806 - DNA, 17 bp, Homo sapiens
aattctgagttttgtgt

SEQ ID NO: 1515807 - DNA, 19 bp, Homo sapiens
aattctgatgtttctgtga

SEQ ID NO: 1515808 - DNA, 20 bp, Homo sapiens
aattctgcaactagccaagg

SEQ ID NO: 1515809 - DNA, 13 bp, Homo sapiens
aattctgccccca

SEQ ID NO: 1515810 - DNA, 19 bp, Homo sapiens
aattctgctacctcactgg

SEQ ID NO: 1515811 - DNA, 14 bp, Homo sapiens
aattctggcccagc

SEQ ID NO: 1515812 - DNA, 17 bp, Homo sapiens
aattctggcccagccaa

SEQ ID NO: 1515813 - DNA, 19 bp, Homo sapiens
aattctgttactttgctat

SEQ ID NO: 1515814 - DNA, 19 bp, Homo sapiens
aattctgtttttaatgcta

SEQ ID NO: 1515815 - DNA, 21 bp, Homo sapiens
aattctgtttttaatgctatt

SEQ ID NO: 1515816 - DNA, 11 bp, Homo sapiens
aattcttaaaa

SEQ ID NO: 1515817 - DNA, 18 bp, Homo sapiens
aattcttaaaaaattgaa

SEQ ID NO: 1515818 - DNA, 23 bp, Homo sapiens
aattcttaaaaggcccatagcag

SEQ ID NO: 1515819 - DNA, 15 bp, Homo sapiens
aattcttacatgttt

SEQ ID NO: 1515820 - DNA, 17 bp, Homo sapiens
aattcttcacctttgta

SEQ ID NO: 1515821 - DNA, 18 bp, Homo sapiens
aattcttcaggtggaaaa

SEQ ID NO: 1515822 - DNA, 15 bp, Homo sapiens
aattcttctgaactc

SEQ ID NO: 1515823 - DNA, 15 bp, Homo sapiens
aattcttctgtcctg

SEQ ID NO: 1515824 - DNA, 21 bp, Homo sapiens
aattcttgaaggaaaatgata

SEQ ID NO: 1515825 - DNA, 13 bp, Homo sapiens
aattcttgataaa

SEQ ID NO: 1515826 - DNA, 15 bp, Homo sapiens
aattctttagtactc

SEQ ID NO: 1515827 - DNA, 12 bp, Homo sapiens
aattctttctgt

SEQ ID NO: 1515828 - DNA, 21 bp, Homo sapiens
aattctttctgttgaaaagca

SEQ ID NO: 1515829 - DNA, 18 bp, Homo sapiens
aattctttgcaaaaatcc

SEQ ID NO: 1515830 - DNA, 13 bp, Homo sapiens
aattcttttctga

SEQ ID NO: 1515831 - DNA, 13 bp, Homo sapiens
aattgaaaaacaa

SEQ ID NO: 1515832 - DNA, 23 bp, Homo sapiens
aattgaaaaacaattttctgtaa

SEQ ID NO: 1515833 - DNA, 14 bp, Homo sapiens
aattgaaaagttat

SEQ ID NO: 1515834 - DNA, 14 bp, Homo sapiens
aattgaaaatgcat

SEQ ID NO: 1515835 - DNA, 21 bp, Homo sapiens
aattgaaaatgcattagggaa

SEQ ID NO: 1515836 - DNA, 22 bp, Homo sapiens
aattgaaataaataaaaatgca

SEQ ID NO: 1515837 - DNA, 20 bp, Homo sapiens
aattgaagtgtataatataa

SEQ ID NO: 1515838 - DNA, 19 bp, Homo sapiens
aattgacagagtaaaagta

SEQ ID NO: 1515839 - DNA, 17 bp, Homo sapiens
aattgactgaagcacag

SEQ ID NO: 1515840 - DNA, 20 bp, Homo sapiens
aattgagataatatctgtga

SEQ ID NO: 1515841 - DNA, 22 bp, Homo sapiens
aattgagctgctttttttgaaa

SEQ ID NO: 1515842 - DNA, 23 bp, Homo sapiens
aattgagctgctttttttgaaac

SEQ ID NO: 1515843 - DNA, 21 bp, Homo sapiens
ccctggtggacagtcctggga

SEQ ID NO: 1515844 - DNA, 16 bp, Homo sapiens
ccctggtgggccaaca

SEQ ID NO: 1515845 - DNA, 23 bp, Homo sapiens
ccctggtgggccaacaaagaaca

SEQ ID NO: 1515846 - DNA, 17 bp, Homo sapiens
ccctggtgtcaggcagg

SEQ ID NO: 1515847 - DNA, 14 bp, Homo sapiens
ccctggtgtgtttc

SEQ ID NO: 1515848 - DNA, 22 bp, Homo sapiens
ccctggttagctgacagtcagc

SEQ ID NO: 1515849 - DNA, 16 bp, Homo sapiens
ccctggttctcatctt

SEQ ID NO: 1515850 - DNA, 14 bp, Homo sapiens
ccctgtacccagct

SEQ ID NO: 1515851 - DNA, 14 bp, Homo sapiens
ccctgtagctcagt

SEQ ID NO: 1515852 - DNA, 16 bp, Homo sapiens
ccctgtagctctgcct

SEQ ID NO: 1515853 - DNA, 21 bp, Homo sapiens
ccctgtcaagttaacaaggaa

SEQ ID NO: 1515854 - DNA, 19 bp, Homo sapiens
ccctgtcaccaagctcaca

SEQ ID NO: 1515855 - DNA, 21 bp, Homo sapiens
ccctgtcacgctcatgtcctg

SEQ ID NO: 1515856 - DNA, 13 bp, Homo sapiens
ccctgtcactcag

SEQ ID NO: 1515857 - DNA, 19 bp, Homo sapiens
ccctgtcatttgaacctgg

SEQ ID NO: 1515858 - DNA, 22 bp, Homo sapiens
ccctgtcccaccaactctgcac

SEQ ID NO: 1515859 - DNA, 15 bp, Homo sapiens
ccctgtcccaccccc

SEQ ID NO: 1515860 - DNA, 17 bp, Homo sapiens
ccctgtcccagggccct

SEQ ID NO: 1515861 - DNA, 17 bp, Homo sapiens
ccctgtcccattctaga

SEQ ID NO: 1515862 - DNA, 19 bp, Homo sapiens
ccctgtcccccagctctgg

SEQ ID NO: 1515863 - DNA, 15 bp, Homo sapiens
ccctgtccggcccag

SEQ ID NO: 1515864 - DNA, 20 bp, Homo sapiens
ccctgtcgagacacttgcct

SEQ ID NO: 1515865 - DNA, 22 bp, Homo sapiens
ccctgtctccagctgcctgggc

SEQ ID NO: 1515866 - DNA, 23 bp, Homo sapiens
ccctgtctgaaggacacttcctg

SEQ ID NO: 1515867 - DNA, 12 bp, Homo sapiens
ccctgtctgtgt

SEQ ID NO: 1515868 - DNA, 20 bp, Homo sapiens
ccctgtctgtgtcccagcca

SEQ ID NO: 1515869 - DNA, 21 bp, Homo sapiens
ccctgtctgtgtcccagccac

SEQ ID NO: 1515870 - DNA, 16 bp, Homo sapiens
ccctgtcttctgggca

SEQ ID NO: 1515871 - DNA, 20 bp, Homo sapiens
ccctgtcttctgggcacagt

SEQ ID NO: 1515872 - DNA, 19 bp, Homo sapiens
ccctgtgacatggtgcctg

SEQ ID NO: 1515873 - DNA, 21 bp, Homo sapiens
ccctgtgacatggtgcctgag

SEQ ID NO: 1515874 - DNA, 18 bp, Homo sapiens
ccctgtgcaggagctagt

SEQ ID NO: 1515875 - DNA, 21 bp, Homo sapiens
ccctgtgcctgggccctgggc

SEQ ID NO: 1515876 - DNA, 24 bp, Homo sapiens
ccctgtgccttggtgtgctgtatc

SEQ ID NO: 1515877 - DNA, 20 bp, Homo sapiens
ccctgtgctcccctgccaca

SEQ ID NO: 1515878 - DNA, 18 bp, Homo sapiens
ccctgtgctgatcctgct

SEQ ID NO: 1515879 - DNA, 21 bp, Homo sapiens
ccctgtgctgatcctgctgac

SEQ ID NO: 1515880 - DNA, 12 bp, Homo sapiens
ccctgtgctggt

SEQ ID NO: 1515881 - DNA, 15 bp, Homo sapiens
ccctgtgctggtgtc

SEQ ID NO: 1515882 - DNA, 21 bp, Homo sapiens
ccctgtgctggtgtcctgacc

SEQ ID NO: 1515883 - DNA, 22 bp, Homo sapiens
ccctgtgctggtgtcctgacca

SEQ ID NO: 1515884 - DNA, 12 bp, Homo sapiens
ccctgtggagtc

SEQ ID NO: 1515885 - DNA, 13 bp, Homo sapiens
ccctgtggccaac

SEQ ID NO: 1515886 - DNA, 16 bp, Homo sapiens
ccctgtggccaactgc

SEQ ID NO: 1515887 - DNA, 18 bp, Homo sapiens
ccctgtggccaactgcaa

SEQ ID NO: 1515888 - DNA, 15 bp, Homo sapiens
ccctgtggccctggc

SEQ ID NO: 1515889 - DNA, 18 bp, Homo sapiens
ccctgtggccctggccac

SEQ ID NO: 1515890 - DNA, 18 bp, Homo sapiens
ccctgtggccgccacctg

SEQ ID NO: 1515891 - DNA, 19 bp, Homo sapiens
ccctgtggccgccacctga

SEQ ID NO: 1515892 - DNA, 20 bp, Homo sapiens
ccctgtggggcaggagtgcc

SEQ ID NO: 1515893 - DNA, 21 bp, Homo sapiens
ccctgtgtcctccaccatgca

SEQ ID NO: 1515894 - DNA, 18 bp, Homo sapiens
ccctgtgttgtctctaga

SEQ ID NO: 1515895 - DNA, 19 bp, Homo sapiens
ccctgttatttttctgccc

SEQ ID NO: 1515896 - DNA, 20 bp, Homo sapiens
ccctgttatttttctgccct

SEQ ID NO: 1515897 - DNA, 21 bp, Homo sapiens
ccctgttatttttctgccctg

SEQ ID NO: 1515898 - DNA, 17 bp, Homo sapiens
ccctgttccccagagaa

SEQ ID NO: 1515899 - DNA, 13 bp, Homo sapiens
ccctgttccctgg

SEQ ID NO: 1515900 - DNA, 14 bp, Homo sapiens
ccctgttccctgga

SEQ ID NO: 1515901 - DNA, 15 bp, Homo sapiens
ccctgttctcctgtc

SEQ ID NO: 1515902 - DNA, 19 bp, Homo sapiens
ccctgttgaattggtgaat

SEQ ID NO: 1515903 - DNA, 20 bp, Homo sapiens
ccctgttgaattggtgaata

SEQ ID NO: 1515904 - DNA, 22 bp, Homo sapiens
ccctgttttcccacgaggaatc

SEQ ID NO: 1515905 - DNA, 16 bp, Homo sapiens
ccctgttttttgtaga

SEQ ID NO: 1515906 - DNA, 21 bp, Homo sapiens
cccttaaacacaggctgtcct

SEQ ID NO: 1515907 - DNA, 13 bp, Homo sapiens
cccttaactccaa

SEQ ID NO: 1515908 - DNA, 13 bp, Homo sapiens
cccttacccatct

SEQ ID NO: 1515909 - DNA, 17 bp, Homo sapiens
cccttaccccttagcct

SEQ ID NO: 1515910 - DNA, 22 bp, Homo sapiens
cccttaccccttagcctccctg

SEQ ID NO: 1515911 - DNA, 18 bp, Homo sapiens
cccttattcctaatggct

SEQ ID NO: 1515912 - DNA, 19 bp, Homo sapiens
cccttattgctgtcctgga

SEQ ID NO: 1515913 - DNA, 12 bp, Homo sapiens
cccttattttca

SEQ ID NO: 1515914 - DNA, 14 bp, Homo sapiens
cccttcaaccattc

SEQ ID NO: 1515915 - DNA, 21 bp, Homo sapiens
cccttcacctttggtgcagag

SEQ ID NO: 1515916 - DNA, 13 bp, Homo sapiens
cccttcagcccac

SEQ ID NO: 1515917 - DNA, 19 bp, Homo sapiens
cccttcagcccaccaccct

SEQ ID NO: 1515918 - DNA, 14 bp, Homo sapiens
cccttcagggccag

SEQ ID NO: 1515919 - DNA, 20 bp, Homo sapiens
cccttcagtaccctctcagc

SEQ ID NO: 1515920 - DNA, 12 bp, Homo sapiens
cccttcagtctg

SEQ ID NO: 1515921 - DNA, 16 bp, Homo sapiens
cccttcagtctgctcc

SEQ ID NO: 1515922 - DNA, 17 bp, Homo sapiens
cccttcagtctgctcca

SEQ ID NO: 1515923 - DNA, 17 bp, Homo sapiens
cccttcagtgcccacca

SEQ ID NO: 1515924 - DNA, 14 bp, Homo sapiens
cccttcatcttcct

SEQ ID NO: 1515925 - DNA, 16 bp, Homo sapiens
cccttcatcttcctgt

SEQ ID NO: 1515926 - DNA, 19 bp, Homo sapiens
cccttcccacctactgcac

SEQ ID NO: 1515927 - DNA, 19 bp, Homo sapiens
cccttcccatttcttccca

SEQ ID NO: 1515928 - DNA, 21 bp, Homo sapiens
cccttcccccagcccatccat

SEQ ID NO: 1515929 - DNA, 21 bp, Homo sapiens
cccttcccctcccccactcct

SEQ ID NO: 1515930 - DNA, 22 bp, Homo sapiens
cccttcccctttactcagccca

SEQ ID NO: 1515931 - DNA, 13 bp, Homo sapiens
cccttccctcacc

SEQ ID NO: 1515932 - DNA, 15 bp, Homo sapiens
cccttccctccctga

SEQ ID NO: 1515933 - DNA, 12 bp, Homo sapiens
cccttccctcct

SEQ ID NO: 1515934 - DNA, 14 bp, Homo sapiens
cccttccctcttcc

SEQ ID NO: 1515935 - DNA, 14 bp, Homo sapiens
cccttccctggcag

SEQ ID NO: 1515936 - DNA, 13 bp, Homo sapiens
cccttccctggga

SEQ ID NO: 1515937 - DNA, 14 bp, Homo sapiens
cccttccctgtccc

SEQ ID NO: 1515938 - DNA, 16 bp, Homo sapiens
cccttccctgtccctc

SEQ ID NO: 1515939 - DNA, 17 bp, Homo sapiens
cccttcccttgagccct

SEQ ID NO: 1515940 - DNA, 20 bp, Homo sapiens
cccttcctcctgatggagtg

SEQ ID NO: 1515941 - DNA, 16 bp, Homo sapiens
cccttcctctccactg

SEQ ID NO: 1515942 - DNA, 20 bp, Homo sapiens
cccttcctctccactgcctt

SEQ ID NO: 1515943 - DNA, 18 bp, Homo sapiens
cccttcctcttcctgccc

SEQ ID NO: 1515944 - DNA, 19 bp, Homo sapiens
cccttcctcttcctgccct

SEQ ID NO: 1515945 - DNA, 15 bp, Homo sapiens
cccttcctctttggt

SEQ ID NO: 1515946 - DNA, 21 bp, Homo sapiens
cccttcctgccactgccgcct

SEQ ID NO: 1515947 - DNA, 12 bp, Homo sapiens
cccttcctggaa

SEQ ID NO: 1515948 - DNA, 17 bp, Homo sapiens
cccttcctggaaacagc

SEQ ID NO: 1515949 - DNA, 21 bp, Homo sapiens
cccttcctggaaacagcatga

SEQ ID NO: 1515950 - DNA, 21 bp, Homo sapiens
cccttctatacccacccagaa

SEQ ID NO: 1515951 - DNA, 15 bp, Homo sapiens
cccttctcccctgca

SEQ ID NO: 1515952 - DNA, 17 bp, Homo sapiens
cccttctcccttgccct

SEQ ID NO: 1515953 - DNA, 15 bp, Homo sapiens
cccttctcctttcct

SEQ ID NO: 1515954 - DNA, 13 bp, Homo sapiens
cccttctctgctc

SEQ ID NO: 1515955 - DNA, 15 bp, Homo sapiens
cccttctctgctcca

SEQ ID NO: 1515956 - DNA, 23 bp, Homo sapiens
cccttctctgctccaccacatcc

SEQ ID NO: 1515957 - DNA, 21 bp, Homo sapiens
cccttgaagaggggaggggcc

SEQ ID NO: 1515958 - DNA, 23 bp, Homo sapiens
cccttgaagaggggaggggccta

SEQ ID NO: 1515959 - DNA, 21 bp, Homo sapiens
aattgagtaatggtgtagaac

SEQ ID NO: 1515960 - DNA, 16 bp, Homo sapiens
aattgataaaagagtt

SEQ ID NO: 1515961 - DNA, 15 bp, Homo sapiens
aattgatattatatt

SEQ ID NO: 1515962 - DNA, 13 bp, Homo sapiens
aattgatgtgttt

SEQ ID NO: 1515963 - DNA, 14 bp, Homo sapiens
aattgattattctg

SEQ ID NO: 1515964 - DNA, 15 bp, Homo sapiens
aattgattgaattaa

SEQ ID NO: 1515965 - DNA, 19 bp, Homo sapiens
aattgatttttctcttcat

SEQ ID NO: 1515966 - DNA, 23 bp, Homo sapiens
aattgatttttctcttcattttt

SEQ ID NO: 1515967 - DNA, 20 bp, Homo sapiens
aattgcaaaaacatagaaat

SEQ ID NO: 1515968 - DNA, 18 bp, Homo sapiens
aattgcaatatataagac

SEQ ID NO: 1515969 - DNA, 14 bp, Homo sapiens
aattgcacttttaa

SEQ ID NO: 1515970 - DNA, 22 bp, Homo sapiens
aattgcatactttgtattttga

SEQ ID NO: 1515971 - DNA, 13 bp, Homo sapiens
aattgccccatcc

SEQ ID NO: 1515972 - DNA, 17 bp, Homo sapiens
aattgccctatgctgtg

SEQ ID NO: 1515973 - DNA, 20 bp, Homo sapiens
aattgcctacaataaaaaga

SEQ ID NO: 1515974 - DNA, 13 bp, Homo sapiens
aattgcctttgag

SEQ ID NO: 1515975 - DNA, 15 bp, Homo sapiens
aattgctatgtgaaa

SEQ ID NO: 1515976 - DNA, 12 bp, Homo sapiens
aattgctgtgcc

SEQ ID NO: 1515977 - DNA, 13 bp, Homo sapiens
aattgctgtgcct

SEQ ID NO: 1515978 - DNA, 15 bp, Homo sapiens
aattgcttacatttt

SEQ ID NO: 1515979 - DNA, 21 bp, Homo sapiens
aattgcttacatttttacaat

SEQ ID NO: 1515980 - DNA, 19 bp, Homo sapiens
aattgcttactcattaaaa

SEQ ID NO: 1515981 - DNA, 23 bp, Homo sapiens
aattgcttggttgtaattaaatt

SEQ ID NO: 1515982 - DNA, 17 bp, Homo sapiens
aattgctttaaatctta

SEQ ID NO: 1515983 - DNA, 14 bp, Homo sapiens
aattgctttgccaa

SEQ ID NO: 1515984 - DNA, 23 bp, Homo sapiens
aattgctttgccaaaataccaga

SEQ ID NO: 1515985 - DNA, 16 bp, Homo sapiens
aattgcttttgttgtg

SEQ ID NO: 1515986 - DNA, 23 bp, Homo sapiens
aattggacagattgcctgtttct

SEQ ID NO: 1515987 - DNA, 16 bp, Homo sapiens
aattggattattttct

SEQ ID NO: 1515988 - DNA, 15 bp, Homo sapiens
aattggatttcctaa

SEQ ID NO: 1515989 - DNA, 15 bp, Homo sapiens
aattggccatcttaa

SEQ ID NO: 1515990 - DNA, 17 bp, Homo sapiens
aattgggtgaagagctt

SEQ ID NO: 1515991 - DNA, 23 bp, Homo sapiens
aattggtacttttaaaaacataa

SEQ ID NO: 1515992 - DNA, 19 bp, Homo sapiens
aattggtttttactgaaac

SEQ ID NO: 1515993 - DNA, 10 bp, Homo sapiens
aattgtaagt

SEQ ID NO: 1515994 - DNA, 12 bp, Homo sapiens
aattgtacaata

SEQ ID NO: 1515995 - DNA, 14 bp, Homo sapiens
aattgtactcaatg

SEQ ID NO: 1515996 - DNA, 18 bp, Homo sapiens
aattgtaggggtgtgtgt

SEQ ID NO: 1515997 - DNA, 17 bp, Homo sapiens
aattgtagttctgtgta

SEQ ID NO: 1515998 - DNA, 23 bp, Homo sapiens
aattgtagttctgtgtacttttt

SEQ ID NO: 1515999 - DNA, 10 bp, Homo sapiens
aattgtataa

SEQ ID NO: 1516000 - DNA, 19 bp, Homo sapiens
aattgtataagtcaagcac

SEQ ID NO: 1516001 - DNA, 14 bp, Homo sapiens
aattgtatacattt

SEQ ID NO: 1516002 - DNA, 14 bp, Homo sapiens
aattgtatattgta

SEQ ID NO: 1516003 - DNA, 24 bp, Homo sapiens
aattgtatcatttgaacaactagg

SEQ ID NO: 1516004 - DNA, 19 bp, Homo sapiens
aattgtattgaaaacactt

SEQ ID NO: 1516005 - DNA, 23 bp, Homo sapiens
aattgtcgaaaagagtcttccaa

SEQ ID NO: 1516006 - DNA, 12 bp, Homo sapiens
aattgtctattt

SEQ ID NO: 1516007 - DNA, 13 bp, Homo sapiens
aattgtctattta

SEQ ID NO: 1516008 - DNA, 21 bp, Homo sapiens
aattgtctatttatcttttat

SEQ ID NO: 1516009 - DNA, 20 bp, Homo sapiens
aattgtctcaacgcctcccc

SEQ ID NO: 1516010 - DNA, 19 bp, Homo sapiens
aattgtcttttttttcctt

SEQ ID NO: 1516011 - DNA, 21 bp, Homo sapiens
aattgtgaccaatacatttgt

SEQ ID NO: 1516012 - DNA, 15 bp, Homo sapiens
aattgtgatgtgtcc

SEQ ID NO: 1516013 - DNA, 20 bp, Homo sapiens
aattgtgattagacagaaca

SEQ ID NO: 1516014 - DNA, 21 bp, Homo sapiens
aattgtgattagacagaacac

SEQ ID NO: 1516015 - DNA, 19 bp, Homo sapiens
aattgtgctgccatttgat

SEQ ID NO: 1516016 - DNA, 18 bp, Homo sapiens
aattgtgctttcaccaga

SEQ ID NO: 1516017 - DNA, 22 bp, Homo sapiens
aattgtgctttcaccagaattt

SEQ ID NO: 1516018 - DNA, 15 bp, Homo sapiens
aattgtggattaatg

SEQ ID NO: 1516019 - DNA, 15 bp, Homo sapiens
aattgtgtaaaaaat

SEQ ID NO: 1516020 - DNA, 13 bp, Homo sapiens
aattgtgtacctt

SEQ ID NO: 1516021 - DNA, 21 bp, Homo sapiens
aattgtgtagcctttttgtat

SEQ ID NO: 1516022 - DNA, 23 bp, Homo sapiens
aattgtgtagtaatgttttttag

SEQ ID NO: 1516023 - DNA, 18 bp, Homo sapiens
aattgtgtattgatgcaa

SEQ ID NO: 1516024 - DNA, 17 bp, Homo sapiens
aattgttacaatagaat

SEQ ID NO: 1516025 - DNA, 13 bp, Homo sapiens
aattgttgacagt

SEQ ID NO: 1516026 - DNA, 18 bp, Homo sapiens
aattgttgacagttctga

SEQ ID NO: 1516027 - DNA, 20 bp, Homo sapiens
aattgttgtccggtttactt

SEQ ID NO: 1516028 - DNA, 20 bp, Homo sapiens
aattgtttaagtgttgtaaa

SEQ ID NO: 1516029 - DNA, 14 bp, Homo sapiens
aattgtttagaaat

SEQ ID NO: 1516030 - DNA, 22 bp, Homo sapiens
aattgtttagattttgtgttta

SEQ ID NO: 1516031 - DNA, 16 bp, Homo sapiens
aattgtttccaacttg

SEQ ID NO: 1516032 - DNA, 11 bp, Homo sapiens
aattgtttctt

SEQ ID NO: 1516033 - DNA, 20 bp, Homo sapiens
aattgtttggcttcctcctg

SEQ ID NO: 1516034 - DNA, 15 bp, Homo sapiens
aattgtttgtcctca

SEQ ID NO: 1516035 - DNA, 13 bp, Homo sapiens
aattgttttcact

SEQ ID NO: 1516036 - DNA, 17 bp, Homo sapiens
aattgttttcacttgta

SEQ ID NO: 1516037 - DNA, 19 bp, Homo sapiens
aattgttttcacttgtatt

SEQ ID NO: 1516038 - DNA, 17 bp, Homo sapiens
aattgttttgcactttt

SEQ ID NO: 1516039 - DNA, 12 bp, Homo sapiens
aattgttttgct

SEQ ID NO: 1516040 - DNA, 16 bp, Homo sapiens
aattgttttggaataa

SEQ ID NO: 1516041 - DNA, 21 bp, Homo sapiens
aattgtttttgaatttaaata

SEQ ID NO: 1516042 - DNA, 17 bp, Homo sapiens
aattgttttttaaagca

SEQ ID NO: 1516043 - DNA, 14 bp, Homo sapiens
aatttaaaaaataa

SEQ ID NO: 1516044 - DNA, 18 bp, Homo sapiens
aatttaaaactgttattt

SEQ ID NO: 1516045 - DNA, 12 bp, Homo sapiens
aatttaaaatta

SEQ ID NO: 1516046 - DNA, 18 bp, Homo sapiens
aatttaaaattaagtaga

SEQ ID NO: 1516047 - DNA, 9 bp, Homo sapiens
aatttaaac

SEQ ID NO: 1516048 - DNA, 15 bp, Homo sapiens
aatttaaacacctcc

SEQ ID NO: 1516049 - DNA, 21 bp, Homo sapiens
ccgagaggtgggccagtctgt

SEQ ID NO: 1516050 - DNA, 18 bp, Homo sapiens
ccgagatccccagggcag

SEQ ID NO: 1516051 - DNA, 20 bp, Homo sapiens
ccgagatgtgacccaccagt

SEQ ID NO: 1516052 - DNA, 22 bp, Homo sapiens
ccgagatgtgacccaccagtgc

SEQ ID NO: 1516053 - DNA, 16 bp, Homo sapiens
ccgagattgcgccact

SEQ ID NO: 1516054 - DNA, 12 bp, Homo sapiens
ccgagccagctt

SEQ ID NO: 1516055 - DNA, 16 bp, Homo sapiens
ccgagcccagctacat

SEQ ID NO: 1516056 - DNA, 14 bp, Homo sapiens
ccgagccctggaga

SEQ ID NO: 1516057 - DNA, 14 bp, Homo sapiens
ccgagcctaatgaa

SEQ ID NO: 1516058 - DNA, 16 bp, Homo sapiens
ccgagctcctcttcca

SEQ ID NO: 1516059 - DNA, 21 bp, Homo sapiens
ccgagctcgtgtatcctgggg

SEQ ID NO: 1516060 - DNA, 19 bp, Homo sapiens
ccgaggaactcgcctcagc

SEQ ID NO: 1516061 - DNA, 23 bp, Homo sapiens
ccgaggagctgggcccctgcaca

SEQ ID NO: 1516062 - DNA, 15 bp, Homo sapiens
ccgaggcccagcggg

SEQ ID NO: 1516063 - DNA, 11 bp, Homo sapiens
ccgaggcctgg

SEQ ID NO: 1516064 - DNA, 12 bp, Homo sapiens
ccgaggcctggc

SEQ ID NO: 1516065 - DNA, 15 bp, Homo sapiens
ccgaggcctggccaa

SEQ ID NO: 1516066 - DNA, 20 bp, Homo sapiens
ccgaggcgggtggatcacga

SEQ ID NO: 1516067 - DNA, 12 bp, Homo sapiens
ccgaggctgaga

SEQ ID NO: 1516068 - DNA, 14 bp, Homo sapiens
ccgaggctgcccca

SEQ ID NO: 1516069 - DNA, 21 bp, Homo sapiens
ccgaggctgccccaggccgga

SEQ ID NO: 1516070 - DNA, 19 bp, Homo sapiens
ccgaggggagagagggact

SEQ ID NO: 1516071 - DNA, 20 bp, Homo sapiens
ccgaggggagagagggactc

SEQ ID NO: 1516072 - DNA, 14 bp, Homo sapiens
ccgaggggcctttg

SEQ ID NO: 1516073 - DNA, 21 bp, Homo sapiens
ccgaggggtggaatgccgctg

SEQ ID NO: 1516074 - DNA, 23 bp, Homo sapiens
ccgagggtcctggctcctgaggg

SEQ ID NO: 1516075 - DNA, 13 bp, Homo sapiens
ccgaggtgggcag

SEQ ID NO: 1516076 - DNA, 20 bp, Homo sapiens
ccgagtagctgggactacag

SEQ ID NO: 1516077 - DNA, 21 bp, Homo sapiens
ccgagtctccgggactgccct

SEQ ID NO: 1516078 - DNA, 16 bp, Homo sapiens
aatttataaaaaggtg

SEQ ID NO: 1516079 - DNA, 23 bp, Homo sapiens
aatttataacgtgttcaatattt

SEQ ID NO: 1516080 - DNA, 15 bp, Homo sapiens
aatttatacaatatc

SEQ ID NO: 1516081 - DNA, 17 bp, Homo sapiens
aatttatacaatatcat

SEQ ID NO: 1516082 - DNA, 22 bp, Homo sapiens
aatttatattccatttacataa

SEQ ID NO: 1516083 - DNA, 19 bp, Homo sapiens
aatttatcctgaaatttca

SEQ ID NO: 1516084 - DNA, 18 bp, Homo sapiens
aatttatcttgtctctgg

SEQ ID NO: 1516085 - DNA, 15 bp, Homo sapiens
aatttatctttacca

SEQ ID NO: 1516086 - DNA, 19 bp, Homo sapiens
aatttatctttaccaaaaa

SEQ ID NO: 1516087 - DNA, 15 bp, Homo sapiens
aatttatctttgata

SEQ ID NO: 1516088 - DNA, 19 bp, Homo sapiens
aatttatgagtttttgata

SEQ ID NO: 1516089 - DNA, 20 bp, Homo sapiens
aatttatgagtttttgatag

SEQ ID NO: 1516090 - DNA, 15 bp, Homo sapiens
aatttatgcatttca

SEQ ID NO: 1516091 - DNA, 19 bp, Homo sapiens
aatttatgcatttcattca

SEQ ID NO: 1516092 - DNA, 21 bp, Homo sapiens
aatttatgcatttcattcaaa

SEQ ID NO: 1516093 - DNA, 22 bp, Homo sapiens
aatttatgccaagaacagaaaa

SEQ ID NO: 1516094 - DNA, 16 bp, Homo sapiens
aatttattcacatata

SEQ ID NO: 1516095 - DNA, 15 bp, Homo sapiens
aatttattgtctgtc

SEQ ID NO: 1516096 - DNA, 17 bp, Homo sapiens
aatttattgtctgtcta

SEQ ID NO: 1516097 - DNA, 20 bp, Homo sapiens
aatttatttatactatttag

SEQ ID NO: 1516098 - DNA, 17 bp, Homo sapiens
aatttatttatattccg

SEQ ID NO: 1516099 - DNA, 17 bp, Homo sapiens
aatttatttcttaacct

SEQ ID NO: 1516100 - DNA, 13 bp, Homo sapiens
aatttatttgttt

SEQ ID NO: 1516101 - DNA, 16 bp, Homo sapiens
aatttatttgtttccc

SEQ ID NO: 1516102 - DNA, 21 bp, Homo sapiens
aatttattttataagaaaaac

SEQ ID NO: 1516103 - DNA, 23 bp, Homo sapiens
aatttattttataagaaaaactt

SEQ ID NO: 1516104 - DNA, 16 bp, Homo sapiens
aatttcaaaaatataa

SEQ ID NO: 1516105 - DNA, 15 bp, Homo sapiens
aatttcaaaatacat

SEQ ID NO: 1516106 - DNA, 16 bp, Homo sapiens
aatttcaaaatacatt

SEQ ID NO: 1516107 - DNA, 22 bp, Homo sapiens
aatttcaaaatacatttgtaag

SEQ ID NO: 1516108 - DNA, 14 bp, Homo sapiens
aatttcaaggttct

SEQ ID NO: 1516109 - DNA, 17 bp, Homo sapiens
aatttcaaggttctaac

SEQ ID NO: 1516110 - DNA, 20 bp, Homo sapiens
aatttcacctgtaaacctga

SEQ ID NO: 1516111 - DNA, 23 bp, Homo sapiens
aatttcagactcccattcctgaa

SEQ ID NO: 1516112 - DNA, 21 bp, Homo sapiens
aatttcaggcattttgttcta

SEQ ID NO: 1516113 - DNA, 20 bp, Homo sapiens
aatttcaggttttgtaaaga

SEQ ID NO: 1516114 - DNA, 22 bp, Homo sapiens
aatttcaggttttgtaaagatg

SEQ ID NO: 1516115 - DNA, 22 bp, Homo sapiens
aatttcatacctatcatcttaa

SEQ ID NO: 1516116 - DNA, 21 bp, Homo sapiens
aatttcatactatttagattt

SEQ ID NO: 1516117 - DNA, 20 bp, Homo sapiens
aatttcatagctgtacttct

SEQ ID NO: 1516118 - DNA, 15 bp, Homo sapiens
aatttcatttaaata

SEQ ID NO: 1516119 - DNA, 20 bp, Homo sapiens
aatttcatttccagcatttt

SEQ ID NO: 1516120 - DNA, 22 bp, Homo sapiens
aatttcatttccagcattttta

SEQ ID NO: 1516121 - DNA, 18 bp, Homo sapiens
aatttccaggaaaaaata

SEQ ID NO: 1516122 - DNA, 20 bp, Homo sapiens
aatttccagtacctttgtca

SEQ ID NO: 1516123 - DNA, 14 bp, Homo sapiens
aatttcccaggacc

SEQ ID NO: 1516124 - DNA, 18 bp, Homo sapiens
aatttcctctccactgct

SEQ ID NO: 1516125 - DNA, 21 bp, Homo sapiens
aatttcctctccactgctgga

SEQ ID NO: 1516126 - DNA, 21 bp, Homo sapiens
aatttcctggccctccactcc

SEQ ID NO: 1516127 - DNA, 21 bp, Homo sapiens
aatttcctgttggatttgttt

SEQ ID NO: 1516128 - DNA, 16 bp, Homo sapiens
aatttccttcaggttt

SEQ ID NO: 1516129 - DNA, 14 bp, Homo sapiens
aatttcctttttga

SEQ ID NO: 1516130 - DNA, 20 bp, Homo sapiens
aatttcctttttgacactga

SEQ ID NO: 1516131 - DNA, 18 bp, Homo sapiens
aatttctaccatttcaga

SEQ ID NO: 1516132 - DNA, 19 bp, Homo sapiens
aatttctcccagtcattta

SEQ ID NO: 1516133 - DNA, 12 bp, Homo sapiens
aatttcttaact

SEQ ID NO: 1516134 - DNA, 15 bp, Homo sapiens
aatttcttaacttct

SEQ ID NO: 1516135 - DNA, 16 bp, Homo sapiens
aatttcttaacttctt

SEQ ID NO: 1516136 - DNA, 20 bp, Homo sapiens
aatttcttactaaacatttt

SEQ ID NO: 1516137 - DNA, 16 bp, Homo sapiens
aatttcttatgtgaca

SEQ ID NO: 1516138 - DNA, 18 bp, Homo sapiens
aatttcttatgtgacatt

SEQ ID NO: 1516139 - DNA, 20 bp, Homo sapiens
aatttcttatgtgacattaa

SEQ ID NO: 1516140 - DNA, 22 bp, Homo sapiens
aatttcttggcaaattttaaaa

SEQ ID NO: 1516141 - DNA, 19 bp, Homo sapiens
aatttctttgtcattcaag

SEQ ID NO: 1516142 - DNA, 20 bp, Homo sapiens
aatttctttgtttaacaaaa

SEQ ID NO: 1516143 - DNA, 14 bp, Homo sapiens
aatttgaagtaatg

SEQ ID NO: 1516144 - DNA, 22 bp, Homo sapiens
aatttgaattatcagcaaagaa

SEQ ID NO: 1516145 - DNA, 16 bp, Homo sapiens
aatttgacttttctgt

SEQ ID NO: 1516146 - DNA, 17 bp, Homo sapiens
aatttgacttttctgta

SEQ ID NO: 1516147 - DNA, 21 bp, Homo sapiens
aatttgagaatacataaacaa

SEQ ID NO: 1516148 - DNA, 20 bp, Homo sapiens
aatttgagagaaatatgaag

SEQ ID NO: 1516149 - DNA, 19 bp, Homo sapiens
aatttgataaacattcctg

SEQ ID NO: 1516150 - DNA, 15 bp, Homo sapiens
aatttgatacataat

SEQ ID NO: 1516151 - DNA, 17 bp, Homo sapiens
aatttgatacataataa

SEQ ID NO: 1516152 - DNA, 17 bp, Homo sapiens
aatttgatgaaagctga

SEQ ID NO: 1516153 - DNA, 12 bp, Homo sapiens
aatttgcacagt

SEQ ID NO: 1516154 - DNA, 15 bp, Homo sapiens
aatttgcagcttcca

SEQ ID NO: 1516155 - DNA, 23 bp, Homo sapiens
aatttgcgcctcggtatctggct

SEQ ID NO: 1516156 - DNA, 22 bp, Homo sapiens
aatttggaggctggagtaatca

SEQ ID NO: 1516157 - DNA, 12 bp, Homo sapiens
aatttggattta

SEQ ID NO: 1516158 - DNA, 14 bp, Homo sapiens
aatttggccttaag

SEQ ID NO: 1516159 - DNA, 19 bp, Homo sapiens
aatttggccttaagaactg

SEQ ID NO: 1516160 - DNA, 15 bp, Homo sapiens
aatttggctttcaca

SEQ ID NO: 1516161 - DNA, 18 bp, Homo sapiens
aatttgggggaaaattta

SEQ ID NO: 1516162 - DNA, 17 bp, Homo sapiens
aatttggttctaggccg

SEQ ID NO: 1516163 - DNA, 13 bp, Homo sapiens
ccgcccctgggga

SEQ ID NO: 1516164 - DNA, 21 bp, Homo sapiens
ccgcccctgtggccctggcca

SEQ ID NO: 1516165 - DNA, 22 bp, Homo sapiens
ccgcccgagggatggtgcccct

SEQ ID NO: 1516166 - DNA, 16 bp, Homo sapiens
ccgcccggcagcccct

SEQ ID NO: 1516167 - DNA, 12 bp, Homo sapiens
ccgccctgccac

SEQ ID NO: 1516168 - DNA, 13 bp, Homo sapiens
ccgccctgccact

SEQ ID NO: 1516169 - DNA, 17 bp, Homo sapiens
ccgccctttccttgcct

SEQ ID NO: 1516170 - DNA, 14 bp, Homo sapiens
ccgccgccgcgcgc

SEQ ID NO: 1516171 - DNA, 14 bp, Homo sapiens
ccgccgcctcccac

SEQ ID NO: 1516172 - DNA, 18 bp, Homo sapiens
ccgccgcctcccacggca

SEQ ID NO: 1516173 - DNA, 15 bp, Homo sapiens
ccgccgctgaccctg

SEQ ID NO: 1516174 - DNA, 17 bp, Homo sapiens
ccgccgtgccggcggca

SEQ ID NO: 1516175 - DNA, 18 bp, Homo sapiens
ccgcctcagcctcctgag

SEQ ID NO: 1516176 - DNA, 12 bp, Homo sapiens
ccgcctccagga

SEQ ID NO: 1516177 - DNA, 19 bp, Homo sapiens
ccgcctcgacctccccacc

SEQ ID NO: 1516178 - DNA, 23 bp, Homo sapiens
ccgcctcgacctccccacccgct

SEQ ID NO: 1516179 - DNA, 20 bp, Homo sapiens
ccgcctcgacctctctcaaa

SEQ ID NO: 1516180 - DNA, 20 bp, Homo sapiens
ccgcctcgtgccagcagcct

SEQ ID NO: 1516181 - DNA, 13 bp, Homo sapiens
ccgcctctcccgt

SEQ ID NO: 1516182 - DNA, 16 bp, Homo sapiens
ccgcctctggccgcca

SEQ ID NO: 1516183 - DNA, 17 bp, Homo sapiens
ccgcctctgtctggagc

SEQ ID NO: 1516184 - DNA, 22 bp, Homo sapiens
ccgcctgagtcagtgctctcag

SEQ ID NO: 1516185 - DNA, 15 bp, Homo sapiens
ccgcctgcctgccac

SEQ ID NO: 1516186 - DNA, 12 bp, Homo sapiens
ccgcctgctcct

SEQ ID NO: 1516187 - DNA, 18 bp, Homo sapiens
ccgcctgctcctcactgg

SEQ ID NO: 1516188 - DNA, 16 bp, Homo sapiens
ccgcctgctgggaaga

SEQ ID NO: 1516189 - DNA, 13 bp, Homo sapiens
ccgcctggcaggt

SEQ ID NO: 1516190 - DNA, 17 bp, Homo sapiens
ccgcctggccaggagca

SEQ ID NO: 1516191 - DNA, 20 bp, Homo sapiens
ccgcctggccaggagcaggc

SEQ ID NO: 1516192 - DNA, 21 bp, Homo sapiens
ccgcctggccaggagcaggca

SEQ ID NO: 1516193 - DNA, 18 bp, Homo sapiens
ccgcctggccggctccag

SEQ ID NO: 1516194 - DNA, 16 bp, Homo sapiens
ccgccttaagctgatc

SEQ ID NO: 1516195 - DNA, 14 bp, Homo sapiens
ccgccttcctcctc

SEQ ID NO: 1516196 - DNA, 20 bp, Homo sapiens
aattttatatcattggatga

SEQ ID NO: 1516197 - DNA, 12 bp, Homo sapiens
aattttatgaat

SEQ ID NO: 1516198 - DNA, 18 bp, Homo sapiens
aattttatgtcatagaaa

SEQ ID NO: 1516199 - DNA, 19 bp, Homo sapiens
aattttattttaaaatttc

SEQ ID NO: 1516200 - DNA, 22 bp, Homo sapiens
aattttattttaaaatttcata

SEQ ID NO: 1516201 - DNA, 23 bp, Homo sapiens
aattttattttgctgagttgttc

SEQ ID NO: 1516202 - DNA, 13 bp, Homo sapiens
aattttattttgt

SEQ ID NO: 1516203 - DNA, 17 bp, Homo sapiens
aattttccaagaacata

SEQ ID NO: 1516204 - DNA, 16 bp, Homo sapiens
aattttctaaaagctt

SEQ ID NO: 1516205 - DNA, 13 bp, Homo sapiens
aattttctctcca

SEQ ID NO: 1516206 - DNA, 12 bp, Homo sapiens
aattttctgcag

SEQ ID NO: 1516207 - DNA, 18 bp, Homo sapiens
aattttctgcagctgttt

SEQ ID NO: 1516208 - DNA, 20 bp, Homo sapiens
aattttctgcagctgtttca

SEQ ID NO: 1516209 - DNA, 12 bp, Homo sapiens
aattttctgtaa

SEQ ID NO: 1516210 - DNA, 16 bp, Homo sapiens
aattttctgtaatctt

SEQ ID NO: 1516211 - DNA, 13 bp, Homo sapiens
aattttcttcatg

SEQ ID NO: 1516212 - DNA, 19 bp, Homo sapiens
aattttcttcatgcaatga

SEQ ID NO: 1516213 - DNA, 22 bp, Homo sapiens
aattttcttcatgcaatgacat

SEQ ID NO: 1516214 - DNA, 14 bp, Homo sapiens
aattttctttgttt

SEQ ID NO: 1516215 - DNA, 18 bp, Homo sapiens
aattttgaaaactctaat

SEQ ID NO: 1516216 - DNA, 14 bp, Homo sapiens
aattttgaagtgct

SEQ ID NO: 1516217 - DNA, 19 bp, Homo sapiens
aattttgaagtgctgttta

SEQ ID NO: 1516218 - DNA, 19 bp, Homo sapiens
aattttgacactatatctg

SEQ ID NO: 1516219 - DNA, 17 bp, Homo sapiens
aattttgacttaatgtg

SEQ ID NO: 1516220 - DNA, 17 bp, Homo sapiens
aattttgagtattccat

SEQ ID NO: 1516221 - DNA, 11 bp, Homo sapiens
aattttgatat

SEQ ID NO: 1516222 - DNA, 13 bp, Homo sapiens
aattttgatatac

SEQ ID NO: 1516223 - DNA, 14 bp, Homo sapiens
aattttgcaaatta

SEQ ID NO: 1516224 - DNA, 17 bp, Homo sapiens
aattttgcctttaacag

SEQ ID NO: 1516225 - DNA, 15 bp, Homo sapiens
aattttgctaactgg

SEQ ID NO: 1516226 - DNA, 23 bp, Homo sapiens
aattttgctaactgggttaaata

SEQ ID NO: 1516227 - DNA, 23 bp, Homo sapiens
aattttgggtattgtaatctgaa

SEQ ID NO: 1516228 - DNA, 15 bp, Homo sapiens
aattttgtaaaacaa

SEQ ID NO: 1516229 - DNA, 12 bp, Homo sapiens
aattttgtaaga

SEQ ID NO: 1516230 - DNA, 13 bp, Homo sapiens
aattttgtaagaa

SEQ ID NO: 1516231 - DNA, 14 bp, Homo sapiens
aattttgtacaaat

SEQ ID NO: 1516232 - DNA, 12 bp, Homo sapiens
aattttgtctta

SEQ ID NO: 1516233 - DNA, 17 bp, Homo sapiens
aattttgtgcattcttt

SEQ ID NO: 1516234 - DNA, 18 bp, Homo sapiens
aattttgttctctgggag

SEQ ID NO: 1516235 - DNA, 21 bp, Homo sapiens
aattttgttctctgggagaaa

SEQ ID NO: 1516236 - DNA, 22 bp, Homo sapiens
aattttgtttcagaattttgta

SEQ ID NO: 1516237 - DNA, 21 bp, Homo sapiens
aattttgtttttattttcaag

SEQ ID NO: 1516238 - DNA, 22 bp, Homo sapiens
aattttgtttttattttcaaga

SEQ ID NO: 1516239 - DNA, 19 bp, Homo sapiens
aatttttaaagtatatatt

SEQ ID NO: 1516240 - DNA, 17 bp, Homo sapiens
aatttttaagctgcaaa

SEQ ID NO: 1516241 - DNA, 20 bp, Homo sapiens
aatttttacattcatcaata

SEQ ID NO: 1516242 - DNA, 18 bp, Homo sapiens
aatttttaccacttctgt

SEQ ID NO: 1516243 - DNA, 22 bp, Homo sapiens
aatttttaccacttctgtttag

SEQ ID NO: 1516244 - DNA, 19 bp, Homo sapiens
aatttttataaattactat

SEQ ID NO: 1516245 - DNA, 19 bp, Homo sapiens
aatttttatttatttttct

SEQ ID NO: 1516246 - DNA, 21 bp, Homo sapiens
aatttttatttctttttaatt

SEQ ID NO: 1516247 - DNA, 16 bp, Homo sapiens
aatttttatttttcta

SEQ ID NO: 1516248 - DNA, 15 bp, Homo sapiens
aatttttatttttga

SEQ ID NO: 1516249 - DNA, 15 bp, Homo sapiens
aatttttcagatgct

SEQ ID NO: 1516250 - DNA, 19 bp, Homo sapiens
aatttttcagatgcttctg

SEQ ID NO: 1516251 - DNA, 19 bp, Homo sapiens
aatttttgagttacaattt

SEQ ID NO: 1516252 - DNA, 20 bp, Homo sapiens
aatttttgccttcattacct

SEQ ID NO: 1516253 - DNA, 15 bp, Homo sapiens
aatttttggagaaat

SEQ ID NO: 1516254 - DNA, 16 bp, Homo sapiens
aatttttgtacattac

SEQ ID NO: 1516255 - DNA, 12 bp, Homo sapiens
aatttttgtatt

SEQ ID NO: 1516256 - DNA, 20 bp, Homo sapiens
aattttttggcacttgccat

SEQ ID NO: 1516257 - DNA, 18 bp, Homo sapiens
aatttttttatgttttgt

SEQ ID NO: 1516258 - DNA, 15 bp, Homo sapiens
aatttttttcaatat

SEQ ID NO: 1516259 - DNA, 21 bp, Homo sapiens
aatttttttcatcttctctgg

SEQ ID NO: 1516260 - DNA, 15 bp, Homo sapiens
aattttttttaatgt

SEQ ID NO: 1516261 - DNA, 17 bp, Homo sapiens
aattttttttaatgtac

SEQ ID NO: 1516262 - DNA, 19 bp, Homo sapiens
aattttttttaatgtacaa

SEQ ID NO: 1516263 - DNA, 20 bp, Homo sapiens
aattttttttaatgtacaag

SEQ ID NO: 1516264 - DNA, 23 bp, Homo sapiens
aattttttttgttttttgtaact

SEQ ID NO: 1516265 - DNA, 20 bp, Homo sapiens
aatttttttttcatagagat

SEQ ID NO: 1516266 - DNA, 22 bp, Homo sapiens
aattttttttttaaacaatgaa

SEQ ID NO: 1516267 - DNA, 16 bp, Homo sapiens
acaaaaaaccaggatg

SEQ ID NO: 1516268 - DNA, 13 bp, Homo sapiens
acaaaaacacagc

SEQ ID NO: 1516269 - DNA, 14 bp, Homo sapiens
acaaaaacacagca

SEQ ID NO: 1516270 - DNA, 15 bp, Homo sapiens
acaaaaacacagcaa

SEQ ID NO: 1516271 - DNA, 19 bp, Homo sapiens
acaaaaacagaatttgaga

SEQ ID NO: 1516272 - DNA, 15 bp, Homo sapiens
acaaaaacagcctca

SEQ ID NO: 1516273 - DNA, 21 bp, Homo sapiens
acaaaaacagcctcacagaag

SEQ ID NO: 1516274 - DNA, 13 bp, Homo sapiens
acaaaaacaggta

SEQ ID NO: 1516275 - DNA, 15 bp, Homo sapiens
acaaaaaccagcagg

SEQ ID NO: 1516276 - DNA, 12 bp, Homo sapiens
acaaaaaccttg

SEQ ID NO: 1516277 - DNA, 13 bp, Homo sapiens
acaaaaagagctt

SEQ ID NO: 1516278 - DNA, 14 bp, Homo sapiens
ccggccacagctgc

SEQ ID NO: 1516279 - DNA, 15 bp, Homo sapiens
ccggccacagctgct

SEQ ID NO: 1516280 - DNA, 15 bp, Homo sapiens
ccggccagcgggcac

SEQ ID NO: 1516281 - DNA, 17 bp, Homo sapiens
ccggccagcgggcacag

SEQ ID NO: 1516282 - DNA, 22 bp, Homo sapiens
ccggccagcgggcacagggcac

SEQ ID NO: 1516283 - DNA, 11 bp, Homo sapiens
ccggccagctc

SEQ ID NO: 1516284 - DNA, 14 bp, Homo sapiens
ccggccccagccag

SEQ ID NO: 1516285 - DNA, 17 bp, Homo sapiens
ccggcccctccccctga

SEQ ID NO: 1516286 - DNA, 14 bp, Homo sapiens
ccggccctggcttg

SEQ ID NO: 1516287 - DNA, 15 bp, Homo sapiens
ccggccctgtgtgca

SEQ ID NO: 1516288 - DNA, 17 bp, Homo sapiens
ccggccctgtgtgcagg

SEQ ID NO: 1516289 - DNA, 14 bp, Homo sapiens
ccggccgcgccgcc

SEQ ID NO: 1516290 - DNA, 20 bp, Homo sapiens
ccggccggccctggcttgga

SEQ ID NO: 1516291 - DNA, 14 bp, Homo sapiens
ccggccggcctggc

SEQ ID NO: 1516292 - DNA, 15 bp, Homo sapiens
ccggccggcctggca

SEQ ID NO: 1516293 - DNA, 18 bp, Homo sapiens
ccggcctaggcacctccc

SEQ ID NO: 1516294 - DNA, 16 bp, Homo sapiens
ccggcctcagggcgct

SEQ ID NO: 1516295 - DNA, 11 bp, Homo sapiens
ccggcctcctc

SEQ ID NO: 1516296 - DNA, 22 bp, Homo sapiens
ccggcctcctcggagagcagca

SEQ ID NO: 1516297 - DNA, 16 bp, Homo sapiens
ccggcctgctcccagc

SEQ ID NO: 1516298 - DNA, 20 bp, Homo sapiens
ccggcctgtgggtctctgaa

SEQ ID NO: 1516299 - DNA, 20 bp, Homo sapiens
ccggcggcagccccacttca

SEQ ID NO: 1516300 - DNA, 16 bp, Homo sapiens
ccggcggccctgctga

SEQ ID NO: 1516301 - DNA, 19 bp, Homo sapiens
ccggcgggatgttgaactg

SEQ ID NO: 1516302 - DNA, 16 bp, Homo sapiens
ccggcgggcgggccgg

SEQ ID NO: 1516303 - DNA, 22 bp, Homo sapiens
ccggcgggtgacagctccggga

SEQ ID NO: 1516304 - DNA, 14 bp, Homo sapiens
ccggcgggtgctct

SEQ ID NO: 1516305 - DNA, 15 bp, Homo sapiens
ccggctccagtttcc

SEQ ID NO: 1516306 - DNA, 22 bp, Homo sapiens
ccggctcgtgtatttattaccg

SEQ ID NO: 1516307 - DNA, 14 bp, Homo sapiens
ccggctgagccccc

SEQ ID NO: 1516308 - DNA, 16 bp, Homo sapiens
ccggctgagcccccca

SEQ ID NO: 1516309 - DNA, 15 bp, Homo sapiens
ccggctgagtggcag

SEQ ID NO: 1516310 - DNA, 19 bp, Homo sapiens
ccggctgagtggcagcagc

SEQ ID NO: 1516311 - DNA, 15 bp, Homo sapiens
ccggctgcagaggcc

SEQ ID NO: 1516312 - DNA, 12 bp, Homo sapiens
ccggctgggcct

SEQ ID NO: 1516313 - DNA, 11 bp, Homo sapiens
ccggctggtga

SEQ ID NO: 1516314 - DNA, 17 bp, Homo sapiens
ccggctgtgattgctgc

SEQ ID NO: 1516315 - DNA, 19 bp, Homo sapiens
ccggctgtgattgctgcca

SEQ ID NO: 1516316 - DNA, 20 bp, Homo sapiens
acaaacactgccatattgtg

SEQ ID NO: 1516317 - DNA, 12 bp, Homo sapiens
acaaacatgaaa

SEQ ID NO: 1516318 - DNA, 23 bp, Homo sapiens
acaaaccaagagcttttacagat

SEQ ID NO: 1516319 - DNA, 20 bp, Homo sapiens
acaaaccacaactgacacag

SEQ ID NO: 1516320 - DNA, 23 bp, Homo sapiens
acaaaccacaactgacacaggaa

SEQ ID NO: 1516321 - DNA, 21 bp, Homo sapiens
acaaaccgagtgcaatgaatg

SEQ ID NO: 1516322 - DNA, 22 bp, Homo sapiens
acaaactcttttttaaaaatta

SEQ ID NO: 1516323 - DNA, 13 bp, Homo sapiens
acaaactgcaata

SEQ ID NO: 1516324 - DNA, 14 bp, Homo sapiens
acaaactgcaatag

SEQ ID NO: 1516325 - DNA, 20 bp, Homo sapiens
acaaactgtgaaaatagtgt

SEQ ID NO: 1516326 - DNA, 20 bp, Homo sapiens
acaaagaaacaaagatgtta

SEQ ID NO: 1516327 - DNA, 18 bp, Homo sapiens
acaaagacaaattctgtt

SEQ ID NO: 1516328 - DNA, 19 bp, Homo sapiens
acaaagacaaattctgttt

SEQ ID NO: 1516329 - DNA, 17 bp, Homo sapiens
acaaagactccttgtgg

SEQ ID NO: 1516330 - DNA, 12 bp, Homo sapiens
acaaagatttct

SEQ ID NO: 1516331 - DNA, 22 bp, Homo sapiens
acaaagcagctttaaaaaaata

SEQ ID NO: 1516332 - DNA, 13 bp, Homo sapiens
acaaagccctgtc

SEQ ID NO: 1516333 - DNA, 14 bp, Homo sapiens
acaaagccctgtcc

SEQ ID NO: 1516334 - DNA, 13 bp, Homo sapiens
acaaagctcaaga

SEQ ID NO: 1516335 - DNA, 18 bp, Homo sapiens
acaaagctcaagatgaca

SEQ ID NO: 1516336 - DNA, 22 bp, Homo sapiens
acaaagcttctatcccaggagg

SEQ ID NO: 1516337 - DNA, 15 bp, Homo sapiens
acaaagctttgctac

SEQ ID NO: 1516338 - DNA, 11 bp, Homo sapiens
acaaaggatga

SEQ ID NO: 1516339 - DNA, 22 bp, Homo sapiens
acaaaggtgaaaattgtttgta

SEQ ID NO: 1516340 - DNA, 19 bp, Homo sapiens
acaaaggtggaataaacat

SEQ ID NO: 1516341 - DNA, 15 bp, Homo sapiens
acaaaggtggtaaat

SEQ ID NO: 1516342 - DNA, 20 bp, Homo sapiens
acaaaggtggtaaattcaga

SEQ ID NO: 1516343 - DNA, 18 bp, Homo sapiens
acaaagtactctttaaca

SEQ ID NO: 1516344 - DNA, 14 bp, Homo sapiens
acaaagtgctggga

SEQ ID NO: 1516345 - DNA, 22 bp, Homo sapiens
acaaagtgtgtaattatgtaaa

SEQ ID NO: 1516346 - DNA, 19 bp, Homo sapiens
acaaagttccaaaatgcca

SEQ ID NO: 1516347 - DNA, 18 bp, Homo sapiens
acaaagtttcagagtata

SEQ ID NO: 1516348 - DNA, 14 bp, Homo sapiens
acaaataaacctga

SEQ ID NO: 1516349 - DNA, 18 bp, Homo sapiens
acaaataaacctgaggca

SEQ ID NO: 1516350 - DNA, 16 bp, Homo sapiens
acaaataataagcaaa

SEQ ID NO: 1516351 - DNA, 22 bp, Homo sapiens
acaaatacctccattaaatggt

SEQ ID NO: 1516352 - DNA, 15 bp, Homo sapiens
acaaatactcttagg

SEQ ID NO: 1516353 - DNA, 19 bp, Homo sapiens
acaaatattcactggcccc

SEQ ID NO: 1516354 - DNA, 12 bp, Homo sapiens
acaaatatttat

SEQ ID NO: 1516355 - DNA, 22 bp, Homo sapiens
acaaatatttattttctttctg

SEQ ID NO: 1516356 - DNA, 14 bp, Homo sapiens
acaaatcagaagtc

SEQ ID NO: 1516357 - DNA, 15 bp, Homo sapiens
acaaatcagaagtca

SEQ ID NO: 1516358 - DNA, 23 bp, Homo sapiens
acaaatcagaagtcatcttgcta

SEQ ID NO: 1516359 - DNA, 15 bp, Homo sapiens
acaaatcataatgta

SEQ ID NO: 1516360 - DNA, 17 bp, Homo sapiens
acaaatctaatctctta

SEQ ID NO: 1516361 - DNA, 15 bp, Homo sapiens
acaaatctttccata

SEQ ID NO: 1516362 - DNA, 21 bp, Homo sapiens
acaaatgaagaaagtcaaaaa

SEQ ID NO: 1516363 - DNA, 13 bp, Homo sapiens
acaaatgatttcc

SEQ ID NO: 1516364 - DNA, 17 bp, Homo sapiens
acaaatgcataaatgca

SEQ ID NO: 1516365 - DNA, 15 bp, Homo sapiens
acaaatggacatagg

SEQ ID NO: 1516366 - DNA, 20 bp, Homo sapiens
acaaatgggactgatgtcat

SEQ ID NO: 1516367 - DNA, 21 bp, Homo sapiens
acaaatgggactgatgtcatc

SEQ ID NO: 1516368 - DNA, 15 bp, Homo sapiens
acaaatgtcattgtc

SEQ ID NO: 1516369 - DNA, 16 bp, Homo sapiens
acaaatgtgtttttct

SEQ ID NO: 1516370 - DNA, 21 bp, Homo sapiens
acaaatgtgtttttctatata

SEQ ID NO: 1516371 - DNA, 22 bp, Homo sapiens
acaaatgtgtttttctatatag

SEQ ID NO: 1516372 - DNA, 18 bp, Homo sapiens
acaaattaatgaagcttt

SEQ ID NO: 1516373 - DNA, 14 bp, Homo sapiens
acaaattagaggag

SEQ ID NO: 1516374 - DNA, 16 bp, Homo sapiens
acaaattataatgtat

SEQ ID NO: 1516375 - DNA, 13 bp, Homo sapiens
acaaattctttag

SEQ ID NO: 1516376 - DNA, 23 bp, Homo sapiens
acaaattctttagtactcaatgt

SEQ ID NO: 1516377 - DNA, 19 bp, Homo sapiens
acaaatttatgcatttcat

SEQ ID NO: 1516378 - DNA, 21 bp, Homo sapiens
acaaatttggccttaagaact

SEQ ID NO: 1516379 - DNA, 22 bp, Homo sapiens
acaaatttggccttaagaactg

SEQ ID NO: 1516380 - DNA, 18 bp, Homo sapiens
acaaatttttatttctaa

SEQ ID NO: 1516381 - DNA, 14 bp, Homo sapiens
acaaatttttctgt

SEQ ID NO: 1516382 - DNA, 13 bp, Homo sapiens
acaacaaaaggac

SEQ ID NO: 1516383 - DNA, 23 bp, Homo sapiens
acaacaaagacatgctttccatt

SEQ ID NO: 1516384 - DNA, 14 bp, Homo sapiens
acaacaataataaa

SEQ ID NO: 1516385 - DNA, 14 bp, Homo sapiens
acaacacaaagaga

SEQ ID NO: 1516386 - DNA, 19 bp, Homo sapiens
acaacaccaaaaaatatct

SEQ ID NO: 1516387 - DNA, 12 bp, Homo sapiens
acaacaccagga

SEQ ID NO: 1516388 - DNA, 15 bp, Homo sapiens
acaacaccaggactt

SEQ ID NO: 1516389 - DNA, 13 bp, Homo sapiens
acaacagaaaaac

SEQ ID NO: 1516390 - DNA, 15 bp, Homo sapiens
acaacagaaaaacaa

SEQ ID NO: 1516391 - DNA, 14 bp, Homo sapiens
acaacagcagatgg

SEQ ID NO: 1516392 - DNA, 16 bp, Homo sapiens
acaacagcagtctcct

SEQ ID NO: 1516393 - DNA, 13 bp, Homo sapiens
ccgtaatttaact

SEQ ID NO: 1516394 - DNA, 12 bp, Homo sapiens
ccgtaccccacc

SEQ ID NO: 1516395 - DNA, 14 bp, Homo sapiens
ccgtaggcagcctc

SEQ ID NO: 1516396 - DNA, 15 bp, Homo sapiens
ccgtagttccctgaa

SEQ ID NO: 1516397 - DNA, 15 bp, Homo sapiens
ccgtatcacagtgtt

SEQ ID NO: 1516398 - DNA, 18 bp, Homo sapiens
ccgtatcacagtgttttt

SEQ ID NO: 1516399 - DNA, 12 bp, Homo sapiens
ccgtatccagag

SEQ ID NO: 1516400 - DNA, 16 bp, Homo sapiens
ccgtcagggcccaagt

SEQ ID NO: 1516401 - DNA, 12 bp, Homo sapiens
ccgtccacccag

SEQ ID NO: 1516402 - DNA, 15 bp, Homo sapiens
ccgtccacccaggct

SEQ ID NO: 1516403 - DNA, 19 bp, Homo sapiens
ccgtccacccaggctgcac

SEQ ID NO: 1516404 - DNA, 21 bp, Homo sapiens
ccgtccacccaggctgcactg

SEQ ID NO: 1516405 - DNA, 15 bp, Homo sapiens
ccgtccaggggagat

SEQ ID NO: 1516406 - DNA, 14 bp, Homo sapiens
ccgtccatggcacc

SEQ ID NO: 1516407 - DNA, 18 bp, Homo sapiens
ccgtcccatatcctgcct

SEQ ID NO: 1516408 - DNA, 16 bp, Homo sapiens
ccgtccctcccaggtc

SEQ ID NO: 1516409 - DNA, 15 bp, Homo sapiens
ccgtcggagctgcct

SEQ ID NO: 1516410 - DNA, 17 bp, Homo sapiens
ccgtcggagctgcctgc

SEQ ID NO: 1516411 - DNA, 19 bp, Homo sapiens
ccgtcggagctgcctgcag

SEQ ID NO: 1516412 - DNA, 16 bp, Homo sapiens
ccgtctgactccagag

SEQ ID NO: 1516413 - DNA, 19 bp, Homo sapiens
ccgtctggggttcagcccc

SEQ ID NO: 1516414 - DNA, 22 bp, Homo sapiens
ccgtctggggttcagcccctcc

SEQ ID NO: 1516415 - DNA, 23 bp, Homo sapiens
ccgtcttcaatctctgttctgct

SEQ ID NO: 1516416 - DNA, 17 bp, Homo sapiens
ccgtcttcacactgcgc

SEQ ID NO: 1516417 - DNA, 14 bp, Homo sapiens
ccgtcttcagccta

SEQ ID NO: 1516418 - DNA, 16 bp, Homo sapiens
ccgtgaagcagtgcct

SEQ ID NO: 1516419 - DNA, 14 bp, Homo sapiens
ccgtgaattgcttt

SEQ ID NO: 1516420 - DNA, 18 bp, Homo sapiens
ccgtgacagtggctgaca

SEQ ID NO: 1516421 - DNA, 22 bp, Homo sapiens
ccgtgagccaatccctcacctt

SEQ ID NO: 1516422 - DNA, 21 bp, Homo sapiens
ccgtgagcgccccgcccccac

SEQ ID NO: 1516423 - DNA, 17 bp, Homo sapiens
ccgtgaggctgctgcca

SEQ ID NO: 1516424 - DNA, 21 bp, Homo sapiens
ccgtgagtgacatagcctcat

SEQ ID NO: 1516425 - DNA, 23 bp, Homo sapiens
ccgtgatccatccatctccaggg

SEQ ID NO: 1516426 - DNA, 22 bp, Homo sapiens
ccgtgcacggttcaatggtaga

SEQ ID NO: 1516427 - DNA, 21 bp, Homo sapiens
ccgtgcccccgcctgccaccg

SEQ ID NO: 1516428 - DNA, 16 bp, Homo sapiens
ccgtgcccgcaggaac

SEQ ID NO: 1516429 - DNA, 17 bp, Homo sapiens
ccgtgcccgcaggaact

SEQ ID NO: 1516430 - DNA, 17 bp, Homo sapiens
ccgtgccgcctgcactc

SEQ ID NO: 1516431 - DNA, 14 bp, Homo sapiens
ccgtgcctccacca

SEQ ID NO: 1516432 - DNA, 22 bp, Homo sapiens
ccgtgcctccaccaccactggc

SEQ ID NO: 1516433 - DNA, 16 bp, Homo sapiens
ccgtgccttcagctct

SEQ ID NO: 1516434 - DNA, 17 bp, Homo sapiens
ccgtgccttcagctcta

SEQ ID NO: 1516435 - DNA, 17 bp, Homo sapiens
acaagaccgccccaggg

SEQ ID NO: 1516436 - DNA, 14 bp, Homo sapiens
acaagactgccagg

SEQ ID NO: 1516437 - DNA, 18 bp, Homo sapiens
acaagagatctacacatg

SEQ ID NO: 1516438 - DNA, 12 bp, Homo sapiens
acaagagcaaaa

SEQ ID NO: 1516439 - DNA, 15 bp, Homo sapiens
acaagagcagcctgt

SEQ ID NO: 1516440 - DNA, 16 bp, Homo sapiens
acaagagcagcctgtg

SEQ ID NO: 1516441 - DNA, 20 bp, Homo sapiens
acaagagcccagcagggcct

SEQ ID NO: 1516442 - DNA, 18 bp, Homo sapiens
acaagaggttaaggtggg

SEQ ID NO: 1516443 - DNA, 23 bp, Homo sapiens
acaagaggttaaggtgggtccag

SEQ ID NO: 1516444 - DNA, 16 bp, Homo sapiens
acaagatattgtacat

SEQ ID NO: 1516445 - DNA, 15 bp, Homo sapiens
acaagatctttcagg

SEQ ID NO: 1516446 - DNA, 18 bp, Homo sapiens
acaagatggaatttatca

SEQ ID NO: 1516447 - DNA, 20 bp, Homo sapiens
acaagatgggacagcaacaa

SEQ ID NO: 1516448 - DNA, 23 bp, Homo sapiens
acaagatggtccatttgttcctg

SEQ ID NO: 1516449 - DNA, 18 bp, Homo sapiens
acaagattcccagagaca

SEQ ID NO: 1516450 - DNA, 21 bp, Homo sapiens
acaagattcccagagacagga

SEQ ID NO: 1516451 - DNA, 20 bp, Homo sapiens
acaagcaaaaccaaagaata

SEQ ID NO: 1516452 - DNA, 16 bp, Homo sapiens
acaagcaagttctgag

SEQ ID NO: 1516453 - DNA, 12 bp, Homo sapiens
acaagcacaaag

SEQ ID NO: 1516454 - DNA, 16 bp, Homo sapiens
acaagcactattttat

SEQ ID NO: 1516455 - DNA, 14 bp, Homo sapiens
acaagcagcccttg

SEQ ID NO: 1516456 - DNA, 17 bp, Homo sapiens
acaagcagcccttgctt

SEQ ID NO: 1516457 - DNA, 15 bp, Homo sapiens
acaagcatgtctctc

SEQ ID NO: 1516458 - DNA, 18 bp, Homo sapiens
acaagcatgtctctctgc

SEQ ID NO: 1516459 - DNA, 21 bp, Homo sapiens
acaagccaaacattcttattt

SEQ ID NO: 1516460 - DNA, 14 bp, Homo sapiens
acaagccaaagagc

SEQ ID NO: 1516461 - DNA, 21 bp, Homo sapiens
acaagccaacttgtaaataca

SEQ ID NO: 1516462 - DNA, 20 bp, Homo sapiens
acaagccacaagtcttccag

SEQ ID NO: 1516463 - DNA, 14 bp, Homo sapiens
acaagccctggcaa

SEQ ID NO: 1516464 - DNA, 22 bp, Homo sapiens
acaagcctggaaaaaaacatca

SEQ ID NO: 1516465 - DNA, 14 bp, Homo sapiens
acaagctaaaatta

SEQ ID NO: 1516466 - DNA, 23 bp, Homo sapiens
acaagctattccctcaaatctga

SEQ ID NO: 1516467 - DNA, 16 bp, Homo sapiens
acaagctcctggtctt

SEQ ID NO: 1516468 - DNA, 19 bp, Homo sapiens
acaagctgacttggcactt

SEQ ID NO: 1516469 - DNA, 17 bp, Homo sapiens
acaagctgcactgtgaa

SEQ ID NO: 1516470 - DNA, 19 bp, Homo sapiens
acaagctgtccctgcaggg

SEQ ID NO: 1516471 - DNA, 15 bp, Homo sapiens
acaaggaaataaagc

SEQ ID NO: 1516472 - DNA, 15 bp, Homo sapiens
acaaggaagccaaag

SEQ ID NO: 1516473 - DNA, 23 bp, Homo sapiens
acaaggaataaatgagagggaat

SEQ ID NO: 1516474 - DNA, 18 bp, Homo sapiens
acaaggaatgcctgtgcc

SEQ ID NO: 1516475 - DNA, 17 bp, Homo sapiens
acaaggacgctggctac

SEQ ID NO: 1516476 - DNA, 15 bp, Homo sapiens
acaaggacttcctgt

SEQ ID NO: 1516477 - DNA, 14 bp, Homo sapiens
acaaggagatttct

SEQ ID NO: 1516478 - DNA, 20 bp, Homo sapiens
acaaggagctcaccctgccc

SEQ ID NO: 1516479 - DNA, 20 bp, Homo sapiens
acaaggctgaccaagagaga

SEQ ID NO: 1516480 - DNA, 22 bp, Homo sapiens
acaaggctgaccaagagagaaa

SEQ ID NO: 1516481 - DNA, 21 bp, Homo sapiens
acaagggaaaaatttttatgt

SEQ ID NO: 1516482 - DNA, 15 bp, Homo sapiens
acaagggatataaaa

SEQ ID NO: 1516483 - DNA, 11 bp, Homo sapiens
acaagggattc

SEQ ID NO: 1516484 - DNA, 18 bp, Homo sapiens
acaagggattctgggaag

SEQ ID NO: 1516485 - DNA, 16 bp, Homo sapiens
acaaggggcttttccc

SEQ ID NO: 1516486 - DNA, 14 bp, Homo sapiens
acaaggtagttttt

SEQ ID NO: 1516487 - DNA, 18 bp, Homo sapiens
acaaggtataataaaatt

SEQ ID NO: 1516488 - DNA, 17 bp, Homo sapiens
acaaggtccaagatacc

SEQ ID NO: 1516489 - DNA, 23 bp, Homo sapiens
acaaggtgagtgtgacttccctt

SEQ ID NO: 1516490 - DNA, 21 bp, Homo sapiens
acaaggtgccctttagccaga

SEQ ID NO: 1516491 - DNA, 15 bp, Homo sapiens
acaaggtgctaacat

SEQ ID NO: 1516492 - DNA, 19 bp, Homo sapiens
acaagtaaaggcattgtcc

SEQ ID NO: 1516493 - DNA, 14 bp, Homo sapiens
acaagtaatgtaaa

SEQ ID NO: 1516494 - DNA, 13 bp, Homo sapiens
acaagtaatgtat

SEQ ID NO: 1516495 - DNA, 13 bp, Homo sapiens
acaagtacttttg

SEQ ID NO: 1516496 - DNA, 18 bp, Homo sapiens
acaagtcacagctgcagc

SEQ ID NO: 1516497 - DNA, 22 bp, Homo sapiens
acaagtcagctccagctttctg

SEQ ID NO: 1516498 - DNA, 23 bp, Homo sapiens
acaagtcattttaactttatcac

SEQ ID NO: 1516499 - DNA, 14 bp, Homo sapiens
acaagtcatttttg

SEQ ID NO: 1516500 - DNA, 14 bp, Homo sapiens
acaagtctttccag

SEQ ID NO: 1516501 - DNA, 22 bp, Homo sapiens
acaagtgactgtatctgtgtag

SEQ ID NO: 1516502 - DNA, 21 bp, Homo sapiens
acaagtgagacaaaaagcact

SEQ ID NO: 1516503 - DNA, 22 bp, Homo sapiens
acaagtggtaatttttgtacat

SEQ ID NO: 1516504 - DNA, 13 bp, Homo sapiens
acaagtgttctta

SEQ ID NO: 1516505 - DNA, 20 bp, Homo sapiens
acaagttccaacatgcaata

SEQ ID NO: 1516506 - DNA, 17 bp, Homo sapiens
acaagttgcgacggaga

SEQ ID NO: 1516507 - DNA, 13 bp, Homo sapiens
acaagtttcagac

SEQ ID NO: 1516508 - DNA, 19 bp, Homo sapiens
cctaagagacacatacaga

SEQ ID NO: 1516509 - DNA, 20 bp, Homo sapiens
cctaagagatgggactagga

SEQ ID NO: 1516510 - DNA, 21 bp, Homo sapiens
cctaagatgaagctgagcttt

SEQ ID NO: 1516511 - DNA, 16 bp, Homo sapiens
cctaagccacttgaaa

SEQ ID NO: 1516512 - DNA, 13 bp, Homo sapiens
cctaagcccccag

SEQ ID NO: 1516513 - DNA, 14 bp, Homo sapiens
cctaagccctgccc

SEQ ID NO: 1516514 - DNA, 18 bp, Homo sapiens
cctaagctggagtgcagt

SEQ ID NO: 1516515 - DNA, 13 bp, Homo sapiens
cctaaggaacctt

SEQ ID NO: 1516516 - DNA, 14 bp, Homo sapiens
cctaaggacacact

SEQ ID NO: 1516517 - DNA, 22 bp, Homo sapiens
cctaaggatctctcaggagcac

SEQ ID NO: 1516518 - DNA, 23 bp, Homo sapiens
cctaaggcatctatctgtgctag

SEQ ID NO: 1516519 - DNA, 12 bp, Homo sapiens
cctaaggcccat

SEQ ID NO: 1516520 - DNA, 18 bp, Homo sapiens
cctaagtcctttatgtgg

SEQ ID NO: 1516521 - DNA, 12 bp, Homo sapiens
cctaagtgccca

SEQ ID NO: 1516522 - DNA, 16 bp, Homo sapiens
cctaagtgcccaaagt

SEQ ID NO: 1516523 - DNA, 18 bp, Homo sapiens
cctaagtggattggcttt

SEQ ID NO: 1516524 - DNA, 16 bp, Homo sapiens
cctaagtggctgcctt

SEQ ID NO: 1516525 - DNA, 19 bp, Homo sapiens
cctaagtggctgccttctt

SEQ ID NO: 1516526 - DNA, 20 bp, Homo sapiens
cctaatattcaatgaacttc

SEQ ID NO: 1516527 - DNA, 16 bp, Homo sapiens
cctaatccccttctcc

SEQ ID NO: 1516528 - DNA, 21 bp, Homo sapiens
cctaatccctgggcattgctt

SEQ ID NO: 1516529 - DNA, 20 bp, Homo sapiens
cctaatctatggtcgggaga

SEQ ID NO: 1516530 - DNA, 14 bp, Homo sapiens
cctaatctcatacc

SEQ ID NO: 1516531 - DNA, 18 bp, Homo sapiens
cctaatctcatacctctg

SEQ ID NO: 1516532 - DNA, 13 bp, Homo sapiens
cctaatctctgta

SEQ ID NO: 1516533 - DNA, 19 bp, Homo sapiens
cctaatggagaagacccac

SEQ ID NO: 1516534 - DNA, 13 bp, Homo sapiens
cctaatgtatcta

SEQ ID NO: 1516535 - DNA, 21 bp, Homo sapiens
cctaattaatatattaaaatt

SEQ ID NO: 1516536 - DNA, 22 bp, Homo sapiens
cctaattatgaatccaacgtgt

SEQ ID NO: 1516537 - DNA, 11 bp, Homo sapiens
cctaattatta

SEQ ID NO: 1516538 - DNA, 15 bp, Homo sapiens
cctaatttctcctcc

SEQ ID NO: 1516539 - DNA, 16 bp, Homo sapiens
cctaatttctcctccc

SEQ ID NO: 1516540 - DNA, 17 bp, Homo sapiens
cctaatttctcctccct

SEQ ID NO: 1516541 - DNA, 23 bp, Homo sapiens
cctaatttctcctcccttccttt

SEQ ID NO: 1516542 - DNA, 16 bp, Homo sapiens
cctaatttttttcctg

SEQ ID NO: 1516543 - DNA, 18 bp, Homo sapiens
cctacaagagcagcctgt

SEQ ID NO: 1516544 - DNA, 16 bp, Homo sapiens
cctacacacacagcct

SEQ ID NO: 1516545 - DNA, 18 bp, Homo sapiens
cctacacacacagcctat

SEQ ID NO: 1516546 - DNA, 21 bp, Homo sapiens
cctacaccattatcttggaaa

SEQ ID NO: 1516547 - DNA, 18 bp, Homo sapiens
cctacactcacctgcact

SEQ ID NO: 1516548 - DNA, 21 bp, Homo sapiens
cctacagaaatactgctctga

SEQ ID NO: 1516549 - DNA, 20 bp, Homo sapiens
cctacagaacttcagaaaga

SEQ ID NO: 1516550 - DNA, 13 bp, Homo sapiens
cctacagagctgt

SEQ ID NO: 1516551 - DNA, 22 bp, Homo sapiens
cctacagcctgcacacacctgc

SEQ ID NO: 1516552 - DNA, 21 bp, Homo sapiens
cctacagttttaactgtggat

SEQ ID NO: 1516553 - DNA, 14 bp, Homo sapiens
acaatgaactgctt

SEQ ID NO: 1516554 - DNA, 21 bp, Homo sapiens
acaatgaactgcttttcctca

SEQ ID NO: 1516555 - DNA, 18 bp, Homo sapiens
acaatgaagataaaaaga

SEQ ID NO: 1516556 - DNA, 13 bp, Homo sapiens
acaatgaagggaa

SEQ ID NO: 1516557 - DNA, 18 bp, Homo sapiens
acaatgaagggaaattgt

SEQ ID NO: 1516558 - DNA, 21 bp, Homo sapiens
acaatgaagggaaattgttta

SEQ ID NO: 1516559 - DNA, 19 bp, Homo sapiens
acaatgaagtgaaaaagtt

SEQ ID NO: 1516560 - DNA, 19 bp, Homo sapiens
acaatgccatgaacaaatt

SEQ ID NO: 1516561 - DNA, 21 bp, Homo sapiens
acaatgccatgaacaaattct

SEQ ID NO: 1516562 - DNA, 22 bp, Homo sapiens
acaatgccatgaacaaattctt

SEQ ID NO: 1516563 - DNA, 23 bp, Homo sapiens
acaatgccatgaacaaattcttt

SEQ ID NO: 1516564 - DNA, 18 bp, Homo sapiens
acaatgcctacagctgtc

SEQ ID NO: 1516565 - DNA, 17 bp, Homo sapiens
acaatgctgatttggtg

SEQ ID NO: 1516566 - DNA, 15 bp, Homo sapiens
acaatgggaggctgt

SEQ ID NO: 1516567 - DNA, 18 bp, Homo sapiens
acaatggtcttacattgg

SEQ ID NO: 1516568 - DNA, 19 bp, Homo sapiens
acaatggtcttacattgga

SEQ ID NO: 1516569 - DNA, 20 bp, Homo sapiens
acaatggttgaatgaataaa

SEQ ID NO: 1516570 - DNA, 12 bp, Homo sapiens
acaatggtttat

SEQ ID NO: 1516571 - DNA, 16 bp, Homo sapiens
acaatgtataaagatt

SEQ ID NO: 1516572 - DNA, 18 bp, Homo sapiens
acaatgtataaagattgt

SEQ ID NO: 1516573 - DNA, 22 bp, Homo sapiens
acaatgtatctttattaaaaca

SEQ ID NO: 1516574 - DNA, 16 bp, Homo sapiens
acaatgtatgtacaat

SEQ ID NO: 1516575 - DNA, 19 bp, Homo sapiens
acaatgtatttatttaaaa

SEQ ID NO: 1516576 - DNA, 23 bp, Homo sapiens
acaatgtatttatttaaaagatt

SEQ ID NO: 1516577 - DNA, 13 bp, Homo sapiens
acaatgtatttta

SEQ ID NO: 1516578 - DNA, 22 bp, Homo sapiens
acaatgtcctaactgaaagatg

SEQ ID NO: 1516579 - DNA, 13 bp, Homo sapiens
acaatgttgagaa

SEQ ID NO: 1516580 - DNA, 22 bp, Homo sapiens
acaatgttgtccaacaataaac

SEQ ID NO: 1516581 - DNA, 22 bp, Homo sapiens
acaatgtttcttcatttctctg

SEQ ID NO: 1516582 - DNA, 23 bp, Homo sapiens
acaatgtttcttcatttctctgc

SEQ ID NO: 1516583 - DNA, 21 bp, Homo sapiens
acaattaaaaacctgatggaa

SEQ ID NO: 1516584 - DNA, 18 bp, Homo sapiens
acaattaaaccgcatgtg

SEQ ID NO: 1516585 - DNA, 18 bp, Homo sapiens
acaattactaaattgtat

SEQ ID NO: 1516586 - DNA, 18 bp, Homo sapiens
acaattatttttacagtt

SEQ ID NO: 1516587 - DNA, 14 bp, Homo sapiens
acaattccaaagga

SEQ ID NO: 1516588 - DNA, 17 bp, Homo sapiens
acaattccatttccagt

SEQ ID NO: 1516589 - DNA, 19 bp, Homo sapiens
acaattcctagataaaaag

SEQ ID NO: 1516590 - DNA, 15 bp, Homo sapiens
acaattctacattgt

SEQ ID NO: 1516591 - DNA, 17 bp, Homo sapiens
acaattctgtttttaat

SEQ ID NO: 1516592 - DNA, 13 bp, Homo sapiens
acaattgaagtaa

SEQ ID NO: 1516593 - DNA, 16 bp, Homo sapiens
acaattgatacttcag

SEQ ID NO: 1516594 - DNA, 22 bp, Homo sapiens
acaattgatacttcaggtgctt

SEQ ID NO: 1516595 - DNA, 17 bp, Homo sapiens
acaattgcactgctgtt

SEQ ID NO: 1516596 - DNA, 13 bp, Homo sapiens
acaattgtaattg

SEQ ID NO: 1516597 - DNA, 18 bp, Homo sapiens
acaattgtgtagcctttt

SEQ ID NO: 1516598 - DNA, 21 bp, Homo sapiens
acaattgtgtagcctttttgt

SEQ ID NO: 1516599 - DNA, 17 bp, Homo sapiens
acaattgttacagtact

SEQ ID NO: 1516600 - DNA, 17 bp, Homo sapiens
acaatttaaaatatttc

SEQ ID NO: 1516601 - DNA, 20 bp, Homo sapiens
acaatttcaaaaaaataaaa

SEQ ID NO: 1516602 - DNA, 14 bp, Homo sapiens
acaatttgatacat

SEQ ID NO: 1516603 - DNA, 17 bp, Homo sapiens
acaatttgatacataat

SEQ ID NO: 1516604 - DNA, 18 bp, Homo sapiens
acaatttgatacataata

SEQ ID NO: 1516605 - DNA, 21 bp, Homo sapiens
acaatttgatacataataaaa

SEQ ID NO: 1516606 - DNA, 19 bp, Homo sapiens
acaatttgtacttttttct

SEQ ID NO: 1516607 - DNA, 14 bp, Homo sapiens
acaattttaaagtt

SEQ ID NO: 1516608 - DNA, 19 bp, Homo sapiens
acaattttaaagttcttat

SEQ ID NO: 1516609 - DNA, 12 bp, Homo sapiens
acaattttaaga

SEQ ID NO: 1516610 - DNA, 12 bp, Homo sapiens
acaattttctgt

SEQ ID NO: 1516611 - DNA, 15 bp, Homo sapiens
acaattttctgtaag

SEQ ID NO: 1516612 - DNA, 20 bp, Homo sapiens
acaattttctgtaatctttt

SEQ ID NO: 1516613 - DNA, 21 bp, Homo sapiens
acaattttctgtaatctttta

SEQ ID NO: 1516614 - DNA, 17 bp, Homo sapiens
acaattttgtcttaagt

SEQ ID NO: 1516615 - DNA, 16 bp, Homo sapiens
acaatttttaataaat

SEQ ID NO: 1516616 - DNA, 15 bp, Homo sapiens
acacaaaacttgaaa

SEQ ID NO: 1516617 - DNA, 17 bp, Homo sapiens
acacaaaacttgaaaga

SEQ ID NO: 1516618 - DNA, 19 bp, Homo sapiens
acacaaaccacaactgaca

SEQ ID NO: 1516619 - DNA, 22 bp, Homo sapiens
acacaaaccacaactgacacag

SEQ ID NO: 1516620 - DNA, 18 bp, Homo sapiens
acacaaacctaaaaattt

SEQ ID NO: 1516621 - DNA, 18 bp, Homo sapiens
acacaaacctactgccca

SEQ ID NO: 1516622 - DNA, 19 bp, Homo sapiens
cctagatctgcaggctgca

SEQ ID NO: 1516623 - DNA, 16 bp, Homo sapiens
cctagatgcacgtggg

SEQ ID NO: 1516624 - DNA, 20 bp, Homo sapiens
cctagattaggtagactttg

SEQ ID NO: 1516625 - DNA, 16 bp, Homo sapiens
cctagcaggcacagga

SEQ ID NO: 1516626 - DNA, 18 bp, Homo sapiens
cctagcaggcacaggaca

SEQ ID NO: 1516627 - DNA, 13 bp, Homo sapiens
cctagcagtgaac

SEQ ID NO: 1516628 - DNA, 14 bp, Homo sapiens
cctagccacctccc

SEQ ID NO: 1516629 - DNA, 16 bp, Homo sapiens
cctagccacctcccac

SEQ ID NO: 1516630 - DNA, 16 bp, Homo sapiens
cctagccattcctggt

SEQ ID NO: 1516631 - DNA, 13 bp, Homo sapiens
cctagccctctca

SEQ ID NO: 1516632 - DNA, 20 bp, Homo sapiens
cctagccctctcacatttat

SEQ ID NO: 1516633 - DNA, 14 bp, Homo sapiens
cctagccgacctca

SEQ ID NO: 1516634 - DNA, 23 bp, Homo sapiens
cctagcctgtgcctctgggactg

SEQ ID NO: 1516635 - DNA, 10 bp, Homo sapiens
cctagccttg

SEQ ID NO: 1516636 - DNA, 16 bp, Homo sapiens
cctagcggagcccagc

SEQ ID NO: 1516637 - DNA, 17 bp, Homo sapiens
cctagcggagcccagcc

SEQ ID NO: 1516638 - DNA, 18 bp, Homo sapiens
cctagctcaccaggcctg

SEQ ID NO: 1516639 - DNA, 22 bp, Homo sapiens
cctagctcaccaggcctggcct

SEQ ID NO: 1516640 - DNA, 21 bp, Homo sapiens
cctagctgaccccgagaagtg

SEQ ID NO: 1516641 - DNA, 14 bp, Homo sapiens
cctagctggctctg

SEQ ID NO: 1516642 - DNA, 15 bp, Homo sapiens
cctagctggctctgt

SEQ ID NO: 1516643 - DNA, 12 bp, Homo sapiens
cctagctgtccc

SEQ ID NO: 1516644 - DNA, 14 bp, Homo sapiens
cctagctgtgtcag

SEQ ID NO: 1516645 - DNA, 16 bp, Homo sapiens
cctagctgtgtgaata

SEQ ID NO: 1516646 - DNA, 17 bp, Homo sapiens
cctagctttacgctcat

SEQ ID NO: 1516647 - DNA, 16 bp, Homo sapiens
cctaggaattcccagc

SEQ ID NO: 1516648 - DNA, 17 bp, Homo sapiens
cctaggagatatctgag

SEQ ID NO: 1516649 - DNA, 12 bp, Homo sapiens
cctaggagctgg

SEQ ID NO: 1516650 - DNA, 17 bp, Homo sapiens
cctaggagctggctggc

SEQ ID NO: 1516651 - DNA, 16 bp, Homo sapiens
cctaggaggctggcca

SEQ ID NO: 1516652 - DNA, 15 bp, Homo sapiens
cctaggatgctgcag

SEQ ID NO: 1516653 - DNA, 14 bp, Homo sapiens
cctaggattctaaa

SEQ ID NO: 1516654 - DNA, 15 bp, Homo sapiens
cctaggcagcctgca

SEQ ID NO: 1516655 - DNA, 22 bp, Homo sapiens
cctaggcattgcaggaccttgg

SEQ ID NO: 1516656 - DNA, 14 bp, Homo sapiens
cctaggccactcct

SEQ ID NO: 1516657 - DNA, 16 bp, Homo sapiens
cctaggccactcctcc

SEQ ID NO: 1516658 - DNA, 18 bp, Homo sapiens
cctaggccactcctccaa

SEQ ID NO: 1516659 - DNA, 21 bp, Homo sapiens
cctaggcccctcctagaccca

SEQ ID NO: 1516660 - DNA, 13 bp, Homo sapiens
cctaggcctggca

SEQ ID NO: 1516661 - DNA, 23 bp, Homo sapiens
cctaggcgattttgtctaccatt

SEQ ID NO: 1516662 - DNA, 17 bp, Homo sapiens
cctaggctccaccccat

SEQ ID NO: 1516663 - DNA, 13 bp, Homo sapiens
cctaggggccagg

SEQ ID NO: 1516664 - DNA, 17 bp, Homo sapiens
cctaggggccagggctt

SEQ ID NO: 1516665 - DNA, 20 bp, Homo sapiens
cctagggtcttgggggtcag

SEQ ID NO: 1516666 - DNA, 17 bp, Homo sapiens
cctaggtaacgagggca

SEQ ID NO: 1516667 - DNA, 15 bp, Homo sapiens
cctaggtgcccaggg

SEQ ID NO: 1516668 - DNA, 17 bp, Homo sapiens
cctagtactctctgctc

SEQ ID NO: 1516669 - DNA, 17 bp, Homo sapiens
cctagtcccctttcctc

SEQ ID NO: 1516670 - DNA, 18 bp, Homo sapiens
cctagtcccctttcctct

SEQ ID NO: 1516671 - DNA, 15 bp, Homo sapiens
cctagtcccttcccc

SEQ ID NO: 1516672 - DNA, 23 bp, Homo sapiens
acacagaattatagatgtctgag

SEQ ID NO: 1516673 - DNA, 15 bp, Homo sapiens
acacagacatatata

SEQ ID NO: 1516674 - DNA, 23 bp, Homo sapiens
acacagacattttgtgtgagact

SEQ ID NO: 1516675 - DNA, 23 bp, Homo sapiens
acacagacgttaggcatttcctg

SEQ ID NO: 1516676 - DNA, 14 bp, Homo sapiens
acacagactttctg

SEQ ID NO: 1516677 - DNA, 15 bp, Homo sapiens
acacagagaaggcta

SEQ ID NO: 1516678 - DNA, 17 bp, Homo sapiens
acacagagattctggat

SEQ ID NO: 1516679 - DNA, 13 bp, Homo sapiens
acacagaggaaga

SEQ ID NO: 1516680 - DNA, 21 bp, Homo sapiens
acacagaggaagagcaggcac

SEQ ID NO: 1516681 - DNA, 21 bp, Homo sapiens
acacagagtggtctttctgga

SEQ ID NO: 1516682 - DNA, 11 bp, Homo sapiens
acacagcacaa

SEQ ID NO: 1516683 - DNA, 22 bp, Homo sapiens
acacagcacaccagccgctgca

SEQ ID NO: 1516684 - DNA, 21 bp, Homo sapiens
acacagcagtgtcccctgccc

SEQ ID NO: 1516685 - DNA, 22 bp, Homo sapiens
acacagcagtgtcccctgcccc

SEQ ID NO: 1516686 - DNA, 13 bp, Homo sapiens
acacagcatgtgc

SEQ ID NO: 1516687 - DNA, 14 bp, Homo sapiens
acacagcatgtgcc

SEQ ID NO: 1516688 - DNA, 15 bp, Homo sapiens
acacagcatgtgtat

SEQ ID NO: 1516689 - DNA, 18 bp, Homo sapiens
acacagcattgtatatgt

SEQ ID NO: 1516690 - DNA, 20 bp, Homo sapiens
acacagcattgtatatgtga

SEQ ID NO: 1516691 - DNA, 20 bp, Homo sapiens
acacagcccagttcccgtga

SEQ ID NO: 1516692 - DNA, 17 bp, Homo sapiens
acacagcgtccctagca

SEQ ID NO: 1516693 - DNA, 11 bp, Homo sapiens
acacagctctt

SEQ ID NO: 1516694 - DNA, 14 bp, Homo sapiens
acacagctcttcat

SEQ ID NO: 1516695 - DNA, 22 bp, Homo sapiens
acacagctgccctagctgaccc

SEQ ID NO: 1516696 - DNA, 18 bp, Homo sapiens
acacagctgttcttctgt

SEQ ID NO: 1516697 - DNA, 22 bp, Homo sapiens
acacaggagtcttcagacccag

SEQ ID NO: 1516698 - DNA, 15 bp, Homo sapiens
acacaggcaactgag

SEQ ID NO: 1516699 - DNA, 19 bp, Homo sapiens
acacaggcaactgaggcag

SEQ ID NO: 1516700 - DNA, 13 bp, Homo sapiens
acacaggcaggta

SEQ ID NO: 1516701 - DNA, 16 bp, Homo sapiens
acacaggccctccctg

SEQ ID NO: 1516702 - DNA, 16 bp, Homo sapiens
acacaggctgtcctta

SEQ ID NO: 1516703 - DNA, 13 bp, Homo sapiens
acacagggaaagc

SEQ ID NO: 1516704 - DNA, 15 bp, Homo sapiens
acacagggaaagcat

SEQ ID NO: 1516705 - DNA, 17 bp, Homo sapiens
acacagggaaagcattt

SEQ ID NO: 1516706 - DNA, 20 bp, Homo sapiens
acacagggcactgactgata

SEQ ID NO: 1516707 - DNA, 17 bp, Homo sapiens
acacaggtacagcaaca

SEQ ID NO: 1516708 - DNA, 20 bp, Homo sapiens
acacaggtacagcaacagga

SEQ ID NO: 1516709 - DNA, 13 bp, Homo sapiens
acacagtacacac

SEQ ID NO: 1516710 - DNA, 20 bp, Homo sapiens
acacagtactttattgtaca

SEQ ID NO: 1516711 - DNA, 17 bp, Homo sapiens
acacagtccagactcaa

SEQ ID NO: 1516712 - DNA, 19 bp, Homo sapiens
acacagtgctcgaccttga

SEQ ID NO: 1516713 - DNA, 20 bp, Homo sapiens
acacagtgttagtgctggtc

SEQ ID NO: 1516714 - DNA, 22 bp, Homo sapiens
acacagtgttagtgctggtcag

SEQ ID NO: 1516715 - DNA, 21 bp, Homo sapiens
acacataaatctgtctgattc

SEQ ID NO: 1516716 - DNA, 14 bp, Homo sapiens
acacataagaaaat

SEQ ID NO: 1516717 - DNA, 18 bp, Homo sapiens
acacatagattaatggca

SEQ ID NO: 1516718 - DNA, 20 bp, Homo sapiens
acacatagattaatggcact

SEQ ID NO: 1516719 - DNA, 22 bp, Homo sapiens
acacatagattaatggcactga

SEQ ID NO: 1516720 - DNA, 14 bp, Homo sapiens
acacatataaacat

SEQ ID NO: 1516721 - DNA, 19 bp, Homo sapiens
acacatatacatatgagaa

SEQ ID NO: 1516722 - DNA, 15 bp, Homo sapiens
acacatatataggca

SEQ ID NO: 1516723 - DNA, 20 bp, Homo sapiens
acacatcagccatcaactaa

SEQ ID NO: 1516724 - DNA, 14 bp, Homo sapiens
acacatcccaggag

SEQ ID NO: 1516725 - DNA, 12 bp, Homo sapiens
acacatctattg

SEQ ID NO: 1516726 - DNA, 18 bp, Homo sapiens
acacatctgggtgccctg

SEQ ID NO: 1516727 - DNA, 15 bp, Homo sapiens
acacatctttcttga

SEQ ID NO: 1516728 - DNA, 21 bp, Homo sapiens
acacatggagtgcttctggaa

SEQ ID NO: 1516729 - DNA, 14 bp, Homo sapiens
acacatgtaaaata

SEQ ID NO: 1516730 - DNA, 18 bp, Homo sapiens
acacattaaacaggattt

SEQ ID NO: 1516731 - DNA, 23 bp, Homo sapiens
acacattaatgataaactcagat

SEQ ID NO: 1516732 - DNA, 20 bp, Homo sapiens
acacattatcgggagcagtg

SEQ ID NO: 1516733 - DNA, 20 bp, Homo sapiens
acacattgcagcttcaactt

SEQ ID NO: 1516734 - DNA, 19 bp, Homo sapiens
acacattggaattgatgtc

SEQ ID NO: 1516735 - DNA, 11 bp, Homo sapiens
acacatttctt

SEQ ID NO: 1516736 - DNA, 17 bp, Homo sapiens
acacatttgctactgtt

SEQ ID NO: 1516737 - DNA, 16 bp, Homo sapiens
cctattttcatttgta

SEQ ID NO: 1516738 - DNA, 20 bp, Homo sapiens
cctatttttgacatggaaat

SEQ ID NO: 1516739 - DNA, 13 bp, Homo sapiens
cctcaaacctcct

SEQ ID NO: 1516740 - DNA, 16 bp, Homo sapiens
cctcaaagaaagtgta

SEQ ID NO: 1516741 - DNA, 20 bp, Homo sapiens
cctcaaagaagtcggaatgt

SEQ ID NO: 1516742 - DNA, 16 bp, Homo sapiens
cctcaaaggcccgctc

SEQ ID NO: 1516743 - DNA, 18 bp, Homo sapiens
cctcaaagggagagaaaa

SEQ ID NO: 1516744 - DNA, 17 bp, Homo sapiens
cctcaaagggcagtttt

SEQ ID NO: 1516745 - DNA, 15 bp, Homo sapiens
cctcaaatcgtccag

SEQ ID NO: 1516746 - DNA, 15 bp, Homo sapiens
cctcaaattttttga

SEQ ID NO: 1516747 - DNA, 17 bp, Homo sapiens
cctcaaattttttgact

SEQ ID NO: 1516748 - DNA, 22 bp, Homo sapiens
cctcaacccatatttcatccag

SEQ ID NO: 1516749 - DNA, 22 bp, Homo sapiens
cctcaactgagggccagggacc

SEQ ID NO: 1516750 - DNA, 17 bp, Homo sapiens
cctcaagatgaaggcaa

SEQ ID NO: 1516751 - DNA, 22 bp, Homo sapiens
cctcaagcaataattgtttcca

SEQ ID NO: 1516752 - DNA, 20 bp, Homo sapiens
cctcaagccaatcccctcct

SEQ ID NO: 1516753 - DNA, 20 bp, Homo sapiens
cctcaagccccatttcctca

SEQ ID NO: 1516754 - DNA, 19 bp, Homo sapiens
cctcaagggggactgtctt

SEQ ID NO: 1516755 - DNA, 23 bp, Homo sapiens
cctcaatgccagtaacgcgtctt

SEQ ID NO: 1516756 - DNA, 22 bp, Homo sapiens
cctcaatgtgaatcagacccta

SEQ ID NO: 1516757 - DNA, 14 bp, Homo sapiens
cctcaatttttgtt

SEQ ID NO: 1516758 - DNA, 14 bp, Homo sapiens
cctcacacccctgt

SEQ ID NO: 1516759 - DNA, 15 bp, Homo sapiens
cctcacacccctgtc

SEQ ID NO: 1516760 - DNA, 15 bp, Homo sapiens
cctcacactttgcca

SEQ ID NO: 1516761 - DNA, 19 bp, Homo sapiens
cctcacagtgacccttccc

SEQ ID NO: 1516762 - DNA, 24 bp, Homo sapiens
cctcacagtgacccttcccaatca

SEQ ID NO: 1516763 - DNA, 17 bp, Homo sapiens
cctcaccatccagtggg

SEQ ID NO: 1516764 - DNA, 18 bp, Homo sapiens
cctcacccaaaagaatta

SEQ ID NO: 1516765 - DNA, 19 bp, Homo sapiens
cctcacccacccctgcaca

SEQ ID NO: 1516766 - DNA, 21 bp, Homo sapiens
cctcacccacccctgcacagt

SEQ ID NO: 1516767 - DNA, 15 bp, Homo sapiens
cctcacccaccctgt

SEQ ID NO: 1516768 - DNA, 15 bp, Homo sapiens
cctcacccctggttc

SEQ ID NO: 1516769 - DNA, 22 bp, Homo sapiens
cctcacccctggttctcatctt

SEQ ID NO: 1516770 - DNA, 16 bp, Homo sapiens
cctcacccctgtaggg

SEQ ID NO: 1516771 - DNA, 14 bp, Homo sapiens
cctcaccctgcctt

SEQ ID NO: 1516772 - DNA, 15 bp, Homo sapiens
cctcaccctgcctta

SEQ ID NO: 1516773 - DNA, 22 bp, Homo sapiens
cctcaccctgccttatcttgca

SEQ ID NO: 1516774 - DNA, 11 bp, Homo sapiens
cctcacctctg

SEQ ID NO: 1516775 - DNA, 18 bp, Homo sapiens
cctcacctctggactggc

SEQ ID NO: 1516776 - DNA, 20 bp, Homo sapiens
cctcacctctggactggcta

SEQ ID NO: 1516777 - DNA, 22 bp, Homo sapiens
cctcacctctggactggctaga

SEQ ID NO: 1516778 - DNA, 21 bp, Homo sapiens
cctcacctgagacctccactc

SEQ ID NO: 1516779 - DNA, 15 bp, Homo sapiens
cctcaccttggcacc

SEQ ID NO: 1516780 - DNA, 16 bp, Homo sapiens
cctcaccttggcacca

SEQ ID NO: 1516781 - DNA, 21 bp, Homo sapiens
cctcaccttggcaccagacac

SEQ ID NO: 1516782 - DNA, 17 bp, Homo sapiens
cctcacgcaggctgagt

SEQ ID NO: 1516783 - DNA, 20 bp, Homo sapiens
cctcacgtatttcacagagc

SEQ ID NO: 1516784 - DNA, 22 bp, Homo sapiens
cctcacgtatttcacagagcac

SEQ ID NO: 1516785 - DNA, 18 bp, Homo sapiens
cctcactactcgagccca

SEQ ID NO: 1516786 - DNA, 20 bp, Homo sapiens
cctcactactcgagcccacc

SEQ ID NO: 1516787 - DNA, 20 bp, Homo sapiens
cctcactatgacactgagca

SEQ ID NO: 1516788 - DNA, 15 bp, Homo sapiens
cctcactccccaggg

SEQ ID NO: 1516789 - DNA, 20 bp, Homo sapiens
acaccgctggtccctgccct

SEQ ID NO: 1516790 - DNA, 22 bp, Homo sapiens
acacctaaaggtgtatttaaac

SEQ ID NO: 1516791 - DNA, 18 bp, Homo sapiens
acacctaccaaaaaataa

SEQ ID NO: 1516792 - DNA, 15 bp, Homo sapiens
acacctaccatgctg

SEQ ID NO: 1516793 - DNA, 16 bp, Homo sapiens
acacctcagccccact

SEQ ID NO: 1516794 - DNA, 16 bp, Homo sapiens
acacctcagtgggaag

SEQ ID NO: 1516795 - DNA, 20 bp, Homo sapiens
acacctcccaccccctgtat

SEQ ID NO: 1516796 - DNA, 12 bp, Homo sapiens
acacctcccagg

SEQ ID NO: 1516797 - DNA, 12 bp, Homo sapiens
acacctccccct

SEQ ID NO: 1516798 - DNA, 13 bp, Homo sapiens
acacctccctgaa

SEQ ID NO: 1516799 - DNA, 14 bp, Homo sapiens
acacctctgccacc

SEQ ID NO: 1516800 - DNA, 14 bp, Homo sapiens
acacctgactctga

SEQ ID NO: 1516801 - DNA, 21 bp, Homo sapiens
acacctgactctgaaatctga

SEQ ID NO: 1516802 - DNA, 12 bp, Homo sapiens
acacctgcacct

SEQ ID NO: 1516803 - DNA, 15 bp, Homo sapiens
acacctgcacctccc

SEQ ID NO: 1516804 - DNA, 18 bp, Homo sapiens
acacctgcacctcccccc

SEQ ID NO: 1516805 - DNA, 12 bp, Homo sapiens
acacctgcctgc

SEQ ID NO: 1516806 - DNA, 19 bp, Homo sapiens
acacctggctgaggttcct

SEQ ID NO: 1516807 - DNA, 17 bp, Homo sapiens
acacctgtagtcccagc

SEQ ID NO: 1516808 - DNA, 19 bp, Homo sapiens
acacctgtagtcccagcta

SEQ ID NO: 1516809 - DNA, 21 bp, Homo sapiens
acacctgtagtcccagctact

SEQ ID NO: 1516810 - DNA, 13 bp, Homo sapiens
acacctgtcttga

SEQ ID NO: 1516811 - DNA, 20 bp, Homo sapiens
acacctgtcttgaataagag

SEQ ID NO: 1516812 - DNA, 21 bp, Homo sapiens
acacctgtgtggcccagttct

SEQ ID NO: 1516813 - DNA, 22 bp, Homo sapiens
acacctgttcacagaaaaagca

SEQ ID NO: 1516814 - DNA, 23 bp, Homo sapiens
acacctgttcacagaaaaagcat

SEQ ID NO: 1516815 - DNA, 18 bp, Homo sapiens
acaccttctgagtattct

SEQ ID NO: 1516816 - DNA, 23 bp, Homo sapiens
acaccttggacatcctcctccca

SEQ ID NO: 1516817 - DNA, 16 bp, Homo sapiens
acacctttaggttctt

SEQ ID NO: 1516818 - DNA, 18 bp, Homo sapiens
acaccttttccccaggag

SEQ ID NO: 1516819 - DNA, 18 bp, Homo sapiens
acacgaactttagctgca

SEQ ID NO: 1516820 - DNA, 22 bp, Homo sapiens
acacgacagcacacacagtgga

SEQ ID NO: 1516821 - DNA, 17 bp, Homo sapiens
acacgagcaaacccaga

SEQ ID NO: 1516822 - DNA, 18 bp, Homo sapiens
acacgagcaaacccagag

SEQ ID NO: 1516823 - DNA, 15 bp, Homo sapiens
acacgatgcatttaa

SEQ ID NO: 1516824 - DNA, 23 bp, Homo sapiens
acacgcaagggcatcaggcactg

SEQ ID NO: 1516825 - DNA, 17 bp, Homo sapiens
acacgcacgcacacaca

SEQ ID NO: 1516826 - DNA, 18 bp, Homo sapiens
acacgcacgcacacacac

SEQ ID NO: 1516827 - DNA, 17 bp, Homo sapiens
acacgcagcctgctctg

SEQ ID NO: 1516828 - DNA, 16 bp, Homo sapiens
acacgccttcccctca

SEQ ID NO: 1516829 - DNA, 21 bp, Homo sapiens
acacgcgggcgcgatcccaca

SEQ ID NO: 1516830 - DNA, 17 bp, Homo sapiens
acacgctccctggaagc

SEQ ID NO: 1516831 - DNA, 13 bp, Homo sapiens
acacgctgcctgg

SEQ ID NO: 1516832 - DNA, 15 bp, Homo sapiens
acacgctgcctggtc

SEQ ID NO: 1516833 - DNA, 18 bp, Homo sapiens
acacggagcccagccctc

SEQ ID NO: 1516834 - DNA, 18 bp, Homo sapiens
acacggaggcatctgcac

SEQ ID NO: 1516835 - DNA, 19 bp, Homo sapiens
acacggcttcactgaccag

SEQ ID NO: 1516836 - DNA, 16 bp, Homo sapiens
acacgggcagcctggc

SEQ ID NO: 1516837 - DNA, 19 bp, Homo sapiens
acacgggcagcctggctcc

SEQ ID NO: 1516838 - DNA, 23 bp, Homo sapiens
acacgtggcctcgtgaggggcaa

SEQ ID NO: 1516839 - DNA, 16 bp, Homo sapiens
acacgtggcctgcacc

SEQ ID NO: 1516840 - DNA, 13 bp, Homo sapiens
acacgtggctggc

SEQ ID NO: 1516841 - DNA, 21 bp, Homo sapiens
acacgtttaatcccagcactt

SEQ ID NO: 1516842 - DNA, 22 bp, Homo sapiens
acactaaccaagctgagtttcc

SEQ ID NO: 1516843 - DNA, 17 bp, Homo sapiens
acactaagctctctggg

SEQ ID NO: 1516844 - DNA, 13 bp, Homo sapiens
acactaatatatt

SEQ ID NO: 1516845 - DNA, 19 bp, Homo sapiens
acactaatatatttaaaaa

SEQ ID NO: 1516846 - DNA, 20 bp, Homo sapiens
acactaatatatttaaaaat

SEQ ID NO: 1516847 - DNA, 15 bp, Homo sapiens
acactacctcttttg

SEQ ID NO: 1516848 - DNA, 21 bp, Homo sapiens
acactacctcttttgagactt

SEQ ID NO: 1516849 - DNA, 16 bp, Homo sapiens
acactaccttatcagg

SEQ ID NO: 1516850 - DNA, 19 bp, Homo sapiens
acactagccagacactctg

SEQ ID NO: 1516851 - DNA, 20 bp, Homo sapiens
cctcagtaacatttctgttc

SEQ ID NO: 1516852 - DNA, 21 bp, Homo sapiens
cctcagtagaaaaggatctaa

SEQ ID NO: 1516853 - DNA, 23 bp, Homo sapiens
cctcagtagtccctgcacagtga

SEQ ID NO: 1516854 - DNA, 21 bp, Homo sapiens
cctcagtcagttcccggagca

SEQ ID NO: 1516855 - DNA, 22 bp, Homo sapiens
cctcagtcagttcccggagcac

SEQ ID NO: 1516856 - DNA, 23 bp, Homo sapiens
cctcagtgacatcaaagcctggc

SEQ ID NO: 1516857 - DNA, 16 bp, Homo sapiens
cctcagtgagataaat

SEQ ID NO: 1516858 - DNA, 13 bp, Homo sapiens
cctcagtgccact

SEQ ID NO: 1516859 - DNA, 16 bp, Homo sapiens
cctcagtgccacttga

SEQ ID NO: 1516860 - DNA, 12 bp, Homo sapiens
cctcagtgggaa

SEQ ID NO: 1516861 - DNA, 22 bp, Homo sapiens
cctcagttcccagctccccccg

SEQ ID NO: 1516862 - DNA, 15 bp, Homo sapiens
cctcagttcccttgg

SEQ ID NO: 1516863 - DNA, 19 bp, Homo sapiens
cctcagttcccttggcctc

SEQ ID NO: 1516864 - DNA, 21 bp, Homo sapiens
cctcagttcccttggcctcag

SEQ ID NO: 1516865 - DNA, 16 bp, Homo sapiens
cctcagttggaatcat

SEQ ID NO: 1516866 - DNA, 15 bp, Homo sapiens
cctcagttttccttc

SEQ ID NO: 1516867 - DNA, 14 bp, Homo sapiens
cctcataccatctg

SEQ ID NO: 1516868 - DNA, 15 bp, Homo sapiens
cctcataccatctgc

SEQ ID NO: 1516869 - DNA, 18 bp, Homo sapiens
cctcataccatctgctgc

SEQ ID NO: 1516870 - DNA, 19 bp, Homo sapiens
cctcatagcatagccagca

SEQ ID NO: 1516871 - DNA, 15 bp, Homo sapiens
cctcatcactggact

SEQ ID NO: 1516872 - DNA, 17 bp, Homo sapiens
cctcatcactggactgc

SEQ ID NO: 1516873 - DNA, 20 bp, Homo sapiens
cctcatcactggactgcatg

SEQ ID NO: 1516874 - DNA, 18 bp, Homo sapiens
cctcatcccctcgtcctg

SEQ ID NO: 1516875 - DNA, 21 bp, Homo sapiens
cctcatcccctcgtcctgtcc

SEQ ID NO: 1516876 - DNA, 13 bp, Homo sapiens
cctcatcctgaga

SEQ ID NO: 1516877 - DNA, 13 bp, Homo sapiens
cctcatctcattc

SEQ ID NO: 1516878 - DNA, 14 bp, Homo sapiens
cctcatctccttta

SEQ ID NO: 1516879 - DNA, 16 bp, Homo sapiens
cctcatctctactaaa

SEQ ID NO: 1516880 - DNA, 19 bp, Homo sapiens
cctcatctgagaggctctc

SEQ ID NO: 1516881 - DNA, 24 bp, Homo sapiens
cctcatctgagaggctctccgtgc

SEQ ID NO: 1516882 - DNA, 22 bp, Homo sapiens
cctcatctgtggagctgccaca

SEQ ID NO: 1516883 - DNA, 19 bp, Homo sapiens
cctcatcttggagcttttt

SEQ ID NO: 1516884 - DNA, 13 bp, Homo sapiens
cctcatgaatgta

SEQ ID NO: 1516885 - DNA, 15 bp, Homo sapiens
cctcatgaatgtaaa

SEQ ID NO: 1516886 - DNA, 19 bp, Homo sapiens
cctcatgaatgtaaatttg

SEQ ID NO: 1516887 - DNA, 23 bp, Homo sapiens
cctcatgaatgtaaatttgtact

SEQ ID NO: 1516888 - DNA, 15 bp, Homo sapiens
cctcatgacagccag

SEQ ID NO: 1516889 - DNA, 20 bp, Homo sapiens
cctcatgccaaccctgggct

SEQ ID NO: 1516890 - DNA, 13 bp, Homo sapiens
cctcatgcccacc

SEQ ID NO: 1516891 - DNA, 15 bp, Homo sapiens
cctcatgcccacccc

SEQ ID NO: 1516892 - DNA, 23 bp, Homo sapiens
cctcatgcccaccccctgccctg

SEQ ID NO: 1516893 - DNA, 14 bp, Homo sapiens
cctcatgcccagct

SEQ ID NO: 1516894 - DNA, 20 bp, Homo sapiens
cctcatgcccagctctctga

SEQ ID NO: 1516895 - DNA, 18 bp, Homo sapiens
cctcatggcccccagggg

SEQ ID NO: 1516896 - DNA, 23 bp, Homo sapiens
cctcatggcccccaggggcagga

SEQ ID NO: 1516897 - DNA, 15 bp, Homo sapiens
cctcatggcccctct

SEQ ID NO: 1516898 - DNA, 22 bp, Homo sapiens
cctcatgggtcccttgaaggaa

SEQ ID NO: 1516899 - DNA, 24 bp, Homo sapiens
cctcatgggtcccttgaaggaaga

SEQ ID NO: 1516900 - DNA, 21 bp, Homo sapiens
cctcatgtacataccctggcc

SEQ ID NO: 1516901 - DNA, 15 bp, Homo sapiens
cctcatgtggctgga

SEQ ID NO: 1516902 - DNA, 18 bp, Homo sapiens
cctcatgtggctggaaga

SEQ ID NO: 1516903 - DNA, 18 bp, Homo sapiens
cctcatgttactcagtgt

SEQ ID NO: 1516904 - DNA, 18 bp, Homo sapiens
cctcattaatagctgcct

SEQ ID NO: 1516905 - DNA, 14 bp, Homo sapiens
cctcattgcctcct

SEQ ID NO: 1516906 - DNA, 21 bp, Homo sapiens
cctcattgcctcctgttctgc

SEQ ID NO: 1516907 - DNA, 20 bp, Homo sapiens
acactgggtggtggcctggt

SEQ ID NO: 1516908 - DNA, 10 bp, Homo sapiens
acactggtct

SEQ ID NO: 1516909 - DNA, 15 bp, Homo sapiens
acactggtctaatgt

SEQ ID NO: 1516910 - DNA, 17 bp, Homo sapiens
acactggtctaatgttt

SEQ ID NO: 1516911 - DNA, 20 bp, Homo sapiens
acactggtctaatgtttgtg

SEQ ID NO: 1516912 - DNA, 18 bp, Homo sapiens
acactggtttgccaggcc

SEQ ID NO: 1516913 - DNA, 19 bp, Homo sapiens
acactggtttgccaggcca

SEQ ID NO: 1516914 - DNA, 14 bp, Homo sapiens
acactgtaatctta

SEQ ID NO: 1516915 - DNA, 13 bp, Homo sapiens
acactgtagtttt

SEQ ID NO: 1516916 - DNA, 21 bp, Homo sapiens
acactgtagtttttgaaaatt

SEQ ID NO: 1516917 - DNA, 14 bp, Homo sapiens
acactgtatctaaa

SEQ ID NO: 1516918 - DNA, 15 bp, Homo sapiens
acactgtatctaaaa

SEQ ID NO: 1516919 - DNA, 16 bp, Homo sapiens
acactgtatctaaaaa

SEQ ID NO: 1516920 - DNA, 19 bp, Homo sapiens
acactgtatctaaaaaata

SEQ ID NO: 1516921 - DNA, 20 bp, Homo sapiens
acactgtatctaaaaaataa

SEQ ID NO: 1516922 - DNA, 12 bp, Homo sapiens
acactgtatttt

SEQ ID NO: 1516923 - DNA, 15 bp, Homo sapiens
acactgtattttaat

SEQ ID NO: 1516924 - DNA, 21 bp, Homo sapiens
acactgtcatgcttcatcatt

SEQ ID NO: 1516925 - DNA, 16 bp, Homo sapiens
acactgtccttccctg

SEQ ID NO: 1516926 - DNA, 19 bp, Homo sapiens
acactgtccttccctgcca

SEQ ID NO: 1516927 - DNA, 13 bp, Homo sapiens
acactgtcttccc

SEQ ID NO: 1516928 - DNA, 19 bp, Homo sapiens
acactgtgaactcaatctc

SEQ ID NO: 1516929 - DNA, 11 bp, Homo sapiens
acactgtgaag

SEQ ID NO: 1516930 - DNA, 22 bp, Homo sapiens
acactgtgcccagcccggacct

SEQ ID NO: 1516931 - DNA, 23 bp, Homo sapiens
acactgtgcccagcccggacctt

SEQ ID NO: 1516932 - DNA, 13 bp, Homo sapiens
acactgtgccctg

SEQ ID NO: 1516933 - DNA, 14 bp, Homo sapiens
acactgtgccctgg

SEQ ID NO: 1516934 - DNA, 15 bp, Homo sapiens
acactgtgccctggt

SEQ ID NO: 1516935 - DNA, 16 bp, Homo sapiens
acactgtgccctggtg

SEQ ID NO: 1516936 - DNA, 18 bp, Homo sapiens
acactgtggtaggtgttt

SEQ ID NO: 1516937 - DNA, 23 bp, Homo sapiens
acactgtgtaaatacccatatgt

SEQ ID NO: 1516938 - DNA, 19 bp, Homo sapiens
acactgtgtcctggtgctc

SEQ ID NO: 1516939 - DNA, 16 bp, Homo sapiens
acactgttttatagaa

SEQ ID NO: 1516940 - DNA, 16 bp, Homo sapiens
acacttaacagatgca

SEQ ID NO: 1516941 - DNA, 20 bp, Homo sapiens
acacttaagggttttagaaa

SEQ ID NO: 1516942 - DNA, 22 bp, Homo sapiens
acacttatattttatgaacatt

SEQ ID NO: 1516943 - DNA, 15 bp, Homo sapiens
acacttcaggctctt

SEQ ID NO: 1516944 - DNA, 19 bp, Homo sapiens
acacttcaggctcttctcc

SEQ ID NO: 1516945 - DNA, 16 bp, Homo sapiens
acacttcatggaccaa

SEQ ID NO: 1516946 - DNA, 18 bp, Homo sapiens
acacttcatggaccaaga

SEQ ID NO: 1516947 - DNA, 13 bp, Homo sapiens
acacttcattgta

SEQ ID NO: 1516948 - DNA, 21 bp, Homo sapiens
acacttcattgtaaatcactt

SEQ ID NO: 1516949 - DNA, 16 bp, Homo sapiens
acacttccaccagcct

SEQ ID NO: 1516950 - DNA, 20 bp, Homo sapiens
acacttccccatctttgatc

SEQ ID NO: 1516951 - DNA, 15 bp, Homo sapiens
acacttccctctgtt

SEQ ID NO: 1516952 - DNA, 18 bp, Homo sapiens
acacttccctctgtttct

SEQ ID NO: 1516953 - DNA, 13 bp, Homo sapiens
acacttcctgcct

SEQ ID NO: 1516954 - DNA, 13 bp, Homo sapiens
acacttctgcttt

SEQ ID NO: 1516955 - DNA, 15 bp, Homo sapiens
acacttctgctttca

SEQ ID NO: 1516956 - DNA, 22 bp, Homo sapiens
acacttcttcttggtcttattt

SEQ ID NO: 1516957 - DNA, 13 bp, Homo sapiens
acacttgaaacct

SEQ ID NO: 1516958 - DNA, 20 bp, Homo sapiens
acacttgcatacatatatat

SEQ ID NO: 1516959 - DNA, 13 bp, Homo sapiens
acacttggagccc

SEQ ID NO: 1516960 - DNA, 19 bp, Homo sapiens
acacttggcatacaaaata

SEQ ID NO: 1516961 - DNA, 20 bp, Homo sapiens
acacttggttagacgccttc

SEQ ID NO: 1516962 - DNA, 18 bp, Homo sapiens
acacttgtgacttttgct

SEQ ID NO: 1516963 - DNA, 13 bp, Homo sapiens
acacttgtgtgtg

SEQ ID NO: 1516964 - DNA, 18 bp, Homo sapiens
acacttgtgtgtgggctg

SEQ ID NO: 1516965 - DNA, 22 bp, Homo sapiens
acacttgtgtgtgggctgtgag

SEQ ID NO: 1516966 - DNA, 12 bp, Homo sapiens
cctccaggcctg

SEQ ID NO: 1516967 - DNA, 16 bp, Homo sapiens
cctccaggcctgcagg

SEQ ID NO: 1516968 - DNA, 18 bp, Homo sapiens
cctccaggcctgcctccc

SEQ ID NO: 1516969 - DNA, 12 bp, Homo sapiens
cctccagggcca

SEQ ID NO: 1516970 - DNA, 14 bp, Homo sapiens
cctccagggccacg

SEQ ID NO: 1516971 - DNA, 16 bp, Homo sapiens
cctccagggccacgtg

SEQ ID NO: 1516972 - DNA, 19 bp, Homo sapiens
cctccagggccacgtgcca

SEQ ID NO: 1516973 - DNA, 22 bp, Homo sapiens
cctccagggccacgtgccaggc

SEQ ID NO: 1516974 - DNA, 17 bp, Homo sapiens
cctccagggctggactg

SEQ ID NO: 1516975 - DNA, 21 bp, Homo sapiens
cctccagggctggactgaggc

SEQ ID NO: 1516976 - DNA, 23 bp, Homo sapiens
cctccagggctggactgaggcct

SEQ ID NO: 1516977 - DNA, 17 bp, Homo sapiens
cctccaggtgcagaggt

SEQ ID NO: 1516978 - DNA, 19 bp, Homo sapiens
cctccaggtgtgcacgtgg

SEQ ID NO: 1516979 - DNA, 20 bp, Homo sapiens
cctccagtacgtcccgctgc

SEQ ID NO: 1516980 - DNA, 21 bp, Homo sapiens
cctccagtacgtcccgctgct

SEQ ID NO: 1516981 - DNA, 22 bp, Homo sapiens
cctccagtacgtcccgctgctg

SEQ ID NO: 1516982 - DNA, 23 bp, Homo sapiens
cctccatcaaacctcacatttgt

SEQ ID NO: 1516983 - DNA, 18 bp, Homo sapiens
cctccatgctcctcacct

SEQ ID NO: 1516984 - DNA, 15 bp, Homo sapiens
cctccatggcagcag

SEQ ID NO: 1516985 - DNA, 17 bp, Homo sapiens
cctccatggcagcagcc

SEQ ID NO: 1516986 - DNA, 20 bp, Homo sapiens
cctccatggcagcagccagg

SEQ ID NO: 1516987 - DNA, 13 bp, Homo sapiens
cctccatgggcta

SEQ ID NO: 1516988 - DNA, 21 bp, Homo sapiens
cctccatttcccaaagtcctc

SEQ ID NO: 1516989 - DNA, 22 bp, Homo sapiens
cctccatttttatttcttcgtg

SEQ ID NO: 1516990 - DNA, 21 bp, Homo sapiens
cctcccaaagtgctgggatga

SEQ ID NO: 1516991 - DNA, 15 bp, Homo sapiens
cctcccaacagcgct

SEQ ID NO: 1516992 - DNA, 12 bp, Homo sapiens
cctcccaacctc

SEQ ID NO: 1516993 - DNA, 13 bp, Homo sapiens
cctcccaacctca

SEQ ID NO: 1516994 - DNA, 23 bp, Homo sapiens
cctcccaagcgttcctggccttc

SEQ ID NO: 1516995 - DNA, 18 bp, Homo sapiens
cctcccaagtagctggga

SEQ ID NO: 1516996 - DNA, 22 bp, Homo sapiens
cctcccaatcctctctcccctc

SEQ ID NO: 1516997 - DNA, 19 bp, Homo sapiens
cctcccacactcccaaggt

SEQ ID NO: 1516998 - DNA, 15 bp, Homo sapiens
cctcccacagcctcc

SEQ ID NO: 1516999 - DNA, 13 bp, Homo sapiens
cctcccaccagag

SEQ ID NO: 1517000 - DNA, 21 bp, Homo sapiens
cctcccacccacagccataga

SEQ ID NO: 1517001 - DNA, 17 bp, Homo sapiens
cctcccaccccactcca

SEQ ID NO: 1517002 - DNA, 19 bp, Homo sapiens
cctcccaccccactccagc

SEQ ID NO: 1517003 - DNA, 13 bp, Homo sapiens
cctcccaccccct

SEQ ID NO: 1517004 - DNA, 16 bp, Homo sapiens
cctcccacctccgtgt

SEQ ID NO: 1517005 - DNA, 16 bp, Homo sapiens
cctcccacggtgccca

SEQ ID NO: 1517006 - DNA, 15 bp, Homo sapiens
cctcccactcctgct

SEQ ID NO: 1517007 - DNA, 17 bp, Homo sapiens
cctcccactcctgctgc

SEQ ID NO: 1517008 - DNA, 21 bp, Homo sapiens
cctcccagaaacatctctggc

SEQ ID NO: 1517009 - DNA, 21 bp, Homo sapiens
cctcccagcccattgctgcca

SEQ ID NO: 1517010 - DNA, 12 bp, Homo sapiens
cctcccaggcaa

SEQ ID NO: 1517011 - DNA, 19 bp, Homo sapiens
cctcccaggcaagcagctg

SEQ ID NO: 1517012 - DNA, 21 bp, Homo sapiens
cctcccaggggagccagctgc

SEQ ID NO: 1517013 - DNA, 14 bp, Homo sapiens
cctcccatcccacc

SEQ ID NO: 1517014 - DNA, 13 bp, Homo sapiens
cctccccaaagcc

SEQ ID NO: 1517015 - DNA, 15 bp, Homo sapiens
cctccccaaagccac

SEQ ID NO: 1517016 - DNA, 19 bp, Homo sapiens
cctccccaaagccactgga

SEQ ID NO: 1517017 - DNA, 18 bp, Homo sapiens
cctccccacacctcccta

SEQ ID NO: 1517018 - DNA, 18 bp, Homo sapiens
cctccccacagtgccacc

SEQ ID NO: 1517019 - DNA, 15 bp, Homo sapiens
cctccccacccgctc

SEQ ID NO: 1517020 - DNA, 14 bp, Homo sapiens
cctccccaggggag

SEQ ID NO: 1517021 - DNA, 16 bp, Homo sapiens
cctccccatggagcca

SEQ ID NO: 1517022 - DNA, 17 bp, Homo sapiens
cctccccattcacagag

SEQ ID NO: 1517023 - DNA, 22 bp, Homo sapiens
cctccccattcacagagccttt

SEQ ID NO: 1517024 - DNA, 14 bp, Homo sapiens
cctccccatttccc

SEQ ID NO: 1517025 - DNA, 21 bp, Homo sapiens
acagacgttaggcatttcctg

SEQ ID NO: 1517026 - DNA, 18 bp, Homo sapiens
acagactccatctcttct

SEQ ID NO: 1517027 - DNA, 24 bp, Homo sapiens
acagactccatctcttctgcaagc

SEQ ID NO: 1517028 - DNA, 12 bp, Homo sapiens
acagactctgat

SEQ ID NO: 1517029 - DNA, 15 bp, Homo sapiens
acagactgttaatta

SEQ ID NO: 1517030 - DNA, 16 bp, Homo sapiens
acagactgttgagtta

SEQ ID NO: 1517031 - DNA, 16 bp, Homo sapiens
acagacttctccagac

SEQ ID NO: 1517032 - DNA, 19 bp, Homo sapiens
acagacttctggaaggctg

SEQ ID NO: 1517033 - DNA, 16 bp, Homo sapiens
acagacttgagaactt

SEQ ID NO: 1517034 - DNA, 17 bp, Homo sapiens
acagacttgagaacttg

SEQ ID NO: 1517035 - DNA, 15 bp, Homo sapiens
acagacttgcactga

SEQ ID NO: 1517036 - DNA, 14 bp, Homo sapiens
acagagaaagaaat

SEQ ID NO: 1517037 - DNA, 13 bp, Homo sapiens
acagagaagctcc

SEQ ID NO: 1517038 - DNA, 14 bp, Homo sapiens
acagagaagctcct

SEQ ID NO: 1517039 - DNA, 21 bp, Homo sapiens
acagagaagtttgtagccagg

SEQ ID NO: 1517040 - DNA, 18 bp, Homo sapiens
acagagacaagtaatttc

SEQ ID NO: 1517041 - DNA, 15 bp, Homo sapiens
acagagacacctgca

SEQ ID NO: 1517042 - DNA, 16 bp, Homo sapiens
acagagacacctgcac

SEQ ID NO: 1517043 - DNA, 17 bp, Homo sapiens
acagagacacctgcacc

SEQ ID NO: 1517044 - DNA, 15 bp, Homo sapiens
acagagacaggccca

SEQ ID NO: 1517045 - DNA, 16 bp, Homo sapiens
acagagaggactgtag

SEQ ID NO: 1517046 - DNA, 18 bp, Homo sapiens
acagagaggatacattta

SEQ ID NO: 1517047 - DNA, 24 bp, Homo sapiens
acagagagggagagcagagaaaga

SEQ ID NO: 1517048 - DNA, 14 bp, Homo sapiens
acagagattctgga

SEQ ID NO: 1517049 - DNA, 17 bp, Homo sapiens
acagagattctggatct

SEQ ID NO: 1517050 - DNA, 17 bp, Homo sapiens
acagagcaaagcgccca

SEQ ID NO: 1517051 - DNA, 23 bp, Homo sapiens
acagagcaaagcgcccacccagg

SEQ ID NO: 1517052 - DNA, 12 bp, Homo sapiens
acagagcacgcc

SEQ ID NO: 1517053 - DNA, 13 bp, Homo sapiens
acagagcatcaaa

SEQ ID NO: 1517054 - DNA, 16 bp, Homo sapiens
acagagccaagcactg

SEQ ID NO: 1517055 - DNA, 11 bp, Homo sapiens
acagagccagg

SEQ ID NO: 1517056 - DNA, 20 bp, Homo sapiens
acagagccaggagaagctca

SEQ ID NO: 1517057 - DNA, 21 bp, Homo sapiens
acagagccttgagagacccag

SEQ ID NO: 1517058 - DNA, 21 bp, Homo sapiens
acagagcgagagtctgtctca

SEQ ID NO: 1517059 - DNA, 13 bp, Homo sapiens
acagagctctggg

SEQ ID NO: 1517060 - DNA, 22 bp, Homo sapiens
acagagctgtcacttttgctcc

SEQ ID NO: 1517061 - DNA, 18 bp, Homo sapiens
acagagcttgaagcctcc

SEQ ID NO: 1517062 - DNA, 16 bp, Homo sapiens
acagaggaagagcagg

SEQ ID NO: 1517063 - DNA, 16 bp, Homo sapiens
acagaggccccagcct

SEQ ID NO: 1517064 - DNA, 18 bp, Homo sapiens
acagaggccccagcctcc

SEQ ID NO: 1517065 - DNA, 13 bp, Homo sapiens
acagagggcacat

SEQ ID NO: 1517066 - DNA, 20 bp, Homo sapiens
acagagggctagggaggtgg

SEQ ID NO: 1517067 - DNA, 16 bp, Homo sapiens
acagagggctgcattc

SEQ ID NO: 1517068 - DNA, 22 bp, Homo sapiens
acagaggtattaaaactaaatt

SEQ ID NO: 1517069 - DNA, 12 bp, Homo sapiens
acagagtaacta

SEQ ID NO: 1517070 - DNA, 23 bp, Homo sapiens
acagagtacttggctgttagccc

SEQ ID NO: 1517071 - DNA, 14 bp, Homo sapiens
acagagtcttcctc

SEQ ID NO: 1517072 - DNA, 16 bp, Homo sapiens
acagagtgcttttctg

SEQ ID NO: 1517073 - DNA, 17 bp, Homo sapiens
acagagtggactcttcc

SEQ ID NO: 1517074 - DNA, 24 bp, Homo sapiens
acagagtggtctttctggagaggt

SEQ ID NO: 1517075 - DNA, 14 bp, Homo sapiens
acagataatcagtg

SEQ ID NO: 1517076 - DNA, 19 bp, Homo sapiens
acagataattcatttgtat

SEQ ID NO: 1517077 - DNA, 20 bp, Homo sapiens
acagatactgtgagcttaca

SEQ ID NO: 1517078 - DNA, 20 bp, Homo sapiens
acagatagatatatgctctg

SEQ ID NO: 1517079 - DNA, 13 bp, Homo sapiens
acagatagttgtg

SEQ ID NO: 1517080 - DNA, 23 bp, Homo sapiens
acagatatgggtgtttttaataa

SEQ ID NO: 1517081 - DNA, 15 bp, Homo sapiens
cctccctcctgcagg

SEQ ID NO: 1517082 - DNA, 17 bp, Homo sapiens
cctccctcctgcaggct

SEQ ID NO: 1517083 - DNA, 13 bp, Homo sapiens
cctccctctccca

SEQ ID NO: 1517084 - DNA, 19 bp, Homo sapiens
cctccctctcccaggcccg

SEQ ID NO: 1517085 - DNA, 14 bp, Homo sapiens
cctccctctgacct

SEQ ID NO: 1517086 - DNA, 18 bp, Homo sapiens
cctccctctgacctgcag

SEQ ID NO: 1517087 - DNA, 15 bp, Homo sapiens
cctccctctgcccca

SEQ ID NO: 1517088 - DNA, 23 bp, Homo sapiens
cctccctctgccccaagcagcca

SEQ ID NO: 1517089 - DNA, 13 bp, Homo sapiens
cctccctgaacca

SEQ ID NO: 1517090 - DNA, 20 bp, Homo sapiens
cctccctgaaccatccctga

SEQ ID NO: 1517091 - DNA, 12 bp, Homo sapiens
cctccctgcaga

SEQ ID NO: 1517092 - DNA, 12 bp, Homo sapiens
cctccctgcccc

SEQ ID NO: 1517093 - DNA, 13 bp, Homo sapiens
cctccctgcccct

SEQ ID NO: 1517094 - DNA, 24 bp, Homo sapiens
cctccctgcccctcccttcaacca

SEQ ID NO: 1517095 - DNA, 20 bp, Homo sapiens
cctccctgccgaacacacat

SEQ ID NO: 1517096 - DNA, 13 bp, Homo sapiens
cctccctgcctca

SEQ ID NO: 1517097 - DNA, 15 bp, Homo sapiens
cctccctgctgtgcc

SEQ ID NO: 1517098 - DNA, 12 bp, Homo sapiens
cctccctggcac

SEQ ID NO: 1517099 - DNA, 15 bp, Homo sapiens
cctccctggctccca

SEQ ID NO: 1517100 - DNA, 16 bp, Homo sapiens
cctccctggctcccat

SEQ ID NO: 1517101 - DNA, 18 bp, Homo sapiens
cctccctggctcccatga

SEQ ID NO: 1517102 - DNA, 20 bp, Homo sapiens
cctccctggctcccatgacc

SEQ ID NO: 1517103 - DNA, 20 bp, Homo sapiens
cctccctggctgccctggcc

SEQ ID NO: 1517104 - DNA, 22 bp, Homo sapiens
cctccctggctgccctggccct

SEQ ID NO: 1517105 - DNA, 15 bp, Homo sapiens
cctccctggggacca

SEQ ID NO: 1517106 - DNA, 24 bp, Homo sapiens
cctccctggggaccaggagctagc

SEQ ID NO: 1517107 - DNA, 13 bp, Homo sapiens
cctccctgggttc

SEQ ID NO: 1517108 - DNA, 15 bp, Homo sapiens
cctccctgggttcag

SEQ ID NO: 1517109 - DNA, 15 bp, Homo sapiens
cctccctgtctccag

SEQ ID NO: 1517110 - DNA, 16 bp, Homo sapiens
cctccctgtctccagc

SEQ ID NO: 1517111 - DNA, 17 bp, Homo sapiens
cctccctgtctccagct

SEQ ID NO: 1517112 - DNA, 13 bp, Homo sapiens
cctcccttacaga

SEQ ID NO: 1517113 - DNA, 22 bp, Homo sapiens
cctcccttccatgccccaggat

SEQ ID NO: 1517114 - DNA, 13 bp, Homo sapiens
cctcccttcccac

SEQ ID NO: 1517115 - DNA, 13 bp, Homo sapiens
cctcccttccttt

SEQ ID NO: 1517116 - DNA, 15 bp, Homo sapiens
cctcccttccttttc

SEQ ID NO: 1517117 - DNA, 16 bp, Homo sapiens
cctcccttccttttcc

SEQ ID NO: 1517118 - DNA, 13 bp, Homo sapiens
cctcccttgcctt

SEQ ID NO: 1517119 - DNA, 19 bp, Homo sapiens
cctcccttggaaacctgcc

SEQ ID NO: 1517120 - DNA, 22 bp, Homo sapiens
cctcccttggaaacctgccctg

SEQ ID NO: 1517121 - DNA, 13 bp, Homo sapiens
cctccctttctct

SEQ ID NO: 1517122 - DNA, 16 bp, Homo sapiens
cctccctttctctctc

SEQ ID NO: 1517123 - DNA, 20 bp, Homo sapiens
cctccgaccacttccagggg

SEQ ID NO: 1517124 - DNA, 17 bp, Homo sapiens
cctccgacgctgcctct

SEQ ID NO: 1517125 - DNA, 14 bp, Homo sapiens
cctccgagagggag

SEQ ID NO: 1517126 - DNA, 16 bp, Homo sapiens
cctccgagagggagag

SEQ ID NO: 1517127 - DNA, 19 bp, Homo sapiens
cctccgagagggagagaga

SEQ ID NO: 1517128 - DNA, 14 bp, Homo sapiens
cctccgaggctccc

SEQ ID NO: 1517129 - DNA, 18 bp, Homo sapiens
cctccgaggctccccgcc

SEQ ID NO: 1517130 - DNA, 22 bp, Homo sapiens
cctccgaggctccccgcctcca

SEQ ID NO: 1517131 - DNA, 17 bp, Homo sapiens
cctccgatgctgaggcc

SEQ ID NO: 1517132 - DNA, 18 bp, Homo sapiens
cctccgcagcagggaagc

SEQ ID NO: 1517133 - DNA, 14 bp, Homo sapiens
cctccgcagtgtct

SEQ ID NO: 1517134 - DNA, 14 bp, Homo sapiens
cctccgccatccac

SEQ ID NO: 1517135 - DNA, 15 bp, Homo sapiens
cctccgccatccacc

SEQ ID NO: 1517136 - DNA, 23 bp, Homo sapiens
cctccgccattctcaagccctgc

SEQ ID NO: 1517137 - DNA, 12 bp, Homo sapiens
cctccgccctgc

SEQ ID NO: 1517138 - DNA, 20 bp, Homo sapiens
cctccgcctactgtccctct

SEQ ID NO: 1517139 - DNA, 13 bp, Homo sapiens
cctccggactggt

SEQ ID NO: 1517140 - DNA, 15 bp, Homo sapiens
cctccggactggtgc

SEQ ID NO: 1517141 - DNA, 22 bp, Homo sapiens
cctccggcgggtgacagctccg

SEQ ID NO: 1517142 - DNA, 18 bp, Homo sapiens
cctccggcgtcttgccca

SEQ ID NO: 1517143 - DNA, 23 bp, Homo sapiens
cctccggcgtcttgcccagcagc

SEQ ID NO: 1517144 - DNA, 19 bp, Homo sapiens
acagcatttgctttcctct

SEQ ID NO: 1517145 - DNA, 12 bp, Homo sapiens
acagcattttaa

SEQ ID NO: 1517146 - DNA, 13 bp, Homo sapiens
acagcattttaag

SEQ ID NO: 1517147 - DNA, 16 bp, Homo sapiens
acagccaactagcccc

SEQ ID NO: 1517148 - DNA, 17 bp, Homo sapiens
acagccaactagcccct

SEQ ID NO: 1517149 - DNA, 17 bp, Homo sapiens
acagccaagacccaaca

SEQ ID NO: 1517150 - DNA, 13 bp, Homo sapiens
acagccacaaaat

SEQ ID NO: 1517151 - DNA, 15 bp, Homo sapiens
acagccagactggca

SEQ ID NO: 1517152 - DNA, 17 bp, Homo sapiens
acagccagagcctgtct

SEQ ID NO: 1517153 - DNA, 16 bp, Homo sapiens
acagccagcacctggc

SEQ ID NO: 1517154 - DNA, 19 bp, Homo sapiens
acagccatagacctacaga

SEQ ID NO: 1517155 - DNA, 13 bp, Homo sapiens
acagcccaagagg

SEQ ID NO: 1517156 - DNA, 13 bp, Homo sapiens
acagcccagagcc

SEQ ID NO: 1517157 - DNA, 15 bp, Homo sapiens
acagcccaggatact

SEQ ID NO: 1517158 - DNA, 20 bp, Homo sapiens
acagcccaggatactggcac

SEQ ID NO: 1517159 - DNA, 16 bp, Homo sapiens
acagccccaacctccc

SEQ ID NO: 1517160 - DNA, 13 bp, Homo sapiens
acagccccaccct

SEQ ID NO: 1517161 - DNA, 20 bp, Homo sapiens
acagcccccttgccctccgc

SEQ ID NO: 1517162 - DNA, 16 bp, Homo sapiens
acagccctcggcctcc

SEQ ID NO: 1517163 - DNA, 18 bp, Homo sapiens
acagccgctcctgtctgc

SEQ ID NO: 1517164 - DNA, 19 bp, Homo sapiens
acagccgctcctgtctgcc

SEQ ID NO: 1517165 - DNA, 20 bp, Homo sapiens
acagccgtcagccaaatgta

SEQ ID NO: 1517166 - DNA, 23 bp, Homo sapiens
acagccgtcccgcgttcaagact

SEQ ID NO: 1517167 - DNA, 15 bp, Homo sapiens
acagcctagggcaga

SEQ ID NO: 1517168 - DNA, 18 bp, Homo sapiens
acagcctcacttgaatgt

SEQ ID NO: 1517169 - DNA, 15 bp, Homo sapiens
acagcctcccacccc

SEQ ID NO: 1517170 - DNA, 20 bp, Homo sapiens
acagcctcccccgccagccc

SEQ ID NO: 1517171 - DNA, 12 bp, Homo sapiens
acagcctgcaca

SEQ ID NO: 1517172 - DNA, 21 bp, Homo sapiens
acagcctgcacacacctgcct

SEQ ID NO: 1517173 - DNA, 12 bp, Homo sapiens
acagcctggcac

SEQ ID NO: 1517174 - DNA, 15 bp, Homo sapiens
acagcctgggcccca

SEQ ID NO: 1517175 - DNA, 10 bp, Homo sapiens
acagccttca

SEQ ID NO: 1517176 - DNA, 12 bp, Homo sapiens
acagccttcact

SEQ ID NO: 1517177 - DNA, 15 bp, Homo sapiens
acagcgagggcagct

SEQ ID NO: 1517178 - DNA, 18 bp, Homo sapiens
acagcgagggcagctgct

SEQ ID NO: 1517179 - DNA, 19 bp, Homo sapiens
acagcgcggaggaggaggg

SEQ ID NO: 1517180 - DNA, 13 bp, Homo sapiens
acagcgctatgca

SEQ ID NO: 1517181 - DNA, 22 bp, Homo sapiens
acagcggaggagaccagctcag

SEQ ID NO: 1517182 - DNA, 23 bp, Homo sapiens
acagcggaggagaccagctcaga

SEQ ID NO: 1517183 - DNA, 23 bp, Homo sapiens
acagcggccttgaagacagagca

SEQ ID NO: 1517184 - DNA, 13 bp, Homo sapiens
acagcgtctgctc

SEQ ID NO: 1517185 - DNA, 15 bp, Homo sapiens
acagcgtctgctcat

SEQ ID NO: 1517186 - DNA, 21 bp, Homo sapiens
acagctacaaccctaccctgg

SEQ ID NO: 1517187 - DNA, 22 bp, Homo sapiens
acagctacaaccctaccctggc

SEQ ID NO: 1517188 - DNA, 24 bp, Homo sapiens
acagctacaaccctaccctggcag

SEQ ID NO: 1517189 - DNA, 13 bp, Homo sapiens
acagctacacaga

SEQ ID NO: 1517190 - DNA, 22 bp, Homo sapiens
acagctactcagtggggctggc

SEQ ID NO: 1517191 - DNA, 22 bp, Homo sapiens
acagctacttctgggaaaaaca

SEQ ID NO: 1517192 - DNA, 15 bp, Homo sapiens
acagctatatttctg

SEQ ID NO: 1517193 - DNA, 22 bp, Homo sapiens
acagctatcgaacttcacaact

SEQ ID NO: 1517194 - DNA, 21 bp, Homo sapiens
acagctatgggagccccaggg

SEQ ID NO: 1517195 - DNA, 20 bp, Homo sapiens
acagctcaagtcttccctga

SEQ ID NO: 1517196 - DNA, 14 bp, Homo sapiens
cctcctgctctggg

SEQ ID NO: 1517197 - DNA, 15 bp, Homo sapiens
cctcctgctctggga

SEQ ID NO: 1517198 - DNA, 16 bp, Homo sapiens
cctcctgctctgggac

SEQ ID NO: 1517199 - DNA, 20 bp, Homo sapiens
cctcctggagctctgtgggt

SEQ ID NO: 1517200 - DNA, 12 bp, Homo sapiens
cctcctgtgcta

SEQ ID NO: 1517201 - DNA, 13 bp, Homo sapiens
cctcctgttctgc

SEQ ID NO: 1517202 - DNA, 13 bp, Homo sapiens
cctccttcagaca

SEQ ID NO: 1517203 - DNA, 14 bp, Homo sapiens
cctccttcagacac

SEQ ID NO: 1517204 - DNA, 16 bp, Homo sapiens
cctccttcccgccgcc

SEQ ID NO: 1517205 - DNA, 15 bp, Homo sapiens
cctccttccttgacc

SEQ ID NO: 1517206 - DNA, 16 bp, Homo sapiens
cctccttctccctttt

SEQ ID NO: 1517207 - DNA, 14 bp, Homo sapiens
cctccttcttccac

SEQ ID NO: 1517208 - DNA, 21 bp, Homo sapiens
cctccttggctttatgcaaat

SEQ ID NO: 1517209 - DNA, 19 bp, Homo sapiens
cctcctttcctatcttcct

SEQ ID NO: 1517210 - DNA, 17 bp, Homo sapiens
cctccttttcttcaccc

SEQ ID NO: 1517211 - DNA, 17 bp, Homo sapiens
cctcgaaccaaggcagc

SEQ ID NO: 1517212 - DNA, 20 bp, Homo sapiens
cctcgaaccaaggcagcctc

SEQ ID NO: 1517213 - DNA, 22 bp, Homo sapiens
cctcgaattttatctgtggagt

SEQ ID NO: 1517214 - DNA, 20 bp, Homo sapiens
cctcgacagggcctggagcc

SEQ ID NO: 1517215 - DNA, 21 bp, Homo sapiens
cctcgaccctgtgcaggagct

SEQ ID NO: 1517216 - DNA, 12 bp, Homo sapiens
cctcgaggcacc

SEQ ID NO: 1517217 - DNA, 12 bp, Homo sapiens
cctcgcacaggc

SEQ ID NO: 1517218 - DNA, 13 bp, Homo sapiens
cctcgcacaggcc

SEQ ID NO: 1517219 - DNA, 12 bp, Homo sapiens
cctcgccctggg

SEQ ID NO: 1517220 - DNA, 13 bp, Homo sapiens
cctcgccctgggt

SEQ ID NO: 1517221 - DNA, 14 bp, Homo sapiens
cctcgccctgggtc

SEQ ID NO: 1517222 - DNA, 17 bp, Homo sapiens
cctcgccggccttgttt

SEQ ID NO: 1517223 - DNA, 18 bp, Homo sapiens
cctcgccgtccctcccag

SEQ ID NO: 1517224 - DNA, 13 bp, Homo sapiens
cctcgcctgacaa

SEQ ID NO: 1517225 - DNA, 14 bp, Homo sapiens
cctcgctcccttca

SEQ ID NO: 1517226 - DNA, 12 bp, Homo sapiens
cctcgctgctgc

SEQ ID NO: 1517227 - DNA, 13 bp, Homo sapiens
cctcgctgctgct

SEQ ID NO: 1517228 - DNA, 14 bp, Homo sapiens
cctcgctgtatgat

SEQ ID NO: 1517229 - DNA, 22 bp, Homo sapiens
cctcggaagccgtctgactcca

SEQ ID NO: 1517230 - DNA, 13 bp, Homo sapiens
cctcggagcctca

SEQ ID NO: 1517231 - DNA, 16 bp, Homo sapiens
cctcggagggatggag

SEQ ID NO: 1517232 - DNA, 22 bp, Homo sapiens
cctcggagggatggagaaagaa

SEQ ID NO: 1517233 - DNA, 18 bp, Homo sapiens
cctcggaggtccagctgg

SEQ ID NO: 1517234 - DNA, 22 bp, Homo sapiens
cctcggaggtccagctgggcct

SEQ ID NO: 1517235 - DNA, 15 bp, Homo sapiens
cctcggatcaccgag

SEQ ID NO: 1517236 - DNA, 21 bp, Homo sapiens
cctcggatgaccatactcaga

SEQ ID NO: 1517237 - DNA, 15 bp, Homo sapiens
cctcggctctggagg

SEQ ID NO: 1517238 - DNA, 22 bp, Homo sapiens
cctcgggatgccgttctgttcc

SEQ ID NO: 1517239 - DNA, 13 bp, Homo sapiens
cctcgggcccacc

SEQ ID NO: 1517240 - DNA, 14 bp, Homo sapiens
cctcgggcccacct

SEQ ID NO: 1517241 - DNA, 17 bp, Homo sapiens
cctcgggccgaggccca

SEQ ID NO: 1517242 - DNA, 18 bp, Homo sapiens
cctcgggccgaggcccag

SEQ ID NO: 1517243 - DNA, 16 bp, Homo sapiens
cctcggtatctggctt

SEQ ID NO: 1517244 - DNA, 20 bp, Homo sapiens
cctcggtgggccagagctga

SEQ ID NO: 1517245 - DNA, 18 bp, Homo sapiens
cctcgtccacaggggcag

SEQ ID NO: 1517246 - DNA, 15 bp, Homo sapiens
cctcgtcctccccct

SEQ ID NO: 1517247 - DNA, 21 bp, Homo sapiens
cctcgtcctccccctgccagt

SEQ ID NO: 1517248 - DNA, 14 bp, Homo sapiens
cctcgtcctgtccc

SEQ ID NO: 1517249 - DNA, 22 bp, Homo sapiens
cctcgtgatccgcctgcctctg

SEQ ID NO: 1517250 - DNA, 15 bp, Homo sapiens
cctcgtgatctgccc

SEQ ID NO: 1517251 - DNA, 14 bp, Homo sapiens
cctcgtgccagcag

SEQ ID NO: 1517252 - DNA, 18 bp, Homo sapiens
cctcgtgccagcagcctc

SEQ ID NO: 1517253 - DNA, 19 bp, Homo sapiens
cctcgtgccagcagcctcg

SEQ ID NO: 1517254 - DNA, 20 bp, Homo sapiens
cctcgtgcctgggggagaga

SEQ ID NO: 1517255 - DNA, 12 bp, Homo sapiens
cctcgtgcgccc

SEQ ID NO: 1517256 - DNA, 15 bp, Homo sapiens
cctcgtggccagccc

SEQ ID NO: 1517257 - DNA, 16 bp, Homo sapiens
cctcgtggccagcccg

SEQ ID NO: 1517258 - DNA, 22 bp, Homo sapiens
cctcgtggccagcccggctggt

SEQ ID NO: 1517259 - DNA, 18 bp, Homo sapiens
cctcgtggccttccccag

SEQ ID NO: 1517260 - DNA, 14 bp, Homo sapiens
cctcgttggagagc

SEQ ID NO: 1517261 - DNA, 16 bp, Homo sapiens
cctcgttggagagcag

SEQ ID NO: 1517262 - DNA, 13 bp, Homo sapiens
cctctaaagcaga

SEQ ID NO: 1517263 - DNA, 13 bp, Homo sapiens
acaggaaggcttg

SEQ ID NO: 1517264 - DNA, 21 bp, Homo sapiens
acaggaatccttactgatatt

SEQ ID NO: 1517265 - DNA, 14 bp, Homo sapiens
acaggaatctcaga

SEQ ID NO: 1517266 - DNA, 15 bp, Homo sapiens
acaggacagaatgtg

SEQ ID NO: 1517267 - DNA, 20 bp, Homo sapiens
acaggacagtgcttcagcct

SEQ ID NO: 1517268 - DNA, 13 bp, Homo sapiens
acaggaccctcag

SEQ ID NO: 1517269 - DNA, 14 bp, Homo sapiens
acaggacctctgct

SEQ ID NO: 1517270 - DNA, 15 bp, Homo sapiens
acaggacctctgctt

SEQ ID NO: 1517271 - DNA, 18 bp, Homo sapiens
acaggacttaaaatgaca

SEQ ID NO: 1517272 - DNA, 11 bp, Homo sapiens
acaggagaaat

SEQ ID NO: 1517273 - DNA, 14 bp, Homo sapiens
acaggagaggcagc

SEQ ID NO: 1517274 - DNA, 14 bp, Homo sapiens
acaggagcctagcg

SEQ ID NO: 1517275 - DNA, 13 bp, Homo sapiens
acaggaggcaggc

SEQ ID NO: 1517276 - DNA, 16 bp, Homo sapiens
acaggaggcggcccgg

SEQ ID NO: 1517277 - DNA, 20 bp, Homo sapiens
acaggaggcggcccggccag

SEQ ID NO: 1517278 - DNA, 12 bp, Homo sapiens
acaggagggcca

SEQ ID NO: 1517279 - DNA, 13 bp, Homo sapiens
acaggagggccag

SEQ ID NO: 1517280 - DNA, 17 bp, Homo sapiens
acaggagtgtcctcttc

SEQ ID NO: 1517281 - DNA, 15 bp, Homo sapiens
acaggatgaggacag

SEQ ID NO: 1517282 - DNA, 19 bp, Homo sapiens
acaggcaaaatccttgctt

SEQ ID NO: 1517283 - DNA, 14 bp, Homo sapiens
acaggcaaacattt

SEQ ID NO: 1517284 - DNA, 15 bp, Homo sapiens
acaggcaaacatttt

SEQ ID NO: 1517285 - DNA, 17 bp, Homo sapiens
acaggcaccgagaatgt

SEQ ID NO: 1517286 - DNA, 21 bp, Homo sapiens
acaggcagctggatgagactt

SEQ ID NO: 1517287 - DNA, 12 bp, Homo sapiens
acaggcagtgca

SEQ ID NO: 1517288 - DNA, 12 bp, Homo sapiens
acaggcatcagg

SEQ ID NO: 1517289 - DNA, 14 bp, Homo sapiens
acaggcatcaggaa

SEQ ID NO: 1517290 - DNA, 20 bp, Homo sapiens
acaggcatctacacagcctg

SEQ ID NO: 1517291 - DNA, 21 bp, Homo sapiens
acaggcatctacacagcctgg

SEQ ID NO: 1517292 - DNA, 22 bp, Homo sapiens
acaggcatctacacagcctgga

SEQ ID NO: 1517293 - DNA, 22 bp, Homo sapiens
acaggcatgaggaatctgggag

SEQ ID NO: 1517294 - DNA, 21 bp, Homo sapiens
acaggcatgggtgcaaggaaa

SEQ ID NO: 1517295 - DNA, 17 bp, Homo sapiens
acaggccatgtgagcca

SEQ ID NO: 1517296 - DNA, 18 bp, Homo sapiens
acaggcccaagagatgaa

SEQ ID NO: 1517297 - DNA, 22 bp, Homo sapiens
acaggcccaagagatgaagagt

SEQ ID NO: 1517298 - DNA, 18 bp, Homo sapiens
acaggcccagcattgctg

SEQ ID NO: 1517299 - DNA, 22 bp, Homo sapiens
acaggcccttcctctccactgc

SEQ ID NO: 1517300 - DNA, 17 bp, Homo sapiens
acaggcctgagatttca

SEQ ID NO: 1517301 - DNA, 21 bp, Homo sapiens
acaggcctgagatttcatctg

SEQ ID NO: 1517302 - DNA, 14 bp, Homo sapiens
acaggcggggccca

SEQ ID NO: 1517303 - DNA, 16 bp, Homo sapiens
acaggctatcaacatg

SEQ ID NO: 1517304 - DNA, 14 bp, Homo sapiens
acaggctcaatatt

SEQ ID NO: 1517305 - DNA, 16 bp, Homo sapiens
acaggctctgaggggc

SEQ ID NO: 1517306 - DNA, 19 bp, Homo sapiens
acaggctcttagcagcttc

SEQ ID NO: 1517307 - DNA, 14 bp, Homo sapiens
acaggctgaagaga

SEQ ID NO: 1517308 - DNA, 19 bp, Homo sapiens
acaggctgaagagagggac

SEQ ID NO: 1517309 - DNA, 21 bp, Homo sapiens
acaggctgaagagagggacag

SEQ ID NO: 1517310 - DNA, 15 bp, Homo sapiens
acaggctgagaactc

SEQ ID NO: 1517311 - DNA, 13 bp, Homo sapiens
acaggctgtaatt

SEQ ID NO: 1517312 - DNA, 10 bp, Homo sapiens
cctctccctg

SEQ ID NO: 1517313 - DNA, 22 bp, Homo sapiens
cctctccctgcactccctcctg

SEQ ID NO: 1517314 - DNA, 14 bp, Homo sapiens
cctctccctgccaa

SEQ ID NO: 1517315 - DNA, 13 bp, Homo sapiens
cctctccctggcc

SEQ ID NO: 1517316 - DNA, 23 bp, Homo sapiens
cctctccgactctgcacccgcct

SEQ ID NO: 1517317 - DNA, 13 bp, Homo sapiens
cctctcctgaccc

SEQ ID NO: 1517318 - DNA, 15 bp, Homo sapiens
cctctcctgccctct

SEQ ID NO: 1517319 - DNA, 18 bp, Homo sapiens
cctctcctgccctctgct

SEQ ID NO: 1517320 - DNA, 22 bp, Homo sapiens
cctctcctgccctctgctctgc

SEQ ID NO: 1517321 - DNA, 16 bp, Homo sapiens
cctctcctgccctgtg

SEQ ID NO: 1517322 - DNA, 17 bp, Homo sapiens
cctctcctgccctgtga

SEQ ID NO: 1517323 - DNA, 18 bp, Homo sapiens
cctctcctgccctgtgat

SEQ ID NO: 1517324 - DNA, 14 bp, Homo sapiens
cctctcctgcctac

SEQ ID NO: 1517325 - DNA, 15 bp, Homo sapiens
cctctcctgcctact

SEQ ID NO: 1517326 - DNA, 17 bp, Homo sapiens
cctctcctgcctactca

SEQ ID NO: 1517327 - DNA, 17 bp, Homo sapiens
cctctccttccttaccc

SEQ ID NO: 1517328 - DNA, 14 bp, Homo sapiens
cctctccttgggct

SEQ ID NO: 1517329 - DNA, 17 bp, Homo sapiens
cctctccttttgaggct

SEQ ID NO: 1517330 - DNA, 18 bp, Homo sapiens
cctctcgacggcacgcac

SEQ ID NO: 1517331 - DNA, 23 bp, Homo sapiens
cctctcgacggcacgcacttgcc

SEQ ID NO: 1517332 - DNA, 18 bp, Homo sapiens
cctctcgccatgatcaga

SEQ ID NO: 1517333 - DNA, 16 bp, Homo sapiens
cctctcgcgcccagca

SEQ ID NO: 1517334 - DNA, 17 bp, Homo sapiens
cctctcgcgcccagcat

SEQ ID NO: 1517335 - DNA, 17 bp, Homo sapiens
cctctcggaaggctggc

SEQ ID NO: 1517336 - DNA, 21 bp, Homo sapiens
cctctcggaaggctggctggg

SEQ ID NO: 1517337 - DNA, 18 bp, Homo sapiens
cctctcggtgctccatct

SEQ ID NO: 1517338 - DNA, 18 bp, Homo sapiens
cctctctcccctctgcaa

SEQ ID NO: 1517339 - DNA, 20 bp, Homo sapiens
cctctctctaccagtctatt

SEQ ID NO: 1517340 - DNA, 10 bp, Homo sapiens
cctctctctc

SEQ ID NO: 1517341 - DNA, 15 bp, Homo sapiens
cctctctctcttcct

SEQ ID NO: 1517342 - DNA, 18 bp, Homo sapiens
cctctctctcttctaggc

SEQ ID NO: 1517343 - DNA, 16 bp, Homo sapiens
cctctctctgaggaca

SEQ ID NO: 1517344 - DNA, 14 bp, Homo sapiens
cctctctctgcctg

SEQ ID NO: 1517345 - DNA, 15 bp, Homo sapiens
cctctctctgcctga

SEQ ID NO: 1517346 - DNA, 13 bp, Homo sapiens
cctctctctgtgg

SEQ ID NO: 1517347 - DNA, 16 bp, Homo sapiens
cctctctcttctgctc

SEQ ID NO: 1517348 - DNA, 18 bp, Homo sapiens
cctctctcttctgctcca

SEQ ID NO: 1517349 - DNA, 20 bp, Homo sapiens
cctctctcttctgctccacc

SEQ ID NO: 1517350 - DNA, 21 bp, Homo sapiens
cctctctcttctgctccaccc

SEQ ID NO: 1517351 - DNA, 20 bp, Homo sapiens
cctctctctttcctccaccc

SEQ ID NO: 1517352 - DNA, 23 bp, Homo sapiens
cctctctctttcctccacccata

SEQ ID NO: 1517353 - DNA, 17 bp, Homo sapiens
cctctctgcagacttcc

SEQ ID NO: 1517354 - DNA, 21 bp, Homo sapiens
cctctctgcagacttcccagc

SEQ ID NO: 1517355 - DNA, 15 bp, Homo sapiens
cctctctggcctccc

SEQ ID NO: 1517356 - DNA, 18 bp, Homo sapiens
cctctctggcctcccacc

SEQ ID NO: 1517357 - DNA, 19 bp, Homo sapiens
cctctctggcctcccaccc

SEQ ID NO: 1517358 - DNA, 22 bp, Homo sapiens
cctctctggtttcctatttgca

SEQ ID NO: 1517359 - DNA, 23 bp, Homo sapiens
cctctctggtttcctatttgcag

SEQ ID NO: 1517360 - DNA, 19 bp, Homo sapiens
cctctctgtagtttatggc

SEQ ID NO: 1517361 - DNA, 20 bp, Homo sapiens
cctctcttatagaatattta

SEQ ID NO: 1517362 - DNA, 13 bp, Homo sapiens
cctctcttcagcc

SEQ ID NO: 1517363 - DNA, 20 bp, Homo sapiens
cctctcttccccttccctta

SEQ ID NO: 1517364 - DNA, 21 bp, Homo sapiens
cctctcttccccttcccttat

SEQ ID NO: 1517365 - DNA, 11 bp, Homo sapiens
cctctcttcct

SEQ ID NO: 1517366 - DNA, 17 bp, Homo sapiens
cctctcttgcacccgcc

SEQ ID NO: 1517367 - DNA, 18 bp, Homo sapiens
cctctcttgcacccgcct

SEQ ID NO: 1517368 - DNA, 18 bp, Homo sapiens
cctctcttggtttccttc

SEQ ID NO: 1517369 - DNA, 11 bp, Homo sapiens
cctctgaaaat

SEQ ID NO: 1517370 - DNA, 22 bp, Homo sapiens
cctctgaaaatatttttttcta

SEQ ID NO: 1517371 - DNA, 15 bp, Homo sapiens
cctctgaacttgcct

SEQ ID NO: 1517372 - DNA, 15 bp, Homo sapiens
cctctgacagtccac

SEQ ID NO: 1517373 - DNA, 19 bp, Homo sapiens
cctctgacagtccacaggg

SEQ ID NO: 1517374 - DNA, 13 bp, Homo sapiens
cctctgaccaaca

SEQ ID NO: 1517375 - DNA, 18 bp, Homo sapiens
cctctgaccaacaggctg

SEQ ID NO: 1517376 - DNA, 22 bp, Homo sapiens
cctctgaccctagctctttcct

SEQ ID NO: 1517377 - DNA, 14 bp, Homo sapiens
cctctgacctgcac

SEQ ID NO: 1517378 - DNA, 17 bp, Homo sapiens
cctctgacctgcactgg

SEQ ID NO: 1517379 - DNA, 19 bp, Homo sapiens
cctctgacctgcaggccaa

SEQ ID NO: 1517380 - DNA, 15 bp, Homo sapiens
cctctgagcagcctc

SEQ ID NO: 1517381 - DNA, 14 bp, Homo sapiens
cctctgatacctca

SEQ ID NO: 1517382 - DNA, 16 bp, Homo sapiens
acagtaggaattggaa

SEQ ID NO: 1517383 - DNA, 18 bp, Homo sapiens
acagtaggtcccggccag

SEQ ID NO: 1517384 - DNA, 19 bp, Homo sapiens
acagtaggtcccggccagc

SEQ ID NO: 1517385 - DNA, 20 bp, Homo sapiens
acagtaggtcccggccagct

SEQ ID NO: 1517386 - DNA, 23 bp, Homo sapiens
acagtagttagaattatatcact

SEQ ID NO: 1517387 - DNA, 16 bp, Homo sapiens
acagtatagatttttg

SEQ ID NO: 1517388 - DNA, 22 bp, Homo sapiens
acagtatatcccaagtgcactt

SEQ ID NO: 1517389 - DNA, 18 bp, Homo sapiens
acagtatattctttggtt

SEQ ID NO: 1517390 - DNA, 15 bp, Homo sapiens
acagtatatttgaaa

SEQ ID NO: 1517391 - DNA, 19 bp, Homo sapiens
acagtatcgtttgtttatg

SEQ ID NO: 1517392 - DNA, 16 bp, Homo sapiens
acagtatgagaagaaa

SEQ ID NO: 1517393 - DNA, 16 bp, Homo sapiens
acagtatgatgaaaat

SEQ ID NO: 1517394 - DNA, 17 bp, Homo sapiens
acagtatgatgaaaata

SEQ ID NO: 1517395 - DNA, 15 bp, Homo sapiens
acagtattatagaca

SEQ ID NO: 1517396 - DNA, 14 bp, Homo sapiens
acagtatttgtaat

SEQ ID NO: 1517397 - DNA, 17 bp, Homo sapiens
acagtatttgtaattaa

SEQ ID NO: 1517398 - DNA, 18 bp, Homo sapiens
acagtcaaaacagagatg

SEQ ID NO: 1517399 - DNA, 18 bp, Homo sapiens
acagtcactgatgtacaa

SEQ ID NO: 1517400 - DNA, 20 bp, Homo sapiens
acagtcagtggagagatgtt

SEQ ID NO: 1517401 - DNA, 18 bp, Homo sapiens
acagtcattctaggatgt

SEQ ID NO: 1517402 - DNA, 21 bp, Homo sapiens
acagtcattggaataaggcat

SEQ ID NO: 1517403 - DNA, 14 bp, Homo sapiens
acagtcatttaaaa

SEQ ID NO: 1517404 - DNA, 14 bp, Homo sapiens
acagtccaaccaga

SEQ ID NO: 1517405 - DNA, 16 bp, Homo sapiens
acagtccacaggggcc

SEQ ID NO: 1517406 - DNA, 22 bp, Homo sapiens
acagtccacaggggccaccacc

SEQ ID NO: 1517407 - DNA, 23 bp, Homo sapiens
acagtcctgggagaacctcaggc

SEQ ID NO: 1517408 - DNA, 18 bp, Homo sapiens
acagtccttaaaaatcac

SEQ ID NO: 1517409 - DNA, 20 bp, Homo sapiens
acagtctacattgagcattt

SEQ ID NO: 1517410 - DNA, 13 bp, Homo sapiens
acagtctcaggaa

SEQ ID NO: 1517411 - DNA, 14 bp, Homo sapiens
acagtctcaggaaa

SEQ ID NO: 1517412 - DNA, 14 bp, Homo sapiens
acagtctctggaaa

SEQ ID NO: 1517413 - DNA, 15 bp, Homo sapiens
acagtctctggaaaa

SEQ ID NO: 1517414 - DNA, 16 bp, Homo sapiens
acagtctggagaaggt

SEQ ID NO: 1517415 - DNA, 15 bp, Homo sapiens
acagtctgttatgca

SEQ ID NO: 1517416 - DNA, 18 bp, Homo sapiens
acagtctgttatgcactg

SEQ ID NO: 1517417 - DNA, 14 bp, Homo sapiens
acagtgaagcaaat

SEQ ID NO: 1517418 - DNA, 20 bp, Homo sapiens
acagtgaagcagcactgtga

SEQ ID NO: 1517419 - DNA, 16 bp, Homo sapiens
acagtgaatgtgtctg

SEQ ID NO: 1517420 - DNA, 16 bp, Homo sapiens
acagtgaattgtcttt

SEQ ID NO: 1517421 - DNA, 21 bp, Homo sapiens
acagtgacactggaccaggtc

SEQ ID NO: 1517422 - DNA, 14 bp, Homo sapiens
acagtgacccttcc

SEQ ID NO: 1517423 - DNA, 15 bp, Homo sapiens
acagtgacttctgag

SEQ ID NO: 1517424 - DNA, 12 bp, Homo sapiens
acagtgagcctg

SEQ ID NO: 1517425 - DNA, 18 bp, Homo sapiens
acagtgagcctgaatttt

SEQ ID NO: 1517426 - DNA, 13 bp, Homo sapiens
acagtgagctcta

SEQ ID NO: 1517427 - DNA, 23 bp, Homo sapiens
cctctgctgctgcccggggtggg

SEQ ID NO: 1517428 - DNA, 20 bp, Homo sapiens
cctctgctgtcctgcagtag

SEQ ID NO: 1517429 - DNA, 12 bp, Homo sapiens
cctctgcttctc

SEQ ID NO: 1517430 - DNA, 21 bp, Homo sapiens
cctctggacggcaggctcact

SEQ ID NO: 1517431 - DNA, 23 bp, Homo sapiens
cctctggacggcaggctcactgc

SEQ ID NO: 1517432 - DNA, 15 bp, Homo sapiens
cctctggactggcta

SEQ ID NO: 1517433 - DNA, 16 bp, Homo sapiens
cctctggactggctag

SEQ ID NO: 1517434 - DNA, 17 bp, Homo sapiens
cctctggactggctaga

SEQ ID NO: 1517435 - DNA, 12 bp, Homo sapiens
cctctggccagg

SEQ ID NO: 1517436 - DNA, 17 bp, Homo sapiens
cctctggctagagccga

SEQ ID NO: 1517437 - DNA, 24 bp, Homo sapiens
cctctggctagaggccagccccac

SEQ ID NO: 1517438 - DNA, 22 bp, Homo sapiens
cctctggctggctaactggaag

SEQ ID NO: 1517439 - DNA, 19 bp, Homo sapiens
cctctgggcagtgtggcct

SEQ ID NO: 1517440 - DNA, 14 bp, Homo sapiens
cctctgggcctgtt

SEQ ID NO: 1517441 - DNA, 17 bp, Homo sapiens
cctctgggcctgttctc

SEQ ID NO: 1517442 - DNA, 21 bp, Homo sapiens
cctctgggggtcctctctgag

SEQ ID NO: 1517443 - DNA, 23 bp, Homo sapiens
cctctgggggtcctctctgagtc

SEQ ID NO: 1517444 - DNA, 21 bp, Homo sapiens
cctctggtcgctcctgcccac

SEQ ID NO: 1517445 - DNA, 22 bp, Homo sapiens
cctctggtggctcctcctagga

SEQ ID NO: 1517446 - DNA, 20 bp, Homo sapiens
cctctggtgtgtggtgaggg

SEQ ID NO: 1517447 - DNA, 21 bp, Homo sapiens
cctctgtagctccctcctccc

SEQ ID NO: 1517448 - DNA, 15 bp, Homo sapiens
cctctgtaggcagca

SEQ ID NO: 1517449 - DNA, 18 bp, Homo sapiens
cctctgtaggcagcagag

SEQ ID NO: 1517450 - DNA, 19 bp, Homo sapiens
cctctgtcatcactccctg

SEQ ID NO: 1517451 - DNA, 21 bp, Homo sapiens
cctctgtcatcactccctgga

SEQ ID NO: 1517452 - DNA, 12 bp, Homo sapiens
cctctgtccaca

SEQ ID NO: 1517453 - DNA, 21 bp, Homo sapiens
cctctgtccagggccctgagc

SEQ ID NO: 1517454 - DNA, 23 bp, Homo sapiens
cctctgtccagggccctgagctc

SEQ ID NO: 1517455 - DNA, 17 bp, Homo sapiens
cctctgtccccttctct

SEQ ID NO: 1517456 - DNA, 19 bp, Homo sapiens
cctctgtccccttctctca

SEQ ID NO: 1517457 - DNA, 21 bp, Homo sapiens
cctctgtccccttctctcatc

SEQ ID NO: 1517458 - DNA, 17 bp, Homo sapiens
cctctgtgcacagtggc

SEQ ID NO: 1517459 - DNA, 19 bp, Homo sapiens
cctctgtgcacagtggctt

SEQ ID NO: 1517460 - DNA, 16 bp, Homo sapiens
cctctgtgctgtgtgt

SEQ ID NO: 1517461 - DNA, 18 bp, Homo sapiens
cctctgtgtagccgccct

SEQ ID NO: 1517462 - DNA, 18 bp, Homo sapiens
cctctgtgtatttgcttt

SEQ ID NO: 1517463 - DNA, 22 bp, Homo sapiens
cctctgttcctttctctgggct

SEQ ID NO: 1517464 - DNA, 14 bp, Homo sapiens
cctcttaaattata

SEQ ID NO: 1517465 - DNA, 22 bp, Homo sapiens
cctcttaccttcccgcctcggc

SEQ ID NO: 1517466 - DNA, 20 bp, Homo sapiens
cctcttcattccggggaaca

SEQ ID NO: 1517467 - DNA, 12 bp, Homo sapiens
cctcttccagtc

SEQ ID NO: 1517468 - DNA, 15 bp, Homo sapiens
cctcttccagtgaac

SEQ ID NO: 1517469 - DNA, 23 bp, Homo sapiens
cctcttcccatgtcccaccctcc

SEQ ID NO: 1517470 - DNA, 12 bp, Homo sapiens
cctcttccccac

SEQ ID NO: 1517471 - DNA, 15 bp, Homo sapiens
cctcttccctctccc

SEQ ID NO: 1517472 - DNA, 19 bp, Homo sapiens
cctcttccctctccctctc

SEQ ID NO: 1517473 - DNA, 14 bp, Homo sapiens
cctcttccctctgg

SEQ ID NO: 1517474 - DNA, 18 bp, Homo sapiens
cctcttccgtgacgtcac

SEQ ID NO: 1517475 - DNA, 13 bp, Homo sapiens
cctcttcctgccc

SEQ ID NO: 1517476 - DNA, 15 bp, Homo sapiens
cctcttcctgccctt

SEQ ID NO: 1517477 - DNA, 18 bp, Homo sapiens
cctcttctattttgtaaa

SEQ ID NO: 1517478 - DNA, 19 bp, Homo sapiens
cctcttctcgtgcctcccc

SEQ ID NO: 1517479 - DNA, 17 bp, Homo sapiens
cctcttctgctcttttc

SEQ ID NO: 1517480 - DNA, 12 bp, Homo sapiens
cctcttctttgt

SEQ ID NO: 1517481 - DNA, 20 bp, Homo sapiens
cctcttctttgtgcctttgg

SEQ ID NO: 1517482 - DNA, 22 bp, Homo sapiens
cctcttctttgtgcctttggcc

SEQ ID NO: 1517483 - DNA, 23 bp, Homo sapiens
cctcttctttgtgcctttggcct

SEQ ID NO: 1517484 - DNA, 13 bp, Homo sapiens
cctcttgcccgca

SEQ ID NO: 1517485 - DNA, 17 bp, Homo sapiens
cctcttgcgggcctgga

SEQ ID NO: 1517486 - DNA, 18 bp, Homo sapiens
cctcttgctcagagctag

SEQ ID NO: 1517487 - DNA, 20 bp, Homo sapiens
cctcttggagaagtctcagc

SEQ ID NO: 1517488 - DNA, 20 bp, Homo sapiens
cctcttggctatttctgtgt

SEQ ID NO: 1517489 - DNA, 17 bp, Homo sapiens
cctcttgtcctggccct

SEQ ID NO: 1517490 - DNA, 14 bp, Homo sapiens
cctcttgtctgatt

SEQ ID NO: 1517491 - DNA, 22 bp, Homo sapiens
cctcttgtcttcctatttcaga

SEQ ID NO: 1517492 - DNA, 21 bp, Homo sapiens
cctcttgtgtaactaatttgt

SEQ ID NO: 1517493 - DNA, 15 bp, Homo sapiens
cctcttgttgcagag

SEQ ID NO: 1517494 - DNA, 14 bp, Homo sapiens
cctctttcctctgt

SEQ ID NO: 1517495 - DNA, 22 bp, Homo sapiens
cctctttccttccttcctcctt

SEQ ID NO: 1517496 - DNA, 22 bp, Homo sapiens
cctctttctgctctgccatctt

SEQ ID NO: 1517497 - DNA, 18 bp, Homo sapiens
cctctttgggcagtgcca

SEQ ID NO: 1517498 - DNA, 14 bp, Homo sapiens
cctcttttcctgct

SEQ ID NO: 1517499 - DNA, 14 bp, Homo sapiens
cctcttttgagact

SEQ ID NO: 1517500 - DNA, 17 bp, Homo sapiens
ctaaatacaacactgat

SEQ ID NO: 1517501 - DNA, 23 bp, Homo sapiens
ctaaatactttaaaatttgtcct

SEQ ID NO: 1517502 - DNA, 19 bp, Homo sapiens
ctaaatatacatctgtgta

SEQ ID NO: 1517503 - DNA, 15 bp, Homo sapiens
ctaaatcagagacaa

SEQ ID NO: 1517504 - DNA, 19 bp, Homo sapiens
ctaaatcagagacaaaata

SEQ ID NO: 1517505 - DNA, 11 bp, Homo sapiens
ctaaatccaaa

SEQ ID NO: 1517506 - DNA, 17 bp, Homo sapiens
ctaaatcctttactgtt

SEQ ID NO: 1517507 - DNA, 20 bp, Homo sapiens
ctaaatccttttgttttgaa

SEQ ID NO: 1517508 - DNA, 21 bp, Homo sapiens
ctaaatctatttattaatatt

SEQ ID NO: 1517509 - DNA, 15 bp, Homo sapiens
ctaaatcttccttgt

SEQ ID NO: 1517510 - DNA, 17 bp, Homo sapiens
ctaaatcttccttgtga

SEQ ID NO: 1517511 - DNA, 15 bp, Homo sapiens
ctaaatgaatgttta

SEQ ID NO: 1517512 - DNA, 16 bp, Homo sapiens
ctaaatgcaccaagaa

SEQ ID NO: 1517513 - DNA, 22 bp, Homo sapiens
ctaaatgcatatcctgagccat

SEQ ID NO: 1517514 - DNA, 18 bp, Homo sapiens
ctaaatggtcgcccagga

SEQ ID NO: 1517515 - DNA, 19 bp, Homo sapiens
ctaaatggtcgcccaggag

SEQ ID NO: 1517516 - DNA, 21 bp, Homo sapiens
ctaaatggtcgcccaggagac

SEQ ID NO: 1517517 - DNA, 17 bp, Homo sapiens
ctaaatgtaaaatttgg

SEQ ID NO: 1517518 - DNA, 18 bp, Homo sapiens
ctaaatgtgcaatagaag

SEQ ID NO: 1517519 - DNA, 21 bp, Homo sapiens
ctaaatgtgcaatagaaggtg

SEQ ID NO: 1517520 - DNA, 22 bp, Homo sapiens
ctaaattattagcatttgtttt

SEQ ID NO: 1517521 - DNA, 13 bp, Homo sapiens
ctaaattgattga

SEQ ID NO: 1517522 - DNA, 16 bp, Homo sapiens
ctaaattttaaagcca

SEQ ID NO: 1517523 - DNA, 17 bp, Homo sapiens
ctaaattttaaagccat

SEQ ID NO: 1517524 - DNA, 15 bp, Homo sapiens
ctaaattttatatct

SEQ ID NO: 1517525 - DNA, 20 bp, Homo sapiens
ctaaattttatatcttgtag

SEQ ID NO: 1517526 - DNA, 13 bp, Homo sapiens
ctaacaaaagaac

SEQ ID NO: 1517527 - DNA, 18 bp, Homo sapiens
ctaacaaaagaactaaga

SEQ ID NO: 1517528 - DNA, 12 bp, Homo sapiens
ctaacaaaataa

SEQ ID NO: 1517529 - DNA, 13 bp, Homo sapiens
ctaacaaaataag

SEQ ID NO: 1517530 - DNA, 13 bp, Homo sapiens
ctaacaaaatgag

SEQ ID NO: 1517531 - DNA, 15 bp, Homo sapiens
ctaacaaaatgagat

SEQ ID NO: 1517532 - DNA, 18 bp, Homo sapiens
ctaacaagaatgtaactc

SEQ ID NO: 1517533 - DNA, 15 bp, Homo sapiens
ctaacaataatattt

SEQ ID NO: 1517534 - DNA, 22 bp, Homo sapiens
ctaacaataatatttcaagtgc

SEQ ID NO: 1517535 - DNA, 14 bp, Homo sapiens
ctaacacagcatgt

SEQ ID NO: 1517536 - DNA, 23 bp, Homo sapiens
ctaacacggtgctcattttttct

SEQ ID NO: 1517537 - DNA, 22 bp, Homo sapiens
ctaacagccctcctctgcactc

SEQ ID NO: 1517538 - DNA, 12 bp, Homo sapiens
ctaacagggaga

SEQ ID NO: 1517539 - DNA, 17 bp, Homo sapiens
ctaacagtccttgcttt

SEQ ID NO: 1517540 - DNA, 20 bp, Homo sapiens
ctaacatagtgtctgctgct

SEQ ID NO: 1517541 - DNA, 23 bp, Homo sapiens
ctaacatataatgttgttattta

SEQ ID NO: 1517542 - DNA, 23 bp, Homo sapiens
ctaacatccttggactgagaaat

SEQ ID NO: 1517543 - DNA, 10 bp, Homo sapiens
ctaaccaagt

SEQ ID NO: 1517544 - DNA, 12 bp, Homo sapiens
ctaaccaagttc

SEQ ID NO: 1517545 - DNA, 13 bp, Homo sapiens
ctaaccatcccca

SEQ ID NO: 1517546 - DNA, 16 bp, Homo sapiens
ctaaccatccccaact

SEQ ID NO: 1517547 - DNA, 16 bp, Homo sapiens
ctaacccaatgcctgt

SEQ ID NO: 1517548 - DNA, 18 bp, Homo sapiens
ctaaccccttacccatct

SEQ ID NO: 1517549 - DNA, 13 bp, Homo sapiens
ctaacccctttcc

SEQ ID NO: 1517550 - DNA, 13 bp, Homo sapiens
ctaacctgacaga

SEQ ID NO: 1517551 - DNA, 21 bp, Homo sapiens
ctaacctgttacactgggctg

SEQ ID NO: 1517552 - DNA, 23 bp, Homo sapiens
ctaacctgttacactgggctggg

SEQ ID NO: 1517553 - DNA, 19 bp, Homo sapiens
ctaaccttgaatgctgcca

SEQ ID NO: 1517554 - DNA, 15 bp, Homo sapiens
ctaactaaataccat

SEQ ID NO: 1517555 - DNA, 15 bp, Homo sapiens
ctaactaactggcag

SEQ ID NO: 1517556 - DNA, 21 bp, Homo sapiens
ctaactagaattagtatgtct

SEQ ID NO: 1517557 - DNA, 15 bp, Homo sapiens
ctaactagacaccaa

SEQ ID NO: 1517558 - DNA, 14 bp, Homo sapiens
ctaactcaaataca

SEQ ID NO: 1517559 - DNA, 16 bp, Homo sapiens
ctaactcaaatacaca

SEQ ID NO: 1517560 - DNA, 21 bp, Homo sapiens
ctaactcaccagccccactgc

SEQ ID NO: 1517561 - DNA, 15 bp, Homo sapiens
ctaactcactgccta

SEQ ID NO: 1517562 - DNA, 17 bp, Homo sapiens
ctaactcactgcctagg

SEQ ID NO: 1517563 - DNA, 14 bp, Homo sapiens
ctaactccgagagc

SEQ ID NO: 1517564 - DNA, 22 bp, Homo sapiens
ctaactcctgccattcttctgg

SEQ ID NO: 1517565 - DNA, 18 bp, Homo sapiens
ctaactccttaacaactg

SEQ ID NO: 1517566 - DNA, 15 bp, Homo sapiens
ctaactggacatgaa

SEQ ID NO: 1517567 - DNA, 18 bp, Homo sapiens
ctaactggacatgaagga

SEQ ID NO: 1517568 - DNA, 16 bp, Homo sapiens
ctaactgggttaaata

SEQ ID NO: 1517569 - DNA, 23 bp, Homo sapiens
ctaactgggttaaatattttgct

SEQ ID NO: 1517570 - DNA, 23 bp, Homo sapiens
ctaactggtaaaaagatccaggg

SEQ ID NO: 1517571 - DNA, 22 bp, Homo sapiens
ctaacttggagccccagtgcca

SEQ ID NO: 1517572 - DNA, 21 bp, Homo sapiens
ctaacttttataggttatcaa

SEQ ID NO: 1517573 - DNA, 19 bp, Homo sapiens
ctaacttttcaatgacatt

SEQ ID NO: 1517574 - DNA, 19 bp, Homo sapiens
ctaagaaagaggagtgctt

SEQ ID NO: 1517575 - DNA, 21 bp, Homo sapiens
ctaagaaagaggagtgcttgt

SEQ ID NO: 1517576 - DNA, 14 bp, Homo sapiens
ctaagaacctggaa

SEQ ID NO: 1517577 - DNA, 16 bp, Homo sapiens
ctaagaacctggaact

SEQ ID NO: 1517578 - DNA, 13 bp, Homo sapiens
ctaagaagacatt

SEQ ID NO: 1517579 - DNA, 15 bp, Homo sapiens
ctaagaagctctggc

SEQ ID NO: 1517580 - DNA, 13 bp, Homo sapiens
ctaagaataaata

SEQ ID NO: 1517581 - DNA, 21 bp, Homo sapiens
ctaagaataaataaagaagaa

SEQ ID NO: 1517582 - DNA, 23 bp, Homo sapiens
ctaagaatgcagacttttcagac

SEQ ID NO: 1517583 - DNA, 13 bp, Homo sapiens
ctaagacagagga

SEQ ID NO: 1517584 - DNA, 15 bp, Homo sapiens
ctaagacagaggaac

SEQ ID NO: 1517585 - DNA, 23 bp, Homo sapiens
ctaagacatgtgaggaggaaaag

SEQ ID NO: 1517586 - DNA, 19 bp, Homo sapiens
ctaagaccctgtgtcctcc

SEQ ID NO: 1517587 - DNA, 13 bp, Homo sapiens
ctaagactatata

SEQ ID NO: 1517588 - DNA, 13 bp, Homo sapiens
ctaagactcaaat

SEQ ID NO: 1517589 - DNA, 16 bp, Homo sapiens
ctaagactcaaatgtt

SEQ ID NO: 1517590 - DNA, 18 bp, Homo sapiens
ctaagacttactctaaga

SEQ ID NO: 1517591 - DNA, 15 bp, Homo sapiens
ctaagagaaactgtg

SEQ ID NO: 1517592 - DNA, 11 bp, Homo sapiens
ctaagagaagt

SEQ ID NO: 1517593 - DNA, 22 bp, Homo sapiens
ctaagagaagttattttctaca

SEQ ID NO: 1517594 - DNA, 11 bp, Homo sapiens
ctaagagccat

SEQ ID NO: 1517595 - DNA, 16 bp, Homo sapiens
ctaagagctagcgctg

SEQ ID NO: 1517596 - DNA, 20 bp, Homo sapiens
ctaagagctagcgctgccgc

SEQ ID NO: 1517597 - DNA, 18 bp, Homo sapiens
ctaagagtggaggaggag

SEQ ID NO: 1517598 - DNA, 15 bp, Homo sapiens
ctaagatagaaagct

SEQ ID NO: 1517599 - DNA, 18 bp, Homo sapiens
ctaagatagaaagctgga

SEQ ID NO: 1517600 - DNA, 22 bp, Homo sapiens
ctaagatagaaagctggactga

SEQ ID NO: 1517601 - DNA, 16 bp, Homo sapiens
ctaagatagtaacaat

SEQ ID NO: 1517602 - DNA, 18 bp, Homo sapiens
ctaagatatacttgtttt

SEQ ID NO: 1517603 - DNA, 22 bp, Homo sapiens
ctaagatatacttgtttttgta

SEQ ID NO: 1517604 - DNA, 16 bp, Homo sapiens
ctaagatcttagattc

SEQ ID NO: 1517605 - DNA, 20 bp, Homo sapiens
ctaagatgagatttgccagc

SEQ ID NO: 1517606 - DNA, 20 bp, Homo sapiens
ctaagatgtgttcttatttt

SEQ ID NO: 1517607 - DNA, 21 bp, Homo sapiens
ctaagattacaaatcagaagt

SEQ ID NO: 1517608 - DNA, 22 bp, Homo sapiens
ctaagattacaaatcagaagtc

SEQ ID NO: 1517609 - DNA, 23 bp, Homo sapiens
ctaagattacaaatcagaagtca

SEQ ID NO: 1517610 - DNA, 15 bp, Homo sapiens
ctaagattctaaagg

SEQ ID NO: 1517611 - DNA, 13 bp, Homo sapiens
ctaagattctaat

SEQ ID NO: 1517612 - DNA, 12 bp, Homo sapiens
ctaagattctag

SEQ ID NO: 1517613 - DNA, 14 bp, Homo sapiens
ctaagattctagat

SEQ ID NO: 1517614 - DNA, 16 bp, Homo sapiens
ctaagattctagatca

SEQ ID NO: 1517615 - DNA, 22 bp, Homo sapiens
ctaagattctagatcagatgct

SEQ ID NO: 1517616 - DNA, 16 bp, Homo sapiens
ctaagcaactaggcct

SEQ ID NO: 1517617 - DNA, 23 bp, Homo sapiens
accgtcatggcttaatgtttatt

SEQ ID NO: 1517618 - DNA, 16 bp, Homo sapiens
accgtccgccctgctc

SEQ ID NO: 1517619 - DNA, 22 bp, Homo sapiens
accgtgagcgccccgcccccac

SEQ ID NO: 1517620 - DNA, 13 bp, Homo sapiens
accgtggacaggc

SEQ ID NO: 1517621 - DNA, 15 bp, Homo sapiens
accgtggacaggccc

SEQ ID NO: 1517622 - DNA, 16 bp, Homo sapiens
accgtggacaggccca

SEQ ID NO: 1517623 - DNA, 18 bp, Homo sapiens
accgtggacaggcccagc

SEQ ID NO: 1517624 - DNA, 14 bp, Homo sapiens
accgtggatctcct

SEQ ID NO: 1517625 - DNA, 15 bp, Homo sapiens
accgtggatctcctt

SEQ ID NO: 1517626 - DNA, 17 bp, Homo sapiens
accgtggatctccttcc

SEQ ID NO: 1517627 - DNA, 19 bp, Homo sapiens
accgtggatctccttccct

SEQ ID NO: 1517628 - DNA, 20 bp, Homo sapiens
accgtggatctccttccctt

SEQ ID NO: 1517629 - DNA, 20 bp, Homo sapiens
accgtggccctgccctctcc

SEQ ID NO: 1517630 - DNA, 20 bp, Homo sapiens
accgtggtatgtctgccatg

SEQ ID NO: 1517631 - DNA, 14 bp, Homo sapiens
accgtgtcaagctg

SEQ ID NO: 1517632 - DNA, 14 bp, Homo sapiens
accgtgtccagcac

SEQ ID NO: 1517633 - DNA, 16 bp, Homo sapiens
accgtgtccagcacag

SEQ ID NO: 1517634 - DNA, 20 bp, Homo sapiens
accgtgttagccaggatggt

SEQ ID NO: 1517635 - DNA, 23 bp, Homo sapiens
accgttaggattcaggcagcagt

SEQ ID NO: 1517636 - DNA, 17 bp, Homo sapiens
accgtttagaaaaaaca

SEQ ID NO: 1517637 - DNA, 21 bp, Homo sapiens
acctaaaaggaaatctcaccc

SEQ ID NO: 1517638 - DNA, 22 bp, Homo sapiens
acctaaaaggaaatctcacccc

SEQ ID NO: 1517639 - DNA, 21 bp, Homo sapiens
acctaaatccattttctaaac

SEQ ID NO: 1517640 - DNA, 15 bp, Homo sapiens
acctaaatggcctca

SEQ ID NO: 1517641 - DNA, 21 bp, Homo sapiens
acctaagattacaaatcagaa

SEQ ID NO: 1517642 - DNA, 18 bp, Homo sapiens
acctaagccctgccccgg

SEQ ID NO: 1517643 - DNA, 15 bp, Homo sapiens
acctaatatcactta

SEQ ID NO: 1517644 - DNA, 20 bp, Homo sapiens
acctaatcaccatgtaagca

SEQ ID NO: 1517645 - DNA, 20 bp, Homo sapiens
acctaatgtttatgagccag

SEQ ID NO: 1517646 - DNA, 14 bp, Homo sapiens
acctaattgtggat

SEQ ID NO: 1517647 - DNA, 15 bp, Homo sapiens
acctacagacctggc

SEQ ID NO: 1517648 - DNA, 21 bp, Homo sapiens
acctacagactccatctcttc

SEQ ID NO: 1517649 - DNA, 11 bp, Homo sapiens
acctacagttt

SEQ ID NO: 1517650 - DNA, 17 bp, Homo sapiens
acctaccagttggccat

SEQ ID NO: 1517651 - DNA, 16 bp, Homo sapiens
acctaccatgctgctt

SEQ ID NO: 1517652 - DNA, 18 bp, Homo sapiens
acctaccccagccaggct

SEQ ID NO: 1517653 - DNA, 15 bp, Homo sapiens
acctactgttctaaa

SEQ ID NO: 1517654 - DNA, 16 bp, Homo sapiens
acctactgttctaaag

SEQ ID NO: 1517655 - DNA, 17 bp, Homo sapiens
acctactgttctaaagc

SEQ ID NO: 1517656 - DNA, 20 bp, Homo sapiens
acctactgttctaaagctct

SEQ ID NO: 1517657 - DNA, 20 bp, Homo sapiens
acctactttgactttttgca

SEQ ID NO: 1517658 - DNA, 21 bp, Homo sapiens
acctagaacgtgcatccttgt

SEQ ID NO: 1517659 - DNA, 18 bp, Homo sapiens
acctagaagtaagaagag

SEQ ID NO: 1517660 - DNA, 15 bp, Homo sapiens
acctagaagtctccc

SEQ ID NO: 1517661 - DNA, 17 bp, Homo sapiens
acctagaagtctccctg

SEQ ID NO: 1517662 - DNA, 15 bp, Homo sapiens
acctagaatgtcaga

SEQ ID NO: 1517663 - DNA, 22 bp, Homo sapiens
acctagagaacaggtggttttt

SEQ ID NO: 1517664 - DNA, 22 bp, Homo sapiens
acctagatgtttaacaaatcta

SEQ ID NO: 1517665 - DNA, 17 bp, Homo sapiens
acctaggccactcctcc

SEQ ID NO: 1517666 - DNA, 20 bp, Homo sapiens
acctagtactctctgctcta

SEQ ID NO: 1517667 - DNA, 21 bp, Homo sapiens
acctagtactctctgctctag

SEQ ID NO: 1517668 - DNA, 23 bp, Homo sapiens
acctagtactctctgctctagcc

SEQ ID NO: 1517669 - DNA, 18 bp, Homo sapiens
acctagttaaagaaagga

SEQ ID NO: 1517670 - DNA, 22 bp, Homo sapiens
acctagttaaagaaaggaaaag

SEQ ID NO: 1517671 - DNA, 14 bp, Homo sapiens
acctagttttccat

SEQ ID NO: 1517672 - DNA, 16 bp, Homo sapiens
acctatacaatgtatg

SEQ ID NO: 1517673 - DNA, 18 bp, Homo sapiens
acctatacaatgtatgta

SEQ ID NO: 1517674 - DNA, 22 bp, Homo sapiens
acctatacaatgtatgtaattt

SEQ ID NO: 1517675 - DNA, 15 bp, Homo sapiens
acctatagtcccagc

SEQ ID NO: 1517676 - DNA, 17 bp, Homo sapiens
acctatcccacctccat

SEQ ID NO: 1517677 - DNA, 14 bp, Homo sapiens
acctatctgtggaa

SEQ ID NO: 1517678 - DNA, 17 bp, Homo sapiens
acctatgagtgagaata

SEQ ID NO: 1517679 - DNA, 13 bp, Homo sapiens
acctatgccagtg

SEQ ID NO: 1517680 - DNA, 22 bp, Homo sapiens
acctatggtataatggttgact

SEQ ID NO: 1517681 - DNA, 23 bp, Homo sapiens
acctatgtcctaaggacacacta

SEQ ID NO: 1517682 - DNA, 17 bp, Homo sapiens
acctattcaccctccac

SEQ ID NO: 1517683 - DNA, 19 bp, Homo sapiens
acctattcaccctccactt

SEQ ID NO: 1517684 - DNA, 16 bp, Homo sapiens
acctatttccagaaat

SEQ ID NO: 1517685 - DNA, 17 bp, Homo sapiens
acctatttccagaaata

SEQ ID NO: 1517686 - DNA, 18 bp, Homo sapiens
acctattttcatttgtac

SEQ ID NO: 1517687 - DNA, 15 bp, Homo sapiens
acctcaaagggcagt

SEQ ID NO: 1517688 - DNA, 21 bp, Homo sapiens
acctcaaccatcctggctgcg

SEQ ID NO: 1517689 - DNA, 16 bp, Homo sapiens
acctcaactgcctact

SEQ ID NO: 1517690 - DNA, 20 bp, Homo sapiens
acctcaagccccatttcctc

SEQ ID NO: 1517691 - DNA, 21 bp, Homo sapiens
acctcaagggggactgtcttt

SEQ ID NO: 1517692 - DNA, 17 bp, Homo sapiens
acctcaagtgtcctgaa

SEQ ID NO: 1517693 - DNA, 21 bp, Homo sapiens
acctcaatttttgtttttgag

SEQ ID NO: 1517694 - DNA, 14 bp, Homo sapiens
acctcacagtgacc

SEQ ID NO: 1517695 - DNA, 15 bp, Homo sapiens
acctcacagtgaccc

SEQ ID NO: 1517696 - DNA, 15 bp, Homo sapiens
acctcacctagaaat

SEQ ID NO: 1517697 - DNA, 21 bp, Homo sapiens
acctcacctcccgaagccacc

SEQ ID NO: 1517698 - DNA, 14 bp, Homo sapiens
acctcacctggtcc

SEQ ID NO: 1517699 - DNA, 14 bp, Homo sapiens
acctcactcctgtt

SEQ ID NO: 1517700 - DNA, 21 bp, Homo sapiens
acctcactggggtcctggggc

SEQ ID NO: 1517701 - DNA, 15 bp, Homo sapiens
acctcactgtcctgt

SEQ ID NO: 1517702 - DNA, 16 bp, Homo sapiens
acctcagccctggccc

SEQ ID NO: 1517703 - DNA, 17 bp, Homo sapiens
acctcagccctggccct

SEQ ID NO: 1517704 - DNA, 22 bp, Homo sapiens
acctcagccctggccctgccca

SEQ ID NO: 1517705 - DNA, 13 bp, Homo sapiens
acctcagcctaga

SEQ ID NO: 1517706 - DNA, 15 bp, Homo sapiens
acctcagcctagacc

SEQ ID NO: 1517707 - DNA, 11 bp, Homo sapiens
acctcagcctg

SEQ ID NO: 1517708 - DNA, 20 bp, Homo sapiens
acctcagcctgcacagtgtc

SEQ ID NO: 1517709 - DNA, 13 bp, Homo sapiens
acctcagcctggc

SEQ ID NO: 1517710 - DNA, 13 bp, Homo sapiens
acctcagctgcac

SEQ ID NO: 1517711 - DNA, 17 bp, Homo sapiens
acctcagctgcacattc

SEQ ID NO: 1517712 - DNA, 22 bp, Homo sapiens
acctcagctgcacattcctggc

SEQ ID NO: 1517713 - DNA, 15 bp, Homo sapiens
acctcaggcagctca

SEQ ID NO: 1517714 - DNA, 17 bp, Homo sapiens
acctcaggcagctcaag

SEQ ID NO: 1517715 - DNA, 13 bp, Homo sapiens
acctcaggccagg

SEQ ID NO: 1517716 - DNA, 19 bp, Homo sapiens
acctcaggcttccttggca

SEQ ID NO: 1517717 - DNA, 10 bp, Homo sapiens
acctcagggc

SEQ ID NO: 1517718 - DNA, 12 bp, Homo sapiens
acctcagggcac

SEQ ID NO: 1517719 - DNA, 21 bp, Homo sapiens
acctcagggcacgcaggacca

SEQ ID NO: 1517720 - DNA, 15 bp, Homo sapiens
acctcagggctccca

SEQ ID NO: 1517721 - DNA, 17 bp, Homo sapiens
acctcagggctcccagg

SEQ ID NO: 1517722 - DNA, 20 bp, Homo sapiens
acctcaggtacggagaagaa

SEQ ID NO: 1517723 - DNA, 21 bp, Homo sapiens
acctcaggtacggagaagaat

SEQ ID NO: 1517724 - DNA, 14 bp, Homo sapiens
acctcagtgggaag

SEQ ID NO: 1517725 - DNA, 15 bp, Homo sapiens
acctcagtgggaaga

SEQ ID NO: 1517726 - DNA, 17 bp, Homo sapiens
acctcagttcccttggc

SEQ ID NO: 1517727 - DNA, 18 bp, Homo sapiens
acctcagttcccttggcc

SEQ ID NO: 1517728 - DNA, 23 bp, Homo sapiens
acctcagttcccttggcctcaga

SEQ ID NO: 1517729 - DNA, 17 bp, Homo sapiens
acctcagttttatcatt

SEQ ID NO: 1517730 - DNA, 21 bp, Homo sapiens
acctcatcactggactgcatg

SEQ ID NO: 1517731 - DNA, 14 bp, Homo sapiens
acctcatcctgctc

SEQ ID NO: 1517732 - DNA, 19 bp, Homo sapiens
acctcatctgtggagctgc

SEQ ID NO: 1517733 - DNA, 15 bp, Homo sapiens
ctaagcaagatgttt

SEQ ID NO: 1517734 - DNA, 19 bp, Homo sapiens
ctaagcaagatgttttgta

SEQ ID NO: 1517735 - DNA, 22 bp, Homo sapiens
ctaagcaagatgttttgtataa

SEQ ID NO: 1517736 - DNA, 17 bp, Homo sapiens
ctaagcagcttattgtt

SEQ ID NO: 1517737 - DNA, 20 bp, Homo sapiens
ctaagcagttttgtaaatgt

SEQ ID NO: 1517738 - DNA, 24 bp, Homo sapiens
ctaagcatgtgtcccaggagcagg

SEQ ID NO: 1517739 - DNA, 15 bp, Homo sapiens
ctaagcccccagggc

SEQ ID NO: 1517740 - DNA, 17 bp, Homo sapiens
ctaagcccccagggcct

SEQ ID NO: 1517741 - DNA, 21 bp, Homo sapiens
ctaagcccccagggcctccag

SEQ ID NO: 1517742 - DNA, 20 bp, Homo sapiens
ctaagcgcctattgtttgta

SEQ ID NO: 1517743 - DNA, 22 bp, Homo sapiens
ctaagctaggaatgaaatcctg

SEQ ID NO: 1517744 - DNA, 22 bp, Homo sapiens
ctaagctattcagtaataactc

SEQ ID NO: 1517745 - DNA, 16 bp, Homo sapiens
ctaagctctctgggcc

SEQ ID NO: 1517746 - DNA, 17 bp, Homo sapiens
ctaagctggagctcttg

SEQ ID NO: 1517747 - DNA, 22 bp, Homo sapiens
ctaagctggagctcttggaaga

SEQ ID NO: 1517748 - DNA, 20 bp, Homo sapiens
ctaaggaaatggagaagctc

SEQ ID NO: 1517749 - DNA, 18 bp, Homo sapiens
ctaaggaagtatcagcac

SEQ ID NO: 1517750 - DNA, 13 bp, Homo sapiens
ctaaggacacact

SEQ ID NO: 1517751 - DNA, 16 bp, Homo sapiens
ctaaggacacactaat

SEQ ID NO: 1517752 - DNA, 17 bp, Homo sapiens
ctaaggacatttcccag

SEQ ID NO: 1517753 - DNA, 19 bp, Homo sapiens
ctaaggacatttcccaggg

SEQ ID NO: 1517754 - DNA, 20 bp, Homo sapiens
ctaaggatagcaccgctttt

SEQ ID NO: 1517755 - DNA, 15 bp, Homo sapiens
ctaaggatctctcag

SEQ ID NO: 1517756 - DNA, 20 bp, Homo sapiens
ctaaggatctctcaggagca

SEQ ID NO: 1517757 - DNA, 17 bp, Homo sapiens
ctaaggatgctaaacct

SEQ ID NO: 1517758 - DNA, 20 bp, Homo sapiens
ctaaggatgctaaaccttag

SEQ ID NO: 1517759 - DNA, 11 bp, Homo sapiens
ctaaggatttt

SEQ ID NO: 1517760 - DNA, 14 bp, Homo sapiens
ctaaggcctaggat

SEQ ID NO: 1517761 - DNA, 11 bp, Homo sapiens
ctaaggctctg

SEQ ID NO: 1517762 - DNA, 13 bp, Homo sapiens
ctaaggctctgag

SEQ ID NO: 1517763 - DNA, 15 bp, Homo sapiens
ctaaggctctgagag

SEQ ID NO: 1517764 - DNA, 21 bp, Homo sapiens
ctaaggctctgagagtctaga

SEQ ID NO: 1517765 - DNA, 23 bp, Homo sapiens
ctaaggctctgagagtctagatt

SEQ ID NO: 1517766 - DNA, 19 bp, Homo sapiens
ctaagggaagatcactgta

SEQ ID NO: 1517767 - DNA, 22 bp, Homo sapiens
ctaagggagagtggtatttgca

SEQ ID NO: 1517768 - DNA, 23 bp, Homo sapiens
ctaaggggcttgtgttctgctcc

SEQ ID NO: 1517769 - DNA, 22 bp, Homo sapiens
ctaagggtcgaaagctctagaa

SEQ ID NO: 1517770 - DNA, 21 bp, Homo sapiens
ctaaggtccggtgttctaaga

SEQ ID NO: 1517771 - DNA, 15 bp, Homo sapiens
ctaaggttctaaggc

SEQ ID NO: 1517772 - DNA, 22 bp, Homo sapiens
ctaaggttgtctacgggggcac

SEQ ID NO: 1517773 - DNA, 16 bp, Homo sapiens
ctaaggtttccagtca

SEQ ID NO: 1517774 - DNA, 18 bp, Homo sapiens
ctaaggtttccagtcaga

SEQ ID NO: 1517775 - DNA, 14 bp, Homo sapiens
ctaagtaaaaccac

SEQ ID NO: 1517776 - DNA, 13 bp, Homo sapiens
ctaagtatttccc

SEQ ID NO: 1517777 - DNA, 16 bp, Homo sapiens
ctaagtatttcccagc

SEQ ID NO: 1517778 - DNA, 18 bp, Homo sapiens
ctaagtcaggtaatatac

SEQ ID NO: 1517779 - DNA, 12 bp, Homo sapiens
ctaagtcagtac

SEQ ID NO: 1517780 - DNA, 19 bp, Homo sapiens
ctaagtccttccacctgcc

SEQ ID NO: 1517781 - DNA, 13 bp, Homo sapiens
ctaagtgcccaaa

SEQ ID NO: 1517782 - DNA, 17 bp, Homo sapiens
ctaagtgcccaaagtgg

SEQ ID NO: 1517783 - DNA, 22 bp, Homo sapiens
ctaagtgcccaaagtggggagg

SEQ ID NO: 1517784 - DNA, 17 bp, Homo sapiens
ctaagtgctaagtgctt

SEQ ID NO: 1517785 - DNA, 17 bp, Homo sapiens
ctaagtgcttattacat

SEQ ID NO: 1517786 - DNA, 16 bp, Homo sapiens
ctaagtggattggctt

SEQ ID NO: 1517787 - DNA, 21 bp, Homo sapiens
ctaagtggattggctttgtgc

SEQ ID NO: 1517788 - DNA, 23 bp, Homo sapiens
ctaagtggattggctttgtgctt

SEQ ID NO: 1517789 - DNA, 12 bp, Homo sapiens
ctaagtgggaca

SEQ ID NO: 1517790 - DNA, 14 bp, Homo sapiens
ctaagtgtgcttag

SEQ ID NO: 1517791 - DNA, 15 bp, Homo sapiens
ctaagtgtgcttagt

SEQ ID NO: 1517792 - DNA, 17 bp, Homo sapiens
ctaagttatttactttt

SEQ ID NO: 1517793 - DNA, 18 bp, Homo sapiens
ctaagttcacattagaat

SEQ ID NO: 1517794 - DNA, 22 bp, Homo sapiens
ctaagttcatgtttgtaaatta

SEQ ID NO: 1517795 - DNA, 17 bp, Homo sapiens
ctaagttctaagttcat

SEQ ID NO: 1517796 - DNA, 13 bp, Homo sapiens
ctaagttctccca

SEQ ID NO: 1517797 - DNA, 19 bp, Homo sapiens
ctaagtttctaagattcta

SEQ ID NO: 1517798 - DNA, 23 bp, Homo sapiens
ctaagtttctaagattctaaagg

SEQ ID NO: 1517799 - DNA, 10 bp, Homo sapiens
ctaataaaac

SEQ ID NO: 1517800 - DNA, 12 bp, Homo sapiens
ctaataaaataa

SEQ ID NO: 1517801 - DNA, 21 bp, Homo sapiens
ctaataaaattcgctttctaa

SEQ ID NO: 1517802 - DNA, 21 bp, Homo sapiens
ctaataaaccagattccagag

SEQ ID NO: 1517803 - DNA, 13 bp, Homo sapiens
ctaataaactgta

SEQ ID NO: 1517804 - DNA, 14 bp, Homo sapiens
ctaataaactgtat

SEQ ID NO: 1517805 - DNA, 15 bp, Homo sapiens
ctaataaactgtatt

SEQ ID NO: 1517806 - DNA, 18 bp, Homo sapiens
ctaataaactgtattaaa

SEQ ID NO: 1517807 - DNA, 20 bp, Homo sapiens
ctaataaactgtattaaatc

SEQ ID NO: 1517808 - DNA, 21 bp, Homo sapiens
ctaataaactgtattaaatct

SEQ ID NO: 1517809 - DNA, 11 bp, Homo sapiens
ctaataaactt

SEQ ID NO: 1517810 - DNA, 13 bp, Homo sapiens
ctaatacctctgt

SEQ ID NO: 1517811 - DNA, 15 bp, Homo sapiens
ctaatacctctgtgt

SEQ ID NO: 1517812 - DNA, 21 bp, Homo sapiens
ctaatacctcttactttgctt

SEQ ID NO: 1517813 - DNA, 18 bp, Homo sapiens
ctaatacgagccttctca

SEQ ID NO: 1517814 - DNA, 21 bp, Homo sapiens
ctaatagaataaaggcagttt

SEQ ID NO: 1517815 - DNA, 23 bp, Homo sapiens
ctaatagaataaaggcagttttc

SEQ ID NO: 1517816 - DNA, 17 bp, Homo sapiens
ctaatagactaaatgaa

SEQ ID NO: 1517817 - DNA, 17 bp, Homo sapiens
ctaatatacagggtagc

SEQ ID NO: 1517818 - DNA, 23 bp, Homo sapiens
ctaatatatacatagaaactttg

SEQ ID NO: 1517819 - DNA, 18 bp, Homo sapiens
ctaatatatatgaataaa

SEQ ID NO: 1517820 - DNA, 14 bp, Homo sapiens
ctaatatatttaaa

SEQ ID NO: 1517821 - DNA, 15 bp, Homo sapiens
ctaatatcacttaaa

SEQ ID NO: 1517822 - DNA, 15 bp, Homo sapiens
ctaatattcaatgaa

SEQ ID NO: 1517823 - DNA, 14 bp, Homo sapiens
ctaatattttatgt

SEQ ID NO: 1517824 - DNA, 22 bp, Homo sapiens
ctaatcacagtgttgcatatga

SEQ ID NO: 1517825 - DNA, 22 bp, Homo sapiens
ctaatcacagtttttcctggaa

SEQ ID NO: 1517826 - DNA, 20 bp, Homo sapiens
ctaatcagggaggtcatttt

SEQ ID NO: 1517827 - DNA, 20 bp, Homo sapiens
ctaatcatgtgggtgagcca

SEQ ID NO: 1517828 - DNA, 19 bp, Homo sapiens
ctaatccaggcagatccag

SEQ ID NO: 1517829 - DNA, 20 bp, Homo sapiens
ctaatccaggcagatccagg

SEQ ID NO: 1517830 - DNA, 23 bp, Homo sapiens
ctaatccaggcagatccaggact

SEQ ID NO: 1517831 - DNA, 16 bp, Homo sapiens
ctaatccccttctccc

SEQ ID NO: 1517832 - DNA, 18 bp, Homo sapiens
ctaatcccgattcaccct

SEQ ID NO: 1517833 - DNA, 19 bp, Homo sapiens
ctaatccctgggcattgct

SEQ ID NO: 1517834 - DNA, 22 bp, Homo sapiens
ctaatccctgggcattgctttc

SEQ ID NO: 1517835 - DNA, 15 bp, Homo sapiens
ctaatccttttcctt

SEQ ID NO: 1517836 - DNA, 16 bp, Homo sapiens
ctaatccttttcctta

SEQ ID NO: 1517837 - DNA, 14 bp, Homo sapiens
ctaatctgcagtgg

SEQ ID NO: 1517838 - DNA, 22 bp, Homo sapiens
ctaatctgtagggctggaccta

SEQ ID NO: 1517839 - DNA, 16 bp, Homo sapiens
ctaatcttgaatgttt

SEQ ID NO: 1517840 - DNA, 13 bp, Homo sapiens
ctaatgagactga

SEQ ID NO: 1517841 - DNA, 21 bp, Homo sapiens
ctaatgagggaaatctgtaaa

SEQ ID NO: 1517842 - DNA, 15 bp, Homo sapiens
ctaatgatcatctga

SEQ ID NO: 1517843 - DNA, 12 bp, Homo sapiens
ctaatgatgttt

SEQ ID NO: 1517844 - DNA, 13 bp, Homo sapiens
ctaatgatgtttt

SEQ ID NO: 1517845 - DNA, 23 bp, Homo sapiens
ctaatgccttttgaatacatttg

SEQ ID NO: 1517846 - DNA, 15 bp, Homo sapiens
ctaatgctaagaaat

SEQ ID NO: 1517847 - DNA, 22 bp, Homo sapiens
ctaatgctaagaaatgctgaaa

SEQ ID NO: 1517848 - DNA, 13 bp, Homo sapiens
ctaatgctcacct

SEQ ID NO: 1517849 - DNA, 22 bp, Homo sapiens
acctcatctgtggagctgccac

SEQ ID NO: 1517850 - DNA, 16 bp, Homo sapiens
acctcatctttctcct

SEQ ID NO: 1517851 - DNA, 14 bp, Homo sapiens
acctcatgacagcc

SEQ ID NO: 1517852 - DNA, 13 bp, Homo sapiens
acctcatgcccac

SEQ ID NO: 1517853 - DNA, 16 bp, Homo sapiens
acctcatgcccacccc

SEQ ID NO: 1517854 - DNA, 20 bp, Homo sapiens
acctcatgcccaccccctgc

SEQ ID NO: 1517855 - DNA, 21 bp, Homo sapiens
acctcatgcccaccccctgcc

SEQ ID NO: 1517856 - DNA, 16 bp, Homo sapiens
acctcatgcccagctc

SEQ ID NO: 1517857 - DNA, 21 bp, Homo sapiens
acctcatgcccagctctctga

SEQ ID NO: 1517858 - DNA, 22 bp, Homo sapiens
acctcatgcccagctctctgac

SEQ ID NO: 1517859 - DNA, 13 bp, Homo sapiens
acctcattctgaa

SEQ ID NO: 1517860 - DNA, 19 bp, Homo sapiens
acctccacacccgtgagaa

SEQ ID NO: 1517861 - DNA, 17 bp, Homo sapiens
acctccacccccgccac

SEQ ID NO: 1517862 - DNA, 14 bp, Homo sapiens
acctccagcctccc

SEQ ID NO: 1517863 - DNA, 15 bp, Homo sapiens
acctccagcctccct

SEQ ID NO: 1517864 - DNA, 20 bp, Homo sapiens
acctccagcctccctgtctc

SEQ ID NO: 1517865 - DNA, 21 bp, Homo sapiens
acctccagcctccctgtctcc

SEQ ID NO: 1517866 - DNA, 21 bp, Homo sapiens
acctccaggcaggccaggctg

SEQ ID NO: 1517867 - DNA, 22 bp, Homo sapiens
acctccaggcaggccaggctgc

SEQ ID NO: 1517868 - DNA, 16 bp, Homo sapiens
acctccattaaatggt

SEQ ID NO: 1517869 - DNA, 16 bp, Homo sapiens
acctcccaccccactc

SEQ ID NO: 1517870 - DNA, 18 bp, Homo sapiens
acctcccactcctgctgc

SEQ ID NO: 1517871 - DNA, 19 bp, Homo sapiens
acctcccactcctgctgca

SEQ ID NO: 1517872 - DNA, 13 bp, Homo sapiens
acctcccagcccc

SEQ ID NO: 1517873 - DNA, 21 bp, Homo sapiens
acctcccagcccctgcccctc

SEQ ID NO: 1517874 - DNA, 14 bp, Homo sapiens
acctcccatcccac

SEQ ID NO: 1517875 - DNA, 15 bp, Homo sapiens
acctccccagcattc

SEQ ID NO: 1517876 - DNA, 18 bp, Homo sapiens
acctcccccaaaccctgc

SEQ ID NO: 1517877 - DNA, 15 bp, Homo sapiens
acctcccccttcccc

SEQ ID NO: 1517878 - DNA, 17 bp, Homo sapiens
acctccccgctctccct

SEQ ID NO: 1517879 - DNA, 23 bp, Homo sapiens
acctccccgctctccctgtcacg

SEQ ID NO: 1517880 - DNA, 15 bp, Homo sapiens
acctccccgctggga

SEQ ID NO: 1517881 - DNA, 21 bp, Homo sapiens
acctcccctatccacccagcc

SEQ ID NO: 1517882 - DNA, 11 bp, Homo sapiens
acctccctccc

SEQ ID NO: 1517883 - DNA, 14 bp, Homo sapiens
acctccctgaacca

SEQ ID NO: 1517884 - DNA, 14 bp, Homo sapiens
acctccctgcaacc

SEQ ID NO: 1517885 - DNA, 13 bp, Homo sapiens
acctccctgtctc

SEQ ID NO: 1517886 - DNA, 17 bp, Homo sapiens
acctccctgtctcccgg

SEQ ID NO: 1517887 - DNA, 16 bp, Homo sapiens
acctcccttccctccc

SEQ ID NO: 1517888 - DNA, 18 bp, Homo sapiens
acctcccttccctccctg

SEQ ID NO: 1517889 - DNA, 14 bp, Homo sapiens
acctccgcccctgc

SEQ ID NO: 1517890 - DNA, 22 bp, Homo sapiens
acctccgcccctgcccccgctc

SEQ ID NO: 1517891 - DNA, 15 bp, Homo sapiens
acctccgcctcccag

SEQ ID NO: 1517892 - DNA, 19 bp, Homo sapiens
acctcctagaggtgggcag

SEQ ID NO: 1517893 - DNA, 21 bp, Homo sapiens
acctcctcacttggctgtctg

SEQ ID NO: 1517894 - DNA, 13 bp, Homo sapiens
acctcctccactc

SEQ ID NO: 1517895 - DNA, 18 bp, Homo sapiens
acctcctccactcactcc

SEQ ID NO: 1517896 - DNA, 19 bp, Homo sapiens
acctcctccactcactcca

SEQ ID NO: 1517897 - DNA, 14 bp, Homo sapiens
acctcctccccctg

SEQ ID NO: 1517898 - DNA, 23 bp, Homo sapiens
acctcctcctttgtttaataaag

SEQ ID NO: 1517899 - DNA, 17 bp, Homo sapiens
acctcctctcagtgttt

SEQ ID NO: 1517900 - DNA, 16 bp, Homo sapiens
acctcctcttctgacg

SEQ ID NO: 1517901 - DNA, 21 bp, Homo sapiens
acctcctgagaaggcgaggag

SEQ ID NO: 1517902 - DNA, 13 bp, Homo sapiens
acctcctgcccag

SEQ ID NO: 1517903 - DNA, 17 bp, Homo sapiens
acctcctgcccaggaga

SEQ ID NO: 1517904 - DNA, 20 bp, Homo sapiens
acctcctgcccaggagagcc

SEQ ID NO: 1517905 - DNA, 13 bp, Homo sapiens
acctcctgctctg

SEQ ID NO: 1517906 - DNA, 13 bp, Homo sapiens
acctcctggtggt

SEQ ID NO: 1517907 - DNA, 15 bp, Homo sapiens
acctcggcctcccaa

SEQ ID NO: 1517908 - DNA, 18 bp, Homo sapiens
acctcggggacaccagag

SEQ ID NO: 1517909 - DNA, 23 bp, Homo sapiens
acctcggggacaccagagctgcc

SEQ ID NO: 1517910 - DNA, 14 bp, Homo sapiens
acctctagaatccc

SEQ ID NO: 1517911 - DNA, 21 bp, Homo sapiens
acctctagaatcccagcagca

SEQ ID NO: 1517912 - DNA, 16 bp, Homo sapiens
acctctattttaatta

SEQ ID NO: 1517913 - DNA, 11 bp, Homo sapiens
acctctccaag

SEQ ID NO: 1517914 - DNA, 20 bp, Homo sapiens
acctctccaagggcttctgc

SEQ ID NO: 1517915 - DNA, 21 bp, Homo sapiens
acctctcctgacccctgcctg

SEQ ID NO: 1517916 - DNA, 13 bp, Homo sapiens
acctctcctgccc

SEQ ID NO: 1517917 - DNA, 16 bp, Homo sapiens
acctctcctgccctgt

SEQ ID NO: 1517918 - DNA, 16 bp, Homo sapiens
acctctcctttctgtg

SEQ ID NO: 1517919 - DNA, 16 bp, Homo sapiens
acctctctatttttaa

SEQ ID NO: 1517920 - DNA, 12 bp, Homo sapiens
acctctctgtcc

SEQ ID NO: 1517921 - DNA, 16 bp, Homo sapiens
acctctctgtcccttg

SEQ ID NO: 1517922 - DNA, 19 bp, Homo sapiens
acctctgaaggcaaatata

SEQ ID NO: 1517923 - DNA, 12 bp, Homo sapiens
acctctgagaag

SEQ ID NO: 1517924 - DNA, 13 bp, Homo sapiens
acctctgatacct

SEQ ID NO: 1517925 - DNA, 12 bp, Homo sapiens
acctctgcctca

SEQ ID NO: 1517926 - DNA, 14 bp, Homo sapiens
acctctgcctcaat

SEQ ID NO: 1517927 - DNA, 19 bp, Homo sapiens
acctctgcttttgcacacc

SEQ ID NO: 1517928 - DNA, 15 bp, Homo sapiens
acctctggactggct

SEQ ID NO: 1517929 - DNA, 18 bp, Homo sapiens
acctctggattcattgtc

SEQ ID NO: 1517930 - DNA, 18 bp, Homo sapiens
acctctggtggctcctcc

SEQ ID NO: 1517931 - DNA, 17 bp, Homo sapiens
acctctggttaatttat

SEQ ID NO: 1517932 - DNA, 21 bp, Homo sapiens
acctctgtaggcagcagagag

SEQ ID NO: 1517933 - DNA, 11 bp, Homo sapiens
acctctgtgtg

SEQ ID NO: 1517934 - DNA, 14 bp, Homo sapiens
acctctgttgtcct

SEQ ID NO: 1517935 - DNA, 13 bp, Homo sapiens
acctcttccccag

SEQ ID NO: 1517936 - DNA, 13 bp, Homo sapiens
acctcttccctct

SEQ ID NO: 1517937 - DNA, 14 bp, Homo sapiens
acctcttccctctg

SEQ ID NO: 1517938 - DNA, 15 bp, Homo sapiens
acctcttccctctgg

SEQ ID NO: 1517939 - DNA, 18 bp, Homo sapiens
acctcttccctctgggcc

SEQ ID NO: 1517940 - DNA, 21 bp, Homo sapiens
acctcttccctctgggcctgt

SEQ ID NO: 1517941 - DNA, 13 bp, Homo sapiens
acctcttcctctg

SEQ ID NO: 1517942 - DNA, 14 bp, Homo sapiens
acctcttcctctgg

SEQ ID NO: 1517943 - DNA, 22 bp, Homo sapiens
acctcttctggagatggaagct

SEQ ID NO: 1517944 - DNA, 14 bp, Homo sapiens
acctcttctggctc

SEQ ID NO: 1517945 - DNA, 17 bp, Homo sapiens
acctctttactctctcc

SEQ ID NO: 1517946 - DNA, 13 bp, Homo sapiens
acctctttgctca

SEQ ID NO: 1517947 - DNA, 21 bp, Homo sapiens
acctctttgctcaacagaaca

SEQ ID NO: 1517948 - DNA, 23 bp, Homo sapiens
acctcttttgagactttgcccag

SEQ ID NO: 1517949 - DNA, 12 bp, Homo sapiens
acctgaaaagta

SEQ ID NO: 1517950 - DNA, 14 bp, Homo sapiens
acctgaaataatat

SEQ ID NO: 1517951 - DNA, 17 bp, Homo sapiens
acctgaaataatatatt

SEQ ID NO: 1517952 - DNA, 16 bp, Homo sapiens
acctgaaattccaaag

SEQ ID NO: 1517953 - DNA, 13 bp, Homo sapiens
acctgaacaggaa

SEQ ID NO: 1517954 - DNA, 23 bp, Homo sapiens
acctgaacaggaatccttactga

SEQ ID NO: 1517955 - DNA, 15 bp, Homo sapiens
acctgaaccccagag

SEQ ID NO: 1517956 - DNA, 18 bp, Homo sapiens
acctgaaccccagaggca

SEQ ID NO: 1517957 - DNA, 21 bp, Homo sapiens
acctgaaccccatgggcttgg

SEQ ID NO: 1517958 - DNA, 16 bp, Homo sapiens
acctgaactgaacacc

SEQ ID NO: 1517959 - DNA, 22 bp, Homo sapiens
acctgaaggtcccctggcagtg

SEQ ID NO: 1517960 - DNA, 12 bp, Homo sapiens
acctgacacaag

SEQ ID NO: 1517961 - DNA, 21 bp, Homo sapiens
acctgacacaccaggcgctaa

SEQ ID NO: 1517962 - DNA, 19 bp, Homo sapiens
acctgacaccgtccctcag

SEQ ID NO: 1517963 - DNA, 22 bp, Homo sapiens
acctgacagatgtcagccgagc

SEQ ID NO: 1517964 - DNA, 15 bp, Homo sapiens
acctgacccctgctc

SEQ ID NO: 1517965 - DNA, 16 bp, Homo sapiens
acctgacccctgctca

SEQ ID NO: 1517966 - DNA, 23 bp, Homo sapiens
acctgacccctgctcagtaaagc

SEQ ID NO: 1517967 - DNA, 16 bp, Homo sapiens
ctaatgtgcagggata

SEQ ID NO: 1517968 - DNA, 23 bp, Homo sapiens
ctaatgtgcagggatattgcctt

SEQ ID NO: 1517969 - DNA, 23 bp, Homo sapiens
ctaatgtggaccttagaatacag

SEQ ID NO: 1517970 - DNA, 17 bp, Homo sapiens
ctaattaaccttactaa

SEQ ID NO: 1517971 - DNA, 17 bp, Homo sapiens
ctaattaattgtaatct

SEQ ID NO: 1517972 - DNA, 19 bp, Homo sapiens
ctaattaattgtaatctga

SEQ ID NO: 1517973 - DNA, 14 bp, Homo sapiens
ctaattatcaaggg

SEQ ID NO: 1517974 - DNA, 23 bp, Homo sapiens
ctaattattattttaaaatatat

SEQ ID NO: 1517975 - DNA, 21 bp, Homo sapiens
ctaattcacacaaagactcct

SEQ ID NO: 1517976 - DNA, 17 bp, Homo sapiens
ctaattcccattttgca

SEQ ID NO: 1517977 - DNA, 18 bp, Homo sapiens
ctaattctcttcgctgtg

SEQ ID NO: 1517978 - DNA, 17 bp, Homo sapiens
ctaattctttgcaaaaa

SEQ ID NO: 1517979 - DNA, 15 bp, Homo sapiens
ctaattggactttta

SEQ ID NO: 1517980 - DNA, 17 bp, Homo sapiens
ctaattgtaagtgaaat

SEQ ID NO: 1517981 - DNA, 17 bp, Homo sapiens
ctaattgtgtatatgtt

SEQ ID NO: 1517982 - DNA, 17 bp, Homo sapiens
ctaattgttttttttct

SEQ ID NO: 1517983 - DNA, 17 bp, Homo sapiens
ctaatttataaaaaggt

SEQ ID NO: 1517984 - DNA, 21 bp, Homo sapiens
ctaatttcaaaaatataactt

SEQ ID NO: 1517985 - DNA, 11 bp, Homo sapiens
ctaatttcata

SEQ ID NO: 1517986 - DNA, 18 bp, Homo sapiens
ctaatttctcctcccttc

SEQ ID NO: 1517987 - DNA, 19 bp, Homo sapiens
ctaatttctcctcccttcc

SEQ ID NO: 1517988 - DNA, 15 bp, Homo sapiens
ctaatttcttcttta

SEQ ID NO: 1517989 - DNA, 22 bp, Homo sapiens
ctaatttgaataaactctcccc

SEQ ID NO: 1517990 - DNA, 12 bp, Homo sapiens
ctaatttttaag

SEQ ID NO: 1517991 - DNA, 22 bp, Homo sapiens
ctaatttttaagaattgagtaa

SEQ ID NO: 1517992 - DNA, 17 bp, Homo sapiens
ctaatttttattaattt

SEQ ID NO: 1517993 - DNA, 12 bp, Homo sapiens
ctaatttttcca

SEQ ID NO: 1517994 - DNA, 20 bp, Homo sapiens
ctaatttttggagaaatgtc

SEQ ID NO: 1517995 - DNA, 16 bp, Homo sapiens
ctaatttttgtatttt

SEQ ID NO: 1517996 - DNA, 17 bp, Homo sapiens
ctaattttttgtacttt

SEQ ID NO: 1517997 - DNA, 15 bp, Homo sapiens
ctacaaaaacacagc

SEQ ID NO: 1517998 - DNA, 17 bp, Homo sapiens
ctacaaaaacacagcaa

SEQ ID NO: 1517999 - DNA, 15 bp, Homo sapiens
ctacaaacaaaattt

SEQ ID NO: 1518000 - DNA, 17 bp, Homo sapiens
ctacaaacaaaatttct

SEQ ID NO: 1518001 - DNA, 20 bp, Homo sapiens
ctacaaacaaaatttctatt

SEQ ID NO: 1518002 - DNA, 19 bp, Homo sapiens
ctacaaagagatgcttgga

SEQ ID NO: 1518003 - DNA, 13 bp, Homo sapiens
ctacaaatttatg

SEQ ID NO: 1518004 - DNA, 18 bp, Homo sapiens
ctacaaccaagctctctg

SEQ ID NO: 1518005 - DNA, 17 bp, Homo sapiens
ctacaaccctaccctgg

SEQ ID NO: 1518006 - DNA, 20 bp, Homo sapiens
ctacaaccctaccctggcag

SEQ ID NO: 1518007 - DNA, 16 bp, Homo sapiens
ctacaacctccgcctc

SEQ ID NO: 1518008 - DNA, 16 bp, Homo sapiens
ctacaacttaatggaa

SEQ ID NO: 1518009 - DNA, 18 bp, Homo sapiens
ctacaagagcagcctgtg

SEQ ID NO: 1518010 - DNA, 20 bp, Homo sapiens
ctacaagagcagcctgtggc

SEQ ID NO: 1518011 - DNA, 15 bp, Homo sapiens
ctacaagatttagaa

SEQ ID NO: 1518012 - DNA, 15 bp, Homo sapiens
ctacaataaaaagaa

SEQ ID NO: 1518013 - DNA, 16 bp, Homo sapiens
ctacaataaaaagaaa

SEQ ID NO: 1518014 - DNA, 12 bp, Homo sapiens
ctacaatatata

SEQ ID NO: 1518015 - DNA, 21 bp, Homo sapiens
ctacaatatgtacatttctaa

SEQ ID NO: 1518016 - DNA, 12 bp, Homo sapiens
ctacaatcatgg

SEQ ID NO: 1518017 - DNA, 17 bp, Homo sapiens
ctacacaatacagtatt

SEQ ID NO: 1518018 - DNA, 17 bp, Homo sapiens
ctacacacacagcctat

SEQ ID NO: 1518019 - DNA, 19 bp, Homo sapiens
ctacacagcacaccagccg

SEQ ID NO: 1518020 - DNA, 24 bp, Homo sapiens
ctacacagcacaccagccgctgca

SEQ ID NO: 1518021 - DNA, 15 bp, Homo sapiens
ctacacagtaaaaac

SEQ ID NO: 1518022 - DNA, 19 bp, Homo sapiens
ctacacagtgggaactctg

SEQ ID NO: 1518023 - DNA, 21 bp, Homo sapiens
ctacacatatgtattcctgat

SEQ ID NO: 1518024 - DNA, 15 bp, Homo sapiens
ctacacatgtaaaat

SEQ ID NO: 1518025 - DNA, 13 bp, Homo sapiens
ctacacatgttgc

SEQ ID NO: 1518026 - DNA, 16 bp, Homo sapiens
ctacacccaagcctga

SEQ ID NO: 1518027 - DNA, 22 bp, Homo sapiens
ctacacccctgtgctcccctgc

SEQ ID NO: 1518028 - DNA, 12 bp, Homo sapiens
ctacacctggct

SEQ ID NO: 1518029 - DNA, 18 bp, Homo sapiens
ctacactccagcctgagc

SEQ ID NO: 1518030 - DNA, 13 bp, Homo sapiens
ctacagaaattct

SEQ ID NO: 1518031 - DNA, 17 bp, Homo sapiens
ctacagaataatgtgtt

SEQ ID NO: 1518032 - DNA, 18 bp, Homo sapiens
ctacagactccatctctt

SEQ ID NO: 1518033 - DNA, 21 bp, Homo sapiens
ctacagacttctccagaccca

SEQ ID NO: 1518034 - DNA, 12 bp, Homo sapiens
ctacagagctgt

SEQ ID NO: 1518035 - DNA, 13 bp, Homo sapiens
ctacagagctgtg

SEQ ID NO: 1518036 - DNA, 14 bp, Homo sapiens
ctacagcctgcaca

SEQ ID NO: 1518037 - DNA, 16 bp, Homo sapiens
ctacagcctgcacaca

SEQ ID NO: 1518038 - DNA, 21 bp, Homo sapiens
ctacagctaatcagcattctc

SEQ ID NO: 1518039 - DNA, 18 bp, Homo sapiens
ctacagctatatttgatt

SEQ ID NO: 1518040 - DNA, 14 bp, Homo sapiens
ctacagctgtcttc

SEQ ID NO: 1518041 - DNA, 21 bp, Homo sapiens
ctacagctgtcttcacatgta

SEQ ID NO: 1518042 - DNA, 21 bp, Homo sapiens
ctacagcttgtttaacggcag

SEQ ID NO: 1518043 - DNA, 23 bp, Homo sapiens
ctacaggatggtgggcaggatct

SEQ ID NO: 1518044 - DNA, 19 bp, Homo sapiens
ctacaggggttagcctgga

SEQ ID NO: 1518045 - DNA, 16 bp, Homo sapiens
ctacagtacttccaga

SEQ ID NO: 1518046 - DNA, 14 bp, Homo sapiens
ctacagtagctgct

SEQ ID NO: 1518047 - DNA, 16 bp, Homo sapiens
ctacagtggttttata

SEQ ID NO: 1518048 - DNA, 16 bp, Homo sapiens
ctacagtttcttactg

SEQ ID NO: 1518049 - DNA, 17 bp, Homo sapiens
ctacagttttaactgtg

SEQ ID NO: 1518050 - DNA, 20 bp, Homo sapiens
ctacagttttaactgtggat

SEQ ID NO: 1518051 - DNA, 22 bp, Homo sapiens
ctacataattaaattttaatgt

SEQ ID NO: 1518052 - DNA, 17 bp, Homo sapiens
ctacataattgtgacca

SEQ ID NO: 1518053 - DNA, 18 bp, Homo sapiens
ctacatacaattccaaac

SEQ ID NO: 1518054 - DNA, 16 bp, Homo sapiens
ctacatatcccttcca

SEQ ID NO: 1518055 - DNA, 19 bp, Homo sapiens
ctacatatcccttccagat

SEQ ID NO: 1518056 - DNA, 21 bp, Homo sapiens
ctacatatcccttccagatgg

SEQ ID NO: 1518057 - DNA, 18 bp, Homo sapiens
ctacatatgctgatcttt

SEQ ID NO: 1518058 - DNA, 14 bp, Homo sapiens
ctacatcagactct

SEQ ID NO: 1518059 - DNA, 17 bp, Homo sapiens
ctacatccccaggtctc

SEQ ID NO: 1518060 - DNA, 15 bp, Homo sapiens
ctacatcttctgcct

SEQ ID NO: 1518061 - DNA, 13 bp, Homo sapiens
ctacatgaaacag

SEQ ID NO: 1518062 - DNA, 14 bp, Homo sapiens
ctacatgaaacaga

SEQ ID NO: 1518063 - DNA, 18 bp, Homo sapiens
ctacatggagtatatgtc

SEQ ID NO: 1518064 - DNA, 20 bp, Homo sapiens
ctacatggagtatatgtcaa

SEQ ID NO: 1518065 - DNA, 15 bp, Homo sapiens
ctacatgttctttgt

SEQ ID NO: 1518066 - DNA, 16 bp, Homo sapiens
ctacatgttctttgta

SEQ ID NO: 1518067 - DNA, 17 bp, Homo sapiens
ctacattaatgtcctct

SEQ ID NO: 1518068 - DNA, 13 bp, Homo sapiens
ctacattcctcag

SEQ ID NO: 1518069 - DNA, 22 bp, Homo sapiens
ctacattcctcagctgccaagc

SEQ ID NO: 1518070 - DNA, 18 bp, Homo sapiens
ctacatttgagggcccag

SEQ ID NO: 1518071 - DNA, 19 bp, Homo sapiens
ctacatttgtttgtattca

SEQ ID NO: 1518072 - DNA, 16 bp, Homo sapiens
ctaccaaacactcagt

SEQ ID NO: 1518073 - DNA, 15 bp, Homo sapiens
ctaccacaaggaaaa

SEQ ID NO: 1518074 - DNA, 13 bp, Homo sapiens
ctaccacagtgtc

SEQ ID NO: 1518075 - DNA, 14 bp, Homo sapiens
ctaccacagtgtct

SEQ ID NO: 1518076 - DNA, 11 bp, Homo sapiens
ctaccagccag

SEQ ID NO: 1518077 - DNA, 12 bp, Homo sapiens
ctaccagccagc

SEQ ID NO: 1518078 - DNA, 13 bp, Homo sapiens
ctaccagccagcc

SEQ ID NO: 1518079 - DNA, 20 bp, Homo sapiens
ctaccagccagcctcagaag

SEQ ID NO: 1518080 - DNA, 22 bp, Homo sapiens
ctaccagcgccaaatgttcatc

SEQ ID NO: 1518081 - DNA, 17 bp, Homo sapiens
ctaccagcgcccgctgg

SEQ ID NO: 1518082 - DNA, 20 bp, Homo sapiens
ctaccagcgcccgctgggct

SEQ ID NO: 1518083 - DNA, 15 bp, Homo sapiens
ctaccaggtgttcta

SEQ ID NO: 1518084 - DNA, 22 bp, Homo sapiens
acctgactcaattatttgcata

SEQ ID NO: 1518085 - DNA, 19 bp, Homo sapiens
acctgactctgaaatctga

SEQ ID NO: 1518086 - DNA, 20 bp, Homo sapiens
acctgactggttaacagcag

SEQ ID NO: 1518087 - DNA, 16 bp, Homo sapiens
acctgagaccctactg

SEQ ID NO: 1518088 - DNA, 14 bp, Homo sapiens
acctgagacctcca

SEQ ID NO: 1518089 - DNA, 15 bp, Homo sapiens
acctgagatgtgtga

SEQ ID NO: 1518090 - DNA, 16 bp, Homo sapiens
acctgagatgtgtgat

SEQ ID NO: 1518091 - DNA, 21 bp, Homo sapiens
acctgagcgctgtggactgtc

SEQ ID NO: 1518092 - DNA, 17 bp, Homo sapiens
acctgaggaactgtctc

SEQ ID NO: 1518093 - DNA, 12 bp, Homo sapiens
acctgaggctgt

SEQ ID NO: 1518094 - DNA, 23 bp, Homo sapiens
acctgaggtgggcccaggaccag

SEQ ID NO: 1518095 - DNA, 24 bp, Homo sapiens
acctgaggtgggcccaggaccagc

SEQ ID NO: 1518096 - DNA, 17 bp, Homo sapiens
acctgaggtgggctggg

SEQ ID NO: 1518097 - DNA, 21 bp, Homo sapiens
acctgagtcgtacagaaagct

SEQ ID NO: 1518098 - DNA, 14 bp, Homo sapiens
acctgagttgaaga

SEQ ID NO: 1518099 - DNA, 17 bp, Homo sapiens
acctgagttgaagaggg

SEQ ID NO: 1518100 - DNA, 15 bp, Homo sapiens
acctgattgatcaca

SEQ ID NO: 1518101 - DNA, 16 bp, Homo sapiens
acctgattgtattttt

SEQ ID NO: 1518102 - DNA, 23 bp, Homo sapiens
acctgattgtattttttttttaa

SEQ ID NO: 1518103 - DNA, 16 bp, Homo sapiens
acctgattttttttcc

SEQ ID NO: 1518104 - DNA, 15 bp, Homo sapiens
acctgcacacaggac

SEQ ID NO: 1518105 - DNA, 21 bp, Homo sapiens
acctgcacctccccccactgc

SEQ ID NO: 1518106 - DNA, 23 bp, Homo sapiens
acctgcactggggagcccgtctc

SEQ ID NO: 1518107 - DNA, 17 bp, Homo sapiens
acctgcaggctccatgc

SEQ ID NO: 1518108 - DNA, 15 bp, Homo sapiens
acctgcagttaacag

SEQ ID NO: 1518109 - DNA, 16 bp, Homo sapiens
acctgcatccttcctg

SEQ ID NO: 1518110 - DNA, 20 bp, Homo sapiens
acctgcatccttcctgggga

SEQ ID NO: 1518111 - DNA, 20 bp, Homo sapiens
acctgccacaaaccaccagg

SEQ ID NO: 1518112 - DNA, 22 bp, Homo sapiens
acctgccacccccttccctggg

SEQ ID NO: 1518113 - DNA, 15 bp, Homo sapiens
acctgccagcctggc

SEQ ID NO: 1518114 - DNA, 16 bp, Homo sapiens
acctgccagcctggct

SEQ ID NO: 1518115 - DNA, 21 bp, Homo sapiens
acctgccagcctggcttctgg

SEQ ID NO: 1518116 - DNA, 13 bp, Homo sapiens
acctgccaggcag

SEQ ID NO: 1518117 - DNA, 15 bp, Homo sapiens
acctgccatttgcac

SEQ ID NO: 1518118 - DNA, 18 bp, Homo sapiens
acctgccatttgcaccct

SEQ ID NO: 1518119 - DNA, 19 bp, Homo sapiens
acctgccatttgcaccctc

SEQ ID NO: 1518120 - DNA, 13 bp, Homo sapiens
acctgccccctgg

SEQ ID NO: 1518121 - DNA, 17 bp, Homo sapiens
acctgccctcaagggtg

SEQ ID NO: 1518122 - DNA, 12 bp, Homo sapiens
acctgccctcta

SEQ ID NO: 1518123 - DNA, 23 bp, Homo sapiens
acctgccctctatttattagcca

SEQ ID NO: 1518124 - DNA, 13 bp, Homo sapiens
acctgccctctct

SEQ ID NO: 1518125 - DNA, 15 bp, Homo sapiens
acctgccctctctgc

SEQ ID NO: 1518126 - DNA, 13 bp, Homo sapiens
acctgccctgcct

SEQ ID NO: 1518127 - DNA, 15 bp, Homo sapiens
acctgccctgcctga

SEQ ID NO: 1518128 - DNA, 13 bp, Homo sapiens
acctgccgacctc

SEQ ID NO: 1518129 - DNA, 17 bp, Homo sapiens
acctgcctaaattaaat

SEQ ID NO: 1518130 - DNA, 19 bp, Homo sapiens
acctgcctaggtttttcct

SEQ ID NO: 1518131 - DNA, 14 bp, Homo sapiens
acctgcctccacca

SEQ ID NO: 1518132 - DNA, 17 bp, Homo sapiens
acctgcctcctgcctgc

SEQ ID NO: 1518133 - DNA, 18 bp, Homo sapiens
acctgcctcctgcctgcc

SEQ ID NO: 1518134 - DNA, 23 bp, Homo sapiens
acctgcctctcacacacatagat

SEQ ID NO: 1518135 - DNA, 12 bp, Homo sapiens
acctgcctggtg

SEQ ID NO: 1518136 - DNA, 23 bp, Homo sapiens
acctgcctggtgcattgctgtgt

SEQ ID NO: 1518137 - DNA, 20 bp, Homo sapiens
acctgcctgtgtgctccgga

SEQ ID NO: 1518138 - DNA, 21 bp, Homo sapiens
acctgcgagggccgcccgctc

SEQ ID NO: 1518139 - DNA, 17 bp, Homo sapiens
acctgctcagccctgca

SEQ ID NO: 1518140 - DNA, 13 bp, Homo sapiens
acctgctccaatt

SEQ ID NO: 1518141 - DNA, 12 bp, Homo sapiens
acctgctccaga

SEQ ID NO: 1518142 - DNA, 14 bp, Homo sapiens
acctgctccagaag

SEQ ID NO: 1518143 - DNA, 22 bp, Homo sapiens
acctgctccagaagatgccagc

SEQ ID NO: 1518144 - DNA, 14 bp, Homo sapiens
acctgctctccggc

SEQ ID NO: 1518145 - DNA, 18 bp, Homo sapiens
acctgctgagggaccagc

SEQ ID NO: 1518146 - DNA, 16 bp, Homo sapiens
acctgctgccccagct

SEQ ID NO: 1518147 - DNA, 14 bp, Homo sapiens
acctgctgcgtccc

SEQ ID NO: 1518148 - DNA, 13 bp, Homo sapiens
acctgcttccttc

SEQ ID NO: 1518149 - DNA, 18 bp, Homo sapiens
acctgcttctgaactcaa

SEQ ID NO: 1518150 - DNA, 23 bp, Homo sapiens
acctgcttctgaactcaagctgc

SEQ ID NO: 1518151 - DNA, 17 bp, Homo sapiens
acctggaaccagagcca

SEQ ID NO: 1518152 - DNA, 19 bp, Homo sapiens
acctggaatgtattttaac

SEQ ID NO: 1518153 - DNA, 14 bp, Homo sapiens
acctggacttcctg

SEQ ID NO: 1518154 - DNA, 17 bp, Homo sapiens
acctggacttcctgtca

SEQ ID NO: 1518155 - DNA, 14 bp, Homo sapiens
acctggagcccctg

SEQ ID NO: 1518156 - DNA, 15 bp, Homo sapiens
acctggagcccctgg

SEQ ID NO: 1518157 - DNA, 17 bp, Homo sapiens
acctggagcccctgggt

SEQ ID NO: 1518158 - DNA, 13 bp, Homo sapiens
acctggaggggca

SEQ ID NO: 1518159 - DNA, 17 bp, Homo sapiens
acctggatccagcactg

SEQ ID NO: 1518160 - DNA, 21 bp, Homo sapiens
acctggcatcgcaccattctg

SEQ ID NO: 1518161 - DNA, 21 bp, Homo sapiens
acctggcatctaattctgatt

SEQ ID NO: 1518162 - DNA, 23 bp, Homo sapiens
acctggccccatgtctctcagaa

SEQ ID NO: 1518163 - DNA, 21 bp, Homo sapiens
acctggccgcctccaggagcc

SEQ ID NO: 1518164 - DNA, 12 bp, Homo sapiens
acctggcctgct

SEQ ID NO: 1518165 - DNA, 13 bp, Homo sapiens
acctggcctgctg

SEQ ID NO: 1518166 - DNA, 15 bp, Homo sapiens
acctggcctgctggg

SEQ ID NO: 1518167 - DNA, 23 bp, Homo sapiens
acctggcctggcctccaaaatat

SEQ ID NO: 1518168 - DNA, 16 bp, Homo sapiens
acctggcctgggccac

SEQ ID NO: 1518169 - DNA, 17 bp, Homo sapiens
acctggccttaaagagg

SEQ ID NO: 1518170 - DNA, 15 bp, Homo sapiens
acctggcgtgctcag

SEQ ID NO: 1518171 - DNA, 23 bp, Homo sapiens
acctggctaattttttgtacttt

SEQ ID NO: 1518172 - DNA, 19 bp, Homo sapiens
acctggctgagcctggctg

SEQ ID NO: 1518173 - DNA, 17 bp, Homo sapiens
acctgggaaaggaccca

SEQ ID NO: 1518174 - DNA, 20 bp, Homo sapiens
acctgggccgggctgtagat

SEQ ID NO: 1518175 - DNA, 22 bp, Homo sapiens
acctggggggcagtggtgtgga

SEQ ID NO: 1518176 - DNA, 17 bp, Homo sapiens
acctgggtatcccctgc

SEQ ID NO: 1518177 - DNA, 22 bp, Homo sapiens
acctgggtatcccctgcctcct

SEQ ID NO: 1518178 - DNA, 18 bp, Homo sapiens
acctgggttagggtgtgt

SEQ ID NO: 1518179 - DNA, 20 bp, Homo sapiens
acctggtattatttttctta

SEQ ID NO: 1518180 - DNA, 16 bp, Homo sapiens
acctggtcctccgcct

SEQ ID NO: 1518181 - DNA, 20 bp, Homo sapiens
acctggtcctccgcctactg

SEQ ID NO: 1518182 - DNA, 13 bp, Homo sapiens
acctggttgagtg

SEQ ID NO: 1518183 - DNA, 16 bp, Homo sapiens
acctgtagtcccagct

SEQ ID NO: 1518184 - DNA, 18 bp, Homo sapiens
acctgtagtcccagctac

SEQ ID NO: 1518185 - DNA, 21 bp, Homo sapiens
acctgtatatttgtaaagcta

SEQ ID NO: 1518186 - DNA, 18 bp, Homo sapiens
acctgtcaccctgcagga

SEQ ID NO: 1518187 - DNA, 18 bp, Homo sapiens
acctgtcaccgtgagcag

SEQ ID NO: 1518188 - DNA, 19 bp, Homo sapiens
acctgtcaccgtgagcagc

SEQ ID NO: 1518189 - DNA, 15 bp, Homo sapiens
acctgtcatgccccc

SEQ ID NO: 1518190 - DNA, 17 bp, Homo sapiens
acctgtcatgcccccct

SEQ ID NO: 1518191 - DNA, 20 bp, Homo sapiens
acctgtcatgcccccctcaa

SEQ ID NO: 1518192 - DNA, 20 bp, Homo sapiens
acctgtcattttgcactgta

SEQ ID NO: 1518193 - DNA, 21 bp, Homo sapiens
acctgtccccaccctccactc

SEQ ID NO: 1518194 - DNA, 22 bp, Homo sapiens
acctgtccccaccctccactca

SEQ ID NO: 1518195 - DNA, 14 bp, Homo sapiens
acctgtccttgcac

SEQ ID NO: 1518196 - DNA, 20 bp, Homo sapiens
acctgtcgtctctcccaccc

SEQ ID NO: 1518197 - DNA, 23 bp, Homo sapiens
acctgtctaggtctcctcagggt

SEQ ID NO: 1518198 - DNA, 14 bp, Homo sapiens
acctgtctgctgcc

SEQ ID NO: 1518199 - DNA, 17 bp, Homo sapiens
acctgtctgctgccagc

SEQ ID NO: 1518200 - DNA, 18 bp, Homo sapiens
acctgtctgctgccagca

SEQ ID NO: 1518201 - DNA, 20 bp, Homo sapiens
acctgtctgctgccagcaca

SEQ ID NO: 1518202 - DNA, 21 bp, Homo sapiens
acctgtctgctgccagcacag

SEQ ID NO: 1518203 - DNA, 19 bp, Homo sapiens
acctgtcttccaaggagac

SEQ ID NO: 1518204 - DNA, 14 bp, Homo sapiens
acctgtcttggcct

SEQ ID NO: 1518205 - DNA, 13 bp, Homo sapiens
acctgtgacaaag

SEQ ID NO: 1518206 - DNA, 19 bp, Homo sapiens
acctgtgaccagcactgtc

SEQ ID NO: 1518207 - DNA, 18 bp, Homo sapiens
acctgtgagtttaaagca

SEQ ID NO: 1518208 - DNA, 18 bp, Homo sapiens
acctgtgatctagtcctt

SEQ ID NO: 1518209 - DNA, 17 bp, Homo sapiens
acctgtgccctcaccac

SEQ ID NO: 1518210 - DNA, 18 bp, Homo sapiens
acctgtgccctcaccacc

SEQ ID NO: 1518211 - DNA, 14 bp, Homo sapiens
acctgtggatattt

SEQ ID NO: 1518212 - DNA, 18 bp, Homo sapiens
acctgtgtattttttaaa

SEQ ID NO: 1518213 - DNA, 13 bp, Homo sapiens
acctgtgtccccg

SEQ ID NO: 1518214 - DNA, 23 bp, Homo sapiens
acctgtgtccccgatgctgacct

SEQ ID NO: 1518215 - DNA, 13 bp, Homo sapiens
acctgtgtgaact

SEQ ID NO: 1518216 - DNA, 16 bp, Homo sapiens
acctgtgtgcccagca

SEQ ID NO: 1518217 - DNA, 13 bp, Homo sapiens
acctgtgtgcttg

SEQ ID NO: 1518218 - DNA, 22 bp, Homo sapiens
acctgttaaaacaaccagttaa

SEQ ID NO: 1518219 - DNA, 18 bp, Homo sapiens
acctgttaaaatgtacac

SEQ ID NO: 1518220 - DNA, 20 bp, Homo sapiens
acctgttaaaatgtacactg

SEQ ID NO: 1518221 - DNA, 18 bp, Homo sapiens
acctgttacactgggctg

SEQ ID NO: 1518222 - DNA, 19 bp, Homo sapiens
acctgttatatatctcttt

SEQ ID NO: 1518223 - DNA, 15 bp, Homo sapiens
acctgttatttatca

SEQ ID NO: 1518224 - DNA, 17 bp, Homo sapiens
acctgttcacagaaaaa

SEQ ID NO: 1518225 - DNA, 17 bp, Homo sapiens
acctgttcagtgtcccg

SEQ ID NO: 1518226 - DNA, 22 bp, Homo sapiens
acctgttcagtgtcccgggccc

SEQ ID NO: 1518227 - DNA, 17 bp, Homo sapiens
acctgttcttagagtgt

SEQ ID NO: 1518228 - DNA, 21 bp, Homo sapiens
acctgttcttagagtgtagct

SEQ ID NO: 1518229 - DNA, 17 bp, Homo sapiens
acctgttgccagcagat

SEQ ID NO: 1518230 - DNA, 13 bp, Homo sapiens
acctgtttaaata

SEQ ID NO: 1518231 - DNA, 21 bp, Homo sapiens
acctgtttatgagatgctggt

SEQ ID NO: 1518232 - DNA, 13 bp, Homo sapiens
acctgttttctga

SEQ ID NO: 1518233 - DNA, 16 bp, Homo sapiens
acctgttttctgaaac

SEQ ID NO: 1518234 - DNA, 19 bp, Homo sapiens
acctgttttctgaaacaca

SEQ ID NO: 1518235 - DNA, 18 bp, Homo sapiens
acctgtttttaagctgtt

SEQ ID NO: 1518236 - DNA, 20 bp, Homo sapiens
accttaaaattaagatttcc

SEQ ID NO: 1518237 - DNA, 18 bp, Homo sapiens
accttaaagctgaattta

SEQ ID NO: 1518238 - DNA, 16 bp, Homo sapiens
accttaaccttaaaat

SEQ ID NO: 1518239 - DNA, 20 bp, Homo sapiens
accttacaacgccgagtgca

SEQ ID NO: 1518240 - DNA, 13 bp, Homo sapiens
accttagcgttct

SEQ ID NO: 1518241 - DNA, 17 bp, Homo sapiens
accttaggccttcctct

SEQ ID NO: 1518242 - DNA, 15 bp, Homo sapiens
accttaggctttgta

SEQ ID NO: 1518243 - DNA, 16 bp, Homo sapiens
accttaggctttgtat

SEQ ID NO: 1518244 - DNA, 19 bp, Homo sapiens
accttagtttcaagagtct

SEQ ID NO: 1518245 - DNA, 19 bp, Homo sapiens
accttatagttactgtgta

SEQ ID NO: 1518246 - DNA, 23 bp, Homo sapiens
accttatagttactgtgtaatta

SEQ ID NO: 1518247 - DNA, 14 bp, Homo sapiens
accttattgtacct

SEQ ID NO: 1518248 - DNA, 20 bp, Homo sapiens
accttattgtacctctctta

SEQ ID NO: 1518249 - DNA, 16 bp, Homo sapiens
accttatttatttttg

SEQ ID NO: 1518250 - DNA, 15 bp, Homo sapiens
accttcaaaatgttc

SEQ ID NO: 1518251 - DNA, 17 bp, Homo sapiens
accttcagagccagccg

SEQ ID NO: 1518252 - DNA, 18 bp, Homo sapiens
accttcatgcccttctga

SEQ ID NO: 1518253 - DNA, 13 bp, Homo sapiens
accttccagctcc

SEQ ID NO: 1518254 - DNA, 14 bp, Homo sapiens
accttccagggccc

SEQ ID NO: 1518255 - DNA, 15 bp, Homo sapiens
accttccagggccct

SEQ ID NO: 1518256 - DNA, 17 bp, Homo sapiens
accttccagggccctag

SEQ ID NO: 1518257 - DNA, 22 bp, Homo sapiens
accttcccaaacgcctcccctg

SEQ ID NO: 1518258 - DNA, 11 bp, Homo sapiens
accttcccagc

SEQ ID NO: 1518259 - DNA, 19 bp, Homo sapiens
accttccctctcaccatcc

SEQ ID NO: 1518260 - DNA, 17 bp, Homo sapiens
accttcccttctacaag

SEQ ID NO: 1518261 - DNA, 11 bp, Homo sapiens
accttctaaaa

SEQ ID NO: 1518262 - DNA, 15 bp, Homo sapiens
accttctaaaagcca

SEQ ID NO: 1518263 - DNA, 18 bp, Homo sapiens
accttctagtcttggcca

SEQ ID NO: 1518264 - DNA, 14 bp, Homo sapiens
accttctccaaatg

SEQ ID NO: 1518265 - DNA, 15 bp, Homo sapiens
accttctgagtattc

SEQ ID NO: 1518266 - DNA, 19 bp, Homo sapiens
accttctgcctttgatgtt

SEQ ID NO: 1518267 - DNA, 20 bp, Homo sapiens
accttctgggggaaagggaa

SEQ ID NO: 1518268 - DNA, 18 bp, Homo sapiens
accttctggttgcttcag

SEQ ID NO: 1518269 - DNA, 16 bp, Homo sapiens
accttcttctcctaca

SEQ ID NO: 1518270 - DNA, 17 bp, Homo sapiens
accttctttcactctgt

SEQ ID NO: 1518271 - DNA, 18 bp, Homo sapiens
accttgaaaaaaaacagt

SEQ ID NO: 1518272 - DNA, 22 bp, Homo sapiens
accttgaaaaaaaacagtggat

SEQ ID NO: 1518273 - DNA, 18 bp, Homo sapiens
accttgaacactggggga

SEQ ID NO: 1518274 - DNA, 23 bp, Homo sapiens
accttgaataaggcccactgtaa

SEQ ID NO: 1518275 - DNA, 15 bp, Homo sapiens
accttgaatgctgcc

SEQ ID NO: 1518276 - DNA, 13 bp, Homo sapiens
accttgacagagc

SEQ ID NO: 1518277 - DNA, 17 bp, Homo sapiens
accttgacgtttcttct

SEQ ID NO: 1518278 - DNA, 20 bp, Homo sapiens
accttgacgtttcttctttc

SEQ ID NO: 1518279 - DNA, 22 bp, Homo sapiens
accttgacttgaaatgctcttt

SEQ ID NO: 1518280 - DNA, 22 bp, Homo sapiens
accttgcctccttttttcttaa

SEQ ID NO: 1518281 - DNA, 21 bp, Homo sapiens
accttgcctgaacatccttcc

SEQ ID NO: 1518282 - DNA, 23 bp, Homo sapiens
accttgcctgaacatccttcctt

SEQ ID NO: 1518283 - DNA, 20 bp, Homo sapiens
accttgctcttctttctgag

SEQ ID NO: 1518284 - DNA, 23 bp, Homo sapiens
accttgctgggacttggatccca

SEQ ID NO: 1518285 - DNA, 12 bp, Homo sapiens
accttgcttctt

SEQ ID NO: 1518286 - DNA, 18 bp, Homo sapiens
accttggaccactcctgt

SEQ ID NO: 1518287 - DNA, 17 bp, Homo sapiens
accttggagagacacag

SEQ ID NO: 1518288 - DNA, 14 bp, Homo sapiens
accttggagagctc

SEQ ID NO: 1518289 - DNA, 14 bp, Homo sapiens
accttggcataaga

SEQ ID NO: 1518290 - DNA, 18 bp, Homo sapiens
accttggcccaggagctc

SEQ ID NO: 1518291 - DNA, 16 bp, Homo sapiens
accttggcttgttatt

SEQ ID NO: 1518292 - DNA, 16 bp, Homo sapiens
accttgggtggcccct

SEQ ID NO: 1518293 - DNA, 14 bp, Homo sapiens
accttgtaaaaaaa

SEQ ID NO: 1518294 - DNA, 19 bp, Homo sapiens
accttgtaaaaaaagcaaa

SEQ ID NO: 1518295 - DNA, 20 bp, Homo sapiens
accttgtcatgtaccatcaa

SEQ ID NO: 1518296 - DNA, 21 bp, Homo sapiens
accttgtcatgtaccatcaat

SEQ ID NO: 1518297 - DNA, 12 bp, Homo sapiens
accttgtctgct

SEQ ID NO: 1518298 - DNA, 23 bp, Homo sapiens
accttgtgcccagggttttgccc

SEQ ID NO: 1518299 - DNA, 12 bp, Homo sapiens
accttgtgcctg

SEQ ID NO: 1518300 - DNA, 16 bp, Homo sapiens
accttgtgcctggggt

SEQ ID NO: 1518301 - DNA, 16 bp, Homo sapiens
accttgtgggaccagt

SEQ ID NO: 1518302 - DNA, 13 bp, Homo sapiens
accttgtgtaaga

SEQ ID NO: 1518303 - DNA, 18 bp, Homo sapiens
accttgtgtctgtacacg

SEQ ID NO: 1518304 - DNA, 15 bp, Homo sapiens
accttgttacttctg

SEQ ID NO: 1518305 - DNA, 18 bp, Homo sapiens
accttgttgcagatgggt

SEQ ID NO: 1518306 - DNA, 18 bp, Homo sapiens
accttgttggagcctgca

SEQ ID NO: 1518307 - DNA, 21 bp, Homo sapiens
accttgtttggggcacagtag

SEQ ID NO: 1518308 - DNA, 18 bp, Homo sapiens
acctttaaatgcaacagt

SEQ ID NO: 1518309 - DNA, 19 bp, Homo sapiens
acctttaacttttttttct

SEQ ID NO: 1518310 - DNA, 20 bp, Homo sapiens
acctttatcacctcattctg

SEQ ID NO: 1518311 - DNA, 15 bp, Homo sapiens
acctttatggtttct

SEQ ID NO: 1518312 - DNA, 16 bp, Homo sapiens
acctttattaaaatct

SEQ ID NO: 1518313 - DNA, 17 bp, Homo sapiens
acctttattaaaatctt

SEQ ID NO: 1518314 - DNA, 20 bp, Homo sapiens
acctttattcacccctgccc

SEQ ID NO: 1518315 - DNA, 17 bp, Homo sapiens
acctttattttagaatt

SEQ ID NO: 1518316 - DNA, 14 bp, Homo sapiens
acctttcaaagctt

SEQ ID NO: 1518317 - DNA, 20 bp, Homo sapiens
ctaccatttgtgttttgaaa

SEQ ID NO: 1518318 - DNA, 13 bp, Homo sapiens
ctacccaaccctg

SEQ ID NO: 1518319 - DNA, 14 bp, Homo sapiens
ctacccaaccctgc

SEQ ID NO: 1518320 - DNA, 19 bp, Homo sapiens
ctacccagatggaaaaata

SEQ ID NO: 1518321 - DNA, 12 bp, Homo sapiens
ctacccagctct

SEQ ID NO: 1518322 - DNA, 14 bp, Homo sapiens
ctacccagctctgt

SEQ ID NO: 1518323 - DNA, 20 bp, Homo sapiens
ctacccattgttcccttcct

SEQ ID NO: 1518324 - DNA, 16 bp, Homo sapiens
ctaccccaaggccagt

SEQ ID NO: 1518325 - DNA, 21 bp, Homo sapiens
ctaccccacaccaggccgtcc

SEQ ID NO: 1518326 - DNA, 13 bp, Homo sapiens
ctaccccaccacg

SEQ ID NO: 1518327 - DNA, 18 bp, Homo sapiens
ctaccccagtcccaggga

SEQ ID NO: 1518328 - DNA, 15 bp, Homo sapiens
ctacccgagcccagc

SEQ ID NO: 1518329 - DNA, 15 bp, Homo sapiens
ctaccctaaccaagt

SEQ ID NO: 1518330 - DNA, 14 bp, Homo sapiens
ctaccctcagcctc

SEQ ID NO: 1518331 - DNA, 15 bp, Homo sapiens
ctaccctcagcctcc

SEQ ID NO: 1518332 - DNA, 19 bp, Homo sapiens
ctaccctcagcctccaatg

SEQ ID NO: 1518333 - DNA, 13 bp, Homo sapiens
ctaccctcccacc

SEQ ID NO: 1518334 - DNA, 17 bp, Homo sapiens
ctaccctccgtttttct

SEQ ID NO: 1518335 - DNA, 13 bp, Homo sapiens
ctaccctggcagg

SEQ ID NO: 1518336 - DNA, 19 bp, Homo sapiens
ctaccctggcagggacctg

SEQ ID NO: 1518337 - DNA, 22 bp, Homo sapiens
ctaccctggcagggacctgaga

SEQ ID NO: 1518338 - DNA, 14 bp, Homo sapiens
ctaccctgtctgtc

SEQ ID NO: 1518339 - DNA, 19 bp, Homo sapiens
ctaccctgtctgtcccttt

SEQ ID NO: 1518340 - DNA, 21 bp, Homo sapiens
ctaccctgtctgtcccttttc

SEQ ID NO: 1518341 - DNA, 13 bp, Homo sapiens
ctacccttctcct

SEQ ID NO: 1518342 - DNA, 21 bp, Homo sapiens
ctacccttctcctttccttcc

SEQ ID NO: 1518343 - DNA, 23 bp, Homo sapiens
ctacccttctcctttccttccca

SEQ ID NO: 1518344 - DNA, 18 bp, Homo sapiens
ctaccctttttctccagc

SEQ ID NO: 1518345 - DNA, 17 bp, Homo sapiens
ctaccgagtctcttctc

SEQ ID NO: 1518346 - DNA, 21 bp, Homo sapiens
ctaccgagtctcttctccact

SEQ ID NO: 1518347 - DNA, 23 bp, Homo sapiens
ctaccgagtctcttctccactgg

SEQ ID NO: 1518348 - DNA, 13 bp, Homo sapiens
ctaccgagttcaa

SEQ ID NO: 1518349 - DNA, 14 bp, Homo sapiens
ctaccgagttcaag

SEQ ID NO: 1518350 - DNA, 14 bp, Homo sapiens
ctaccgcaggcccg

SEQ ID NO: 1518351 - DNA, 19 bp, Homo sapiens
ctaccggggaccgggaccc

SEQ ID NO: 1518352 - DNA, 17 bp, Homo sapiens
ctaccgtggatctcctt

SEQ ID NO: 1518353 - DNA, 16 bp, Homo sapiens
ctacctagaagtaaga

SEQ ID NO: 1518354 - DNA, 20 bp, Homo sapiens
ctacctagaagtaagaagag

SEQ ID NO: 1518355 - DNA, 15 bp, Homo sapiens
ctacctccaccctgc

SEQ ID NO: 1518356 - DNA, 11 bp, Homo sapiens
ctacctccctc

SEQ ID NO: 1518357 - DNA, 23 bp, Homo sapiens
ctacctccctccccgtctcattc

SEQ ID NO: 1518358 - DNA, 13 bp, Homo sapiens
ctacctcctcact

SEQ ID NO: 1518359 - DNA, 13 bp, Homo sapiens
ctacctctctgtc

SEQ ID NO: 1518360 - DNA, 19 bp, Homo sapiens
ctacctgctcagccctgca

SEQ ID NO: 1518361 - DNA, 23 bp, Homo sapiens
ctacctgggacctgatttattga

SEQ ID NO: 1518362 - DNA, 14 bp, Homo sapiens
ctacctgtctgctg

SEQ ID NO: 1518363 - DNA, 18 bp, Homo sapiens
ctacctgtctgctgccag

SEQ ID NO: 1518364 - DNA, 20 bp, Homo sapiens
ctacctgtctgctgccagca

SEQ ID NO: 1518365 - DNA, 23 bp, Homo sapiens
ctacctgtctgctgccagcacag

SEQ ID NO: 1518366 - DNA, 14 bp, Homo sapiens
ctacctgtgagcat

SEQ ID NO: 1518367 - DNA, 15 bp, Homo sapiens
ctaccttccccagac

SEQ ID NO: 1518368 - DNA, 16 bp, Homo sapiens
ctaccttccccagact

SEQ ID NO: 1518369 - DNA, 19 bp, Homo sapiens
ctacgtttgcaccgcctgc

SEQ ID NO: 1518370 - DNA, 14 bp, Homo sapiens
ctactaaaattcaa

SEQ ID NO: 1518371 - DNA, 20 bp, Homo sapiens
ctactaaaattcaaaaacaa

SEQ ID NO: 1518372 - DNA, 17 bp, Homo sapiens
ctactaagaataaataa

SEQ ID NO: 1518373 - DNA, 20 bp, Homo sapiens
ctactaagttcacattagaa

SEQ ID NO: 1518374 - DNA, 17 bp, Homo sapiens
ctactaccacaaggaaa

SEQ ID NO: 1518375 - DNA, 22 bp, Homo sapiens
ctactacccattgttcccttcc

SEQ ID NO: 1518376 - DNA, 18 bp, Homo sapiens
ctactacccgagcccagc

SEQ ID NO: 1518377 - DNA, 12 bp, Homo sapiens
ctactactggtg

SEQ ID NO: 1518378 - DNA, 18 bp, Homo sapiens
ctactaggagaggggggc

SEQ ID NO: 1518379 - DNA, 14 bp, Homo sapiens
ctactataaagaga

SEQ ID NO: 1518380 - DNA, 15 bp, Homo sapiens
ctactataaagagaa

SEQ ID NO: 1518381 - DNA, 13 bp, Homo sapiens
ctactcagaagcc

SEQ ID NO: 1518382 - DNA, 16 bp, Homo sapiens
ctactcagaagcctga

SEQ ID NO: 1518383 - DNA, 21 bp, Homo sapiens
ctactcagcagccctcctcac

SEQ ID NO: 1518384 - DNA, 18 bp, Homo sapiens
ctactccctcttcactgt

SEQ ID NO: 1518385 - DNA, 13 bp, Homo sapiens
ctactcgagccca

SEQ ID NO: 1518386 - DNA, 15 bp, Homo sapiens
ctactcgagcccacc

SEQ ID NO: 1518387 - DNA, 21 bp, Homo sapiens
ctactcgagcccacccagcat

SEQ ID NO: 1518388 - DNA, 18 bp, Homo sapiens
ctactctaaagaaaaatg

SEQ ID NO: 1518389 - DNA, 22 bp, Homo sapiens
ctactctcaggatcaagaaagt

SEQ ID NO: 1518390 - DNA, 19 bp, Homo sapiens
ctactctccccacgagggc

SEQ ID NO: 1518391 - DNA, 21 bp, Homo sapiens
ctactctccccacgagggctg

SEQ ID NO: 1518392 - DNA, 22 bp, Homo sapiens
ctactctccccacgagggctgg

SEQ ID NO: 1518393 - DNA, 14 bp, Homo sapiens
ctactctgtccagg

SEQ ID NO: 1518394 - DNA, 15 bp, Homo sapiens
ctactctgtccaggc

SEQ ID NO: 1518395 - DNA, 17 bp, Homo sapiens
ctactctgtccaggcca

SEQ ID NO: 1518396 - DNA, 20 bp, Homo sapiens
ctactctgtccaggccactg

SEQ ID NO: 1518397 - DNA, 15 bp, Homo sapiens
ctactctgttccttc

SEQ ID NO: 1518398 - DNA, 19 bp, Homo sapiens
ctactctgttccttcacat

SEQ ID NO: 1518399 - DNA, 17 bp, Homo sapiens
ctactcttacagagcct

SEQ ID NO: 1518400 - DNA, 18 bp, Homo sapiens
ctactcttgagagctcag

SEQ ID NO: 1518401 - DNA, 23 bp, Homo sapiens
ctactcttgagagctcaggcagc

SEQ ID NO: 1518402 - DNA, 15 bp, Homo sapiens
ctactcttgtcattt

SEQ ID NO: 1518403 - DNA, 18 bp, Homo sapiens
ctactgaaacagatttca

SEQ ID NO: 1518404 - DNA, 15 bp, Homo sapiens
ctactgaagtggctg

SEQ ID NO: 1518405 - DNA, 16 bp, Homo sapiens
ctactgacagggagca

SEQ ID NO: 1518406 - DNA, 20 bp, Homo sapiens
ctactgacatgtggggccag

SEQ ID NO: 1518407 - DNA, 20 bp, Homo sapiens
ctactgaggatatggacact

SEQ ID NO: 1518408 - DNA, 17 bp, Homo sapiens
ctactgataaagaaaga

SEQ ID NO: 1518409 - DNA, 16 bp, Homo sapiens
ctactgatgaaatctg

SEQ ID NO: 1518410 - DNA, 17 bp, Homo sapiens
ctactgattgtttcatt

SEQ ID NO: 1518411 - DNA, 18 bp, Homo sapiens
ctactgcactccagcctg

SEQ ID NO: 1518412 - DNA, 19 bp, Homo sapiens
ctactgcactttccccctt

SEQ ID NO: 1518413 - DNA, 20 bp, Homo sapiens
ctactgcactttcccccttc

SEQ ID NO: 1518414 - DNA, 18 bp, Homo sapiens
ctactgcagcacctccag

SEQ ID NO: 1518415 - DNA, 20 bp, Homo sapiens
ctactgcagcacctccaggc

SEQ ID NO: 1518416 - DNA, 11 bp, Homo sapiens
ctactgcccac

SEQ ID NO: 1518417 - DNA, 15 bp, Homo sapiens
ctactgcccacattt

SEQ ID NO: 1518418 - DNA, 12 bp, Homo sapiens
ctactgccctcc

SEQ ID NO: 1518419 - DNA, 15 bp, Homo sapiens
ctactgccctcccct

SEQ ID NO: 1518420 - DNA, 15 bp, Homo sapiens
ctactgctcctgtgg

SEQ ID NO: 1518421 - DNA, 16 bp, Homo sapiens
ctactgctcctgtggc

SEQ ID NO: 1518422 - DNA, 18 bp, Homo sapiens
ctactgctggactgtgga

SEQ ID NO: 1518423 - DNA, 20 bp, Homo sapiens
ctactggaaatgtagcactt

SEQ ID NO: 1518424 - DNA, 21 bp, Homo sapiens
ctactggaaatgtagcactta

SEQ ID NO: 1518425 - DNA, 22 bp, Homo sapiens
ctactggaatggtgttttgtca

SEQ ID NO: 1518426 - DNA, 15 bp, Homo sapiens
ctactggacgctgcc

SEQ ID NO: 1518427 - DNA, 11 bp, Homo sapiens
ctactggcagc

SEQ ID NO: 1518428 - DNA, 12 bp, Homo sapiens
ctactggcagct

SEQ ID NO: 1518429 - DNA, 15 bp, Homo sapiens
ctactggcagctcct

SEQ ID NO: 1518430 - DNA, 16 bp, Homo sapiens
ctactggcagctcctc

SEQ ID NO: 1518431 - DNA, 16 bp, Homo sapiens
ctactggggaggctga

SEQ ID NO: 1518432 - DNA, 20 bp, Homo sapiens
ctactggggaggctgaggca

SEQ ID NO: 1518433 - DNA, 21 bp, Homo sapiens
ctactgtactttgccattttt

SEQ ID NO: 1518434 - DNA, 14 bp, Homo sapiens
accagagggcatgc

SEQ ID NO: 1518435 - DNA, 17 bp, Homo sapiens
accagatctttctcttc

SEQ ID NO: 1518436 - DNA, 19 bp, Homo sapiens
accagatctttctcttccc

SEQ ID NO: 1518437 - DNA, 20 bp, Homo sapiens
accagatctttctcttccct

SEQ ID NO: 1518438 - DNA, 21 bp, Homo sapiens
accagatgacacataaatctg

SEQ ID NO: 1518439 - DNA, 23 bp, Homo sapiens
accagcaacttgtctttttctgg

SEQ ID NO: 1518440 - DNA, 20 bp, Homo sapiens
accagcagacagagccagga

SEQ ID NO: 1518441 - DNA, 15 bp, Homo sapiens
accagcagatcccag

SEQ ID NO: 1518442 - DNA, 19 bp, Homo sapiens
accagcagatcccagctca

SEQ ID NO: 1518443 - DNA, 21 bp, Homo sapiens
accagcagatcccagctcacg

SEQ ID NO: 1518444 - DNA, 18 bp, Homo sapiens
accagcagcactggaacc

SEQ ID NO: 1518445 - DNA, 23 bp, Homo sapiens
accagcagcatagaacaggacct

SEQ ID NO: 1518446 - DNA, 18 bp, Homo sapiens
accagcaggtgtggtggc

SEQ ID NO: 1518447 - DNA, 21 bp, Homo sapiens
accagcaggtgtggtggctca

SEQ ID NO: 1518448 - DNA, 23 bp, Homo sapiens
accagcaggtgtggtggctcatg

SEQ ID NO: 1518449 - DNA, 15 bp, Homo sapiens
accagcattccctac

SEQ ID NO: 1518450 - DNA, 16 bp, Homo sapiens
accagcattccctaca

SEQ ID NO: 1518451 - DNA, 11 bp, Homo sapiens
accagccaggc

SEQ ID NO: 1518452 - DNA, 14 bp, Homo sapiens
accagccaggcaga

SEQ ID NO: 1518453 - DNA, 13 bp, Homo sapiens
accagccccagca

SEQ ID NO: 1518454 - DNA, 14 bp, Homo sapiens
accagccccagcaa

SEQ ID NO: 1518455 - DNA, 15 bp, Homo sapiens
accagccccctggat

SEQ ID NO: 1518456 - DNA, 16 bp, Homo sapiens
accagccccctggatg

SEQ ID NO: 1518457 - DNA, 21 bp, Homo sapiens
accagccccctggatgggcat

SEQ ID NO: 1518458 - DNA, 17 bp, Homo sapiens
accagcccgaacaccat

SEQ ID NO: 1518459 - DNA, 21 bp, Homo sapiens
accagcccgacagtgccatcc

SEQ ID NO: 1518460 - DNA, 14 bp, Homo sapiens
accagcccggcctg

SEQ ID NO: 1518461 - DNA, 15 bp, Homo sapiens
accagcccggcctgc

SEQ ID NO: 1518462 - DNA, 20 bp, Homo sapiens
accagccctagctgtcccat

SEQ ID NO: 1518463 - DNA, 16 bp, Homo sapiens
accagccgctgcaggg

SEQ ID NO: 1518464 - DNA, 15 bp, Homo sapiens
accagccgtatttta

SEQ ID NO: 1518465 - DNA, 16 bp, Homo sapiens
accagccgtattttac

SEQ ID NO: 1518466 - DNA, 22 bp, Homo sapiens
accagcctgctgacagacacta

SEQ ID NO: 1518467 - DNA, 11 bp, Homo sapiens
accagcctggc

SEQ ID NO: 1518468 - DNA, 20 bp, Homo sapiens
accagcctggtcaacatggt

SEQ ID NO: 1518469 - DNA, 22 bp, Homo sapiens
accagcctgtccaacatggtga

SEQ ID NO: 1518470 - DNA, 15 bp, Homo sapiens
accagccttcggagc

SEQ ID NO: 1518471 - DNA, 22 bp, Homo sapiens
accagcctttctcccaggccag

SEQ ID NO: 1518472 - DNA, 19 bp, Homo sapiens
accagcgccaaatgttcat

SEQ ID NO: 1518473 - DNA, 14 bp, Homo sapiens
accagcgcccgctg

SEQ ID NO: 1518474 - DNA, 19 bp, Homo sapiens
accagcgcccgctgggctg

SEQ ID NO: 1518475 - DNA, 20 bp, Homo sapiens
accagcgcccgctgggctga

SEQ ID NO: 1518476 - DNA, 13 bp, Homo sapiens
accagcggctgct

SEQ ID NO: 1518477 - DNA, 15 bp, Homo sapiens
accagcggctgctca

SEQ ID NO: 1518478 - DNA, 18 bp, Homo sapiens
accagcggctgctcaagc

SEQ ID NO: 1518479 - DNA, 13 bp, Homo sapiens
accagctcagagg

SEQ ID NO: 1518480 - DNA, 11 bp, Homo sapiens
accagctccca

SEQ ID NO: 1518481 - DNA, 19 bp, Homo sapiens
accagctcccaacagaggc

SEQ ID NO: 1518482 - DNA, 22 bp, Homo sapiens
accagctcccaacagaggcctc

SEQ ID NO: 1518483 - DNA, 12 bp, Homo sapiens
accagctcccag

SEQ ID NO: 1518484 - DNA, 15 bp, Homo sapiens
accagctcccagggt

SEQ ID NO: 1518485 - DNA, 17 bp, Homo sapiens
accagctcccagggtgg

SEQ ID NO: 1518486 - DNA, 20 bp, Homo sapiens
accagctctcttcctgtctt

SEQ ID NO: 1518487 - DNA, 15 bp, Homo sapiens
accagctctgtggcc

SEQ ID NO: 1518488 - DNA, 23 bp, Homo sapiens
accagctctgtggcctgtgtcca

SEQ ID NO: 1518489 - DNA, 20 bp, Homo sapiens
accagctgaaagttgggact

SEQ ID NO: 1518490 - DNA, 18 bp, Homo sapiens
accagctgcgcttgcttt

SEQ ID NO: 1518491 - DNA, 19 bp, Homo sapiens
accagctgcgcttgctttt

SEQ ID NO: 1518492 - DNA, 15 bp, Homo sapiens
accagctgctctgcc

SEQ ID NO: 1518493 - DNA, 19 bp, Homo sapiens
accagctgctgtgccccac

SEQ ID NO: 1518494 - DNA, 16 bp, Homo sapiens
accagcttaaaacact

SEQ ID NO: 1518495 - DNA, 20 bp, Homo sapiens
accagcttaaaacacttctt

SEQ ID NO: 1518496 - DNA, 17 bp, Homo sapiens
accagcttaaaggcagt

SEQ ID NO: 1518497 - DNA, 13 bp, Homo sapiens
accaggaacagca

SEQ ID NO: 1518498 - DNA, 22 bp, Homo sapiens
accaggactagggctggagtga

SEQ ID NO: 1518499 - DNA, 15 bp, Homo sapiens
accaggactccctcc

SEQ ID NO: 1518500 - DNA, 23 bp, Homo sapiens
accaggagaagggctggggccgg

SEQ ID NO: 1518501 - DNA, 22 bp, Homo sapiens
accaggagcagcagccagcacc

SEQ ID NO: 1518502 - DNA, 18 bp, Homo sapiens
accaggagctagcccagt

SEQ ID NO: 1518503 - DNA, 18 bp, Homo sapiens
accaggatttattttgag

SEQ ID NO: 1518504 - DNA, 20 bp, Homo sapiens
accaggcaacctcccatccc

SEQ ID NO: 1518505 - DNA, 16 bp, Homo sapiens
accaggcacctcttcc

SEQ ID NO: 1518506 - DNA, 22 bp, Homo sapiens
accaggcacgaacccacctgct

SEQ ID NO: 1518507 - DNA, 17 bp, Homo sapiens
accaggccacctcccca

SEQ ID NO: 1518508 - DNA, 14 bp, Homo sapiens
accaggccgggctt

SEQ ID NO: 1518509 - DNA, 21 bp, Homo sapiens
accaggccgggcttgggccct

SEQ ID NO: 1518510 - DNA, 16 bp, Homo sapiens
accaggccgtcctccc

SEQ ID NO: 1518511 - DNA, 18 bp, Homo sapiens
accaggccgtcctcccgg

SEQ ID NO: 1518512 - DNA, 14 bp, Homo sapiens
accaggcctggcct

SEQ ID NO: 1518513 - DNA, 19 bp, Homo sapiens
accaggccttcatcctcct

SEQ ID NO: 1518514 - DNA, 21 bp, Homo sapiens
accaggctgcagcctccactt

SEQ ID NO: 1518515 - DNA, 20 bp, Homo sapiens
accaggctggacaccctctg

SEQ ID NO: 1518516 - DNA, 23 bp, Homo sapiens
accaggctggacaccctctgccg

SEQ ID NO: 1518517 - DNA, 22 bp, Homo sapiens
accaggctggcgcagccaaggc

SEQ ID NO: 1518518 - DNA, 13 bp, Homo sapiens
accaggctgtgtc

SEQ ID NO: 1518519 - DNA, 23 bp, Homo sapiens
accagggaagaagatcaacgcct

SEQ ID NO: 1518520 - DNA, 20 bp, Homo sapiens
accagggagcccctttgatg

SEQ ID NO: 1518521 - DNA, 13 bp, Homo sapiens
accagggatgctg

SEQ ID NO: 1518522 - DNA, 14 bp, Homo sapiens
accagggatgctgg

SEQ ID NO: 1518523 - DNA, 20 bp, Homo sapiens
accagggatgctgggctggg

SEQ ID NO: 1518524 - DNA, 23 bp, Homo sapiens
accagggccttttctggcaccgc

SEQ ID NO: 1518525 - DNA, 16 bp, Homo sapiens
accaggggaaggaagg

SEQ ID NO: 1518526 - DNA, 17 bp, Homo sapiens
accaggggaaggaagga

SEQ ID NO: 1518527 - DNA, 20 bp, Homo sapiens
accaggggaaggaaggaggg

SEQ ID NO: 1518528 - DNA, 17 bp, Homo sapiens
accaggggaggagcctg

SEQ ID NO: 1518529 - DNA, 22 bp, Homo sapiens
accaggggtgctcacctctgcc

SEQ ID NO: 1518530 - DNA, 16 bp, Homo sapiens
accaggggtttctcgc

SEQ ID NO: 1518531 - DNA, 20 bp, Homo sapiens
accagggtccgcaccagctg

SEQ ID NO: 1518532 - DNA, 21 bp, Homo sapiens
accagggtccgcaccagctgc

SEQ ID NO: 1518533 - DNA, 22 bp, Homo sapiens
accagggtccgcaccagctgct

SEQ ID NO: 1518534 - DNA, 15 bp, Homo sapiens
accaggtcctgctcc

SEQ ID NO: 1518535 - DNA, 22 bp, Homo sapiens
accaggtcctgctccgctgcct

SEQ ID NO: 1518536 - DNA, 23 bp, Homo sapiens
accaggtgttctacactcatctt

SEQ ID NO: 1518537 - DNA, 19 bp, Homo sapiens
accaggttgggaacatgct

SEQ ID NO: 1518538 - DNA, 16 bp, Homo sapiens
accagtcagggacagc

SEQ ID NO: 1518539 - DNA, 21 bp, Homo sapiens
accagtcagggacagcagcct

SEQ ID NO: 1518540 - DNA, 11 bp, Homo sapiens
accagtctatt

SEQ ID NO: 1518541 - DNA, 15 bp, Homo sapiens
accagtctgtctact

SEQ ID NO: 1518542 - DNA, 19 bp, Homo sapiens
accagtctgtctactgtgg

SEQ ID NO: 1518543 - DNA, 20 bp, Homo sapiens
accagtgagaactctctccc

SEQ ID NO: 1518544 - DNA, 18 bp, Homo sapiens
accagtgagtggccccac

SEQ ID NO: 1518545 - DNA, 22 bp, Homo sapiens
accagtgagtggccccacctgt

SEQ ID NO: 1518546 - DNA, 18 bp, Homo sapiens
accagtgcgattctggat

SEQ ID NO: 1518547 - DNA, 14 bp, Homo sapiens
accagtggtgctca

SEQ ID NO: 1518548 - DNA, 12 bp, Homo sapiens
accagtgtacag

SEQ ID NO: 1518549 - DNA, 16 bp, Homo sapiens
accagtgtagccttgc

SEQ ID NO: 1518550 - DNA, 21 bp, Homo sapiens
cgccaaggtagccatcccatg

SEQ ID NO: 1518551 - DNA, 22 bp, Homo sapiens
cgccaaggtagccatcccatga

SEQ ID NO: 1518552 - DNA, 14 bp, Homo sapiens
cgccacagcccagc

SEQ ID NO: 1518553 - DNA, 21 bp, Homo sapiens
cgccacagcccagccacggac

SEQ ID NO: 1518554 - DNA, 23 bp, Homo sapiens
cgccacccccatcttccacctgt

SEQ ID NO: 1518555 - DNA, 18 bp, Homo sapiens
cgccacctttcaccctca

SEQ ID NO: 1518556 - DNA, 15 bp, Homo sapiens
cgccacggccaccct

SEQ ID NO: 1518557 - DNA, 15 bp, Homo sapiens
cgccacgtcccagca

SEQ ID NO: 1518558 - DNA, 21 bp, Homo sapiens
cgccacgtcccagcatccctg

SEQ ID NO: 1518559 - DNA, 18 bp, Homo sapiens
cgccactaggtgtcccca

SEQ ID NO: 1518560 - DNA, 19 bp, Homo sapiens
cgccactaggtgtccccaa

SEQ ID NO: 1518561 - DNA, 19 bp, Homo sapiens
cgccactcagccatttccc

SEQ ID NO: 1518562 - DNA, 24 bp, Homo sapiens
cgccactcctatccccaggccagg

SEQ ID NO: 1518563 - DNA, 13 bp, Homo sapiens
cgccactgcactc

SEQ ID NO: 1518564 - DNA, 17 bp, Homo sapiens
cgccagaggtgcttcac

SEQ ID NO: 1518565 - DNA, 16 bp, Homo sapiens
cgccagccccaagctg

SEQ ID NO: 1518566 - DNA, 17 bp, Homo sapiens
cgccagccccaagctgg

SEQ ID NO: 1518567 - DNA, 16 bp, Homo sapiens
cgccagcctcagtgcc

SEQ ID NO: 1518568 - DNA, 19 bp, Homo sapiens
cgccagcctcagtgccact

SEQ ID NO: 1518569 - DNA, 23 bp, Homo sapiens
cgccagcctcctctggacggcag

SEQ ID NO: 1518570 - DNA, 15 bp, Homo sapiens
cgccagcgaacttga

SEQ ID NO: 1518571 - DNA, 16 bp, Homo sapiens
cgccagcgtgtggagc

SEQ ID NO: 1518572 - DNA, 11 bp, Homo sapiens
cgccagctcct

SEQ ID NO: 1518573 - DNA, 15 bp, Homo sapiens
cgccagctgccgcac

SEQ ID NO: 1518574 - DNA, 20 bp, Homo sapiens
cgccagctgccgcaccagcc

SEQ ID NO: 1518575 - DNA, 14 bp, Homo sapiens
cgccagctgggagc

SEQ ID NO: 1518576 - DNA, 15 bp, Homo sapiens
cgccaggcagagctg

SEQ ID NO: 1518577 - DNA, 23 bp, Homo sapiens
cgccaggcagagctgagggccct

SEQ ID NO: 1518578 - DNA, 15 bp, Homo sapiens
cgccaggcgctgcag

SEQ ID NO: 1518579 - DNA, 11 bp, Homo sapiens
cgccagggctg

SEQ ID NO: 1518580 - DNA, 16 bp, Homo sapiens
cgccagggctggggac

SEQ ID NO: 1518581 - DNA, 24 bp, Homo sapiens
cgccatccttcaccagagcccatg

SEQ ID NO: 1518582 - DNA, 19 bp, Homo sapiens
cgccattgcactccagcct

SEQ ID NO: 1518583 - DNA, 16 bp, Homo sapiens
cgccattgccaccagg

SEQ ID NO: 1518584 - DNA, 18 bp, Homo sapiens
cgccattgtactccagcc

SEQ ID NO: 1518585 - DNA, 21 bp, Homo sapiens
cgccattgtactccagcctgg

SEQ ID NO: 1518586 - DNA, 14 bp, Homo sapiens
cgcccaccctgggc

SEQ ID NO: 1518587 - DNA, 21 bp, Homo sapiens
cgcccacctagtgcttccact

SEQ ID NO: 1518588 - DNA, 14 bp, Homo sapiens
cgcccactgtcctg

SEQ ID NO: 1518589 - DNA, 16 bp, Homo sapiens
cgcccactgtcctggg

SEQ ID NO: 1518590 - DNA, 19 bp, Homo sapiens
cgcccactgtcctgggcgc

SEQ ID NO: 1518591 - DNA, 22 bp, Homo sapiens
cgcccactgtcctgggcgccct

SEQ ID NO: 1518592 - DNA, 22 bp, Homo sapiens
cgcccagagacccaagctgcct

SEQ ID NO: 1518593 - DNA, 14 bp, Homo sapiens
cgcccagcagaggc

SEQ ID NO: 1518594 - DNA, 12 bp, Homo sapiens
cgcccagctccg

SEQ ID NO: 1518595 - DNA, 18 bp, Homo sapiens
cgcccagctccgcctgct

SEQ ID NO: 1518596 - DNA, 23 bp, Homo sapiens
cgcccagctgcacctgccagcct

SEQ ID NO: 1518597 - DNA, 14 bp, Homo sapiens
cgcccaggacagct

SEQ ID NO: 1518598 - DNA, 20 bp, Homo sapiens
cgcccaggctggagtgcagt

SEQ ID NO: 1518599 - DNA, 17 bp, Homo sapiens
cgcccatcaccttggag

SEQ ID NO: 1518600 - DNA, 14 bp, Homo sapiens
cgcccatctcagga

SEQ ID NO: 1518601 - DNA, 19 bp, Homo sapiens
cgcccattcgtctgtccca

SEQ ID NO: 1518602 - DNA, 12 bp, Homo sapiens
cgccccaacact

SEQ ID NO: 1518603 - DNA, 13 bp, Homo sapiens
cgcccccacccct

SEQ ID NO: 1518604 - DNA, 23 bp, Homo sapiens
cgcccccacccctacagcctgca

SEQ ID NO: 1518605 - DNA, 22 bp, Homo sapiens
cgcccccagtccccacccctgc

SEQ ID NO: 1518606 - DNA, 19 bp, Homo sapiens
cgccccctccgccctgcca

SEQ ID NO: 1518607 - DNA, 20 bp, Homo sapiens
cgccccctccgccctgccac

SEQ ID NO: 1518608 - DNA, 13 bp, Homo sapiens
cgcccccttggct

SEQ ID NO: 1518609 - DNA, 19 bp, Homo sapiens
cgccccgttgtgagctgga

SEQ ID NO: 1518610 - DNA, 22 bp, Homo sapiens
cgcccctccaaacctccagcct

SEQ ID NO: 1518611 - DNA, 23 bp, Homo sapiens
cgcccctccaaacctccagcctc

SEQ ID NO: 1518612 - DNA, 14 bp, Homo sapiens
cgcccctgccacct

SEQ ID NO: 1518613 - DNA, 20 bp, Homo sapiens
cgcccctgggctaccatctg

SEQ ID NO: 1518614 - DNA, 12 bp, Homo sapiens
cgcccctgtggc

SEQ ID NO: 1518615 - DNA, 13 bp, Homo sapiens
cgcccctgtggcc

SEQ ID NO: 1518616 - DNA, 15 bp, Homo sapiens
cgcccctgtggccaa

SEQ ID NO: 1518617 - DNA, 15 bp, Homo sapiens
cgcccctgttttttg

SEQ ID NO: 1518618 - DNA, 13 bp, Homo sapiens
cgccccttccccc

SEQ ID NO: 1518619 - DNA, 14 bp, Homo sapiens
cgcccgcccactgt

SEQ ID NO: 1518620 - DNA, 19 bp, Homo sapiens
cgcccgcccactgtcctgg

SEQ ID NO: 1518621 - DNA, 21 bp, Homo sapiens
cgcccgcccactgtcctgggc

SEQ ID NO: 1518622 - DNA, 13 bp, Homo sapiens
cgcccgcgcccgc

SEQ ID NO: 1518623 - DNA, 13 bp, Homo sapiens
cgcccggcagccc

SEQ ID NO: 1518624 - DNA, 16 bp, Homo sapiens
cgccctactccactgc

SEQ ID NO: 1518625 - DNA, 16 bp, Homo sapiens
cgccctaggcctggca

SEQ ID NO: 1518626 - DNA, 16 bp, Homo sapiens
cgccctatttctatgt

SEQ ID NO: 1518627 - DNA, 15 bp, Homo sapiens
cgccctccctctccc

SEQ ID NO: 1518628 - DNA, 21 bp, Homo sapiens
cgccctcctcgggccgaggcc

SEQ ID NO: 1518629 - DNA, 19 bp, Homo sapiens
cgccctctctgctccttca

SEQ ID NO: 1518630 - DNA, 22 bp, Homo sapiens
cgccctctctgctccttcactg

SEQ ID NO: 1518631 - DNA, 21 bp, Homo sapiens
cgccctgcgttggagccactc

SEQ ID NO: 1518632 - DNA, 15 bp, Homo sapiens
cgccctgctcctccc

SEQ ID NO: 1518633 - DNA, 16 bp, Homo sapiens
cgccctggaagccggc

SEQ ID NO: 1518634 - DNA, 18 bp, Homo sapiens
cgcccttcagcccaccac

SEQ ID NO: 1518635 - DNA, 20 bp, Homo sapiens
cgcccttccatgtgcctttc

SEQ ID NO: 1518636 - DNA, 17 bp, Homo sapiens
cgcccttggcttctgtg

SEQ ID NO: 1518637 - DNA, 15 bp, Homo sapiens
cgcccttgtgccctg

SEQ ID NO: 1518638 - DNA, 20 bp, Homo sapiens
cgccctttcctcctcaggca

SEQ ID NO: 1518639 - DNA, 19 bp, Homo sapiens
cgccctttccttgccttct

SEQ ID NO: 1518640 - DNA, 18 bp, Homo sapiens
cgccgccttggccttgca

SEQ ID NO: 1518641 - DNA, 18 bp, Homo sapiens
cgccgcgccagtccccgc

SEQ ID NO: 1518642 - DNA, 20 bp, Homo sapiens
cgccgcgcgcccctgcccga

SEQ ID NO: 1518643 - DNA, 13 bp, Homo sapiens
cgccgctgaccct

SEQ ID NO: 1518644 - DNA, 22 bp, Homo sapiens
cgccgctgaccctgggcctgga

SEQ ID NO: 1518645 - DNA, 22 bp, Homo sapiens
cgccgctgcccttgggtccccc

SEQ ID NO: 1518646 - DNA, 13 bp, Homo sapiens
cgccgggcaccaa

SEQ ID NO: 1518647 - DNA, 13 bp, Homo sapiens
cgccgtccctccc

SEQ ID NO: 1518648 - DNA, 16 bp, Homo sapiens
cgccgtccctcccagg

SEQ ID NO: 1518649 - DNA, 15 bp, Homo sapiens
cgccgtctccagggg

SEQ ID NO: 1518650 - DNA, 21 bp, Homo sapiens
cgccgtgccggcggcagcccc

SEQ ID NO: 1518651 - DNA, 16 bp, Homo sapiens
cgcctactcttcaggg

SEQ ID NO: 1518652 - DNA, 21 bp, Homo sapiens
cgcctactcttcagggtctaa

SEQ ID NO: 1518653 - DNA, 16 bp, Homo sapiens
cgcctatgatcccagc

SEQ ID NO: 1518654 - DNA, 21 bp, Homo sapiens
cgcctcactgcaaccttcacc

SEQ ID NO: 1518655 - DNA, 21 bp, Homo sapiens
cgcctcagcctgatcaggctt

SEQ ID NO: 1518656 - DNA, 14 bp, Homo sapiens
cgcctccactctag

SEQ ID NO: 1518657 - DNA, 19 bp, Homo sapiens
cgcctccaggagcctaccc

SEQ ID NO: 1518658 - DNA, 15 bp, Homo sapiens
cgcctcccccgcagg

SEQ ID NO: 1518659 - DNA, 22 bp, Homo sapiens
cgcctccctagttagcatccag

SEQ ID NO: 1518660 - DNA, 22 bp, Homo sapiens
cgcctccctctcagaggcctgc

SEQ ID NO: 1518661 - DNA, 24 bp, Homo sapiens
cgcctcggctaggggtcctcggga

SEQ ID NO: 1518662 - DNA, 17 bp, Homo sapiens
acccacagctcagctgc

SEQ ID NO: 1518663 - DNA, 15 bp, Homo sapiens
acccacattactttt

SEQ ID NO: 1518664 - DNA, 17 bp, Homo sapiens
acccaccacccccttta

SEQ ID NO: 1518665 - DNA, 13 bp, Homo sapiens
acccaccagtgcc

SEQ ID NO: 1518666 - DNA, 21 bp, Homo sapiens
acccaccccaactctccccag

SEQ ID NO: 1518667 - DNA, 17 bp, Homo sapiens
acccaccccctttggtt

SEQ ID NO: 1518668 - DNA, 12 bp, Homo sapiens
acccacccctgc

SEQ ID NO: 1518669 - DNA, 14 bp, Homo sapiens
acccacccctgccc

SEQ ID NO: 1518670 - DNA, 20 bp, Homo sapiens
acccacccggctggccggga

SEQ ID NO: 1518671 - DNA, 22 bp, Homo sapiens
acccaccgtccgccctgctcct

SEQ ID NO: 1518672 - DNA, 15 bp, Homo sapiens
acccaccgtggagga

SEQ ID NO: 1518673 - DNA, 23 bp, Homo sapiens
acccacctccccctccccggcca

SEQ ID NO: 1518674 - DNA, 11 bp, Homo sapiens
acccacctgct

SEQ ID NO: 1518675 - DNA, 22 bp, Homo sapiens
acccacctgctgagagacccaa

SEQ ID NO: 1518676 - DNA, 19 bp, Homo sapiens
acccacctgttttctgaaa

SEQ ID NO: 1518677 - DNA, 15 bp, Homo sapiens
acccaccttgacgtt

SEQ ID NO: 1518678 - DNA, 20 bp, Homo sapiens
acccaccttgttggagcctg

SEQ ID NO: 1518679 - DNA, 21 bp, Homo sapiens
acccaccttgttggagcctgc

SEQ ID NO: 1518680 - DNA, 18 bp, Homo sapiens
acccacgaacgctcttag

SEQ ID NO: 1518681 - DNA, 12 bp, Homo sapiens
acccacgaggat

SEQ ID NO: 1518682 - DNA, 13 bp, Homo sapiens
acccactaaagag

SEQ ID NO: 1518683 - DNA, 22 bp, Homo sapiens
acccactgaaatgaccaagaca

SEQ ID NO: 1518684 - DNA, 12 bp, Homo sapiens
acccactgaccc

SEQ ID NO: 1518685 - DNA, 16 bp, Homo sapiens
acccactgacccaact

SEQ ID NO: 1518686 - DNA, 17 bp, Homo sapiens
acccacttatttttcaa

SEQ ID NO: 1518687 - DNA, 19 bp, Homo sapiens
acccactttgtaatttttg

SEQ ID NO: 1518688 - DNA, 20 bp, Homo sapiens
acccactttgtaatttttgc

SEQ ID NO: 1518689 - DNA, 14 bp, Homo sapiens
acccagaaaggcta

SEQ ID NO: 1518690 - DNA, 19 bp, Homo sapiens
acccagaatgagacatcca

SEQ ID NO: 1518691 - DNA, 14 bp, Homo sapiens
acccagaatggagc

SEQ ID NO: 1518692 - DNA, 18 bp, Homo sapiens
acccagaatggagcctgc

SEQ ID NO: 1518693 - DNA, 19 bp, Homo sapiens
acccagactggaatgcagt

SEQ ID NO: 1518694 - DNA, 18 bp, Homo sapiens
acccagagaatatataca

SEQ ID NO: 1518695 - DNA, 17 bp, Homo sapiens
acccagagaggaatcag

SEQ ID NO: 1518696 - DNA, 19 bp, Homo sapiens
acccagatgttgcttttga

SEQ ID NO: 1518697 - DNA, 20 bp, Homo sapiens
acccagattgtgtacataga

SEQ ID NO: 1518698 - DNA, 14 bp, Homo sapiens
acccagcatctccc

SEQ ID NO: 1518699 - DNA, 22 bp, Homo sapiens
acccagcatctcccagcaagac

SEQ ID NO: 1518700 - DNA, 15 bp, Homo sapiens
acccagccatctgcc

SEQ ID NO: 1518701 - DNA, 19 bp, Homo sapiens
acccagccatctgcccagg

SEQ ID NO: 1518702 - DNA, 21 bp, Homo sapiens
acccagccatctgcccagggg

SEQ ID NO: 1518703 - DNA, 23 bp, Homo sapiens
acccagcccattctctctcctgt

SEQ ID NO: 1518704 - DNA, 20 bp, Homo sapiens
acccagccccttgagaaacc

SEQ ID NO: 1518705 - DNA, 21 bp, Homo sapiens
acccagctccttttgtcccca

SEQ ID NO: 1518706 - DNA, 19 bp, Homo sapiens
acccagcttagagttcttc

SEQ ID NO: 1518707 - DNA, 20 bp, Homo sapiens
acccagcttagagttcttct

SEQ ID NO: 1518708 - DNA, 23 bp, Homo sapiens
acccaggaccatcctggagggct

SEQ ID NO: 1518709 - DNA, 23 bp, Homo sapiens
acccaggacttatttaaactctg

SEQ ID NO: 1518710 - DNA, 20 bp, Homo sapiens
acccaggaggtggaggttgc

SEQ ID NO: 1518711 - DNA, 16 bp, Homo sapiens
acccaggccctccatg

SEQ ID NO: 1518712 - DNA, 19 bp, Homo sapiens
acccaggccctccatgggc

SEQ ID NO: 1518713 - DNA, 21 bp, Homo sapiens
acccaggccctccatgggcta

SEQ ID NO: 1518714 - DNA, 17 bp, Homo sapiens
acccaggcctccctgca

SEQ ID NO: 1518715 - DNA, 18 bp, Homo sapiens
acccaggcctccctgcag

SEQ ID NO: 1518716 - DNA, 22 bp, Homo sapiens
acccaggcctccctgcagactc

SEQ ID NO: 1518717 - DNA, 23 bp, Homo sapiens
acccaggcctccctgcagactcc

SEQ ID NO: 1518718 - DNA, 11 bp, Homo sapiens
acccaggctgc

SEQ ID NO: 1518719 - DNA, 13 bp, Homo sapiens
acccaggctgcac

SEQ ID NO: 1518720 - DNA, 17 bp, Homo sapiens
acccaggctgcactgca

SEQ ID NO: 1518721 - DNA, 11 bp, Homo sapiens
acccagggctc

SEQ ID NO: 1518722 - DNA, 16 bp, Homo sapiens
acccaggggacagctg

SEQ ID NO: 1518723 - DNA, 21 bp, Homo sapiens
acccaggtcccccgactgcct

SEQ ID NO: 1518724 - DNA, 21 bp, Homo sapiens
acccaggtggagggcacagcc

SEQ ID NO: 1518725 - DNA, 23 bp, Homo sapiens
acccaggtggagggcacagccct

SEQ ID NO: 1518726 - DNA, 14 bp, Homo sapiens
acccaggtgtgcct

SEQ ID NO: 1518727 - DNA, 16 bp, Homo sapiens
acccaggtgtgcctgt

SEQ ID NO: 1518728 - DNA, 19 bp, Homo sapiens
acccaggtgtgcctgtgct

SEQ ID NO: 1518729 - DNA, 17 bp, Homo sapiens
acccaggttaagaaaat

SEQ ID NO: 1518730 - DNA, 19 bp, Homo sapiens
acccaggttggagtgcagt

SEQ ID NO: 1518731 - DNA, 23 bp, Homo sapiens
acccagtccccacccgcctgcag

SEQ ID NO: 1518732 - DNA, 14 bp, Homo sapiens
acccagtccctggg

SEQ ID NO: 1518733 - DNA, 14 bp, Homo sapiens
acccagtgaacaca

SEQ ID NO: 1518734 - DNA, 22 bp, Homo sapiens
acccagtgaggatgctgcagtg

SEQ ID NO: 1518735 - DNA, 18 bp, Homo sapiens
acccagtgcagaatgtaa

SEQ ID NO: 1518736 - DNA, 14 bp, Homo sapiens
acccagtgctgaat

SEQ ID NO: 1518737 - DNA, 22 bp, Homo sapiens
acccagtgctgccatgccactg

SEQ ID NO: 1518738 - DNA, 18 bp, Homo sapiens
acccagtgggtctgggat

SEQ ID NO: 1518739 - DNA, 15 bp, Homo sapiens
acccagtgtccttcc

SEQ ID NO: 1518740 - DNA, 21 bp, Homo sapiens
acccagttgctgatccctgct

SEQ ID NO: 1518741 - DNA, 19 bp, Homo sapiens
acccagttggtgactggga

SEQ ID NO: 1518742 - DNA, 20 bp, Homo sapiens
acccagttggtgactgggaa

SEQ ID NO: 1518743 - DNA, 18 bp, Homo sapiens
acccataaacagcacacc

SEQ ID NO: 1518744 - DNA, 21 bp, Homo sapiens
acccatacaatgtatgtacaa

SEQ ID NO: 1518745 - DNA, 17 bp, Homo sapiens
acccatagatcttctga

SEQ ID NO: 1518746 - DNA, 15 bp, Homo sapiens
acccatagcagcttt

SEQ ID NO: 1518747 - DNA, 15 bp, Homo sapiens
acccatagcttccat

SEQ ID NO: 1518748 - DNA, 16 bp, Homo sapiens
acccatagcttccatg

SEQ ID NO: 1518749 - DNA, 16 bp, Homo sapiens
acccatattgtaaaac

SEQ ID NO: 1518750 - DNA, 22 bp, Homo sapiens
acccatattttccccctgtttt

SEQ ID NO: 1518751 - DNA, 14 bp, Homo sapiens
acccatcagaagga

SEQ ID NO: 1518752 - DNA, 19 bp, Homo sapiens
acccatcaggaccactcag

SEQ ID NO: 1518753 - DNA, 16 bp, Homo sapiens
acccatcgtccacccc

SEQ ID NO: 1518754 - DNA, 13 bp, Homo sapiens
acccatctgtagt

SEQ ID NO: 1518755 - DNA, 20 bp, Homo sapiens
acccatctgtagtaatttat

SEQ ID NO: 1518756 - DNA, 16 bp, Homo sapiens
acccatcttcctgctg

SEQ ID NO: 1518757 - DNA, 19 bp, Homo sapiens
acccatcttcctgctgctg

SEQ ID NO: 1518758 - DNA, 20 bp, Homo sapiens
acccatcttcctgctgctgt

SEQ ID NO: 1518759 - DNA, 12 bp, Homo sapiens
acccatgaagat

SEQ ID NO: 1518760 - DNA, 20 bp, Homo sapiens
acccatgaggcaatgtcagg

SEQ ID NO: 1518761 - DNA, 13 bp, Homo sapiens
acccatgatactc

SEQ ID NO: 1518762 - DNA, 16 bp, Homo sapiens
acccatgatactccac

SEQ ID NO: 1518763 - DNA, 22 bp, Homo sapiens
acccatgcaagcagaggaccag

SEQ ID NO: 1518764 - DNA, 17 bp, Homo sapiens
acccatgcagctgctcc

SEQ ID NO: 1518765 - DNA, 16 bp, Homo sapiens
acccatgccagagagg

SEQ ID NO: 1518766 - DNA, 23 bp, Homo sapiens
acccatgtgggcgcccaccctgg

SEQ ID NO: 1518767 - DNA, 24 bp, Homo sapiens
acccatgtgggcgcccaccctggg

SEQ ID NO: 1518768 - DNA, 20 bp, Homo sapiens
acccatgtgttaaaatactc

SEQ ID NO: 1518769 - DNA, 15 bp, Homo sapiens
acccattatctggaa

SEQ ID NO: 1518770 - DNA, 13 bp, Homo sapiens
acccattcagaga

SEQ ID NO: 1518771 - DNA, 20 bp, Homo sapiens
acccattcccccatgtggct

SEQ ID NO: 1518772 - DNA, 22 bp, Homo sapiens
acccattcccccatgtggctga

SEQ ID NO: 1518773 - DNA, 23 bp, Homo sapiens
acccattcccccatgtggctgaa

SEQ ID NO: 1518774 - DNA, 22 bp, Homo sapiens
acccattgccccagacctggaa

SEQ ID NO: 1518775 - DNA, 17 bp, Homo sapiens
acccattgttgtcaagg

SEQ ID NO: 1518776 - DNA, 13 bp, Homo sapiens
cgctgatatatgt

SEQ ID NO: 1518777 - DNA, 14 bp, Homo sapiens
cgctgatgcagaca

SEQ ID NO: 1518778 - DNA, 15 bp, Homo sapiens
cgctgatggagcccc

SEQ ID NO: 1518779 - DNA, 16 bp, Homo sapiens
cgctgatggagcccca

SEQ ID NO: 1518780 - DNA, 17 bp, Homo sapiens
cgctgcagggctcccat

SEQ ID NO: 1518781 - DNA, 22 bp, Homo sapiens
cgctgcaggtacttcctcctga

SEQ ID NO: 1518782 - DNA, 20 bp, Homo sapiens
cgctgccaccacgtctgcca

SEQ ID NO: 1518783 - DNA, 17 bp, Homo sapiens
cgctgccagcacagagc

SEQ ID NO: 1518784 - DNA, 14 bp, Homo sapiens
cgctgccagccttg

SEQ ID NO: 1518785 - DNA, 23 bp, Homo sapiens
accccaacctctcctttctgtgc

SEQ ID NO: 1518786 - DNA, 17 bp, Homo sapiens
accccaacgcacaggaa

SEQ ID NO: 1518787 - DNA, 20 bp, Homo sapiens
accccaactctccccagtgc

SEQ ID NO: 1518788 - DNA, 16 bp, Homo sapiens
accccaagagaactcg

SEQ ID NO: 1518789 - DNA, 13 bp, Homo sapiens
accccaaggactg

SEQ ID NO: 1518790 - DNA, 16 bp, Homo sapiens
accccacaccaggccg

SEQ ID NO: 1518791 - DNA, 16 bp, Homo sapiens
accccacacctgcagt

SEQ ID NO: 1518792 - DNA, 20 bp, Homo sapiens
accccacagaaccttcaacc

SEQ ID NO: 1518793 - DNA, 11 bp, Homo sapiens
accccacccaa

SEQ ID NO: 1518794 - DNA, 21 bp, Homo sapiens
accccaccctagtttccctga

SEQ ID NO: 1518795 - DNA, 12 bp, Homo sapiens
accccactccag

SEQ ID NO: 1518796 - DNA, 14 bp, Homo sapiens
accccactccagcc

SEQ ID NO: 1518797 - DNA, 16 bp, Homo sapiens
accccactccagccct

SEQ ID NO: 1518798 - DNA, 19 bp, Homo sapiens
accccactgggccagccct

SEQ ID NO: 1518799 - DNA, 22 bp, Homo sapiens
accccactgggccagccctgca

SEQ ID NO: 1518800 - DNA, 22 bp, Homo sapiens
accccagaaattctggcccagc

SEQ ID NO: 1518801 - DNA, 13 bp, Homo sapiens
accccagaggcag

SEQ ID NO: 1518802 - DNA, 23 bp, Homo sapiens
accccagaggcagaggttgcagt

SEQ ID NO: 1518803 - DNA, 16 bp, Homo sapiens
accccagccaggctcc

SEQ ID NO: 1518804 - DNA, 22 bp, Homo sapiens
accccagcctggccacgcagcc

SEQ ID NO: 1518805 - DNA, 14 bp, Homo sapiens
accccagctcccta

SEQ ID NO: 1518806 - DNA, 23 bp, Homo sapiens
accccagctccctaggagaccaa

SEQ ID NO: 1518807 - DNA, 18 bp, Homo sapiens
accccagggcccccacag

SEQ ID NO: 1518808 - DNA, 17 bp, Homo sapiens
accccagtcccagggaa

SEQ ID NO: 1518809 - DNA, 22 bp, Homo sapiens
accccatctctatcagaaatac

SEQ ID NO: 1518810 - DNA, 16 bp, Homo sapiens
accccatgccaaagct

SEQ ID NO: 1518811 - DNA, 13 bp, Homo sapiens
accccattcctga

SEQ ID NO: 1518812 - DNA, 20 bp, Homo sapiens
acccccacaagctgtccctg

SEQ ID NO: 1518813 - DNA, 23 bp, Homo sapiens
acccccacaagctgtccctgcag

SEQ ID NO: 1518814 - DNA, 19 bp, Homo sapiens
acccccacccccagctcaa

SEQ ID NO: 1518815 - DNA, 21 bp, Homo sapiens
acccccactctcattccccag

SEQ ID NO: 1518816 - DNA, 12 bp, Homo sapiens
acccccagcact

SEQ ID NO: 1518817 - DNA, 20 bp, Homo sapiens
acccccagctaataaaccag

SEQ ID NO: 1518818 - DNA, 14 bp, Homo sapiens
acccccagttccta

SEQ ID NO: 1518819 - DNA, 20 bp, Homo sapiens
acccccagttcctatgacac

SEQ ID NO: 1518820 - DNA, 16 bp, Homo sapiens
acccccatccagcctc

SEQ ID NO: 1518821 - DNA, 19 bp, Homo sapiens
acccccatccagcctccag

SEQ ID NO: 1518822 - DNA, 16 bp, Homo sapiens
acccccatctccctag

SEQ ID NO: 1518823 - DNA, 15 bp, Homo sapiens
accccccagcactga

SEQ ID NO: 1518824 - DNA, 20 bp, Homo sapiens
acccccctccccaactccct

SEQ ID NO: 1518825 - DNA, 15 bp, Homo sapiens
acccccctcctgctc

SEQ ID NO: 1518826 - DNA, 23 bp, Homo sapiens
acccccctcctgctcctccctgc

SEQ ID NO: 1518827 - DNA, 18 bp, Homo sapiens
acccccctctctttctct

SEQ ID NO: 1518828 - DNA, 15 bp, Homo sapiens
acccccctctgctgc

SEQ ID NO: 1518829 - DNA, 16 bp, Homo sapiens
acccccgaccctgccc

SEQ ID NO: 1518830 - DNA, 15 bp, Homo sapiens
acccccgccacggcc

SEQ ID NO: 1518831 - DNA, 19 bp, Homo sapiens
acccccgccacggccaccc

SEQ ID NO: 1518832 - DNA, 23 bp, Homo sapiens
acccccgccacggccaccctcct

SEQ ID NO: 1518833 - DNA, 12 bp, Homo sapiens
accccctcacca

SEQ ID NO: 1518834 - DNA, 16 bp, Homo sapiens
accccctcattgttta

SEQ ID NO: 1518835 - DNA, 16 bp, Homo sapiens
accccctccccagggg

SEQ ID NO: 1518836 - DNA, 15 bp, Homo sapiens
accccctccccgccc

SEQ ID NO: 1518837 - DNA, 17 bp, Homo sapiens
accccctccctgtccca

SEQ ID NO: 1518838 - DNA, 11 bp, Homo sapiens
accccctcctc

SEQ ID NO: 1518839 - DNA, 16 bp, Homo sapiens
accccctcctccccca

SEQ ID NO: 1518840 - DNA, 14 bp, Homo sapiens
accccctgccctgc

SEQ ID NO: 1518841 - DNA, 17 bp, Homo sapiens
accccctggccctgcct

SEQ ID NO: 1518842 - DNA, 13 bp, Homo sapiens
accccctgtccca

SEQ ID NO: 1518843 - DNA, 21 bp, Homo sapiens
accccctgtcccattctagat

SEQ ID NO: 1518844 - DNA, 15 bp, Homo sapiens
acccccttccctggg

SEQ ID NO: 1518845 - DNA, 18 bp, Homo sapiens
acccccttctactgagcc

SEQ ID NO: 1518846 - DNA, 13 bp, Homo sapiens
acccccttctctg

SEQ ID NO: 1518847 - DNA, 16 bp, Homo sapiens
acccccttctctgctc

SEQ ID NO: 1518848 - DNA, 17 bp, Homo sapiens
acccccttctctgctcc

SEQ ID NO: 1518849 - DNA, 18 bp, Homo sapiens
accccgagaaccctgagc

SEQ ID NO: 1518850 - DNA, 20 bp, Homo sapiens
accccgcagacaccttggac

SEQ ID NO: 1518851 - DNA, 12 bp, Homo sapiens
accccgcagccc

SEQ ID NO: 1518852 - DNA, 13 bp, Homo sapiens
accccgcagcccg

SEQ ID NO: 1518853 - DNA, 21 bp, Homo sapiens
accccgcaggatccctcctga

SEQ ID NO: 1518854 - DNA, 23 bp, Homo sapiens
accccgcaggatccctcctgagc

SEQ ID NO: 1518855 - DNA, 14 bp, Homo sapiens
accccgcctgcctc

SEQ ID NO: 1518856 - DNA, 22 bp, Homo sapiens
accccgcggtgctctggcggct

SEQ ID NO: 1518857 - DNA, 21 bp, Homo sapiens
accccggcctccactccccca

SEQ ID NO: 1518858 - DNA, 13 bp, Homo sapiens
accccgggctctc

SEQ ID NO: 1518859 - DNA, 15 bp, Homo sapiens
accccgggctctctg

SEQ ID NO: 1518860 - DNA, 21 bp, Homo sapiens
accccgggctctctgctgtac

SEQ ID NO: 1518861 - DNA, 19 bp, Homo sapiens
accccggtggcggccccag

SEQ ID NO: 1518862 - DNA, 21 bp, Homo sapiens
accccggtggcggccccagca

SEQ ID NO: 1518863 - DNA, 19 bp, Homo sapiens
accccgtctctataccaac

SEQ ID NO: 1518864 - DNA, 21 bp, Homo sapiens
acccctaaaagaaaccctgca

SEQ ID NO: 1518865 - DNA, 16 bp, Homo sapiens
acccctacagcctgca

SEQ ID NO: 1518866 - DNA, 18 bp, Homo sapiens
acccctacagcctgcaca

SEQ ID NO: 1518867 - DNA, 16 bp, Homo sapiens
acccctacatgaaaca

SEQ ID NO: 1518868 - DNA, 14 bp, Homo sapiens
acccctcactcccc

SEQ ID NO: 1518869 - DNA, 11 bp, Homo sapiens
acccctccacg

SEQ ID NO: 1518870 - DNA, 12 bp, Homo sapiens
acccctccagga

SEQ ID NO: 1518871 - DNA, 14 bp, Homo sapiens
acccctcccaacct

SEQ ID NO: 1518872 - DNA, 12 bp, Homo sapiens
acccctccccat

SEQ ID NO: 1518873 - DNA, 20 bp, Homo sapiens
acccctccccattcacagag

SEQ ID NO: 1518874 - DNA, 13 bp, Homo sapiens
acccctccctttc

SEQ ID NO: 1518875 - DNA, 16 bp, Homo sapiens
acccctccctttctcc

SEQ ID NO: 1518876 - DNA, 19 bp, Homo sapiens
acccctccctttctcccct

SEQ ID NO: 1518877 - DNA, 14 bp, Homo sapiens
acccctcctggctg

SEQ ID NO: 1518878 - DNA, 17 bp, Homo sapiens
acccctccttccttgac

SEQ ID NO: 1518879 - DNA, 22 bp, Homo sapiens
acccctccttccttgaccagca

SEQ ID NO: 1518880 - DNA, 18 bp, Homo sapiens
acccctcgccacctttca

SEQ ID NO: 1518881 - DNA, 13 bp, Homo sapiens
acccctctcttag

SEQ ID NO: 1518882 - DNA, 13 bp, Homo sapiens
acccctctggcca

SEQ ID NO: 1518883 - DNA, 14 bp, Homo sapiens
acccctctggccag

SEQ ID NO: 1518884 - DNA, 22 bp, Homo sapiens
acccctctggtgtgtggtgagg

SEQ ID NO: 1518885 - DNA, 12 bp, Homo sapiens
acccctgcccag

SEQ ID NO: 1518886 - DNA, 12 bp, Homo sapiens
acccctgccccc

SEQ ID NO: 1518887 - DNA, 20 bp, Homo sapiens
acccctgcccccagccccgg

SEQ ID NO: 1518888 - DNA, 11 bp, Homo sapiens
acccctgcctg

SEQ ID NO: 1518889 - DNA, 19 bp, Homo sapiens
acccctgctcccattcctc

SEQ ID NO: 1518890 - DNA, 19 bp, Homo sapiens
acccctggaagagcccagt

SEQ ID NO: 1518891 - DNA, 16 bp, Homo sapiens
cggaggtctctgggag

SEQ ID NO: 1518892 - DNA, 18 bp, Homo sapiens
cggaggtctctgggagcc

SEQ ID NO: 1518893 - DNA, 22 bp, Homo sapiens
cggaggttgggtgggccggctt

SEQ ID NO: 1518894 - DNA, 17 bp, Homo sapiens
cggagtaatcaggcagc

SEQ ID NO: 1518895 - DNA, 23 bp, Homo sapiens
cggagtcattttgtgttgaagag

SEQ ID NO: 1518896 - DNA, 15 bp, Homo sapiens
cggagtcgtggggtg

SEQ ID NO: 1518897 - DNA, 22 bp, Homo sapiens
cggagtgaagaggggcagccct

SEQ ID NO: 1518898 - DNA, 15 bp, Homo sapiens
cggagtgcctggagt

SEQ ID NO: 1518899 - DNA, 18 bp, Homo sapiens
cggatcaccgagagtagc

SEQ ID NO: 1518900 - DNA, 23 bp, Homo sapiens
cggatcaccgagagtagccgaga

SEQ ID NO: 1518901 - DNA, 20 bp, Homo sapiens
cggatcctaagcatctaagt

SEQ ID NO: 1518902 - DNA, 20 bp, Homo sapiens
cggatgacaccctggcctga

SEQ ID NO: 1518903 - DNA, 13 bp, Homo sapiens
cggatgaccaaac

SEQ ID NO: 1518904 - DNA, 15 bp, Homo sapiens
cggatgaccaaacca

SEQ ID NO: 1518905 - DNA, 20 bp, Homo sapiens
cggatgaccaaaccagcctt

SEQ ID NO: 1518906 - DNA, 11 bp, Homo sapiens
cggatttctaa

SEQ ID NO: 1518907 - DNA, 15 bp, Homo sapiens
cggatttggggtgga

SEQ ID NO: 1518908 - DNA, 13 bp, Homo sapiens
cggcaaaaggaaa

SEQ ID NO: 1518909 - DNA, 19 bp, Homo sapiens
cggcaacgtagcctgggct

SEQ ID NO: 1518910 - DNA, 23 bp, Homo sapiens
cggcaacgtagcctgggctcact

SEQ ID NO: 1518911 - DNA, 19 bp, Homo sapiens
cggcaagcgcttctgctga

SEQ ID NO: 1518912 - DNA, 20 bp, Homo sapiens
cggcaagcgcttctgctgaa

SEQ ID NO: 1518913 - DNA, 18 bp, Homo sapiens
cggcacagggtctgctct

SEQ ID NO: 1518914 - DNA, 19 bp, Homo sapiens
cggcacagggtctgctctt

SEQ ID NO: 1518915 - DNA, 21 bp, Homo sapiens
cggcacagggtctgctctttc

SEQ ID NO: 1518916 - DNA, 22 bp, Homo sapiens
cggcacctacatccccaggtct

SEQ ID NO: 1518917 - DNA, 18 bp, Homo sapiens
cggcacgcacttgcctgt

SEQ ID NO: 1518918 - DNA, 24 bp, Homo sapiens
cggcagagcaattccaggctgagc

SEQ ID NO: 1518919 - DNA, 15 bp, Homo sapiens
cggcagccccacttc

SEQ ID NO: 1518920 - DNA, 15 bp, Homo sapiens
cggcagcgggcggag

SEQ ID NO: 1518921 - DNA, 17 bp, Homo sapiens
cggcaggcctgagaatg

SEQ ID NO: 1518922 - DNA, 20 bp, Homo sapiens
cggcagggcgggcagagggc

SEQ ID NO: 1518923 - DNA, 15 bp, Homo sapiens
cggcaggggcctgga

SEQ ID NO: 1518924 - DNA, 21 bp, Homo sapiens
cggcatgagactcagtgcaga

SEQ ID NO: 1518925 - DNA, 18 bp, Homo sapiens
cggcatgtttccagcaga

SEQ ID NO: 1518926 - DNA, 13 bp, Homo sapiens
cggccaagaatgt

SEQ ID NO: 1518927 - DNA, 14 bp, Homo sapiens
cggccaaggtgcca

SEQ ID NO: 1518928 - DNA, 23 bp, Homo sapiens
cggccaaggtgccaccaccctgc

SEQ ID NO: 1518929 - DNA, 17 bp, Homo sapiens
cggccacacccagcggc

SEQ ID NO: 1518930 - DNA, 14 bp, Homo sapiens
cggccacagctgct

SEQ ID NO: 1518931 - DNA, 15 bp, Homo sapiens
cggccacagctgctg

SEQ ID NO: 1518932 - DNA, 17 bp, Homo sapiens
cggccacagctgctgga

SEQ ID NO: 1518933 - DNA, 21 bp, Homo sapiens
cggccacagggcggtaccttg

SEQ ID NO: 1518934 - DNA, 14 bp, Homo sapiens
cggccacatgccgc

SEQ ID NO: 1518935 - DNA, 10 bp, Homo sapiens
cggccaccct

SEQ ID NO: 1518936 - DNA, 17 bp, Homo sapiens
cggccacgcactgggcc

SEQ ID NO: 1518937 - DNA, 22 bp, Homo sapiens
cggccacgcactgggccacgga

SEQ ID NO: 1518938 - DNA, 15 bp, Homo sapiens
cggccagcgggcaca

SEQ ID NO: 1518939 - DNA, 21 bp, Homo sapiens
cggccagcgggcacagggcac

SEQ ID NO: 1518940 - DNA, 14 bp, Homo sapiens
cggccaggcacagg

SEQ ID NO: 1518941 - DNA, 15 bp, Homo sapiens
cggccaggcacaggg

SEQ ID NO: 1518942 - DNA, 18 bp, Homo sapiens
cggccaggcacagggccc

SEQ ID NO: 1518943 - DNA, 20 bp, Homo sapiens
cggccaggcacagggcccgc

SEQ ID NO: 1518944 - DNA, 16 bp, Homo sapiens
cggccaggcacccatg

SEQ ID NO: 1518945 - DNA, 21 bp, Homo sapiens
cggccaggcattggctcagcc

SEQ ID NO: 1518946 - DNA, 16 bp, Homo sapiens
cggccagggagaagct

SEQ ID NO: 1518947 - DNA, 21 bp, Homo sapiens
cggccagtgcggctgccaggt

SEQ ID NO: 1518948 - DNA, 16 bp, Homo sapiens
cggcccaagcccgact

SEQ ID NO: 1518949 - DNA, 12 bp, Homo sapiens
cggcccacagct

SEQ ID NO: 1518950 - DNA, 15 bp, Homo sapiens
cggcccacagctccc

SEQ ID NO: 1518951 - DNA, 19 bp, Homo sapiens
cggcccactttcctgagct

SEQ ID NO: 1518952 - DNA, 16 bp, Homo sapiens
cggcccagtgccactg

SEQ ID NO: 1518953 - DNA, 20 bp, Homo sapiens
cggcccagtgccactgcccc

SEQ ID NO: 1518954 - DNA, 20 bp, Homo sapiens
cggcccatccccaggcacct

SEQ ID NO: 1518955 - DNA, 22 bp, Homo sapiens
cggccccagcacctcagcctgc

SEQ ID NO: 1518956 - DNA, 17 bp, Homo sapiens
cggccccccgcacagcc

SEQ ID NO: 1518957 - DNA, 23 bp, Homo sapiens
cggccccccgcgctcgcccagca

SEQ ID NO: 1518958 - DNA, 15 bp, Homo sapiens
cggccccggccccag

SEQ ID NO: 1518959 - DNA, 21 bp, Homo sapiens
cggcccggccagcgggcacag

SEQ ID NO: 1518960 - DNA, 22 bp, Homo sapiens
cggcccggccagcgggcacagg

SEQ ID NO: 1518961 - DNA, 20 bp, Homo sapiens
cggccctaccagcgcccgct

SEQ ID NO: 1518962 - DNA, 21 bp, Homo sapiens
cggccctcagtagtccctgca

SEQ ID NO: 1518963 - DNA, 17 bp, Homo sapiens
cggccctgcagccagct

SEQ ID NO: 1518964 - DNA, 12 bp, Homo sapiens
cggccctgctga

SEQ ID NO: 1518965 - DNA, 17 bp, Homo sapiens
cggccctgctgaagctg

SEQ ID NO: 1518966 - DNA, 19 bp, Homo sapiens
cggccctgctgaagctgct

SEQ ID NO: 1518967 - DNA, 13 bp, Homo sapiens
cggccctggcttg

SEQ ID NO: 1518968 - DNA, 16 bp, Homo sapiens
cggccgaccaggctgg

SEQ ID NO: 1518969 - DNA, 16 bp, Homo sapiens
cggccgcgccgccgcc

SEQ ID NO: 1518970 - DNA, 17 bp, Homo sapiens
cggcctaggcacctccc

SEQ ID NO: 1518971 - DNA, 19 bp, Homo sapiens
cggcctcagggcgctcaga

SEQ ID NO: 1518972 - DNA, 10 bp, Homo sapiens
cggcctccac

SEQ ID NO: 1518973 - DNA, 16 bp, Homo sapiens
cggcctccacacctga

SEQ ID NO: 1518974 - DNA, 12 bp, Homo sapiens
cggcctccactc

SEQ ID NO: 1518975 - DNA, 14 bp, Homo sapiens
cggcctccactccc

SEQ ID NO: 1518976 - DNA, 21 bp, Homo sapiens
cggcctccactcccccacctg

SEQ ID NO: 1518977 - DNA, 14 bp, Homo sapiens
cggcctcccaaagt

SEQ ID NO: 1518978 - DNA, 20 bp, Homo sapiens
cggcctcccaaagtgctggg

SEQ ID NO: 1518979 - DNA, 16 bp, Homo sapiens
cggcctccgaggctcc

SEQ ID NO: 1518980 - DNA, 21 bp, Homo sapiens
cggcctccgtccaggagcctg

SEQ ID NO: 1518981 - DNA, 18 bp, Homo sapiens
cggcctcctcggagagca

SEQ ID NO: 1518982 - DNA, 19 bp, Homo sapiens
cggcctctctcttcccagc

SEQ ID NO: 1518983 - DNA, 15 bp, Homo sapiens
cggcctctctggcct

SEQ ID NO: 1518984 - DNA, 18 bp, Homo sapiens
cggcctctctggcctccc

SEQ ID NO: 1518985 - DNA, 19 bp, Homo sapiens
cggcctctctggcctccca

SEQ ID NO: 1518986 - DNA, 20 bp, Homo sapiens
cggcctctctggcctcccac

SEQ ID NO: 1518987 - DNA, 13 bp, Homo sapiens
cggcctctgcctt

SEQ ID NO: 1518988 - DNA, 17 bp, Homo sapiens
cggcctctgcctttgca

SEQ ID NO: 1518989 - DNA, 16 bp, Homo sapiens
cggcctgatgctccct

SEQ ID NO: 1518990 - DNA, 19 bp, Homo sapiens
cggcctgctcccagcagcc

SEQ ID NO: 1518991 - DNA, 12 bp, Homo sapiens
cggcctggcacc

SEQ ID NO: 1518992 - DNA, 19 bp, Homo sapiens
cggccttcaactgaaaaga

SEQ ID NO: 1518993 - DNA, 15 bp, Homo sapiens
cggccttgaagacag

SEQ ID NO: 1518994 - DNA, 16 bp, Homo sapiens
cggcgcagacaggcgg

SEQ ID NO: 1518995 - DNA, 15 bp, Homo sapiens
cggcgccaccatcct

SEQ ID NO: 1518996 - DNA, 17 bp, Homo sapiens
cggcgccaccatcctgc

SEQ ID NO: 1518997 - DNA, 19 bp, Homo sapiens
cggcgcgggcccctcacct

SEQ ID NO: 1518998 - DNA, 16 bp, Homo sapiens
cggcgcttcccagcac

SEQ ID NO: 1518999 - DNA, 23 bp, Homo sapiens
cggcggcagccccacttcacccc

SEQ ID NO: 1519000 - DNA, 14 bp, Homo sapiens
cggcggccaggcac

SEQ ID NO: 1519001 - DNA, 16 bp, Homo sapiens
cggcggccaggcacag

SEQ ID NO: 1519002 - DNA, 19 bp, Homo sapiens
cggcggccaggcacagggc

SEQ ID NO: 1519003 - DNA, 12 bp, Homo sapiens
cggcggcctctc

SEQ ID NO: 1519004 - DNA, 19 bp, Homo sapiens
cggcgggatcctccacaga

SEQ ID NO: 1519005 - DNA, 18 bp, Homo sapiens
cggcgggtgctctgaggc

SEQ ID NO: 1519006 - DNA, 14 bp, Homo sapiens
cctttctctgggct

SEQ ID NO: 1519007 - DNA, 22 bp, Homo sapiens
cctttctcttttcccctttcct

SEQ ID NO: 1519008 - DNA, 21 bp, Homo sapiens
cctttctggaagtttctggtg

SEQ ID NO: 1519009 - DNA, 12 bp, Homo sapiens
cctttctgtgtt

SEQ ID NO: 1519010 - DNA, 12 bp, Homo sapiens
cctttcttctgt

SEQ ID NO: 1519011 - DNA, 16 bp, Homo sapiens
cctttcttctgtgtta

SEQ ID NO: 1519012 - DNA, 12 bp, Homo sapiens
cctttctttgcc

SEQ ID NO: 1519013 - DNA, 22 bp, Homo sapiens
cctttcttttaatgatgccatg

SEQ ID NO: 1519014 - DNA, 16 bp, Homo sapiens
cctttctttttcttct

SEQ ID NO: 1519015 - DNA, 18 bp, Homo sapiens
cctttgagatctggggag

SEQ ID NO: 1519016 - DNA, 19 bp, Homo sapiens
cctttgagatctggggagg

SEQ ID NO: 1519017 - DNA, 17 bp, Homo sapiens
cctttgataaaataaat

SEQ ID NO: 1519018 - DNA, 14 bp, Homo sapiens
cctttgcactgagg

SEQ ID NO: 1519019 - DNA, 13 bp, Homo sapiens
cctttgcactgta

SEQ ID NO: 1519020 - DNA, 22 bp, Homo sapiens
cctttgcagttggactctcagg

SEQ ID NO: 1519021 - DNA, 23 bp, Homo sapiens
cctttgcagttggactctcaggg

SEQ ID NO: 1519022 - DNA, 16 bp, Homo sapiens
cctttgcccagaaaga

SEQ ID NO: 1519023 - DNA, 11 bp, Homo sapiens
cctttgccgcg

SEQ ID NO: 1519024 - DNA, 16 bp, Homo sapiens
cctttgcgcctgtgac

SEQ ID NO: 1519025 - DNA, 17 bp, Homo sapiens
cctttgctatgtaaggg

SEQ ID NO: 1519026 - DNA, 12 bp, Homo sapiens
cctttgctcttg

SEQ ID NO: 1519027 - DNA, 23 bp, Homo sapiens
cctttgctgtgaggctgtcctgt

SEQ ID NO: 1519028 - DNA, 18 bp, Homo sapiens
cctttggaacaagacagc

SEQ ID NO: 1519029 - DNA, 22 bp, Homo sapiens
cctttggaacaagacagccttc

SEQ ID NO: 1519030 - DNA, 14 bp, Homo sapiens
cctttggagaccat

SEQ ID NO: 1519031 - DNA, 12 bp, Homo sapiens
cctttggcctgg

SEQ ID NO: 1519032 - DNA, 22 bp, Homo sapiens
cctttggcctggggtgcatctc

SEQ ID NO: 1519033 - DNA, 18 bp, Homo sapiens
cctttgggtcctgggcag

SEQ ID NO: 1519034 - DNA, 14 bp, Homo sapiens
cctttggtgcagag

SEQ ID NO: 1519035 - DNA, 17 bp, Homo sapiens
cctttggtgcagaggtt

SEQ ID NO: 1519036 - DNA, 14 bp, Homo sapiens
cctttggttctggc

SEQ ID NO: 1519037 - DNA, 15 bp, Homo sapiens
cctttggtttgacaa

SEQ ID NO: 1519038 - DNA, 21 bp, Homo sapiens
cctttggtttgacaattttgt

SEQ ID NO: 1519039 - DNA, 12 bp, Homo sapiens
cctttgtaagtt

SEQ ID NO: 1519040 - DNA, 22 bp, Homo sapiens
cctttgtattctgtcttcatcc

SEQ ID NO: 1519041 - DNA, 12 bp, Homo sapiens
cctttgtcattt

SEQ ID NO: 1519042 - DNA, 17 bp, Homo sapiens
cctttgtcttgtacttc

SEQ ID NO: 1519043 - DNA, 22 bp, Homo sapiens
cctttgtgtgtattcagaggca

SEQ ID NO: 1519044 - DNA, 13 bp, Homo sapiens
cctttgttctggg

SEQ ID NO: 1519045 - DNA, 20 bp, Homo sapiens
cctttgttgaactgttagaa

SEQ ID NO: 1519046 - DNA, 11 bp, Homo sapiens
ccttttacttt

SEQ ID NO: 1519047 - DNA, 19 bp, Homo sapiens
ccttttatcccaaagttgt

SEQ ID NO: 1519048 - DNA, 23 bp, Homo sapiens
ccttttatttttatttctgactc

SEQ ID NO: 1519049 - DNA, 14 bp, Homo sapiens
ccttttcaggaaaa

SEQ ID NO: 1519050 - DNA, 15 bp, Homo sapiens
ccttttcccttgctg

SEQ ID NO: 1519051 - DNA, 13 bp, Homo sapiens
ccttttcctatcc

SEQ ID NO: 1519052 - DNA, 22 bp, Homo sapiens
ccttttcttttctaccctagcc

SEQ ID NO: 1519053 - DNA, 14 bp, Homo sapiens
ccttttgaacttgt

SEQ ID NO: 1519054 - DNA, 17 bp, Homo sapiens
ccttttgatggggagaa

SEQ ID NO: 1519055 - DNA, 18 bp, Homo sapiens
ccttttgatggggagaaa

SEQ ID NO: 1519056 - DNA, 18 bp, Homo sapiens
ccttttgcacccctccca

SEQ ID NO: 1519057 - DNA, 18 bp, Homo sapiens
ccttttgcataagattaa

SEQ ID NO: 1519058 - DNA, 15 bp, Homo sapiens
ccttttgcctggctg

SEQ ID NO: 1519059 - DNA, 18 bp, Homo sapiens
ccttttggaacatttctt

SEQ ID NO: 1519060 - DNA, 22 bp, Homo sapiens
ccttttggaacatttctttctt

SEQ ID NO: 1519061 - DNA, 18 bp, Homo sapiens
ccttttgtccccagggcc

SEQ ID NO: 1519062 - DNA, 11 bp, Homo sapiens
ccttttgtgta

SEQ ID NO: 1519063 - DNA, 19 bp, Homo sapiens
cctttttaatatgcttaaa

SEQ ID NO: 1519064 - DNA, 13 bp, Homo sapiens
cctttttccttcc

SEQ ID NO: 1519065 - DNA, 14 bp, Homo sapiens
cctttttctccagc

SEQ ID NO: 1519066 - DNA, 16 bp, Homo sapiens
cctttttctccagctg

SEQ ID NO: 1519067 - DNA, 20 bp, Homo sapiens
cctttttctttataaacttt

SEQ ID NO: 1519068 - DNA, 16 bp, Homo sapiens
cctttttgacactgaa

SEQ ID NO: 1519069 - DNA, 23 bp, Homo sapiens
cctttttggtacttattactgct

SEQ ID NO: 1519070 - DNA, 14 bp, Homo sapiens
cctttttgtataaa

SEQ ID NO: 1519071 - DNA, 19 bp, Homo sapiens
cctttttgtataaaataga

SEQ ID NO: 1519072 - DNA, 12 bp, Homo sapiens
ccttttttcaaa

SEQ ID NO: 1519073 - DNA, 23 bp, Homo sapiens
ccttttttgtcccccaacttgag

SEQ ID NO: 1519074 - DNA, 20 bp, Homo sapiens
cgaaactccatctcaaaaca

SEQ ID NO: 1519075 - DNA, 13 bp, Homo sapiens
cgaaagctctaga

SEQ ID NO: 1519076 - DNA, 23 bp, Homo sapiens
cgaaaggaggccctgttccctgg

SEQ ID NO: 1519077 - DNA, 11 bp, Homo sapiens
cgaaaggcctt

SEQ ID NO: 1519078 - DNA, 19 bp, Homo sapiens
cgaaaggccttcagacaca

SEQ ID NO: 1519079 - DNA, 13 bp, Homo sapiens
cgaaatgttattt

SEQ ID NO: 1519080 - DNA, 17 bp, Homo sapiens
cgaaattccaaggccca

SEQ ID NO: 1519081 - DNA, 11 bp, Homo sapiens
cgaacacacat

SEQ ID NO: 1519082 - DNA, 19 bp, Homo sapiens
cgaacatccaaccttccca

SEQ ID NO: 1519083 - DNA, 22 bp, Homo sapiens
cgaacatggaactcattcctgc

SEQ ID NO: 1519084 - DNA, 20 bp, Homo sapiens
cgaaccaaggcagcctccag

SEQ ID NO: 1519085 - DNA, 22 bp, Homo sapiens
cgaaccaaggcagcctccagag

SEQ ID NO: 1519086 - DNA, 15 bp, Homo sapiens
cgaacgctcttagct

SEQ ID NO: 1519087 - DNA, 15 bp, Homo sapiens
cgaactcctggcctc

SEQ ID NO: 1519088 - DNA, 16 bp, Homo sapiens
cgaactcctggcctca

SEQ ID NO: 1519089 - DNA, 22 bp, Homo sapiens
cgaagagggaatggatggggag

SEQ ID NO: 1519090 - DNA, 21 bp, Homo sapiens
cgaagagtatttttgacagaa

SEQ ID NO: 1519091 - DNA, 22 bp, Homo sapiens
cgaagccatcacttctccccgc

SEQ ID NO: 1519092 - DNA, 20 bp, Homo sapiens
cgaagccatctttctttgga

SEQ ID NO: 1519093 - DNA, 15 bp, Homo sapiens
cgaagccccttggag

SEQ ID NO: 1519094 - DNA, 20 bp, Homo sapiens
cgaagccccttggagagaga

SEQ ID NO: 1519095 - DNA, 22 bp, Homo sapiens
cgaagccggacacggcttcact

SEQ ID NO: 1519096 - DNA, 23 bp, Homo sapiens
cgaagccggacacggcttcactg

SEQ ID NO: 1519097 - DNA, 17 bp, Homo sapiens
cgaagcggagagagcca

SEQ ID NO: 1519098 - DNA, 18 bp, Homo sapiens
cgaagcggagagagccaa

SEQ ID NO: 1519099 - DNA, 21 bp, Homo sapiens
cgaagctcttgtgaactgtct

SEQ ID NO: 1519100 - DNA, 22 bp, Homo sapiens
cgaagtgtttatgtaatagttc

SEQ ID NO: 1519101 - DNA, 21 bp, Homo sapiens
cgaataaaatctgctgcacct

SEQ ID NO: 1519102 - DNA, 20 bp, Homo sapiens
cgaataaaggtcccatgctc

SEQ ID NO: 1519103 - DNA, 19 bp, Homo sapiens
cgaatcccctccctgtcaa

SEQ ID NO: 1519104 - DNA, 15 bp, Homo sapiens
cgaatctcaaaatta

SEQ ID NO: 1519105 - DNA, 16 bp, Homo sapiens
cgaatctcatccctca

SEQ ID NO: 1519106 - DNA, 14 bp, Homo sapiens
cgaatggtctttgc

SEQ ID NO: 1519107 - DNA, 17 bp, Homo sapiens
cgaatggtctttgctcc

SEQ ID NO: 1519108 - DNA, 19 bp, Homo sapiens
cgaatggtctttgctccag

SEQ ID NO: 1519109 - DNA, 20 bp, Homo sapiens
cgaatggtctttgctccaga

SEQ ID NO: 1519110 - DNA, 21 bp, Homo sapiens
cgaatggtctttgctccagat

SEQ ID NO: 1519111 - DNA, 19 bp, Homo sapiens
cgaatgtaattggaatctt

SEQ ID NO: 1519112 - DNA, 20 bp, Homo sapiens
cgaattgagataatatctgt

SEQ ID NO: 1519113 - DNA, 21 bp, Homo sapiens
cgacaaaaacgaaactccatc

SEQ ID NO: 1519114 - DNA, 16 bp, Homo sapiens
cgacaaaatctcctgg

SEQ ID NO: 1519115 - DNA, 20 bp, Homo sapiens
cgacaaaatctcctggcttt

SEQ ID NO: 1519116 - DNA, 12 bp, Homo sapiens
cgacaccagaag

SEQ ID NO: 1519117 - DNA, 16 bp, Homo sapiens
cgacagagcgagactt

SEQ ID NO: 1519118 - DNA, 16 bp, Homo sapiens
cgacagcacacacagt

SEQ ID NO: 1519119 - DNA, 13 bp, Homo sapiens
cgacagcctggca

SEQ ID NO: 1519120 - DNA, 14 bp, Homo sapiens
cgacagcctggcac

SEQ ID NO: 1519121 - DNA, 19 bp, Homo sapiens
cgacagggcctggagcccc

SEQ ID NO: 1519122 - DNA, 20 bp, Homo sapiens
cgacatccgtcattgctgct

SEQ ID NO: 1519123 - DNA, 22 bp, Homo sapiens
ccttggctttatgcaaatacaa

SEQ ID NO: 1519124 - DNA, 23 bp, Homo sapiens
ccttggctttatgcaaatacaat

SEQ ID NO: 1519125 - DNA, 20 bp, Homo sapiens
ccttggctttcagagccagc

SEQ ID NO: 1519126 - DNA, 19 bp, Homo sapiens
ccttgggataattccttgg

SEQ ID NO: 1519127 - DNA, 18 bp, Homo sapiens
ccttgggcatccacccag

SEQ ID NO: 1519128 - DNA, 19 bp, Homo sapiens
ccttgggcatccacccagt

SEQ ID NO: 1519129 - DNA, 23 bp, Homo sapiens
ccttgggcatccacccagtgctg

SEQ ID NO: 1519130 - DNA, 11 bp, Homo sapiens
ccttgggcctg

SEQ ID NO: 1519131 - DNA, 15 bp, Homo sapiens
ccttgggcctggcca

SEQ ID NO: 1519132 - DNA, 17 bp, Homo sapiens
ccttgggcggctgagag

SEQ ID NO: 1519133 - DNA, 18 bp, Homo sapiens
ccttgggcggctgagagc

SEQ ID NO: 1519134 - DNA, 15 bp, Homo sapiens
ccttgggctcctggc

SEQ ID NO: 1519135 - DNA, 19 bp, Homo sapiens
ccttgggctcctggctgcc

SEQ ID NO: 1519136 - DNA, 18 bp, Homo sapiens
ccttggggcagggcctgg

SEQ ID NO: 1519137 - DNA, 13 bp, Homo sapiens
ccttggggcctgg

SEQ ID NO: 1519138 - DNA, 15 bp, Homo sapiens
ccttgggggctccca

SEQ ID NO: 1519139 - DNA, 13 bp, Homo sapiens
ccttggtgagaaa

SEQ ID NO: 1519140 - DNA, 17 bp, Homo sapiens
ccttggtgctgtgtgcc

SEQ ID NO: 1519141 - DNA, 17 bp, Homo sapiens
ccttggtggagcagcca

SEQ ID NO: 1519142 - DNA, 19 bp, Homo sapiens
ccttggtggagcagccaga

SEQ ID NO: 1519143 - DNA, 21 bp, Homo sapiens
ccttggtggagcagccagagc

SEQ ID NO: 1519144 - DNA, 15 bp, Homo sapiens
ccttggtgtccacct

SEQ ID NO: 1519145 - DNA, 17 bp, Homo sapiens
ccttggtgtccacctgg

SEQ ID NO: 1519146 - DNA, 18 bp, Homo sapiens
ccttggtgtccacctggc

SEQ ID NO: 1519147 - DNA, 17 bp, Homo sapiens
ccttggttcatcagtgt

SEQ ID NO: 1519148 - DNA, 18 bp, Homo sapiens
ccttggttcatcagtgtt

SEQ ID NO: 1519149 - DNA, 17 bp, Homo sapiens
ccttggttcccttgtgt

SEQ ID NO: 1519150 - DNA, 21 bp, Homo sapiens
ccttggtttttactgctctga

SEQ ID NO: 1519151 - DNA, 15 bp, Homo sapiens
ccttgtaaaaaaagc

SEQ ID NO: 1519152 - DNA, 18 bp, Homo sapiens
ccttgtaaaaaaagcaaa

SEQ ID NO: 1519153 - DNA, 16 bp, Homo sapiens
ccttgtaattctaaat

SEQ ID NO: 1519154 - DNA, 11 bp, Homo sapiens
ccttgtataaa

SEQ ID NO: 1519155 - DNA, 18 bp, Homo sapiens
ccttgtataatattgaaa

SEQ ID NO: 1519156 - DNA, 13 bp, Homo sapiens
ccttgtatttaaa

SEQ ID NO: 1519157 - DNA, 19 bp, Homo sapiens
ccttgtattttgttaaagc

SEQ ID NO: 1519158 - DNA, 22 bp, Homo sapiens
ccttgtcacgatcacaggcctt

SEQ ID NO: 1519159 - DNA, 20 bp, Homo sapiens
ccttgtccaggtctcactgc

SEQ ID NO: 1519160 - DNA, 13 bp, Homo sapiens
ccttgtcctgcca

SEQ ID NO: 1519161 - DNA, 18 bp, Homo sapiens
ccttgtcctgccagctgc

SEQ ID NO: 1519162 - DNA, 19 bp, Homo sapiens
ccttgtcctgccagctgcc

SEQ ID NO: 1519163 - DNA, 22 bp, Homo sapiens
ccttgtgcccagggttttgccc

SEQ ID NO: 1519164 - DNA, 14 bp, Homo sapiens
ccttgtgcctgggg

SEQ ID NO: 1519165 - DNA, 15 bp, Homo sapiens
ccttgtgccttcttt

SEQ ID NO: 1519166 - DNA, 24 bp, Homo sapiens
ccttgtgcttggtggggctcgtgg

SEQ ID NO: 1519167 - DNA, 14 bp, Homo sapiens
ccttgtggactggc

SEQ ID NO: 1519168 - DNA, 15 bp, Homo sapiens
ccttgtggactggct

SEQ ID NO: 1519169 - DNA, 12 bp, Homo sapiens
ccttgtggcttc

SEQ ID NO: 1519170 - DNA, 15 bp, Homo sapiens
ccttgtgtgatttta

SEQ ID NO: 1519171 - DNA, 15 bp, Homo sapiens
ccttgtgtgtcaggc

SEQ ID NO: 1519172 - DNA, 22 bp, Homo sapiens
ccttgtgtgtcaggccctctgc

SEQ ID NO: 1519173 - DNA, 23 bp, Homo sapiens
ccttgtgttcagctctttccaaa

SEQ ID NO: 1519174 - DNA, 15 bp, Homo sapiens
ccttgttacttctga

SEQ ID NO: 1519175 - DNA, 16 bp, Homo sapiens
ccttgttacttctgag

SEQ ID NO: 1519176 - DNA, 18 bp, Homo sapiens
ccttgttacttctgaggt

SEQ ID NO: 1519177 - DNA, 19 bp, Homo sapiens
ccttgttggagcctgcagg

SEQ ID NO: 1519178 - DNA, 14 bp, Homo sapiens
ccttgtttcaaaca

SEQ ID NO: 1519179 - DNA, 20 bp, Homo sapiens
ccttgtttcaaacacaaatg

SEQ ID NO: 1519180 - DNA, 22 bp, Homo sapiens
ccttgtttcaaacacaaatgca

SEQ ID NO: 1519181 - DNA, 22 bp, Homo sapiens
ccttgtttgattttagctgcag

SEQ ID NO: 1519182 - DNA, 15 bp, Homo sapiens
cctttaaaaaagaaa

SEQ ID NO: 1519183 - DNA, 18 bp, Homo sapiens
cctttaaagtatgaatct

SEQ ID NO: 1519184 - DNA, 22 bp, Homo sapiens
cctttaaagtatgaatctatgc

SEQ ID NO: 1519185 - DNA, 19 bp, Homo sapiens
cctttaactgacaagccat

SEQ ID NO: 1519186 - DNA, 20 bp, Homo sapiens
cctttaacttttttttctct

SEQ ID NO: 1519187 - DNA, 23 bp, Homo sapiens
cctttaacttttttttctctctt

SEQ ID NO: 1519188 - DNA, 14 bp, Homo sapiens
cctttaagccaaag

SEQ ID NO: 1519189 - DNA, 21 bp, Homo sapiens
cctttaagcctgcattcttaa

SEQ ID NO: 1519190 - DNA, 18 bp, Homo sapiens
cctttaattgtaaagtaa

SEQ ID NO: 1519191 - DNA, 18 bp, Homo sapiens
cctttacaccaactccta

SEQ ID NO: 1519192 - DNA, 15 bp, Homo sapiens
cctttacgtgtttaa

SEQ ID NO: 1519193 - DNA, 13 bp, Homo sapiens
cctttactcagcc

SEQ ID NO: 1519194 - DNA, 18 bp, Homo sapiens
cctttactcagcccagct

SEQ ID NO: 1519195 - DNA, 15 bp, Homo sapiens
cctttacttgacctc

SEQ ID NO: 1519196 - DNA, 15 bp, Homo sapiens
cctttagcctggacc

SEQ ID NO: 1519197 - DNA, 14 bp, Homo sapiens
cctttagctgtgtt

SEQ ID NO: 1519198 - DNA, 14 bp, Homo sapiens
cctttagggcagct

SEQ ID NO: 1519199 - DNA, 15 bp, Homo sapiens
cctttagggcagctt

SEQ ID NO: 1519200 - DNA, 20 bp, Homo sapiens
cctttagggcagcttgcccc

SEQ ID NO: 1519201 - DNA, 22 bp, Homo sapiens
cctttagggcagcttgccccgg

SEQ ID NO: 1519202 - DNA, 16 bp, Homo sapiens
cctttaggtctggttg

SEQ ID NO: 1519203 - DNA, 16 bp, Homo sapiens
cctttatcacctcatt

SEQ ID NO: 1519204 - DNA, 20 bp, Homo sapiens
cctttatcttgaagtcagcc

SEQ ID NO: 1519205 - DNA, 12 bp, Homo sapiens
cctttatgtgaa

SEQ ID NO: 1519206 - DNA, 13 bp, Homo sapiens
cctttatgtgaat

SEQ ID NO: 1519207 - DNA, 14 bp, Homo sapiens
cctttattaaaatc

SEQ ID NO: 1519208 - DNA, 20 bp, Homo sapiens
cctttattcacccctgcccc

SEQ ID NO: 1519209 - DNA, 21 bp, Homo sapiens
cctttatttttggcgtggctg

SEQ ID NO: 1519210 - DNA, 17 bp, Homo sapiens
cctttcaactagaaaat

SEQ ID NO: 1519211 - DNA, 22 bp, Homo sapiens
cctttcacaaaattttattcct

SEQ ID NO: 1519212 - DNA, 23 bp, Homo sapiens
cctttcacacatctgggtgccct

SEQ ID NO: 1519213 - DNA, 17 bp, Homo sapiens
cctttcaccctcatgaa

SEQ ID NO: 1519214 - DNA, 18 bp, Homo sapiens
cctttcaccctcatgaaa

SEQ ID NO: 1519215 - DNA, 13 bp, Homo sapiens
cctttcagatgtc

SEQ ID NO: 1519216 - DNA, 20 bp, Homo sapiens
cctttcagatgtcttctgcc

SEQ ID NO: 1519217 - DNA, 23 bp, Homo sapiens
cctttcaggccaaggctatgaag

SEQ ID NO: 1519218 - DNA, 17 bp, Homo sapiens
cctttcatctctctacc

SEQ ID NO: 1519219 - DNA, 21 bp, Homo sapiens
cctttcatctggattctacaa

SEQ ID NO: 1519220 - DNA, 15 bp, Homo sapiens
cctttcattttgctt

SEQ ID NO: 1519221 - DNA, 16 bp, Homo sapiens
cctttccaacctcact

SEQ ID NO: 1519222 - DNA, 16 bp, Homo sapiens
cctttccaaggcttct

SEQ ID NO: 1519223 - DNA, 18 bp, Homo sapiens
cctttccagagcaaccag

SEQ ID NO: 1519224 - DNA, 14 bp, Homo sapiens
cctttccatctgtc

SEQ ID NO: 1519225 - DNA, 18 bp, Homo sapiens
cctttcctgatgcccctg

SEQ ID NO: 1519226 - DNA, 20 bp, Homo sapiens
cctttcctgatgcccctgac

SEQ ID NO: 1519227 - DNA, 15 bp, Homo sapiens
cctttcctgtcccac

SEQ ID NO: 1519228 - DNA, 13 bp, Homo sapiens
cctttccttccca

SEQ ID NO: 1519229 - DNA, 12 bp, Homo sapiens
cctttccttcct

SEQ ID NO: 1519230 - DNA, 19 bp, Homo sapiens
cctttctaagccctgttct

SEQ ID NO: 1519231 - DNA, 14 bp, Homo sapiens
cctttctacaactg

SEQ ID NO: 1519232 - DNA, 17 bp, Homo sapiens
cctttctcccaggccag

SEQ ID NO: 1519233 - DNA, 15 bp, Homo sapiens
cctttctcccctgcc

SEQ ID NO: 1519234 - DNA, 18 bp, Homo sapiens
cctttctcccctgccccc

SEQ ID NO: 1519235 - DNA, 19 bp, Homo sapiens
cctttctcccctgccccca

SEQ ID NO: 1519236 - DNA, 20 bp, Homo sapiens
cctttctcccctgcccccag

SEQ ID NO: 1519237 - DNA, 15 bp, Homo sapiens
cctttctcctgcccc

SEQ ID NO: 1519238 - DNA, 17 bp, Homo sapiens
cctttctctcctggctc

SEQ ID NO: 1519239 - DNA, 15 bp, Homo sapiens
cctttctctctctaa

SEQ ID NO: 1519240 - DNA, 22 bp, Homo sapiens
acagttttccttctcatctgtg

SEQ ID NO: 1519241 - DNA, 12 bp, Homo sapiens
acagtttttaaa

SEQ ID NO: 1519242 - DNA, 17 bp, Homo sapiens
acagtttttttctttgt

SEQ ID NO: 1519243 - DNA, 16 bp, Homo sapiens
acataaaaacaacttt

SEQ ID NO: 1519244 - DNA, 19 bp, Homo sapiens
acataaaaactgatttgct

SEQ ID NO: 1519245 - DNA, 15 bp, Homo sapiens
acataaaacaaaacc

SEQ ID NO: 1519246 - DNA, 13 bp, Homo sapiens
acataaagcaaat

SEQ ID NO: 1519247 - DNA, 15 bp, Homo sapiens
acataaagcaaatag

SEQ ID NO: 1519248 - DNA, 14 bp, Homo sapiens
acataaatctgtct

SEQ ID NO: 1519249 - DNA, 18 bp, Homo sapiens
acataaatctgtctgatt

SEQ ID NO: 1519250 - DNA, 20 bp, Homo sapiens
acataaatctgtctgattct

SEQ ID NO: 1519251 - DNA, 12 bp, Homo sapiens
acataactgaaa

SEQ ID NO: 1519252 - DNA, 18 bp, Homo sapiens
acataacttgatatagaa

SEQ ID NO: 1519253 - DNA, 13 bp, Homo sapiens
acataagagaaag

SEQ ID NO: 1519254 - DNA, 16 bp, Homo sapiens
acataagataaatgtg

SEQ ID NO: 1519255 - DNA, 14 bp, Homo sapiens
acataagctcagaa

SEQ ID NO: 1519256 - DNA, 18 bp, Homo sapiens
acataagcttccatttta

SEQ ID NO: 1519257 - DNA, 19 bp, Homo sapiens
acataatctagtttacaga

SEQ ID NO: 1519258 - DNA, 18 bp, Homo sapiens
acatacaagaaaatgtat

SEQ ID NO: 1519259 - DNA, 22 bp, Homo sapiens
acatacaattatttttacagtt

SEQ ID NO: 1519260 - DNA, 13 bp, Homo sapiens
acatacagagtgg

SEQ ID NO: 1519261 - DNA, 19 bp, Homo sapiens
acatacctaccagtattat

SEQ ID NO: 1519262 - DNA, 19 bp, Homo sapiens
acatacgggctttaatagt

SEQ ID NO: 1519263 - DNA, 12 bp, Homo sapiens
acatacgtgtta

SEQ ID NO: 1519264 - DNA, 14 bp, Homo sapiens
acatactacctaga

SEQ ID NO: 1519265 - DNA, 15 bp, Homo sapiens
acatacttgaagggc

SEQ ID NO: 1519266 - DNA, 17 bp, Homo sapiens
acatacttgaagggcca

SEQ ID NO: 1519267 - DNA, 13 bp, Homo sapiens
acatagaaacttt

SEQ ID NO: 1519268 - DNA, 12 bp, Homo sapiens
acatagaaagtt

SEQ ID NO: 1519269 - DNA, 18 bp, Homo sapiens
acatagagctttttaata

SEQ ID NO: 1519270 - DNA, 23 bp, Homo sapiens
ccttccatgtgcctttctttgcc

SEQ ID NO: 1519271 - DNA, 17 bp, Homo sapiens
ccttccattttccccca

SEQ ID NO: 1519272 - DNA, 20 bp, Homo sapiens
ccttcccaatcagcactgaa

SEQ ID NO: 1519273 - DNA, 15 bp, Homo sapiens
ccttcccagaccagg

SEQ ID NO: 1519274 - DNA, 14 bp, Homo sapiens
ccttcccagctctc

SEQ ID NO: 1519275 - DNA, 19 bp, Homo sapiens
ccttcccagctctccctct

SEQ ID NO: 1519276 - DNA, 13 bp, Homo sapiens
ccttcccaggccc

SEQ ID NO: 1519277 - DNA, 15 bp, Homo sapiens
ccttcccatctcttc

SEQ ID NO: 1519278 - DNA, 15 bp, Homo sapiens
ccttcccatgcctgt

SEQ ID NO: 1519279 - DNA, 22 bp, Homo sapiens
ccttccccagctttgctgcctg

SEQ ID NO: 1519280 - DNA, 13 bp, Homo sapiens
ccttccccaggcc

SEQ ID NO: 1519281 - DNA, 19 bp, Homo sapiens
ccttccccaggcccaccat

SEQ ID NO: 1519282 - DNA, 15 bp, Homo sapiens
ccttcccccagccca

SEQ ID NO: 1519283 - DNA, 16 bp, Homo sapiens
ccttcccccagcccaa

SEQ ID NO: 1519284 - DNA, 17 bp, Homo sapiens
ccttcccccagcccaat

SEQ ID NO: 1519285 - DNA, 19 bp, Homo sapiens
ccttcccccagcccaataa

SEQ ID NO: 1519286 - DNA, 20 bp, Homo sapiens
ccttcccccagcccaataaa

SEQ ID NO: 1519287 - DNA, 20 bp, Homo sapiens
ccttccccctcccagggcca

SEQ ID NO: 1519288 - DNA, 23 bp, Homo sapiens
ccttcccccttttttgtccccca

SEQ ID NO: 1519289 - DNA, 23 bp, Homo sapiens
ccttcccctcagccacacccagg

SEQ ID NO: 1519290 - DNA, 18 bp, Homo sapiens
ccttcccctccctggctc

SEQ ID NO: 1519291 - DNA, 16 bp, Homo sapiens
ccttcccctccttctc

SEQ ID NO: 1519292 - DNA, 12 bp, Homo sapiens
ccttcccctgca

SEQ ID NO: 1519293 - DNA, 21 bp, Homo sapiens
ccttcccctgcacctggcctg

SEQ ID NO: 1519294 - DNA, 20 bp, Homo sapiens
ccttccccttgcccagggct

SEQ ID NO: 1519295 - DNA, 21 bp, Homo sapiens
ccttcccctttactcagccca

SEQ ID NO: 1519296 - DNA, 20 bp, Homo sapiens
ccttccccttttgcctggct

SEQ ID NO: 1519297 - DNA, 22 bp, Homo sapiens
ccttccccttttgcctggctgt

SEQ ID NO: 1519298 - DNA, 12 bp, Homo sapiens
ccttccctagct

SEQ ID NO: 1519299 - DNA, 23 bp, Homo sapiens
ccttccctcaccttggcaccaga

SEQ ID NO: 1519300 - DNA, 12 bp, Homo sapiens
ccttccctctcc

SEQ ID NO: 1519301 - DNA, 14 bp, Homo sapiens
ccttccctggcagg

SEQ ID NO: 1519302 - DNA, 14 bp, Homo sapiens
ccttccctggctac

SEQ ID NO: 1519303 - DNA, 23 bp, Homo sapiens
ccttccctggctacttcccttcc

SEQ ID NO: 1519304 - DNA, 12 bp, Homo sapiens
ccttccctggga

SEQ ID NO: 1519305 - DNA, 13 bp, Homo sapiens
ccttccctgtccc

SEQ ID NO: 1519306 - DNA, 14 bp, Homo sapiens
ccttccctgtccct

SEQ ID NO: 1519307 - DNA, 14 bp, Homo sapiens
ccttcccttctctt

SEQ ID NO: 1519308 - DNA, 21 bp, Homo sapiens
ccttccgatgacagtgctcta

SEQ ID NO: 1519309 - DNA, 22 bp, Homo sapiens
ccttccgctgcgggcccagctg

SEQ ID NO: 1519310 - DNA, 14 bp, Homo sapiens
ccttcctcactgcc

SEQ ID NO: 1519311 - DNA, 18 bp, Homo sapiens
ccttcctcatccacccca

SEQ ID NO: 1519312 - DNA, 19 bp, Homo sapiens
ccttcctcatccaccccat

SEQ ID NO: 1519313 - DNA, 20 bp, Homo sapiens
ccttcctcatccaccccatc

SEQ ID NO: 1519314 - DNA, 18 bp, Homo sapiens
ccttcctccccacactcc

SEQ ID NO: 1519315 - DNA, 15 bp, Homo sapiens
ccttcctcccggggc

SEQ ID NO: 1519316 - DNA, 14 bp, Homo sapiens
ccttcctcctccac

SEQ ID NO: 1519317 - DNA, 17 bp, Homo sapiens
ccttcctctcaagctag

SEQ ID NO: 1519318 - DNA, 17 bp, Homo sapiens
ccttcctctctccagat

SEQ ID NO: 1519319 - DNA, 17 bp, Homo sapiens
ccttcctctgcagctga

SEQ ID NO: 1519320 - DNA, 14 bp, Homo sapiens
ccttcctgccccca

SEQ ID NO: 1519321 - DNA, 14 bp, Homo sapiens
ccttcctgctgctg

SEQ ID NO: 1519322 - DNA, 15 bp, Homo sapiens
ccttcctggaaacag

SEQ ID NO: 1519323 - DNA, 20 bp, Homo sapiens
ccttcctggaaacagcatga

SEQ ID NO: 1519324 - DNA, 11 bp, Homo sapiens
ccttcctggcc

SEQ ID NO: 1519325 - DNA, 18 bp, Homo sapiens
ccttcctggcctcactgg

SEQ ID NO: 1519326 - DNA, 17 bp, Homo sapiens
ccttcctgtcttcctgc

SEQ ID NO: 1519327 - DNA, 19 bp, Homo sapiens
ccttcctgtcttcctgcat

SEQ ID NO: 1519328 - DNA, 14 bp, Homo sapiens
ccttccttccctgg

SEQ ID NO: 1519329 - DNA, 15 bp, Homo sapiens
ccttccttccctggc

SEQ ID NO: 1519330 - DNA, 15 bp, Homo sapiens
ccttccttccctggg

SEQ ID NO: 1519331 - DNA, 16 bp, Homo sapiens
ccttccttgaccagca

SEQ ID NO: 1519332 - DNA, 23 bp, Homo sapiens
ccttccttgaccagcagatccca

SEQ ID NO: 1519333 - DNA, 19 bp, Homo sapiens
ccttcctttaggtctggtt

SEQ ID NO: 1519334 - DNA, 16 bp, Homo sapiens
ccttccttttccctgc

SEQ ID NO: 1519335 - DNA, 17 bp, Homo sapiens
ccttccttttccctgct

SEQ ID NO: 1519336 - DNA, 18 bp, Homo sapiens
ccttccttttccctgctt

SEQ ID NO: 1519337 - DNA, 23 bp, Homo sapiens
ccttccttttccctgcttccagg

SEQ ID NO: 1519338 - DNA, 16 bp, Homo sapiens
ccttcgcttcttgcct

SEQ ID NO: 1519339 - DNA, 13 bp, Homo sapiens
ccttcggctccgg

SEQ ID NO: 1519340 - DNA, 18 bp, Homo sapiens
ccttcgggcgtctgtgtg

SEQ ID NO: 1519341 - DNA, 17 bp, Homo sapiens
ccttcgtgtctctccca

SEQ ID NO: 1519342 - DNA, 20 bp, Homo sapiens
ccttcgtgtctctcccaccc

SEQ ID NO: 1519343 - DNA, 20 bp, Homo sapiens
ccttctaacatgttatcaaa

SEQ ID NO: 1519344 - DNA, 19 bp, Homo sapiens
ccttctaccccaaggccag

SEQ ID NO: 1519345 - DNA, 18 bp, Homo sapiens
ccttctatacccacccag

SEQ ID NO: 1519346 - DNA, 14 bp, Homo sapiens
ccttctcaccccag

SEQ ID NO: 1519347 - DNA, 18 bp, Homo sapiens
ccttctcagaagcacaga

SEQ ID NO: 1519348 - DNA, 14 bp, Homo sapiens
ccttctccccagcc

SEQ ID NO: 1519349 - DNA, 15 bp, Homo sapiens
ccttctccccagcca

SEQ ID NO: 1519350 - DNA, 13 bp, Homo sapiens
ccttctcccctgc

SEQ ID NO: 1519351 - DNA, 16 bp, Homo sapiens
ccttctcccctgcact

SEQ ID NO: 1519352 - DNA, 15 bp, Homo sapiens
ccttctcccctgccg

SEQ ID NO: 1519353 - DNA, 22 bp, Homo sapiens
ccttctccctagctcctcccct

SEQ ID NO: 1519354 - DNA, 15 bp, Homo sapiens
ccttctcctttcctt

SEQ ID NO: 1519355 - DNA, 18 bp, Homo sapiens
ccttctcctttccttccc

SEQ ID NO: 1519356 - DNA, 21 bp, Homo sapiens
ccttctcctttctaagccctg

SEQ ID NO: 1519357 - DNA, 19 bp, Homo sapiens
ccttctcggagctggccca

SEQ ID NO: 1519358 - DNA, 18 bp, Homo sapiens
ccttctctacccatctcc

SEQ ID NO: 1519359 - DNA, 16 bp, Homo sapiens
ccttctctcactgtgt

SEQ ID NO: 1519360 - DNA, 18 bp, Homo sapiens
ccttctctcagctcccag

SEQ ID NO: 1519361 - DNA, 22 bp, Homo sapiens
ccttctctcagctcccaggcca

SEQ ID NO: 1519362 - DNA, 16 bp, Homo sapiens
ccttctctcctcccca

SEQ ID NO: 1519363 - DNA, 21 bp, Homo sapiens
ccttctctcttttcttctcag

SEQ ID NO: 1519364 - DNA, 14 bp, Homo sapiens
ccttctctgctcca

SEQ ID NO: 1519365 - DNA, 18 bp, Homo sapiens
ccttctcttttttcagag

SEQ ID NO: 1519366 - DNA, 15 bp, Homo sapiens
ccttctgaactccat

SEQ ID NO: 1519367 - DNA, 14 bp, Homo sapiens
ccttctgactgttt

SEQ ID NO: 1519368 - DNA, 15 bp, Homo sapiens
ccttctgactgttta

SEQ ID NO: 1519369 - DNA, 17 bp, Homo sapiens
ccttctgactgtttatt

SEQ ID NO: 1519370 - DNA, 22 bp, Homo sapiens
ccttctgactgtttatttaagg

SEQ ID NO: 1519371 - DNA, 23 bp, Homo sapiens
ccttctgactgtttatttaagga

SEQ ID NO: 1519372 - DNA, 14 bp, Homo sapiens
ccttctgagctcca

SEQ ID NO: 1519373 - DNA, 17 bp, Homo sapiens
accacacagaggctgcc

SEQ ID NO: 1519374 - DNA, 14 bp, Homo sapiens
accacaccagcctc

SEQ ID NO: 1519375 - DNA, 16 bp, Homo sapiens
accacactacacagca

SEQ ID NO: 1519376 - DNA, 11 bp, Homo sapiens
accacactgaa

SEQ ID NO: 1519377 - DNA, 13 bp, Homo sapiens
accacacttgaaa

SEQ ID NO: 1519378 - DNA, 12 bp, Homo sapiens
accacagacaca

SEQ ID NO: 1519379 - DNA, 14 bp, Homo sapiens
accacagacacaca

SEQ ID NO: 1519380 - DNA, 16 bp, Homo sapiens
accacagacacacaca

SEQ ID NO: 1519381 - DNA, 20 bp, Homo sapiens
accacagacacacacacgca

SEQ ID NO: 1519382 - DNA, 14 bp, Homo sapiens
accacagacttgca

SEQ ID NO: 1519383 - DNA, 22 bp, Homo sapiens
accacagacttgcactgaagcc

SEQ ID NO: 1519384 - DNA, 23 bp, Homo sapiens
accacagacttgcactgaagccg

SEQ ID NO: 1519385 - DNA, 21 bp, Homo sapiens
accacagcagcacctcctcca

SEQ ID NO: 1519386 - DNA, 12 bp, Homo sapiens
accacagcagga

SEQ ID NO: 1519387 - DNA, 11 bp, Homo sapiens
accacagcagt

SEQ ID NO: 1519388 - DNA, 16 bp, Homo sapiens
accacagccagcacct

SEQ ID NO: 1519389 - DNA, 20 bp, Homo sapiens
accacagccagcacctggca

SEQ ID NO: 1519390 - DNA, 19 bp, Homo sapiens
accacagcccgctctctgg

SEQ ID NO: 1519391 - DNA, 14 bp, Homo sapiens
accacagctgctgg

SEQ ID NO: 1519392 - DNA, 18 bp, Homo sapiens
accacagctgctggccag

SEQ ID NO: 1519393 - DNA, 17 bp, Homo sapiens
accacaggcatctacac

SEQ ID NO: 1519394 - DNA, 17 bp, Homo sapiens
accacagggttcaaaat

SEQ ID NO: 1519395 - DNA, 22 bp, Homo sapiens
accacaggttcatgccaccatg

SEQ ID NO: 1519396 - DNA, 15 bp, Homo sapiens
accacagtcagtgga

SEQ ID NO: 1519397 - DNA, 16 bp, Homo sapiens
accacagtcagtggag

SEQ ID NO: 1519398 - DNA, 19 bp, Homo sapiens
accacagtgagcctgagag

SEQ ID NO: 1519399 - DNA, 11 bp, Homo sapiens
accacagtgtc

SEQ ID NO: 1519400 - DNA, 21 bp, Homo sapiens
accacatagcatgcttccttt

SEQ ID NO: 1519401 - DNA, 22 bp, Homo sapiens
accacatagcatgcttcctttc

SEQ ID NO: 1519402 - DNA, 12 bp, Homo sapiens
accaccagcagg

SEQ ID NO: 1519403 - DNA, 14 bp, Homo sapiens
accaccagcaggca

SEQ ID NO: 1519404 - DNA, 15 bp, Homo sapiens
accaccagccccagc

SEQ ID NO: 1519405 - DNA, 19 bp, Homo sapiens
accaccaggactgaaagaa

SEQ ID NO: 1519406 - DNA, 18 bp, Homo sapiens
accaccaggagcagcagc

SEQ ID NO: 1519407 - DNA, 21 bp, Homo sapiens
accaccaggagcagcagccag

SEQ ID NO: 1519408 - DNA, 18 bp, Homo sapiens
accaccccaacaaaccat

SEQ ID NO: 1519409 - DNA, 22 bp, Homo sapiens
accacccccccccatccccgct

SEQ ID NO: 1519410 - DNA, 10 bp, Homo sapiens
accaccccct

SEQ ID NO: 1519411 - DNA, 12 bp, Homo sapiens
accaccctgagc

SEQ ID NO: 1519412 - DNA, 14 bp, Homo sapiens
accaccctgctcat

SEQ ID NO: 1519413 - DNA, 23 bp, Homo sapiens
accaccggccccctccccccaga

SEQ ID NO: 1519414 - DNA, 15 bp, Homo sapiens
accacctaatgttta

SEQ ID NO: 1519415 - DNA, 15 bp, Homo sapiens
accacctacacagga

SEQ ID NO: 1519416 - DNA, 16 bp, Homo sapiens
accacctacacaggag

SEQ ID NO: 1519417 - DNA, 16 bp, Homo sapiens
accacctaggccactc

SEQ ID NO: 1519418 - DNA, 15 bp, Homo sapiens
accacctctgtgggc

SEQ ID NO: 1519419 - DNA, 20 bp, Homo sapiens
accacctgcttctgaactca

SEQ ID NO: 1519420 - DNA, 15 bp, Homo sapiens
accaccttcccagct

SEQ ID NO: 1519421 - DNA, 16 bp, Homo sapiens
accaccttcccagctc

SEQ ID NO: 1519422 - DNA, 17 bp, Homo sapiens
accaccttcccagctct

SEQ ID NO: 1519423 - DNA, 19 bp, Homo sapiens
accaccttcccagctctcc

SEQ ID NO: 1519424 - DNA, 21 bp, Homo sapiens
accaccttcccagctctccct

SEQ ID NO: 1519425 - DNA, 22 bp, Homo sapiens
accaccttcccagctctccctc

SEQ ID NO: 1519426 - DNA, 14 bp, Homo sapiens
accacctttactgt

SEQ ID NO: 1519427 - DNA, 19 bp, Homo sapiens
accacgatgtggccctggc

SEQ ID NO: 1519428 - DNA, 21 bp, Homo sapiens
accacgatgtggccctggcct

SEQ ID NO: 1519429 - DNA, 19 bp, Homo sapiens
accacgcccgtcctgcctg

SEQ ID NO: 1519430 - DNA, 22 bp, Homo sapiens
accacgcctcttgaccaggctg

SEQ ID NO: 1519431 - DNA, 14 bp, Homo sapiens
accacggaaaagag

SEQ ID NO: 1519432 - DNA, 18 bp, Homo sapiens
accacggaaaagagcgca

SEQ ID NO: 1519433 - DNA, 22 bp, Homo sapiens
accacgggacatcacagggtgg

SEQ ID NO: 1519434 - DNA, 15 bp, Homo sapiens
accacgtctgccagg

SEQ ID NO: 1519435 - DNA, 17 bp, Homo sapiens
accacgtctgccaggcc

SEQ ID NO: 1519436 - DNA, 20 bp, Homo sapiens
accacgtctggctccctgcc

SEQ ID NO: 1519437 - DNA, 17 bp, Homo sapiens
accacgtggggctcact

SEQ ID NO: 1519438 - DNA, 17 bp, Homo sapiens
accactaaccatcccca

SEQ ID NO: 1519439 - DNA, 22 bp, Homo sapiens
accactaccagccagcctcaga

SEQ ID NO: 1519440 - DNA, 19 bp, Homo sapiens
accactaggaatcccagag

SEQ ID NO: 1519441 - DNA, 22 bp, Homo sapiens
accactatctccgttccatctg

SEQ ID NO: 1519442 - DNA, 20 bp, Homo sapiens
accactcaaattaatctttc

SEQ ID NO: 1519443 - DNA, 21 bp, Homo sapiens
accactcctgtccctgtagct

SEQ ID NO: 1519444 - DNA, 18 bp, Homo sapiens
accactcttttgctgtgc

SEQ ID NO: 1519445 - DNA, 16 bp, Homo sapiens
accactgaaaaaatat

SEQ ID NO: 1519446 - DNA, 19 bp, Homo sapiens
accactgaattcactccag

SEQ ID NO: 1519447 - DNA, 21 bp, Homo sapiens
accactgaattcactccagtc

SEQ ID NO: 1519448 - DNA, 14 bp, Homo sapiens
accactgcactcca

SEQ ID NO: 1519449 - DNA, 20 bp, Homo sapiens
accactgcactccagcctgg

SEQ ID NO: 1519450 - DNA, 18 bp, Homo sapiens
accactgccattacccag

SEQ ID NO: 1519451 - DNA, 19 bp, Homo sapiens
accactgccctgcctgccc

SEQ ID NO: 1519452 - DNA, 12 bp, Homo sapiens
accactgcttct

SEQ ID NO: 1519453 - DNA, 15 bp, Homo sapiens
accactggccaccag

SEQ ID NO: 1519454 - DNA, 17 bp, Homo sapiens
accactggccaccaggc

SEQ ID NO: 1519455 - DNA, 17 bp, Homo sapiens
accactggtacttcctt

SEQ ID NO: 1519456 - DNA, 12 bp, Homo sapiens
accactgtctcc

SEQ ID NO: 1519457 - DNA, 23 bp, Homo sapiens
accactgtgccactgacttgctg

SEQ ID NO: 1519458 - DNA, 21 bp, Homo sapiens
accactgtggcgttctgctgc

SEQ ID NO: 1519459 - DNA, 22 bp, Homo sapiens
accactgtggcgttctgctgcc

SEQ ID NO: 1519460 - DNA, 16 bp, Homo sapiens
accactgtgtatttaa

SEQ ID NO: 1519461 - DNA, 18 bp, Homo sapiens
accacttaaaaaatgtcc

SEQ ID NO: 1519462 - DNA, 13 bp, Homo sapiens
accacttcattct

SEQ ID NO: 1519463 - DNA, 20 bp, Homo sapiens
accacttccaggggaacctg

SEQ ID NO: 1519464 - DNA, 13 bp, Homo sapiens
accacttcgaaac

SEQ ID NO: 1519465 - DNA, 17 bp, Homo sapiens
accacttctccatgctg

SEQ ID NO: 1519466 - DNA, 20 bp, Homo sapiens
accacttctccatgctgcaa

SEQ ID NO: 1519467 - DNA, 13 bp, Homo sapiens
accacttgagcct

SEQ ID NO: 1519468 - DNA, 11 bp, Homo sapiens
accacttttgg

SEQ ID NO: 1519469 - DNA, 13 bp, Homo sapiens
accagaaaagcaa

SEQ ID NO: 1519470 - DNA, 22 bp, Homo sapiens
accagaaacacccctctgtcta

SEQ ID NO: 1519471 - DNA, 12 bp, Homo sapiens
accagaaagctc

SEQ ID NO: 1519472 - DNA, 19 bp, Homo sapiens
accagaaagctctacattt

SEQ ID NO: 1519473 - DNA, 21 bp, Homo sapiens
accagaacgtggtttgcctga

SEQ ID NO: 1519474 - DNA, 14 bp, Homo sapiens
accagaagccaaag

SEQ ID NO: 1519475 - DNA, 21 bp, Homo sapiens
accagaagctgttgggagaaa

SEQ ID NO: 1519476 - DNA, 22 bp, Homo sapiens
accagaatgaaaactgtaaata

SEQ ID NO: 1519477 - DNA, 20 bp, Homo sapiens
accagagataatatgagaat

SEQ ID NO: 1519478 - DNA, 22 bp, Homo sapiens
accagagccagatgcaggacag

SEQ ID NO: 1519479 - DNA, 14 bp, Homo sapiens
accagagccccaca

SEQ ID NO: 1519480 - DNA, 17 bp, Homo sapiens
accagagccgggaggaa

SEQ ID NO: 1519481 - DNA, 13 bp, Homo sapiens
accagagccttca

SEQ ID NO: 1519482 - DNA, 20 bp, Homo sapiens
accagagccttcaagtgcca

SEQ ID NO: 1519483 - DNA, 17 bp, Homo sapiens
accagagcgtgcacttg

SEQ ID NO: 1519484 - DNA, 19 bp, Homo sapiens
accagagctctatccccat

SEQ ID NO: 1519485 - DNA, 19 bp, Homo sapiens
accagagcttctctgggct

SEQ ID NO: 1519486 - DNA, 20 bp, Homo sapiens
accagagcttctctgggctg

SEQ ID NO: 1519487 - DNA, 23 bp, Homo sapiens
accagagcttctctgggctgaat

SEQ ID NO: 1519488 - DNA, 13 bp, Homo sapiens
accagaggaagcc

SEQ ID NO: 1519489 - DNA, 16 bp, Homo sapiens
accagaggagcctttt

SEQ ID NO: 1519490 - DNA, 20 bp, Homo sapiens
ccttctgctggataaaatga

SEQ ID NO: 1519491 - DNA, 19 bp, Homo sapiens
ccttctggatccatggggg

SEQ ID NO: 1519492 - DNA, 17 bp, Homo sapiens
ccttctggccggtgctg

SEQ ID NO: 1519493 - DNA, 19 bp, Homo sapiens
ccttctggccggtgctggg

SEQ ID NO: 1519494 - DNA, 18 bp, Homo sapiens
ccttctggcctctgctga

SEQ ID NO: 1519495 - DNA, 22 bp, Homo sapiens
ccttctgtaaaggtttttggaa

SEQ ID NO: 1519496 - DNA, 17 bp, Homo sapiens
ccttcttattctcactc

SEQ ID NO: 1519497 - DNA, 18 bp, Homo sapiens
ccttcttattctcactcc

SEQ ID NO: 1519498 - DNA, 14 bp, Homo sapiens
ccttcttcacccag

SEQ ID NO: 1519499 - DNA, 23 bp, Homo sapiens
ccttcttcacccagctaatctgt

SEQ ID NO: 1519500 - DNA, 22 bp, Homo sapiens
ccttcttcggggaactcctgga

SEQ ID NO: 1519501 - DNA, 17 bp, Homo sapiens
ccttctttattctgtgt

SEQ ID NO: 1519502 - DNA, 18 bp, Homo sapiens
ccttctttattctgtgtt

SEQ ID NO: 1519503 - DNA, 12 bp, Homo sapiens
ccttcttttgta

SEQ ID NO: 1519504 - DNA, 23 bp, Homo sapiens
ccttctttttcatatttctacct

SEQ ID NO: 1519505 - DNA, 23 bp, Homo sapiens
ccttctttttctgagacagcttg

SEQ ID NO: 1519506 - DNA, 17 bp, Homo sapiens
ccttgaaaaaaaacagt

SEQ ID NO: 1519507 - DNA, 19 bp, Homo sapiens
ccttgaaaaacaagtcttt

SEQ ID NO: 1519508 - DNA, 13 bp, Homo sapiens
ccttgaacactgg

SEQ ID NO: 1519509 - DNA, 23 bp, Homo sapiens
ccttgaagaaggggctgttcttc

SEQ ID NO: 1519510 - DNA, 17 bp, Homo sapiens
ccttgaagacagagcaa

SEQ ID NO: 1519511 - DNA, 22 bp, Homo sapiens
ccttgaagactccctgatccca

SEQ ID NO: 1519512 - DNA, 19 bp, Homo sapiens
ccttgaagaggggaggggc

SEQ ID NO: 1519513 - DNA, 12 bp, Homo sapiens
ccttgaatgctg

SEQ ID NO: 1519514 - DNA, 15 bp, Homo sapiens
ccttgaatgctgcca

SEQ ID NO: 1519515 - DNA, 19 bp, Homo sapiens
ccttgaatgctgccagtgt

SEQ ID NO: 1519516 - DNA, 20 bp, Homo sapiens
ccttgaatgctgccagtgtg

SEQ ID NO: 1519517 - DNA, 16 bp, Homo sapiens
ccttgaattgtgtatt

SEQ ID NO: 1519518 - DNA, 23 bp, Homo sapiens
ccttgaccagcagatcccagctc

SEQ ID NO: 1519519 - DNA, 19 bp, Homo sapiens
ccttgagaaaccttattgt

SEQ ID NO: 1519520 - DNA, 14 bp, Homo sapiens
ccttgagacctcag

SEQ ID NO: 1519521 - DNA, 18 bp, Homo sapiens
ccttgagagacccagctg

SEQ ID NO: 1519522 - DNA, 15 bp, Homo sapiens
ccttgagctgttgtg

SEQ ID NO: 1519523 - DNA, 17 bp, Homo sapiens
ccttgaggatggagagc

SEQ ID NO: 1519524 - DNA, 14 bp, Homo sapiens
ccttgagtggggtt

SEQ ID NO: 1519525 - DNA, 18 bp, Homo sapiens
ccttgatcagccccaccc

SEQ ID NO: 1519526 - DNA, 20 bp, Homo sapiens
ccttgatcagccccaccctg

SEQ ID NO: 1519527 - DNA, 19 bp, Homo sapiens
ccttgatgccagagggcca

SEQ ID NO: 1519528 - DNA, 22 bp, Homo sapiens
ccttgatgccagagggccagca

SEQ ID NO: 1519529 - DNA, 20 bp, Homo sapiens
ccttgattttgccccctgag

SEQ ID NO: 1519530 - DNA, 23 bp, Homo sapiens
ccttgcaaagaccataaagtcca

SEQ ID NO: 1519531 - DNA, 19 bp, Homo sapiens
ccttgcacactcccctgca

SEQ ID NO: 1519532 - DNA, 13 bp, Homo sapiens
ccttgcacctgca

SEQ ID NO: 1519533 - DNA, 21 bp, Homo sapiens
ccttgcagatatctgcatgtg

SEQ ID NO: 1519534 - DNA, 15 bp, Homo sapiens
ccttgcagctagttt

SEQ ID NO: 1519535 - DNA, 18 bp, Homo sapiens
ccttgcaggggtcccccc

SEQ ID NO: 1519536 - DNA, 17 bp, Homo sapiens
ccttgcagttcagcacc

SEQ ID NO: 1519537 - DNA, 13 bp, Homo sapiens
ccttgccagagat

SEQ ID NO: 1519538 - DNA, 16 bp, Homo sapiens
ccttgccagagatcca

SEQ ID NO: 1519539 - DNA, 19 bp, Homo sapiens
ccttgccaggtccctttca

SEQ ID NO: 1519540 - DNA, 13 bp, Homo sapiens
ccttgcccagggc

SEQ ID NO: 1519541 - DNA, 20 bp, Homo sapiens
ccttgcccagggctcagcct

SEQ ID NO: 1519542 - DNA, 21 bp, Homo sapiens
ccttgcccagggctcagcctg

SEQ ID NO: 1519543 - DNA, 17 bp, Homo sapiens
ccttgcccccatccctc

SEQ ID NO: 1519544 - DNA, 17 bp, Homo sapiens
ccttgcccgccagcctc

SEQ ID NO: 1519545 - DNA, 18 bp, Homo sapiens
ccttgcccggattctggg

SEQ ID NO: 1519546 - DNA, 20 bp, Homo sapiens
ccttgcccgtcgtgtgctga

SEQ ID NO: 1519547 - DNA, 20 bp, Homo sapiens
ccttgccctccctttctctc

SEQ ID NO: 1519548 - DNA, 13 bp, Homo sapiens
ccttgcccttgga

SEQ ID NO: 1519549 - DNA, 23 bp, Homo sapiens
ccttgcctaaatttaatgctgcc

SEQ ID NO: 1519550 - DNA, 15 bp, Homo sapiens
ccttgcctcaatgcc

SEQ ID NO: 1519551 - DNA, 20 bp, Homo sapiens
ccttgcctcaatgccagtaa

SEQ ID NO: 1519552 - DNA, 22 bp, Homo sapiens
ccttgcctccccatttcccatc

SEQ ID NO: 1519553 - DNA, 11 bp, Homo sapiens
ccttgcctctg

SEQ ID NO: 1519554 - DNA, 13 bp, Homo sapiens
ccttgcctctgcc

SEQ ID NO: 1519555 - DNA, 12 bp, Homo sapiens
ccttgcctggcc

SEQ ID NO: 1519556 - DNA, 20 bp, Homo sapiens
ccttgcctttcgaggcctga

SEQ ID NO: 1519557 - DNA, 22 bp, Homo sapiens
ccttgctaaattgattgaatta

SEQ ID NO: 1519558 - DNA, 11 bp, Homo sapiens
ccttgctacct

SEQ ID NO: 1519559 - DNA, 18 bp, Homo sapiens
ccttgctcgctgtaaaat

SEQ ID NO: 1519560 - DNA, 19 bp, Homo sapiens
ccttgctgacaataaagat

SEQ ID NO: 1519561 - DNA, 15 bp, Homo sapiens
ccttgctgcagcttc

SEQ ID NO: 1519562 - DNA, 19 bp, Homo sapiens
ccttgctggccccagccct

SEQ ID NO: 1519563 - DNA, 13 bp, Homo sapiens
ccttgctgggcca

SEQ ID NO: 1519564 - DNA, 19 bp, Homo sapiens
ccttgctgggccagggaaa

SEQ ID NO: 1519565 - DNA, 22 bp, Homo sapiens
ccttgctgggccagggaaacaa

SEQ ID NO: 1519566 - DNA, 20 bp, Homo sapiens
ccttgctgtatgctgatcat

SEQ ID NO: 1519567 - DNA, 16 bp, Homo sapiens
ccttgctgtcctaggc

SEQ ID NO: 1519568 - DNA, 21 bp, Homo sapiens
ccttgcttgttgggattcctg

SEQ ID NO: 1519569 - DNA, 17 bp, Homo sapiens
ccttgctttcctgggcc

SEQ ID NO: 1519570 - DNA, 18 bp, Homo sapiens
ccttgctttcctgggcct

SEQ ID NO: 1519571 - DNA, 21 bp, Homo sapiens
ccttgctttgttttaataaac

SEQ ID NO: 1519572 - DNA, 19 bp, Homo sapiens
ccttggaaacctgccctgc

SEQ ID NO: 1519573 - DNA, 20 bp, Homo sapiens
ccttggaaacctgccctgcc

SEQ ID NO: 1519574 - DNA, 23 bp, Homo sapiens
ccttggaaacctgccctgcctga

SEQ ID NO: 1519575 - DNA, 17 bp, Homo sapiens
ccttggaacaccctgga

SEQ ID NO: 1519576 - DNA, 18 bp, Homo sapiens
ccttggaacaccctggat

SEQ ID NO: 1519577 - DNA, 19 bp, Homo sapiens
ccttggaacaccctggatg

SEQ ID NO: 1519578 - DNA, 11 bp, Homo sapiens
ccttggaaggg

SEQ ID NO: 1519579 - DNA, 21 bp, Homo sapiens
ccttggaatctaacgggcatt

SEQ ID NO: 1519580 - DNA, 17 bp, Homo sapiens
ccttggagagacacagc

SEQ ID NO: 1519581 - DNA, 23 bp, Homo sapiens
ccttggagagagaggctgcctca

SEQ ID NO: 1519582 - DNA, 13 bp, Homo sapiens
ccttggagagctc

SEQ ID NO: 1519583 - DNA, 16 bp, Homo sapiens
ccttggagagctcagg

SEQ ID NO: 1519584 - DNA, 15 bp, Homo sapiens
ccttggagaggagag

SEQ ID NO: 1519585 - DNA, 22 bp, Homo sapiens
ccttggagctgccgtgcctgtg

SEQ ID NO: 1519586 - DNA, 19 bp, Homo sapiens
ccttggagtcccaggggca

SEQ ID NO: 1519587 - DNA, 11 bp, Homo sapiens
ccttggagtga

SEQ ID NO: 1519588 - DNA, 23 bp, Homo sapiens
ccttggataatgctgttgcctca

SEQ ID NO: 1519589 - DNA, 16 bp, Homo sapiens
ccttggattcctgcac

SEQ ID NO: 1519590 - DNA, 15 bp, Homo sapiens
ccttggcatgccttc

SEQ ID NO: 1519591 - DNA, 21 bp, Homo sapiens
ccttggcatgccttccagcac

SEQ ID NO: 1519592 - DNA, 14 bp, Homo sapiens
ccttggccacagac

SEQ ID NO: 1519593 - DNA, 18 bp, Homo sapiens
ccttggcccaggagctct

SEQ ID NO: 1519594 - DNA, 15 bp, Homo sapiens
ccttggccgcaccta

SEQ ID NO: 1519595 - DNA, 19 bp, Homo sapiens
ccttggcctccatttctgt

SEQ ID NO: 1519596 - DNA, 24 bp, Homo sapiens
ccttggcctccatttctgtctcta

SEQ ID NO: 1519597 - DNA, 12 bp, Homo sapiens
ccttggcctccc

SEQ ID NO: 1519598 - DNA, 16 bp, Homo sapiens
ccttggcctcccagaa

SEQ ID NO: 1519599 - DNA, 22 bp, Homo sapiens
ccttggccttgcagctggccca

SEQ ID NO: 1519600 - DNA, 22 bp, Homo sapiens
ccttggctcaatcctctaagct

SEQ ID NO: 1519601 - DNA, 20 bp, Homo sapiens
ccttggctgacatgaagctg

SEQ ID NO: 1519602 - DNA, 19 bp, Homo sapiens
ccttggctgcaggcaacac

SEQ ID NO: 1519603 - DNA, 20 bp, Homo sapiens
ccttggcttcaggggagtcc

SEQ ID NO: 1519604 - DNA, 21 bp, Homo sapiens
ccttggctttatgcaaataca

SEQ ID NO: 1519605 - DNA, 14 bp, Homo sapiens
ctcttactctttcc

SEQ ID NO: 1519606 - DNA, 15 bp, Homo sapiens
ctcttactctttcct

SEQ ID NO: 1519607 - DNA, 17 bp, Homo sapiens
ctcttactttgcttgag

SEQ ID NO: 1519608 - DNA, 19 bp, Homo sapiens
ctcttacttttccagtctg

SEQ ID NO: 1519609 - DNA, 23 bp, Homo sapiens
ctcttacttttccagtctgtaca

SEQ ID NO: 1519610 - DNA, 23 bp, Homo sapiens
ctcttagaggaaggagataggga

SEQ ID NO: 1519611 - DNA, 17 bp, Homo sapiens
ctcttagcagcttccag

SEQ ID NO: 1519612 - DNA, 18 bp, Homo sapiens
ctcttagctcccctccaa

SEQ ID NO: 1519613 - DNA, 16 bp, Homo sapiens
ctcttagcttacagga

SEQ ID NO: 1519614 - DNA, 18 bp, Homo sapiens
ctcttagtctctttggta

SEQ ID NO: 1519615 - DNA, 20 bp, Homo sapiens
ctcttagtgcccgcctagga

SEQ ID NO: 1519616 - DNA, 20 bp, Homo sapiens
ctcttatagaatatttatta

SEQ ID NO: 1519617 - DNA, 22 bp, Homo sapiens
ctcttatagaatatttattacc

SEQ ID NO: 1519618 - DNA, 16 bp, Homo sapiens
ctcttatgtgtgcctt

SEQ ID NO: 1519619 - DNA, 18 bp, Homo sapiens
ctcttattccaggagaag

SEQ ID NO: 1519620 - DNA, 16 bp, Homo sapiens
ctcttcaatctctgga

SEQ ID NO: 1519621 - DNA, 16 bp, Homo sapiens
ctcttcactaccctga

SEQ ID NO: 1519622 - DNA, 17 bp, Homo sapiens
ctcttcactgtggccac

SEQ ID NO: 1519623 - DNA, 21 bp, Homo sapiens
ctcttcactgtggccacagcc

SEQ ID NO: 1519624 - DNA, 21 bp, Homo sapiens
ctcttcagatgccacttctaa

SEQ ID NO: 1519625 - DNA, 17 bp, Homo sapiens
ctcttcaggcctccctc

SEQ ID NO: 1519626 - DNA, 18 bp, Homo sapiens
ctcttcaggcctccctct

SEQ ID NO: 1519627 - DNA, 19 bp, Homo sapiens
ctcttcaggcctccctctc

SEQ ID NO: 1519628 - DNA, 12 bp, Homo sapiens
ctcttcaggttc

SEQ ID NO: 1519629 - DNA, 14 bp, Homo sapiens
ctcttcaggttctt

SEQ ID NO: 1519630 - DNA, 15 bp, Homo sapiens
ctcttcaggttctta

SEQ ID NO: 1519631 - DNA, 13 bp, Homo sapiens
ctcttcagtctct

SEQ ID NO: 1519632 - DNA, 18 bp, Homo sapiens
ctcttcagtgactcctgc

SEQ ID NO: 1519633 - DNA, 22 bp, Homo sapiens
ctcttcagtgactcctgctggt

SEQ ID NO: 1519634 - DNA, 21 bp, Homo sapiens
ctcttcatgcttgacatacct

SEQ ID NO: 1519635 - DNA, 17 bp, Homo sapiens
ctcttcatttattttga

SEQ ID NO: 1519636 - DNA, 14 bp, Homo sapiens
ctcttccaaagctc

SEQ ID NO: 1519637 - DNA, 16 bp, Homo sapiens
ctcttccactccttct

SEQ ID NO: 1519638 - DNA, 13 bp, Homo sapiens
ctcttccagaatc

SEQ ID NO: 1519639 - DNA, 23 bp, Homo sapiens
ctcttccagtcttcctgacactt

SEQ ID NO: 1519640 - DNA, 22 bp, Homo sapiens
ctcttccagtgaacattcccag

SEQ ID NO: 1519641 - DNA, 16 bp, Homo sapiens
ctcttccatgctgtgc

SEQ ID NO: 1519642 - DNA, 15 bp, Homo sapiens
ctcttcccccaagat

SEQ ID NO: 1519643 - DNA, 15 bp, Homo sapiens
ctcttcccccaccac

SEQ ID NO: 1519644 - DNA, 15 bp, Homo sapiens
ctcttccccttccct

SEQ ID NO: 1519645 - DNA, 16 bp, Homo sapiens
ctcttccccttccctt

SEQ ID NO: 1519646 - DNA, 17 bp, Homo sapiens
ctcttccccttcctgtt

SEQ ID NO: 1519647 - DNA, 19 bp, Homo sapiens
ctcttccccttcctgtttc

SEQ ID NO: 1519648 - DNA, 15 bp, Homo sapiens
ctcttccctctccct

SEQ ID NO: 1519649 - DNA, 16 bp, Homo sapiens
ctcttccctctcgctc

SEQ ID NO: 1519650 - DNA, 12 bp, Homo sapiens
ctcttccctctg

SEQ ID NO: 1519651 - DNA, 21 bp, Homo sapiens
ctcttccctgaacgttttctt

SEQ ID NO: 1519652 - DNA, 22 bp, Homo sapiens
ctcttccctgaacttcctgctt

SEQ ID NO: 1519653 - DNA, 22 bp, Homo sapiens
ctcttcccttagcctctcccac

SEQ ID NO: 1519654 - DNA, 14 bp, Homo sapiens
ctcttcccttccca

SEQ ID NO: 1519655 - DNA, 15 bp, Homo sapiens
ctcttcccttcccag

SEQ ID NO: 1519656 - DNA, 16 bp, Homo sapiens
ctcttcccttcccaga

SEQ ID NO: 1519657 - DNA, 22 bp, Homo sapiens
ctcttccgaatgggttttctat

SEQ ID NO: 1519658 - DNA, 19 bp, Homo sapiens
ctcttcctacccaaccact

SEQ ID NO: 1519659 - DNA, 22 bp, Homo sapiens
ctcttcctagatctgcaggctg

SEQ ID NO: 1519660 - DNA, 16 bp, Homo sapiens
ctcttcctatttttgt

SEQ ID NO: 1519661 - DNA, 12 bp, Homo sapiens
ctcttcctctgg

SEQ ID NO: 1519662 - DNA, 13 bp, Homo sapiens
ctcttcctcttcc

SEQ ID NO: 1519663 - DNA, 12 bp, Homo sapiens
ctcttcctgccc

SEQ ID NO: 1519664 - DNA, 15 bp, Homo sapiens
ctcttcctggacctg

SEQ ID NO: 1519665 - DNA, 18 bp, Homo sapiens
ctcttcctggacctgagt

SEQ ID NO: 1519666 - DNA, 13 bp, Homo sapiens
ctcttcctgtgat

SEQ ID NO: 1519667 - DNA, 23 bp, Homo sapiens
ctcttccttgaagaactgcaggc

SEQ ID NO: 1519668 - DNA, 13 bp, Homo sapiens
ctcttccttgaat

SEQ ID NO: 1519669 - DNA, 16 bp, Homo sapiens
ctcttcgaagccttgc

SEQ ID NO: 1519670 - DNA, 18 bp, Homo sapiens
ctcttcgaagccttgcct

SEQ ID NO: 1519671 - DNA, 15 bp, Homo sapiens
ctcttcggtttctga

SEQ ID NO: 1519672 - DNA, 16 bp, Homo sapiens
ctcttcggtttctgag

SEQ ID NO: 1519673 - DNA, 19 bp, Homo sapiens
ctcttcgtggttgtgtttc

SEQ ID NO: 1519674 - DNA, 22 bp, Homo sapiens
ctcttctagatggaccccagca

SEQ ID NO: 1519675 - DNA, 22 bp, Homo sapiens
ctcttctaggcccattgtcctc

SEQ ID NO: 1519676 - DNA, 21 bp, Homo sapiens
ctcttctatgcaagccttgct

SEQ ID NO: 1519677 - DNA, 17 bp, Homo sapiens
ctcttctattttgtaaa

SEQ ID NO: 1519678 - DNA, 19 bp, Homo sapiens
ctcttctattttgtaaact

SEQ ID NO: 1519679 - DNA, 11 bp, Homo sapiens
ctcttctcatt

SEQ ID NO: 1519680 - DNA, 15 bp, Homo sapiens
ctcttctccactgga

SEQ ID NO: 1519681 - DNA, 19 bp, Homo sapiens
ctcttctccactggatgga

SEQ ID NO: 1519682 - DNA, 15 bp, Homo sapiens
ctcttctcctttcac

SEQ ID NO: 1519683 - DNA, 15 bp, Homo sapiens
ctcttctctccagct

SEQ ID NO: 1519684 - DNA, 19 bp, Homo sapiens
ctcttctctccagctgact

SEQ ID NO: 1519685 - DNA, 10 bp, Homo sapiens
ctcttctgaa

SEQ ID NO: 1519686 - DNA, 16 bp, Homo sapiens
ctcttctgacgtgcct

SEQ ID NO: 1519687 - DNA, 20 bp, Homo sapiens
ctcttctgacgtgccttttg

SEQ ID NO: 1519688 - DNA, 18 bp, Homo sapiens
ctcttctgagctatttca

SEQ ID NO: 1519689 - DNA, 14 bp, Homo sapiens
ctcttctgcaagcc

SEQ ID NO: 1519690 - DNA, 19 bp, Homo sapiens
ctcttctgcaagcctcatg

SEQ ID NO: 1519691 - DNA, 21 bp, Homo sapiens
ctcttctgctccacccttggc

SEQ ID NO: 1519692 - DNA, 15 bp, Homo sapiens
ctcttctgctctttt

SEQ ID NO: 1519693 - DNA, 22 bp, Homo sapiens
ctcttctggagatggaagcttg

SEQ ID NO: 1519694 - DNA, 13 bp, Homo sapiens
ctcttctgtccct

SEQ ID NO: 1519695 - DNA, 16 bp, Homo sapiens
ctcttctgttgaaaca

SEQ ID NO: 1519696 - DNA, 18 bp, Homo sapiens
ctcttcttcttcagaaga

SEQ ID NO: 1519697 - DNA, 21 bp, Homo sapiens
ctcttcttggggcccagtgca

SEQ ID NO: 1519698 - DNA, 15 bp, Homo sapiens
ctcttctttctgaga

SEQ ID NO: 1519699 - DNA, 14 bp, Homo sapiens
ctcttctttgtgcc

SEQ ID NO: 1519700 - DNA, 23 bp, Homo sapiens
ctcttctttgtgcctttggcctg

SEQ ID NO: 1519701 - DNA, 22 bp, Homo sapiens
ctcttgaaaagttcagggaccg

SEQ ID NO: 1519702 - DNA, 18 bp, Homo sapiens
ctcttgaaatattcagaa

SEQ ID NO: 1519703 - DNA, 20 bp, Homo sapiens
ctcttgaaatattcagaaat

SEQ ID NO: 1519704 - DNA, 21 bp, Homo sapiens
ctcttgaaatattcagaaatt

SEQ ID NO: 1519705 - DNA, 14 bp, Homo sapiens
ctcttgaaatgtag

SEQ ID NO: 1519706 - DNA, 15 bp, Homo sapiens
ctcttgaagtccagg

SEQ ID NO: 1519707 - DNA, 18 bp, Homo sapiens
ctcttgaagtccaggact

SEQ ID NO: 1519708 - DNA, 19 bp, Homo sapiens
ctcttgagataaggtttta

SEQ ID NO: 1519709 - DNA, 15 bp, Homo sapiens
ctcttgagcatcaat

SEQ ID NO: 1519710 - DNA, 15 bp, Homo sapiens
ctcttgatctctctt

SEQ ID NO: 1519711 - DNA, 23 bp, Homo sapiens
ctcttgatctctcttgtcctctt

SEQ ID NO: 1519712 - DNA, 21 bp, Homo sapiens
ctcttgatggtggactaagca

SEQ ID NO: 1519713 - DNA, 16 bp, Homo sapiens
ctcttgattcctggtt

SEQ ID NO: 1519714 - DNA, 21 bp, Homo sapiens
ctcttgattcctggtttgact

SEQ ID NO: 1519715 - DNA, 20 bp, Homo sapiens
ctcttgcacccgcctctccc

SEQ ID NO: 1519716 - DNA, 23 bp, Homo sapiens
ctcttgcatctgggccagaagtc

SEQ ID NO: 1519717 - DNA, 20 bp, Homo sapiens
ctcttgcccttccctgtccc

SEQ ID NO: 1519718 - DNA, 22 bp, Homo sapiens
ctcttgcccttccctgtccctc

SEQ ID NO: 1519719 - DNA, 19 bp, Homo sapiens
agacagggtaggaaagggc

SEQ ID NO: 1519720 - DNA, 19 bp, Homo sapiens
agacagggtttcaccatgt

SEQ ID NO: 1519721 - DNA, 22 bp, Homo sapiens
agacaggtccctccccttctct

SEQ ID NO: 1519722 - DNA, 18 bp, Homo sapiens
agacagtcctaacaatat

SEQ ID NO: 1519723 - DNA, 15 bp, Homo sapiens
agacagtcctttccc

SEQ ID NO: 1519724 - DNA, 12 bp, Homo sapiens
agacagtgatct

SEQ ID NO: 1519725 - DNA, 15 bp, Homo sapiens
agacagtgatctcca

SEQ ID NO: 1519726 - DNA, 15 bp, Homo sapiens
agacagttcaagaaa

SEQ ID NO: 1519727 - DNA, 16 bp, Homo sapiens
agacatacgaaacaca

SEQ ID NO: 1519728 - DNA, 14 bp, Homo sapiens
agacatacttgaag

SEQ ID NO: 1519729 - DNA, 16 bp, Homo sapiens
agacatacttgaaggg

SEQ ID NO: 1519730 - DNA, 21 bp, Homo sapiens
agacatacttgaagggccaga

SEQ ID NO: 1519731 - DNA, 14 bp, Homo sapiens
agacatcagtctcc

SEQ ID NO: 1519732 - DNA, 20 bp, Homo sapiens
agacatccaaactaaaagga

SEQ ID NO: 1519733 - DNA, 22 bp, Homo sapiens
agacatctcaggatttcaccag

SEQ ID NO: 1519734 - DNA, 19 bp, Homo sapiens
agacatctgaggttttatt

SEQ ID NO: 1519735 - DNA, 19 bp, Homo sapiens
agacatgcagcctaaggct

SEQ ID NO: 1519736 - DNA, 13 bp, Homo sapiens
agacatggagact

SEQ ID NO: 1519737 - DNA, 16 bp, Homo sapiens
agacatggaggttcta

SEQ ID NO: 1519738 - DNA, 17 bp, Homo sapiens
ctctgcatctactccca

SEQ ID NO: 1519739 - DNA, 20 bp, Homo sapiens
ctctgcatctactcccaagt

SEQ ID NO: 1519740 - DNA, 20 bp, Homo sapiens
ctctgccaacatgaggacag

SEQ ID NO: 1519741 - DNA, 10 bp, Homo sapiens
ctctgccacc

SEQ ID NO: 1519742 - DNA, 23 bp, Homo sapiens
ctctgccaccccaggtttttcat

SEQ ID NO: 1519743 - DNA, 20 bp, Homo sapiens
ctctgccaccctacctgttc

SEQ ID NO: 1519744 - DNA, 14 bp, Homo sapiens
ctctgccagccaca

SEQ ID NO: 1519745 - DNA, 15 bp, Homo sapiens
ctctgccaggcctgt

SEQ ID NO: 1519746 - DNA, 15 bp, Homo sapiens
ctctgcccagccggg

SEQ ID NO: 1519747 - DNA, 17 bp, Homo sapiens
ctctgcccagcttgggc

SEQ ID NO: 1519748 - DNA, 15 bp, Homo sapiens
ctctgccccaagcag

SEQ ID NO: 1519749 - DNA, 16 bp, Homo sapiens
ctctgccccaagcagc

SEQ ID NO: 1519750 - DNA, 17 bp, Homo sapiens
ctctgccccaagcagcc

SEQ ID NO: 1519751 - DNA, 19 bp, Homo sapiens
ctctgccccaagcagccag

SEQ ID NO: 1519752 - DNA, 15 bp, Homo sapiens
ctctgccccaagccc

SEQ ID NO: 1519753 - DNA, 16 bp, Homo sapiens
ctctgccccaagcccc

SEQ ID NO: 1519754 - DNA, 21 bp, Homo sapiens
ctctgccccaatcgggtccag

SEQ ID NO: 1519755 - DNA, 13 bp, Homo sapiens
ctctgccccacat

SEQ ID NO: 1519756 - DNA, 13 bp, Homo sapiens
ctctgccccagct

SEQ ID NO: 1519757 - DNA, 16 bp, Homo sapiens
ctctgccccagctctg

SEQ ID NO: 1519758 - DNA, 21 bp, Homo sapiens
ctctgcccccgcgggttctag

SEQ ID NO: 1519759 - DNA, 14 bp, Homo sapiens
ctctgcccccgctg

SEQ ID NO: 1519760 - DNA, 15 bp, Homo sapiens
ctctgcccccgctga

SEQ ID NO: 1519761 - DNA, 14 bp, Homo sapiens
ctctgccccctccc

SEQ ID NO: 1519762 - DNA, 17 bp, Homo sapiens
ctctgccccctccccca

SEQ ID NO: 1519763 - DNA, 19 bp, Homo sapiens
ctctgccccctcccccatg

SEQ ID NO: 1519764 - DNA, 21 bp, Homo sapiens
ctctgccccttgggcatccac

SEQ ID NO: 1519765 - DNA, 14 bp, Homo sapiens
ctctgccctctgct

SEQ ID NO: 1519766 - DNA, 16 bp, Homo sapiens
ctctgccctctgctgc

SEQ ID NO: 1519767 - DNA, 13 bp, Homo sapiens
ctctgccctggat

SEQ ID NO: 1519768 - DNA, 15 bp, Homo sapiens
ctctgccctggattg

SEQ ID NO: 1519769 - DNA, 16 bp, Homo sapiens
ctctgccggtccccca

SEQ ID NO: 1519770 - DNA, 21 bp, Homo sapiens
ctctgccggtcgggcagccag

SEQ ID NO: 1519771 - DNA, 15 bp, Homo sapiens
ctctgcctacagaac

SEQ ID NO: 1519772 - DNA, 13 bp, Homo sapiens
ctctgcctcccaa

SEQ ID NO: 1519773 - DNA, 16 bp, Homo sapiens
ctctgcctcccaggtt

SEQ ID NO: 1519774 - DNA, 13 bp, Homo sapiens
ctctgcctccctc

SEQ ID NO: 1519775 - DNA, 16 bp, Homo sapiens
ctctgcctctagtccc

SEQ ID NO: 1519776 - DNA, 12 bp, Homo sapiens
ctctgcctgcac

SEQ ID NO: 1519777 - DNA, 14 bp, Homo sapiens
ctctgcctgcactc

SEQ ID NO: 1519778 - DNA, 18 bp, Homo sapiens
ctctgcctgcactccctg

SEQ ID NO: 1519779 - DNA, 21 bp, Homo sapiens
ctctgcctgcactccctggcc

SEQ ID NO: 1519780 - DNA, 16 bp, Homo sapiens
ctctgcctgcattctg

SEQ ID NO: 1519781 - DNA, 11 bp, Homo sapiens
ctctgcctgcc

SEQ ID NO: 1519782 - DNA, 11 bp, Homo sapiens
ctctgcctgct

SEQ ID NO: 1519783 - DNA, 14 bp, Homo sapiens
ctctgcctggagtg

SEQ ID NO: 1519784 - DNA, 13 bp, Homo sapiens
ctctgcctgtctg

SEQ ID NO: 1519785 - DNA, 16 bp, Homo sapiens
ctctgcctgtgagcca

SEQ ID NO: 1519786 - DNA, 17 bp, Homo sapiens
ctctgcctgtgagccag

SEQ ID NO: 1519787 - DNA, 19 bp, Homo sapiens
ctctgcctgtgagccagtc

SEQ ID NO: 1519788 - DNA, 23 bp, Homo sapiens
ctctgcctttgcaccacgggaca

SEQ ID NO: 1519789 - DNA, 18 bp, Homo sapiens
ctctgcctttgctctggt

SEQ ID NO: 1519790 - DNA, 16 bp, Homo sapiens
ctctgcgccaggcaga

SEQ ID NO: 1519791 - DNA, 22 bp, Homo sapiens
ctctgcgccaggcagagctgag

SEQ ID NO: 1519792 - DNA, 15 bp, Homo sapiens
ctctgcgctgaggcc

SEQ ID NO: 1519793 - DNA, 23 bp, Homo sapiens
ctctgcggggaggacccgggacc

SEQ ID NO: 1519794 - DNA, 21 bp, Homo sapiens
ctctgcgtctatcctgtgtag

SEQ ID NO: 1519795 - DNA, 22 bp, Homo sapiens
ctctgcgtgcagggacaaagag

SEQ ID NO: 1519796 - DNA, 19 bp, Homo sapiens
ctctgcgtggcgcaggtgc

SEQ ID NO: 1519797 - DNA, 21 bp, Homo sapiens
ctctgcgtggcgcaggtgcca

SEQ ID NO: 1519798 - DNA, 18 bp, Homo sapiens
ctctgctagactcctcag

SEQ ID NO: 1519799 - DNA, 23 bp, Homo sapiens
ctctgctatatataaaacggtgc

SEQ ID NO: 1519800 - DNA, 15 bp, Homo sapiens
ctctgctatttctct

SEQ ID NO: 1519801 - DNA, 21 bp, Homo sapiens
ctctgctcaccgcccatcagg

SEQ ID NO: 1519802 - DNA, 22 bp, Homo sapiens
ctctgctcaccgcccatcaggg

SEQ ID NO: 1519803 - DNA, 18 bp, Homo sapiens
ctctgctccaccacatcc

SEQ ID NO: 1519804 - DNA, 13 bp, Homo sapiens
ctctgctccagca

SEQ ID NO: 1519805 - DNA, 21 bp, Homo sapiens
ctctgctccagcaactgccct

SEQ ID NO: 1519806 - DNA, 13 bp, Homo sapiens
ctctgctccctct

SEQ ID NO: 1519807 - DNA, 16 bp, Homo sapiens
ctctgctctagccagg

SEQ ID NO: 1519808 - DNA, 19 bp, Homo sapiens
ctctgctctagccaggagt

SEQ ID NO: 1519809 - DNA, 12 bp, Homo sapiens
ctctgctctgcc

SEQ ID NO: 1519810 - DNA, 13 bp, Homo sapiens
ctctgctctgccc

SEQ ID NO: 1519811 - DNA, 14 bp, Homo sapiens
ctctgctctgcctg

SEQ ID NO: 1519812 - DNA, 14 bp, Homo sapiens
ctctgctgctgccc

SEQ ID NO: 1519813 - DNA, 12 bp, Homo sapiens
ctctgctggaag

SEQ ID NO: 1519814 - DNA, 23 bp, Homo sapiens
ctctgctggcaggattcttcccg

SEQ ID NO: 1519815 - DNA, 14 bp, Homo sapiens
ctctgctggcccag

SEQ ID NO: 1519816 - DNA, 13 bp, Homo sapiens
ctctgctgtagct

SEQ ID NO: 1519817 - DNA, 12 bp, Homo sapiens
ctctgctgtcct

SEQ ID NO: 1519818 - DNA, 12 bp, Homo sapiens
ctctgcttctct

SEQ ID NO: 1519819 - DNA, 16 bp, Homo sapiens
ctctgcttctctgact

SEQ ID NO: 1519820 - DNA, 21 bp, Homo sapiens
ctctgcttctctgacttctgc

SEQ ID NO: 1519821 - DNA, 21 bp, Homo sapiens
ctctggaagagaggaatgcct

SEQ ID NO: 1519822 - DNA, 19 bp, Homo sapiens
ctctggaataaagttgcag

SEQ ID NO: 1519823 - DNA, 15 bp, Homo sapiens
ctctggacagcccca

SEQ ID NO: 1519824 - DNA, 18 bp, Homo sapiens
ctctggacagccccaccc

SEQ ID NO: 1519825 - DNA, 17 bp, Homo sapiens
ctctggacgtgaaatac

SEQ ID NO: 1519826 - DNA, 14 bp, Homo sapiens
ctctggactggcct

SEQ ID NO: 1519827 - DNA, 14 bp, Homo sapiens
ctctggactggcta

SEQ ID NO: 1519828 - DNA, 17 bp, Homo sapiens
ctctggagaacagtggt

SEQ ID NO: 1519829 - DNA, 15 bp, Homo sapiens
ctctggagcagccaa

SEQ ID NO: 1519830 - DNA, 12 bp, Homo sapiens
ctctggagcccc

SEQ ID NO: 1519831 - DNA, 13 bp, Homo sapiens
ctctggagcccct

SEQ ID NO: 1519832 - DNA, 16 bp, Homo sapiens
ctctggagcccctcct

SEQ ID NO: 1519833 - DNA, 19 bp, Homo sapiens
ctctggaggctgcagagct

SEQ ID NO: 1519834 - DNA, 20 bp, Homo sapiens
ctctggaggggtgtggctcc

SEQ ID NO: 1519835 - DNA, 21 bp, Homo sapiens
ctctggaggggtgtggctcct

SEQ ID NO: 1519836 - DNA, 21 bp, Homo sapiens
ctctggaggtcatctggcgga

SEQ ID NO: 1519837 - DNA, 18 bp, Homo sapiens
ctctggcattagaattat

SEQ ID NO: 1519838 - DNA, 13 bp, Homo sapiens
ctctggccaccct

SEQ ID NO: 1519839 - DNA, 22 bp, Homo sapiens
ctctggccaccctggcccgccc

SEQ ID NO: 1519840 - DNA, 19 bp, Homo sapiens
ctctggccaggatggaggg

SEQ ID NO: 1519841 - DNA, 19 bp, Homo sapiens
ctctggcccagaaagcctc

SEQ ID NO: 1519842 - DNA, 13 bp, Homo sapiens
ctctggccctgcc

SEQ ID NO: 1519843 - DNA, 15 bp, Homo sapiens
ctctggccctgcctt

SEQ ID NO: 1519844 - DNA, 13 bp, Homo sapiens
ctctggccctggc

SEQ ID NO: 1519845 - DNA, 16 bp, Homo sapiens
ctctggccctggccct

SEQ ID NO: 1519846 - DNA, 13 bp, Homo sapiens
ctctggcctccca

SEQ ID NO: 1519847 - DNA, 20 bp, Homo sapiens
ctctggcggcttcctgtcca

SEQ ID NO: 1519848 - DNA, 17 bp, Homo sapiens
ctctggctagagccgag

SEQ ID NO: 1519849 - DNA, 20 bp, Homo sapiens
ctctggctgaaccctgtgct

SEQ ID NO: 1519850 - DNA, 19 bp, Homo sapiens
ctctggctgtaaggctcta

SEQ ID NO: 1519851 - DNA, 20 bp, Homo sapiens
ctctggcttctctcttttcc

SEQ ID NO: 1519852 - DNA, 20 bp, Homo sapiens
ctctgggagaaaatcatcaa

SEQ ID NO: 1519853 - DNA, 16 bp, Homo sapiens
ctctgggagcccagaa

SEQ ID NO: 1519854 - DNA, 15 bp, Homo sapiens
ctctgggcacagtgg

SEQ ID NO: 1519855 - DNA, 14 bp, Homo sapiens
ctctgggcagtgtg

SEQ ID NO: 1519856 - DNA, 14 bp, Homo sapiens
agaattgtttagat

SEQ ID NO: 1519857 - DNA, 22 bp, Homo sapiens
agaattgtttttgaatttaaat

SEQ ID NO: 1519858 - DNA, 14 bp, Homo sapiens
agaatttagtatta

SEQ ID NO: 1519859 - DNA, 15 bp, Homo sapiens
agaatttattacaaa

SEQ ID NO: 1519860 - DNA, 13 bp, Homo sapiens
agaatttattcaa

SEQ ID NO: 1519861 - DNA, 14 bp, Homo sapiens
agaatttattcaat

SEQ ID NO: 1519862 - DNA, 13 bp, Homo sapiens
agaatttctaaga

SEQ ID NO: 1519863 - DNA, 16 bp, Homo sapiens
agaatttctaccattt

SEQ ID NO: 1519864 - DNA, 20 bp, Homo sapiens
agaatttctaccatttcaga

SEQ ID NO: 1519865 - DNA, 13 bp, Homo sapiens
agaatttcttggt

SEQ ID NO: 1519866 - DNA, 22 bp, Homo sapiens
agaattttaagcctttgttgaa

SEQ ID NO: 1519867 - DNA, 17 bp, Homo sapiens
agaattttaatgtgaag

SEQ ID NO: 1519868 - DNA, 19 bp, Homo sapiens
agaattttaatgtgaagac

SEQ ID NO: 1519869 - DNA, 13 bp, Homo sapiens
agaattttaggaa

SEQ ID NO: 1519870 - DNA, 14 bp, Homo sapiens
agaattttaggaac

SEQ ID NO: 1519871 - DNA, 22 bp, Homo sapiens
agaattttaggaacttcagaga

SEQ ID NO: 1519872 - DNA, 20 bp, Homo sapiens
agaattttatatcattggat

SEQ ID NO: 1519873 - DNA, 12 bp, Homo sapiens
ctcattgacttt

SEQ ID NO: 1519874 - DNA, 13 bp, Homo sapiens
ctcattgctacca

SEQ ID NO: 1519875 - DNA, 22 bp, Homo sapiens
ctcattgctaccacagacttgc

SEQ ID NO: 1519876 - DNA, 15 bp, Homo sapiens
ctcattgtttttccc

SEQ ID NO: 1519877 - DNA, 15 bp, Homo sapiens
ctcatttcacagcct

SEQ ID NO: 1519878 - DNA, 23 bp, Homo sapiens
ctcatttcacccctccctttctc

SEQ ID NO: 1519879 - DNA, 15 bp, Homo sapiens
ctcatttctgccagc

SEQ ID NO: 1519880 - DNA, 16 bp, Homo sapiens
ctcatttctgccagcg

SEQ ID NO: 1519881 - DNA, 19 bp, Homo sapiens
ctcatttgagataaagtca

SEQ ID NO: 1519882 - DNA, 17 bp, Homo sapiens
ctcatttgttaaaatta

SEQ ID NO: 1519883 - DNA, 13 bp, Homo sapiens
ctcattttctggt

SEQ ID NO: 1519884 - DNA, 20 bp, Homo sapiens
ctcattttgacaaagtgcct

SEQ ID NO: 1519885 - DNA, 19 bp, Homo sapiens
ctcattttgggggtcatct

SEQ ID NO: 1519886 - DNA, 14 bp, Homo sapiens
ctcatttttcatta

SEQ ID NO: 1519887 - DNA, 15 bp, Homo sapiens
ctccaaacctccagc

SEQ ID NO: 1519888 - DNA, 18 bp, Homo sapiens
ctccaaacctccagcctc

SEQ ID NO: 1519889 - DNA, 19 bp, Homo sapiens
ctccaaacctccagcctcc

SEQ ID NO: 1519890 - DNA, 23 bp, Homo sapiens
ctccaaactgaagcagcctctcc

SEQ ID NO: 1519891 - DNA, 14 bp, Homo sapiens
ctccaaactgatta

SEQ ID NO: 1519892 - DNA, 22 bp, Homo sapiens
ctccaaaggggctgctggggca

SEQ ID NO: 1519893 - DNA, 23 bp, Homo sapiens
ctccaaatattattcaagtgcct

SEQ ID NO: 1519894 - DNA, 15 bp, Homo sapiens
ctccaaatgagatct

SEQ ID NO: 1519895 - DNA, 18 bp, Homo sapiens
ctccaaccaaataagact

SEQ ID NO: 1519896 - DNA, 13 bp, Homo sapiens
ctccaaccactgt

SEQ ID NO: 1519897 - DNA, 21 bp, Homo sapiens
ctccaaccactgtgccactga

SEQ ID NO: 1519898 - DNA, 15 bp, Homo sapiens
ctccaacctgaaggt

SEQ ID NO: 1519899 - DNA, 13 bp, Homo sapiens
ctccaacgcccct

SEQ ID NO: 1519900 - DNA, 18 bp, Homo sapiens
ctccaactggattataaa

SEQ ID NO: 1519901 - DNA, 18 bp, Homo sapiens
ctccaagaaactgaatga

SEQ ID NO: 1519902 - DNA, 19 bp, Homo sapiens
ctccaagaatggaagcctg

SEQ ID NO: 1519903 - DNA, 15 bp, Homo sapiens
ctccaagattctaga

SEQ ID NO: 1519904 - DNA, 18 bp, Homo sapiens
ctccaagattctagatga

SEQ ID NO: 1519905 - DNA, 16 bp, Homo sapiens
ctccaagcatttcatg

SEQ ID NO: 1519906 - DNA, 19 bp, Homo sapiens
ctccaagcatttcatgaaa

SEQ ID NO: 1519907 - DNA, 15 bp, Homo sapiens
ctccaagccccatct

SEQ ID NO: 1519908 - DNA, 18 bp, Homo sapiens
ctccaagcctgcctccca

SEQ ID NO: 1519909 - DNA, 21 bp, Homo sapiens
ctccaaggaggggctgtaaaa

SEQ ID NO: 1519910 - DNA, 22 bp, Homo sapiens
ctccaaggaggggctgtaaaat

SEQ ID NO: 1519911 - DNA, 19 bp, Homo sapiens
ctccaagggcttctgcacc

SEQ ID NO: 1519912 - DNA, 23 bp, Homo sapiens
ctccaagggcttctgcaccctcc

SEQ ID NO: 1519913 - DNA, 14 bp, Homo sapiens
ctccaagtgccaga

SEQ ID NO: 1519914 - DNA, 16 bp, Homo sapiens
ctccaagtgccagagg

SEQ ID NO: 1519915 - DNA, 18 bp, Homo sapiens
ctccaagtgccagaggtg

SEQ ID NO: 1519916 - DNA, 20 bp, Homo sapiens
ctccaagtgccagaggtggg

SEQ ID NO: 1519917 - DNA, 21 bp, Homo sapiens
ctccaatcagtgtttggtgta

SEQ ID NO: 1519918 - DNA, 22 bp, Homo sapiens
ctccaatcccaccaaccctcag

SEQ ID NO: 1519919 - DNA, 16 bp, Homo sapiens
ctccaatgcattggcc

SEQ ID NO: 1519920 - DNA, 18 bp, Homo sapiens
ctccaatgcattggcctc

SEQ ID NO: 1519921 - DNA, 23 bp, Homo sapiens
ctccacacagcagtgtcccctgc

SEQ ID NO: 1519922 - DNA, 16 bp, Homo sapiens
ctccacaccagctgct

SEQ ID NO: 1519923 - DNA, 17 bp, Homo sapiens
ctccacaccctctccca

SEQ ID NO: 1519924 - DNA, 13 bp, Homo sapiens
ctccacagcgagg

SEQ ID NO: 1519925 - DNA, 16 bp, Homo sapiens
ctccacagcgagggca

SEQ ID NO: 1519926 - DNA, 19 bp, Homo sapiens
ctccacagcgagggcagct

SEQ ID NO: 1519927 - DNA, 15 bp, Homo sapiens
ctccacagcggagga

SEQ ID NO: 1519928 - DNA, 15 bp, Homo sapiens
ctccacagctgcagc

SEQ ID NO: 1519929 - DNA, 12 bp, Homo sapiens
ctccacagtgtt

SEQ ID NO: 1519930 - DNA, 13 bp, Homo sapiens
ctccacagtgttg

SEQ ID NO: 1519931 - DNA, 21 bp, Homo sapiens
ctccacagtgttgtgcccctt

SEQ ID NO: 1519932 - DNA, 14 bp, Homo sapiens
ctccacatcctttc

SEQ ID NO: 1519933 - DNA, 16 bp, Homo sapiens
ctccacatctgcatca

SEQ ID NO: 1519934 - DNA, 21 bp, Homo sapiens
ctccacatctgcatcactcat

SEQ ID NO: 1519935 - DNA, 20 bp, Homo sapiens
ctccaccaacccatcagaag

SEQ ID NO: 1519936 - DNA, 12 bp, Homo sapiens
ctccaccaccac

SEQ ID NO: 1519937 - DNA, 15 bp, Homo sapiens
ctccaccagcagcat

SEQ ID NO: 1519938 - DNA, 16 bp, Homo sapiens
ctccaccagcagcatg

SEQ ID NO: 1519939 - DNA, 20 bp, Homo sapiens
ctccaccagcatcacctgcc

SEQ ID NO: 1519940 - DNA, 22 bp, Homo sapiens
ctccaccagcatcacctgcctg

SEQ ID NO: 1519941 - DNA, 23 bp, Homo sapiens
ctccaccagcatcacctgcctgt

SEQ ID NO: 1519942 - DNA, 11 bp, Homo sapiens
ctccaccagcc

SEQ ID NO: 1519943 - DNA, 17 bp, Homo sapiens
ctccaccagcctgctga

SEQ ID NO: 1519944 - DNA, 19 bp, Homo sapiens
ctccaccagcctgctgaca

SEQ ID NO: 1519945 - DNA, 16 bp, Homo sapiens
ctccaccatccccacc

SEQ ID NO: 1519946 - DNA, 14 bp, Homo sapiens
ctccacccaccagt

SEQ ID NO: 1519947 - DNA, 22 bp, Homo sapiens
ctccaccccccagaacctgtcc

SEQ ID NO: 1519948 - DNA, 17 bp, Homo sapiens
ctccaccctgtccccca

SEQ ID NO: 1519949 - DNA, 14 bp, Homo sapiens
ctccacccttggcc

SEQ ID NO: 1519950 - DNA, 15 bp, Homo sapiens
ctccacccttggcct

SEQ ID NO: 1519951 - DNA, 19 bp, Homo sapiens
ctccaccgaccaactgccc

SEQ ID NO: 1519952 - DNA, 20 bp, Homo sapiens
ctccaccgaccaactgccct

SEQ ID NO: 1519953 - DNA, 14 bp, Homo sapiens
ctccaccgctgcct

SEQ ID NO: 1519954 - DNA, 16 bp, Homo sapiens
ctccaccgctgcctaa

SEQ ID NO: 1519955 - DNA, 11 bp, Homo sapiens
ctccacctcaa

SEQ ID NO: 1519956 - DNA, 12 bp, Homo sapiens
ctccacctcagc

SEQ ID NO: 1519957 - DNA, 15 bp, Homo sapiens
ctccacctcagcctt

SEQ ID NO: 1519958 - DNA, 15 bp, Homo sapiens
ctccacctctggtgg

SEQ ID NO: 1519959 - DNA, 9 bp, Homo sapiens
agaaggaag

SEQ ID NO: 1519960 - DNA, 15 bp, Homo sapiens
agaaggaaggaggca

SEQ ID NO: 1519961 - DNA, 17 bp, Homo sapiens
agaaggaaggaggcaga

SEQ ID NO: 1519962 - DNA, 19 bp, Homo sapiens
agaaggaaggaggcagact

SEQ ID NO: 1519963 - DNA, 14 bp, Homo sapiens
agaaggaagggcag

SEQ ID NO: 1519964 - DNA, 15 bp, Homo sapiens
agaaggaagggcaga

SEQ ID NO: 1519965 - DNA, 20 bp, Homo sapiens
agaaggaatggtgcgtggct

SEQ ID NO: 1519966 - DNA, 14 bp, Homo sapiens
agaaggaatttgta

SEQ ID NO: 1519967 - DNA, 15 bp, Homo sapiens
agaaggacggtgcca

SEQ ID NO: 1519968 - DNA, 20 bp, Homo sapiens
agaaggacggtgccaagggc

SEQ ID NO: 1519969 - DNA, 21 bp, Homo sapiens
agaaggacggtgccaagggcc

SEQ ID NO: 1519970 - DNA, 12 bp, Homo sapiens
agaaggagggca

SEQ ID NO: 1519971 - DNA, 14 bp, Homo sapiens
agaaggcaaagttt

SEQ ID NO: 1519972 - DNA, 13 bp, Homo sapiens
agaaggcaatatt

SEQ ID NO: 1519973 - DNA, 15 bp, Homo sapiens
agaaggcagggaaag

SEQ ID NO: 1519974 - DNA, 17 bp, Homo sapiens
agaaggccaagaggctg

SEQ ID NO: 1519975 - DNA, 14 bp, Homo sapiens
agaaggccgctgcc

SEQ ID NO: 1519976 - DNA, 16 bp, Homo sapiens
agaaggccgctgcccc

SEQ ID NO: 1519977 - DNA, 19 bp, Homo sapiens
agaaggcctcttgtgctca

SEQ ID NO: 1519978 - DNA, 14 bp, Homo sapiens
agaagggaatttgg

SEQ ID NO: 1519979 - DNA, 21 bp, Homo sapiens
agaagggatatctactgtggt

SEQ ID NO: 1519980 - DNA, 16 bp, Homo sapiens
agaagggctgcatgat

SEQ ID NO: 1519981 - DNA, 15 bp, Homo sapiens
agaaggggaagcact

SEQ ID NO: 1519982 - DNA, 21 bp, Homo sapiens
agaagggggacgtttctggaa

SEQ ID NO: 1519983 - DNA, 20 bp, Homo sapiens
agaagggggctctgccccag

SEQ ID NO: 1519984 - DNA, 18 bp, Homo sapiens
agaagggggtctctgtta

SEQ ID NO: 1519985 - DNA, 23 bp, Homo sapiens
agaagggtggatgacagggcaga

SEQ ID NO: 1519986 - DNA, 17 bp, Homo sapiens
agaagggttcaggactt

SEQ ID NO: 1519987 - DNA, 19 bp, Homo sapiens
agaagggttctgccctgcc

SEQ ID NO: 1519988 - DNA, 23 bp, Homo sapiens
agaagggttctgccctgcctgag

SEQ ID NO: 1519989 - DNA, 21 bp, Homo sapiens
agaaggtccttaatgatccgt

SEQ ID NO: 1519990 - DNA, 13 bp, Homo sapiens
agaaggtctgttt

SEQ ID NO: 1519991 - DNA, 21 bp, Homo sapiens
agaaggtgcctcaagaatttc

SEQ ID NO: 1519992 - DNA, 17 bp, Homo sapiens
agaaggtggacctggca

SEQ ID NO: 1519993 - DNA, 16 bp, Homo sapiens
agaaggttggtggggg

SEQ ID NO: 1519994 - DNA, 18 bp, Homo sapiens
agaaggtttattgttaat

SEQ ID NO: 1519995 - DNA, 19 bp, Homo sapiens
agaagtagattaagagcca

SEQ ID NO: 1519996 - DNA, 21 bp, Homo sapiens
agaagtagctagtagcaatgt

SEQ ID NO: 1519997 - DNA, 15 bp, Homo sapiens
agaagtaggaggaaa

SEQ ID NO: 1519998 - DNA, 16 bp, Homo sapiens
agaagtattcctgttg

SEQ ID NO: 1519999 - DNA, 16 bp, Homo sapiens
agaagtatttttgtct

SEQ ID NO: 1520000 - DNA, 21 bp, Homo sapiens
agaagtcactcacactggcca

SEQ ID NO: 1520001 - DNA, 15 bp, Homo sapiens
agaagtcatcttgct

SEQ ID NO: 1520002 - DNA, 16 bp, Homo sapiens
agaagtcatcttgcta

SEQ ID NO: 1520003 - DNA, 22 bp, Homo sapiens
agaagtcatcttgctaccagta

SEQ ID NO: 1520004 - DNA, 13 bp, Homo sapiens
agaagtcatgaag

SEQ ID NO: 1520005 - DNA, 17 bp, Homo sapiens
agaagtcatgaagccca

SEQ ID NO: 1520006 - DNA, 22 bp, Homo sapiens
agaagtcctccctcctgcaggc

SEQ ID NO: 1520007 - DNA, 14 bp, Homo sapiens
agaagtcggaatgt

SEQ ID NO: 1520008 - DNA, 13 bp, Homo sapiens
agaagtctcagct

SEQ ID NO: 1520009 - DNA, 14 bp, Homo sapiens
agaagtctcagcta

SEQ ID NO: 1520010 - DNA, 22 bp, Homo sapiens
agaagtctcagctaagctcacg

SEQ ID NO: 1520011 - DNA, 15 bp, Homo sapiens
agaagtctccctgca

SEQ ID NO: 1520012 - DNA, 16 bp, Homo sapiens
agaagtctccctgcac

SEQ ID NO: 1520013 - DNA, 15 bp, Homo sapiens
agaagtctggaaaaa

SEQ ID NO: 1520014 - DNA, 15 bp, Homo sapiens
agaagtctggctttg

SEQ ID NO: 1520015 - DNA, 17 bp, Homo sapiens
agaagtcttagatgtat

SEQ ID NO: 1520016 - DNA, 19 bp, Homo sapiens
agaagtcttagatgtatat

SEQ ID NO: 1520017 - DNA, 15 bp, Homo sapiens
agaagtgaagaatgc

SEQ ID NO: 1520018 - DNA, 19 bp, Homo sapiens
agaagtgaatgctgggact

SEQ ID NO: 1520019 - DNA, 23 bp, Homo sapiens
agaagtgagctttgctgctacag

SEQ ID NO: 1520020 - DNA, 22 bp, Homo sapiens
agaagtgagtggtgtgactctt

SEQ ID NO: 1520021 - DNA, 21 bp, Homo sapiens
agaagtgagtttgtaaatatt

SEQ ID NO: 1520022 - DNA, 14 bp, Homo sapiens
agaagtgctccctg

SEQ ID NO: 1520023 - DNA, 19 bp, Homo sapiens
agaagtgctccctggaggc

SEQ ID NO: 1520024 - DNA, 24 bp, Homo sapiens
agaagtgctccctggaggcacgca

SEQ ID NO: 1520025 - DNA, 21 bp, Homo sapiens
agaagtgctcttggctgaccc

SEQ ID NO: 1520026 - DNA, 18 bp, Homo sapiens
agaagtggaccaggacag

SEQ ID NO: 1520027 - DNA, 23 bp, Homo sapiens
agaagtggaccaggacaggacca

SEQ ID NO: 1520028 - DNA, 17 bp, Homo sapiens
agaagtgggccaggaca

SEQ ID NO: 1520029 - DNA, 18 bp, Homo sapiens
agaagtgggccaggacag

SEQ ID NO: 1520030 - DNA, 23 bp, Homo sapiens
agaagtgggccaggacaggcccg

SEQ ID NO: 1520031 - DNA, 17 bp, Homo sapiens
agaagtgtcgttttcat

SEQ ID NO: 1520032 - DNA, 13 bp, Homo sapiens
agaagtgttgtaa

SEQ ID NO: 1520033 - DNA, 20 bp, Homo sapiens
agaagttaaaaaacagctgc

SEQ ID NO: 1520034 - DNA, 15 bp, Homo sapiens
agaagttaagcaaca

SEQ ID NO: 1520035 - DNA, 19 bp, Homo sapiens
agaagttaagcaacatcta

SEQ ID NO: 1520036 - DNA, 13 bp, Homo sapiens
agaagttactttt

SEQ ID NO: 1520037 - DNA, 23 bp, Homo sapiens
agaagttattttctacagtggtt

SEQ ID NO: 1520038 - DNA, 17 bp, Homo sapiens
agaagttcatgtccaaa

SEQ ID NO: 1520039 - DNA, 13 bp, Homo sapiens
agaagttctcaga

SEQ ID NO: 1520040 - DNA, 23 bp, Homo sapiens
agaagttctcagaataactacct

SEQ ID NO: 1520041 - DNA, 20 bp, Homo sapiens
agaagttctttgattctgta

SEQ ID NO: 1520042 - DNA, 13 bp, Homo sapiens
agaagtttaaata

SEQ ID NO: 1520043 - DNA, 21 bp, Homo sapiens
agaagtttggctgctgtcata

SEQ ID NO: 1520044 - DNA, 18 bp, Homo sapiens
agaagtttgtagccaggt

SEQ ID NO: 1520045 - DNA, 13 bp, Homo sapiens
agaagtttttctt

SEQ ID NO: 1520046 - DNA, 15 bp, Homo sapiens
agaataaaagctata

SEQ ID NO: 1520047 - DNA, 19 bp, Homo sapiens
agaataaaagctataaagt

SEQ ID NO: 1520048 - DNA, 20 bp, Homo sapiens
agaataaaagctataaagta

SEQ ID NO: 1520049 - DNA, 18 bp, Homo sapiens
agaataaaggcagttttc

SEQ ID NO: 1520050 - DNA, 17 bp, Homo sapiens
agaataaagttctgagt

SEQ ID NO: 1520051 - DNA, 21 bp, Homo sapiens
agaataaagttctgagtgttt

SEQ ID NO: 1520052 - DNA, 19 bp, Homo sapiens
agaataaataaagaagaaa

SEQ ID NO: 1520053 - DNA, 16 bp, Homo sapiens
agaataagagaaagaa

SEQ ID NO: 1520054 - DNA, 17 bp, Homo sapiens
agaataaggaggaggag

SEQ ID NO: 1520055 - DNA, 22 bp, Homo sapiens
agaataatatgctgccaaattt

SEQ ID NO: 1520056 - DNA, 16 bp, Homo sapiens
agaataatctttgggt

SEQ ID NO: 1520057 - DNA, 17 bp, Homo sapiens
agaataatgtgttaaac

SEQ ID NO: 1520058 - DNA, 21 bp, Homo sapiens
agaatacagaaagatggatgt

SEQ ID NO: 1520059 - DNA, 22 bp, Homo sapiens
agaatacagtaagctgctctat

SEQ ID NO: 1520060 - DNA, 15 bp, Homo sapiens
agaatacataaacaa

SEQ ID NO: 1520061 - DNA, 17 bp, Homo sapiens
agaatactgggttctta

SEQ ID NO: 1520062 - DNA, 20 bp, Homo sapiens
agaatactgggttcttagtt

SEQ ID NO: 1520063 - DNA, 13 bp, Homo sapiens
agaatactggtct

SEQ ID NO: 1520064 - DNA, 17 bp, Homo sapiens
agaatactggtctcagg

SEQ ID NO: 1520065 - DNA, 12 bp, Homo sapiens
agaatacttttt

SEQ ID NO: 1520066 - DNA, 21 bp, Homo sapiens
agaatagaaacgtaaactatg

SEQ ID NO: 1520067 - DNA, 20 bp, Homo sapiens
agaatagagctgccactggg

SEQ ID NO: 1520068 - DNA, 13 bp, Homo sapiens
agaataggaaaac

SEQ ID NO: 1520069 - DNA, 14 bp, Homo sapiens
agaataggaaaaca

SEQ ID NO: 1520070 - DNA, 15 bp, Homo sapiens
agaataggaaaacat

SEQ ID NO: 1520071 - DNA, 23 bp, Homo sapiens
agaataggaaaacattgcaataa

SEQ ID NO: 1520072 - DNA, 20 bp, Homo sapiens
agaataggcagggggccctg

SEQ ID NO: 1520073 - DNA, 18 bp, Homo sapiens
agaataggcattaacaca

SEQ ID NO: 1520074 - DNA, 17 bp, Homo sapiens
agaatataccttattta

SEQ ID NO: 1520075 - DNA, 19 bp, Homo sapiens
agaatataccttatttatt

SEQ ID NO: 1520076 - DNA, 21 bp, Homo sapiens
agaatatcctttaaaatttaa

SEQ ID NO: 1520077 - DNA, 22 bp, Homo sapiens
agaatatcctttaaaatttaaa

SEQ ID NO: 1520078 - DNA, 13 bp, Homo sapiens
agaatatgtttca

SEQ ID NO: 1520079 - DNA, 19 bp, Homo sapiens
agaatatgtttcaaacttt

SEQ ID NO: 1520080 - DNA, 21 bp, Homo sapiens
agaatatgtttcaaactttgg

SEQ ID NO: 1520081 - DNA, 23 bp, Homo sapiens
agaatattagctttactgtttgt

SEQ ID NO: 1520082 - DNA, 16 bp, Homo sapiens
agaatatttattacct

SEQ ID NO: 1520083 - DNA, 21 bp, Homo sapiens
agaatatttttatatttcctt

SEQ ID NO: 1520084 - DNA, 22 bp, Homo sapiens
agaatatttttatatttccttt

SEQ ID NO: 1520085 - DNA, 17 bp, Homo sapiens
agaatcagaagatagtc

SEQ ID NO: 1520086 - DNA, 13 bp, Homo sapiens
agaatcatgtttc

SEQ ID NO: 1520087 - DNA, 19 bp, Homo sapiens
agaatcatgtttctttgat

SEQ ID NO: 1520088 - DNA, 21 bp, Homo sapiens
ctccgactctgcacccgcctc

SEQ ID NO: 1520089 - DNA, 14 bp, Homo sapiens
ctccgagagcagtg

SEQ ID NO: 1520090 - DNA, 20 bp, Homo sapiens
ctccgagagcagtgggcagg

SEQ ID NO: 1520091 - DNA, 23 bp, Homo sapiens
ctccgagagcagtgggcaggtgg

SEQ ID NO: 1520092 - DNA, 14 bp, Homo sapiens
ctccgagagggaga

SEQ ID NO: 1520093 - DNA, 17 bp, Homo sapiens
ctccgagctctggtgct

SEQ ID NO: 1520094 - DNA, 17 bp, Homo sapiens
ctccgaggacccaggaa

SEQ ID NO: 1520095 - DNA, 15 bp, Homo sapiens
ctccgaggctccccg

SEQ ID NO: 1520096 - DNA, 18 bp, Homo sapiens
ctccgaggctccccgcct

SEQ ID NO: 1520097 - DNA, 23 bp, Homo sapiens
ctccgaggctccccgcctccact

SEQ ID NO: 1520098 - DNA, 13 bp, Homo sapiens
ctccgaggggtgg

SEQ ID NO: 1520099 - DNA, 15 bp, Homo sapiens
ctccgatgctgaggc

SEQ ID NO: 1520100 - DNA, 23 bp, Homo sapiens
ctccgcagtgcctgcaggggagc

SEQ ID NO: 1520101 - DNA, 14 bp, Homo sapiens
ctccgcagtgtctc

SEQ ID NO: 1520102 - DNA, 12 bp, Homo sapiens
ctccgccagcct

SEQ ID NO: 1520103 - DNA, 18 bp, Homo sapiens
ctccgccagcctcctctg

SEQ ID NO: 1520104 - DNA, 13 bp, Homo sapiens
ctccgccatccac

SEQ ID NO: 1520105 - DNA, 16 bp, Homo sapiens
ctccgcccgctcctgc

SEQ ID NO: 1520106 - DNA, 22 bp, Homo sapiens
ctccgcccgctcctgccgcaga

SEQ ID NO: 1520107 - DNA, 17 bp, Homo sapiens
ctccgccctcctcgggc

SEQ ID NO: 1520108 - DNA, 15 bp, Homo sapiens
ctccgccctgccact

SEQ ID NO: 1520109 - DNA, 16 bp, Homo sapiens
ctccgccctgccactc

SEQ ID NO: 1520110 - DNA, 14 bp, Homo sapiens
ctccgcctactgtc

SEQ ID NO: 1520111 - DNA, 22 bp, Homo sapiens
ctccgcctccacactgaccaag

SEQ ID NO: 1520112 - DNA, 13 bp, Homo sapiens
ctccgcctgggat

SEQ ID NO: 1520113 - DNA, 14 bp, Homo sapiens
ctccgcctgggatc

SEQ ID NO: 1520114 - DNA, 18 bp, Homo sapiens
ctccgccttcactccggt

SEQ ID NO: 1520115 - DNA, 15 bp, Homo sapiens
ctccgcgccgatgcc

SEQ ID NO: 1520116 - DNA, 20 bp, Homo sapiens
ctccgcgccgatgccaccgg

SEQ ID NO: 1520117 - DNA, 15 bp, Homo sapiens
ctccgctcccaccgc

SEQ ID NO: 1520118 - DNA, 16 bp, Homo sapiens
ctccgctcccaccgcc

SEQ ID NO: 1520119 - DNA, 17 bp, Homo sapiens
ctccgctcccaccgccc

SEQ ID NO: 1520120 - DNA, 13 bp, Homo sapiens
ctccgctgcctgg

SEQ ID NO: 1520121 - DNA, 14 bp, Homo sapiens
ctccgctgggcttc

SEQ ID NO: 1520122 - DNA, 15 bp, Homo sapiens
ctccgctgggcttca

SEQ ID NO: 1520123 - DNA, 19 bp, Homo sapiens
ctccggccagcgagtggtc

SEQ ID NO: 1520124 - DNA, 18 bp, Homo sapiens
ctccggcctgggtgacag

SEQ ID NO: 1520125 - DNA, 19 bp, Homo sapiens
ctccggcgtcttgcccagc

SEQ ID NO: 1520126 - DNA, 20 bp, Homo sapiens
ctccggcgtcttgcccagca

SEQ ID NO: 1520127 - DNA, 21 bp, Homo sapiens
ctccggggagcgcccgcgccc

SEQ ID NO: 1520128 - DNA, 15 bp, Homo sapiens
ctccggggtctgtgc

SEQ ID NO: 1520129 - DNA, 16 bp, Homo sapiens
ctccggggtctgtgct

SEQ ID NO: 1520130 - DNA, 18 bp, Homo sapiens
ctccggtgtgcctgcagc

SEQ ID NO: 1520131 - DNA, 21 bp, Homo sapiens
ctccgtagggtctttcttggg

SEQ ID NO: 1520132 - DNA, 16 bp, Homo sapiens
ctccgtccacccaggc

SEQ ID NO: 1520133 - DNA, 18 bp, Homo sapiens
ctccgtccacccaggctg

SEQ ID NO: 1520134 - DNA, 19 bp, Homo sapiens
ctccgtccacccaggctgc

SEQ ID NO: 1520135 - DNA, 20 bp, Homo sapiens
ctccgtccacccaggctgca

SEQ ID NO: 1520136 - DNA, 20 bp, Homo sapiens
ctccgtccaggagcctgtgc

SEQ ID NO: 1520137 - DNA, 13 bp, Homo sapiens
ctccgtccatatc

SEQ ID NO: 1520138 - DNA, 17 bp, Homo sapiens
ctccgtcccccaaacat

SEQ ID NO: 1520139 - DNA, 17 bp, Homo sapiens
ctccgtctctgtcctcg

SEQ ID NO: 1520140 - DNA, 22 bp, Homo sapiens
ctccgtcttagaagtggaccag

SEQ ID NO: 1520141 - DNA, 21 bp, Homo sapiens
ctccgtgaggctgctgccatc

SEQ ID NO: 1520142 - DNA, 21 bp, Homo sapiens
ctccgtgatccatccatctcc

SEQ ID NO: 1520143 - DNA, 21 bp, Homo sapiens
ctccgtgcctccaccaccact

SEQ ID NO: 1520144 - DNA, 17 bp, Homo sapiens
ctccgtggactgcagtc

SEQ ID NO: 1520145 - DNA, 15 bp, Homo sapiens
ctccgtgtggactgt

SEQ ID NO: 1520146 - DNA, 23 bp, Homo sapiens
ctccgtgtggactgtgcctcagg

SEQ ID NO: 1520147 - DNA, 18 bp, Homo sapiens
ctccgttagctcctgtgg

SEQ ID NO: 1520148 - DNA, 20 bp, Homo sapiens
ctccgttggccactccgaga

SEQ ID NO: 1520149 - DNA, 19 bp, Homo sapiens
ctccgtttatgggccttgc

SEQ ID NO: 1520150 - DNA, 20 bp, Homo sapiens
ctccgtttatgggccttgct

SEQ ID NO: 1520151 - DNA, 21 bp, Homo sapiens
ctccgtttatgggccttgctt

SEQ ID NO: 1520152 - DNA, 19 bp, Homo sapiens
ctcctacatatcccttcca

SEQ ID NO: 1520153 - DNA, 14 bp, Homo sapiens
ctcctacctcagcc

SEQ ID NO: 1520154 - DNA, 14 bp, Homo sapiens
ctcctacctgtctg

SEQ ID NO: 1520155 - DNA, 12 bp, Homo sapiens
ctcctagaagaa

SEQ ID NO: 1520156 - DNA, 15 bp, Homo sapiens
ctcctagaagaacca

SEQ ID NO: 1520157 - DNA, 23 bp, Homo sapiens
ctcctagaggtgggcagctgggc

SEQ ID NO: 1520158 - DNA, 22 bp, Homo sapiens
ctcctagcctgtgcctctggga

SEQ ID NO: 1520159 - DNA, 18 bp, Homo sapiens
ctcctaggaaaccagctc

SEQ ID NO: 1520160 - DNA, 17 bp, Homo sapiens
ctcctagtttgtggggg

SEQ ID NO: 1520161 - DNA, 18 bp, Homo sapiens
ctcctatatatttctatt

SEQ ID NO: 1520162 - DNA, 14 bp, Homo sapiens
ctcctatcctggtt

SEQ ID NO: 1520163 - DNA, 15 bp, Homo sapiens
ctcctatctccctgg

SEQ ID NO: 1520164 - DNA, 15 bp, Homo sapiens
ctcctatctgtgttt

SEQ ID NO: 1520165 - DNA, 20 bp, Homo sapiens
ctcctattctataaaactct

SEQ ID NO: 1520166 - DNA, 14 bp, Homo sapiens
ctcctcaactcacc

SEQ ID NO: 1520167 - DNA, 15 bp, Homo sapiens
ctcctcacccccagc

SEQ ID NO: 1520168 - DNA, 17 bp, Homo sapiens
ctcctcacccccagctt

SEQ ID NO: 1520169 - DNA, 16 bp, Homo sapiens
ctcctcacctcatgcc

SEQ ID NO: 1520170 - DNA, 16 bp, Homo sapiens
ctcctcacctctggac

SEQ ID NO: 1520171 - DNA, 21 bp, Homo sapiens
ctcctcacctctggactggct

SEQ ID NO: 1520172 - DNA, 22 bp, Homo sapiens
ctcctcacctctggactggcta

SEQ ID NO: 1520173 - DNA, 14 bp, Homo sapiens
ctcctcactgtatc

SEQ ID NO: 1520174 - DNA, 23 bp, Homo sapiens
ctcctcagcgagaggcagcaagg

SEQ ID NO: 1520175 - DNA, 17 bp, Homo sapiens
ctcctcaggcacacagc

SEQ ID NO: 1520176 - DNA, 21 bp, Homo sapiens
ctcctcaggcacacagctact

SEQ ID NO: 1520177 - DNA, 11 bp, Homo sapiens
ctcctcagggt

SEQ ID NO: 1520178 - DNA, 13 bp, Homo sapiens
ctcctcagggtgg

SEQ ID NO: 1520179 - DNA, 15 bp, Homo sapiens
ctcctcatcccgtgt

SEQ ID NO: 1520180 - DNA, 11 bp, Homo sapiens
ctcctcatgta

SEQ ID NO: 1520181 - DNA, 14 bp, Homo sapiens
ctcctccacagtgc

SEQ ID NO: 1520182 - DNA, 15 bp, Homo sapiens
ctcctccacagtgct

SEQ ID NO: 1520183 - DNA, 18 bp, Homo sapiens
ctcctccacagtgctgct

SEQ ID NO: 1520184 - DNA, 15 bp, Homo sapiens
ctcctccacccaccc

SEQ ID NO: 1520185 - DNA, 12 bp, Homo sapiens
ctcctccactca

SEQ ID NO: 1520186 - DNA, 15 bp, Homo sapiens
ctcctccagcccctg

SEQ ID NO: 1520187 - DNA, 17 bp, Homo sapiens
ctcctccagcccctgtc

SEQ ID NO: 1520188 - DNA, 18 bp, Homo sapiens
ctcctccagcccctgtcc

SEQ ID NO: 1520189 - DNA, 20 bp, Homo sapiens
ctcctccagcccctgtccca

SEQ ID NO: 1520190 - DNA, 19 bp, Homo sapiens
ctcctccagccgctggcaa

SEQ ID NO: 1520191 - DNA, 14 bp, Homo sapiens
ctcctccaggcctg

SEQ ID NO: 1520192 - DNA, 19 bp, Homo sapiens
ctcctccaggcctgcctcc

SEQ ID NO: 1520193 - DNA, 14 bp, Homo sapiens
ctcctccagggcca

SEQ ID NO: 1520194 - DNA, 21 bp, Homo sapiens
ctcctccagggtgattttatg

SEQ ID NO: 1520195 - DNA, 22 bp, Homo sapiens
ctcctccagtacgtcccgctgc

SEQ ID NO: 1520196 - DNA, 18 bp, Homo sapiens
ctcctccatctttctaca

SEQ ID NO: 1520197 - DNA, 15 bp, Homo sapiens
ctcctcccacccggc

SEQ ID NO: 1520198 - DNA, 13 bp, Homo sapiens
ctcctcccagtgc

SEQ ID NO: 1520199 - DNA, 15 bp, Homo sapiens
ctcctcccagtgcct

SEQ ID NO: 1520200 - DNA, 13 bp, Homo sapiens
ctcctcccatctc

SEQ ID NO: 1520201 - DNA, 14 bp, Homo sapiens
ctcctccccaaatc

SEQ ID NO: 1520202 - DNA, 19 bp, Homo sapiens
ctcctccccaactgtgggg

SEQ ID NO: 1520203 - DNA, 13 bp, Homo sapiens
ctcgaatctctgt

SEQ ID NO: 1520204 - DNA, 14 bp, Homo sapiens
ctcgaatctctgtg

SEQ ID NO: 1520205 - DNA, 21 bp, Homo sapiens
ctcgacccagaatggagcctg

SEQ ID NO: 1520206 - DNA, 16 bp, Homo sapiens
ctcgacctccccaccc

SEQ ID NO: 1520207 - DNA, 15 bp, Homo sapiens
ctcgacggcacgcac

SEQ ID NO: 1520208 - DNA, 22 bp, Homo sapiens
ctcgacggcacgcacttgcctg

SEQ ID NO: 1520209 - DNA, 18 bp, Homo sapiens
ctcgagaccatcctggcc

SEQ ID NO: 1520210 - DNA, 19 bp, Homo sapiens
ctcgagaccatcctggccc

SEQ ID NO: 1520211 - DNA, 21 bp, Homo sapiens
ctcgagaccatcctggcccct

SEQ ID NO: 1520212 - DNA, 17 bp, Homo sapiens
ctcgagcagtcctgcct

SEQ ID NO: 1520213 - DNA, 23 bp, Homo sapiens
ctcgagccccctggatgtcccct

SEQ ID NO: 1520214 - DNA, 14 bp, Homo sapiens
ctcgaggcaccggc

SEQ ID NO: 1520215 - DNA, 16 bp, Homo sapiens
ctcgaggggtgggctg

SEQ ID NO: 1520216 - DNA, 13 bp, Homo sapiens
ctcgatctcctga

SEQ ID NO: 1520217 - DNA, 21 bp, Homo sapiens
ctcgatgtaagggattccttg

SEQ ID NO: 1520218 - DNA, 14 bp, Homo sapiens
ctcgcacaggccct

SEQ ID NO: 1520219 - DNA, 14 bp, Homo sapiens
ctcgcacctttcca

SEQ ID NO: 1520220 - DNA, 15 bp, Homo sapiens
ctcgcacctttccaa

SEQ ID NO: 1520221 - DNA, 14 bp, Homo sapiens
ctcgcagcctgaag

SEQ ID NO: 1520222 - DNA, 20 bp, Homo sapiens
ctcgcagcctgaagcctgga

SEQ ID NO: 1520223 - DNA, 21 bp, Homo sapiens
ctcgcagcctgaagcctggat

SEQ ID NO: 1520224 - DNA, 20 bp, Homo sapiens
ctcgcagggaatgcagcagg

SEQ ID NO: 1520225 - DNA, 19 bp, Homo sapiens
ctcgcataggacctttcca

SEQ ID NO: 1520226 - DNA, 22 bp, Homo sapiens
ctcgcataggacctttccacca

SEQ ID NO: 1520227 - DNA, 24 bp, Homo sapiens
ctcgccatgatcagacatacagct

SEQ ID NO: 1520228 - DNA, 17 bp, Homo sapiens
ctcgccatgccgggggt

SEQ ID NO: 1520229 - DNA, 13 bp, Homo sapiens
ctcgcccagcagg

SEQ ID NO: 1520230 - DNA, 19 bp, Homo sapiens
ctcgcccatacccgtgaca

SEQ ID NO: 1520231 - DNA, 16 bp, Homo sapiens
ctcgcccgcccactgt

SEQ ID NO: 1520232 - DNA, 20 bp, Homo sapiens
ctcgcccgcccactgtcctg

SEQ ID NO: 1520233 - DNA, 22 bp, Homo sapiens
ctcgcccgcccactgtcctggg

SEQ ID NO: 1520234 - DNA, 23 bp, Homo sapiens
ctcgcccgcccactgtcctgggc

SEQ ID NO: 1520235 - DNA, 12 bp, Homo sapiens
ctcgccctgggt

SEQ ID NO: 1520236 - DNA, 20 bp, Homo sapiens
ctcgccgtgtctcagcctct

SEQ ID NO: 1520237 - DNA, 11 bp, Homo sapiens
ctcgcctcagc

SEQ ID NO: 1520238 - DNA, 19 bp, Homo sapiens
ctcgcctcagcctgatcag

SEQ ID NO: 1520239 - DNA, 23 bp, Homo sapiens
ctcgcctgacaaccactggtctg

SEQ ID NO: 1520240 - DNA, 15 bp, Homo sapiens
ctcgcggccctcagt

SEQ ID NO: 1520241 - DNA, 16 bp, Homo sapiens
ctcgcggccctcagta

SEQ ID NO: 1520242 - DNA, 15 bp, Homo sapiens
ctcgcgggcagcggg

SEQ ID NO: 1520243 - DNA, 20 bp, Homo sapiens
ctcgcgggcagcgggccagg

SEQ ID NO: 1520244 - DNA, 22 bp, Homo sapiens
ctcgcgggcagcgggccaggcc

SEQ ID NO: 1520245 - DNA, 22 bp, Homo sapiens
ctcgctgagggcagactggggc

SEQ ID NO: 1520246 - DNA, 20 bp, Homo sapiens
ctcgctgcgtcctcatttcc

SEQ ID NO: 1520247 - DNA, 16 bp, Homo sapiens
ctcgctgctgctacta

SEQ ID NO: 1520248 - DNA, 16 bp, Homo sapiens
ctcgctgtatgattta

SEQ ID NO: 1520249 - DNA, 18 bp, Homo sapiens
ctcgcttcctcagcctcc

SEQ ID NO: 1520250 - DNA, 14 bp, Homo sapiens
ctcgcttgccgggc

SEQ ID NO: 1520251 - DNA, 17 bp, Homo sapiens
ctcgctttgttgcccag

SEQ ID NO: 1520252 - DNA, 14 bp, Homo sapiens
ctcggaagagcccg

SEQ ID NO: 1520253 - DNA, 17 bp, Homo sapiens
ctcggaagccgtctgac

SEQ ID NO: 1520254 - DNA, 19 bp, Homo sapiens
ctcggaagccgtctgactc

SEQ ID NO: 1520255 - DNA, 16 bp, Homo sapiens
ctcggaaggctggctg

SEQ ID NO: 1520256 - DNA, 19 bp, Homo sapiens
ctcggagccaatgaacagc

SEQ ID NO: 1520257 - DNA, 22 bp, Homo sapiens
ctcggagcctcatccgaggcag

SEQ ID NO: 1520258 - DNA, 13 bp, Homo sapiens
ctcggagctggcc

SEQ ID NO: 1520259 - DNA, 21 bp, Homo sapiens
ctcggaggtccagctgggcct

SEQ ID NO: 1520260 - DNA, 17 bp, Homo sapiens
ctcggatgacaccctgg

SEQ ID NO: 1520261 - DNA, 17 bp, Homo sapiens
ctcggatgaccaaacca

SEQ ID NO: 1520262 - DNA, 21 bp, Homo sapiens
ctcggatgaccatactcagac

SEQ ID NO: 1520263 - DNA, 13 bp, Homo sapiens
ctcggccaggcat

SEQ ID NO: 1520264 - DNA, 22 bp, Homo sapiens
ctcggcctcccaaagtgctggg

SEQ ID NO: 1520265 - DNA, 17 bp, Homo sapiens
ctcggccttcacaatct

SEQ ID NO: 1520266 - DNA, 19 bp, Homo sapiens
ctcggctccccatgtgtcc

SEQ ID NO: 1520267 - DNA, 17 bp, Homo sapiens
ctcggcttggatcctgg

SEQ ID NO: 1520268 - DNA, 20 bp, Homo sapiens
ctcggcttggatcctgggct

SEQ ID NO: 1520269 - DNA, 17 bp, Homo sapiens
ctcgggaagcagccagc

SEQ ID NO: 1520270 - DNA, 20 bp, Homo sapiens
ctcgggaggctgaggcagga

SEQ ID NO: 1520271 - DNA, 21 bp, Homo sapiens
ctcgggatgccgttctgttcc

SEQ ID NO: 1520272 - DNA, 16 bp, Homo sapiens
ctcgggcccacctggc

SEQ ID NO: 1520273 - DNA, 20 bp, Homo sapiens
ctcgggcccacctggccacc

SEQ ID NO: 1520274 - DNA, 13 bp, Homo sapiens
ctcgggccgaggc

SEQ ID NO: 1520275 - DNA, 17 bp, Homo sapiens
ctcgggccgaggcccag

SEQ ID NO: 1520276 - DNA, 19 bp, Homo sapiens
ctcgggctggagcctccga

SEQ ID NO: 1520277 - DNA, 24 bp, Homo sapiens
ctcggggcccttggggcctggctt

SEQ ID NO: 1520278 - DNA, 18 bp, Homo sapiens
ctcggggggctctgcctt

SEQ ID NO: 1520279 - DNA, 19 bp, Homo sapiens
ctcggggggctctgccttc

SEQ ID NO: 1520280 - DNA, 19 bp, Homo sapiens
ctcggggtaaaaagtggct

SEQ ID NO: 1520281 - DNA, 15 bp, Homo sapiens
ctcggggtccagtgc

SEQ ID NO: 1520282 - DNA, 17 bp, Homo sapiens
ctcggggtccagtgcat

SEQ ID NO: 1520283 - DNA, 22 bp, Homo sapiens
ctcgggtgcgtgtgtttgtatg

SEQ ID NO: 1520284 - DNA, 21 bp, Homo sapiens
ctcgggtggctagtcagagag

SEQ ID NO: 1520285 - DNA, 11 bp, Homo sapiens
ctcgggtgggg

SEQ ID NO: 1520286 - DNA, 12 bp, Homo sapiens
ctcggtatctgg

SEQ ID NO: 1520287 - DNA, 18 bp, Homo sapiens
ctcggtggacccagggat

SEQ ID NO: 1520288 - DNA, 13 bp, Homo sapiens
ctcggtttctcca

SEQ ID NO: 1520289 - DNA, 15 bp, Homo sapiens
ctcgtaatagcttct

SEQ ID NO: 1520290 - DNA, 16 bp, Homo sapiens
ctcgtaatagcttctg

SEQ ID NO: 1520291 - DNA, 19 bp, Homo sapiens
ctcgtaatagcttctgtgt

SEQ ID NO: 1520292 - DNA, 20 bp, Homo sapiens
ctcgtaatagcttctgtgtg

SEQ ID NO: 1520293 - DNA, 21 bp, Homo sapiens
ctcgtaatagcttctgtgtgt

SEQ ID NO: 1520294 - DNA, 21 bp, Homo sapiens
ctcgtatcccaaatctgtcag

SEQ ID NO: 1520295 - DNA, 18 bp, Homo sapiens
ctcgtccaagggacagcc

SEQ ID NO: 1520296 - DNA, 22 bp, Homo sapiens
ctcgtccacaggggcaggcctg

SEQ ID NO: 1520297 - DNA, 23 bp, Homo sapiens
ctcgtccacaggggcaggcctgg

SEQ ID NO: 1520298 - DNA, 17 bp, Homo sapiens
ctcgtccgtctgtctcg

SEQ ID NO: 1520299 - DNA, 14 bp, Homo sapiens
ctcgtcctccccct

SEQ ID NO: 1520300 - DNA, 20 bp, Homo sapiens
ctcgtcctccccctgccagt

SEQ ID NO: 1520301 - DNA, 13 bp, Homo sapiens
ctcgtcctgtccc

SEQ ID NO: 1520302 - DNA, 15 bp, Homo sapiens
ctcgtcctgtcccag

SEQ ID NO: 1520303 - DNA, 20 bp, Homo sapiens
ctcgtctccctggtgcctct

SEQ ID NO: 1520304 - DNA, 15 bp, Homo sapiens
ctcgtgaggggcaag

SEQ ID NO: 1520305 - DNA, 16 bp, Homo sapiens
ctcgtgccagcagcct

SEQ ID NO: 1520306 - DNA, 21 bp, Homo sapiens
ctcgtgccagcagcctcgcac

SEQ ID NO: 1520307 - DNA, 18 bp, Homo sapiens
ctcgtgcgcatctcagaa

SEQ ID NO: 1520308 - DNA, 18 bp, Homo sapiens
ctcgtggccagcccggct

SEQ ID NO: 1520309 - DNA, 11 bp, Homo sapiens
ctcgtggcctt

SEQ ID NO: 1520310 - DNA, 14 bp, Homo sapiens
ctcgtggccttccc

SEQ ID NO: 1520311 - DNA, 18 bp, Homo sapiens
ctcgtggccttccccagc

SEQ ID NO: 1520312 - DNA, 20 bp, Homo sapiens
ctcgtggccttccccagcct

SEQ ID NO: 1520313 - DNA, 18 bp, Homo sapiens
ctcgtggcggggcagcag

SEQ ID NO: 1520314 - DNA, 15 bp, Homo sapiens
ctcgtgtatcctggg

SEQ ID NO: 1520315 - DNA, 17 bp, Homo sapiens
ctcgtgtatcctggggc

SEQ ID NO: 1520316 - DNA, 18 bp, Homo sapiens
ctcgtgtatcctggggct

SEQ ID NO: 1520317 - DNA, 20 bp, Homo sapiens
acttttatggctctatcttt

SEQ ID NO: 1520318 - DNA, 22 bp, Homo sapiens
acttttcaagtctgatccatat

SEQ ID NO: 1520319 - DNA, 13 bp, Homo sapiens
acttttcacactg

SEQ ID NO: 1520320 - DNA, 14 bp, Homo sapiens
acttttcacactgt

SEQ ID NO: 1520321 - DNA, 14 bp, Homo sapiens
acttttcagactga

SEQ ID NO: 1520322 - DNA, 10 bp, Homo sapiens
acttttcatt

SEQ ID NO: 1520323 - DNA, 15 bp, Homo sapiens
acttttccagtctgt

SEQ ID NO: 1520324 - DNA, 17 bp, Homo sapiens
acttttcctccctcagt

SEQ ID NO: 1520325 - DNA, 16 bp, Homo sapiens
acttttcgttaacatt

SEQ ID NO: 1520326 - DNA, 17 bp, Homo sapiens
acttttcgttaacattg

SEQ ID NO: 1520327 - DNA, 15 bp, Homo sapiens
acttttctaagaaaa

SEQ ID NO: 1520328 - DNA, 19 bp, Homo sapiens
acttttctaagaaaagcat

SEQ ID NO: 1520329 - DNA, 16 bp, Homo sapiens
acttttcttaaacctt

SEQ ID NO: 1520330 - DNA, 13 bp, Homo sapiens
acttttgctttaa

SEQ ID NO: 1520331 - DNA, 16 bp, Homo sapiens
acttttgtactgaatt

SEQ ID NO: 1520332 - DNA, 17 bp, Homo sapiens
acttttgtgtattctgt

SEQ ID NO: 1520333 - DNA, 18 bp, Homo sapiens
acttttgtgtattctgtg

SEQ ID NO: 1520334 - DNA, 19 bp, Homo sapiens
actttttaactattaagag

SEQ ID NO: 1520335 - DNA, 18 bp, Homo sapiens
actttttaattcaccaaa

SEQ ID NO: 1520336 - DNA, 10 bp, Homo sapiens
actttttagc

SEQ ID NO: 1520337 - DNA, 22 bp, Homo sapiens
actttttagccagtgacttttt

SEQ ID NO: 1520338 - DNA, 17 bp, Homo sapiens
actttttagtaatttct

SEQ ID NO: 1520339 - DNA, 14 bp, Homo sapiens
actttttatactcc

SEQ ID NO: 1520340 - DNA, 22 bp, Homo sapiens
actttttatgggtgaaaataag

SEQ ID NO: 1520341 - DNA, 21 bp, Homo sapiens
actttttcagagttgctttaa

SEQ ID NO: 1520342 - DNA, 12 bp, Homo sapiens
actttttccccc

SEQ ID NO: 1520343 - DNA, 13 bp, Homo sapiens
actttttcctggc

SEQ ID NO: 1520344 - DNA, 19 bp, Homo sapiens
actttttcttaatcatttt

SEQ ID NO: 1520345 - DNA, 13 bp, Homo sapiens
actttttgcattt

SEQ ID NO: 1520346 - DNA, 18 bp, Homo sapiens
actttttgttctggtcct

SEQ ID NO: 1520347 - DNA, 23 bp, Homo sapiens
actttttgttctggtcctttttg

SEQ ID NO: 1520348 - DNA, 19 bp, Homo sapiens
acttttttagaaatgcaaa

SEQ ID NO: 1520349 - DNA, 18 bp, Homo sapiens
acttttttatgaagaaaa

SEQ ID NO: 1520350 - DNA, 22 bp, Homo sapiens
acttttttgagtggatgatgtt

SEQ ID NO: 1520351 - DNA, 13 bp, Homo sapiens
acttttttgtgta

SEQ ID NO: 1520352 - DNA, 15 bp, Homo sapiens
acttttttgtgtatg

SEQ ID NO: 1520353 - DNA, 18 bp, Homo sapiens
actttttttcttctactt

SEQ ID NO: 1520354 - DNA, 17 bp, Homo sapiens
actttttttctttttct

SEQ ID NO: 1520355 - DNA, 16 bp, Homo sapiens
actttttttgtatgtg

SEQ ID NO: 1520356 - DNA, 17 bp, Homo sapiens
acttttttttctctctt

SEQ ID NO: 1520357 - DNA, 18 bp, Homo sapiens
acttttttttctctcttt

SEQ ID NO: 1520358 - DNA, 15 bp, Homo sapiens
acttttttttgagaa

SEQ ID NO: 1520359 - DNA, 21 bp, Homo sapiens
actttttttttttctgcctga

SEQ ID NO: 1520360 - DNA, 18 bp, Homo sapiens
actttttttttttttccc

SEQ ID NO: 1520361 - DNA, 12 bp, Homo sapiens
agaaaaaaaacc

SEQ ID NO: 1520362 - DNA, 19 bp, Homo sapiens
agaaaaaaaataacacaga

SEQ ID NO: 1520363 - DNA, 16 bp, Homo sapiens
agaaaaaaatactatt

SEQ ID NO: 1520364 - DNA, 12 bp, Homo sapiens
agaaaaaacaat

SEQ ID NO: 1520365 - DNA, 20 bp, Homo sapiens
agaaaaaacttgctggtcct

SEQ ID NO: 1520366 - DNA, 12 bp, Homo sapiens
agaaaaaagaag

SEQ ID NO: 1520367 - DNA, 17 bp, Homo sapiens
agaaaaaagtccagatt

SEQ ID NO: 1520368 - DNA, 15 bp, Homo sapiens
agaaaaaagtgttga

SEQ ID NO: 1520369 - DNA, 18 bp, Homo sapiens
agaaaaaataacacacat

SEQ ID NO: 1520370 - DNA, 12 bp, Homo sapiens
agaaaaacatgt

SEQ ID NO: 1520371 - DNA, 15 bp, Homo sapiens
agaaaaacatgtcat

SEQ ID NO: 1520372 - DNA, 14 bp, Homo sapiens
agaaaaagaaatgc

SEQ ID NO: 1520373 - DNA, 21 bp, Homo sapiens
agaaaaagcttaatgattctg

SEQ ID NO: 1520374 - DNA, 13 bp, Homo sapiens
agaaaaataaaat

SEQ ID NO: 1520375 - DNA, 21 bp, Homo sapiens
agaaaaatcttgtgctagaat

SEQ ID NO: 1520376 - DNA, 14 bp, Homo sapiens
agaaaaatgtataa

SEQ ID NO: 1520377 - DNA, 12 bp, Homo sapiens
agaaaacaaaaa

SEQ ID NO: 1520378 - DNA, 21 bp, Homo sapiens
agaaaacaaaaaacgaatgaa

SEQ ID NO: 1520379 - DNA, 21 bp, Homo sapiens
agaaaacaaactcttttttaa

SEQ ID NO: 1520380 - DNA, 22 bp, Homo sapiens
agaaaacaacttggcatttcta

SEQ ID NO: 1520381 - DNA, 20 bp, Homo sapiens
agaaaacaccatggagatga

SEQ ID NO: 1520382 - DNA, 13 bp, Homo sapiens
agaaaacactgtt

SEQ ID NO: 1520383 - DNA, 18 bp, Homo sapiens
agaaaacactgttatcat

SEQ ID NO: 1520384 - DNA, 14 bp, Homo sapiens
agaaaacagtacag

SEQ ID NO: 1520385 - DNA, 16 bp, Homo sapiens
agaaaacttttgttta

SEQ ID NO: 1520386 - DNA, 16 bp, Homo sapiens
agaaaagaccctgaga

SEQ ID NO: 1520387 - DNA, 18 bp, Homo sapiens
agaaaagagccactttca

SEQ ID NO: 1520388 - DNA, 15 bp, Homo sapiens
agaaaagataaagat

SEQ ID NO: 1520389 - DNA, 17 bp, Homo sapiens
agaaaagataaagatga

SEQ ID NO: 1520390 - DNA, 16 bp, Homo sapiens
agaaaagcacctgccg

SEQ ID NO: 1520391 - DNA, 12 bp, Homo sapiens
agaaaagcattt

SEQ ID NO: 1520392 - DNA, 19 bp, Homo sapiens
agaaaagcctaatcacagt

SEQ ID NO: 1520393 - DNA, 16 bp, Homo sapiens
agaaaagcctgaacta

SEQ ID NO: 1520394 - DNA, 14 bp, Homo sapiens
agaaaagtgaattg

SEQ ID NO: 1520395 - DNA, 14 bp, Homo sapiens
agaaaagtgcctga

SEQ ID NO: 1520396 - DNA, 14 bp, Homo sapiens
agaaaataaaacta

SEQ ID NO: 1520397 - DNA, 14 bp, Homo sapiens
agaaaataaaatat

SEQ ID NO: 1520398 - DNA, 22 bp, Homo sapiens
agaaaataacaagagttttaac

SEQ ID NO: 1520399 - DNA, 11 bp, Homo sapiens
agaaaataacc

SEQ ID NO: 1520400 - DNA, 15 bp, Homo sapiens
agaaaatacaataaa

SEQ ID NO: 1520401 - DNA, 17 bp, Homo sapiens
agaaaatacaataaact

SEQ ID NO: 1520402 - DNA, 22 bp, Homo sapiens
agaaaatatctgaaatgtgata

SEQ ID NO: 1520403 - DNA, 22 bp, Homo sapiens
agaaaatatgtcccagaaatgt

SEQ ID NO: 1520404 - DNA, 23 bp, Homo sapiens
agaaaatattatgtgtttccata

SEQ ID NO: 1520405 - DNA, 13 bp, Homo sapiens
agaaaatcactta

SEQ ID NO: 1520406 - DNA, 17 bp, Homo sapiens
agaaaatcatcaagaag

SEQ ID NO: 1520407 - DNA, 15 bp, Homo sapiens
agaaaatctttataa

SEQ ID NO: 1520408 - DNA, 11 bp, Homo sapiens
agaaaatgaag

SEQ ID NO: 1520409 - DNA, 19 bp, Homo sapiens
agaaaatgaattttttcca

SEQ ID NO: 1520410 - DNA, 20 bp, Homo sapiens
agaaaatgacttatttctgc

SEQ ID NO: 1520411 - DNA, 21 bp, Homo sapiens
agaaaatgcctcaattcacat

SEQ ID NO: 1520412 - DNA, 22 bp, Homo sapiens
agaaaatgcggttataaaaaat

SEQ ID NO: 1520413 - DNA, 16 bp, Homo sapiens
agaaaatgtaaggcaa

SEQ ID NO: 1520414 - DNA, 13 bp, Homo sapiens
agaaaattgagtt

SEQ ID NO: 1520415 - DNA, 15 bp, Homo sapiens
agaaaattgatattt

SEQ ID NO: 1520416 - DNA, 18 bp, Homo sapiens
agaaaattgctgtgcctc

SEQ ID NO: 1520417 - DNA, 13 bp, Homo sapiens
agaaaattttgta

SEQ ID NO: 1520418 - DNA, 16 bp, Homo sapiens
agaaaattttgtaaaa

SEQ ID NO: 1520419 - DNA, 16 bp, Homo sapiens
agaaacaaaaagagct

SEQ ID NO: 1520420 - DNA, 13 bp, Homo sapiens
agaaacaaagatg

SEQ ID NO: 1520421 - DNA, 13 bp, Homo sapiens
agaaacaagctgt

SEQ ID NO: 1520422 - DNA, 14 bp, Homo sapiens
agaaacaagctgtg

SEQ ID NO: 1520423 - DNA, 17 bp, Homo sapiens
agaaacaagctgtgcag

SEQ ID NO: 1520424 - DNA, 14 bp, Homo sapiens
agaaacacaatatt

SEQ ID NO: 1520425 - DNA, 22 bp, Homo sapiens
agaaacacccctctgtctagga

SEQ ID NO: 1520426 - DNA, 23 bp, Homo sapiens
agaaacacgaactttagctgcat

SEQ ID NO: 1520427 - DNA, 23 bp, Homo sapiens
agaaacactaagctctctgggcc

SEQ ID NO: 1520428 - DNA, 17 bp, Homo sapiens
agaaacactgaaaagaa

SEQ ID NO: 1520429 - DNA, 18 bp, Homo sapiens
agaaacactgaagccatt

SEQ ID NO: 1520430 - DNA, 15 bp, Homo sapiens
agaaacactgccttt

SEQ ID NO: 1520431 - DNA, 17 bp, Homo sapiens
agaaacagagtggcctc

SEQ ID NO: 1520432 - DNA, 13 bp, Homo sapiens
agaaacagccagc

SEQ ID NO: 1520433 - DNA, 18 bp, Homo sapiens
agaaacagctcagccagt

SEQ ID NO: 1520434 - DNA, 17 bp, Homo sapiens
agaaacagctttcaagt

SEQ ID NO: 1520435 - DNA, 18 bp, Homo sapiens
ctcgtgtgatttcctaca

SEQ ID NO: 1520436 - DNA, 16 bp, Homo sapiens
ctcgtgtgtcctcatg

SEQ ID NO: 1520437 - DNA, 14 bp, Homo sapiens
ctcgttacctgccg

SEQ ID NO: 1520438 - DNA, 16 bp, Homo sapiens
ctcgttccagtggcgg

SEQ ID NO: 1520439 - DNA, 17 bp, Homo sapiens
ctcgttccagtggcggc

SEQ ID NO: 1520440 - DNA, 19 bp, Homo sapiens
ctctaaaaagaagccacag

SEQ ID NO: 1520441 - DNA, 20 bp, Homo sapiens
ctctaaaagatcctttttaa

SEQ ID NO: 1520442 - DNA, 23 bp, Homo sapiens
ctctaaaataggtaaatgtattt

SEQ ID NO: 1520443 - DNA, 11 bp, Homo sapiens
ctctaaaatat

SEQ ID NO: 1520444 - DNA, 21 bp, Homo sapiens
ctctaaaatatttatgaagaa

SEQ ID NO: 1520445 - DNA, 22 bp, Homo sapiens
ctctaaactggcatctgctcta

SEQ ID NO: 1520446 - DNA, 14 bp, Homo sapiens
ctctaaagaaaaat

SEQ ID NO: 1520447 - DNA, 18 bp, Homo sapiens
ctctaaagcaataatggt

SEQ ID NO: 1520448 - DNA, 23 bp, Homo sapiens
ctctaaagcaataatggtcccat

SEQ ID NO: 1520449 - DNA, 18 bp, Homo sapiens
ctctaaatgggaaagtat

SEQ ID NO: 1520450 - DNA, 13 bp, Homo sapiens
ctctaaccagtgt

SEQ ID NO: 1520451 - DNA, 17 bp, Homo sapiens
ctctaacccagtggctg

SEQ ID NO: 1520452 - DNA, 16 bp, Homo sapiens
ctctaactcctgccat

SEQ ID NO: 1520453 - DNA, 16 bp, Homo sapiens
ctctaagatcttagat

SEQ ID NO: 1520454 - DNA, 19 bp, Homo sapiens
ctctaagatcttagattct

SEQ ID NO: 1520455 - DNA, 14 bp, Homo sapiens
ctctaagctggagc

SEQ ID NO: 1520456 - DNA, 14 bp, Homo sapiens
ctctaaggagcagc

SEQ ID NO: 1520457 - DNA, 12 bp, Homo sapiens
ctctaagtgcca

SEQ ID NO: 1520458 - DNA, 18 bp, Homo sapiens
ctctaagtgggcattgcc

SEQ ID NO: 1520459 - DNA, 19 bp, Homo sapiens
ctctaagtgggcattgcca

SEQ ID NO: 1520460 - DNA, 14 bp, Homo sapiens
ctctaataaacact

SEQ ID NO: 1520461 - DNA, 19 bp, Homo sapiens
ctctaataaacactgtttt

SEQ ID NO: 1520462 - DNA, 18 bp, Homo sapiens
ctctaatctggatgttaa

SEQ ID NO: 1520463 - DNA, 20 bp, Homo sapiens
ctctaatgtctgcagctcaa

SEQ ID NO: 1520464 - DNA, 23 bp, Homo sapiens
ctctaatgttgtatcatactctt

SEQ ID NO: 1520465 - DNA, 17 bp, Homo sapiens
ctctacaattggaagat

SEQ ID NO: 1520466 - DNA, 19 bp, Homo sapiens
ctctacccatattacagat

SEQ ID NO: 1520467 - DNA, 13 bp, Homo sapiens
ctctacccctgct

SEQ ID NO: 1520468 - DNA, 15 bp, Homo sapiens
ctctaccctcccacc

SEQ ID NO: 1520469 - DNA, 17 bp, Homo sapiens
ctctaccctcccacccc

SEQ ID NO: 1520470 - DNA, 22 bp, Homo sapiens
ctctaccctcccacccccttct

SEQ ID NO: 1520471 - DNA, 14 bp, Homo sapiens
ctctaccctgtctg

SEQ ID NO: 1520472 - DNA, 21 bp, Homo sapiens
ctctaccctgtctgtcccttt

SEQ ID NO: 1520473 - DNA, 16 bp, Homo sapiens
ctctacctccaccctg

SEQ ID NO: 1520474 - DNA, 17 bp, Homo sapiens
ctctacctccaccctgc

SEQ ID NO: 1520475 - DNA, 15 bp, Homo sapiens
ctctactaaaaagaa

SEQ ID NO: 1520476 - DNA, 20 bp, Homo sapiens
ctctactaaaaatacaaaaa

SEQ ID NO: 1520477 - DNA, 19 bp, Homo sapiens
ctctactaaaaataccaaa

SEQ ID NO: 1520478 - DNA, 18 bp, Homo sapiens
ctctactaccacaaggaa

SEQ ID NO: 1520479 - DNA, 22 bp, Homo sapiens
ctctactgccctccccttcccc

SEQ ID NO: 1520480 - DNA, 17 bp, Homo sapiens
ctctacttaatccaatg

SEQ ID NO: 1520481 - DNA, 20 bp, Homo sapiens
ctctacttagcatgtcccta

SEQ ID NO: 1520482 - DNA, 15 bp, Homo sapiens
ctctactttgattct

SEQ ID NO: 1520483 - DNA, 11 bp, Homo sapiens
ctctagaacat

SEQ ID NO: 1520484 - DNA, 17 bp, Homo sapiens
ctctagaacatgcacat

SEQ ID NO: 1520485 - DNA, 19 bp, Homo sapiens
ctctagaagccaagggaaa

SEQ ID NO: 1520486 - DNA, 13 bp, Homo sapiens
ctctagaatccca

SEQ ID NO: 1520487 - DNA, 15 bp, Homo sapiens
ctctagaatcccagc

SEQ ID NO: 1520488 - DNA, 18 bp, Homo sapiens
ctctagaatcccagcagc

SEQ ID NO: 1520489 - DNA, 19 bp, Homo sapiens
ctctagaatcccagcagca

SEQ ID NO: 1520490 - DNA, 20 bp, Homo sapiens
ctctagaattttaagccttt

SEQ ID NO: 1520491 - DNA, 17 bp, Homo sapiens
ctctagagagccttaac

SEQ ID NO: 1520492 - DNA, 23 bp, Homo sapiens
ctctagaggcatcacctgggacc

SEQ ID NO: 1520493 - DNA, 23 bp, Homo sapiens
ctctagagtagaggtataattgt

SEQ ID NO: 1520494 - DNA, 13 bp, Homo sapiens
ctctagcaaggct

SEQ ID NO: 1520495 - DNA, 15 bp, Homo sapiens
ctctagcaaggctca

SEQ ID NO: 1520496 - DNA, 21 bp, Homo sapiens
ctctagccaggagtctgtgct

SEQ ID NO: 1520497 - DNA, 23 bp, Homo sapiens
ctctagcctggcaacagagcgag

SEQ ID NO: 1520498 - DNA, 20 bp, Homo sapiens
ctctagcctgggccagagaa

SEQ ID NO: 1520499 - DNA, 15 bp, Homo sapiens
ctctagctggcagga

SEQ ID NO: 1520500 - DNA, 18 bp, Homo sapiens
ctctagctggcaggacac

SEQ ID NO: 1520501 - DNA, 22 bp, Homo sapiens
ctctaggagggagccttgtgag

SEQ ID NO: 1520502 - DNA, 17 bp, Homo sapiens
ctctagggaatctggat

SEQ ID NO: 1520503 - DNA, 23 bp, Homo sapiens
ctctagtccccaaggcctctctc

SEQ ID NO: 1520504 - DNA, 13 bp, Homo sapiens
ctctagtgccctc

SEQ ID NO: 1520505 - DNA, 14 bp, Homo sapiens
ctctagtgccctcc

SEQ ID NO: 1520506 - DNA, 17 bp, Homo sapiens
ctctagtgcggtttact

SEQ ID NO: 1520507 - DNA, 19 bp, Homo sapiens
ctctagtgggacagcccag

SEQ ID NO: 1520508 - DNA, 23 bp, Homo sapiens
ctctagtgggacagcccagagcc

SEQ ID NO: 1520509 - DNA, 16 bp, Homo sapiens
ctctagttctagatga

SEQ ID NO: 1520510 - DNA, 13 bp, Homo sapiens
ctctagttctttg

SEQ ID NO: 1520511 - DNA, 18 bp, Homo sapiens
ctctataccaataaagtg

SEQ ID NO: 1520512 - DNA, 17 bp, Homo sapiens
ctctatactttgttctg

SEQ ID NO: 1520513 - DNA, 18 bp, Homo sapiens
ctctatactttgttctgt

SEQ ID NO: 1520514 - DNA, 23 bp, Homo sapiens
ctctatactttgttctgttgtct

SEQ ID NO: 1520515 - DNA, 22 bp, Homo sapiens
ctctatagcagacactaaagac

SEQ ID NO: 1520516 - DNA, 22 bp, Homo sapiens
ctctatatttagattgttaaaa

SEQ ID NO: 1520517 - DNA, 21 bp, Homo sapiens
ctctatccccatccaggtctt

SEQ ID NO: 1520518 - DNA, 15 bp, Homo sapiens
ctctatgacatgaaa

SEQ ID NO: 1520519 - DNA, 15 bp, Homo sapiens
ctctatgtatattct

SEQ ID NO: 1520520 - DNA, 21 bp, Homo sapiens
ctctatgtatattctatttta

SEQ ID NO: 1520521 - DNA, 20 bp, Homo sapiens
ctctattaagatttccaagt

SEQ ID NO: 1520522 - DNA, 14 bp, Homo sapiens
ctctatttaagata

SEQ ID NO: 1520523 - DNA, 21 bp, Homo sapiens
ctctatttaagatatatacat

SEQ ID NO: 1520524 - DNA, 17 bp, Homo sapiens
ctctatttatgtttgca

SEQ ID NO: 1520525 - DNA, 15 bp, Homo sapiens
ctctcaagctagcca

SEQ ID NO: 1520526 - DNA, 20 bp, Homo sapiens
ctctcaagctagccagaggg

SEQ ID NO: 1520527 - DNA, 13 bp, Homo sapiens
ctctcacactgaa

SEQ ID NO: 1520528 - DNA, 21 bp, Homo sapiens
ctctcacccagtccccacccg

SEQ ID NO: 1520529 - DNA, 13 bp, Homo sapiens
ctctcacccccat

SEQ ID NO: 1520530 - DNA, 14 bp, Homo sapiens
ctctcacccccatc

SEQ ID NO: 1520531 - DNA, 23 bp, Homo sapiens
ctctcactgtattagagcgccag

SEQ ID NO: 1520532 - DNA, 17 bp, Homo sapiens
ctctcagaattcttcag

SEQ ID NO: 1520533 - DNA, 12 bp, Homo sapiens
ctctcagagtga

SEQ ID NO: 1520534 - DNA, 15 bp, Homo sapiens
ctctcagagtgacag

SEQ ID NO: 1520535 - DNA, 15 bp, Homo sapiens
ctctcagcaagtgcc

SEQ ID NO: 1520536 - DNA, 23 bp, Homo sapiens
ctctcagcaccaagagcagctgg

SEQ ID NO: 1520537 - DNA, 22 bp, Homo sapiens
ctctcagcatagcctgcctgat

SEQ ID NO: 1520538 - DNA, 14 bp, Homo sapiens
ctctcagcctccca

SEQ ID NO: 1520539 - DNA, 19 bp, Homo sapiens
ctctcagcctcccaacccc

SEQ ID NO: 1520540 - DNA, 16 bp, Homo sapiens
ctctcagcctcccaca

SEQ ID NO: 1520541 - DNA, 13 bp, Homo sapiens
ctctcaggagcac

SEQ ID NO: 1520542 - DNA, 16 bp, Homo sapiens
ctctcaggagcacagg

SEQ ID NO: 1520543 - DNA, 18 bp, Homo sapiens
ctctcaggagcacaggca

SEQ ID NO: 1520544 - DNA, 19 bp, Homo sapiens
ctctcaggagcacaggcag

SEQ ID NO: 1520545 - DNA, 14 bp, Homo sapiens
ctctcaggatcaag

SEQ ID NO: 1520546 - DNA, 14 bp, Homo sapiens
ctctcaggatccaa

SEQ ID NO: 1520547 - DNA, 16 bp, Homo sapiens
ctctcagtgccttctc

SEQ ID NO: 1520548 - DNA, 22 bp, Homo sapiens
ctctcagtgttttggactccat

SEQ ID NO: 1520549 - DNA, 15 bp, Homo sapiens
ctctcagttctctcc

SEQ ID NO: 1520550 - DNA, 12 bp, Homo sapiens
ctctcatattcg

SEQ ID NO: 1520551 - DNA, 17 bp, Homo sapiens
agaaacagttggtaact

SEQ ID NO: 1520552 - DNA, 14 bp, Homo sapiens
agaaacatcagtta

SEQ ID NO: 1520553 - DNA, 18 bp, Homo sapiens
agaaacatgaaatgcttc

SEQ ID NO: 1520554 - DNA, 14 bp, Homo sapiens
agaaaccaagccat

SEQ ID NO: 1520555 - DNA, 21 bp, Homo sapiens
agaaaccagttatgtgaatga

SEQ ID NO: 1520556 - DNA, 16 bp, Homo sapiens
agaaacccaccagcct

SEQ ID NO: 1520557 - DNA, 21 bp, Homo sapiens
agaaaccctaaaaagagaaga

SEQ ID NO: 1520558 - DNA, 21 bp, Homo sapiens
agaaacccttcagtgctacat

SEQ ID NO: 1520559 - DNA, 22 bp, Homo sapiens
agaaaccgatttttaaagttgg

SEQ ID NO: 1520560 - DNA, 14 bp, Homo sapiens
agaaaccttttatt

SEQ ID NO: 1520561 - DNA, 16 bp, Homo sapiens
agaaaccttttatttt

SEQ ID NO: 1520562 - DNA, 17 bp, Homo sapiens
agaaacgagatttgcca

SEQ ID NO: 1520563 - DNA, 18 bp, Homo sapiens
agaaacgcatccagcaag

SEQ ID NO: 1520564 - DNA, 15 bp, Homo sapiens
agaaacgcctgcccc

SEQ ID NO: 1520565 - DNA, 17 bp, Homo sapiens
agaaacgtaaactatga

SEQ ID NO: 1520566 - DNA, 13 bp, Homo sapiens
agaaactcctgtt

SEQ ID NO: 1520567 - DNA, 22 bp, Homo sapiens
agaaactccttttgctgtcttt

SEQ ID NO: 1520568 - DNA, 15 bp, Homo sapiens
agaaactgaatgaat

SEQ ID NO: 1520569 - DNA, 16 bp, Homo sapiens
agaaactgagaccaaa

SEQ ID NO: 1520570 - DNA, 13 bp, Homo sapiens
agaaactgctgca

SEQ ID NO: 1520571 - DNA, 14 bp, Homo sapiens
agaaactgtagtct

SEQ ID NO: 1520572 - DNA, 20 bp, Homo sapiens
agaaacttaaatgttattat

SEQ ID NO: 1520573 - DNA, 17 bp, Homo sapiens
agaaacttagaggaaaa

SEQ ID NO: 1520574 - DNA, 20 bp, Homo sapiens
agaaactttgagtacagata

SEQ ID NO: 1520575 - DNA, 15 bp, Homo sapiens
agaaacttttttatt

SEQ ID NO: 1520576 - DNA, 19 bp, Homo sapiens
agaaagaaaagaccctgag

SEQ ID NO: 1520577 - DNA, 12 bp, Homo sapiens
agaaagaaatta

SEQ ID NO: 1520578 - DNA, 13 bp, Homo sapiens
agaaagaaggaag

SEQ ID NO: 1520579 - DNA, 18 bp, Homo sapiens
agaaagaaggaagtgaag

SEQ ID NO: 1520580 - DNA, 23 bp, Homo sapiens
agaaagactattcaaacagtctc

SEQ ID NO: 1520581 - DNA, 17 bp, Homo sapiens
agaaagagaaacagttg

SEQ ID NO: 1520582 - DNA, 19 bp, Homo sapiens
agaaagagagaagccagcc

SEQ ID NO: 1520583 - DNA, 14 bp, Homo sapiens
agaaagagctgcct

SEQ ID NO: 1520584 - DNA, 16 bp, Homo sapiens
agaaagagctgcctgg

SEQ ID NO: 1520585 - DNA, 19 bp, Homo sapiens
agaaagagctgcctggatg

SEQ ID NO: 1520586 - DNA, 14 bp, Homo sapiens
agaaagagggacaa

SEQ ID NO: 1520587 - DNA, 17 bp, Homo sapiens
agaaagatcgtttaaaa

SEQ ID NO: 1520588 - DNA, 14 bp, Homo sapiens
agaaagatggaaat

SEQ ID NO: 1520589 - DNA, 14 bp, Homo sapiens
agaaagatttgtta

SEQ ID NO: 1520590 - DNA, 13 bp, Homo sapiens
agaaagcaaaata

SEQ ID NO: 1520591 - DNA, 19 bp, Homo sapiens
agaaagcacttaaacagaa

SEQ ID NO: 1520592 - DNA, 19 bp, Homo sapiens
agaaagcaggagcagctgt

SEQ ID NO: 1520593 - DNA, 17 bp, Homo sapiens
agaaagcatccctcacc

SEQ ID NO: 1520594 - DNA, 17 bp, Homo sapiens
agaaagccaagggcagt

SEQ ID NO: 1520595 - DNA, 21 bp, Homo sapiens
agaaagcctccgctgggcttc

SEQ ID NO: 1520596 - DNA, 19 bp, Homo sapiens
agaaagcctctctctccct

SEQ ID NO: 1520597 - DNA, 19 bp, Homo sapiens
agaaagctctacatttgca

SEQ ID NO: 1520598 - DNA, 22 bp, Homo sapiens
agaaagctctacatttgcagat

SEQ ID NO: 1520599 - DNA, 13 bp, Homo sapiens
agaaagctgcctg

SEQ ID NO: 1520600 - DNA, 14 bp, Homo sapiens
agaaagctggactg

SEQ ID NO: 1520601 - DNA, 16 bp, Homo sapiens
agaaagctggactgac

SEQ ID NO: 1520602 - DNA, 21 bp, Homo sapiens
agaaagctggactgaccaaag

SEQ ID NO: 1520603 - DNA, 19 bp, Homo sapiens
agaaaggaagcattgtaaa

SEQ ID NO: 1520604 - DNA, 21 bp, Homo sapiens
agaaaggaagcattgtaaaat

SEQ ID NO: 1520605 - DNA, 16 bp, Homo sapiens
agaaaggatatttaag

SEQ ID NO: 1520606 - DNA, 21 bp, Homo sapiens
agaaaggcaaagtacattgta

SEQ ID NO: 1520607 - DNA, 16 bp, Homo sapiens
agaaaggggagaatgt

SEQ ID NO: 1520608 - DNA, 14 bp, Homo sapiens
agaaaggggagccc

SEQ ID NO: 1520609 - DNA, 15 bp, Homo sapiens
agaaaggggagccca

SEQ ID NO: 1520610 - DNA, 17 bp, Homo sapiens
agaaaggggcattttgt

SEQ ID NO: 1520611 - DNA, 15 bp, Homo sapiens
agaaagtgaagcaaa

SEQ ID NO: 1520612 - DNA, 13 bp, Homo sapiens
agaaagtgacatt

SEQ ID NO: 1520613 - DNA, 16 bp, Homo sapiens
agaaagtgggaggtca

SEQ ID NO: 1520614 - DNA, 18 bp, Homo sapiens
agaaagtgggaggtcagg

SEQ ID NO: 1520615 - DNA, 11 bp, Homo sapiens
agaaagtgtat

SEQ ID NO: 1520616 - DNA, 20 bp, Homo sapiens
agaaagttggaaaggaaaaa

SEQ ID NO: 1520617 - DNA, 22 bp, Homo sapiens
agaaataaaaatcaacttgtgt

SEQ ID NO: 1520618 - DNA, 18 bp, Homo sapiens
agaaataaagtttgctta

SEQ ID NO: 1520619 - DNA, 21 bp, Homo sapiens
agaaataaagtttgcttagaa

SEQ ID NO: 1520620 - DNA, 14 bp, Homo sapiens
agaaataaattttg

SEQ ID NO: 1520621 - DNA, 15 bp, Homo sapiens
agaaataaattttgt

SEQ ID NO: 1520622 - DNA, 16 bp, Homo sapiens
agaaataagaaaatgg

SEQ ID NO: 1520623 - DNA, 14 bp, Homo sapiens
agaaataataaaaa

SEQ ID NO: 1520624 - DNA, 15 bp, Homo sapiens
agaaataatatgcat

SEQ ID NO: 1520625 - DNA, 22 bp, Homo sapiens
agaaataatgctacaattttaa

SEQ ID NO: 1520626 - DNA, 15 bp, Homo sapiens
agaaatacataaaaa

SEQ ID NO: 1520627 - DNA, 16 bp, Homo sapiens
agaaatactcatgtgc

SEQ ID NO: 1520628 - DNA, 14 bp, Homo sapiens
agaaatactgctct

SEQ ID NO: 1520629 - DNA, 18 bp, Homo sapiens
agaaatactgctctgaat

SEQ ID NO: 1520630 - DNA, 16 bp, Homo sapiens
agaaatagaattataa

SEQ ID NO: 1520631 - DNA, 13 bp, Homo sapiens
agaaatagacaaa

SEQ ID NO: 1520632 - DNA, 17 bp, Homo sapiens
agaaatagacaaaaagt

SEQ ID NO: 1520633 - DNA, 18 bp, Homo sapiens
agaaatagacaaaaagta

SEQ ID NO: 1520634 - DNA, 21 bp, Homo sapiens
agaaatagacaaaaagtatat

SEQ ID NO: 1520635 - DNA, 19 bp, Homo sapiens
agaaatatagtgcaatagt

SEQ ID NO: 1520636 - DNA, 19 bp, Homo sapiens
agaaatatctttctcttac

SEQ ID NO: 1520637 - DNA, 21 bp, Homo sapiens
agaaatatgcacaatagcagt

SEQ ID NO: 1520638 - DNA, 15 bp, Homo sapiens
agaaatatgtggttt

SEQ ID NO: 1520639 - DNA, 17 bp, Homo sapiens
agaaatattaagcatgt

SEQ ID NO: 1520640 - DNA, 13 bp, Homo sapiens
agaaatattgact

SEQ ID NO: 1520641 - DNA, 17 bp, Homo sapiens
agaaatattggttgaaa

SEQ ID NO: 1520642 - DNA, 21 bp, Homo sapiens
agaaatattggttgaaagtta

SEQ ID NO: 1520643 - DNA, 21 bp, Homo sapiens
agaaatattttaatttttaaa

SEQ ID NO: 1520644 - DNA, 19 bp, Homo sapiens
agaaatcaatagttgaatt

SEQ ID NO: 1520645 - DNA, 16 bp, Homo sapiens
agaaatcacaggggcg

SEQ ID NO: 1520646 - DNA, 22 bp, Homo sapiens
agaaatcacaggggcggggcag

SEQ ID NO: 1520647 - DNA, 16 bp, Homo sapiens
agaaatcattgtagaa

SEQ ID NO: 1520648 - DNA, 17 bp, Homo sapiens
agaaatcattgtagaaa

SEQ ID NO: 1520649 - DNA, 14 bp, Homo sapiens
agaaatctagaaga

SEQ ID NO: 1520650 - DNA, 22 bp, Homo sapiens
agaaatctggtcttgttagaaa

SEQ ID NO: 1520651 - DNA, 18 bp, Homo sapiens
agaaatgaaataaaatgg

SEQ ID NO: 1520652 - DNA, 16 bp, Homo sapiens
agaaatgcaataactc

SEQ ID NO: 1520653 - DNA, 21 bp, Homo sapiens
agaaatgcaataactctggga

SEQ ID NO: 1520654 - DNA, 14 bp, Homo sapiens
agaaatgctgcctg

SEQ ID NO: 1520655 - DNA, 22 bp, Homo sapiens
agaaatgctgcctgcctgtctg

SEQ ID NO: 1520656 - DNA, 17 bp, Homo sapiens
agaaatgctgctggcca

SEQ ID NO: 1520657 - DNA, 16 bp, Homo sapiens
agaaatggaaattttg

SEQ ID NO: 1520658 - DNA, 17 bp, Homo sapiens
agaaatggattcagtat

SEQ ID NO: 1520659 - DNA, 23 bp, Homo sapiens
agaaatggcgtctgctctggtgg

SEQ ID NO: 1520660 - DNA, 17 bp, Homo sapiens
agaaatggtttcctctg

SEQ ID NO: 1520661 - DNA, 20 bp, Homo sapiens
agaaatgtctaaatgctgaa

SEQ ID NO: 1520662 - DNA, 18 bp, Homo sapiens
agaaattacctgtggata

SEQ ID NO: 1520663 - DNA, 12 bp, Homo sapiens
agaaattagaaa

SEQ ID NO: 1520664 - DNA, 16 bp, Homo sapiens
agaaattctgttttta

SEQ ID NO: 1520665 - DNA, 16 bp, Homo sapiens
agaaattgtatattgt

SEQ ID NO: 1520666 - DNA, 20 bp, Homo sapiens
agaaattgtatattgtaatt

SEQ ID NO: 1520667 - DNA, 17 bp, Homo sapiens
agaaattgtgtgtgcaa

SEQ ID NO: 1520668 - DNA, 16 bp, Homo sapiens
ctctcatcaactgaat

SEQ ID NO: 1520669 - DNA, 14 bp, Homo sapiens
ctctcatcggaggc

SEQ ID NO: 1520670 - DNA, 18 bp, Homo sapiens
ctctcatcggaggcccat

SEQ ID NO: 1520671 - DNA, 13 bp, Homo sapiens
ctctcatctcagg

SEQ ID NO: 1520672 - DNA, 15 bp, Homo sapiens
ctctcattccccagg

SEQ ID NO: 1520673 - DNA, 16 bp, Homo sapiens
ctctccaaaggggctg

SEQ ID NO: 1520674 - DNA, 18 bp, Homo sapiens
ctctccaaaggggctgct

SEQ ID NO: 1520675 - DNA, 23 bp, Homo sapiens
ctctccaaaggggctgctggggc

SEQ ID NO: 1520676 - DNA, 13 bp, Homo sapiens
ctctccaaccact

SEQ ID NO: 1520677 - DNA, 14 bp, Homo sapiens
ctctccaaccactg

SEQ ID NO: 1520678 - DNA, 16 bp, Homo sapiens
ctctccaaccactgtg

SEQ ID NO: 1520679 - DNA, 13 bp, Homo sapiens
ctctccaacctgg

SEQ ID NO: 1520680 - DNA, 15 bp, Homo sapiens
ctctccaagggcttc

SEQ ID NO: 1520681 - DNA, 21 bp, Homo sapiens
ctctccaagggcttctgcacc

SEQ ID NO: 1520682 - DNA, 14 bp, Homo sapiens
ctctccaagtgcca

SEQ ID NO: 1520683 - DNA, 17 bp, Homo sapiens
ctctccaatgttctatt

SEQ ID NO: 1520684 - DNA, 13 bp, Homo sapiens
ctctccacagtgt

SEQ ID NO: 1520685 - DNA, 14 bp, Homo sapiens
ctctccacagtgtt

SEQ ID NO: 1520686 - DNA, 23 bp, Homo sapiens
ctctccacagtgttgtgcccctt

SEQ ID NO: 1520687 - DNA, 13 bp, Homo sapiens
ctctccacctcag

SEQ ID NO: 1520688 - DNA, 14 bp, Homo sapiens
ctctccacctcagc

SEQ ID NO: 1520689 - DNA, 16 bp, Homo sapiens
ctctccacctcagcct

SEQ ID NO: 1520690 - DNA, 17 bp, Homo sapiens
ctctccacctcagcctt

SEQ ID NO: 1520691 - DNA, 12 bp, Homo sapiens
ctctccactgct

SEQ ID NO: 1520692 - DNA, 12 bp, Homo sapiens
ctctccagactg

SEQ ID NO: 1520693 - DNA, 20 bp, Homo sapiens
ctctccagatgtttccagac

SEQ ID NO: 1520694 - DNA, 15 bp, Homo sapiens
ctctccagctgacta

SEQ ID NO: 1520695 - DNA, 18 bp, Homo sapiens
ctctccaggtcagcctgg

SEQ ID NO: 1520696 - DNA, 21 bp, Homo sapiens
ctctccaggtcagcctggaag

SEQ ID NO: 1520697 - DNA, 23 bp, Homo sapiens
ctctccagtttgcacctgtcccc

SEQ ID NO: 1520698 - DNA, 19 bp, Homo sapiens
ctctccattttagcccagt

SEQ ID NO: 1520699 - DNA, 21 bp, Homo sapiens
ctctcccaccccggcctccac

SEQ ID NO: 1520700 - DNA, 22 bp, Homo sapiens
ctctcccaccccggcctccact

SEQ ID NO: 1520701 - DNA, 12 bp, Homo sapiens
ctctcccacccg

SEQ ID NO: 1520702 - DNA, 15 bp, Homo sapiens
ctctcccacccggcc

SEQ ID NO: 1520703 - DNA, 21 bp, Homo sapiens
ctctcccacccggccacagct

SEQ ID NO: 1520704 - DNA, 12 bp, Homo sapiens
ctctcccaggac

SEQ ID NO: 1520705 - DNA, 13 bp, Homo sapiens
ctctcccatcccc

SEQ ID NO: 1520706 - DNA, 16 bp, Homo sapiens
ctctcccatccccctg

SEQ ID NO: 1520707 - DNA, 13 bp, Homo sapiens
ctctcccatcctg

SEQ ID NO: 1520708 - DNA, 14 bp, Homo sapiens
ctctcccatcctgg

SEQ ID NO: 1520709 - DNA, 18 bp, Homo sapiens
ctctcccatcctggggca

SEQ ID NO: 1520710 - DNA, 21 bp, Homo sapiens
ctctcccatcctggggcagca

SEQ ID NO: 1520711 - DNA, 16 bp, Homo sapiens
ctctcccatttcagga

SEQ ID NO: 1520712 - DNA, 14 bp, Homo sapiens
ctctccccacacta

SEQ ID NO: 1520713 - DNA, 19 bp, Homo sapiens
ctctccccacgagggctgg

SEQ ID NO: 1520714 - DNA, 21 bp, Homo sapiens
ctctccccacgagggctggct

SEQ ID NO: 1520715 - DNA, 15 bp, Homo sapiens
ctctccccagcccag

SEQ ID NO: 1520716 - DNA, 17 bp, Homo sapiens
ctctccccagcccagag

SEQ ID NO: 1520717 - DNA, 19 bp, Homo sapiens
ctctccccagcccagagac

SEQ ID NO: 1520718 - DNA, 15 bp, Homo sapiens
ctctccccaggtcca

SEQ ID NO: 1520719 - DNA, 23 bp, Homo sapiens
ctctccccaggtccagctctgga

SEQ ID NO: 1520720 - DNA, 20 bp, Homo sapiens
ctctccccagtgcctgccac

SEQ ID NO: 1520721 - DNA, 16 bp, Homo sapiens
ctctcccccaccccct

SEQ ID NO: 1520722 - DNA, 16 bp, Homo sapiens
ctctcccccttggatt

SEQ ID NO: 1520723 - DNA, 23 bp, Homo sapiens
ctctcccccttggatttgaactt

SEQ ID NO: 1520724 - DNA, 19 bp, Homo sapiens
ctctccccctttcaaggaa

SEQ ID NO: 1520725 - DNA, 23 bp, Homo sapiens
ctctccccggcaggcctgagaat

SEQ ID NO: 1520726 - DNA, 18 bp, Homo sapiens
ctctcccctcctgctggg

SEQ ID NO: 1520727 - DNA, 16 bp, Homo sapiens
ctctcccctctgcaac

SEQ ID NO: 1520728 - DNA, 13 bp, Homo sapiens
ctctcccctttct

SEQ ID NO: 1520729 - DNA, 14 bp, Homo sapiens
ctctcccggctgcc

SEQ ID NO: 1520730 - DNA, 17 bp, Homo sapiens
ctctcccggttcttcca

SEQ ID NO: 1520731 - DNA, 13 bp, Homo sapiens
ctctccctacctt

SEQ ID NO: 1520732 - DNA, 14 bp, Homo sapiens
ctctccctaccttg

SEQ ID NO: 1520733 - DNA, 20 bp, Homo sapiens
ctctccctaccttgcctcct

SEQ ID NO: 1520734 - DNA, 13 bp, Homo sapiens
ctctccctcccct

SEQ ID NO: 1520735 - DNA, 17 bp, Homo sapiens
ctctccctcccctgcca

SEQ ID NO: 1520736 - DNA, 18 bp, Homo sapiens
ctctccctctggccctgc

SEQ ID NO: 1520737 - DNA, 13 bp, Homo sapiens
ctctccctgcact

SEQ ID NO: 1520738 - DNA, 15 bp, Homo sapiens
ctctccctgccaagt

SEQ ID NO: 1520739 - DNA, 12 bp, Homo sapiens
ctctccctggcc

SEQ ID NO: 1520740 - DNA, 10 bp, Homo sapiens
ctctccctgt

SEQ ID NO: 1520741 - DNA, 14 bp, Homo sapiens
ctctccgagctctg

SEQ ID NO: 1520742 - DNA, 15 bp, Homo sapiens
ctctccggtctctct

SEQ ID NO: 1520743 - DNA, 19 bp, Homo sapiens
ctctcctcatctccaaggc

SEQ ID NO: 1520744 - DNA, 17 bp, Homo sapiens
ctctcctcctcccctcc

SEQ ID NO: 1520745 - DNA, 12 bp, Homo sapiens
ctctcctgaccc

SEQ ID NO: 1520746 - DNA, 13 bp, Homo sapiens
ctctcctgacccc

SEQ ID NO: 1520747 - DNA, 16 bp, Homo sapiens
ctctcctgccctctgc

SEQ ID NO: 1520748 - DNA, 21 bp, Homo sapiens
ctctcctgccctctgctctgc

SEQ ID NO: 1520749 - DNA, 13 bp, Homo sapiens
ctctcctgcctac

SEQ ID NO: 1520750 - DNA, 13 bp, Homo sapiens
ctctcctggacgc

SEQ ID NO: 1520751 - DNA, 12 bp, Homo sapiens
ctctcctggcct

SEQ ID NO: 1520752 - DNA, 20 bp, Homo sapiens
ctctcctggcctatccgctg

SEQ ID NO: 1520753 - DNA, 12 bp, Homo sapiens
ctctcctggctc

SEQ ID NO: 1520754 - DNA, 17 bp, Homo sapiens
ctctcctggctcggggt

SEQ ID NO: 1520755 - DNA, 18 bp, Homo sapiens
ctctcctgtactttttcc

SEQ ID NO: 1520756 - DNA, 16 bp, Homo sapiens
ctctccttcctcttgg

SEQ ID NO: 1520757 - DNA, 20 bp, Homo sapiens
ctctccttggccacagactg

SEQ ID NO: 1520758 - DNA, 18 bp, Homo sapiens
ctctccttgggctcctgg

SEQ ID NO: 1520759 - DNA, 23 bp, Homo sapiens
ctctccttgggctcctggctgcc

SEQ ID NO: 1520760 - DNA, 16 bp, Homo sapiens
ctctcctttctttttc

SEQ ID NO: 1520761 - DNA, 13 bp, Homo sapiens
ctctcgcacacct

SEQ ID NO: 1520762 - DNA, 15 bp, Homo sapiens
ctctcgcacacctct

SEQ ID NO: 1520763 - DNA, 19 bp, Homo sapiens
ctctcggaaggctggctgg

SEQ ID NO: 1520764 - DNA, 15 bp, Homo sapiens
ctctcggggcccttg

SEQ ID NO: 1520765 - DNA, 23 bp, Homo sapiens
ctctcggggcccttggggcctgg

SEQ ID NO: 1520766 - DNA, 19 bp, Homo sapiens
ctctcggtgctccatctcc

SEQ ID NO: 1520767 - DNA, 22 bp, Homo sapiens
ctctctaggagggagccttgtg

SEQ ID NO: 1520768 - DNA, 14 bp, Homo sapiens
ctctctatcctctc

SEQ ID NO: 1520769 - DNA, 15 bp, Homo sapiens
ctctctcacacacac

SEQ ID NO: 1520770 - DNA, 21 bp, Homo sapiens
ctctctcataccctccctccc

SEQ ID NO: 1520771 - DNA, 17 bp, Homo sapiens
ctctctccaccccccac

SEQ ID NO: 1520772 - DNA, 12 bp, Homo sapiens
ctctctccagat

SEQ ID NO: 1520773 - DNA, 20 bp, Homo sapiens
ctctctccctccctctctca

SEQ ID NO: 1520774 - DNA, 15 bp, Homo sapiens
ctctctccctggtct

SEQ ID NO: 1520775 - DNA, 19 bp, Homo sapiens
ctctctcctgtccaaccta

SEQ ID NO: 1520776 - DNA, 22 bp, Homo sapiens
ctctctcgctgcgtcctcattt

SEQ ID NO: 1520777 - DNA, 14 bp, Homo sapiens
ctctctctcgctgc

SEQ ID NO: 1520778 - DNA, 12 bp, Homo sapiens
ctctctctgagg

SEQ ID NO: 1520779 - DNA, 13 bp, Homo sapiens
ctctctctgcctg

SEQ ID NO: 1520780 - DNA, 16 bp, Homo sapiens
ctctctgacctttcat

SEQ ID NO: 1520781 - DNA, 21 bp, Homo sapiens
ctctctgacgcttgtgacagt

SEQ ID NO: 1520782 - DNA, 20 bp, Homo sapiens
ctctctgaggacagagcttg

SEQ ID NO: 1520783 - DNA, 18 bp, Homo sapiens
ctctctgagtcaaatcca

SEQ ID NO: 1520784 - DNA, 20 bp, Homo sapiens
ctctctgagtcaaatccagt

SEQ ID NO: 1520785 - DNA, 21 bp, Homo sapiens
ctctctgagtcaaatccagtg

SEQ ID NO: 1520786 - DNA, 21 bp, Homo sapiens
agaaatttaattcatgtttct

SEQ ID NO: 1520787 - DNA, 22 bp, Homo sapiens
agaaatttaattcatgtttctt

SEQ ID NO: 1520788 - DNA, 22 bp, Homo sapiens
agaaattttacaataggtgctt

SEQ ID NO: 1520789 - DNA, 11 bp, Homo sapiens
agaaattttca

SEQ ID NO: 1520790 - DNA, 13 bp, Homo sapiens
agaaattttcaag

SEQ ID NO: 1520791 - DNA, 22 bp, Homo sapiens
agaaattttgtaagaaggcaat

SEQ ID NO: 1520792 - DNA, 18 bp, Homo sapiens
agaaatttttcagatgct

SEQ ID NO: 1520793 - DNA, 13 bp, Homo sapiens
agaacaaaaaacc

SEQ ID NO: 1520794 - DNA, 20 bp, Homo sapiens
agaacaaacacctccccagc

SEQ ID NO: 1520795 - DNA, 14 bp, Homo sapiens
agaacaaacagaaa

SEQ ID NO: 1520796 - DNA, 21 bp, Homo sapiens
agaacaaaggacagagtatga

SEQ ID NO: 1520797 - DNA, 14 bp, Homo sapiens
agaacaaatgtgtt

SEQ ID NO: 1520798 - DNA, 21 bp, Homo sapiens
agaacaaatgtgtttttctat

SEQ ID NO: 1520799 - DNA, 17 bp, Homo sapiens
agaacaagtcacagctg

SEQ ID NO: 1520800 - DNA, 21 bp, Homo sapiens
agaacaagtcacagctgcagc

SEQ ID NO: 1520801 - DNA, 23 bp, Homo sapiens
agaacaagtcacagctgcagctg

SEQ ID NO: 1520802 - DNA, 17 bp, Homo sapiens
agaacaataatgagagc

SEQ ID NO: 1520803 - DNA, 23 bp, Homo sapiens
agaacaattcacagtatgagaag

SEQ ID NO: 1520804 - DNA, 15 bp, Homo sapiens
agaacaccctctaaa

SEQ ID NO: 1520805 - DNA, 20 bp, Homo sapiens
agaacactaactcaccagcc

SEQ ID NO: 1520806 - DNA, 19 bp, Homo sapiens
agaacagataatcagtgtg

SEQ ID NO: 1520807 - DNA, 18 bp, Homo sapiens
agaacagccgctcctgtc

SEQ ID NO: 1520808 - DNA, 22 bp, Homo sapiens
agaacagccgctcctgtctgcc

SEQ ID NO: 1520809 - DNA, 17 bp, Homo sapiens
agaacaggtgggctgta

SEQ ID NO: 1520810 - DNA, 23 bp, Homo sapiens
agaacaggttcttaaaaaggaac

SEQ ID NO: 1520811 - DNA, 12 bp, Homo sapiens
agaacagtgggc

SEQ ID NO: 1520812 - DNA, 22 bp, Homo sapiens
agaacagtgggcgttgggagcc

SEQ ID NO: 1520813 - DNA, 18 bp, Homo sapiens
agaacagtggttgcctgg

SEQ ID NO: 1520814 - DNA, 14 bp, Homo sapiens
agaacataaagcaa

SEQ ID NO: 1520815 - DNA, 16 bp, Homo sapiens
agaacatcattagaac

SEQ ID NO: 1520816 - DNA, 15 bp, Homo sapiens
agaacatccaaggag

SEQ ID NO: 1520817 - DNA, 18 bp, Homo sapiens
agaacatccaaggagaaa

SEQ ID NO: 1520818 - DNA, 13 bp, Homo sapiens
agaacatgcacat

SEQ ID NO: 1520819 - DNA, 20 bp, Homo sapiens
agaacatgcacatttatata

SEQ ID NO: 1520820 - DNA, 16 bp, Homo sapiens
agaacattcagctctg

SEQ ID NO: 1520821 - DNA, 18 bp, Homo sapiens
agaacattcagctctgga

SEQ ID NO: 1520822 - DNA, 19 bp, Homo sapiens
agaacattcagctctggag

SEQ ID NO: 1520823 - DNA, 20 bp, Homo sapiens
agaacattcagctctggaga

SEQ ID NO: 1520824 - DNA, 22 bp, Homo sapiens
agaacattcagctctggagaac

SEQ ID NO: 1520825 - DNA, 11 bp, Homo sapiens
agaacattgta

SEQ ID NO: 1520826 - DNA, 19 bp, Homo sapiens
agaaccaaaaatcccacct

SEQ ID NO: 1520827 - DNA, 15 bp, Homo sapiens
agaaccaaatacctc

SEQ ID NO: 1520828 - DNA, 16 bp, Homo sapiens
agaaccaaatctggaa

SEQ ID NO: 1520829 - DNA, 18 bp, Homo sapiens
agaaccaaatctggaagc

SEQ ID NO: 1520830 - DNA, 13 bp, Homo sapiens
agaaccaaatctt

SEQ ID NO: 1520831 - DNA, 20 bp, Homo sapiens
agaaccaagcttcagagcct

SEQ ID NO: 1520832 - DNA, 23 bp, Homo sapiens
agaaccaagcttcagagcctagc

SEQ ID NO: 1520833 - DNA, 16 bp, Homo sapiens
agaaccacacttgaaa

SEQ ID NO: 1520834 - DNA, 19 bp, Homo sapiens
agaaccacacttgaaacct

SEQ ID NO: 1520835 - DNA, 21 bp, Homo sapiens
agaaccacacttgaaaccttt

SEQ ID NO: 1520836 - DNA, 19 bp, Homo sapiens
agaaccaccactgcctgac

SEQ ID NO: 1520837 - DNA, 23 bp, Homo sapiens
agaaccactgtctagagcaactt

SEQ ID NO: 1520838 - DNA, 20 bp, Homo sapiens
agaaccagtccccccaccct

SEQ ID NO: 1520839 - DNA, 13 bp, Homo sapiens
agaacccaagtgc

SEQ ID NO: 1520840 - DNA, 18 bp, Homo sapiens
agaaccctatttaaaact

SEQ ID NO: 1520841 - DNA, 13 bp, Homo sapiens
agaaccctgagca

SEQ ID NO: 1520842 - DNA, 14 bp, Homo sapiens
agaaccctgagcag

SEQ ID NO: 1520843 - DNA, 13 bp, Homo sapiens
agaaccctgcagg

SEQ ID NO: 1520844 - DNA, 14 bp, Homo sapiens
agaaccgagcaaag

SEQ ID NO: 1520845 - DNA, 20 bp, Homo sapiens
agaaccgagcaaagatcaaa

SEQ ID NO: 1520846 - DNA, 21 bp, Homo sapiens
agaaccgagcaaagatcaaaa

SEQ ID NO: 1520847 - DNA, 21 bp, Homo sapiens
agaacctcagattcttcattg

SEQ ID NO: 1520848 - DNA, 17 bp, Homo sapiens
agaacctgcacacagga

SEQ ID NO: 1520849 - DNA, 20 bp, Homo sapiens
agaacctgcacacaggacag

SEQ ID NO: 1520850 - DNA, 21 bp, Homo sapiens
agaacctggaaaaattccaga

SEQ ID NO: 1520851 - DNA, 13 bp, Homo sapiens
agaacctggaact

SEQ ID NO: 1520852 - DNA, 21 bp, Homo sapiens
agaacctggaacttggggagt

SEQ ID NO: 1520853 - DNA, 20 bp, Homo sapiens
agaaccttggaccactcctg

SEQ ID NO: 1520854 - DNA, 20 bp, Homo sapiens
agaacggggctcttctcatt

SEQ ID NO: 1520855 - DNA, 12 bp, Homo sapiens
agaactaaactc

SEQ ID NO: 1520856 - DNA, 22 bp, Homo sapiens
agaactacaaacaaaatttcta

SEQ ID NO: 1520857 - DNA, 23 bp, Homo sapiens
agaactacaaacaaaatttctat

SEQ ID NO: 1520858 - DNA, 15 bp, Homo sapiens
agaactatgaaatca

SEQ ID NO: 1520859 - DNA, 17 bp, Homo sapiens
agaactatgctaatttt

SEQ ID NO: 1520860 - DNA, 19 bp, Homo sapiens
agaactcactggggcctac

SEQ ID NO: 1520861 - DNA, 17 bp, Homo sapiens
agaactcagttttaact

SEQ ID NO: 1520862 - DNA, 17 bp, Homo sapiens
agaactccttattttgt

SEQ ID NO: 1520863 - DNA, 18 bp, Homo sapiens
agaactccttattttgta

SEQ ID NO: 1520864 - DNA, 19 bp, Homo sapiens
agaactccttattttgtat

SEQ ID NO: 1520865 - DNA, 16 bp, Homo sapiens
agaactctaaccagtg

SEQ ID NO: 1520866 - DNA, 18 bp, Homo sapiens
agaactctaaccagtgta

SEQ ID NO: 1520867 - DNA, 20 bp, Homo sapiens
agaactctctccctggtctc

SEQ ID NO: 1520868 - DNA, 21 bp, Homo sapiens
agaactctctggaagcccctg

SEQ ID NO: 1520869 - DNA, 20 bp, Homo sapiens
agaactctgggctgccatgt

SEQ ID NO: 1520870 - DNA, 23 bp, Homo sapiens
agaactgaaccggctttaccaaa

SEQ ID NO: 1520871 - DNA, 19 bp, Homo sapiens
agaactgaattttgggact

SEQ ID NO: 1520872 - DNA, 22 bp, Homo sapiens
agaactgagggctctgtttgtg

SEQ ID NO: 1520873 - DNA, 15 bp, Homo sapiens
agaactgcatatgtt

SEQ ID NO: 1520874 - DNA, 20 bp, Homo sapiens
agaactgcatatgtttcgct

SEQ ID NO: 1520875 - DNA, 20 bp, Homo sapiens
agaactgcatggacctaaca

SEQ ID NO: 1520876 - DNA, 20 bp, Homo sapiens
agaactggactcaggatgcc

SEQ ID NO: 1520877 - DNA, 22 bp, Homo sapiens
agaactggactcaggatgccca

SEQ ID NO: 1520878 - DNA, 18 bp, Homo sapiens
agaactgtactgttttct

SEQ ID NO: 1520879 - DNA, 20 bp, Homo sapiens
agaactgtcccacaaaatat

SEQ ID NO: 1520880 - DNA, 19 bp, Homo sapiens
agaactgtgataaaaagag

SEQ ID NO: 1520881 - DNA, 21 bp, Homo sapiens
agaacttactgattattttct

SEQ ID NO: 1520882 - DNA, 22 bp, Homo sapiens
agaacttagcctttacctgtga

SEQ ID NO: 1520883 - DNA, 17 bp, Homo sapiens
agaacttcagaaagact

SEQ ID NO: 1520884 - DNA, 18 bp, Homo sapiens
agaacttcagaaagactt

SEQ ID NO: 1520885 - DNA, 17 bp, Homo sapiens
agaacttgaatttctgg

SEQ ID NO: 1520886 - DNA, 13 bp, Homo sapiens
agaacttgctgct

SEQ ID NO: 1520887 - DNA, 16 bp, Homo sapiens
agaacttgctgctgcc

SEQ ID NO: 1520888 - DNA, 20 bp, Homo sapiens
agaacttgctgctgccttca

SEQ ID NO: 1520889 - DNA, 22 bp, Homo sapiens
agaacttgctgctgccttcaca

SEQ ID NO: 1520890 - DNA, 19 bp, Homo sapiens
agaactttaaagctcagga

SEQ ID NO: 1520891 - DNA, 21 bp, Homo sapiens
agaactttaaagctcaggagg

SEQ ID NO: 1520892 - DNA, 23 bp, Homo sapiens
agaactttaaagctcaggagggt

SEQ ID NO: 1520893 - DNA, 15 bp, Homo sapiens
agaactttcattttt

SEQ ID NO: 1520894 - DNA, 22 bp, Homo sapiens
agaactttccagggatccaggg

SEQ ID NO: 1520895 - DNA, 18 bp, Homo sapiens
agaagaaaacaaagttct

SEQ ID NO: 1520896 - DNA, 12 bp, Homo sapiens
agaagaaaacag

SEQ ID NO: 1520897 - DNA, 17 bp, Homo sapiens
agaagaaaacagtacag

SEQ ID NO: 1520898 - DNA, 15 bp, Homo sapiens
agaagaaaacatcta

SEQ ID NO: 1520899 - DNA, 23 bp, Homo sapiens
agaagaaaacatctattctctcc

SEQ ID NO: 1520900 - DNA, 14 bp, Homo sapiens
agaagaaaataacc

SEQ ID NO: 1520901 - DNA, 23 bp, Homo sapiens
ctctctgagtcaaatccagtggt

SEQ ID NO: 1520902 - DNA, 16 bp, Homo sapiens
ctctctgcagccagcc

SEQ ID NO: 1520903 - DNA, 20 bp, Homo sapiens
ctctctgcagccagcccagc

SEQ ID NO: 1520904 - DNA, 12 bp, Homo sapiens
ctctctgcagct

SEQ ID NO: 1520905 - DNA, 22 bp, Homo sapiens
ctctctgccccacataattctg

SEQ ID NO: 1520906 - DNA, 13 bp, Homo sapiens
ctctctgccctgt

SEQ ID NO: 1520907 - DNA, 12 bp, Homo sapiens
ctctctgctcct

SEQ ID NO: 1520908 - DNA, 14 bp, Homo sapiens
ctctctgctggcag

SEQ ID NO: 1520909 - DNA, 13 bp, Homo sapiens
ctctctgctgtac

SEQ ID NO: 1520910 - DNA, 20 bp, Homo sapiens
ctctctggaagcccctgggc

SEQ ID NO: 1520911 - DNA, 15 bp, Homo sapiens
ctctctggagcccct

SEQ ID NO: 1520912 - DNA, 16 bp, Homo sapiens
ctctctggagcccctc

SEQ ID NO: 1520913 - DNA, 16 bp, Homo sapiens
ctctctggcctcccac

SEQ ID NO: 1520914 - DNA, 17 bp, Homo sapiens
ctctctggcctcccacc

SEQ ID NO: 1520915 - DNA, 13 bp, Homo sapiens
ctctctggctgtc

SEQ ID NO: 1520916 - DNA, 21 bp, Homo sapiens
ctctctggcttctctcttttc

SEQ ID NO: 1520917 - DNA, 16 bp, Homo sapiens
ctctctgggactctcc

SEQ ID NO: 1520918 - DNA, 18 bp, Homo sapiens
ctctctgggactctcctc

SEQ ID NO: 1520919 - DNA, 15 bp, Homo sapiens
ctctctgggcccagg

SEQ ID NO: 1520920 - DNA, 18 bp, Homo sapiens
ctctctgtcccttgctgt

SEQ ID NO: 1520921 - DNA, 19 bp, Homo sapiens
ctctctgtcccttgctgta

SEQ ID NO: 1520922 - DNA, 15 bp, Homo sapiens
ctctctgtggggctg

SEQ ID NO: 1520923 - DNA, 16 bp, Homo sapiens
ctctctgtggggctga

SEQ ID NO: 1520924 - DNA, 23 bp, Homo sapiens
ctctctgtggggctgaattgcca

SEQ ID NO: 1520925 - DNA, 18 bp, Homo sapiens
ctctcttatagaatattt

SEQ ID NO: 1520926 - DNA, 23 bp, Homo sapiens
ctctcttatagaatatttattac

SEQ ID NO: 1520927 - DNA, 16 bp, Homo sapiens
ctctcttcaatctctg

SEQ ID NO: 1520928 - DNA, 13 bp, Homo sapiens
ctctcttcaggag

SEQ ID NO: 1520929 - DNA, 13 bp, Homo sapiens
ctctcttcccctt

SEQ ID NO: 1520930 - DNA, 11 bp, Homo sapiens
ctctcttccct

SEQ ID NO: 1520931 - DNA, 14 bp, Homo sapiens
ctctcttcctgtct

SEQ ID NO: 1520932 - DNA, 17 bp, Homo sapiens
ctctcttctgctccacc

SEQ ID NO: 1520933 - DNA, 17 bp, Homo sapiens
ctctctttaaccctccc

SEQ ID NO: 1520934 - DNA, 19 bp, Homo sapiens
ctctctttatacagctgta

SEQ ID NO: 1520935 - DNA, 14 bp, Homo sapiens
ctctctttccttga

SEQ ID NO: 1520936 - DNA, 16 bp, Homo sapiens
ctctctttctagaggt

SEQ ID NO: 1520937 - DNA, 15 bp, Homo sapiens
ctctgaaataaaatg

SEQ ID NO: 1520938 - DNA, 16 bp, Homo sapiens
ctctgaaatctgaaga

SEQ ID NO: 1520939 - DNA, 15 bp, Homo sapiens
ctctgaaatcttccc

SEQ ID NO: 1520940 - DNA, 13 bp, Homo sapiens
ctctgaagagtgg

SEQ ID NO: 1520941 - DNA, 22 bp, Homo sapiens
ctctgaagagtgggtttcacaa

SEQ ID NO: 1520942 - DNA, 12 bp, Homo sapiens
ctctgaagctaa

SEQ ID NO: 1520943 - DNA, 20 bp, Homo sapiens
ctctgaagctaattgtacta

SEQ ID NO: 1520944 - DNA, 15 bp, Homo sapiens
ctctgaagggacccc

SEQ ID NO: 1520945 - DNA, 18 bp, Homo sapiens
ctctgaatattttgtaat

SEQ ID NO: 1520946 - DNA, 17 bp, Homo sapiens
ctctgaatgccccataa

SEQ ID NO: 1520947 - DNA, 16 bp, Homo sapiens
ctctgaatgggagcca

SEQ ID NO: 1520948 - DNA, 18 bp, Homo sapiens
ctctgaatgggagccaga

SEQ ID NO: 1520949 - DNA, 20 bp, Homo sapiens
ctctgaatttacttccttgc

SEQ ID NO: 1520950 - DNA, 15 bp, Homo sapiens
ctctgaatttatctt

SEQ ID NO: 1520951 - DNA, 18 bp, Homo sapiens
ctctgaattttcagagac

SEQ ID NO: 1520952 - DNA, 18 bp, Homo sapiens
ctctgacaagggctgacc

SEQ ID NO: 1520953 - DNA, 18 bp, Homo sapiens
ctctgacactgtgtaaga

SEQ ID NO: 1520954 - DNA, 12 bp, Homo sapiens
ctctgacagctc

SEQ ID NO: 1520955 - DNA, 13 bp, Homo sapiens
ctctgacagctcc

SEQ ID NO: 1520956 - DNA, 17 bp, Homo sapiens
ctctgacagtccacagg

SEQ ID NO: 1520957 - DNA, 15 bp, Homo sapiens
ctctgacatcccttc

SEQ ID NO: 1520958 - DNA, 21 bp, Homo sapiens
ctctgacatcccttcctggaa

SEQ ID NO: 1520959 - DNA, 23 bp, Homo sapiens
ctctgacattatgtggttttaga

SEQ ID NO: 1520960 - DNA, 20 bp, Homo sapiens
ctctgaccacttgaggcctg

SEQ ID NO: 1520961 - DNA, 23 bp, Homo sapiens
ctctgacccaagtggggcctcct

SEQ ID NO: 1520962 - DNA, 18 bp, Homo sapiens
ctctgaccgattccttta

SEQ ID NO: 1520963 - DNA, 14 bp, Homo sapiens
ctctgacctgcact

SEQ ID NO: 1520964 - DNA, 16 bp, Homo sapiens
ctctgacctgcaggcc

SEQ ID NO: 1520965 - DNA, 20 bp, Homo sapiens
ctctgacgcttgtgacagtg

SEQ ID NO: 1520966 - DNA, 13 bp, Homo sapiens
ctctgacttctgc

SEQ ID NO: 1520967 - DNA, 19 bp, Homo sapiens
ctctgacttctgcctggag

SEQ ID NO: 1520968 - DNA, 21 bp, Homo sapiens
ctctgacttctgcctggagac

SEQ ID NO: 1520969 - DNA, 13 bp, Homo sapiens
ctctgagaagaca

SEQ ID NO: 1520970 - DNA, 16 bp, Homo sapiens
ctctgagaagctctga

SEQ ID NO: 1520971 - DNA, 23 bp, Homo sapiens
ctctgagaattgttgagatactt

SEQ ID NO: 1520972 - DNA, 16 bp, Homo sapiens
ctctgagactgctaag

SEQ ID NO: 1520973 - DNA, 16 bp, Homo sapiens
ctctgagagtctagat

SEQ ID NO: 1520974 - DNA, 22 bp, Homo sapiens
ctctgagagtctagattctctg

SEQ ID NO: 1520975 - DNA, 15 bp, Homo sapiens
ctctgagcagcctct

SEQ ID NO: 1520976 - DNA, 18 bp, Homo sapiens
ctctgagccacagtggga

SEQ ID NO: 1520977 - DNA, 11 bp, Homo sapiens
ctctgagccca

SEQ ID NO: 1520978 - DNA, 15 bp, Homo sapiens
ctctgagcccaggcc

SEQ ID NO: 1520979 - DNA, 15 bp, Homo sapiens
ctctgaggacagagc

SEQ ID NO: 1520980 - DNA, 20 bp, Homo sapiens
ctctgaggacagaggccggg

SEQ ID NO: 1520981 - DNA, 18 bp, Homo sapiens
ctctgaggggaggcacct

SEQ ID NO: 1520982 - DNA, 22 bp, Homo sapiens
ctctgaggggaggcacctccag

SEQ ID NO: 1520983 - DNA, 13 bp, Homo sapiens
ctctgaggggcac

SEQ ID NO: 1520984 - DNA, 21 bp, Homo sapiens
ctctgagggggtgggggtgcc

SEQ ID NO: 1520985 - DNA, 21 bp, Homo sapiens
ctctgagtcaaatccagtggt

SEQ ID NO: 1520986 - DNA, 16 bp, Homo sapiens
ctctgagtttaccatt

SEQ ID NO: 1520987 - DNA, 22 bp, Homo sapiens
ctctgagtttaccatttgtaat

SEQ ID NO: 1520988 - DNA, 13 bp, Homo sapiens
ctctgatatggga

SEQ ID NO: 1520989 - DNA, 16 bp, Homo sapiens
ctctgatatgggactg

SEQ ID NO: 1520990 - DNA, 19 bp, Homo sapiens
ctctgatatgggactgagc

SEQ ID NO: 1520991 - DNA, 13 bp, Homo sapiens
ctctgatctaaca

SEQ ID NO: 1520992 - DNA, 16 bp, Homo sapiens
ctctgatcttgtgctc

SEQ ID NO: 1520993 - DNA, 14 bp, Homo sapiens
ctctgattcacctc

SEQ ID NO: 1520994 - DNA, 21 bp, Homo sapiens
ctctgattcacctcttcctct

SEQ ID NO: 1520995 - DNA, 17 bp, Homo sapiens
ctctgattctacagtga

SEQ ID NO: 1520996 - DNA, 15 bp, Homo sapiens
ctctgattttcaaag

SEQ ID NO: 1520997 - DNA, 20 bp, Homo sapiens
ctctgattttcaaagctttt

SEQ ID NO: 1520998 - DNA, 17 bp, Homo sapiens
ctctgcaaccccccagc

SEQ ID NO: 1520999 - DNA, 21 bp, Homo sapiens
ctctgcaagacagaaacctcc

SEQ ID NO: 1521000 - DNA, 18 bp, Homo sapiens
ctctgcacagacaagcag

SEQ ID NO: 1521001 - DNA, 15 bp, Homo sapiens
ctctgcacagatgga

SEQ ID NO: 1521002 - DNA, 15 bp, Homo sapiens
ctctgcacatgtctt

SEQ ID NO: 1521003 - DNA, 23 bp, Homo sapiens
ctctgcacccgcctcgacctccc

SEQ ID NO: 1521004 - DNA, 20 bp, Homo sapiens
ctctgcactactcctctgca

SEQ ID NO: 1521005 - DNA, 17 bp, Homo sapiens
ctctgcactccatggcc

SEQ ID NO: 1521006 - DNA, 22 bp, Homo sapiens
ctctgcactccatggccacccc

SEQ ID NO: 1521007 - DNA, 23 bp, Homo sapiens
ctctgcactccatggccaccccg

SEQ ID NO: 1521008 - DNA, 19 bp, Homo sapiens
ctctgcagacttcccagct

SEQ ID NO: 1521009 - DNA, 22 bp, Homo sapiens
ctctgcagacttcccagctagg

SEQ ID NO: 1521010 - DNA, 14 bp, Homo sapiens
ctctgcagagtcac

SEQ ID NO: 1521011 - DNA, 16 bp, Homo sapiens
ctctgcagccagccca

SEQ ID NO: 1521012 - DNA, 17 bp, Homo sapiens
ctctgcagccagcccag

SEQ ID NO: 1521013 - DNA, 12 bp, Homo sapiens
ctctgcagctgc

SEQ ID NO: 1521014 - DNA, 13 bp, Homo sapiens
ctctgcagctgcc

SEQ ID NO: 1521015 - DNA, 12 bp, Homo sapiens
ctctgcaggcca

SEQ ID NO: 1521016 - DNA, 20 bp, Homo sapiens
ctctgcaggccactgtgagc

SEQ ID NO: 1521017 - DNA, 19 bp, Homo sapiens
ctctgcagtttttcccaag

SEQ ID NO: 1521018 - DNA, 12 bp, Homo sapiens
ctccaccttcca

SEQ ID NO: 1521019 - DNA, 12 bp, Homo sapiens
ctccaccttccc

SEQ ID NO: 1521020 - DNA, 23 bp, Homo sapiens
ctccacgtgtccgtccacccttc

SEQ ID NO: 1521021 - DNA, 20 bp, Homo sapiens
ctccactattttattaaaaa

SEQ ID NO: 1521022 - DNA, 17 bp, Homo sapiens
ctccactcactccagcc

SEQ ID NO: 1521023 - DNA, 21 bp, Homo sapiens
ctccactccacatctgcatca

SEQ ID NO: 1521024 - DNA, 13 bp, Homo sapiens
ctccactcccagc

SEQ ID NO: 1521025 - DNA, 19 bp, Homo sapiens
ctccactcccagcagctca

SEQ ID NO: 1521026 - DNA, 13 bp, Homo sapiens
ctccactccccca

SEQ ID NO: 1521027 - DNA, 21 bp, Homo sapiens
ctccactcccccacctgacaa

SEQ ID NO: 1521028 - DNA, 14 bp, Homo sapiens
ctccactcgaccca

SEQ ID NO: 1521029 - DNA, 20 bp, Homo sapiens
ctccactctccttcgtgtct

SEQ ID NO: 1521030 - DNA, 19 bp, Homo sapiens
ctccactctgattcacctc

SEQ ID NO: 1521031 - DNA, 22 bp, Homo sapiens
ctccactctgattcacctcttc

SEQ ID NO: 1521032 - DNA, 13 bp, Homo sapiens
ctccactctgctt

SEQ ID NO: 1521033 - DNA, 14 bp, Homo sapiens
ctccactctgcttc

SEQ ID NO: 1521034 - DNA, 17 bp, Homo sapiens
ctccactctgcttctct

SEQ ID NO: 1521035 - DNA, 20 bp, Homo sapiens
ctccactcttgatctctctt

SEQ ID NO: 1521036 - DNA, 12 bp, Homo sapiens
ctccactgacaa

SEQ ID NO: 1521037 - DNA, 16 bp, Homo sapiens
ctccactgccctggca

SEQ ID NO: 1521038 - DNA, 13 bp, Homo sapiens
ctccactgtgcac

SEQ ID NO: 1521039 - DNA, 13 bp, Homo sapiens
ctccacttccctc

SEQ ID NO: 1521040 - DNA, 21 bp, Homo sapiens
ctccacttcttgttccccact

SEQ ID NO: 1521041 - DNA, 15 bp, Homo sapiens
ctccacttgaagcac

SEQ ID NO: 1521042 - DNA, 22 bp, Homo sapiens
ctccagaagatgccagcttctc

SEQ ID NO: 1521043 - DNA, 17 bp, Homo sapiens
actgttttgggcctcca

SEQ ID NO: 1521044 - DNA, 19 bp, Homo sapiens
actgtttttgaaaaattac

SEQ ID NO: 1521045 - DNA, 23 bp, Homo sapiens
actgtttttgaaaaattacagct

SEQ ID NO: 1521046 - DNA, 16 bp, Homo sapiens
acttaaaaaatgtcca

SEQ ID NO: 1521047 - DNA, 17 bp, Homo sapiens
acttaaaaacaagagaa

SEQ ID NO: 1521048 - DNA, 14 bp, Homo sapiens
acttaaaaatgtaa

SEQ ID NO: 1521049 - DNA, 19 bp, Homo sapiens
acttaaaaatgtaaatatt

SEQ ID NO: 1521050 - DNA, 14 bp, Homo sapiens
acttaaaaattaat

SEQ ID NO: 1521051 - DNA, 17 bp, Homo sapiens
acttaaaaattaatagt

SEQ ID NO: 1521052 - DNA, 13 bp, Homo sapiens
acttaaaacatgg

SEQ ID NO: 1521053 - DNA, 20 bp, Homo sapiens
acttaaaagagctcagacat

SEQ ID NO: 1521054 - DNA, 22 bp, Homo sapiens
acttaaaataggggatatttaa

SEQ ID NO: 1521055 - DNA, 17 bp, Homo sapiens
acttaaaattagtcttt

SEQ ID NO: 1521056 - DNA, 13 bp, Homo sapiens
acttaaacaaaaa

SEQ ID NO: 1521057 - DNA, 17 bp, Homo sapiens
acttaaaggctgtggta

SEQ ID NO: 1521058 - DNA, 19 bp, Homo sapiens
acttaaatggaaaaaatga

SEQ ID NO: 1521059 - DNA, 14 bp, Homo sapiens
acttaaatgttatg

SEQ ID NO: 1521060 - DNA, 13 bp, Homo sapiens
acttaaatttgtt

SEQ ID NO: 1521061 - DNA, 16 bp, Homo sapiens
acttaaatttgttctt

SEQ ID NO: 1521062 - DNA, 20 bp, Homo sapiens
acttaaatttgttctttgtt

SEQ ID NO: 1521063 - DNA, 20 bp, Homo sapiens
acttaacacgtgaatatttt

SEQ ID NO: 1521064 - DNA, 16 bp, Homo sapiens
acttaaccggagttcg

SEQ ID NO: 1521065 - DNA, 17 bp, Homo sapiens
acttaacggaccaaagc

SEQ ID NO: 1521066 - DNA, 15 bp, Homo sapiens
acttaactttaactt

SEQ ID NO: 1521067 - DNA, 17 bp, Homo sapiens
acttaagacaaatggga

SEQ ID NO: 1521068 - DNA, 23 bp, Homo sapiens
acttaagacaaatgggactgatg

SEQ ID NO: 1521069 - DNA, 20 bp, Homo sapiens
acttaagcaaaagaaaaaga

SEQ ID NO: 1521070 - DNA, 17 bp, Homo sapiens
acttaagcatctggctc

SEQ ID NO: 1521071 - DNA, 21 bp, Homo sapiens
acttaagcatctggctctaat

SEQ ID NO: 1521072 - DNA, 17 bp, Homo sapiens
acttaagtcttccttaa

SEQ ID NO: 1521073 - DNA, 15 bp, Homo sapiens
acttaagtgcacttt

SEQ ID NO: 1521074 - DNA, 17 bp, Homo sapiens
acttaataactgtgtac

SEQ ID NO: 1521075 - DNA, 18 bp, Homo sapiens
acttaataactgtgtact

SEQ ID NO: 1521076 - DNA, 23 bp, Homo sapiens
acttaataatttttacctaatct

SEQ ID NO: 1521077 - DNA, 14 bp, Homo sapiens
acttaatctttcta

SEQ ID NO: 1521078 - DNA, 22 bp, Homo sapiens
acttaatggctgttgagggcca

SEQ ID NO: 1521079 - DNA, 13 bp, Homo sapiens
acttaatgtatgt

SEQ ID NO: 1521080 - DNA, 19 bp, Homo sapiens
acttaattcagtctcagct

SEQ ID NO: 1521081 - DNA, 19 bp, Homo sapiens
acttaattctgattagaga

SEQ ID NO: 1521082 - DNA, 15 bp, Homo sapiens
acttacacttataaa

SEQ ID NO: 1521083 - DNA, 16 bp, Homo sapiens
acttacacttggagcc

SEQ ID NO: 1521084 - DNA, 17 bp, Homo sapiens
acttacactttatgcac

SEQ ID NO: 1521085 - DNA, 18 bp, Homo sapiens
acttacatactaggtgcc

SEQ ID NO: 1521086 - DNA, 23 bp, Homo sapiens
acttacctgaaaagtagagaaat

SEQ ID NO: 1521087 - DNA, 15 bp, Homo sapiens
acttacgtaaaacat

SEQ ID NO: 1521088 - DNA, 16 bp, Homo sapiens
acttacgtaaaacatt

SEQ ID NO: 1521089 - DNA, 14 bp, Homo sapiens
acttactctaagat

SEQ ID NO: 1521090 - DNA, 16 bp, Homo sapiens
acttactctaagatct

SEQ ID NO: 1521091 - DNA, 14 bp, Homo sapiens
acttactgtatatg

SEQ ID NO: 1521092 - DNA, 15 bp, Homo sapiens
acttactgtatatgt

SEQ ID NO: 1521093 - DNA, 16 bp, Homo sapiens
acttactgtatatgta

SEQ ID NO: 1521094 - DNA, 14 bp, Homo sapiens
acttacttgcttat

SEQ ID NO: 1521095 - DNA, 16 bp, Homo sapiens
acttacttgcttattt

SEQ ID NO: 1521096 - DNA, 12 bp, Homo sapiens
acttagaaactg

SEQ ID NO: 1521097 - DNA, 14 bp, Homo sapiens
acttagaggaaaat

SEQ ID NO: 1521098 - DNA, 15 bp, Homo sapiens
acttagaggaaaatg

SEQ ID NO: 1521099 - DNA, 19 bp, Homo sapiens
acttagaggcaacaggatt

SEQ ID NO: 1521100 - DNA, 22 bp, Homo sapiens
acttagaggcaacaggattgat

SEQ ID NO: 1521101 - DNA, 12 bp, Homo sapiens
acttagccagag

SEQ ID NO: 1521102 - DNA, 15 bp, Homo sapiens
acttagcccaagagg

SEQ ID NO: 1521103 - DNA, 21 bp, Homo sapiens
acttagccgtccatggcacca

SEQ ID NO: 1521104 - DNA, 18 bp, Homo sapiens
acttagcgtcaagacatt

SEQ ID NO: 1521105 - DNA, 16 bp, Homo sapiens
acttagctagttttat

SEQ ID NO: 1521106 - DNA, 11 bp, Homo sapiens
acttagctcag

SEQ ID NO: 1521107 - DNA, 23 bp, Homo sapiens
acttagggcaccaggggtttctc

SEQ ID NO: 1521108 - DNA, 20 bp, Homo sapiens
acttaggttattttgctttg

SEQ ID NO: 1521109 - DNA, 23 bp, Homo sapiens
acttaggttattttgctttggtt

SEQ ID NO: 1521110 - DNA, 16 bp, Homo sapiens
acttaggttttgtcca

SEQ ID NO: 1521111 - DNA, 18 bp, Homo sapiens
acttagtggtatgtctct

SEQ ID NO: 1521112 - DNA, 20 bp, Homo sapiens
acttagtggtatgtctcttt

SEQ ID NO: 1521113 - DNA, 13 bp, Homo sapiens
acttagttttgca

SEQ ID NO: 1521114 - DNA, 23 bp, Homo sapiens
acttataagtgaagtgatactat

SEQ ID NO: 1521115 - DNA, 12 bp, Homo sapiens
acttatattgaa

SEQ ID NO: 1521116 - DNA, 12 bp, Homo sapiens
acttatatttta

SEQ ID NO: 1521117 - DNA, 13 bp, Homo sapiens
acttatcacattt

SEQ ID NO: 1521118 - DNA, 14 bp, Homo sapiens
acttatcacatttt

SEQ ID NO: 1521119 - DNA, 18 bp, Homo sapiens
acttatcctaaaacaaat

SEQ ID NO: 1521120 - DNA, 17 bp, Homo sapiens
acttatctctcaaaaca

SEQ ID NO: 1521121 - DNA, 18 bp, Homo sapiens
acttatctctcaaaacaa

SEQ ID NO: 1521122 - DNA, 21 bp, Homo sapiens
acttatctctcaaaacaatat

SEQ ID NO: 1521123 - DNA, 14 bp, Homo sapiens
acttatcttatgcc

SEQ ID NO: 1521124 - DNA, 16 bp, Homo sapiens
acttatgatttcatgt

SEQ ID NO: 1521125 - DNA, 16 bp, Homo sapiens
acttattactgctaag

SEQ ID NO: 1521126 - DNA, 19 bp, Homo sapiens
acttattactgctaagtat

SEQ ID NO: 1521127 - DNA, 20 bp, Homo sapiens
acttattactgctaagtatt

SEQ ID NO: 1521128 - DNA, 17 bp, Homo sapiens
acttattcatagtttta

SEQ ID NO: 1521129 - DNA, 22 bp, Homo sapiens
acttatttaaaaatatttcaga

SEQ ID NO: 1521130 - DNA, 15 bp, Homo sapiens
acttattttctgaat

SEQ ID NO: 1521131 - DNA, 15 bp, Homo sapiens
acttattttgcttta

SEQ ID NO: 1521132 - DNA, 22 bp, Homo sapiens
acttatttttgacagtgttgaa

SEQ ID NO: 1521133 - DNA, 16 bp, Homo sapiens
acttcaaagcaagctg

SEQ ID NO: 1521134 - DNA, 14 bp, Homo sapiens
acttcaacccccag

SEQ ID NO: 1521135 - DNA, 15 bp, Homo sapiens
acttcaacccccagc

SEQ ID NO: 1521136 - DNA, 15 bp, Homo sapiens
acttcaataatcatt

SEQ ID NO: 1521137 - DNA, 14 bp, Homo sapiens
acttcaattaatgc

SEQ ID NO: 1521138 - DNA, 16 bp, Homo sapiens
ctccatatctccttcc

SEQ ID NO: 1521139 - DNA, 13 bp, Homo sapiens
ctccatatttccg

SEQ ID NO: 1521140 - DNA, 13 bp, Homo sapiens
ctccatccaaggc

SEQ ID NO: 1521141 - DNA, 14 bp, Homo sapiens
ctccatccaaggcc

SEQ ID NO: 1521142 - DNA, 18 bp, Homo sapiens
ctccatccaaggccaggt

SEQ ID NO: 1521143 - DNA, 21 bp, Homo sapiens
ctccatccacctcatcactgg

SEQ ID NO: 1521144 - DNA, 13 bp, Homo sapiens
ctccatccatcct

SEQ ID NO: 1521145 - DNA, 22 bp, Homo sapiens
ctccatcccaacagccatgccc

SEQ ID NO: 1521146 - DNA, 14 bp, Homo sapiens
ctccatcccagaca

SEQ ID NO: 1521147 - DNA, 21 bp, Homo sapiens
ctccatcctgtttgtatgaaa

SEQ ID NO: 1521148 - DNA, 18 bp, Homo sapiens
ctccatcgccatcttctt

SEQ ID NO: 1521149 - DNA, 19 bp, Homo sapiens
ctccatcgccatcttcttc

SEQ ID NO: 1521150 - DNA, 17 bp, Homo sapiens
ctccatctcaaaacaaa

SEQ ID NO: 1521151 - DNA, 16 bp, Homo sapiens
ctccatctcttctgca

SEQ ID NO: 1521152 - DNA, 23 bp, Homo sapiens
ctccatctctttaaaaacaaaca

SEQ ID NO: 1521153 - DNA, 16 bp, Homo sapiens
ctccatctttatagaa

SEQ ID NO: 1521154 - DNA, 21 bp, Homo sapiens
ctccatgaagagcttgtgtcc

SEQ ID NO: 1521155 - DNA, 18 bp, Homo sapiens
ctccatgactggctgtct

SEQ ID NO: 1521156 - DNA, 20 bp, Homo sapiens
ctccatgaggtactggtccc

SEQ ID NO: 1521157 - DNA, 14 bp, Homo sapiens
ctccatgcacctcc

SEQ ID NO: 1521158 - DNA, 16 bp, Homo sapiens
acttcaggaacaagta

SEQ ID NO: 1521159 - DNA, 16 bp, Homo sapiens
acttcaggctcttctc

SEQ ID NO: 1521160 - DNA, 17 bp, Homo sapiens
acttcaggctcttctcc

SEQ ID NO: 1521161 - DNA, 20 bp, Homo sapiens
acttcaggtgtgactctagc

SEQ ID NO: 1521162 - DNA, 20 bp, Homo sapiens
acttcagtttaatgtctcct

SEQ ID NO: 1521163 - DNA, 21 bp, Homo sapiens
acttcagtttcacagaaaata

SEQ ID NO: 1521164 - DNA, 19 bp, Homo sapiens
acttcatagatgcaggagg

SEQ ID NO: 1521165 - DNA, 23 bp, Homo sapiens
acttcatggcctttgataaatgt

SEQ ID NO: 1521166 - DNA, 22 bp, Homo sapiens
acttcatgtaattttattttaa

SEQ ID NO: 1521167 - DNA, 13 bp, Homo sapiens
acttcattctaaa

SEQ ID NO: 1521168 - DNA, 20 bp, Homo sapiens
acttcattctaaaccaaaac

SEQ ID NO: 1521169 - DNA, 19 bp, Homo sapiens
acttcattcttgaaagctg

SEQ ID NO: 1521170 - DNA, 18 bp, Homo sapiens
acttcattgtaaatcact

SEQ ID NO: 1521171 - DNA, 17 bp, Homo sapiens
acttcatttggtgctgg

SEQ ID NO: 1521172 - DNA, 16 bp, Homo sapiens
acttccaaagaaagtt

SEQ ID NO: 1521173 - DNA, 20 bp, Homo sapiens
acttccaaagactccctcca

SEQ ID NO: 1521174 - DNA, 17 bp, Homo sapiens
acttccaagaaaaataa

SEQ ID NO: 1521175 - DNA, 22 bp, Homo sapiens
acttccaaggccctgctttttt

SEQ ID NO: 1521176 - DNA, 19 bp, Homo sapiens
acttccaagtgataatttt

SEQ ID NO: 1521177 - DNA, 18 bp, Homo sapiens
acttccaatttacatact

SEQ ID NO: 1521178 - DNA, 18 bp, Homo sapiens
acttccaccagcctgcac

SEQ ID NO: 1521179 - DNA, 21 bp, Homo sapiens
acttccacctcgggcacattt

SEQ ID NO: 1521180 - DNA, 12 bp, Homo sapiens
acttccaccttg

SEQ ID NO: 1521181 - DNA, 17 bp, Homo sapiens
acttccactgccatcct

SEQ ID NO: 1521182 - DNA, 19 bp, Homo sapiens
acttccataggacatactg

SEQ ID NO: 1521183 - DNA, 17 bp, Homo sapiens
acttccatgaggccaaa

SEQ ID NO: 1521184 - DNA, 14 bp, Homo sapiens
acttccatttgtat

SEQ ID NO: 1521185 - DNA, 16 bp, Homo sapiens
acttccatttgtattc

SEQ ID NO: 1521186 - DNA, 20 bp, Homo sapiens
acttcccaggatctgctcca

SEQ ID NO: 1521187 - DNA, 17 bp, Homo sapiens
acttcccagtgaattct

SEQ ID NO: 1521188 - DNA, 23 bp, Homo sapiens
acttcccagttcaggagtcccaa

SEQ ID NO: 1521189 - DNA, 18 bp, Homo sapiens
acttccccaatatcttgc

SEQ ID NO: 1521190 - DNA, 15 bp, Homo sapiens
acttccccagctctc

SEQ ID NO: 1521191 - DNA, 21 bp, Homo sapiens
acttccccatcccgaagccat

SEQ ID NO: 1521192 - DNA, 20 bp, Homo sapiens
acttcccgtcccatatcctg

SEQ ID NO: 1521193 - DNA, 23 bp, Homo sapiens
acttcccgtcccatatcctgcct

SEQ ID NO: 1521194 - DNA, 15 bp, Homo sapiens
acttccctagtcccc

SEQ ID NO: 1521195 - DNA, 20 bp, Homo sapiens
acttccctctgtttctcttt

SEQ ID NO: 1521196 - DNA, 12 bp, Homo sapiens
acttccctgtgt

SEQ ID NO: 1521197 - DNA, 13 bp, Homo sapiens
acttccgcctcct

SEQ ID NO: 1521198 - DNA, 14 bp, Homo sapiens
acttccgctgaggg

SEQ ID NO: 1521199 - DNA, 15 bp, Homo sapiens
acttcctagggatct

SEQ ID NO: 1521200 - DNA, 17 bp, Homo sapiens
acttcctcctccccact

SEQ ID NO: 1521201 - DNA, 15 bp, Homo sapiens
acttcctgaggcctc

SEQ ID NO: 1521202 - DNA, 11 bp, Homo sapiens
acttcctgctg

SEQ ID NO: 1521203 - DNA, 16 bp, Homo sapiens
acttcctgctgcaccc

SEQ ID NO: 1521204 - DNA, 18 bp, Homo sapiens
acttcctgctgcaccctg

SEQ ID NO: 1521205 - DNA, 16 bp, Homo sapiens
acttcctgcttcctca

SEQ ID NO: 1521206 - DNA, 17 bp, Homo sapiens
acttcctggattttctt

SEQ ID NO: 1521207 - DNA, 23 bp, Homo sapiens
acttcctggattttctttctatg

SEQ ID NO: 1521208 - DNA, 18 bp, Homo sapiens
acttcctggggccccgct

SEQ ID NO: 1521209 - DNA, 23 bp, Homo sapiens
acttcctgtccagctccaacctg

SEQ ID NO: 1521210 - DNA, 12 bp, Homo sapiens
acttcctgtgta

SEQ ID NO: 1521211 - DNA, 13 bp, Homo sapiens
acttcctgtgtac

SEQ ID NO: 1521212 - DNA, 15 bp, Homo sapiens
acttcgactcaggat

SEQ ID NO: 1521213 - DNA, 16 bp, Homo sapiens
acttcgctagaaaaaa

SEQ ID NO: 1521214 - DNA, 15 bp, Homo sapiens
acttcgtcttctaat

SEQ ID NO: 1521215 - DNA, 20 bp, Homo sapiens
acttcgtcttctaatttcaa

SEQ ID NO: 1521216 - DNA, 18 bp, Homo sapiens
acttctaagtaaaaccac

SEQ ID NO: 1521217 - DNA, 22 bp, Homo sapiens
acttctacccagatggaaaaat

SEQ ID NO: 1521218 - DNA, 19 bp, Homo sapiens
acttctagatctcagccat

SEQ ID NO: 1521219 - DNA, 16 bp, Homo sapiens
acttctatattttaat

SEQ ID NO: 1521220 - DNA, 21 bp, Homo sapiens
acttctatattttaatagaaa

SEQ ID NO: 1521221 - DNA, 16 bp, Homo sapiens
acttctccatgctgca

SEQ ID NO: 1521222 - DNA, 22 bp, Homo sapiens
acttctctctaaggagaatggc

SEQ ID NO: 1521223 - DNA, 14 bp, Homo sapiens
acttctctgtgtgc

SEQ ID NO: 1521224 - DNA, 18 bp, Homo sapiens
acttctctgttgtcaaac

SEQ ID NO: 1521225 - DNA, 17 bp, Homo sapiens
acttctcttgaaaagtt

SEQ ID NO: 1521226 - DNA, 17 bp, Homo sapiens
acttctgacaaaggtgg

SEQ ID NO: 1521227 - DNA, 12 bp, Homo sapiens
acttctgagatc

SEQ ID NO: 1521228 - DNA, 13 bp, Homo sapiens
acttctgcctctt

SEQ ID NO: 1521229 - DNA, 13 bp, Homo sapiens
acttctgcctgga

SEQ ID NO: 1521230 - DNA, 13 bp, Homo sapiens
acttctgctttca

SEQ ID NO: 1521231 - DNA, 16 bp, Homo sapiens
acttctggaaggctgg

SEQ ID NO: 1521232 - DNA, 17 bp, Homo sapiens
acttctggaaggctggc

SEQ ID NO: 1521233 - DNA, 22 bp, Homo sapiens
acttctgggcttcatctggcaa

SEQ ID NO: 1521234 - DNA, 16 bp, Homo sapiens
acttctgggtggggca

SEQ ID NO: 1521235 - DNA, 21 bp, Homo sapiens
acttctggttgtatttctata

SEQ ID NO: 1521236 - DNA, 15 bp, Homo sapiens
acttctgtaaactta

SEQ ID NO: 1521237 - DNA, 21 bp, Homo sapiens
acttctgtcttcacaacagat

SEQ ID NO: 1521238 - DNA, 22 bp, Homo sapiens
acttctgtcttcacaacagatt

SEQ ID NO: 1521239 - DNA, 19 bp, Homo sapiens
acttctgtgagacccccac

SEQ ID NO: 1521240 - DNA, 15 bp, Homo sapiens
acttctgtgttcatt

SEQ ID NO: 1521241 - DNA, 15 bp, Homo sapiens
acttcttaaaccatt

SEQ ID NO: 1521242 - DNA, 17 bp, Homo sapiens
acttcttaaaggcctgg

SEQ ID NO: 1521243 - DNA, 23 bp, Homo sapiens
acttcttaaaggcctggaaccag

SEQ ID NO: 1521244 - DNA, 17 bp, Homo sapiens
acttcttatacatttga

SEQ ID NO: 1521245 - DNA, 18 bp, Homo sapiens
acttcttatttttcttac

SEQ ID NO: 1521246 - DNA, 23 bp, Homo sapiens
acttcttatttttcttaccaatt

SEQ ID NO: 1521247 - DNA, 20 bp, Homo sapiens
acttcttcacctcttccact

SEQ ID NO: 1521248 - DNA, 21 bp, Homo sapiens
acttcttgaatataaaaaatc

SEQ ID NO: 1521249 - DNA, 19 bp, Homo sapiens
acttcttgctggtctagtc

SEQ ID NO: 1521250 - DNA, 11 bp, Homo sapiens
acttcttgctt

SEQ ID NO: 1521251 - DNA, 21 bp, Homo sapiens
acttcttggtttggggagaaa

SEQ ID NO: 1521252 - DNA, 23 bp, Homo sapiens
acttcttggtttggggagaaata

SEQ ID NO: 1521253 - DNA, 23 bp, Homo sapiens
acttctttagcatttttatgcag

SEQ ID NO: 1521254 - DNA, 20 bp, Homo sapiens
acttcttttgctcttagctg

SEQ ID NO: 1521255 - DNA, 14 bp, Homo sapiens
ctcccatccccctg

SEQ ID NO: 1521256 - DNA, 16 bp, Homo sapiens
ctcccatccccctgcc

SEQ ID NO: 1521257 - DNA, 18 bp, Homo sapiens
ctcccatccccctgccct

SEQ ID NO: 1521258 - DNA, 19 bp, Homo sapiens
ctcccatccccctgccctc

SEQ ID NO: 1521259 - DNA, 18 bp, Homo sapiens
ctcccatcctggggcagc

SEQ ID NO: 1521260 - DNA, 14 bp, Homo sapiens
ctcccatctccttc

SEQ ID NO: 1521261 - DNA, 11 bp, Homo sapiens
ctcccatctgg

SEQ ID NO: 1521262 - DNA, 20 bp, Homo sapiens
ctcccatctgggagtcccct

SEQ ID NO: 1521263 - DNA, 14 bp, Homo sapiens
ctcccatggcacct

SEQ ID NO: 1521264 - DNA, 14 bp, Homo sapiens
ctcccatgtatgga

SEQ ID NO: 1521265 - DNA, 19 bp, Homo sapiens
ctcccattaggacaatcag

SEQ ID NO: 1521266 - DNA, 15 bp, Homo sapiens
ctcccattcctccct

SEQ ID NO: 1521267 - DNA, 15 bp, Homo sapiens
ctcccattcctgaag

SEQ ID NO: 1521268 - DNA, 16 bp, Homo sapiens
ctcccattcctgaaga

SEQ ID NO: 1521269 - DNA, 21 bp, Homo sapiens
ctcccatttcaggaatttaaa

SEQ ID NO: 1521270 - DNA, 14 bp, Homo sapiens
ctcccatttcctga

SEQ ID NO: 1521271 - DNA, 21 bp, Homo sapiens
ctccccaaatcaatacactag

SEQ ID NO: 1521272 - DNA, 21 bp, Homo sapiens
acttgagatgtatgaaggctt

SEQ ID NO: 1521273 - DNA, 19 bp, Homo sapiens
acttgagcaagatgatgta

SEQ ID NO: 1521274 - DNA, 22 bp, Homo sapiens
acttgagccatccaaagaaaca

SEQ ID NO: 1521275 - DNA, 13 bp, Homo sapiens
acttgaggcctga

SEQ ID NO: 1521276 - DNA, 18 bp, Homo sapiens
acttgagttacaccagac

SEQ ID NO: 1521277 - DNA, 18 bp, Homo sapiens
acttgataatattagtga

SEQ ID NO: 1521278 - DNA, 21 bp, Homo sapiens
acttgataatattagtgattc

SEQ ID NO: 1521279 - DNA, 20 bp, Homo sapiens
acttgatcacatgcttgaat

SEQ ID NO: 1521280 - DNA, 22 bp, Homo sapiens
acttgatgtacataactcctgt

SEQ ID NO: 1521281 - DNA, 19 bp, Homo sapiens
acttgatgtttcctggaag

SEQ ID NO: 1521282 - DNA, 23 bp, Homo sapiens
acttgatgtttcctggaagcaga

SEQ ID NO: 1521283 - DNA, 15 bp, Homo sapiens
acttgattgagaaag

SEQ ID NO: 1521284 - DNA, 22 bp, Homo sapiens
acttgcactgaagccggacagc

SEQ ID NO: 1521285 - DNA, 20 bp, Homo sapiens
acttgcagctgatgttggaa

SEQ ID NO: 1521286 - DNA, 19 bp, Homo sapiens
acttgcatccaactccagg

SEQ ID NO: 1521287 - DNA, 20 bp, Homo sapiens
acttgcatctaaccaaaaag

SEQ ID NO: 1521288 - DNA, 14 bp, Homo sapiens
acttgcatttgatt

SEQ ID NO: 1521289 - DNA, 22 bp, Homo sapiens
acttgccatgcaggaagaggcc

SEQ ID NO: 1521290 - DNA, 24 bp, Homo sapiens
acttgccatgcaggaagaggccca

SEQ ID NO: 1521291 - DNA, 14 bp, Homo sapiens
acttgccattaaaa

SEQ ID NO: 1521292 - DNA, 13 bp, Homo sapiens
acttgcctctgca

SEQ ID NO: 1521293 - DNA, 17 bp, Homo sapiens
acttgcctcttccttga

SEQ ID NO: 1521294 - DNA, 21 bp, Homo sapiens
acttgcctggggtctgagcat

SEQ ID NO: 1521295 - DNA, 12 bp, Homo sapiens
acttgcctgggt

SEQ ID NO: 1521296 - DNA, 18 bp, Homo sapiens
acttgcctgttggctgct

SEQ ID NO: 1521297 - DNA, 19 bp, Homo sapiens
acttgcctgttggctgctg

SEQ ID NO: 1521298 - DNA, 21 bp, Homo sapiens
acttgcctgttggctgctgcg

SEQ ID NO: 1521299 - DNA, 14 bp, Homo sapiens
acttgcgtcctgca

SEQ ID NO: 1521300 - DNA, 13 bp, Homo sapiens
acttgctaaagca

SEQ ID NO: 1521301 - DNA, 17 bp, Homo sapiens
acttgctaaagcacttt

SEQ ID NO: 1521302 - DNA, 22 bp, Homo sapiens
acttgctagtgatacactgtat

SEQ ID NO: 1521303 - DNA, 17 bp, Homo sapiens
acttgctgcctgaagaa

SEQ ID NO: 1521304 - DNA, 13 bp, Homo sapiens
acttgctgctgcc

SEQ ID NO: 1521305 - DNA, 13 bp, Homo sapiens
acttgctgtgtga

SEQ ID NO: 1521306 - DNA, 22 bp, Homo sapiens
acttgctgtgtgaccctgggca

SEQ ID NO: 1521307 - DNA, 18 bp, Homo sapiens
acttgctgttttgttctg

SEQ ID NO: 1521308 - DNA, 19 bp, Homo sapiens
acttgcttaaatttcttat

SEQ ID NO: 1521309 - DNA, 15 bp, Homo sapiens
acttgcttctctagc

SEQ ID NO: 1521310 - DNA, 22 bp, Homo sapiens
acttggaacctcattgctacca

SEQ ID NO: 1521311 - DNA, 21 bp, Homo sapiens
acttggacttgtcctcagcag

SEQ ID NO: 1521312 - DNA, 17 bp, Homo sapiens
acttggacttttgatag

SEQ ID NO: 1521313 - DNA, 19 bp, Homo sapiens
acttggagactcctggtct

SEQ ID NO: 1521314 - DNA, 14 bp, Homo sapiens
acttggagccaagg

SEQ ID NO: 1521315 - DNA, 19 bp, Homo sapiens
acttggagccccagtgcca

SEQ ID NO: 1521316 - DNA, 15 bp, Homo sapiens
acttggagcccgtgc

SEQ ID NO: 1521317 - DNA, 20 bp, Homo sapiens
acttggagctgtcctccaga

SEQ ID NO: 1521318 - DNA, 15 bp, Homo sapiens
acttggaggacctgg

SEQ ID NO: 1521319 - DNA, 21 bp, Homo sapiens
acttggatgagttttgggaag

SEQ ID NO: 1521320 - DNA, 15 bp, Homo sapiens
acttggattctctaa

SEQ ID NO: 1521321 - DNA, 12 bp, Homo sapiens
acttggcactta

SEQ ID NO: 1521322 - DNA, 16 bp, Homo sapiens
acttggcacttaagtg

SEQ ID NO: 1521323 - DNA, 16 bp, Homo sapiens
acttggcaggtgcctg

SEQ ID NO: 1521324 - DNA, 14 bp, Homo sapiens
acttggcatttcta

SEQ ID NO: 1521325 - DNA, 15 bp, Homo sapiens
acttggcatttctat

SEQ ID NO: 1521326 - DNA, 21 bp, Homo sapiens
acttggccctcttgcgggcct

SEQ ID NO: 1521327 - DNA, 23 bp, Homo sapiens
acttggccctcttgcgggcctgg

SEQ ID NO: 1521328 - DNA, 22 bp, Homo sapiens
acttggctcgaatctctgtgcc

SEQ ID NO: 1521329 - DNA, 22 bp, Homo sapiens
acttggctgtctgaccagagaa

SEQ ID NO: 1521330 - DNA, 23 bp, Homo sapiens
acttggctgtctgaccagagaat

SEQ ID NO: 1521331 - DNA, 13 bp, Homo sapiens
acttggctttcat

SEQ ID NO: 1521332 - DNA, 15 bp, Homo sapiens
acttgggtcttccct

SEQ ID NO: 1521333 - DNA, 15 bp, Homo sapiens
acttggtcagagcca

SEQ ID NO: 1521334 - DNA, 19 bp, Homo sapiens
acttggtcttgaagtctgt

SEQ ID NO: 1521335 - DNA, 18 bp, Homo sapiens
acttggttgggtcctcac

SEQ ID NO: 1521336 - DNA, 14 bp, Homo sapiens
acttgtaaatacac

SEQ ID NO: 1521337 - DNA, 16 bp, Homo sapiens
acttgtaaatacacca

SEQ ID NO: 1521338 - DNA, 22 bp, Homo sapiens
acttgtactatgttaataactt

SEQ ID NO: 1521339 - DNA, 14 bp, Homo sapiens
acttgtagcagcta

SEQ ID NO: 1521340 - DNA, 22 bp, Homo sapiens
acttgtattccttttagcagta

SEQ ID NO: 1521341 - DNA, 14 bp, Homo sapiens
acttgtattgactt

SEQ ID NO: 1521342 - DNA, 10 bp, Homo sapiens
acttgtattt

SEQ ID NO: 1521343 - DNA, 23 bp, Homo sapiens
acttgtccttttgtaccatggtg

SEQ ID NO: 1521344 - DNA, 20 bp, Homo sapiens
acttgtctaaataagtttgc

SEQ ID NO: 1521345 - DNA, 12 bp, Homo sapiens
acttgtctgagg

SEQ ID NO: 1521346 - DNA, 14 bp, Homo sapiens
acttgtctgaggcc

SEQ ID NO: 1521347 - DNA, 16 bp, Homo sapiens
acttgtctgaggcctc

SEQ ID NO: 1521348 - DNA, 20 bp, Homo sapiens
acttgtctgggaattgtgtg

SEQ ID NO: 1521349 - DNA, 16 bp, Homo sapiens
acttgtctttttctgg

SEQ ID NO: 1521350 - DNA, 19 bp, Homo sapiens
acttgtgaaacacagctgt

SEQ ID NO: 1521351 - DNA, 20 bp, Homo sapiens
acttgtgaaacacagctgtt

SEQ ID NO: 1521352 - DNA, 23 bp, Homo sapiens
acttgtgacttttgctttaattc

SEQ ID NO: 1521353 - DNA, 19 bp, Homo sapiens
acttgtgagcatcagaggg

SEQ ID NO: 1521354 - DNA, 17 bp, Homo sapiens
acttgtgattatttatt

SEQ ID NO: 1521355 - DNA, 13 bp, Homo sapiens
acttgtgggcttc

SEQ ID NO: 1521356 - DNA, 18 bp, Homo sapiens
acttgtggtgtgaccatg

SEQ ID NO: 1521357 - DNA, 20 bp, Homo sapiens
acttgtgtactgataaaata

SEQ ID NO: 1521358 - DNA, 21 bp, Homo sapiens
acttgtgtactgataaaatac

SEQ ID NO: 1521359 - DNA, 23 bp, Homo sapiens
acttgtgtatattttaatgaata

SEQ ID NO: 1521360 - DNA, 22 bp, Homo sapiens
acttgtgtccctaatgtgttta

SEQ ID NO: 1521361 - DNA, 21 bp, Homo sapiens
acttgtgtctctgtgctttta

SEQ ID NO: 1521362 - DNA, 22 bp, Homo sapiens
acttgtgtctctgtgcttttaa

SEQ ID NO: 1521363 - DNA, 11 bp, Homo sapiens
acttgtgtctg

SEQ ID NO: 1521364 - DNA, 22 bp, Homo sapiens
acttgtgtgtgggctgtgagtg

SEQ ID NO: 1521365 - DNA, 13 bp, Homo sapiens
acttgtgttactt

SEQ ID NO: 1521366 - DNA, 15 bp, Homo sapiens
acttgttccagctct

SEQ ID NO: 1521367 - DNA, 16 bp, Homo sapiens
acttgttggtgtggat

SEQ ID NO: 1521368 - DNA, 20 bp, Homo sapiens
acttgtttgaggcaaatcta

SEQ ID NO: 1521369 - DNA, 14 bp, Homo sapiens
acttgtttgctatg

SEQ ID NO: 1521370 - DNA, 16 bp, Homo sapiens
acttgtttgtcttcca

SEQ ID NO: 1521371 - DNA, 17 bp, Homo sapiens
acttgtttgtcttccat

SEQ ID NO: 1521372 - DNA, 16 bp, Homo sapiens
acttgttttggatgcc

SEQ ID NO: 1521373 - DNA, 20 bp, Homo sapiens
ctcccgcttcctggcctccc

SEQ ID NO: 1521374 - DNA, 12 bp, Homo sapiens
ctcccggcaagc

SEQ ID NO: 1521375 - DNA, 18 bp, Homo sapiens
ctcccggcactccatgct

SEQ ID NO: 1521376 - DNA, 21 bp, Homo sapiens
ctcccggcctaggcacctccc

SEQ ID NO: 1521377 - DNA, 18 bp, Homo sapiens
ctcccggcgggtgctctg

SEQ ID NO: 1521378 - DNA, 13 bp, Homo sapiens
ctcccggctgcct

SEQ ID NO: 1521379 - DNA, 14 bp, Homo sapiens
ctcccggctgcctg

SEQ ID NO: 1521380 - DNA, 15 bp, Homo sapiens
ctcccggctgcctgc

SEQ ID NO: 1521381 - DNA, 16 bp, Homo sapiens
ctcccggctgcctgcc

SEQ ID NO: 1521382 - DNA, 17 bp, Homo sapiens
ctcccggctgcctgccg

SEQ ID NO: 1521383 - DNA, 17 bp, Homo sapiens
ctcccggggcagggcag

SEQ ID NO: 1521384 - DNA, 20 bp, Homo sapiens
ctcccgggggcagggtgggg

SEQ ID NO: 1521385 - DNA, 21 bp, Homo sapiens
ctcccggtgcccaagaataga

SEQ ID NO: 1521386 - DNA, 20 bp, Homo sapiens
actttaattgcttaaaagac

SEQ ID NO: 1521387 - DNA, 15 bp, Homo sapiens
actttacaaaccatt

SEQ ID NO: 1521388 - DNA, 21 bp, Homo sapiens
actttacaaaccattacctgt

SEQ ID NO: 1521389 - DNA, 18 bp, Homo sapiens
actttacccacctagaac

SEQ ID NO: 1521390 - DNA, 15 bp, Homo sapiens
actttacttgtggtg

SEQ ID NO: 1521391 - DNA, 15 bp, Homo sapiens
actttagagtagcat

SEQ ID NO: 1521392 - DNA, 19 bp, Homo sapiens
actttagagtagcatgaga

SEQ ID NO: 1521393 - DNA, 13 bp, Homo sapiens
actttataaatcc

SEQ ID NO: 1521394 - DNA, 22 bp, Homo sapiens
actttataagtcattgtatgtt

SEQ ID NO: 1521395 - DNA, 22 bp, Homo sapiens
actttatacccagaaagttatt

SEQ ID NO: 1521396 - DNA, 13 bp, Homo sapiens
actttatcactta

SEQ ID NO: 1521397 - DNA, 13 bp, Homo sapiens
actttatcatgaa

SEQ ID NO: 1521398 - DNA, 15 bp, Homo sapiens
actttatgccggatg

SEQ ID NO: 1521399 - DNA, 19 bp, Homo sapiens
actttatgttgtatgattc

SEQ ID NO: 1521400 - DNA, 12 bp, Homo sapiens
actttattcttg

SEQ ID NO: 1521401 - DNA, 14 bp, Homo sapiens
actttattcttgct

SEQ ID NO: 1521402 - DNA, 20 bp, Homo sapiens
actttattgccctaacaatt

SEQ ID NO: 1521403 - DNA, 13 bp, Homo sapiens
actttattgtaca

SEQ ID NO: 1521404 - DNA, 22 bp, Homo sapiens
actttatttaaaaaagaaaaaa

SEQ ID NO: 1521405 - DNA, 17 bp, Homo sapiens
actttatttatttctag

SEQ ID NO: 1521406 - DNA, 12 bp, Homo sapiens
actttatttctg

SEQ ID NO: 1521407 - DNA, 17 bp, Homo sapiens
actttatttttctgata

SEQ ID NO: 1521408 - DNA, 17 bp, Homo sapiens
actttcacatagatgtc

SEQ ID NO: 1521409 - DNA, 18 bp, Homo sapiens
actttcacgtggcctccg

SEQ ID NO: 1521410 - DNA, 11 bp, Homo sapiens
actttcacttc

SEQ ID NO: 1521411 - DNA, 17 bp, Homo sapiens
actttcacttcttccta

SEQ ID NO: 1521412 - DNA, 13 bp, Homo sapiens
actttcactttga

SEQ ID NO: 1521413 - DNA, 18 bp, Homo sapiens
actttcaggtactaaata

SEQ ID NO: 1521414 - DNA, 21 bp, Homo sapiens
actttcaggtactaaatacct

SEQ ID NO: 1521415 - DNA, 20 bp, Homo sapiens
actttcatctaccttttctg

SEQ ID NO: 1521416 - DNA, 17 bp, Homo sapiens
actttcatgctacagaa

SEQ ID NO: 1521417 - DNA, 17 bp, Homo sapiens
actttcatttttttcca

SEQ ID NO: 1521418 - DNA, 20 bp, Homo sapiens
actttcatttttttccaggc

SEQ ID NO: 1521419 - DNA, 13 bp, Homo sapiens
actttccatctct

SEQ ID NO: 1521420 - DNA, 18 bp, Homo sapiens
actttccatctctgcctg

SEQ ID NO: 1521421 - DNA, 16 bp, Homo sapiens
actttcccaggttctg

SEQ ID NO: 1521422 - DNA, 13 bp, Homo sapiens
actttcccctctc

SEQ ID NO: 1521423 - DNA, 14 bp, Homo sapiens
actttcccctctcg

SEQ ID NO: 1521424 - DNA, 19 bp, Homo sapiens
actttcccttggctgttaa

SEQ ID NO: 1521425 - DNA, 13 bp, Homo sapiens
actttcctgagct

SEQ ID NO: 1521426 - DNA, 23 bp, Homo sapiens
actttccttagacccgccaggtc

SEQ ID NO: 1521427 - DNA, 18 bp, Homo sapiens
actttcgtaatagctcag

SEQ ID NO: 1521428 - DNA, 18 bp, Homo sapiens
actttctcagttttcata

SEQ ID NO: 1521429 - DNA, 15 bp, Homo sapiens
actttctctctttgt

SEQ ID NO: 1521430 - DNA, 21 bp, Homo sapiens
actttctggactcccactctt

SEQ ID NO: 1521431 - DNA, 17 bp, Homo sapiens
actttctggtgctgtct

SEQ ID NO: 1521432 - DNA, 23 bp, Homo sapiens
actttctgtgacgcagacagagg

SEQ ID NO: 1521433 - DNA, 13 bp, Homo sapiens
actttctgttaaa

SEQ ID NO: 1521434 - DNA, 16 bp, Homo sapiens
actttctgttaaaatg

SEQ ID NO: 1521435 - DNA, 17 bp, Homo sapiens
actttctgttaaaatgc

SEQ ID NO: 1521436 - DNA, 18 bp, Homo sapiens
actttctgttatgggctt

SEQ ID NO: 1521437 - DNA, 16 bp, Homo sapiens
actttcttattctgta

SEQ ID NO: 1521438 - DNA, 15 bp, Homo sapiens
actttctttctaaag

SEQ ID NO: 1521439 - DNA, 19 bp, Homo sapiens
actttgaaaagttggaagg

SEQ ID NO: 1521440 - DNA, 18 bp, Homo sapiens
actttgaaaggagatgtc

SEQ ID NO: 1521441 - DNA, 20 bp, Homo sapiens
actttgaaaggagatgtctt

SEQ ID NO: 1521442 - DNA, 17 bp, Homo sapiens
actttgaaatgtgtttc

SEQ ID NO: 1521443 - DNA, 21 bp, Homo sapiens
actttgaagcaaatacaattc

SEQ ID NO: 1521444 - DNA, 14 bp, Homo sapiens
actttgaagggcaa

SEQ ID NO: 1521445 - DNA, 14 bp, Homo sapiens
actttgacaaggaa

SEQ ID NO: 1521446 - DNA, 20 bp, Homo sapiens
actttgacctaaattattta

SEQ ID NO: 1521447 - DNA, 17 bp, Homo sapiens
actttgagaggctgagg

SEQ ID NO: 1521448 - DNA, 17 bp, Homo sapiens
actttgagatctaaaaa

SEQ ID NO: 1521449 - DNA, 18 bp, Homo sapiens
actttgagcctgggaaat

SEQ ID NO: 1521450 - DNA, 14 bp, Homo sapiens
actttgattctgat

SEQ ID NO: 1521451 - DNA, 20 bp, Homo sapiens
actttgcaatccaaataaag

SEQ ID NO: 1521452 - DNA, 22 bp, Homo sapiens
actttgcccagggtcctgtgcc

SEQ ID NO: 1521453 - DNA, 15 bp, Homo sapiens
actttgcctcaagac

SEQ ID NO: 1521454 - DNA, 22 bp, Homo sapiens
actttgcttagtattgacaact

SEQ ID NO: 1521455 - DNA, 14 bp, Homo sapiens
actttgcttcccat

SEQ ID NO: 1521456 - DNA, 17 bp, Homo sapiens
actttgcttgagaatcc

SEQ ID NO: 1521457 - DNA, 15 bp, Homo sapiens
actttgcttgctttg

SEQ ID NO: 1521458 - DNA, 22 bp, Homo sapiens
actttggaaccagactcttgcc

SEQ ID NO: 1521459 - DNA, 20 bp, Homo sapiens
actttggcaacatcttggct

SEQ ID NO: 1521460 - DNA, 18 bp, Homo sapiens
actttggcaatttcctgg

SEQ ID NO: 1521461 - DNA, 18 bp, Homo sapiens
actttggcttctcctgtg

SEQ ID NO: 1521462 - DNA, 19 bp, Homo sapiens
actttggcttctcctgtga

SEQ ID NO: 1521463 - DNA, 20 bp, Homo sapiens
actttggcttctcctgtgac

SEQ ID NO: 1521464 - DNA, 19 bp, Homo sapiens
actttgggaaaacatgtta

SEQ ID NO: 1521465 - DNA, 19 bp, Homo sapiens
actttgggaggctgaggtg

SEQ ID NO: 1521466 - DNA, 19 bp, Homo sapiens
actttgggattctttccat

SEQ ID NO: 1521467 - DNA, 16 bp, Homo sapiens
actttgggcttagtat

SEQ ID NO: 1521468 - DNA, 23 bp, Homo sapiens
actttgggcttagtatttctcag

SEQ ID NO: 1521469 - DNA, 22 bp, Homo sapiens
actttggtgcgggcacaataaa

SEQ ID NO: 1521470 - DNA, 18 bp, Homo sapiens
actttggttttgctgaga

SEQ ID NO: 1521471 - DNA, 23 bp, Homo sapiens
actttgtaaataggatttttaga

SEQ ID NO: 1521472 - DNA, 14 bp, Homo sapiens
actttgtctgaaaa

SEQ ID NO: 1521473 - DNA, 14 bp, Homo sapiens
actttgtcttttca

SEQ ID NO: 1521474 - DNA, 18 bp, Homo sapiens
actttgtgcattctggat

SEQ ID NO: 1521475 - DNA, 15 bp, Homo sapiens
actttgtgttcattt

SEQ ID NO: 1521476 - DNA, 19 bp, Homo sapiens
actttgtgttcatttcatt

SEQ ID NO: 1521477 - DNA, 23 bp, Homo sapiens
actttgttctgttgtctgcgcct

SEQ ID NO: 1521478 - DNA, 21 bp, Homo sapiens
actttgttgcaagatgtgaat

SEQ ID NO: 1521479 - DNA, 13 bp, Homo sapiens
acttttaaactgt

SEQ ID NO: 1521480 - DNA, 15 bp, Homo sapiens
acttttaaactgtgt

SEQ ID NO: 1521481 - DNA, 22 bp, Homo sapiens
acttttaaagaaaaatatgata

SEQ ID NO: 1521482 - DNA, 15 bp, Homo sapiens
acttttaatcagtga

SEQ ID NO: 1521483 - DNA, 13 bp, Homo sapiens
acttttaattcat

SEQ ID NO: 1521484 - DNA, 21 bp, Homo sapiens
acttttaccactatttaagtt

SEQ ID NO: 1521485 - DNA, 15 bp, Homo sapiens
acttttactctgcct

SEQ ID NO: 1521486 - DNA, 16 bp, Homo sapiens
acttttactctgccta

SEQ ID NO: 1521487 - DNA, 14 bp, Homo sapiens
acttttataaagca

SEQ ID NO: 1521488 - DNA, 21 bp, Homo sapiens
acttttatctattctgagaaa

SEQ ID NO: 1521489 - DNA, 20 bp, Homo sapiens
acttttatgcagcaaatata

SEQ ID NO: 1521490 - DNA, 22 bp, Homo sapiens
acttttatgcagcaaatatatg

SEQ ID NO: 1521491 - DNA, 20 bp, Homo sapiens
actggcttctgcttgtcatc

SEQ ID NO: 1521492 - DNA, 15 bp, Homo sapiens
actggcttctgtgca

SEQ ID NO: 1521493 - DNA, 15 bp, Homo sapiens
actggcttgaaggac

SEQ ID NO: 1521494 - DNA, 20 bp, Homo sapiens
actggcttgtacatttttaa

SEQ ID NO: 1521495 - DNA, 10 bp, Homo sapiens
actgggaaac

SEQ ID NO: 1521496 - DNA, 23 bp, Homo sapiens
actgggaaagttaggattcagat

SEQ ID NO: 1521497 - DNA, 12 bp, Homo sapiens
actgggaagaag

SEQ ID NO: 1521498 - DNA, 16 bp, Homo sapiens
actgggaagaagcaag

SEQ ID NO: 1521499 - DNA, 19 bp, Homo sapiens
actgggaagataggctctg

SEQ ID NO: 1521500 - DNA, 16 bp, Homo sapiens
actgggacagctggct

SEQ ID NO: 1521501 - DNA, 19 bp, Homo sapiens
actgggacagctggctggg

SEQ ID NO: 1521502 - DNA, 22 bp, Homo sapiens
actgggagccacttctccccag

SEQ ID NO: 1521503 - DNA, 14 bp, Homo sapiens
actgggagtgtggg

SEQ ID NO: 1521504 - DNA, 21 bp, Homo sapiens
actgggagtgtgggctgccct

SEQ ID NO: 1521505 - DNA, 22 bp, Homo sapiens
actgggattaagaaaccttgct

SEQ ID NO: 1521506 - DNA, 15 bp, Homo sapiens
actgggcatttcaat

SEQ ID NO: 1521507 - DNA, 14 bp, Homo sapiens
actgggccacggag

SEQ ID NO: 1521508 - DNA, 14 bp, Homo sapiens
actgggccagccct

SEQ ID NO: 1521509 - DNA, 23 bp, Homo sapiens
actgggccataatgttgcttctc

SEQ ID NO: 1521510 - DNA, 16 bp, Homo sapiens
actgggcccaggcagg

SEQ ID NO: 1521511 - DNA, 17 bp, Homo sapiens
actgggcccaggcaggt

SEQ ID NO: 1521512 - DNA, 14 bp, Homo sapiens
actgggccctgagt

SEQ ID NO: 1521513 - DNA, 11 bp, Homo sapiens
actgggcctgg

SEQ ID NO: 1521514 - DNA, 21 bp, Homo sapiens
actgggctaaggaagtatcag

SEQ ID NO: 1521515 - DNA, 23 bp, Homo sapiens
actgggctgggcctcgtgcgccc

SEQ ID NO: 1521516 - DNA, 16 bp, Homo sapiens
actggggactttattt

SEQ ID NO: 1521517 - DNA, 17 bp, Homo sapiens
actggggagcccgtctc

SEQ ID NO: 1521518 - DNA, 18 bp, Homo sapiens
actggggaggctgaggca

SEQ ID NO: 1521519 - DNA, 21 bp, Homo sapiens
actggggaggctgaggcagga

SEQ ID NO: 1521520 - DNA, 16 bp, Homo sapiens
actggggagggctgca

SEQ ID NO: 1521521 - DNA, 13 bp, Homo sapiens
actggggcctcca

SEQ ID NO: 1521522 - DNA, 18 bp, Homo sapiens
actggggttcaagcccag

SEQ ID NO: 1521523 - DNA, 19 bp, Homo sapiens
actggggttcaagcccagg

SEQ ID NO: 1521524 - DNA, 21 bp, Homo sapiens
actgggtacaagagatgggat

SEQ ID NO: 1521525 - DNA, 15 bp, Homo sapiens
actgggtaggaaaga

SEQ ID NO: 1521526 - DNA, 16 bp, Homo sapiens
actgggtcatcatttg

SEQ ID NO: 1521527 - DNA, 14 bp, Homo sapiens
actgggtctgacct

SEQ ID NO: 1521528 - DNA, 18 bp, Homo sapiens
actgggtggggtgaggac

SEQ ID NO: 1521529 - DNA, 20 bp, Homo sapiens
actgggtggggtgaggacca

SEQ ID NO: 1521530 - DNA, 13 bp, Homo sapiens
actgggttaaata

SEQ ID NO: 1521531 - DNA, 20 bp, Homo sapiens
actgggttctttggaagcag

SEQ ID NO: 1521532 - DNA, 14 bp, Homo sapiens
actgggtttctagc

SEQ ID NO: 1521533 - DNA, 20 bp, Homo sapiens
actgggtttctctgtatagt

SEQ ID NO: 1521534 - DNA, 19 bp, Homo sapiens
actgggtttggaccccagc

SEQ ID NO: 1521535 - DNA, 22 bp, Homo sapiens
actgggtttggaccccagctgg

SEQ ID NO: 1521536 - DNA, 23 bp, Homo sapiens
actgggtttggaccccagctggg

SEQ ID NO: 1521537 - DNA, 13 bp, Homo sapiens
actggtaaatgtt

SEQ ID NO: 1521538 - DNA, 16 bp, Homo sapiens
actggtaattgtacaa

SEQ ID NO: 1521539 - DNA, 20 bp, Homo sapiens
actggtaattgtacaatact

SEQ ID NO: 1521540 - DNA, 14 bp, Homo sapiens
actggtacttcctt

SEQ ID NO: 1521541 - DNA, 21 bp, Homo sapiens
actggtccaaaagattgctga

SEQ ID NO: 1521542 - DNA, 12 bp, Homo sapiens
actggtccagct

SEQ ID NO: 1521543 - DNA, 14 bp, Homo sapiens
actggtccagctct

SEQ ID NO: 1521544 - DNA, 22 bp, Homo sapiens
actggtccaggtcttcagtttc

SEQ ID NO: 1521545 - DNA, 18 bp, Homo sapiens
actggtgcgaccccccac

SEQ ID NO: 1521546 - DNA, 19 bp, Homo sapiens
actggtgtttgaaagtagg

SEQ ID NO: 1521547 - DNA, 13 bp, Homo sapiens
actggttgctgtg

SEQ ID NO: 1521548 - DNA, 22 bp, Homo sapiens
actggttggctcccgcggtgcc

SEQ ID NO: 1521549 - DNA, 20 bp, Homo sapiens
actggtttatccacccacaa

SEQ ID NO: 1521550 - DNA, 16 bp, Homo sapiens
actgtaaaatgcaaaa

SEQ ID NO: 1521551 - DNA, 16 bp, Homo sapiens
actgtaaaatgtggga

SEQ ID NO: 1521552 - DNA, 21 bp, Homo sapiens
actgtaaaatgtgggattatg

SEQ ID NO: 1521553 - DNA, 13 bp, Homo sapiens
actgtaaagatgt

SEQ ID NO: 1521554 - DNA, 22 bp, Homo sapiens
actgtaaataaaatgtgtacag

SEQ ID NO: 1521555 - DNA, 16 bp, Homo sapiens
actgtaaatatgaatc

SEQ ID NO: 1521556 - DNA, 11 bp, Homo sapiens
actgtaaatca

SEQ ID NO: 1521557 - DNA, 12 bp, Homo sapiens
actgtaaatcat

SEQ ID NO: 1521558 - DNA, 16 bp, Homo sapiens
actgtaaatgccttgc

SEQ ID NO: 1521559 - DNA, 13 bp, Homo sapiens
actgtaaattttt

SEQ ID NO: 1521560 - DNA, 12 bp, Homo sapiens
actgtaacctga

SEQ ID NO: 1521561 - DNA, 13 bp, Homo sapiens
actgtaacctgat

SEQ ID NO: 1521562 - DNA, 10 bp, Homo sapiens
actgtaatga

SEQ ID NO: 1521563 - DNA, 15 bp, Homo sapiens
actgtaatgggtaat

SEQ ID NO: 1521564 - DNA, 19 bp, Homo sapiens
actgtaatgggtaattctg

SEQ ID NO: 1521565 - DNA, 21 bp, Homo sapiens
actgtaatgggtaattctgac

SEQ ID NO: 1521566 - DNA, 17 bp, Homo sapiens
actgtaattatttgaat

SEQ ID NO: 1521567 - DNA, 17 bp, Homo sapiens
actgtacattgtgagct

SEQ ID NO: 1521568 - DNA, 19 bp, Homo sapiens
actgtacattgtgagctct

SEQ ID NO: 1521569 - DNA, 15 bp, Homo sapiens
actgtacatttaaaa

SEQ ID NO: 1521570 - DNA, 13 bp, Homo sapiens
actgtactgcatg

SEQ ID NO: 1521571 - DNA, 16 bp, Homo sapiens
actgtactgcatgtga

SEQ ID NO: 1521572 - DNA, 22 bp, Homo sapiens
actgtactttgccatttttcta

SEQ ID NO: 1521573 - DNA, 22 bp, Homo sapiens
actgtagaagaagcccatatca

SEQ ID NO: 1521574 - DNA, 20 bp, Homo sapiens
actgtagaatgatttcatgc

SEQ ID NO: 1521575 - DNA, 15 bp, Homo sapiens
actgtagatgatgta

SEQ ID NO: 1521576 - DNA, 17 bp, Homo sapiens
actgtagattgcttctg

SEQ ID NO: 1521577 - DNA, 22 bp, Homo sapiens
actgtagattgcttctgtagta

SEQ ID NO: 1521578 - DNA, 15 bp, Homo sapiens
actgtaggattcaag

SEQ ID NO: 1521579 - DNA, 21 bp, Homo sapiens
actgtagtttagttctgttga

SEQ ID NO: 1521580 - DNA, 15 bp, Homo sapiens
actgtatagacatgc

SEQ ID NO: 1521581 - DNA, 14 bp, Homo sapiens
actgtatataaaca

SEQ ID NO: 1521582 - DNA, 14 bp, Homo sapiens
actgtatataaact

SEQ ID NO: 1521583 - DNA, 13 bp, Homo sapiens
actgtatatgtat

SEQ ID NO: 1521584 - DNA, 17 bp, Homo sapiens
actgtatcaaatctgta

SEQ ID NO: 1521585 - DNA, 12 bp, Homo sapiens
actgtatctaaa

SEQ ID NO: 1521586 - DNA, 17 bp, Homo sapiens
actgtatctaaaaaata

SEQ ID NO: 1521587 - DNA, 14 bp, Homo sapiens
actgtattaaatct

SEQ ID NO: 1521588 - DNA, 22 bp, Homo sapiens
actgtattaaatcttaaacaat

SEQ ID NO: 1521589 - DNA, 21 bp, Homo sapiens
actgtattaagagtgaaaatt

SEQ ID NO: 1521590 - DNA, 20 bp, Homo sapiens
actgtattagagcgccagct

SEQ ID NO: 1521591 - DNA, 17 bp, Homo sapiens
actgtatttaagaaaac

SEQ ID NO: 1521592 - DNA, 18 bp, Homo sapiens
actgtatttaagaaaaca

SEQ ID NO: 1521593 - DNA, 20 bp, Homo sapiens
actgtatttttacctttttc

SEQ ID NO: 1521594 - DNA, 15 bp, Homo sapiens
actgtcaataaacag

SEQ ID NO: 1521595 - DNA, 18 bp, Homo sapiens
actgtcaataaacagctt

SEQ ID NO: 1521596 - DNA, 14 bp, Homo sapiens
actgtcactcattg

SEQ ID NO: 1521597 - DNA, 23 bp, Homo sapiens
actgtcactcattgctgagcctc

SEQ ID NO: 1521598 - DNA, 13 bp, Homo sapiens
actgtcactgccg

SEQ ID NO: 1521599 - DNA, 18 bp, Homo sapiens
actgtcagagaatatgac

SEQ ID NO: 1521600 - DNA, 18 bp, Homo sapiens
actgtcagccgggccctg

SEQ ID NO: 1521601 - DNA, 13 bp, Homo sapiens
actgtcagctgag

SEQ ID NO: 1521602 - DNA, 16 bp, Homo sapiens
actgtcaggaagaaat

SEQ ID NO: 1521603 - DNA, 23 bp, Homo sapiens
actgtcagtggggcagcctctcc

SEQ ID NO: 1521604 - DNA, 18 bp, Homo sapiens
actgtcagttctctggga

SEQ ID NO: 1521605 - DNA, 13 bp, Homo sapiens
actgtcatagaaa

SEQ ID NO: 1521606 - DNA, 12 bp, Homo sapiens
actgagcatcac

SEQ ID NO: 1521607 - DNA, 21 bp, Homo sapiens
actgagcatcactagtgacaa

SEQ ID NO: 1521608 - DNA, 20 bp, Homo sapiens
actgagccagtcccaggggc

SEQ ID NO: 1521609 - DNA, 13 bp, Homo sapiens
actgagccccccc

SEQ ID NO: 1521610 - DNA, 14 bp, Homo sapiens
actgagcctgttca

SEQ ID NO: 1521611 - DNA, 14 bp, Homo sapiens
actgagccttgtaa

SEQ ID NO: 1521612 - DNA, 16 bp, Homo sapiens
actgagctctccaggc

SEQ ID NO: 1521613 - DNA, 18 bp, Homo sapiens
actgagctctccaggcca

SEQ ID NO: 1521614 - DNA, 21 bp, Homo sapiens
actgagctctccaggccaggt

SEQ ID NO: 1521615 - DNA, 15 bp, Homo sapiens
actgagctgggggaa

SEQ ID NO: 1521616 - DNA, 16 bp, Homo sapiens
actgagcttagagtat

SEQ ID NO: 1521617 - DNA, 16 bp, Homo sapiens
actgaggaattttctt

SEQ ID NO: 1521618 - DNA, 20 bp, Homo sapiens
actgaggaattttctttgtg

SEQ ID NO: 1521619 - DNA, 15 bp, Homo sapiens
actgaggagacagaa

SEQ ID NO: 1521620 - DNA, 20 bp, Homo sapiens
actgaggagatgaccaggga

SEQ ID NO: 1521621 - DNA, 15 bp, Homo sapiens
actgaggcagacagc

SEQ ID NO: 1521622 - DNA, 22 bp, Homo sapiens
actgaggcagacagcagctcag

SEQ ID NO: 1521623 - DNA, 13 bp, Homo sapiens
actgaggcctgag

SEQ ID NO: 1521624 - DNA, 13 bp, Homo sapiens
actgaggcctgct

SEQ ID NO: 1521625 - DNA, 15 bp, Homo sapiens
actgaggcctgcttc

SEQ ID NO: 1521626 - DNA, 14 bp, Homo sapiens
actgaggccttgtg

SEQ ID NO: 1521627 - DNA, 20 bp, Homo sapiens
actgagggaccaactgggcc

SEQ ID NO: 1521628 - DNA, 14 bp, Homo sapiens
actgagggcagtgc

SEQ ID NO: 1521629 - DNA, 22 bp, Homo sapiens
actgagggccacactattacca

SEQ ID NO: 1521630 - DNA, 19 bp, Homo sapiens
actgaggtataaagacaag

SEQ ID NO: 1521631 - DNA, 22 bp, Homo sapiens
actgagtcatcttgtgagtgga

SEQ ID NO: 1521632 - DNA, 18 bp, Homo sapiens
actgagtcccctccagga

SEQ ID NO: 1521633 - DNA, 13 bp, Homo sapiens
actgagtgggaag

SEQ ID NO: 1521634 - DNA, 18 bp, Homo sapiens
actgagttatcaggtgca

SEQ ID NO: 1521635 - DNA, 21 bp, Homo sapiens
actgataaacctaatattcaa

SEQ ID NO: 1521636 - DNA, 16 bp, Homo sapiens
actgataacaaccttt

SEQ ID NO: 1521637 - DNA, 19 bp, Homo sapiens
actgatagcttacactgag

SEQ ID NO: 1521638 - DNA, 22 bp, Homo sapiens
actgatagcttacactgaggac

SEQ ID NO: 1521639 - DNA, 16 bp, Homo sapiens
actgatatattttaca

SEQ ID NO: 1521640 - DNA, 21 bp, Homo sapiens
actgcgcaggtctcttctggg

SEQ ID NO: 1521641 - DNA, 23 bp, Homo sapiens
actgcgggagctctgtatggtca

SEQ ID NO: 1521642 - DNA, 14 bp, Homo sapiens
actgcgttctgcaa

SEQ ID NO: 1521643 - DNA, 20 bp, Homo sapiens
actgcgttctgcaagcatca

SEQ ID NO: 1521644 - DNA, 18 bp, Homo sapiens
actgctaagtatttccca

SEQ ID NO: 1521645 - DNA, 19 bp, Homo sapiens
actgctaagtatttcccag

SEQ ID NO: 1521646 - DNA, 23 bp, Homo sapiens
actgctacaaatactcttaggaa

SEQ ID NO: 1521647 - DNA, 14 bp, Homo sapiens
actgctacagcaat

SEQ ID NO: 1521648 - DNA, 18 bp, Homo sapiens
actgctcaagaagacatg

SEQ ID NO: 1521649 - DNA, 15 bp, Homo sapiens
actgctcacgtctct

SEQ ID NO: 1521650 - DNA, 17 bp, Homo sapiens
actgctcacgtctctgc

SEQ ID NO: 1521651 - DNA, 18 bp, Homo sapiens
actgctcacgtctctgcc

SEQ ID NO: 1521652 - DNA, 22 bp, Homo sapiens
actgctcagaacttgctgctgt

SEQ ID NO: 1521653 - DNA, 13 bp, Homo sapiens
actgctcctcctc

SEQ ID NO: 1521654 - DNA, 17 bp, Homo sapiens
actgctcctgtggcagg

SEQ ID NO: 1521655 - DNA, 14 bp, Homo sapiens
actgctctcagcct

SEQ ID NO: 1521656 - DNA, 16 bp, Homo sapiens
actgctctcagcctcc

SEQ ID NO: 1521657 - DNA, 17 bp, Homo sapiens
actgctctcagcctccc

SEQ ID NO: 1521658 - DNA, 20 bp, Homo sapiens
actgctctcagcctcccaac

SEQ ID NO: 1521659 - DNA, 15 bp, Homo sapiens
actgctcttgtttct

SEQ ID NO: 1521660 - DNA, 20 bp, Homo sapiens
actgctctttcatagtataa

SEQ ID NO: 1521661 - DNA, 15 bp, Homo sapiens
actgctgagccactc

SEQ ID NO: 1521662 - DNA, 16 bp, Homo sapiens
actgctgagccactcg

SEQ ID NO: 1521663 - DNA, 15 bp, Homo sapiens
actgctgattcttgt

SEQ ID NO: 1521664 - DNA, 20 bp, Homo sapiens
actgctgattcttgtaaatc

SEQ ID NO: 1521665 - DNA, 23 bp, Homo sapiens
actgctgattcttgtaaatcttt

SEQ ID NO: 1521666 - DNA, 15 bp, Homo sapiens
actgctgcaaggtgg

SEQ ID NO: 1521667 - DNA, 17 bp, Homo sapiens
actgctgcaaggtggcc

SEQ ID NO: 1521668 - DNA, 15 bp, Homo sapiens
actgctgcagattag

SEQ ID NO: 1521669 - DNA, 20 bp, Homo sapiens
actgctgcttcatgtttgcc

SEQ ID NO: 1521670 - DNA, 14 bp, Homo sapiens
actgctggacatga

SEQ ID NO: 1521671 - DNA, 13 bp, Homo sapiens
actgctggctgcc

SEQ ID NO: 1521672 - DNA, 12 bp, Homo sapiens
actgctggggag

SEQ ID NO: 1521673 - DNA, 22 bp, Homo sapiens
actgctgtaaataaatgcttta

SEQ ID NO: 1521674 - DNA, 15 bp, Homo sapiens
actgctgttttatgt

SEQ ID NO: 1521675 - DNA, 16 bp, Homo sapiens
actgcttcccactggg

SEQ ID NO: 1521676 - DNA, 17 bp, Homo sapiens
actgcttcccactgggg

SEQ ID NO: 1521677 - DNA, 17 bp, Homo sapiens
actgcttcccatcctac

SEQ ID NO: 1521678 - DNA, 20 bp, Homo sapiens
actgcttcccatcctaccct

SEQ ID NO: 1521679 - DNA, 17 bp, Homo sapiens
actgcttctcttttgaa

SEQ ID NO: 1521680 - DNA, 18 bp, Homo sapiens
actgcttcttatggtggt

SEQ ID NO: 1521681 - DNA, 21 bp, Homo sapiens
actgcttcttggagctttgga

SEQ ID NO: 1521682 - DNA, 20 bp, Homo sapiens
actgcttggatccatacaaa

SEQ ID NO: 1521683 - DNA, 21 bp, Homo sapiens
actgctttgcaccgtggtcag

SEQ ID NO: 1521684 - DNA, 16 bp, Homo sapiens
actgcttttaaatgac

SEQ ID NO: 1521685 - DNA, 20 bp, Homo sapiens
actgcttttcctcaagcaat

SEQ ID NO: 1521686 - DNA, 21 bp, Homo sapiens
actgcttttcctcaagcaata

SEQ ID NO: 1521687 - DNA, 22 bp, Homo sapiens
actgcttttcctcaagcaataa

SEQ ID NO: 1521688 - DNA, 21 bp, Homo sapiens
actgcttttttttttccagca

SEQ ID NO: 1521689 - DNA, 18 bp, Homo sapiens
actggaaaacagaacact

SEQ ID NO: 1521690 - DNA, 17 bp, Homo sapiens
actggaaaggggagagc

SEQ ID NO: 1521691 - DNA, 20 bp, Homo sapiens
actggaaaggggagagcctg

SEQ ID NO: 1521692 - DNA, 22 bp, Homo sapiens
actggaaaggggagagcctgct

SEQ ID NO: 1521693 - DNA, 23 bp, Homo sapiens
actggaaaggggagagcctgctg

SEQ ID NO: 1521694 - DNA, 18 bp, Homo sapiens
actggaaatgtagcactt

SEQ ID NO: 1521695 - DNA, 19 bp, Homo sapiens
actggaaatgtagcactta

SEQ ID NO: 1521696 - DNA, 17 bp, Homo sapiens
actggaacatggctagc

SEQ ID NO: 1521697 - DNA, 21 bp, Homo sapiens
actggaagacacttcagatct

SEQ ID NO: 1521698 - DNA, 14 bp, Homo sapiens
actggaaggagcac

SEQ ID NO: 1521699 - DNA, 19 bp, Homo sapiens
actggaaggagcacatact

SEQ ID NO: 1521700 - DNA, 13 bp, Homo sapiens
actggaagttgtg

SEQ ID NO: 1521701 - DNA, 21 bp, Homo sapiens
actggaagttgtggatatcag

SEQ ID NO: 1521702 - DNA, 17 bp, Homo sapiens
actggaagttttgcatt

SEQ ID NO: 1521703 - DNA, 18 bp, Homo sapiens
actggaattcttctgcaa

SEQ ID NO: 1521704 - DNA, 16 bp, Homo sapiens
actggaccgctgactg

SEQ ID NO: 1521705 - DNA, 12 bp, Homo sapiens
actggactcagg

SEQ ID NO: 1521706 - DNA, 17 bp, Homo sapiens
actggactcaggaactt

SEQ ID NO: 1521707 - DNA, 14 bp, Homo sapiens
actggactcaggat

SEQ ID NO: 1521708 - DNA, 20 bp, Homo sapiens
actggactcaggatgcccag

SEQ ID NO: 1521709 - DNA, 14 bp, Homo sapiens
actggactgcatgg

SEQ ID NO: 1521710 - DNA, 15 bp, Homo sapiens
actggactgcatggg

SEQ ID NO: 1521711 - DNA, 12 bp, Homo sapiens
actggagcccag

SEQ ID NO: 1521712 - DNA, 13 bp, Homo sapiens
actggagcccagg

SEQ ID NO: 1521713 - DNA, 21 bp, Homo sapiens
actggagcttttaaaaatgtt

SEQ ID NO: 1521714 - DNA, 14 bp, Homo sapiens
actggaggagcagc

SEQ ID NO: 1521715 - DNA, 21 bp, Homo sapiens
actggaggcccctggagccag

SEQ ID NO: 1521716 - DNA, 22 bp, Homo sapiens
actggaggcccctggagccaga

SEQ ID NO: 1521717 - DNA, 17 bp, Homo sapiens
actggaggttgaagcca

SEQ ID NO: 1521718 - DNA, 18 bp, Homo sapiens
actggaggttgaagccaa

SEQ ID NO: 1521719 - DNA, 17 bp, Homo sapiens
actggagtccagtctct

SEQ ID NO: 1521720 - DNA, 18 bp, Homo sapiens
actggagtgcagggagga

SEQ ID NO: 1521721 - DNA, 16 bp, Homo sapiens
actggagttacattaa

SEQ ID NO: 1521722 - DNA, 15 bp, Homo sapiens
actggagttccttat

SEQ ID NO: 1521723 - DNA, 22 bp, Homo sapiens
actggatatttcaatcttttaa

SEQ ID NO: 1521724 - DNA, 17 bp, Homo sapiens
actcttcagttaattct

SEQ ID NO: 1521725 - DNA, 18 bp, Homo sapiens
actcttccgatgtttgtg

SEQ ID NO: 1521726 - DNA, 16 bp, Homo sapiens
actcttctaaaacttg

SEQ ID NO: 1521727 - DNA, 20 bp, Homo sapiens
actcttcttaacttaaattt

SEQ ID NO: 1521728 - DNA, 15 bp, Homo sapiens
actcttcttgaaatt

SEQ ID NO: 1521729 - DNA, 19 bp, Homo sapiens
actcttcttgaaattttaa

SEQ ID NO: 1521730 - DNA, 15 bp, Homo sapiens
actcttgaagtccag

SEQ ID NO: 1521731 - DNA, 13 bp, Homo sapiens
actcttgatctct

SEQ ID NO: 1521732 - DNA, 16 bp, Homo sapiens
actcttgatctctctt

SEQ ID NO: 1521733 - DNA, 16 bp, Homo sapiens
actcttggctattgaa

SEQ ID NO: 1521734 - DNA, 18 bp, Homo sapiens
actcttgtcatttttaat

SEQ ID NO: 1521735 - DNA, 19 bp, Homo sapiens
actcttgtcatttttaata

SEQ ID NO: 1521736 - DNA, 20 bp, Homo sapiens
actctttatttctagcagag

SEQ ID NO: 1521737 - DNA, 21 bp, Homo sapiens
actctttatttctagcagagt

SEQ ID NO: 1521738 - DNA, 20 bp, Homo sapiens
actctttgggtccattcaga

SEQ ID NO: 1521739 - DNA, 20 bp, Homo sapiens
actcttttaagatcttgtta

SEQ ID NO: 1521740 - DNA, 22 bp, Homo sapiens
actcttttaagatcttgttaaa

SEQ ID NO: 1521741 - DNA, 20 bp, Homo sapiens
actcttttaattgaaattaa

SEQ ID NO: 1521742 - DNA, 18 bp, Homo sapiens
actctttttgttttttgt

SEQ ID NO: 1521743 - DNA, 20 bp, Homo sapiens
actcttttttcatggacact

SEQ ID NO: 1521744 - DNA, 22 bp, Homo sapiens
actctttttttgagtgacagct

SEQ ID NO: 1521745 - DNA, 23 bp, Homo sapiens
actgaaaaaaaaaaagaagaaga

SEQ ID NO: 1521746 - DNA, 14 bp, Homo sapiens
actgaaaaaatata

SEQ ID NO: 1521747 - DNA, 16 bp, Homo sapiens
actgaaaaaatatatg

SEQ ID NO: 1521748 - DNA, 16 bp, Homo sapiens
actgaaaacttagcca

SEQ ID NO: 1521749 - DNA, 17 bp, Homo sapiens
actgaaaacttagccag

SEQ ID NO: 1521750 - DNA, 14 bp, Homo sapiens
actgaaaagaagga

SEQ ID NO: 1521751 - DNA, 19 bp, Homo sapiens
actgaaaataccatcaggc

SEQ ID NO: 1521752 - DNA, 19 bp, Homo sapiens
actgaaaatgtgctatact

SEQ ID NO: 1521753 - DNA, 22 bp, Homo sapiens
actgaaaattcgaaccaggaaa

SEQ ID NO: 1521754 - DNA, 14 bp, Homo sapiens
actgaaacagattt

SEQ ID NO: 1521755 - DNA, 18 bp, Homo sapiens
actgaaacagatttcata

SEQ ID NO: 1521756 - DNA, 13 bp, Homo sapiens
actgaaaccattt

SEQ ID NO: 1521757 - DNA, 13 bp, Homo sapiens
actgaaacctctg

SEQ ID NO: 1521758 - DNA, 17 bp, Homo sapiens
actgaaacctctgcctt

SEQ ID NO: 1521759 - DNA, 12 bp, Homo sapiens
cggctgcagagg

SEQ ID NO: 1521760 - DNA, 12 bp, Homo sapiens
cggctgcctgcc

SEQ ID NO: 1521761 - DNA, 13 bp, Homo sapiens
cggctgcctgccg

SEQ ID NO: 1521762 - DNA, 14 bp, Homo sapiens
cggctgcctgccgc

SEQ ID NO: 1521763 - DNA, 14 bp, Homo sapiens
cggctgctcaagcc

SEQ ID NO: 1521764 - DNA, 12 bp, Homo sapiens
cggctggagaaa

SEQ ID NO: 1521765 - DNA, 14 bp, Homo sapiens
cggctgggcctcct

SEQ ID NO: 1521766 - DNA, 22 bp, Homo sapiens
cggctgggcctccttcttccac

SEQ ID NO: 1521767 - DNA, 14 bp, Homo sapiens
cggctgggtctgtg

SEQ ID NO: 1521768 - DNA, 16 bp, Homo sapiens
cggctggtcactctgc

SEQ ID NO: 1521769 - DNA, 15 bp, Homo sapiens
cggctggtgcagggc

SEQ ID NO: 1521770 - DNA, 22 bp, Homo sapiens
cggctggttttgtaagatgctg

SEQ ID NO: 1521771 - DNA, 22 bp, Homo sapiens
cggctgtggaccgtggacaggc

SEQ ID NO: 1521772 - DNA, 23 bp, Homo sapiens
cggcttagacttcgactcaggat

SEQ ID NO: 1521773 - DNA, 15 bp, Homo sapiens
cggcttcactgacca

SEQ ID NO: 1521774 - DNA, 16 bp, Homo sapiens
cggcttcatgccagct

SEQ ID NO: 1521775 - DNA, 15 bp, Homo sapiens
cggcttcctttccca

SEQ ID NO: 1521776 - DNA, 19 bp, Homo sapiens
cggcttcctttcccaagcc

SEQ ID NO: 1521777 - DNA, 19 bp, Homo sapiens
cggcttggatcctgggctg

SEQ ID NO: 1521778 - DNA, 18 bp, Homo sapiens
cggcttgttcttgcagca

SEQ ID NO: 1521779 - DNA, 20 bp, Homo sapiens
cgggaacagtgtttcccata

SEQ ID NO: 1521780 - DNA, 13 bp, Homo sapiens
cgggaagcagcca

SEQ ID NO: 1521781 - DNA, 22 bp, Homo sapiens
cgggaagcagccagctccccac

SEQ ID NO: 1521782 - DNA, 13 bp, Homo sapiens
cgggacagacctg

SEQ ID NO: 1521783 - DNA, 22 bp, Homo sapiens
cgggacatcacagggtgggcct

SEQ ID NO: 1521784 - DNA, 17 bp, Homo sapiens
cgggaccacagctgctg

SEQ ID NO: 1521785 - DNA, 23 bp, Homo sapiens
cgggaccacagctgctggccagg

SEQ ID NO: 1521786 - DNA, 18 bp, Homo sapiens
cgggaccaccctgagccg

SEQ ID NO: 1521787 - DNA, 14 bp, Homo sapiens
cgggaccagctcac

SEQ ID NO: 1521788 - DNA, 17 bp, Homo sapiens
cgggaccattgacctca

SEQ ID NO: 1521789 - DNA, 18 bp, Homo sapiens
cgggaccattgacctcag

SEQ ID NO: 1521790 - DNA, 17 bp, Homo sapiens
cgggacccggcggccct

SEQ ID NO: 1521791 - DNA, 15 bp, Homo sapiens
cgggagaagccacct

SEQ ID NO: 1521792 - DNA, 16 bp, Homo sapiens
cgggagaaggcatgag

SEQ ID NO: 1521793 - DNA, 17 bp, Homo sapiens
cgggagcacccagagca

SEQ ID NO: 1521794 - DNA, 18 bp, Homo sapiens
cgggagcacccagagcac

SEQ ID NO: 1521795 - DNA, 20 bp, Homo sapiens
cgggagcagtgtcttccata

SEQ ID NO: 1521796 - DNA, 22 bp, Homo sapiens
cgggagcatctcttgaggccag

SEQ ID NO: 1521797 - DNA, 22 bp, Homo sapiens
cgggagcattggcccctgagcc

SEQ ID NO: 1521798 - DNA, 18 bp, Homo sapiens
cgggagctctgtatggtc

SEQ ID NO: 1521799 - DNA, 18 bp, Homo sapiens
cgggaggagcagcccggg

SEQ ID NO: 1521800 - DNA, 16 bp, Homo sapiens
cgggaggcaccagctc

SEQ ID NO: 1521801 - DNA, 18 bp, Homo sapiens
cgggaggcaccagctctg

SEQ ID NO: 1521802 - DNA, 19 bp, Homo sapiens
cgggaggcaccagctctgt

SEQ ID NO: 1521803 - DNA, 15 bp, Homo sapiens
cgggatattatagaa

SEQ ID NO: 1521804 - DNA, 23 bp, Homo sapiens
cgggatgattgcttgagctcagg

SEQ ID NO: 1521805 - DNA, 19 bp, Homo sapiens
cgggatgccgttctgttcc

SEQ ID NO: 1521806 - DNA, 20 bp, Homo sapiens
cgggatgccgttctgttcca

SEQ ID NO: 1521807 - DNA, 16 bp, Homo sapiens
cgggatggtcctgggg

SEQ ID NO: 1521808 - DNA, 14 bp, Homo sapiens
cgggcacagacacg

SEQ ID NO: 1521809 - DNA, 12 bp, Homo sapiens
cgggcacagggc

SEQ ID NO: 1521810 - DNA, 17 bp, Homo sapiens
cgggcacagggcaccag

SEQ ID NO: 1521811 - DNA, 20 bp, Homo sapiens
cgggcacagggcaccagagg

SEQ ID NO: 1521812 - DNA, 14 bp, Homo sapiens
cgggcaccagccag

SEQ ID NO: 1521813 - DNA, 19 bp, Homo sapiens
cgggcacctatagtcccag

SEQ ID NO: 1521814 - DNA, 14 bp, Homo sapiens
cgggcacctgtagt

SEQ ID NO: 1521815 - DNA, 15 bp, Homo sapiens
cgggcagagggctgg

SEQ ID NO: 1521816 - DNA, 23 bp, Homo sapiens
cgggcagagggctggaggcccag

SEQ ID NO: 1521817 - DNA, 15 bp, Homo sapiens
cgggcagccagcaga

SEQ ID NO: 1521818 - DNA, 14 bp, Homo sapiens
cgggcagcgggcca

SEQ ID NO: 1521819 - DNA, 16 bp, Homo sapiens
cgggcagggctcccac

SEQ ID NO: 1521820 - DNA, 17 bp, Homo sapiens
cgggcagggctcccaca

SEQ ID NO: 1521821 - DNA, 16 bp, Homo sapiens
cgggcagtggaggctg

SEQ ID NO: 1521822 - DNA, 19 bp, Homo sapiens
cgggcagtggaggctgctg

SEQ ID NO: 1521823 - DNA, 21 bp, Homo sapiens
cgggcagtggaggctgctgtg

SEQ ID NO: 1521824 - DNA, 17 bp, Homo sapiens
cgggcatggtggcaggc

SEQ ID NO: 1521825 - DNA, 21 bp, Homo sapiens
cgggcatggtggctcatgcct

SEQ ID NO: 1521826 - DNA, 16 bp, Homo sapiens
cgggccaagtgaagaa

SEQ ID NO: 1521827 - DNA, 13 bp, Homo sapiens
cgggccagccagg

SEQ ID NO: 1521828 - DNA, 16 bp, Homo sapiens
cgggccagccaggcgg

SEQ ID NO: 1521829 - DNA, 23 bp, Homo sapiens
cgggccagccaggcgggctcaag

SEQ ID NO: 1521830 - DNA, 18 bp, Homo sapiens
cgggccaggcccgcaccc

SEQ ID NO: 1521831 - DNA, 10 bp, Homo sapiens
cgggccaggg

SEQ ID NO: 1521832 - DNA, 18 bp, Homo sapiens
cgggccagggctgcccct

SEQ ID NO: 1521833 - DNA, 15 bp, Homo sapiens
cgggcccctgggctt

SEQ ID NO: 1521834 - DNA, 11 bp, Homo sapiens
cgggccctccc

SEQ ID NO: 1521835 - DNA, 17 bp, Homo sapiens
cgggccctcccttggaa

SEQ ID NO: 1521836 - DNA, 18 bp, Homo sapiens
cgggccctctgtagctcc

SEQ ID NO: 1521837 - DNA, 15 bp, Homo sapiens
cgggccgaggcccag

SEQ ID NO: 1521838 - DNA, 22 bp, Homo sapiens
cgggccgtaggggctcctgagt

SEQ ID NO: 1521839 - DNA, 12 bp, Homo sapiens
cgggcctcccac

SEQ ID NO: 1521840 - DNA, 13 bp, Homo sapiens
cgggcctggacaa

SEQ ID NO: 1521841 - DNA, 14 bp, Homo sapiens
cgggcctgggcctc

SEQ ID NO: 1521842 - DNA, 17 bp, Homo sapiens
cgggcgctcgctcaggt

SEQ ID NO: 1521843 - DNA, 13 bp, Homo sapiens
cgggcgctgcagc

SEQ ID NO: 1521844 - DNA, 14 bp, Homo sapiens
cgggcgctgcagcc

SEQ ID NO: 1521845 - DNA, 13 bp, Homo sapiens
cgggctccagcca

SEQ ID NO: 1521846 - DNA, 18 bp, Homo sapiens
cgggctccagccatctca

SEQ ID NO: 1521847 - DNA, 14 bp, Homo sapiens
cgggctccttcccc

SEQ ID NO: 1521848 - DNA, 23 bp, Homo sapiens
cgggctccttcccctgcacctgg

SEQ ID NO: 1521849 - DNA, 18 bp, Homo sapiens
cgggctctggccaccctg

SEQ ID NO: 1521850 - DNA, 16 bp, Homo sapiens
cgggctggcctgtgcc

SEQ ID NO: 1521851 - DNA, 17 bp, Homo sapiens
cgggctggcctgtgcct

SEQ ID NO: 1521852 - DNA, 16 bp, Homo sapiens
cgggcttcccttctcc

SEQ ID NO: 1521853 - DNA, 17 bp, Homo sapiens
cgggcttgggccctgca

SEQ ID NO: 1521854 - DNA, 12 bp, Homo sapiens
cggggaccctgt

SEQ ID NO: 1521855 - DNA, 14 bp, Homo sapiens
cggggatggatctt

SEQ ID NO: 1521856 - DNA, 18 bp, Homo sapiens
cggggatggatcttttct

SEQ ID NO: 1521857 - DNA, 17 bp, Homo sapiens
cggggcatgctggggca

SEQ ID NO: 1521858 - DNA, 19 bp, Homo sapiens
cggggcatgctggggcaag

SEQ ID NO: 1521859 - DNA, 21 bp, Homo sapiens
actcgccatttcctcacgtgc

SEQ ID NO: 1521860 - DNA, 15 bp, Homo sapiens
actcgcccgcccact

SEQ ID NO: 1521861 - DNA, 13 bp, Homo sapiens
actcgcctcagcc

SEQ ID NO: 1521862 - DNA, 17 bp, Homo sapiens
actcgcctcagcctgat

SEQ ID NO: 1521863 - DNA, 21 bp, Homo sapiens
actcgggaggctgaggcagga

SEQ ID NO: 1521864 - DNA, 13 bp, Homo sapiens
actcgggtgcgtg

SEQ ID NO: 1521865 - DNA, 17 bp, Homo sapiens
actcggtgtgtggccgc

SEQ ID NO: 1521866 - DNA, 16 bp, Homo sapiens
actcgttacctgccgc

SEQ ID NO: 1521867 - DNA, 23 bp, Homo sapiens
actcgttctgttacccagggctc

SEQ ID NO: 1521868 - DNA, 12 bp, Homo sapiens
actctaaaagat

SEQ ID NO: 1521869 - DNA, 14 bp, Homo sapiens
actctaaaagatcc

SEQ ID NO: 1521870 - DNA, 15 bp, Homo sapiens
actctaaaagatcct

SEQ ID NO: 1521871 - DNA, 13 bp, Homo sapiens
actctaaatgcag

SEQ ID NO: 1521872 - DNA, 19 bp, Homo sapiens
actctaaccagtgtacagg

SEQ ID NO: 1521873 - DNA, 20 bp, Homo sapiens
actctaagatcttagattct

SEQ ID NO: 1521874 - DNA, 21 bp, Homo sapiens
actctaagatcttagattctc

SEQ ID NO: 1521875 - DNA, 16 bp, Homo sapiens
actctaagctggagct

SEQ ID NO: 1521876 - DNA, 14 bp, Homo sapiens
actctaatagtgct

SEQ ID NO: 1521877 - DNA, 16 bp, Homo sapiens
actctacccctgctcc

SEQ ID NO: 1521878 - DNA, 23 bp, Homo sapiens
actctacccctgctcccattcct

SEQ ID NO: 1521879 - DNA, 13 bp, Homo sapiens
actctaccctccc

SEQ ID NO: 1521880 - DNA, 17 bp, Homo sapiens
actctagaacatgcaca

SEQ ID NO: 1521881 - DNA, 20 bp, Homo sapiens
actctagaacatgcacattt

SEQ ID NO: 1521882 - DNA, 10 bp, Homo sapiens
actctagaag

SEQ ID NO: 1521883 - DNA, 20 bp, Homo sapiens
actctagacaagatattgta

SEQ ID NO: 1521884 - DNA, 15 bp, Homo sapiens
actctagagagcctt

SEQ ID NO: 1521885 - DNA, 16 bp, Homo sapiens
actctagagagcctta

SEQ ID NO: 1521886 - DNA, 19 bp, Homo sapiens
actctagagagccttaact

SEQ ID NO: 1521887 - DNA, 21 bp, Homo sapiens
actctagagagccttaacttc

SEQ ID NO: 1521888 - DNA, 14 bp, Homo sapiens
actctagattccat

SEQ ID NO: 1521889 - DNA, 18 bp, Homo sapiens
actctatagactctagga

SEQ ID NO: 1521890 - DNA, 20 bp, Homo sapiens
actctatatgtagtgcattt

SEQ ID NO: 1521891 - DNA, 12 bp, Homo sapiens
actctcaccatg

SEQ ID NO: 1521892 - DNA, 14 bp, Homo sapiens
actctcattcccca

SEQ ID NO: 1521893 - DNA, 16 bp, Homo sapiens
actctcattccccagg

SEQ ID NO: 1521894 - DNA, 17 bp, Homo sapiens
actctccaacctggaca

SEQ ID NO: 1521895 - DNA, 16 bp, Homo sapiens
actctccaatgttcta

SEQ ID NO: 1521896 - DNA, 13 bp, Homo sapiens
actctccatatcc

SEQ ID NO: 1521897 - DNA, 18 bp, Homo sapiens
ctcagcccgcttggccac

SEQ ID NO: 1521898 - DNA, 22 bp, Homo sapiens
ctcagccctagaggcgagccag

SEQ ID NO: 1521899 - DNA, 14 bp, Homo sapiens
ctcagccctccctg

SEQ ID NO: 1521900 - DNA, 11 bp, Homo sapiens
ctcagccctga

SEQ ID NO: 1521901 - DNA, 15 bp, Homo sapiens
ctcagccctgaggtg

SEQ ID NO: 1521902 - DNA, 18 bp, Homo sapiens
ctcagccctggccctgcc

SEQ ID NO: 1521903 - DNA, 21 bp, Homo sapiens
ctcagccctggccctgcccag

SEQ ID NO: 1521904 - DNA, 15 bp, Homo sapiens
ctcagccctgggccc

SEQ ID NO: 1521905 - DNA, 13 bp, Homo sapiens
ctcagcccttgcc

SEQ ID NO: 1521906 - DNA, 16 bp, Homo sapiens
ctcagcctcatcctga

SEQ ID NO: 1521907 - DNA, 14 bp, Homo sapiens
ctcagcctccaaag

SEQ ID NO: 1521908 - DNA, 20 bp, Homo sapiens
ctcagcctccaaagtggagc

SEQ ID NO: 1521909 - DNA, 21 bp, Homo sapiens
ctcagcctccaatgcattggc

SEQ ID NO: 1521910 - DNA, 15 bp, Homo sapiens
ctcagcctcccaaag

SEQ ID NO: 1521911 - DNA, 20 bp, Homo sapiens
ctcagcctccggagtagctg

SEQ ID NO: 1521912 - DNA, 13 bp, Homo sapiens
ctcagcctcctga

SEQ ID NO: 1521913 - DNA, 14 bp, Homo sapiens
ctcagcctctgcca

SEQ ID NO: 1521914 - DNA, 23 bp, Homo sapiens
ctcagcctgatcaggcttcctgg

SEQ ID NO: 1521915 - DNA, 16 bp, Homo sapiens
ctcagcctggccagac

SEQ ID NO: 1521916 - DNA, 19 bp, Homo sapiens
ctcagcctggccagacaca

SEQ ID NO: 1521917 - DNA, 12 bp, Homo sapiens
ctcagcctggtg

SEQ ID NO: 1521918 - DNA, 19 bp, Homo sapiens
ctcagcctggtgggcctcc

SEQ ID NO: 1521919 - DNA, 20 bp, Homo sapiens
ctcagcctggtgggcctcct

SEQ ID NO: 1521920 - DNA, 14 bp, Homo sapiens
ctcagcctgtgctg

SEQ ID NO: 1521921 - DNA, 19 bp, Homo sapiens
ctcagccttctcctcccaa

SEQ ID NO: 1521922 - DNA, 18 bp, Homo sapiens
ctcagccttgaaaaacaa

SEQ ID NO: 1521923 - DNA, 15 bp, Homo sapiens
ctcagccttgctgct

SEQ ID NO: 1521924 - DNA, 17 bp, Homo sapiens
ctcagccttgctgctct

SEQ ID NO: 1521925 - DNA, 21 bp, Homo sapiens
ctcagccttgctgctctgcgt

SEQ ID NO: 1521926 - DNA, 15 bp, Homo sapiens
ctcagcgagaggcag

SEQ ID NO: 1521927 - DNA, 13 bp, Homo sapiens
ctcagcgggggcc

SEQ ID NO: 1521928 - DNA, 22 bp, Homo sapiens
ctcagcgggggccttgaagact

SEQ ID NO: 1521929 - DNA, 15 bp, Homo sapiens
ctcagctaagctcac

SEQ ID NO: 1521930 - DNA, 23 bp, Homo sapiens
ctcagctagttggggagctaagg

SEQ ID NO: 1521931 - DNA, 18 bp, Homo sapiens
ctcagctattaagaaaat

SEQ ID NO: 1521932 - DNA, 15 bp, Homo sapiens
ctcagctcactgcaa

SEQ ID NO: 1521933 - DNA, 19 bp, Homo sapiens
ctcagctccaggtggctct

SEQ ID NO: 1521934 - DNA, 15 bp, Homo sapiens
ctcagctcccaggcc

SEQ ID NO: 1521935 - DNA, 16 bp, Homo sapiens
ctcagctcccaggcca

SEQ ID NO: 1521936 - DNA, 13 bp, Homo sapiens
ctcagctcctggg

SEQ ID NO: 1521937 - DNA, 13 bp, Homo sapiens
ctcagctctctgg

SEQ ID NO: 1521938 - DNA, 13 bp, Homo sapiens
ctcagctctggtc

SEQ ID NO: 1521939 - DNA, 19 bp, Homo sapiens
ctcagctctggtccaggcc

SEQ ID NO: 1521940 - DNA, 13 bp, Homo sapiens
ctcagctgcacat

SEQ ID NO: 1521941 - DNA, 14 bp, Homo sapiens
ctcagctgccaagc

SEQ ID NO: 1521942 - DNA, 22 bp, Homo sapiens
ctcagctgcccatcccagtccc

SEQ ID NO: 1521943 - DNA, 13 bp, Homo sapiens
ctcagctgctgaa

SEQ ID NO: 1521944 - DNA, 17 bp, Homo sapiens
ctcagctgtcctgcagc

SEQ ID NO: 1521945 - DNA, 20 bp, Homo sapiens
ctcagcttcttcacaggcac

SEQ ID NO: 1521946 - DNA, 16 bp, Homo sapiens
ctcagctttgagaagc

SEQ ID NO: 1521947 - DNA, 21 bp, Homo sapiens
ctcagctttgagaagccttca

SEQ ID NO: 1521948 - DNA, 12 bp, Homo sapiens
ctcaggaagaac

SEQ ID NO: 1521949 - DNA, 14 bp, Homo sapiens
ctcaggaagaacac

SEQ ID NO: 1521950 - DNA, 16 bp, Homo sapiens
ctcaggaagagctatg

SEQ ID NO: 1521951 - DNA, 21 bp, Homo sapiens
ctcaggaagagctatggccca

SEQ ID NO: 1521952 - DNA, 14 bp, Homo sapiens
ctcaggaattcagt

SEQ ID NO: 1521953 - DNA, 19 bp, Homo sapiens
ctcaggaattcagtgcctt

SEQ ID NO: 1521954 - DNA, 21 bp, Homo sapiens
ctcaggaattcagtgccttca

SEQ ID NO: 1521955 - DNA, 18 bp, Homo sapiens
ctcaggacagatgccaca

SEQ ID NO: 1521956 - DNA, 14 bp, Homo sapiens
ctcaggacccaggc

SEQ ID NO: 1521957 - DNA, 21 bp, Homo sapiens
ctcaggacctctgtaggcagc

SEQ ID NO: 1521958 - DNA, 22 bp, Homo sapiens
ctcaggacctctgtaggcagca

SEQ ID NO: 1521959 - DNA, 19 bp, Homo sapiens
ctcaggagagacccctccc

SEQ ID NO: 1521960 - DNA, 18 bp, Homo sapiens
ctcaggagcacaggcagc

SEQ ID NO: 1521961 - DNA, 16 bp, Homo sapiens
ctcaggagcctctgct

SEQ ID NO: 1521962 - DNA, 19 bp, Homo sapiens
ctcaggaggctgaggcaga

SEQ ID NO: 1521963 - DNA, 22 bp, Homo sapiens
ctcaggaggctgaggcaggagg

SEQ ID NO: 1521964 - DNA, 23 bp, Homo sapiens
ctcaggagggtgacgcccagctc

SEQ ID NO: 1521965 - DNA, 13 bp, Homo sapiens
ctcaggagtctgc

SEQ ID NO: 1521966 - DNA, 20 bp, Homo sapiens
ctcaggatccaagctaagca

SEQ ID NO: 1521967 - DNA, 14 bp, Homo sapiens
ctcaggatgcccag

SEQ ID NO: 1521968 - DNA, 15 bp, Homo sapiens
ctcaggatgcccagg

SEQ ID NO: 1521969 - DNA, 19 bp, Homo sapiens
ctcaggatgcccagggcca

SEQ ID NO: 1521970 - DNA, 19 bp, Homo sapiens
ctcaggatttaaaaactgg

SEQ ID NO: 1521971 - DNA, 13 bp, Homo sapiens
ctcaggcaagccc

SEQ ID NO: 1521972 - DNA, 15 bp, Homo sapiens
ctcaggcaagcccct

SEQ ID NO: 1521973 - DNA, 20 bp, Homo sapiens
ctcaggcaagcccctcagcc

SEQ ID NO: 1521974 - DNA, 21 bp, Homo sapiens
ctcaggcaagcccctcagccc

SEQ ID NO: 1521975 - DNA, 13 bp, Homo sapiens
ctcaggcacacag

SEQ ID NO: 1521976 - DNA, 22 bp, Homo sapiens
ctcaggcagacaagagctgctg

SEQ ID NO: 1521977 - DNA, 14 bp, Homo sapiens
ctcaggcagcacca

SEQ ID NO: 1521978 - DNA, 20 bp, Homo sapiens
ctcaggcagcgttagggctg

SEQ ID NO: 1521979 - DNA, 16 bp, Homo sapiens
ctcaggcataggcctg

SEQ ID NO: 1521980 - DNA, 19 bp, Homo sapiens
ctcaggccaacaagccaac

SEQ ID NO: 1521981 - DNA, 16 bp, Homo sapiens
ctcaggccagggctca

SEQ ID NO: 1521982 - DNA, 13 bp, Homo sapiens
ctcaggcccagaa

SEQ ID NO: 1521983 - DNA, 23 bp, Homo sapiens
ctcaggcccagaattgcagttca

SEQ ID NO: 1521984 - DNA, 16 bp, Homo sapiens
ctcaggccccgggctt

SEQ ID NO: 1521985 - DNA, 21 bp, Homo sapiens
ctcaggccccgggcttccctt

SEQ ID NO: 1521986 - DNA, 23 bp, Homo sapiens
ctcaggccccgggcttcccttct

SEQ ID NO: 1521987 - DNA, 23 bp, Homo sapiens
ctcaggcctataaccccagctcc

SEQ ID NO: 1521988 - DNA, 16 bp, Homo sapiens
ctcaggcctctgcaga

SEQ ID NO: 1521989 - DNA, 20 bp, Homo sapiens
ctcaggcgatccacctgtct

SEQ ID NO: 1521990 - DNA, 15 bp, Homo sapiens
ctcaggctctgccct

SEQ ID NO: 1521991 - DNA, 16 bp, Homo sapiens
ctcagggaagcccagc

SEQ ID NO: 1521992 - DNA, 21 bp, Homo sapiens
ctcagggaagcccagctccag

SEQ ID NO: 1521993 - DNA, 23 bp, Homo sapiens
ctcagggaagcccagctccaggg

SEQ ID NO: 1521994 - DNA, 14 bp, Homo sapiens
ctcagggacagaga

SEQ ID NO: 1521995 - DNA, 23 bp, Homo sapiens
ctcagggacagagacacctgcac

SEQ ID NO: 1521996 - DNA, 17 bp, Homo sapiens
ctcagggaccggtgctg

SEQ ID NO: 1521997 - DNA, 20 bp, Homo sapiens
ctcagggaccggtgctgcag

SEQ ID NO: 1521998 - DNA, 10 bp, Homo sapiens
ctcagggcac

SEQ ID NO: 1521999 - DNA, 16 bp, Homo sapiens
ctcagggcacgcagga

SEQ ID NO: 1522000 - DNA, 13 bp, Homo sapiens
ctcagggccccag

SEQ ID NO: 1522001 - DNA, 15 bp, Homo sapiens
ctcagggcgctcaga

SEQ ID NO: 1522002 - DNA, 18 bp, Homo sapiens
ctcagggcgctcagacgg

SEQ ID NO: 1522003 - DNA, 15 bp, Homo sapiens
ctcagggctcccagg

SEQ ID NO: 1522004 - DNA, 14 bp, Homo sapiens
ctcaggggcctgga

SEQ ID NO: 1522005 - DNA, 15 bp, Homo sapiens
ctcaggggcctggag

SEQ ID NO: 1522006 - DNA, 16 bp, Homo sapiens
ctcaggggcctggagg

SEQ ID NO: 1522007 - DNA, 14 bp, Homo sapiens
ctcaggggctgttt

SEQ ID NO: 1522008 - DNA, 16 bp, Homo sapiens
ctcaggggctgtttga

SEQ ID NO: 1522009 - DNA, 19 bp, Homo sapiens
ctcaggggctgtttgagga

SEQ ID NO: 1522010 - DNA, 13 bp, Homo sapiens
ctcagggtggggg

SEQ ID NO: 1522011 - DNA, 18 bp, Homo sapiens
ctcagggtggggggtgac

SEQ ID NO: 1522012 - DNA, 16 bp, Homo sapiens
ctcagggtggtctctt

SEQ ID NO: 1522013 - DNA, 16 bp, Homo sapiens
ctcagggttggccatt

SEQ ID NO: 1522014 - DNA, 12 bp, Homo sapiens
actccagagaca

SEQ ID NO: 1522015 - DNA, 18 bp, Homo sapiens
actccagagtctgagccc

SEQ ID NO: 1522016 - DNA, 14 bp, Homo sapiens
actccagatagaga

SEQ ID NO: 1522017 - DNA, 20 bp, Homo sapiens
actccagcaacttcttctcc

SEQ ID NO: 1522018 - DNA, 9 bp, Homo sapiens
actccagcc

SEQ ID NO: 1522019 - DNA, 14 bp, Homo sapiens
actccagcccaaca

SEQ ID NO: 1522020 - DNA, 22 bp, Homo sapiens
actccagccctgtcccctgaaa

SEQ ID NO: 1522021 - DNA, 13 bp, Homo sapiens
actccagcctggg

SEQ ID NO: 1522022 - DNA, 15 bp, Homo sapiens
actccagcctgggcg

SEQ ID NO: 1522023 - DNA, 19 bp, Homo sapiens
actccagcctggggacccc

SEQ ID NO: 1522024 - DNA, 16 bp, Homo sapiens
actccagcctgggtca

SEQ ID NO: 1522025 - DNA, 23 bp, Homo sapiens
actccagcctgggtcacagagtg

SEQ ID NO: 1522026 - DNA, 11 bp, Homo sapiens
actccaggcct

SEQ ID NO: 1522027 - DNA, 19 bp, Homo sapiens
actccaggcctgaccaggg

SEQ ID NO: 1522028 - DNA, 18 bp, Homo sapiens
actccagtgctcagctgt

SEQ ID NO: 1522029 - DNA, 20 bp, Homo sapiens
actccagtgctcagctgtgg

SEQ ID NO: 1522030 - DNA, 22 bp, Homo sapiens
actccagtgctcagctgtggct

SEQ ID NO: 1522031 - DNA, 14 bp, Homo sapiens
actccatacagcct

SEQ ID NO: 1522032 - DNA, 19 bp, Homo sapiens
actccatcgccatcttctt

SEQ ID NO: 1522033 - DNA, 20 bp, Homo sapiens
actccatcgccatcttcttc

SEQ ID NO: 1522034 - DNA, 18 bp, Homo sapiens
actccatctcaaaacaaa

SEQ ID NO: 1522035 - DNA, 13 bp, Homo sapiens
actccatctcttc

SEQ ID NO: 1522036 - DNA, 14 bp, Homo sapiens
actccatctcttct

SEQ ID NO: 1522037 - DNA, 18 bp, Homo sapiens
actccatctcttctgcaa

SEQ ID NO: 1522038 - DNA, 11 bp, Homo sapiens
actccatcttg

SEQ ID NO: 1522039 - DNA, 21 bp, Homo sapiens
actccatgctccttgagagga

SEQ ID NO: 1522040 - DNA, 15 bp, Homo sapiens
actccatggccaccc

SEQ ID NO: 1522041 - DNA, 22 bp, Homo sapiens
actccatggccaccccgtgcca

SEQ ID NO: 1522042 - DNA, 15 bp, Homo sapiens
actccattactgtga

SEQ ID NO: 1522043 - DNA, 18 bp, Homo sapiens
actccattactgtgattt

SEQ ID NO: 1522044 - DNA, 17 bp, Homo sapiens
actcccaacttcttcct

SEQ ID NO: 1522045 - DNA, 20 bp, Homo sapiens
actcccaacttcttcctgtg

SEQ ID NO: 1522046 - DNA, 21 bp, Homo sapiens
actcccaagggacagcaagtg

SEQ ID NO: 1522047 - DNA, 14 bp, Homo sapiens
actcccaagtatgg

SEQ ID NO: 1522048 - DNA, 14 bp, Homo sapiens
actcccaccacagg

SEQ ID NO: 1522049 - DNA, 18 bp, Homo sapiens
actcccagcagctcaacc

SEQ ID NO: 1522050 - DNA, 22 bp, Homo sapiens
actcccagtccaaatgtcctcc

SEQ ID NO: 1522051 - DNA, 16 bp, Homo sapiens
actcccattcctgaag

SEQ ID NO: 1522052 - DNA, 18 bp, Homo sapiens
actccccagagctgtgcc

SEQ ID NO: 1522053 - DNA, 20 bp, Homo sapiens
actccccagagctgtgccag

SEQ ID NO: 1522054 - DNA, 17 bp, Homo sapiens
actcccccgtttctcct

SEQ ID NO: 1522055 - DNA, 19 bp, Homo sapiens
actcccccgtttctccttt

SEQ ID NO: 1522056 - DNA, 12 bp, Homo sapiens
actccctccacc

SEQ ID NO: 1522057 - DNA, 15 bp, Homo sapiens
actccctccaccagc

SEQ ID NO: 1522058 - DNA, 16 bp, Homo sapiens
actccctccaccagcc

SEQ ID NO: 1522059 - DNA, 21 bp, Homo sapiens
actccctccaccagcctgctg

SEQ ID NO: 1522060 - DNA, 16 bp, Homo sapiens
actccctctccctccc

SEQ ID NO: 1522061 - DNA, 23 bp, Homo sapiens
actccctctccctccctaacagt

SEQ ID NO: 1522062 - DNA, 12 bp, Homo sapiens
actccctctgca

SEQ ID NO: 1522063 - DNA, 22 bp, Homo sapiens
actccctcttcactgtggccac

SEQ ID NO: 1522064 - DNA, 17 bp, Homo sapiens
actccctgatcccagac

SEQ ID NO: 1522065 - DNA, 12 bp, Homo sapiens
actccctgccta

SEQ ID NO: 1522066 - DNA, 21 bp, Homo sapiens
actccctggatgtgtggggca

SEQ ID NO: 1522067 - DNA, 15 bp, Homo sapiens
actccctgttttagt

SEQ ID NO: 1522068 - DNA, 17 bp, Homo sapiens
actccctgttttagttt

SEQ ID NO: 1522069 - DNA, 23 bp, Homo sapiens
actcccttccctctctcccattt

SEQ ID NO: 1522070 - DNA, 15 bp, Homo sapiens
actcccttcctggcc

SEQ ID NO: 1522071 - DNA, 16 bp, Homo sapiens
actcccttcctggcct

SEQ ID NO: 1522072 - DNA, 18 bp, Homo sapiens
actcccttcctggcctca

SEQ ID NO: 1522073 - DNA, 22 bp, Homo sapiens
actcccttgaggatggagagca

SEQ ID NO: 1522074 - DNA, 23 bp, Homo sapiens
actcccttgaggatggagagcag

SEQ ID NO: 1522075 - DNA, 22 bp, Homo sapiens
actccgagaggtgggccagtct

SEQ ID NO: 1522076 - DNA, 22 bp, Homo sapiens
actccgccctcctcgggccgag

SEQ ID NO: 1522077 - DNA, 23 bp, Homo sapiens
actccgccctcctcgggccgagg

SEQ ID NO: 1522078 - DNA, 23 bp, Homo sapiens
actccgcgccgatgccaccggcc

SEQ ID NO: 1522079 - DNA, 23 bp, Homo sapiens
actccgcggagtgatcatggaaa

SEQ ID NO: 1522080 - DNA, 15 bp, Homo sapiens
actccggcctgggtg

SEQ ID NO: 1522081 - DNA, 15 bp, Homo sapiens
actccggtgtgcctg

SEQ ID NO: 1522082 - DNA, 20 bp, Homo sapiens
actccggtgtgcctgcagcc

SEQ ID NO: 1522083 - DNA, 18 bp, Homo sapiens
actccgtgaggctgctgc

SEQ ID NO: 1522084 - DNA, 20 bp, Homo sapiens
actccgtgaggctgctgcca

SEQ ID NO: 1522085 - DNA, 19 bp, Homo sapiens
actcctaattttaaataat

SEQ ID NO: 1522086 - DNA, 17 bp, Homo sapiens
actcctacctcagccta

SEQ ID NO: 1522087 - DNA, 14 bp, Homo sapiens
actcctacctggta

SEQ ID NO: 1522088 - DNA, 17 bp, Homo sapiens
actcctataaggagagt

SEQ ID NO: 1522089 - DNA, 23 bp, Homo sapiens
actcctatccccaggccaggtcc

SEQ ID NO: 1522090 - DNA, 18 bp, Homo sapiens
actcctcaggagagaccc

SEQ ID NO: 1522091 - DNA, 20 bp, Homo sapiens
actcctcatccccacaatct

SEQ ID NO: 1522092 - DNA, 12 bp, Homo sapiens
actcctcccagg

SEQ ID NO: 1522093 - DNA, 11 bp, Homo sapiens
actcctccctc

SEQ ID NO: 1522094 - DNA, 18 bp, Homo sapiens
actcctctctagggcaga

SEQ ID NO: 1522095 - DNA, 12 bp, Homo sapiens
actcctctgcag

SEQ ID NO: 1522096 - DNA, 19 bp, Homo sapiens
actcctgacgtctgaagct

SEQ ID NO: 1522097 - DNA, 23 bp, Homo sapiens
actcctgacgtctgaagcttgac

SEQ ID NO: 1522098 - DNA, 18 bp, Homo sapiens
actcctgccagttgaaaa

SEQ ID NO: 1522099 - DNA, 21 bp, Homo sapiens
actcctgccattcttctggtg

SEQ ID NO: 1522100 - DNA, 21 bp, Homo sapiens
actcctgcctgagtttccagc

SEQ ID NO: 1522101 - DNA, 11 bp, Homo sapiens
actcctgctgc

SEQ ID NO: 1522102 - DNA, 18 bp, Homo sapiens
actcctgctgcacaggcc

SEQ ID NO: 1522103 - DNA, 15 bp, Homo sapiens
actcctgctggtacc

SEQ ID NO: 1522104 - DNA, 18 bp, Homo sapiens
actcctgctggtacctgc

SEQ ID NO: 1522105 - DNA, 21 bp, Homo sapiens
actcctggggcctcttgggtc

SEQ ID NO: 1522106 - DNA, 13 bp, Homo sapiens
actcctgtacact

SEQ ID NO: 1522107 - DNA, 18 bp, Homo sapiens
actcctgtacactgaata

SEQ ID NO: 1522108 - DNA, 12 bp, Homo sapiens
actcctgtcccg

SEQ ID NO: 1522109 - DNA, 21 bp, Homo sapiens
actcctgtcccgccttcctcc

SEQ ID NO: 1522110 - DNA, 12 bp, Homo sapiens
actcctgtgtgt

SEQ ID NO: 1522111 - DNA, 14 bp, Homo sapiens
actcctgtgtgtgg

SEQ ID NO: 1522112 - DNA, 16 bp, Homo sapiens
actcctgtgtgtggaa

SEQ ID NO: 1522113 - DNA, 19 bp, Homo sapiens
actcctgtgtgtggaaggc

SEQ ID NO: 1522114 - DNA, 17 bp, Homo sapiens
actcctgttacttacct

SEQ ID NO: 1522115 - DNA, 20 bp, Homo sapiens
actcctgttacttacctaaa

SEQ ID NO: 1522116 - DNA, 12 bp, Homo sapiens
actccttagaga

SEQ ID NO: 1522117 - DNA, 18 bp, Homo sapiens
actccttattttgtatta

SEQ ID NO: 1522118 - DNA, 15 bp, Homo sapiens
actccttcctggcct

SEQ ID NO: 1522119 - DNA, 16 bp, Homo sapiens
actccttcctggcctg

SEQ ID NO: 1522120 - DNA, 21 bp, Homo sapiens
actccttctctcactgtgtta

SEQ ID NO: 1522121 - DNA, 23 bp, Homo sapiens
actccttgtggactggctgtgcc

SEQ ID NO: 1522122 - DNA, 22 bp, Homo sapiens
actccttgttagcccttcagat

SEQ ID NO: 1522123 - DNA, 17 bp, Homo sapiens
actcctttcagccacat

SEQ ID NO: 1522124 - DNA, 20 bp, Homo sapiens
actcctttttcaaatgagtt

SEQ ID NO: 1522125 - DNA, 20 bp, Homo sapiens
actcgagaccatcctggccc

SEQ ID NO: 1522126 - DNA, 17 bp, Homo sapiens
actcgagcccacccagc

SEQ ID NO: 1522127 - DNA, 20 bp, Homo sapiens
actcgatcaaaaccttcctt

SEQ ID NO: 1522128 - DNA, 21 bp, Homo sapiens
actcgatcaaaaccttccttc

SEQ ID NO: 1522129 - DNA, 16 bp, Homo sapiens
actcgcagtcgcagga

SEQ ID NO: 1522130 - DNA, 21 bp, Homo sapiens
ctcaggtaggaagcaacagct

SEQ ID NO: 1522131 - DNA, 23 bp, Homo sapiens
ctcaggtcccaggctcctatgca

SEQ ID NO: 1522132 - DNA, 20 bp, Homo sapiens
ctcaggtgatctacctgcct

SEQ ID NO: 1522133 - DNA, 14 bp, Homo sapiens
ctcaggtgggccct

SEQ ID NO: 1522134 - DNA, 15 bp, Homo sapiens
ctcaggtgttgccaa

SEQ ID NO: 1522135 - DNA, 13 bp, Homo sapiens
ctcaggttccaga

SEQ ID NO: 1522136 - DNA, 14 bp, Homo sapiens
ctcaggttccagaa

SEQ ID NO: 1522137 - DNA, 18 bp, Homo sapiens
ctcaggtttgtcctggtc

SEQ ID NO: 1522138 - DNA, 20 bp, Homo sapiens
ctcaggtttgtcctggtcat

SEQ ID NO: 1522139 - DNA, 20 bp, Homo sapiens
ctcagtaaatgtacaactgc

SEQ ID NO: 1522140 - DNA, 21 bp, Homo sapiens
ctcagtaacataactgcttct

SEQ ID NO: 1522141 - DNA, 16 bp, Homo sapiens
ctcagtaacatttctg

SEQ ID NO: 1522142 - DNA, 22 bp, Homo sapiens
ctcagtaacatttctgttctca

SEQ ID NO: 1522143 - DNA, 12 bp, Homo sapiens
ctcagtagaaaa

SEQ ID NO: 1522144 - DNA, 20 bp, Homo sapiens
ctcagtcagttcccggagca

SEQ ID NO: 1522145 - DNA, 22 bp, Homo sapiens
ctcagtcagttcccggagcaca

SEQ ID NO: 1522146 - DNA, 13 bp, Homo sapiens
ctcagtccactgt

SEQ ID NO: 1522147 - DNA, 15 bp, Homo sapiens
ctcagtccactgttg

SEQ ID NO: 1522148 - DNA, 22 bp, Homo sapiens
ctcagtcccccaccacactgaa

SEQ ID NO: 1522149 - DNA, 23 bp, Homo sapiens
ctcagtctcccagctaattgaga

SEQ ID NO: 1522150 - DNA, 12 bp, Homo sapiens
ctcagtgcagat

SEQ ID NO: 1522151 - DNA, 20 bp, Homo sapiens
ctcagtgccacttgacattc

SEQ ID NO: 1522152 - DNA, 14 bp, Homo sapiens
ctcagtgccttctc

SEQ ID NO: 1522153 - DNA, 18 bp, Homo sapiens
ctcagtgggaagaaaaat

SEQ ID NO: 1522154 - DNA, 18 bp, Homo sapiens
ctcagtggggctggcatc

SEQ ID NO: 1522155 - DNA, 20 bp, Homo sapiens
ctcagtggggctggcatcaa

SEQ ID NO: 1522156 - DNA, 22 bp, Homo sapiens
ctcagtgtcatttatgaaaaga

SEQ ID NO: 1522157 - DNA, 20 bp, Homo sapiens
ctcagtgtccagcttccaaa

SEQ ID NO: 1522158 - DNA, 14 bp, Homo sapiens
ctcagtgttagaga

SEQ ID NO: 1522159 - DNA, 17 bp, Homo sapiens
ctcagtgttttggactc

SEQ ID NO: 1522160 - DNA, 23 bp, Homo sapiens
ctcagttattacatgtaatttga

SEQ ID NO: 1522161 - DNA, 12 bp, Homo sapiens
ctcagttccagg

SEQ ID NO: 1522162 - DNA, 14 bp, Homo sapiens
ctcagttccaggcc

SEQ ID NO: 1522163 - DNA, 14 bp, Homo sapiens
ctcagttcccttgg

SEQ ID NO: 1522164 - DNA, 19 bp, Homo sapiens
ctcagttcccttggcctca

SEQ ID NO: 1522165 - DNA, 20 bp, Homo sapiens
ctcagttcccttggcctcag

SEQ ID NO: 1522166 - DNA, 21 bp, Homo sapiens
ctcagttcgaccaaactcagt

SEQ ID NO: 1522167 - DNA, 22 bp, Homo sapiens
ctcagttcgaccaaactcagtt

SEQ ID NO: 1522168 - DNA, 20 bp, Homo sapiens
ctcagttctctcccttcctc

SEQ ID NO: 1522169 - DNA, 23 bp, Homo sapiens
ctcagttctctcccttcctctct

SEQ ID NO: 1522170 - DNA, 14 bp, Homo sapiens
ctcagttggaatca

SEQ ID NO: 1522171 - DNA, 19 bp, Homo sapiens
ctcagttgtttgcttcttg

SEQ ID NO: 1522172 - DNA, 12 bp, Homo sapiens
ctcagtttccct

SEQ ID NO: 1522173 - DNA, 13 bp, Homo sapiens
ctcagtttcccta

SEQ ID NO: 1522174 - DNA, 18 bp, Homo sapiens
ctcagtttctccatcagc

SEQ ID NO: 1522175 - DNA, 15 bp, Homo sapiens
ctcagttttccttct

SEQ ID NO: 1522176 - DNA, 15 bp, Homo sapiens
ctcataaaactgtga

SEQ ID NO: 1522177 - DNA, 20 bp, Homo sapiens
ctcataaactgccaagagct

SEQ ID NO: 1522178 - DNA, 14 bp, Homo sapiens
ctcataaattggcc

SEQ ID NO: 1522179 - DNA, 16 bp, Homo sapiens
ctcataaggtgctatc

SEQ ID NO: 1522180 - DNA, 18 bp, Homo sapiens
ctcataagttggaccaga

SEQ ID NO: 1522181 - DNA, 13 bp, Homo sapiens
ctcataatttata

SEQ ID NO: 1522182 - DNA, 14 bp, Homo sapiens
ctcataattttgca

SEQ ID NO: 1522183 - DNA, 16 bp, Homo sapiens
ctcataattttgcaaa

SEQ ID NO: 1522184 - DNA, 18 bp, Homo sapiens
ctcataccacatggcttt

SEQ ID NO: 1522185 - DNA, 12 bp, Homo sapiens
ctcataccatct

SEQ ID NO: 1522186 - DNA, 17 bp, Homo sapiens
ctcataccctccctccc

SEQ ID NO: 1522187 - DNA, 14 bp, Homo sapiens
ctcatagacactga

SEQ ID NO: 1522188 - DNA, 18 bp, Homo sapiens
ctcatagacactgatctg

SEQ ID NO: 1522189 - DNA, 17 bp, Homo sapiens
ctcatagaggtgagaaa

SEQ ID NO: 1522190 - DNA, 20 bp, Homo sapiens
ctcatagccccggtgtgcgg

SEQ ID NO: 1522191 - DNA, 23 bp, Homo sapiens
ctcataggaaaagtacatttaat

SEQ ID NO: 1522192 - DNA, 14 bp, Homo sapiens
ctcatagggaagac

SEQ ID NO: 1522193 - DNA, 19 bp, Homo sapiens
ctcatagggaagacctgct

SEQ ID NO: 1522194 - DNA, 22 bp, Homo sapiens
ctcataggttaaaaaaaaaagt

SEQ ID NO: 1522195 - DNA, 19 bp, Homo sapiens
ctcatatggcccagtgtca

SEQ ID NO: 1522196 - DNA, 19 bp, Homo sapiens
ctcatattgtgattctgcc

SEQ ID NO: 1522197 - DNA, 21 bp, Homo sapiens
ctcatattgtgattctgcctt

SEQ ID NO: 1522198 - DNA, 12 bp, Homo sapiens
ctcatcataaaa

SEQ ID NO: 1522199 - DNA, 16 bp, Homo sapiens
ctcatcataaaataaa

SEQ ID NO: 1522200 - DNA, 17 bp, Homo sapiens
ctcatcatattgtatgt

SEQ ID NO: 1522201 - DNA, 14 bp, Homo sapiens
ctcatcccccctgc

SEQ ID NO: 1522202 - DNA, 16 bp, Homo sapiens
ctcatcccccctgctg

SEQ ID NO: 1522203 - DNA, 20 bp, Homo sapiens
ctcatcccccctgctgccca

SEQ ID NO: 1522204 - DNA, 17 bp, Homo sapiens
ctcatcccctcgtcctg

SEQ ID NO: 1522205 - DNA, 20 bp, Homo sapiens
ctcatcccctcgtcctgtcc

SEQ ID NO: 1522206 - DNA, 19 bp, Homo sapiens
ctcatcccgtgttctcctt

SEQ ID NO: 1522207 - DNA, 14 bp, Homo sapiens
ctcatccctcaact

SEQ ID NO: 1522208 - DNA, 15 bp, Homo sapiens
ctcatccctcaactg

SEQ ID NO: 1522209 - DNA, 17 bp, Homo sapiens
ctcatccctcggaagcc

SEQ ID NO: 1522210 - DNA, 15 bp, Homo sapiens
ctcatccgaggcagg

SEQ ID NO: 1522211 - DNA, 13 bp, Homo sapiens
ctcatcctccagt

SEQ ID NO: 1522212 - DNA, 22 bp, Homo sapiens
ctcatcctccagtaccttgctt

SEQ ID NO: 1522213 - DNA, 12 bp, Homo sapiens
ctcatcctgaga

SEQ ID NO: 1522214 - DNA, 16 bp, Homo sapiens
ctcatcctgctctttt

SEQ ID NO: 1522215 - DNA, 24 bp, Homo sapiens
ctcatcctgctcttttgtgatgaa

SEQ ID NO: 1522216 - DNA, 21 bp, Homo sapiens
ctcatcctggcacgccctact

SEQ ID NO: 1522217 - DNA, 22 bp, Homo sapiens
ctcatcggagactgccccacgg

SEQ ID NO: 1522218 - DNA, 18 bp, Homo sapiens
ctcatcggaggcccatgc

SEQ ID NO: 1522219 - DNA, 18 bp, Homo sapiens
ctcatctatctcaatcct

SEQ ID NO: 1522220 - DNA, 14 bp, Homo sapiens
ctcatctatttgga

SEQ ID NO: 1522221 - DNA, 17 bp, Homo sapiens
ctcatctctctgcccaa

SEQ ID NO: 1522222 - DNA, 12 bp, Homo sapiens
ctcatctgtgat

SEQ ID NO: 1522223 - DNA, 16 bp, Homo sapiens
ctcatctgtggagctg

SEQ ID NO: 1522224 - DNA, 22 bp, Homo sapiens
ctcatctgtggagctgccacag

SEQ ID NO: 1522225 - DNA, 17 bp, Homo sapiens
ctcatctttctccttca

SEQ ID NO: 1522226 - DNA, 12 bp, Homo sapiens
ctcatctttctt

SEQ ID NO: 1522227 - DNA, 15 bp, Homo sapiens
ctcatctttcttgat

SEQ ID NO: 1522228 - DNA, 12 bp, Homo sapiens
ctcatgacagcc

SEQ ID NO: 1522229 - DNA, 13 bp, Homo sapiens
ctcatgacagcca

SEQ ID NO: 1522230 - DNA, 14 bp, Homo sapiens
ctcatgacagccag

SEQ ID NO: 1522231 - DNA, 19 bp, Homo sapiens
ctcatgaggggagaggaga

SEQ ID NO: 1522232 - DNA, 18 bp, Homo sapiens
ctcatgataccaccttta

SEQ ID NO: 1522233 - DNA, 20 bp, Homo sapiens
ctcatgcaaatcaattactg

SEQ ID NO: 1522234 - DNA, 14 bp, Homo sapiens
ctcatgcagccgtg

SEQ ID NO: 1522235 - DNA, 18 bp, Homo sapiens
ctcatgcatagtcccagc

SEQ ID NO: 1522236 - DNA, 19 bp, Homo sapiens
ctcatgcatagtcccagct

SEQ ID NO: 1522237 - DNA, 21 bp, Homo sapiens
ctcatgccaaccccgccctag

SEQ ID NO: 1522238 - DNA, 12 bp, Homo sapiens
ctcatgccacac

SEQ ID NO: 1522239 - DNA, 17 bp, Homo sapiens
ctcatgccacaccttct

SEQ ID NO: 1522240 - DNA, 13 bp, Homo sapiens
ctcatgcccaccc

SEQ ID NO: 1522241 - DNA, 22 bp, Homo sapiens
ctcatgcccaccccctgccctg

SEQ ID NO: 1522242 - DNA, 15 bp, Homo sapiens
ctcatgcccagctct

SEQ ID NO: 1522243 - DNA, 16 bp, Homo sapiens
ctcatgcccagctctc

SEQ ID NO: 1522244 - DNA, 17 bp, Homo sapiens
ctcatgccccctttcag

SEQ ID NO: 1522245 - DNA, 14 bp, Homo sapiens
ctcatgctgttgct

SEQ ID NO: 1522246 - DNA, 15 bp, Homo sapiens
ctcatgctgttgctg

SEQ ID NO: 1522247 - DNA, 23 bp, Homo sapiens
actcaaattttggcgaatctcaa

SEQ ID NO: 1522248 - DNA, 23 bp, Homo sapiens
actcaacatgttactgaccagca

SEQ ID NO: 1522249 - DNA, 14 bp, Homo sapiens
actcaaccagagtc

SEQ ID NO: 1522250 - DNA, 23 bp, Homo sapiens
actcaaccttaagacctactgtt

SEQ ID NO: 1522251 - DNA, 15 bp, Homo sapiens
actcaagaggaatct

SEQ ID NO: 1522252 - DNA, 17 bp, Homo sapiens
actcaagaggaatctgt

SEQ ID NO: 1522253 - DNA, 21 bp, Homo sapiens
actcaagaggaatctgtttct

SEQ ID NO: 1522254 - DNA, 14 bp, Homo sapiens
actcaagaggctga

SEQ ID NO: 1522255 - DNA, 16 bp, Homo sapiens
actcaagagttcagtg

SEQ ID NO: 1522256 - DNA, 15 bp, Homo sapiens
actcaagctgtctct

SEQ ID NO: 1522257 - DNA, 21 bp, Homo sapiens
actcaagggaaaggcaagctt

SEQ ID NO: 1522258 - DNA, 19 bp, Homo sapiens
actcaatggtatcattaca

SEQ ID NO: 1522259 - DNA, 16 bp, Homo sapiens
actcaatgtttctgga

SEQ ID NO: 1522260 - DNA, 21 bp, Homo sapiens
actcaatgtttctggacattc

SEQ ID NO: 1522261 - DNA, 22 bp, Homo sapiens
actcacaatttaaaatatttcc

SEQ ID NO: 1522262 - DNA, 15 bp, Homo sapiens
actcacactggccac

SEQ ID NO: 1522263 - DNA, 18 bp, Homo sapiens
actcacagacctggagcc

SEQ ID NO: 1522264 - DNA, 22 bp, Homo sapiens
actcacagacctggagcccctg

SEQ ID NO: 1522265 - DNA, 18 bp, Homo sapiens
actcacagagtcaaggcc

SEQ ID NO: 1522266 - DNA, 19 bp, Homo sapiens
actcacagagtcaaggcct

SEQ ID NO: 1522267 - DNA, 21 bp, Homo sapiens
actcacagagtcaaggcctgc

SEQ ID NO: 1522268 - DNA, 16 bp, Homo sapiens
actcacagtgctttta

SEQ ID NO: 1522269 - DNA, 17 bp, Homo sapiens
actcacatataacatgc

SEQ ID NO: 1522270 - DNA, 11 bp, Homo sapiens
actcaccagcc

SEQ ID NO: 1522271 - DNA, 12 bp, Homo sapiens
actcaccagccc

SEQ ID NO: 1522272 - DNA, 20 bp, Homo sapiens
actcaccagccccactgcca

SEQ ID NO: 1522273 - DNA, 22 bp, Homo sapiens
actcaccagccccactgccagc

SEQ ID NO: 1522274 - DNA, 16 bp, Homo sapiens
actcaccagccctagc

SEQ ID NO: 1522275 - DNA, 17 bp, Homo sapiens
actcaccagccctagct

SEQ ID NO: 1522276 - DNA, 13 bp, Homo sapiens
actcaccagggtc

SEQ ID NO: 1522277 - DNA, 19 bp, Homo sapiens
actcaccagggtccgcacc

SEQ ID NO: 1522278 - DNA, 21 bp, Homo sapiens
actcaccagggtccgcaccag

SEQ ID NO: 1522279 - DNA, 17 bp, Homo sapiens
actcacccctagccctg

SEQ ID NO: 1522280 - DNA, 18 bp, Homo sapiens
actcacccctagccctgg

SEQ ID NO: 1522281 - DNA, 20 bp, Homo sapiens
actcacccctagccctggtt

SEQ ID NO: 1522282 - DNA, 18 bp, Homo sapiens
actcaccctgggagccag

SEQ ID NO: 1522283 - DNA, 17 bp, Homo sapiens
actcaccgaagccactt

SEQ ID NO: 1522284 - DNA, 17 bp, Homo sapiens
actcacctaatgtttat

SEQ ID NO: 1522285 - DNA, 17 bp, Homo sapiens
actcacctctgcctcaa

SEQ ID NO: 1522286 - DNA, 17 bp, Homo sapiens
actcactaacagggaga

SEQ ID NO: 1522287 - DNA, 15 bp, Homo sapiens
actcactaggccccc

SEQ ID NO: 1522288 - DNA, 21 bp, Homo sapiens
actcactgcctaggaggctgg

SEQ ID NO: 1522289 - DNA, 22 bp, Homo sapiens
actcactgctcaagaagacatg

SEQ ID NO: 1522290 - DNA, 19 bp, Homo sapiens
actcacttgatgtttcctg

SEQ ID NO: 1522291 - DNA, 23 bp, Homo sapiens
actcacttgatgtttcctggaag

SEQ ID NO: 1522292 - DNA, 15 bp, Homo sapiens
actcagaaacatcag

SEQ ID NO: 1522293 - DNA, 16 bp, Homo sapiens
actcagaagcctgagg

SEQ ID NO: 1522294 - DNA, 17 bp, Homo sapiens
actcagaatataacatg

SEQ ID NO: 1522295 - DNA, 20 bp, Homo sapiens
actcagaatataacatgtaa

SEQ ID NO: 1522296 - DNA, 14 bp, Homo sapiens
actcagaatattgc

SEQ ID NO: 1522297 - DNA, 18 bp, Homo sapiens
actcagacattggcacct

SEQ ID NO: 1522298 - DNA, 12 bp, Homo sapiens
actcagacctga

SEQ ID NO: 1522299 - DNA, 24 bp, Homo sapiens
actcagacgtgtgacctccatact

SEQ ID NO: 1522300 - DNA, 22 bp, Homo sapiens
actcagagaaaaatgctcccca

SEQ ID NO: 1522301 - DNA, 16 bp, Homo sapiens
actcagatttaagcct

SEQ ID NO: 1522302 - DNA, 22 bp, Homo sapiens
actcagatttaagccttacaaa

SEQ ID NO: 1522303 - DNA, 13 bp, Homo sapiens
actcagcagccct

SEQ ID NO: 1522304 - DNA, 18 bp, Homo sapiens
actcagcagccctcctca

SEQ ID NO: 1522305 - DNA, 12 bp, Homo sapiens
actcagcagtga

SEQ ID NO: 1522306 - DNA, 22 bp, Homo sapiens
actcagccatttccccctcctc

SEQ ID NO: 1522307 - DNA, 16 bp, Homo sapiens
actcagcccagctggc

SEQ ID NO: 1522308 - DNA, 17 bp, Homo sapiens
actcagcccagctggcc

SEQ ID NO: 1522309 - DNA, 11 bp, Homo sapiens
actcagccctg

SEQ ID NO: 1522310 - DNA, 13 bp, Homo sapiens
actcagccctggg

SEQ ID NO: 1522311 - DNA, 18 bp, Homo sapiens
actcagctgtcctgcagc

SEQ ID NO: 1522312 - DNA, 12 bp, Homo sapiens
actcaggaactt

SEQ ID NO: 1522313 - DNA, 13 bp, Homo sapiens
actcaggaacttt

SEQ ID NO: 1522314 - DNA, 18 bp, Homo sapiens
actcaggaacttttgtta

SEQ ID NO: 1522315 - DNA, 19 bp, Homo sapiens
actcaggaggctgagacag

SEQ ID NO: 1522316 - DNA, 16 bp, Homo sapiens
actcaggaggctgagg

SEQ ID NO: 1522317 - DNA, 17 bp, Homo sapiens
actcaggaggctgaggg

SEQ ID NO: 1522318 - DNA, 18 bp, Homo sapiens
actcaggatccagtccct

SEQ ID NO: 1522319 - DNA, 18 bp, Homo sapiens
actcaggatgcccagggc

SEQ ID NO: 1522320 - DNA, 17 bp, Homo sapiens
actcaggatttaaaaac

SEQ ID NO: 1522321 - DNA, 18 bp, Homo sapiens
actcagggccatgcctgc

SEQ ID NO: 1522322 - DNA, 13 bp, Homo sapiens
actcagggcccca

SEQ ID NO: 1522323 - DNA, 15 bp, Homo sapiens
actcaggtgggccct

SEQ ID NO: 1522324 - DNA, 15 bp, Homo sapiens
actcaggttccagaa

SEQ ID NO: 1522325 - DNA, 20 bp, Homo sapiens
actcagtagctgaacctgtc

SEQ ID NO: 1522326 - DNA, 21 bp, Homo sapiens
actcagtagctgaacctgtct

SEQ ID NO: 1522327 - DNA, 16 bp, Homo sapiens
actcagtccactgttg

SEQ ID NO: 1522328 - DNA, 22 bp, Homo sapiens
actcagtcccccaccacactga

SEQ ID NO: 1522329 - DNA, 23 bp, Homo sapiens
actcagtctctcttctctccagc

SEQ ID NO: 1522330 - DNA, 13 bp, Homo sapiens
actcagtctttaa

SEQ ID NO: 1522331 - DNA, 23 bp, Homo sapiens
actcagtgagctggggccgtctg

SEQ ID NO: 1522332 - DNA, 22 bp, Homo sapiens
actcagtgtgtgatccggtttc

SEQ ID NO: 1522333 - DNA, 17 bp, Homo sapiens
actcagtgttagagaaa

SEQ ID NO: 1522334 - DNA, 20 bp, Homo sapiens
actcagtgttagagaaatcc

SEQ ID NO: 1522335 - DNA, 22 bp, Homo sapiens
actcagttaaaatgtctgtttc

SEQ ID NO: 1522336 - DNA, 17 bp, Homo sapiens
actcagttcaaaccatt

SEQ ID NO: 1522337 - DNA, 13 bp, Homo sapiens
actcagtttgtca

SEQ ID NO: 1522338 - DNA, 19 bp, Homo sapiens
actcagtttgtcagacttt

SEQ ID NO: 1522339 - DNA, 20 bp, Homo sapiens
actcataagttggaccagag

SEQ ID NO: 1522340 - DNA, 12 bp, Homo sapiens
actcatcataaa

SEQ ID NO: 1522341 - DNA, 19 bp, Homo sapiens
actcatcttactgtacctg

SEQ ID NO: 1522342 - DNA, 16 bp, Homo sapiens
actcatgcacacagat

SEQ ID NO: 1522343 - DNA, 23 bp, Homo sapiens
actcatgtctggagtcccctcct

SEQ ID NO: 1522344 - DNA, 13 bp, Homo sapiens
actcattcaaaag

SEQ ID NO: 1522345 - DNA, 15 bp, Homo sapiens
actcattccttcact

SEQ ID NO: 1522346 - DNA, 19 bp, Homo sapiens
actcattctgaattaatta

SEQ ID NO: 1522347 - DNA, 21 bp, Homo sapiens
actcattgctgagcctctgct

SEQ ID NO: 1522348 - DNA, 23 bp, Homo sapiens
actcattgctgagcctctgctcc

SEQ ID NO: 1522349 - DNA, 21 bp, Homo sapiens
actcatttataaagctaaaat

SEQ ID NO: 1522350 - DNA, 20 bp, Homo sapiens
actcattttaaaaaatggaa

SEQ ID NO: 1522351 - DNA, 19 bp, Homo sapiens
actccaatggggccagcac

SEQ ID NO: 1522352 - DNA, 13 bp, Homo sapiens
actccacagcgga

SEQ ID NO: 1522353 - DNA, 21 bp, Homo sapiens
actccacagcggaggagacca

SEQ ID NO: 1522354 - DNA, 13 bp, Homo sapiens
actccacatctgc

SEQ ID NO: 1522355 - DNA, 20 bp, Homo sapiens
actccaccaacccatcagaa

SEQ ID NO: 1522356 - DNA, 14 bp, Homo sapiens
actccaccgaccaa

SEQ ID NO: 1522357 - DNA, 20 bp, Homo sapiens
actccaccgaccaactgccc

SEQ ID NO: 1522358 - DNA, 16 bp, Homo sapiens
actccactcccagcag

SEQ ID NO: 1522359 - DNA, 14 bp, Homo sapiens
actccactgacaaa

SEQ ID NO: 1522360 - DNA, 14 bp, Homo sapiens
actccactgccctg

SEQ ID NO: 1522361 - DNA, 15 bp, Homo sapiens
actccactgccctgg

SEQ ID NO: 1522362 - DNA, 23 bp, Homo sapiens
actccactgccctggcagcagca

SEQ ID NO: 1522363 - DNA, 16 bp, Homo sapiens
ctcactccaccaccca

SEQ ID NO: 1522364 - DNA, 20 bp, Homo sapiens
ctcactcccaagggacagca

SEQ ID NO: 1522365 - DNA, 15 bp, Homo sapiens
ctcactcccagtcca

SEQ ID NO: 1522366 - DNA, 13 bp, Homo sapiens
ctcactccccagg

SEQ ID NO: 1522367 - DNA, 12 bp, Homo sapiens
ctcactcctgag

SEQ ID NO: 1522368 - DNA, 11 bp, Homo sapiens
ctcactcctgc

SEQ ID NO: 1522369 - DNA, 11 bp, Homo sapiens
ctcactcctgt

SEQ ID NO: 1522370 - DNA, 13 bp, Homo sapiens
ctcactctgggct

SEQ ID NO: 1522371 - DNA, 14 bp, Homo sapiens
ctcactgaaaccag

SEQ ID NO: 1522372 - DNA, 20 bp, Homo sapiens
ctcactgaaacctctgcctt

SEQ ID NO: 1522373 - DNA, 18 bp, Homo sapiens
ctcactgaactccaccga

SEQ ID NO: 1522374 - DNA, 19 bp, Homo sapiens
ctcactgagaggcctggag

SEQ ID NO: 1522375 - DNA, 20 bp, Homo sapiens
ctcactgcaacctccgcctc

SEQ ID NO: 1522376 - DNA, 19 bp, Homo sapiens
ctcactgcagcctccgcct

SEQ ID NO: 1522377 - DNA, 19 bp, Homo sapiens
ctcactgccaggccagcct

SEQ ID NO: 1522378 - DNA, 16 bp, Homo sapiens
ctcactgctcaagaag

SEQ ID NO: 1522379 - DNA, 17 bp, Homo sapiens
ctcactgctgctgcctc

SEQ ID NO: 1522380 - DNA, 18 bp, Homo sapiens
ctcactgcttgaactagg

SEQ ID NO: 1522381 - DNA, 17 bp, Homo sapiens
ctcactggctggggcag

SEQ ID NO: 1522382 - DNA, 16 bp, Homo sapiens
ctcactggggcctaca

SEQ ID NO: 1522383 - DNA, 18 bp, Homo sapiens
ctcactggggcctacagc

SEQ ID NO: 1522384 - DNA, 23 bp, Homo sapiens
ctcactgtattagagcgccagct

SEQ ID NO: 1522385 - DNA, 12 bp, Homo sapiens
ctcactgtcctg

SEQ ID NO: 1522386 - DNA, 23 bp, Homo sapiens
ctcactgtgtcacccagactgga

SEQ ID NO: 1522387 - DNA, 19 bp, Homo sapiens
ctcactgtgtcacccaggc

SEQ ID NO: 1522388 - DNA, 15 bp, Homo sapiens
ctcactgttgaattt

SEQ ID NO: 1522389 - DNA, 21 bp, Homo sapiens
ctcactgttgaattttctcta

SEQ ID NO: 1522390 - DNA, 22 bp, Homo sapiens
ctcactgttgcagtggcctggc

SEQ ID NO: 1522391 - DNA, 19 bp, Homo sapiens
ctcactgtttgtttttatt

SEQ ID NO: 1522392 - DNA, 15 bp, Homo sapiens
ctcacttagtccttt

SEQ ID NO: 1522393 - DNA, 21 bp, Homo sapiens
ctcacttcccgtagctgccag

SEQ ID NO: 1522394 - DNA, 19 bp, Homo sapiens
ctcacttctgtctcctgtc

SEQ ID NO: 1522395 - DNA, 20 bp, Homo sapiens
ctcacttgatgtttcctgga

SEQ ID NO: 1522396 - DNA, 22 bp, Homo sapiens
ctcacttgatgtttcctggaag

SEQ ID NO: 1522397 - DNA, 17 bp, Homo sapiens
ctcacttggctgtctga

SEQ ID NO: 1522398 - DNA, 20 bp, Homo sapiens
ctcacttggctgtctgacca

SEQ ID NO: 1522399 - DNA, 16 bp, Homo sapiens
ctcactttaaacctgt

SEQ ID NO: 1522400 - DNA, 16 bp, Homo sapiens
ctcacttttcatcctt

SEQ ID NO: 1522401 - DNA, 19 bp, Homo sapiens
ctcagaaaaaggcagtggc

SEQ ID NO: 1522402 - DNA, 23 bp, Homo sapiens
ctcagaaagtgtataataagaaa

SEQ ID NO: 1522403 - DNA, 17 bp, Homo sapiens
ctcagaaatttttattt

SEQ ID NO: 1522404 - DNA, 21 bp, Homo sapiens
ctcagaaatttttatttttct

SEQ ID NO: 1522405 - DNA, 14 bp, Homo sapiens
ctcagaacagctga

SEQ ID NO: 1522406 - DNA, 10 bp, Homo sapiens
ctcagaacat

SEQ ID NO: 1522407 - DNA, 16 bp, Homo sapiens
ctcagaacatactgat

SEQ ID NO: 1522408 - DNA, 21 bp, Homo sapiens
ctcagaacatactgattggga

SEQ ID NO: 1522409 - DNA, 19 bp, Homo sapiens
ctcagaacttgctgctgtc

SEQ ID NO: 1522410 - DNA, 12 bp, Homo sapiens
ctcagaagaaaa

SEQ ID NO: 1522411 - DNA, 11 bp, Homo sapiens
ctcagaagcct

SEQ ID NO: 1522412 - DNA, 17 bp, Homo sapiens
ctcagaagcctgaggct

SEQ ID NO: 1522413 - DNA, 18 bp, Homo sapiens
ctcagaaggaatggtgcg

SEQ ID NO: 1522414 - DNA, 16 bp, Homo sapiens
ctcagaatctcaaata

SEQ ID NO: 1522415 - DNA, 14 bp, Homo sapiens
ctcagaattatttt

SEQ ID NO: 1522416 - DNA, 17 bp, Homo sapiens
ctcagaattatttttaa

SEQ ID NO: 1522417 - DNA, 11 bp, Homo sapiens
ctcagaattcg

SEQ ID NO: 1522418 - DNA, 13 bp, Homo sapiens
ctcagacattggc

SEQ ID NO: 1522419 - DNA, 12 bp, Homo sapiens
ctcagacatttt

SEQ ID NO: 1522420 - DNA, 13 bp, Homo sapiens
ctcagacccccac

SEQ ID NO: 1522421 - DNA, 14 bp, Homo sapiens
ctcagacccccact

SEQ ID NO: 1522422 - DNA, 15 bp, Homo sapiens
ctcagacccccactc

SEQ ID NO: 1522423 - DNA, 16 bp, Homo sapiens
ctcagacccccactct

SEQ ID NO: 1522424 - DNA, 23 bp, Homo sapiens
ctcagacccccactctcattccc

SEQ ID NO: 1522425 - DNA, 15 bp, Homo sapiens
ctcagacggcggcca

SEQ ID NO: 1522426 - DNA, 17 bp, Homo sapiens
ctcagacggcggccagg

SEQ ID NO: 1522427 - DNA, 18 bp, Homo sapiens
ctcagacggcggccaggc

SEQ ID NO: 1522428 - DNA, 20 bp, Homo sapiens
ctcagacggcggccaggcac

SEQ ID NO: 1522429 - DNA, 15 bp, Homo sapiens
ctcagacttgccagg

SEQ ID NO: 1522430 - DNA, 21 bp, Homo sapiens
ctcagagaaaaatgctcccca

SEQ ID NO: 1522431 - DNA, 23 bp, Homo sapiens
ctcagagaaaaatgctccccaca

SEQ ID NO: 1522432 - DNA, 16 bp, Homo sapiens
ctcagagaccagcact

SEQ ID NO: 1522433 - DNA, 23 bp, Homo sapiens
ctcagagaccagcactcagcctc

SEQ ID NO: 1522434 - DNA, 13 bp, Homo sapiens
ctcagagaccagg

SEQ ID NO: 1522435 - DNA, 16 bp, Homo sapiens
ctcagagaccgtgagc

SEQ ID NO: 1522436 - DNA, 14 bp, Homo sapiens
ctcagagcagagca

SEQ ID NO: 1522437 - DNA, 15 bp, Homo sapiens
ctcagagcagggcca

SEQ ID NO: 1522438 - DNA, 23 bp, Homo sapiens
ctcagagcagggccaaagcacag

SEQ ID NO: 1522439 - DNA, 15 bp, Homo sapiens
ctcagagccacccct

SEQ ID NO: 1522440 - DNA, 16 bp, Homo sapiens
ctcagaggcccaggaa

SEQ ID NO: 1522441 - DNA, 14 bp, Homo sapiens
ctcagaggcctgct

SEQ ID NO: 1522442 - DNA, 23 bp, Homo sapiens
ctcagaggtttacctagagaaca

SEQ ID NO: 1522443 - DNA, 22 bp, Homo sapiens
ctcagagtgacagtcataaata

SEQ ID NO: 1522444 - DNA, 16 bp, Homo sapiens
ctcagagtggagttga

SEQ ID NO: 1522445 - DNA, 16 bp, Homo sapiens
ctcagatccagggaca

SEQ ID NO: 1522446 - DNA, 15 bp, Homo sapiens
ctcagatccttgttt

SEQ ID NO: 1522447 - DNA, 19 bp, Homo sapiens
ctcagatcggccacagggc

SEQ ID NO: 1522448 - DNA, 13 bp, Homo sapiens
ctcagatggggca

SEQ ID NO: 1522449 - DNA, 17 bp, Homo sapiens
ctcagatggggcaccaa

SEQ ID NO: 1522450 - DNA, 22 bp, Homo sapiens
ctcagatttaagccttacaaag

SEQ ID NO: 1522451 - DNA, 13 bp, Homo sapiens
ctcagcaagccct

SEQ ID NO: 1522452 - DNA, 16 bp, Homo sapiens
ctcagcaaggggctct

SEQ ID NO: 1522453 - DNA, 13 bp, Homo sapiens
ctcagcaagtgcc

SEQ ID NO: 1522454 - DNA, 16 bp, Homo sapiens
ctcagcaagtgcccag

SEQ ID NO: 1522455 - DNA, 21 bp, Homo sapiens
ctcagcacattcgggaccaat

SEQ ID NO: 1522456 - DNA, 17 bp, Homo sapiens
ctcagcaccccttccat

SEQ ID NO: 1522457 - DNA, 20 bp, Homo sapiens
ctcagcaccccttccatgtg

SEQ ID NO: 1522458 - DNA, 21 bp, Homo sapiens
ctcagcaccccttccatgtgg

SEQ ID NO: 1522459 - DNA, 12 bp, Homo sapiens
ctcagcagccag

SEQ ID NO: 1522460 - DNA, 24 bp, Homo sapiens
ctcagcagccagtctcagagacca

SEQ ID NO: 1522461 - DNA, 16 bp, Homo sapiens
ctcagcagccctcctc

SEQ ID NO: 1522462 - DNA, 19 bp, Homo sapiens
ctcagcagccctcctcacc

SEQ ID NO: 1522463 - DNA, 21 bp, Homo sapiens
ctcagcagccctcctcacccc

SEQ ID NO: 1522464 - DNA, 14 bp, Homo sapiens
ctcagcagtgacca

SEQ ID NO: 1522465 - DNA, 15 bp, Homo sapiens
ctcagcatttctttt

SEQ ID NO: 1522466 - DNA, 23 bp, Homo sapiens
ctcagccaaatttcctgtttgaa

SEQ ID NO: 1522467 - DNA, 21 bp, Homo sapiens
ctcagccaccctgagttgctt

SEQ ID NO: 1522468 - DNA, 22 bp, Homo sapiens
ctcagccagggctgccagccag

SEQ ID NO: 1522469 - DNA, 16 bp, Homo sapiens
ctcagccagtggcaca

SEQ ID NO: 1522470 - DNA, 17 bp, Homo sapiens
ctcagccagtggcacag

SEQ ID NO: 1522471 - DNA, 22 bp, Homo sapiens
ctcagccagtggcacaggagac

SEQ ID NO: 1522472 - DNA, 23 bp, Homo sapiens
ctcagccagtggcacaggagact

SEQ ID NO: 1522473 - DNA, 15 bp, Homo sapiens
ctcagccatgaggag

SEQ ID NO: 1522474 - DNA, 16 bp, Homo sapiens
ctcagccatttccccc

SEQ ID NO: 1522475 - DNA, 18 bp, Homo sapiens
ctcagccatttccccctc

SEQ ID NO: 1522476 - DNA, 21 bp, Homo sapiens
ctcagccatttccccctcctc

SEQ ID NO: 1522477 - DNA, 15 bp, Homo sapiens
ctcagcccagctggc

SEQ ID NO: 1522478 - DNA, 17 bp, Homo sapiens
ctcagcccagctggcca

SEQ ID NO: 1522479 - DNA, 20 bp, Homo sapiens
ctcagcccagctggccacct

SEQ ID NO: 1522480 - DNA, 14 bp, Homo sapiens
ctcaatgtcttccc

SEQ ID NO: 1522481 - DNA, 13 bp, Homo sapiens
ctcaatgtttctg

SEQ ID NO: 1522482 - DNA, 23 bp, Homo sapiens
ctcaatttttgtttttgagtact

SEQ ID NO: 1522483 - DNA, 13 bp, Homo sapiens
ctcacaacccctg

SEQ ID NO: 1522484 - DNA, 18 bp, Homo sapiens
ctcacaagcctcttctga

SEQ ID NO: 1522485 - DNA, 13 bp, Homo sapiens
ctcacacccaccg

SEQ ID NO: 1522486 - DNA, 22 bp, Homo sapiens
ctcacacccaccgtccgccctg

SEQ ID NO: 1522487 - DNA, 12 bp, Homo sapiens
ctcacacccctg

SEQ ID NO: 1522488 - DNA, 15 bp, Homo sapiens
ctcacacccctgtcc

SEQ ID NO: 1522489 - DNA, 18 bp, Homo sapiens
ctcacaccctaccttccc

SEQ ID NO: 1522490 - DNA, 20 bp, Homo sapiens
ctcacaccctaccttcccca

SEQ ID NO: 1522491 - DNA, 20 bp, Homo sapiens
ctcacacgtttaatcccagc

SEQ ID NO: 1522492 - DNA, 21 bp, Homo sapiens
ctcacacgtttaatcccagca

SEQ ID NO: 1522493 - DNA, 12 bp, Homo sapiens
ctcacactgaga

SEQ ID NO: 1522494 - DNA, 15 bp, Homo sapiens
ctcacactggccaca

SEQ ID NO: 1522495 - DNA, 13 bp, Homo sapiens
ctcacagaagaat

SEQ ID NO: 1522496 - DNA, 22 bp, Homo sapiens
ctcacagacctggagcccctgg

SEQ ID NO: 1522497 - DNA, 18 bp, Homo sapiens
ctcacagagaagctcctg

SEQ ID NO: 1522498 - DNA, 24 bp, Homo sapiens
ctcacagagaagctcctgctactt

SEQ ID NO: 1522499 - DNA, 12 bp, Homo sapiens
ctcacagagtca

SEQ ID NO: 1522500 - DNA, 16 bp, Homo sapiens
ctcacagtgacccttc

SEQ ID NO: 1522501 - DNA, 19 bp, Homo sapiens
ctcacagtgggagccaggg

SEQ ID NO: 1522502 - DNA, 17 bp, Homo sapiens
ctcacagtgttgcccag

SEQ ID NO: 1522503 - DNA, 13 bp, Homo sapiens
ctcacagttatta

SEQ ID NO: 1522504 - DNA, 13 bp, Homo sapiens
ctcacagttcctc

SEQ ID NO: 1522505 - DNA, 18 bp, Homo sapiens
ctcacagttcctcgccct

SEQ ID NO: 1522506 - DNA, 20 bp, Homo sapiens
ctcacagttcctcgccctgg

SEQ ID NO: 1522507 - DNA, 22 bp, Homo sapiens
ctcacagttcctcgccctgggt

SEQ ID NO: 1522508 - DNA, 23 bp, Homo sapiens
ctcacagttcctcgccctgggtc

SEQ ID NO: 1522509 - DNA, 13 bp, Homo sapiens
ctcacataagccc

SEQ ID NO: 1522510 - DNA, 22 bp, Homo sapiens
ctcacatacataagcagcattt

SEQ ID NO: 1522511 - DNA, 14 bp, Homo sapiens
ctcacatactgact

SEQ ID NO: 1522512 - DNA, 17 bp, Homo sapiens
ctcacatagccaactct

SEQ ID NO: 1522513 - DNA, 17 bp, Homo sapiens
ctcacatataacatgca

SEQ ID NO: 1522514 - DNA, 16 bp, Homo sapiens
ctcacattacacacac

SEQ ID NO: 1522515 - DNA, 13 bp, Homo sapiens
ctcacattgctgt

SEQ ID NO: 1522516 - DNA, 12 bp, Homo sapiens
ctcacatttatg

SEQ ID NO: 1522517 - DNA, 13 bp, Homo sapiens
ctcaccaaaatat

SEQ ID NO: 1522518 - DNA, 14 bp, Homo sapiens
ctcaccaaaatata

SEQ ID NO: 1522519 - DNA, 21 bp, Homo sapiens
ctcaccaaaatatagttaatt

SEQ ID NO: 1522520 - DNA, 15 bp, Homo sapiens
ctcaccaccacacta

SEQ ID NO: 1522521 - DNA, 18 bp, Homo sapiens
ctcaccactaccagccag

SEQ ID NO: 1522522 - DNA, 19 bp, Homo sapiens
ctcaccactaccagccagc

SEQ ID NO: 1522523 - DNA, 23 bp, Homo sapiens
ctcaccactaccagccagcctca

SEQ ID NO: 1522524 - DNA, 21 bp, Homo sapiens
ctcaccactgccccctgctgc

SEQ ID NO: 1522525 - DNA, 18 bp, Homo sapiens
ctcaccagccccactgcc

SEQ ID NO: 1522526 - DNA, 17 bp, Homo sapiens
ctcaccagccccccgcg

SEQ ID NO: 1522527 - DNA, 20 bp, Homo sapiens
ctcaccagccccccgcgcgc

SEQ ID NO: 1522528 - DNA, 12 bp, Homo sapiens
ctcaccagccct

SEQ ID NO: 1522529 - DNA, 19 bp, Homo sapiens
ctcaccagccctagctgtc

SEQ ID NO: 1522530 - DNA, 21 bp, Homo sapiens
ctcaccagctggggtcctgtc

SEQ ID NO: 1522531 - DNA, 17 bp, Homo sapiens
ctcaccaggcctggcct

SEQ ID NO: 1522532 - DNA, 18 bp, Homo sapiens
ctcaccaggcctggcctc

SEQ ID NO: 1522533 - DNA, 12 bp, Homo sapiens
ctcaccagggtc

SEQ ID NO: 1522534 - DNA, 21 bp, Homo sapiens
ctcaccagggtccgcaccagc

SEQ ID NO: 1522535 - DNA, 12 bp, Homo sapiens
ctcaccatccag

SEQ ID NO: 1522536 - DNA, 14 bp, Homo sapiens
ctcaccatccagtg

SEQ ID NO: 1522537 - DNA, 19 bp, Homo sapiens
ctcaccatgatgtgaagag

SEQ ID NO: 1522538 - DNA, 13 bp, Homo sapiens
ctcacccaaaaga

SEQ ID NO: 1522539 - DNA, 22 bp, Homo sapiens
ctcacccagtccccacccgcct

SEQ ID NO: 1522540 - DNA, 17 bp, Homo sapiens
ctcacccccaggtgttg

SEQ ID NO: 1522541 - DNA, 20 bp, Homo sapiens
ctcacccccaggtgttgcca

SEQ ID NO: 1522542 - DNA, 15 bp, Homo sapiens
ctcaccccgtctggg

SEQ ID NO: 1522543 - DNA, 16 bp, Homo sapiens
ctcacccctagccctg

SEQ ID NO: 1522544 - DNA, 17 bp, Homo sapiens
ctcacccctagccctgg

SEQ ID NO: 1522545 - DNA, 18 bp, Homo sapiens
ctcacccctagccctggt

SEQ ID NO: 1522546 - DNA, 14 bp, Homo sapiens
ctcacccctcgcca

SEQ ID NO: 1522547 - DNA, 16 bp, Homo sapiens
ctcacccctgccctgg

SEQ ID NO: 1522548 - DNA, 19 bp, Homo sapiens
ctcacccctggttctcatc

SEQ ID NO: 1522549 - DNA, 21 bp, Homo sapiens
ctcacccctggttctcatctt

SEQ ID NO: 1522550 - DNA, 15 bp, Homo sapiens
ctcaccctcatacca

SEQ ID NO: 1522551 - DNA, 21 bp, Homo sapiens
ctcaccctcataccatctgct

SEQ ID NO: 1522552 - DNA, 22 bp, Homo sapiens
ctcaccctcccaagtagctggg

SEQ ID NO: 1522553 - DNA, 15 bp, Homo sapiens
ctcaccctgcccgct

SEQ ID NO: 1522554 - DNA, 13 bp, Homo sapiens
ctcaccctgcctt

SEQ ID NO: 1522555 - DNA, 15 bp, Homo sapiens
ctcaccctgccttat

SEQ ID NO: 1522556 - DNA, 14 bp, Homo sapiens
ctcacccttgcacc

SEQ ID NO: 1522557 - DNA, 13 bp, Homo sapiens
ctcaccggctctc

SEQ ID NO: 1522558 - DNA, 15 bp, Homo sapiens
ctcacctagcctgat

SEQ ID NO: 1522559 - DNA, 23 bp, Homo sapiens
ctcacctcatgcccaccccctgc

SEQ ID NO: 1522560 - DNA, 19 bp, Homo sapiens
ctcacctcccgaagccacc

SEQ ID NO: 1522561 - DNA, 14 bp, Homo sapiens
ctcacctctgagga

SEQ ID NO: 1522562 - DNA, 15 bp, Homo sapiens
ctcacctctgaggac

SEQ ID NO: 1522563 - DNA, 12 bp, Homo sapiens
ctcacctctgcc

SEQ ID NO: 1522564 - DNA, 14 bp, Homo sapiens
ctcacctctgcctc

SEQ ID NO: 1522565 - DNA, 15 bp, Homo sapiens
ctcacctctgcctca

SEQ ID NO: 1522566 - DNA, 18 bp, Homo sapiens
ctcacctctgcctcaatg

SEQ ID NO: 1522567 - DNA, 19 bp, Homo sapiens
ctcacctctgcctcaatgt

SEQ ID NO: 1522568 - DNA, 14 bp, Homo sapiens
ctcacctctggact

SEQ ID NO: 1522569 - DNA, 15 bp, Homo sapiens
ctcacctctggactg

SEQ ID NO: 1522570 - DNA, 21 bp, Homo sapiens
ctcacctctggactggctaga

SEQ ID NO: 1522571 - DNA, 22 bp, Homo sapiens
ctcacctctggactggctagag

SEQ ID NO: 1522572 - DNA, 20 bp, Homo sapiens
ctcacctgagacctccactc

SEQ ID NO: 1522573 - DNA, 20 bp, Homo sapiens
ctcacctgggcagggatgat

SEQ ID NO: 1522574 - DNA, 21 bp, Homo sapiens
ctcacctgtgtgcccagcacc

SEQ ID NO: 1522575 - DNA, 14 bp, Homo sapiens
ctcaccttctgagt

SEQ ID NO: 1522576 - DNA, 19 bp, Homo sapiens
ctcaccttggcaccagaca

SEQ ID NO: 1522577 - DNA, 17 bp, Homo sapiens
ctcacctttcccatctt

SEQ ID NO: 1522578 - DNA, 14 bp, Homo sapiens
ctcacctttgtttt

SEQ ID NO: 1522579 - DNA, 22 bp, Homo sapiens
ctcacgcctgtaatcccagcac

SEQ ID NO: 1522580 - DNA, 16 bp, Homo sapiens
ctcacggggttggctg

SEQ ID NO: 1522581 - DNA, 21 bp, Homo sapiens
ctcacggggttggctgttcca

SEQ ID NO: 1522582 - DNA, 22 bp, Homo sapiens
ctcacggggttggctgttccag

SEQ ID NO: 1522583 - DNA, 13 bp, Homo sapiens
ctcacgtaatgca

SEQ ID NO: 1522584 - DNA, 17 bp, Homo sapiens
ctcacgtaatgcattgc

SEQ ID NO: 1522585 - DNA, 22 bp, Homo sapiens
ctcacgtaatgcattgcctgta

SEQ ID NO: 1522586 - DNA, 21 bp, Homo sapiens
ctcacgtatttcacagagcac

SEQ ID NO: 1522587 - DNA, 13 bp, Homo sapiens
ctcacgtctctgc

SEQ ID NO: 1522588 - DNA, 17 bp, Homo sapiens
ctcacgtctctgccgcc

SEQ ID NO: 1522589 - DNA, 14 bp, Homo sapiens
ctcactaaagcatg

SEQ ID NO: 1522590 - DNA, 23 bp, Homo sapiens
ctcactaatttttgtattatttt

SEQ ID NO: 1522591 - DNA, 11 bp, Homo sapiens
ctcactactga

SEQ ID NO: 1522592 - DNA, 16 bp, Homo sapiens
ctcactactgaacaca

SEQ ID NO: 1522593 - DNA, 12 bp, Homo sapiens
ctcactcagcca

SEQ ID NO: 1522594 - DNA, 22 bp, Homo sapiens
ctcactcagccaccctgagttg

SEQ ID NO: 1522595 - DNA, 14 bp, Homo sapiens
ctcactccacagag

SEQ ID NO: 1522596 - DNA, 14 bp, Homo sapiens
ctcactccaccacc

SEQ ID NO: 1522597 - DNA, 21 bp, Homo sapiens
ctataaattcaacacttattt

SEQ ID NO: 1522598 - DNA, 22 bp, Homo sapiens
ctataaattcaacacttatttt

SEQ ID NO: 1522599 - DNA, 18 bp, Homo sapiens
ctataacaatcactggct

SEQ ID NO: 1522600 - DNA, 17 bp, Homo sapiens
ctataacactgtgaaga

SEQ ID NO: 1522601 - DNA, 13 bp, Homo sapiens
ctataagaataag

SEQ ID NO: 1522602 - DNA, 21 bp, Homo sapiens
ctataagagaattatatattt

SEQ ID NO: 1522603 - DNA, 22 bp, Homo sapiens
ctataagagaattatatatttc

SEQ ID NO: 1522604 - DNA, 23 bp, Homo sapiens
ctataaggtgctctctttctgtc

SEQ ID NO: 1522605 - DNA, 15 bp, Homo sapiens
ctataataaagaagt

SEQ ID NO: 1522606 - DNA, 21 bp, Homo sapiens
ctataatgtaagctctactga

SEQ ID NO: 1522607 - DNA, 17 bp, Homo sapiens
ctataattctgttatat

SEQ ID NO: 1522608 - DNA, 15 bp, Homo sapiens
ctataattttgcctt

SEQ ID NO: 1522609 - DNA, 21 bp, Homo sapiens
ctatacaaattttcagaaggt

SEQ ID NO: 1522610 - DNA, 19 bp, Homo sapiens
ctatactgcatacttttta

SEQ ID NO: 1522611 - DNA, 21 bp, Homo sapiens
ctatactgcatactttttaaa

SEQ ID NO: 1522612 - DNA, 15 bp, Homo sapiens
ctatacttctccttt

SEQ ID NO: 1522613 - DNA, 20 bp, Homo sapiens
ctatactttgttctgttgtc

SEQ ID NO: 1522614 - DNA, 12 bp, Homo sapiens
ctatagactcta

SEQ ID NO: 1522615 - DNA, 19 bp, Homo sapiens
ctatagagagggggctctc

SEQ ID NO: 1522616 - DNA, 21 bp, Homo sapiens
ctatagagagggggctctcca

SEQ ID NO: 1522617 - DNA, 14 bp, Homo sapiens
ctatagctacatgt

SEQ ID NO: 1522618 - DNA, 20 bp, Homo sapiens
ctataggtgctacaaaaaca

SEQ ID NO: 1522619 - DNA, 14 bp, Homo sapiens
ctatagttctagac

SEQ ID NO: 1522620 - DNA, 15 bp, Homo sapiens
ctatagttctagaca

SEQ ID NO: 1522621 - DNA, 14 bp, Homo sapiens
ctatatagttcctt

SEQ ID NO: 1522622 - DNA, 19 bp, Homo sapiens
ctatatagttccttgcctt

SEQ ID NO: 1522623 - DNA, 19 bp, Homo sapiens
ctatatataaaacggtgct

SEQ ID NO: 1522624 - DNA, 16 bp, Homo sapiens
ctatatataaagacaa

SEQ ID NO: 1522625 - DNA, 23 bp, Homo sapiens
ctatatataaagacaacaaaaga

SEQ ID NO: 1522626 - DNA, 18 bp, Homo sapiens
ctatatatacatatgtaa

SEQ ID NO: 1522627 - DNA, 13 bp, Homo sapiens
ctatatatgtgta

SEQ ID NO: 1522628 - DNA, 16 bp, Homo sapiens
ctatatatttctatta

SEQ ID NO: 1522629 - DNA, 17 bp, Homo sapiens
ctatatcagtcgtttta

SEQ ID NO: 1522630 - DNA, 21 bp, Homo sapiens
ctatatcagtcgttttagtgt

SEQ ID NO: 1522631 - DNA, 22 bp, Homo sapiens
ctatatcataactatacttgat

SEQ ID NO: 1522632 - DNA, 16 bp, Homo sapiens
ctatatcatatttctg

SEQ ID NO: 1522633 - DNA, 14 bp, Homo sapiens
ctatatctatttga

SEQ ID NO: 1522634 - DNA, 16 bp, Homo sapiens
ctatatctatttgaga

SEQ ID NO: 1522635 - DNA, 16 bp, Homo sapiens
ctatatctgtatataa

SEQ ID NO: 1522636 - DNA, 20 bp, Homo sapiens
ctatatctgtatataaaata

SEQ ID NO: 1522637 - DNA, 16 bp, Homo sapiens
ctatatgaatttaaat

SEQ ID NO: 1522638 - DNA, 21 bp, Homo sapiens
ctatatggcaaatagccacaa

SEQ ID NO: 1522639 - DNA, 20 bp, Homo sapiens
ctatatgtgaaacatttttt

SEQ ID NO: 1522640 - DNA, 20 bp, Homo sapiens
ctatattatgtcttcttttg

SEQ ID NO: 1522641 - DNA, 22 bp, Homo sapiens
ctatattgcttagtaagtattt

SEQ ID NO: 1522642 - DNA, 23 bp, Homo sapiens
ctatattgttttcagtgtacatg

SEQ ID NO: 1522643 - DNA, 13 bp, Homo sapiens
ctatatttagatt

SEQ ID NO: 1522644 - DNA, 23 bp, Homo sapiens
ctatatttgctagactctagaca

SEQ ID NO: 1522645 - DNA, 13 bp, Homo sapiens
ctatatttgtctt

SEQ ID NO: 1522646 - DNA, 14 bp, Homo sapiens
ctatatttgtcttc

SEQ ID NO: 1522647 - DNA, 14 bp, Homo sapiens
ctatattttaatag

SEQ ID NO: 1522648 - DNA, 17 bp, Homo sapiens
ctatatttttgtactga

SEQ ID NO: 1522649 - DNA, 16 bp, Homo sapiens
ctatcaaactgaagcc

SEQ ID NO: 1522650 - DNA, 20 bp, Homo sapiens
ctatcaaactgaagccagaa

SEQ ID NO: 1522651 - DNA, 15 bp, Homo sapiens
ctatcaacaataaaa

SEQ ID NO: 1522652 - DNA, 13 bp, Homo sapiens
ctatcaactacaa

SEQ ID NO: 1522653 - DNA, 19 bp, Homo sapiens
ctatcacacatgaataaag

SEQ ID NO: 1522654 - DNA, 12 bp, Homo sapiens
ctatcacctgtc

SEQ ID NO: 1522655 - DNA, 16 bp, Homo sapiens
ctatcacctgtcatca

SEQ ID NO: 1522656 - DNA, 14 bp, Homo sapiens
ctatcagtgctttg

SEQ ID NO: 1522657 - DNA, 20 bp, Homo sapiens
ctatcattgcttcctcctcc

SEQ ID NO: 1522658 - DNA, 21 bp, Homo sapiens
ctatccccatctccctgcctg

SEQ ID NO: 1522659 - DNA, 15 bp, Homo sapiens
ctatcctctcttcct

SEQ ID NO: 1522660 - DNA, 20 bp, Homo sapiens
ctatcctctcttcctcttcc

SEQ ID NO: 1522661 - DNA, 17 bp, Homo sapiens
ctatcctgattccaaat

SEQ ID NO: 1522662 - DNA, 16 bp, Homo sapiens
ctatccttccagtggc

SEQ ID NO: 1522663 - DNA, 19 bp, Homo sapiens
ctatccttccagtggctcg

SEQ ID NO: 1522664 - DNA, 22 bp, Homo sapiens
ctatccttggctttcagagcca

SEQ ID NO: 1522665 - DNA, 18 bp, Homo sapiens
ctatcgagtttgcaatgt

SEQ ID NO: 1522666 - DNA, 16 bp, Homo sapiens
ctatcgccctcctttc

SEQ ID NO: 1522667 - DNA, 20 bp, Homo sapiens
ctatcgccctcctttccctt

SEQ ID NO: 1522668 - DNA, 21 bp, Homo sapiens
ctatcgccctcctttccctta

SEQ ID NO: 1522669 - DNA, 19 bp, Homo sapiens
ctatcgtaacctggtgcct

SEQ ID NO: 1522670 - DNA, 17 bp, Homo sapiens
ctatctaaccctcccat

SEQ ID NO: 1522671 - DNA, 12 bp, Homo sapiens
ctatctcatcta

SEQ ID NO: 1522672 - DNA, 19 bp, Homo sapiens
ctatctccagcggccctgt

SEQ ID NO: 1522673 - DNA, 13 bp, Homo sapiens
ctatctccctggc

SEQ ID NO: 1522674 - DNA, 16 bp, Homo sapiens
ctatctccctggctca

SEQ ID NO: 1522675 - DNA, 18 bp, Homo sapiens
ctatctccgttccatctg

SEQ ID NO: 1522676 - DNA, 12 bp, Homo sapiens
ctatctcctgac

SEQ ID NO: 1522677 - DNA, 17 bp, Homo sapiens
ctatctctgtgtgcaca

SEQ ID NO: 1522678 - DNA, 21 bp, Homo sapiens
ctatctctgtgtgcacaaata

SEQ ID NO: 1522679 - DNA, 17 bp, Homo sapiens
ctatctgattttgtgca

SEQ ID NO: 1522680 - DNA, 18 bp, Homo sapiens
ctatctgccaaattgaga

SEQ ID NO: 1522681 - DNA, 19 bp, Homo sapiens
ctatctggaggccttccag

SEQ ID NO: 1522682 - DNA, 23 bp, Homo sapiens
ctatctggaggccttccagctgc

SEQ ID NO: 1522683 - DNA, 15 bp, Homo sapiens
ctatctgtggaaagc

SEQ ID NO: 1522684 - DNA, 14 bp, Homo sapiens
ctatctgtgttttg

SEQ ID NO: 1522685 - DNA, 20 bp, Homo sapiens
ctatcttatctcagatattt

SEQ ID NO: 1522686 - DNA, 14 bp, Homo sapiens
ctatctttgctgca

SEQ ID NO: 1522687 - DNA, 18 bp, Homo sapiens
ctatgaagacttaaaaga

SEQ ID NO: 1522688 - DNA, 23 bp, Homo sapiens
ctatgaagtatataatggtttca

SEQ ID NO: 1522689 - DNA, 16 bp, Homo sapiens
ctatgaagttgctgtt

SEQ ID NO: 1522690 - DNA, 22 bp, Homo sapiens
ctatgaagttgctgtttatttt

SEQ ID NO: 1522691 - DNA, 12 bp, Homo sapiens
ctatgacacagt

SEQ ID NO: 1522692 - DNA, 21 bp, Homo sapiens
ctatgacataaaaacaacttt

SEQ ID NO: 1522693 - DNA, 16 bp, Homo sapiens
ctatgacattactgta

SEQ ID NO: 1522694 - DNA, 15 bp, Homo sapiens
ctatgactacatttt

SEQ ID NO: 1522695 - DNA, 16 bp, Homo sapiens
ctatgactgtatcttg

SEQ ID NO: 1522696 - DNA, 16 bp, Homo sapiens
ctatgagaaaagaggc

SEQ ID NO: 1522697 - DNA, 21 bp, Homo sapiens
ctatgagaattgggattacat

SEQ ID NO: 1522698 - DNA, 16 bp, Homo sapiens
ctatgagagatgtgtc

SEQ ID NO: 1522699 - DNA, 16 bp, Homo sapiens
ctatgatcacagtgac

SEQ ID NO: 1522700 - DNA, 14 bp, Homo sapiens
ctatgatctcagga

SEQ ID NO: 1522701 - DNA, 16 bp, Homo sapiens
ctatgatctcaggagc

SEQ ID NO: 1522702 - DNA, 19 bp, Homo sapiens
ctatgatgagaggccagca

SEQ ID NO: 1522703 - DNA, 13 bp, Homo sapiens
ctatgatgtttct

SEQ ID NO: 1522704 - DNA, 18 bp, Homo sapiens
ctatgattatgccactgc

SEQ ID NO: 1522705 - DNA, 20 bp, Homo sapiens
ctatgcaaaatagacatctt

SEQ ID NO: 1522706 - DNA, 21 bp, Homo sapiens
ctatgcaaaatagacatcttt

SEQ ID NO: 1522707 - DNA, 21 bp, Homo sapiens
ctatgcacatatggactctgc

SEQ ID NO: 1522708 - DNA, 17 bp, Homo sapiens
ctatgcagaggcctggg

SEQ ID NO: 1522709 - DNA, 13 bp, Homo sapiens
ctatgcatggtgc

SEQ ID NO: 1522710 - DNA, 19 bp, Homo sapiens
ctatgccgtcttctgccct

SEQ ID NO: 1522711 - DNA, 16 bp, Homo sapiens
ctatgcctgtatttcc

SEQ ID NO: 1522712 - DNA, 17 bp, Homo sapiens
ctatgcctgtatttcca

SEQ ID NO: 1522713 - DNA, 22 bp, Homo sapiens
ctatgctaatttttggagaaat

SEQ ID NO: 1522714 - DNA, 13 bp, Homo sapiens
ctatgctggtaga

SEQ ID NO: 1522715 - DNA, 20 bp, Homo sapiens
ctatggaatagttctgtata

SEQ ID NO: 1522716 - DNA, 22 bp, Homo sapiens
ctatggatcaaagaaattcaga

SEQ ID NO: 1522717 - DNA, 22 bp, Homo sapiens
ctatggcagaaaaaatgtctgt

SEQ ID NO: 1522718 - DNA, 14 bp, Homo sapiens
ctatggcagtccag

SEQ ID NO: 1522719 - DNA, 17 bp, Homo sapiens
ctatggcagtccagcca

SEQ ID NO: 1522720 - DNA, 22 bp, Homo sapiens
ctatggcagtccagccagctcc

SEQ ID NO: 1522721 - DNA, 23 bp, Homo sapiens
ctatggcagtccagccagctcct

SEQ ID NO: 1522722 - DNA, 14 bp, Homo sapiens
ctatggccagtctg

SEQ ID NO: 1522723 - DNA, 15 bp, Homo sapiens
ctatggcccagaaac

SEQ ID NO: 1522724 - DNA, 17 bp, Homo sapiens
ctatggctgcctgcatc

SEQ ID NO: 1522725 - DNA, 15 bp, Homo sapiens
ctatgggagccccag

SEQ ID NO: 1522726 - DNA, 19 bp, Homo sapiens
ctatgggcctgccgggctg

SEQ ID NO: 1522727 - DNA, 23 bp, Homo sapiens
ctatgggcctgccgggctgaggg

SEQ ID NO: 1522728 - DNA, 20 bp, Homo sapiens
ctatggggatagatgtgtgg

SEQ ID NO: 1522729 - DNA, 20 bp, Homo sapiens
ctatgggttatttttattaa

SEQ ID NO: 1522730 - DNA, 15 bp, Homo sapiens
ctatggtaacacttt

SEQ ID NO: 1522731 - DNA, 20 bp, Homo sapiens
ctatggttcccaataaaagt

SEQ ID NO: 1522732 - DNA, 23 bp, Homo sapiens
ctatggttcccaataaaagtgac

SEQ ID NO: 1522733 - DNA, 15 bp, Homo sapiens
ctatgtataaaatac

SEQ ID NO: 1522734 - DNA, 17 bp, Homo sapiens
ctatgtataaaatacat

SEQ ID NO: 1522735 - DNA, 14 bp, Homo sapiens
ctatgtatatacat

SEQ ID NO: 1522736 - DNA, 14 bp, Homo sapiens
ctatgtatggaata

SEQ ID NO: 1522737 - DNA, 22 bp, Homo sapiens
ctatgtatggaatacagtgtta

SEQ ID NO: 1522738 - DNA, 14 bp, Homo sapiens
ctatgtatgttaat

SEQ ID NO: 1522739 - DNA, 20 bp, Homo sapiens
ctatgtcaatttgtatatca

SEQ ID NO: 1522740 - DNA, 19 bp, Homo sapiens
ctatgtcatttttaatgta

SEQ ID NO: 1522741 - DNA, 14 bp, Homo sapiens
ctatgtcctaagga

SEQ ID NO: 1522742 - DNA, 20 bp, Homo sapiens
ctatgtcctaaggacacact

SEQ ID NO: 1522743 - DNA, 16 bp, Homo sapiens
ctatgtcgagagctgg

SEQ ID NO: 1522744 - DNA, 13 bp, Homo sapiens
ctatgtctcagga

SEQ ID NO: 1522745 - DNA, 12 bp, Homo sapiens
ctatgtgacaat

SEQ ID NO: 1522746 - DNA, 17 bp, Homo sapiens
ctatgtgccagttcctg

SEQ ID NO: 1522747 - DNA, 15 bp, Homo sapiens
ctatgtggctgaaaa

SEQ ID NO: 1522748 - DNA, 15 bp, Homo sapiens
ctatgttactatttt

SEQ ID NO: 1522749 - DNA, 16 bp, Homo sapiens
ctatgttactattttc

SEQ ID NO: 1522750 - DNA, 13 bp, Homo sapiens
ctatgttcaaaga

SEQ ID NO: 1522751 - DNA, 18 bp, Homo sapiens
ctatgttctgtcttccca

SEQ ID NO: 1522752 - DNA, 13 bp, Homo sapiens
ctatgtttgtgtg

SEQ ID NO: 1522753 - DNA, 23 bp, Homo sapiens
ctatgtttgtgtgatttcctaaa

SEQ ID NO: 1522754 - DNA, 23 bp, Homo sapiens
ctattaaaaaagtctacaacata

SEQ ID NO: 1522755 - DNA, 23 bp, Homo sapiens
ctattaaagtgctaaggttctaa

SEQ ID NO: 1522756 - DNA, 23 bp, Homo sapiens
ctattaagatttccaagtgccaa

SEQ ID NO: 1522757 - DNA, 19 bp, Homo sapiens
ctattaatcacctctctgt

SEQ ID NO: 1522758 - DNA, 22 bp, Homo sapiens
ctattacgtgggtgccctctcc

SEQ ID NO: 1522759 - DNA, 16 bp, Homo sapiens
ctattagagtatttcc

SEQ ID NO: 1522760 - DNA, 20 bp, Homo sapiens
ctattagagtatttcccttc

SEQ ID NO: 1522761 - DNA, 17 bp, Homo sapiens
ctattataatttaatgc

SEQ ID NO: 1522762 - DNA, 17 bp, Homo sapiens
ctattatagcaacttta

SEQ ID NO: 1522763 - DNA, 14 bp, Homo sapiens
ctattatattaaaa

SEQ ID NO: 1522764 - DNA, 12 bp, Homo sapiens
ctattatttcct

SEQ ID NO: 1522765 - DNA, 12 bp, Homo sapiens
ctattatttgga

SEQ ID NO: 1522766 - DNA, 13 bp, Homo sapiens
ctattatttggag

SEQ ID NO: 1522767 - DNA, 22 bp, Homo sapiens
ctattattttcactgtagaatg

SEQ ID NO: 1522768 - DNA, 23 bp, Homo sapiens
ctattcaagaggaaatgtcacag

SEQ ID NO: 1522769 - DNA, 11 bp, Homo sapiens
ctattcacaac

SEQ ID NO: 1522770 - DNA, 23 bp, Homo sapiens
ctattcacgccgtaattctttct

SEQ ID NO: 1522771 - DNA, 21 bp, Homo sapiens
ctattcaggagagtagaacag

SEQ ID NO: 1522772 - DNA, 14 bp, Homo sapiens
ctattcctaggagg

SEQ ID NO: 1522773 - DNA, 22 bp, Homo sapiens
ctattcctgtaaataagagttg

SEQ ID NO: 1522774 - DNA, 16 bp, Homo sapiens
ctattccttttctgta

SEQ ID NO: 1522775 - DNA, 17 bp, Homo sapiens
ctattccttttctgtat

SEQ ID NO: 1522776 - DNA, 23 bp, Homo sapiens
ctattctagcctgcattgagctt

SEQ ID NO: 1522777 - DNA, 16 bp, Homo sapiens
ctattctcatgcctca

SEQ ID NO: 1522778 - DNA, 21 bp, Homo sapiens
ctattctctccaaaaatgcac

SEQ ID NO: 1522779 - DNA, 16 bp, Homo sapiens
ctattctgagaaaaca

SEQ ID NO: 1522780 - DNA, 17 bp, Homo sapiens
ctattctgagaaaacaa

SEQ ID NO: 1522781 - DNA, 13 bp, Homo sapiens
ctattctgagcct

SEQ ID NO: 1522782 - DNA, 15 bp, Homo sapiens
ctattctgagccttg

SEQ ID NO: 1522783 - DNA, 12 bp, Homo sapiens
ctattctgtcag

SEQ ID NO: 1522784 - DNA, 22 bp, Homo sapiens
ctattctgtcagtgttaaagat

SEQ ID NO: 1522785 - DNA, 14 bp, Homo sapiens
ctattcttgatgta

SEQ ID NO: 1522786 - DNA, 17 bp, Homo sapiens
ctattcttgatgtaaaa

SEQ ID NO: 1522787 - DNA, 18 bp, Homo sapiens
ctattcttgatgtaaaat

SEQ ID NO: 1522788 - DNA, 17 bp, Homo sapiens
ctattgacaagtcattt

SEQ ID NO: 1522789 - DNA, 16 bp, Homo sapiens
ctattgacttttcaat

SEQ ID NO: 1522790 - DNA, 18 bp, Homo sapiens
ctattgacttttcaataa

SEQ ID NO: 1522791 - DNA, 20 bp, Homo sapiens
ctattgatgtacagtctgtc

SEQ ID NO: 1522792 - DNA, 23 bp, Homo sapiens
ctattgatgtacagtctgtcatg

SEQ ID NO: 1522793 - DNA, 21 bp, Homo sapiens
ctattgcaaaggttccaactg

SEQ ID NO: 1522794 - DNA, 16 bp, Homo sapiens
ctattgcgctctcaag

SEQ ID NO: 1522795 - DNA, 19 bp, Homo sapiens
ctattgcgctctcaagacc

SEQ ID NO: 1522796 - DNA, 22 bp, Homo sapiens
ctattggaatttttttttcctg

SEQ ID NO: 1522797 - DNA, 20 bp, Homo sapiens
ctattgggcacagcctaggg

SEQ ID NO: 1522798 - DNA, 16 bp, Homo sapiens
ctattgtaatcatttg

SEQ ID NO: 1522799 - DNA, 14 bp, Homo sapiens
ctattgtagagcca

SEQ ID NO: 1522800 - DNA, 16 bp, Homo sapiens
ctattgtagcatttct

SEQ ID NO: 1522801 - DNA, 15 bp, Homo sapiens
ctattgttaaacaaa

SEQ ID NO: 1522802 - DNA, 17 bp, Homo sapiens
ctattgttaaacaaatg

SEQ ID NO: 1522803 - DNA, 18 bp, Homo sapiens
ctattgttaaacaaatga

SEQ ID NO: 1522804 - DNA, 19 bp, Homo sapiens
ctattgttaaacaaatgat

SEQ ID NO: 1522805 - DNA, 15 bp, Homo sapiens
ctattgttgtgggct

SEQ ID NO: 1522806 - DNA, 14 bp, Homo sapiens
ctattgtttattct

SEQ ID NO: 1522807 - DNA, 11 bp, Homo sapiens
ctatttaatgg

SEQ ID NO: 1522808 - DNA, 17 bp, Homo sapiens
ctatttagtttttgtaa

SEQ ID NO: 1522809 - DNA, 22 bp, Homo sapiens
ctatttagtttttgtaatttat

SEQ ID NO: 1522810 - DNA, 23 bp, Homo sapiens
ctatttagtttttgtaatttatt

SEQ ID NO: 1522811 - DNA, 18 bp, Homo sapiens
ctatttataagtgacttt

SEQ ID NO: 1522812 - DNA, 12 bp, Homo sapiens
ctatttatatca

SEQ ID NO: 1522813 - DNA, 13 bp, Homo sapiens
ctatttatatcac

SEQ ID NO: 1522814 - DNA, 23 bp, Homo sapiens
ctatttatatcacacaatatagt

SEQ ID NO: 1522815 - DNA, 21 bp, Homo sapiens
ctatttatctgtagtaaacta

SEQ ID NO: 1522816 - DNA, 11 bp, Homo sapiens
ctatttatgaa

SEQ ID NO: 1522817 - DNA, 15 bp, Homo sapiens
ctatttattaatatt

SEQ ID NO: 1522818 - DNA, 18 bp, Homo sapiens
ctatttattgactttgac

SEQ ID NO: 1522819 - DNA, 18 bp, Homo sapiens
ctatttatttactgagct

SEQ ID NO: 1522820 - DNA, 15 bp, Homo sapiens
ctatttcaaaatgtc

SEQ ID NO: 1522821 - DNA, 18 bp, Homo sapiens
ctatttccactgaacaaa

SEQ ID NO: 1522822 - DNA, 21 bp, Homo sapiens
ctatttccccaggggaaaatg

SEQ ID NO: 1522823 - DNA, 17 bp, Homo sapiens
ctatttcccctcttctg

SEQ ID NO: 1522824 - DNA, 14 bp, Homo sapiens
ctatttctatctgc

SEQ ID NO: 1522825 - DNA, 18 bp, Homo sapiens
ctatttctatgtcatttt

SEQ ID NO: 1522826 - DNA, 21 bp, Homo sapiens
ctatttctgggtcttttgcta

SEQ ID NO: 1522827 - DNA, 15 bp, Homo sapiens
ctatttctgtgtcca

SEQ ID NO: 1522828 - DNA, 20 bp, Homo sapiens
ctatttcttaatgtaacatg

SEQ ID NO: 1522829 - DNA, 20 bp, Homo sapiens
ctatttctttcagcagaaat

SEQ ID NO: 1522830 - DNA, 14 bp, Homo sapiens
ctatttgaacaagt

SEQ ID NO: 1522831 - DNA, 18 bp, Homo sapiens
ctatttgagaagttctca

SEQ ID NO: 1522832 - DNA, 23 bp, Homo sapiens
ctatttgagcatgcacagctgct

SEQ ID NO: 1522833 - DNA, 18 bp, Homo sapiens
ctatttgcttatttaata

SEQ ID NO: 1522834 - DNA, 12 bp, Homo sapiens
ctatttgtacaa

SEQ ID NO: 1522835 - DNA, 13 bp, Homo sapiens
ctatttgtacaat

SEQ ID NO: 1522836 - DNA, 23 bp, Homo sapiens
ctatttgtatttctcttgtcctt

SEQ ID NO: 1522837 - DNA, 15 bp, Homo sapiens
ctatttgttcagaga

SEQ ID NO: 1522838 - DNA, 20 bp, Homo sapiens
ctatttgttcagagaggcct

SEQ ID NO: 1522839 - DNA, 14 bp, Homo sapiens
ctattttaaaataa

SEQ ID NO: 1522840 - DNA, 20 bp, Homo sapiens
ctattttaaaataaattagt

SEQ ID NO: 1522841 - DNA, 23 bp, Homo sapiens
ctattttattctaaacagactca

SEQ ID NO: 1522842 - DNA, 18 bp, Homo sapiens
ctattttcataatcagta

SEQ ID NO: 1522843 - DNA, 14 bp, Homo sapiens
ctattttctacaat

SEQ ID NO: 1522844 - DNA, 19 bp, Homo sapiens
ctattttgacagttatttt

SEQ ID NO: 1522845 - DNA, 14 bp, Homo sapiens
ctatttttcaaatt

SEQ ID NO: 1522846 - DNA, 22 bp, Homo sapiens
ctatttttgtcttatatatatt

SEQ ID NO: 1522847 - DNA, 12 bp, Homo sapiens
ctatttttgtgt

SEQ ID NO: 1522848 - DNA, 14 bp, Homo sapiens
ctatttttttctct

SEQ ID NO: 1522849 - DNA, 14 bp, Homo sapiens
ctcaaaaagaaatc

SEQ ID NO: 1522850 - DNA, 18 bp, Homo sapiens
ctcaaaaagcagaaggag

SEQ ID NO: 1522851 - DNA, 14 bp, Homo sapiens
ctcaaaacctggag

SEQ ID NO: 1522852 - DNA, 19 bp, Homo sapiens
ctcaaaagaggttacttta

SEQ ID NO: 1522853 - DNA, 20 bp, Homo sapiens
ctcaaaagcacccttgacgt

SEQ ID NO: 1522854 - DNA, 14 bp, Homo sapiens
ctcaaaaggaaacc

SEQ ID NO: 1522855 - DNA, 18 bp, Homo sapiens
ctcaaaaggaaaccaagt

SEQ ID NO: 1522856 - DNA, 22 bp, Homo sapiens
ctcaaaatctttgtataaataa

SEQ ID NO: 1522857 - DNA, 13 bp, Homo sapiens
ctcaaaattagat

SEQ ID NO: 1522858 - DNA, 19 bp, Homo sapiens
ctcaaacatggaagatgaa

SEQ ID NO: 1522859 - DNA, 15 bp, Homo sapiens
ctcaaaccatatttt

SEQ ID NO: 1522860 - DNA, 14 bp, Homo sapiens
ctcaaacctcctct

SEQ ID NO: 1522861 - DNA, 21 bp, Homo sapiens
ctcaaacctgtttaaatattt

SEQ ID NO: 1522862 - DNA, 13 bp, Homo sapiens
ctcaaactcctga

SEQ ID NO: 1522863 - DNA, 13 bp, Homo sapiens
ctcaaactgagct

SEQ ID NO: 1522864 - DNA, 17 bp, Homo sapiens
ctcaaactgccttggct

SEQ ID NO: 1522865 - DNA, 16 bp, Homo sapiens
ctcaaagatctgaatt

SEQ ID NO: 1522866 - DNA, 22 bp, Homo sapiens
ctcaaagcactgttgagaagga

SEQ ID NO: 1522867 - DNA, 23 bp, Homo sapiens
ctcaaaggagaaaaaaaaccttg

SEQ ID NO: 1522868 - DNA, 17 bp, Homo sapiens
ctcaaaggagctttctc

SEQ ID NO: 1522869 - DNA, 18 bp, Homo sapiens
ctcaaaggagctttctca

SEQ ID NO: 1522870 - DNA, 19 bp, Homo sapiens
ctcaaaggagctttctcaa

SEQ ID NO: 1522871 - DNA, 23 bp, Homo sapiens
ctcaaagggcagttttgaggcat

SEQ ID NO: 1522872 - DNA, 17 bp, Homo sapiens
ctcaaaggtttggaagg

SEQ ID NO: 1522873 - DNA, 23 bp, Homo sapiens
ctcaaagtgactattcagttttc

SEQ ID NO: 1522874 - DNA, 15 bp, Homo sapiens
ctcaaagtttgacag

SEQ ID NO: 1522875 - DNA, 12 bp, Homo sapiens
ctcaaataacta

SEQ ID NO: 1522876 - DNA, 16 bp, Homo sapiens
ctcaaatacacatttg

SEQ ID NO: 1522877 - DNA, 21 bp, Homo sapiens
ctcaaataggctattaaaaaa

SEQ ID NO: 1522878 - DNA, 20 bp, Homo sapiens
ctcaaataggtcatcatgaa

SEQ ID NO: 1522879 - DNA, 21 bp, Homo sapiens
ctcaaatcagtgataattggt

SEQ ID NO: 1522880 - DNA, 17 bp, Homo sapiens
ctcaaatctctgttact

SEQ ID NO: 1522881 - DNA, 15 bp, Homo sapiens
ctcaaatcttaagaa

SEQ ID NO: 1522882 - DNA, 16 bp, Homo sapiens
ctcaaatcttaagaaa

SEQ ID NO: 1522883 - DNA, 22 bp, Homo sapiens
ctcaaatgagtaacatttgctg

SEQ ID NO: 1522884 - DNA, 15 bp, Homo sapiens
ctcaaatggggccag

SEQ ID NO: 1522885 - DNA, 16 bp, Homo sapiens
ctcaaatggggccaga

SEQ ID NO: 1522886 - DNA, 21 bp, Homo sapiens
ctcaaatggggccagatccag

SEQ ID NO: 1522887 - DNA, 16 bp, Homo sapiens
ctcaaatgttctaagt

SEQ ID NO: 1522888 - DNA, 16 bp, Homo sapiens
ctcaaattaatctttc

SEQ ID NO: 1522889 - DNA, 23 bp, Homo sapiens
ctcaaattaatctttctttacct

SEQ ID NO: 1522890 - DNA, 24 bp, Homo sapiens
ctcaacagagaggaccaacatcca

SEQ ID NO: 1522891 - DNA, 13 bp, Homo sapiens
ctcaaccactgtg

SEQ ID NO: 1522892 - DNA, 16 bp, Homo sapiens
ctcaacccattgttgt

SEQ ID NO: 1522893 - DNA, 20 bp, Homo sapiens
ctcaacccattgttgtcaag

SEQ ID NO: 1522894 - DNA, 12 bp, Homo sapiens
ctcaacctcttc

SEQ ID NO: 1522895 - DNA, 14 bp, Homo sapiens
ctcaaccttctggg

SEQ ID NO: 1522896 - DNA, 18 bp, Homo sapiens
ctcaactaatttttgtat

SEQ ID NO: 1522897 - DNA, 17 bp, Homo sapiens
ctcaactcacagcttct

SEQ ID NO: 1522898 - DNA, 17 bp, Homo sapiens
ctcaactctacccctgc

SEQ ID NO: 1522899 - DNA, 13 bp, Homo sapiens
ctcaactctgagc

SEQ ID NO: 1522900 - DNA, 17 bp, Homo sapiens
ctcaactctgagcccat

SEQ ID NO: 1522901 - DNA, 15 bp, Homo sapiens
ctcaactgagggcca

SEQ ID NO: 1522902 - DNA, 15 bp, Homo sapiens
ctcaagaaattccca

SEQ ID NO: 1522903 - DNA, 17 bp, Homo sapiens
ctcaagaacaaacagaa

SEQ ID NO: 1522904 - DNA, 21 bp, Homo sapiens
ctcaagaatctagaagatgtg

SEQ ID NO: 1522905 - DNA, 22 bp, Homo sapiens
ctcaagaatctagaagatgtgt

SEQ ID NO: 1522906 - DNA, 13 bp, Homo sapiens
ctcaagactttag

SEQ ID NO: 1522907 - DNA, 19 bp, Homo sapiens
ctcaagagggcactggtgg

SEQ ID NO: 1522908 - DNA, 19 bp, Homo sapiens
ctcaagagttcagtgctca

SEQ ID NO: 1522909 - DNA, 17 bp, Homo sapiens
ctcaagatgacagctct

SEQ ID NO: 1522910 - DNA, 18 bp, Homo sapiens
ctcaagatgacagctctt

SEQ ID NO: 1522911 - DNA, 15 bp, Homo sapiens
ctcaagatgggggca

SEQ ID NO: 1522912 - DNA, 21 bp, Homo sapiens
ctcaagatgggggcagggctg

SEQ ID NO: 1522913 - DNA, 21 bp, Homo sapiens
ctcaagccagccccctccagc

SEQ ID NO: 1522914 - DNA, 17 bp, Homo sapiens
ctcaagccccatttcct

SEQ ID NO: 1522915 - DNA, 12 bp, Homo sapiens
ctcaagccctgc

SEQ ID NO: 1522916 - DNA, 14 bp, Homo sapiens
ctcaaggaaagggg

SEQ ID NO: 1522917 - DNA, 22 bp, Homo sapiens
ctcaaggacaaagtctccagcc

SEQ ID NO: 1522918 - DNA, 16 bp, Homo sapiens
ctcaaggactttgcag

SEQ ID NO: 1522919 - DNA, 20 bp, Homo sapiens
ctcaaggataccttcttatt

SEQ ID NO: 1522920 - DNA, 18 bp, Homo sapiens
ctcaagggaaaggcaagc

SEQ ID NO: 1522921 - DNA, 16 bp, Homo sapiens
ctcaagggctggcact

SEQ ID NO: 1522922 - DNA, 16 bp, Homo sapiens
ctcaagggtggcaggt

SEQ ID NO: 1522923 - DNA, 18 bp, Homo sapiens
ctcaagggttctttcctc

SEQ ID NO: 1522924 - DNA, 19 bp, Homo sapiens
ctcaaggttttaggttcta

SEQ ID NO: 1522925 - DNA, 20 bp, Homo sapiens
ctcaaggttttaggttctaa

SEQ ID NO: 1522926 - DNA, 23 bp, Homo sapiens
ctcaaggttttaggttctaaagt

SEQ ID NO: 1522927 - DNA, 14 bp, Homo sapiens
ctcaagtagaaaag

SEQ ID NO: 1522928 - DNA, 16 bp, Homo sapiens
ctcaagtatatgtcat

SEQ ID NO: 1522929 - DNA, 19 bp, Homo sapiens
ctcaagtatcttctatttt

SEQ ID NO: 1522930 - DNA, 16 bp, Homo sapiens
ctcaagtcttccctga

SEQ ID NO: 1522931 - DNA, 18 bp, Homo sapiens
ctcaagtcttccctgatc

SEQ ID NO: 1522932 - DNA, 15 bp, Homo sapiens
ctcaagttctaagat

SEQ ID NO: 1522933 - DNA, 16 bp, Homo sapiens
ctcaataaatgattct

SEQ ID NO: 1522934 - DNA, 15 bp, Homo sapiens
ctcaatcagtgcagt

SEQ ID NO: 1522935 - DNA, 18 bp, Homo sapiens
ctcaatcccagctactca

SEQ ID NO: 1522936 - DNA, 19 bp, Homo sapiens
ctcaatcctaatttctcct

SEQ ID NO: 1522937 - DNA, 20 bp, Homo sapiens
ctcaatcctaatttctcctc

SEQ ID NO: 1522938 - DNA, 23 bp, Homo sapiens
ctcaatcctaatttctcctccct

SEQ ID NO: 1522939 - DNA, 14 bp, Homo sapiens
ctcaatcctctaag

SEQ ID NO: 1522940 - DNA, 13 bp, Homo sapiens
ctcaatgccctgc

SEQ ID NO: 1522941 - DNA, 14 bp, Homo sapiens
ctcaatgccctgcc

SEQ ID NO: 1522942 - DNA, 15 bp, Homo sapiens
ctcaatgccctgcca

SEQ ID NO: 1522943 - DNA, 17 bp, Homo sapiens
ctcaatgccctgccatt

SEQ ID NO: 1522944 - DNA, 14 bp, Homo sapiens
ctcaatggactgga

SEQ ID NO: 1522945 - DNA, 20 bp, Homo sapiens
ctcaatggactggaagggga

SEQ ID NO: 1522946 - DNA, 15 bp, Homo sapiens
ctagatcagatgctc

SEQ ID NO: 1522947 - DNA, 18 bp, Homo sapiens
ctagatcagatgctccaa

SEQ ID NO: 1522948 - DNA, 17 bp, Homo sapiens
ctagatcataaggcttc

SEQ ID NO: 1522949 - DNA, 17 bp, Homo sapiens
ctagatcatatttaaag

SEQ ID NO: 1522950 - DNA, 18 bp, Homo sapiens
ctagatcatatttaaaga

SEQ ID NO: 1522951 - DNA, 13 bp, Homo sapiens
ctagatccacaca

SEQ ID NO: 1522952 - DNA, 19 bp, Homo sapiens
ctagatccacacacagagg

SEQ ID NO: 1522953 - DNA, 15 bp, Homo sapiens
ctagatcctaagggt

SEQ ID NO: 1522954 - DNA, 14 bp, Homo sapiens
ctagatcctgcacc

SEQ ID NO: 1522955 - DNA, 13 bp, Homo sapiens
ctagatctgcagg

SEQ ID NO: 1522956 - DNA, 14 bp, Homo sapiens
ctagatctgcaggc

SEQ ID NO: 1522957 - DNA, 20 bp, Homo sapiens
ctagatgattaaataagatt

SEQ ID NO: 1522958 - DNA, 23 bp, Homo sapiens
ctagatgattaaataagattcta

SEQ ID NO: 1522959 - DNA, 21 bp, Homo sapiens
ctagatgattttttgaaagtt

SEQ ID NO: 1522960 - DNA, 21 bp, Homo sapiens
ctagatggagaaagtaacaca

SEQ ID NO: 1522961 - DNA, 20 bp, Homo sapiens
ctagatgtagtattttttgt

SEQ ID NO: 1522962 - DNA, 22 bp, Homo sapiens
ctagatgtagtattttttgtat

SEQ ID NO: 1522963 - DNA, 23 bp, Homo sapiens
ctagatgtagtattttttgtata

SEQ ID NO: 1522964 - DNA, 13 bp, Homo sapiens
ctagatgtcttta

SEQ ID NO: 1522965 - DNA, 23 bp, Homo sapiens
ctagatgtttattcttctagagt

SEQ ID NO: 1522966 - DNA, 21 bp, Homo sapiens
ctagattaccccctcattgtt

SEQ ID NO: 1522967 - DNA, 17 bp, Homo sapiens
ctagattcaaaggttct

SEQ ID NO: 1522968 - DNA, 13 bp, Homo sapiens
ctagattcataaa

SEQ ID NO: 1522969 - DNA, 24 bp, Homo sapiens
ctagattgagagaagagacaaaca

SEQ ID NO: 1522970 - DNA, 12 bp, Homo sapiens
ctagatttgtcc

SEQ ID NO: 1522971 - DNA, 19 bp, Homo sapiens
ctagattttaatttatttg

SEQ ID NO: 1522972 - DNA, 12 bp, Homo sapiens
ctagatttttaa

SEQ ID NO: 1522973 - DNA, 17 bp, Homo sapiens
ctagcaagaagattcta

SEQ ID NO: 1522974 - DNA, 18 bp, Homo sapiens
ctagcaagaagattctaa

SEQ ID NO: 1522975 - DNA, 22 bp, Homo sapiens
ctagcaagaagattctaaaaca

SEQ ID NO: 1522976 - DNA, 16 bp, Homo sapiens
ctagcaagatagtctt

SEQ ID NO: 1522977 - DNA, 21 bp, Homo sapiens
ctagcaagctgccgaaccaaa

SEQ ID NO: 1522978 - DNA, 14 bp, Homo sapiens
ctagcaattttctt

SEQ ID NO: 1522979 - DNA, 20 bp, Homo sapiens
ctagcaattttctttgtttc

SEQ ID NO: 1522980 - DNA, 21 bp, Homo sapiens
ctagcagagtgaggatgtgtt

SEQ ID NO: 1522981 - DNA, 23 bp, Homo sapiens
ctagcagcccaccctgctgctgg

SEQ ID NO: 1522982 - DNA, 12 bp, Homo sapiens
ctagcagctgca

SEQ ID NO: 1522983 - DNA, 17 bp, Homo sapiens
ctagcaggcacaggaca

SEQ ID NO: 1522984 - DNA, 22 bp, Homo sapiens
ctagcattgtaaaattatttca

SEQ ID NO: 1522985 - DNA, 14 bp, Homo sapiens
ctagccaaggctag

SEQ ID NO: 1522986 - DNA, 13 bp, Homo sapiens
ctagccacctccc

SEQ ID NO: 1522987 - DNA, 15 bp, Homo sapiens
ctagccagacactct

SEQ ID NO: 1522988 - DNA, 23 bp, Homo sapiens
ctagccagacactctgctctgcc

SEQ ID NO: 1522989 - DNA, 17 bp, Homo sapiens
ctagccaggagtctgtg

SEQ ID NO: 1522990 - DNA, 20 bp, Homo sapiens
ctagccaggagtctgtgctc

SEQ ID NO: 1522991 - DNA, 21 bp, Homo sapiens
ctagccaggagtctgtgctct

SEQ ID NO: 1522992 - DNA, 17 bp, Homo sapiens
ctagccattcctggtac

SEQ ID NO: 1522993 - DNA, 18 bp, Homo sapiens
ctagcccaatgaaatgaa

SEQ ID NO: 1522994 - DNA, 21 bp, Homo sapiens
ctagcccactccctgcctaca

SEQ ID NO: 1522995 - DNA, 13 bp, Homo sapiens
ctagcccagtccc

SEQ ID NO: 1522996 - DNA, 22 bp, Homo sapiens
ctagcccagtccctggagctgt

SEQ ID NO: 1522997 - DNA, 19 bp, Homo sapiens
ctagccccgagacaccatc

SEQ ID NO: 1522998 - DNA, 22 bp, Homo sapiens
ctagccccgagacaccatcctg

SEQ ID NO: 1522999 - DNA, 21 bp, Homo sapiens
ctagccctgcggagccggcac

SEQ ID NO: 1523000 - DNA, 20 bp, Homo sapiens
ctagccctggttagctgaca

SEQ ID NO: 1523001 - DNA, 12 bp, Homo sapiens
ctagcctaattt

SEQ ID NO: 1523002 - DNA, 13 bp, Homo sapiens
ctagcctctccag

SEQ ID NO: 1523003 - DNA, 19 bp, Homo sapiens
ctagcctgtgcctctggga

SEQ ID NO: 1523004 - DNA, 17 bp, Homo sapiens
ctagcgatctctcctgg

SEQ ID NO: 1523005 - DNA, 16 bp, Homo sapiens
ctagcgctgccgcacc

SEQ ID NO: 1523006 - DNA, 22 bp, Homo sapiens
ctagcggagcccagcctgggag

SEQ ID NO: 1523007 - DNA, 20 bp, Homo sapiens
ctagctaccttctctaccca

SEQ ID NO: 1523008 - DNA, 19 bp, Homo sapiens
ctagctagaagtgggccag

SEQ ID NO: 1523009 - DNA, 23 bp, Homo sapiens
ctagctagaagtgggccaggaca

SEQ ID NO: 1523010 - DNA, 18 bp, Homo sapiens
ctagctcaccaggcctgg

SEQ ID NO: 1523011 - DNA, 20 bp, Homo sapiens
ctagctcaccaggcctggcc

SEQ ID NO: 1523012 - DNA, 23 bp, Homo sapiens
ctagctcaccaggcctggcctct

SEQ ID NO: 1523013 - DNA, 19 bp, Homo sapiens
ctagctcctcctcctgggc

SEQ ID NO: 1523014 - DNA, 22 bp, Homo sapiens
ctagctctctaggcctctccag

SEQ ID NO: 1523015 - DNA, 19 bp, Homo sapiens
ctagctctttgggcctctc

SEQ ID NO: 1523016 - DNA, 22 bp, Homo sapiens
ctagctctttgggcctctcctg

SEQ ID NO: 1523017 - DNA, 12 bp, Homo sapiens
ctagctggcagg

SEQ ID NO: 1523018 - DNA, 13 bp, Homo sapiens
ctagctggcagga

SEQ ID NO: 1523019 - DNA, 22 bp, Homo sapiens
ctagctggcaggacacatcccg

SEQ ID NO: 1523020 - DNA, 16 bp, Homo sapiens
ctagctgtatgatttg

SEQ ID NO: 1523021 - DNA, 14 bp, Homo sapiens
ctagctgtgggggt

SEQ ID NO: 1523022 - DNA, 16 bp, Homo sapiens
ctagctgttctggact

SEQ ID NO: 1523023 - DNA, 19 bp, Homo sapiens
ctagctgttctggactaca

SEQ ID NO: 1523024 - DNA, 14 bp, Homo sapiens
ctagcttactgata

SEQ ID NO: 1523025 - DNA, 18 bp, Homo sapiens
ctagcttctgcttttctg

SEQ ID NO: 1523026 - DNA, 23 bp, Homo sapiens
ctagctttacgctcatcacctaa

SEQ ID NO: 1523027 - DNA, 18 bp, Homo sapiens
ctagctttagaccctggg

SEQ ID NO: 1523028 - DNA, 19 bp, Homo sapiens
ctagctttagaccctgggt

SEQ ID NO: 1523029 - DNA, 14 bp, Homo sapiens
ctagcttttaggaa

SEQ ID NO: 1523030 - DNA, 11 bp, Homo sapiens
ctaggaaaaaa

SEQ ID NO: 1523031 - DNA, 19 bp, Homo sapiens
ctaggaaaccagctcgtgg

SEQ ID NO: 1523032 - DNA, 19 bp, Homo sapiens
ctaggaagagcaggactcc

SEQ ID NO: 1523033 - DNA, 17 bp, Homo sapiens
ctaggaagtacgagccc

SEQ ID NO: 1523034 - DNA, 16 bp, Homo sapiens
ctaggaatgaaatcct

SEQ ID NO: 1523035 - DNA, 23 bp, Homo sapiens
ctaggaccatggttaagagtcca

SEQ ID NO: 1523036 - DNA, 16 bp, Homo sapiens
ctaggactctgaggct

SEQ ID NO: 1523037 - DNA, 14 bp, Homo sapiens
ctaggactgaggag

SEQ ID NO: 1523038 - DNA, 15 bp, Homo sapiens
ctaggactgaggagt

SEQ ID NO: 1523039 - DNA, 18 bp, Homo sapiens
ctaggactgaggagtggg

SEQ ID NO: 1523040 - DNA, 15 bp, Homo sapiens
ctaggactgcagtgt

SEQ ID NO: 1523041 - DNA, 22 bp, Homo sapiens
ctaggacttaaaattagtcttt

SEQ ID NO: 1523042 - DNA, 18 bp, Homo sapiens
ctaggagaaccaaatctg

SEQ ID NO: 1523043 - DNA, 23 bp, Homo sapiens
ctaggagaaggaggggaaccaga

SEQ ID NO: 1523044 - DNA, 12 bp, Homo sapiens
ctaggagacaga

SEQ ID NO: 1523045 - DNA, 15 bp, Homo sapiens
ctaggagaggggggc

SEQ ID NO: 1523046 - DNA, 14 bp, Homo sapiens
ctaggagccccagc

SEQ ID NO: 1523047 - DNA, 15 bp, Homo sapiens
ctaggagccccagct

SEQ ID NO: 1523048 - DNA, 18 bp, Homo sapiens
ctaggagccccagcttcc

SEQ ID NO: 1523049 - DNA, 21 bp, Homo sapiens
ctaggagccccagcttcctgt

SEQ ID NO: 1523050 - DNA, 15 bp, Homo sapiens
ctaggagctgggagg

SEQ ID NO: 1523051 - DNA, 16 bp, Homo sapiens
ctaggagctgggagga

SEQ ID NO: 1523052 - DNA, 13 bp, Homo sapiens
ctaggaggctggc

SEQ ID NO: 1523053 - DNA, 21 bp, Homo sapiens
ctaggagggagccttgtgaga

SEQ ID NO: 1523054 - DNA, 13 bp, Homo sapiens
ctaggatacagaa

SEQ ID NO: 1523055 - DNA, 14 bp, Homo sapiens
ctaggatcccactg

SEQ ID NO: 1523056 - DNA, 17 bp, Homo sapiens
ctaggatgctgcagcag

SEQ ID NO: 1523057 - DNA, 14 bp, Homo sapiens
ctaggatgtggagc

SEQ ID NO: 1523058 - DNA, 14 bp, Homo sapiens
ctaggattgggcct

SEQ ID NO: 1523059 - DNA, 20 bp, Homo sapiens
ctaggcacctccccgctctc

SEQ ID NO: 1523060 - DNA, 19 bp, Homo sapiens
ctaggcactgtagttctaa

SEQ ID NO: 1523061 - DNA, 15 bp, Homo sapiens
ctaggcatcccaggg

SEQ ID NO: 1523062 - DNA, 18 bp, Homo sapiens
ctaggcatcccaggggac

SEQ ID NO: 1523063 - DNA, 17 bp, Homo sapiens
ctaggcatctctgtact

SEQ ID NO: 1523064 - DNA, 15 bp, Homo sapiens
ctaggcattgcagga

SEQ ID NO: 1523065 - DNA, 16 bp, Homo sapiens
ctaggcattgcaggac

SEQ ID NO: 1523066 - DNA, 16 bp, Homo sapiens
ctaggccactcctcca

SEQ ID NO: 1523067 - DNA, 19 bp, Homo sapiens
ctaggccactcctccaaag

SEQ ID NO: 1523068 - DNA, 15 bp, Homo sapiens
ctaggccccagaggc

SEQ ID NO: 1523069 - DNA, 21 bp, Homo sapiens
ctaggccccagaggccctgga

SEQ ID NO: 1523070 - DNA, 22 bp, Homo sapiens
ctaggccccagaggccctggag

SEQ ID NO: 1523071 - DNA, 23 bp, Homo sapiens
ctaggccccagaggccctggagg

SEQ ID NO: 1523072 - DNA, 20 bp, Homo sapiens
ctaggcccctcctagaccca

SEQ ID NO: 1523073 - DNA, 22 bp, Homo sapiens
ctaggcccctcctagacccagg

SEQ ID NO: 1523074 - DNA, 23 bp, Homo sapiens
ctaggcttcccaggctgggctct

SEQ ID NO: 1523075 - DNA, 10 bp, Homo sapiens
ctagggagcc

SEQ ID NO: 1523076 - DNA, 17 bp, Homo sapiens
ctagggagccatttgag

SEQ ID NO: 1523077 - DNA, 13 bp, Homo sapiens
ctagggatctgaa

SEQ ID NO: 1523078 - DNA, 19 bp, Homo sapiens
ctagggatctgaaatccat

SEQ ID NO: 1523079 - DNA, 19 bp, Homo sapiens
ctagggatgttctggccct

SEQ ID NO: 1523080 - DNA, 17 bp, Homo sapiens
ctagggattcaggctgc

SEQ ID NO: 1523081 - DNA, 14 bp, Homo sapiens
ctagggcagaagac

SEQ ID NO: 1523082 - DNA, 16 bp, Homo sapiens
ctagggccttggaaat

SEQ ID NO: 1523083 - DNA, 16 bp, Homo sapiens
ctaggggaagggcttt

SEQ ID NO: 1523084 - DNA, 19 bp, Homo sapiens
ctaggggacacttccctct

SEQ ID NO: 1523085 - DNA, 16 bp, Homo sapiens
ctaggggtcctcggga

SEQ ID NO: 1523086 - DNA, 21 bp, Homo sapiens
ctaggggtgcgctcacctgca

SEQ ID NO: 1523087 - DNA, 22 bp, Homo sapiens
ctaggggtgcgctcacctgcag

SEQ ID NO: 1523088 - DNA, 17 bp, Homo sapiens
ctagggtggcccttgca

SEQ ID NO: 1523089 - DNA, 22 bp, Homo sapiens
ctaggtatcattcaactctcca

SEQ ID NO: 1523090 - DNA, 12 bp, Homo sapiens
ctaggtctccag

SEQ ID NO: 1523091 - DNA, 16 bp, Homo sapiens
ctaggtctcctcaggg

SEQ ID NO: 1523092 - DNA, 20 bp, Homo sapiens
ctaggtctcctcagggtggg

SEQ ID NO: 1523093 - DNA, 23 bp, Homo sapiens
ctaggtgccttttgtttttggct

SEQ ID NO: 1523094 - DNA, 15 bp, Homo sapiens
ctaggtgtccccaac

SEQ ID NO: 1523095 - DNA, 19 bp, Homo sapiens
ctaggttggacagccccct

SEQ ID NO: 1523096 - DNA, 14 bp, Homo sapiens
ctaggttttttcct

SEQ ID NO: 1523097 - DNA, 22 bp, Homo sapiens
ctagtaagaagacaaactgctt

SEQ ID NO: 1523098 - DNA, 13 bp, Homo sapiens
ctagtaagatgca

SEQ ID NO: 1523099 - DNA, 12 bp, Homo sapiens
ctagtaatatat

SEQ ID NO: 1523100 - DNA, 15 bp, Homo sapiens
ctagtactctctgct

SEQ ID NO: 1523101 - DNA, 22 bp, Homo sapiens
ctagtactctctgctctagcca

SEQ ID NO: 1523102 - DNA, 23 bp, Homo sapiens
ctagtatcttcaaactttcactt

SEQ ID NO: 1523103 - DNA, 16 bp, Homo sapiens
ctagtatgaaattata

SEQ ID NO: 1523104 - DNA, 21 bp, Homo sapiens
ctagtatttcatgctgggaat

SEQ ID NO: 1523105 - DNA, 11 bp, Homo sapiens
ctagtattttt

SEQ ID NO: 1523106 - DNA, 18 bp, Homo sapiens
ctagtcaactgctgtttt

SEQ ID NO: 1523107 - DNA, 22 bp, Homo sapiens
ctagtcaccgacagcggccttg

SEQ ID NO: 1523108 - DNA, 13 bp, Homo sapiens
ctagtcagagaga

SEQ ID NO: 1523109 - DNA, 16 bp, Homo sapiens
ctagtcagagagagtg

SEQ ID NO: 1523110 - DNA, 15 bp, Homo sapiens
ctagtccccaaggcc

SEQ ID NO: 1523111 - DNA, 17 bp, Homo sapiens
ctagtccccaaggcctc

SEQ ID NO: 1523112 - DNA, 18 bp, Homo sapiens
ctagtccccaaggcctct

SEQ ID NO: 1523113 - DNA, 23 bp, Homo sapiens
ctagtccccaaggcctctctctg

SEQ ID NO: 1523114 - DNA, 20 bp, Homo sapiens
ctagtcccccaaagggcctc

SEQ ID NO: 1523115 - DNA, 21 bp, Homo sapiens
ctagtcccccaaagggcctcc

SEQ ID NO: 1523116 - DNA, 18 bp, Homo sapiens
ctagtcccctttcctcta

SEQ ID NO: 1523117 - DNA, 17 bp, Homo sapiens
ctagtcccttcccctcc

SEQ ID NO: 1523118 - DNA, 20 bp, Homo sapiens
ctagtcctcacttctagatc

SEQ ID NO: 1523119 - DNA, 20 bp, Homo sapiens
ctagtctcctttgcactgag

SEQ ID NO: 1523120 - DNA, 21 bp, Homo sapiens
ctagtctcctttgcactgagg

SEQ ID NO: 1523121 - DNA, 17 bp, Homo sapiens
ctagtctgtaactcttt

SEQ ID NO: 1523122 - DNA, 14 bp, Homo sapiens
ctagtcttcacaac

SEQ ID NO: 1523123 - DNA, 19 bp, Homo sapiens
ctagtcttgaatttctgac

SEQ ID NO: 1523124 - DNA, 20 bp, Homo sapiens
ctagtgaaatggctggggcc

SEQ ID NO: 1523125 - DNA, 16 bp, Homo sapiens
ctagtgacagcttgtg

SEQ ID NO: 1523126 - DNA, 18 bp, Homo sapiens
ctagtgacttgtgtccca

SEQ ID NO: 1523127 - DNA, 15 bp, Homo sapiens
ctagtgagtcagcac

SEQ ID NO: 1523128 - DNA, 18 bp, Homo sapiens
ctagtgagtcagcacctt

SEQ ID NO: 1523129 - DNA, 14 bp, Homo sapiens
ctagtgcagctgaa

SEQ ID NO: 1523130 - DNA, 17 bp, Homo sapiens
ctagtgcagctgaaatt

SEQ ID NO: 1523131 - DNA, 14 bp, Homo sapiens
ctagtgccccagac

SEQ ID NO: 1523132 - DNA, 23 bp, Homo sapiens
ctagtgccccagactgagctctc

SEQ ID NO: 1523133 - DNA, 17 bp, Homo sapiens
ctagtgctattctgtgt

SEQ ID NO: 1523134 - DNA, 18 bp, Homo sapiens
ctagtgctattctgtgtt

SEQ ID NO: 1523135 - DNA, 19 bp, Homo sapiens
ctagtgctattctgtgttg

SEQ ID NO: 1523136 - DNA, 19 bp, Homo sapiens
ctagtgctgtaatattgta

SEQ ID NO: 1523137 - DNA, 20 bp, Homo sapiens
ctagtgctgtaatattgtaa

SEQ ID NO: 1523138 - DNA, 22 bp, Homo sapiens
ctagtgctgtaatattgtaaat

SEQ ID NO: 1523139 - DNA, 17 bp, Homo sapiens
ctagtgggacagcccag

SEQ ID NO: 1523140 - DNA, 22 bp, Homo sapiens
ctagtgggacagcccagagcct

SEQ ID NO: 1523141 - DNA, 20 bp, Homo sapiens
ctagtgggccctctctctgg

SEQ ID NO: 1523142 - DNA, 20 bp, Homo sapiens
ctagtggggtctccctctcc

SEQ ID NO: 1523143 - DNA, 19 bp, Homo sapiens
ctagtggggtgaacagctg

SEQ ID NO: 1523144 - DNA, 16 bp, Homo sapiens
ctagtgtaacactgca

SEQ ID NO: 1523145 - DNA, 22 bp, Homo sapiens
ctagtgtaacactgcaagaagt

SEQ ID NO: 1523146 - DNA, 21 bp, Homo sapiens
ctagtgtacctcctctcagtg

SEQ ID NO: 1523147 - DNA, 21 bp, Homo sapiens
ctagtgtgagtggcagccatg

SEQ ID NO: 1523148 - DNA, 22 bp, Homo sapiens
ctagtgtgagtggcagccatgc

SEQ ID NO: 1523149 - DNA, 16 bp, Homo sapiens
ctagtgtgtgtgcttt

SEQ ID NO: 1523150 - DNA, 17 bp, Homo sapiens
ctagtgtttaaaaggct

SEQ ID NO: 1523151 - DNA, 23 bp, Homo sapiens
ctagttatacttatttgtatatg

SEQ ID NO: 1523152 - DNA, 22 bp, Homo sapiens
ctagttcatccaatcctcactg

SEQ ID NO: 1523153 - DNA, 24 bp, Homo sapiens
ctagttcatccaatcctcactggg

SEQ ID NO: 1523154 - DNA, 16 bp, Homo sapiens
ctagttctcagcttgc

SEQ ID NO: 1523155 - DNA, 15 bp, Homo sapiens
ctagttctttcctcc

SEQ ID NO: 1523156 - DNA, 22 bp, Homo sapiens
ctagttctttcctccccctgca

SEQ ID NO: 1523157 - DNA, 21 bp, Homo sapiens
ctagttgggagagttggagag

SEQ ID NO: 1523158 - DNA, 18 bp, Homo sapiens
ctagtttcagtaaataat

SEQ ID NO: 1523159 - DNA, 22 bp, Homo sapiens
ctagtttgacctcacagtgacc

SEQ ID NO: 1523160 - DNA, 13 bp, Homo sapiens
ctagtttgcattc

SEQ ID NO: 1523161 - DNA, 18 bp, Homo sapiens
ctagtttgggaggagcag

SEQ ID NO: 1523162 - DNA, 15 bp, Homo sapiens
ctagttttcagcctt

SEQ ID NO: 1523163 - DNA, 18 bp, Homo sapiens
ctagttttctcctcccag

SEQ ID NO: 1523164 - DNA, 19 bp, Homo sapiens
ctagttttctcctcccagg

SEQ ID NO: 1523165 - DNA, 16 bp, Homo sapiens
ctagttttttttgtaa

SEQ ID NO: 1523166 - DNA, 23 bp, Homo sapiens
ctataaaaagaaaaaaatggaaa

SEQ ID NO: 1523167 - DNA, 13 bp, Homo sapiens
ctataaaatagat

SEQ ID NO: 1523168 - DNA, 21 bp, Homo sapiens
ctataaacttaagggcaagga

SEQ ID NO: 1523169 - DNA, 13 bp, Homo sapiens
ctataaagctgtt

SEQ ID NO: 1523170 - DNA, 14 bp, Homo sapiens
ctataaagctgtta

SEQ ID NO: 1523171 - DNA, 20 bp, Homo sapiens
ctataaagggcccacacctg

SEQ ID NO: 1523172 - DNA, 15 bp, Homo sapiens
ctataaagtatatat

SEQ ID NO: 1523173 - DNA, 15 bp, Homo sapiens
ctataaatcagtatt

SEQ ID NO: 1523174 - DNA, 18 bp, Homo sapiens
ctataaatgccagagcca

SEQ ID NO: 1523175 - DNA, 22 bp, Homo sapiens
ctataaatgccagagccaacct

SEQ ID NO: 1523176 - DNA, 18 bp, Homo sapiens
ctataaatggtgtttttt

SEQ ID NO: 1523177 - DNA, 15 bp, Homo sapiens
actactgacagggag

SEQ ID NO: 1523178 - DNA, 20 bp, Homo sapiens
actactgacagggagcagcc

SEQ ID NO: 1523179 - DNA, 16 bp, Homo sapiens
actactgtggaaagac

SEQ ID NO: 1523180 - DNA, 22 bp, Homo sapiens
actactttgttaggattttcac

SEQ ID NO: 1523181 - DNA, 16 bp, Homo sapiens
actactttttatactc

SEQ ID NO: 1523182 - DNA, 18 bp, Homo sapiens
actagaaagaaggaccca

SEQ ID NO: 1523183 - DNA, 19 bp, Homo sapiens
actagaagattagaaacta

SEQ ID NO: 1523184 - DNA, 23 bp, Homo sapiens
actagaagggccagtcctgcctg

SEQ ID NO: 1523185 - DNA, 16 bp, Homo sapiens
actagaagtcctgctg

SEQ ID NO: 1523186 - DNA, 18 bp, Homo sapiens
actagaattagtatgtct

SEQ ID NO: 1523187 - DNA, 18 bp, Homo sapiens
actagaattctagtgctg

SEQ ID NO: 1523188 - DNA, 15 bp, Homo sapiens
actagaatttattca

SEQ ID NO: 1523189 - DNA, 14 bp, Homo sapiens
actagagggcccat

SEQ ID NO: 1523190 - DNA, 21 bp, Homo sapiens
actagagggcccatcaggcag

SEQ ID NO: 1523191 - DNA, 21 bp, Homo sapiens
actagagtctgaacagctgta

SEQ ID NO: 1523192 - DNA, 13 bp, Homo sapiens
actagattgacta

SEQ ID NO: 1523193 - DNA, 23 bp, Homo sapiens
actagcaatctcttcattattct

SEQ ID NO: 1523194 - DNA, 17 bp, Homo sapiens
actagcatacttaaaat

SEQ ID NO: 1523195 - DNA, 20 bp, Homo sapiens
actagcattacattattaaa

SEQ ID NO: 1523196 - DNA, 15 bp, Homo sapiens
actagccactcctgc

SEQ ID NO: 1523197 - DNA, 21 bp, Homo sapiens
actagccatgataactgcaat

SEQ ID NO: 1523198 - DNA, 17 bp, Homo sapiens
actagcccaatgaaatg

SEQ ID NO: 1523199 - DNA, 15 bp, Homo sapiens
actagcctctccagg

SEQ ID NO: 1523200 - DNA, 19 bp, Homo sapiens
actagctatctaggtggag

SEQ ID NO: 1523201 - DNA, 18 bp, Homo sapiens
actaggaaatccattcac

SEQ ID NO: 1523202 - DNA, 23 bp, Homo sapiens
actaggctgagcaatctgaccct

SEQ ID NO: 1523203 - DNA, 14 bp, Homo sapiens
actaggtgtcccca

SEQ ID NO: 1523204 - DNA, 19 bp, Homo sapiens
actaggttggacagccccc

SEQ ID NO: 1523205 - DNA, 13 bp, Homo sapiens
actagttacacat

SEQ ID NO: 1523206 - DNA, 13 bp, Homo sapiens
actagtttccagt

SEQ ID NO: 1523207 - DNA, 15 bp, Homo sapiens
actagtttccagtgg

SEQ ID NO: 1523208 - DNA, 23 bp, Homo sapiens
actagtttttagaaaagaaagca

SEQ ID NO: 1523209 - DNA, 19 bp, Homo sapiens
actataaacttaagggcaa

SEQ ID NO: 1523210 - DNA, 12 bp, Homo sapiens
actataaagaga

SEQ ID NO: 1523211 - DNA, 13 bp, Homo sapiens
actataaagagaa

SEQ ID NO: 1523212 - DNA, 14 bp, Homo sapiens
actataaagctgtt

SEQ ID NO: 1523213 - DNA, 18 bp, Homo sapiens
actataaaggttgacaat

SEQ ID NO: 1523214 - DNA, 15 bp, Homo sapiens
actataacaatcact

SEQ ID NO: 1523215 - DNA, 16 bp, Homo sapiens
actataaggtgcctca

SEQ ID NO: 1523216 - DNA, 21 bp, Homo sapiens
actataagtagttggtttgta

SEQ ID NO: 1523217 - DNA, 21 bp, Homo sapiens
actataatgtaagctctactg

SEQ ID NO: 1523218 - DNA, 20 bp, Homo sapiens
actatataaccctaggaatt

SEQ ID NO: 1523219 - DNA, 16 bp, Homo sapiens
actatatatataaatg

SEQ ID NO: 1523220 - DNA, 17 bp, Homo sapiens
actatatatataaatgt

SEQ ID NO: 1523221 - DNA, 18 bp, Homo sapiens
actatatctgtatataaa

SEQ ID NO: 1523222 - DNA, 22 bp, Homo sapiens
actatatctgtatataaaatat

SEQ ID NO: 1523223 - DNA, 19 bp, Homo sapiens
actatattcatttccactc

SEQ ID NO: 1523224 - DNA, 15 bp, Homo sapiens
actatcaactacaaa

SEQ ID NO: 1523225 - DNA, 19 bp, Homo sapiens
actatcaactacaaattag

SEQ ID NO: 1523226 - DNA, 15 bp, Homo sapiens
actatccatttcttc

SEQ ID NO: 1523227 - DNA, 22 bp, Homo sapiens
actatcccaatcaaagaattac

SEQ ID NO: 1523228 - DNA, 19 bp, Homo sapiens
actatcggttcaagttgat

SEQ ID NO: 1523229 - DNA, 16 bp, Homo sapiens
actatctaaatgttga

SEQ ID NO: 1523230 - DNA, 21 bp, Homo sapiens
actatctaaatgttgaaagat

SEQ ID NO: 1523231 - DNA, 20 bp, Homo sapiens
actatctgaagatttccatt

SEQ ID NO: 1523232 - DNA, 16 bp, Homo sapiens
actatctgttgaaaag

SEQ ID NO: 1523233 - DNA, 22 bp, Homo sapiens
actatcttatctcagatatttg

SEQ ID NO: 1523234 - DNA, 14 bp, Homo sapiens
actatctttctgat

SEQ ID NO: 1523235 - DNA, 17 bp, Homo sapiens
actatgaagacttaaaa

SEQ ID NO: 1523236 - DNA, 20 bp, Homo sapiens
actatgcatggtgccccagg

SEQ ID NO: 1523237 - DNA, 22 bp, Homo sapiens
actatgcatggtgccccaggac

SEQ ID NO: 1523238 - DNA, 24 bp, Homo sapiens
actatgcatggtgccccaggacca

SEQ ID NO: 1523239 - DNA, 15 bp, Homo sapiens
actatgcccttttat

SEQ ID NO: 1523240 - DNA, 19 bp, Homo sapiens
actatggagcctggcacag

SEQ ID NO: 1523241 - DNA, 16 bp, Homo sapiens
actatggtaacacttt

SEQ ID NO: 1523242 - DNA, 17 bp, Homo sapiens
actatgtgccagttcct

SEQ ID NO: 1523243 - DNA, 22 bp, Homo sapiens
actatgtggctgaaaatgcaaa

SEQ ID NO: 1523244 - DNA, 17 bp, Homo sapiens
actatgttcctaacaaa

SEQ ID NO: 1523245 - DNA, 21 bp, Homo sapiens
actatgttcctaacaaaatga

SEQ ID NO: 1523246 - DNA, 16 bp, Homo sapiens
actattagagtatttc

SEQ ID NO: 1523247 - DNA, 21 bp, Homo sapiens
actattagagtatttcccttc

SEQ ID NO: 1523248 - DNA, 22 bp, Homo sapiens
actattaggtgcaatttcaagg

SEQ ID NO: 1523249 - DNA, 16 bp, Homo sapiens
actattataaggccat

SEQ ID NO: 1523250 - DNA, 16 bp, Homo sapiens
actattcaaacagtct

SEQ ID NO: 1523251 - DNA, 18 bp, Homo sapiens
actattcaaacagtctca

SEQ ID NO: 1523252 - DNA, 17 bp, Homo sapiens
actattccttttctgta

SEQ ID NO: 1523253 - DNA, 17 bp, Homo sapiens
actattcttgatgtaaa

SEQ ID NO: 1523254 - DNA, 19 bp, Homo sapiens
actattcttgatgtaaaat

SEQ ID NO: 1523255 - DNA, 18 bp, Homo sapiens
actattgaagttgcagat

SEQ ID NO: 1523256 - DNA, 13 bp, Homo sapiens
actattgagaaga

SEQ ID NO: 1523257 - DNA, 20 bp, Homo sapiens
actattgcagacctgtcacc

SEQ ID NO: 1523258 - DNA, 14 bp, Homo sapiens
actattggaaagta

SEQ ID NO: 1523259 - DNA, 13 bp, Homo sapiens
actattggagggt

SEQ ID NO: 1523260 - DNA, 19 bp, Homo sapiens
actattggagggtgggaga

SEQ ID NO: 1523261 - DNA, 15 bp, Homo sapiens
actattgtgccaact

SEQ ID NO: 1523262 - DNA, 16 bp, Homo sapiens
actattgtgccaactg

SEQ ID NO: 1523263 - DNA, 11 bp, Homo sapiens
actatttaaag

SEQ ID NO: 1523264 - DNA, 15 bp, Homo sapiens
actatttaactgact

SEQ ID NO: 1523265 - DNA, 16 bp, Homo sapiens
actatttaactgacta

SEQ ID NO: 1523266 - DNA, 20 bp, Homo sapiens
actatttagtttttgtaatt

SEQ ID NO: 1523267 - DNA, 21 bp, Homo sapiens
actatttagtttttgtaattt

SEQ ID NO: 1523268 - DNA, 23 bp, Homo sapiens
actatttagtttttgtaatttat

SEQ ID NO: 1523269 - DNA, 19 bp, Homo sapiens
actatttatatcacacaat

SEQ ID NO: 1523270 - DNA, 13 bp, Homo sapiens
actatttcaaaat

SEQ ID NO: 1523271 - DNA, 17 bp, Homo sapiens
actatttccaaaagcac

SEQ ID NO: 1523272 - DNA, 12 bp, Homo sapiens
actatttccttt

SEQ ID NO: 1523273 - DNA, 16 bp, Homo sapiens
actatttcctttataa

SEQ ID NO: 1523274 - DNA, 23 bp, Homo sapiens
actatttctgggtcttttgctac

SEQ ID NO: 1523275 - DNA, 21 bp, Homo sapiens
actatttcttatatatgtgaa

SEQ ID NO: 1523276 - DNA, 15 bp, Homo sapiens
actatttctttttat

SEQ ID NO: 1523277 - DNA, 19 bp, Homo sapiens
actatttgcttatttaata

SEQ ID NO: 1523278 - DNA, 20 bp, Homo sapiens
actattttatatttaaaaat

SEQ ID NO: 1523279 - DNA, 18 bp, Homo sapiens
actattttattaaaaata

SEQ ID NO: 1523280 - DNA, 14 bp, Homo sapiens
actattttcaaaga

SEQ ID NO: 1523281 - DNA, 16 bp, Homo sapiens
actattttcaaagaaa

SEQ ID NO: 1523282 - DNA, 18 bp, Homo sapiens
actatttttatattaaag

SEQ ID NO: 1523283 - DNA, 15 bp, Homo sapiens
actcaaaatatttgt

SEQ ID NO: 1523284 - DNA, 17 bp, Homo sapiens
actcaaaatatttgtac

SEQ ID NO: 1523285 - DNA, 16 bp, Homo sapiens
actcaaaatctgtcat

SEQ ID NO: 1523286 - DNA, 18 bp, Homo sapiens
actcaaaatctgtcataa

SEQ ID NO: 1523287 - DNA, 17 bp, Homo sapiens
actcaaacggaggaagc

SEQ ID NO: 1523288 - DNA, 19 bp, Homo sapiens
actcaaagcaaaagtgctg

SEQ ID NO: 1523289 - DNA, 22 bp, Homo sapiens
actcaaaggaactttctggtcc

SEQ ID NO: 1523290 - DNA, 19 bp, Homo sapiens
actcaaagtttcagagacc

SEQ ID NO: 1523291 - DNA, 22 bp, Homo sapiens
actcaaagtttcagagaccatt

SEQ ID NO: 1523292 - DNA, 18 bp, Homo sapiens
actcaaatcttaagaaat

SEQ ID NO: 1523293 - DNA, 15 bp, Homo sapiens
ctactgtagaaagat

SEQ ID NO: 1523294 - DNA, 19 bp, Homo sapiens
ctactgtctattaaaattc

SEQ ID NO: 1523295 - DNA, 20 bp, Homo sapiens
ctactgtctcactgaaacat

SEQ ID NO: 1523296 - DNA, 15 bp, Homo sapiens
ctactgtggaaagac

SEQ ID NO: 1523297 - DNA, 22 bp, Homo sapiens
ctactgttcagcttttattcct

SEQ ID NO: 1523298 - DNA, 23 bp, Homo sapiens
ctactgttcagcttttattcctg

SEQ ID NO: 1523299 - DNA, 17 bp, Homo sapiens
ctacttccaagaaaaat

SEQ ID NO: 1523300 - DNA, 21 bp, Homo sapiens
ctacttccccagctctcagta

SEQ ID NO: 1523301 - DNA, 14 bp, Homo sapiens
ctacttcccttcct

SEQ ID NO: 1523302 - DNA, 15 bp, Homo sapiens
ctacttcccttcctc

SEQ ID NO: 1523303 - DNA, 19 bp, Homo sapiens
ctacttcctcctccccact

SEQ ID NO: 1523304 - DNA, 17 bp, Homo sapiens
ctacttctgactttact

SEQ ID NO: 1523305 - DNA, 23 bp, Homo sapiens
ctacttcttttttcaaaagaaag

SEQ ID NO: 1523306 - DNA, 23 bp, Homo sapiens
ctacttgataatattagtgattc

SEQ ID NO: 1523307 - DNA, 15 bp, Homo sapiens
ctacttgcctcattt

SEQ ID NO: 1523308 - DNA, 15 bp, Homo sapiens
ctactttaagtgata

SEQ ID NO: 1523309 - DNA, 15 bp, Homo sapiens
ctactttagccactg

SEQ ID NO: 1523310 - DNA, 14 bp, Homo sapiens
ctactttataacta

SEQ ID NO: 1523311 - DNA, 16 bp, Homo sapiens
ctactttgcttccgcc

SEQ ID NO: 1523312 - DNA, 17 bp, Homo sapiens
ctactttgtggcaatct

SEQ ID NO: 1523313 - DNA, 16 bp, Homo sapiens
ctactttttatgtgct

SEQ ID NO: 1523314 - DNA, 22 bp, Homo sapiens
ctagaaaacttgactccatttc

SEQ ID NO: 1523315 - DNA, 22 bp, Homo sapiens
ctagaaagaaaagaccctgaga

SEQ ID NO: 1523316 - DNA, 16 bp, Homo sapiens
ctagaaatatctttct

SEQ ID NO: 1523317 - DNA, 16 bp, Homo sapiens
ctagaaattgggcagt

SEQ ID NO: 1523318 - DNA, 12 bp, Homo sapiens
ctagaaattttc

SEQ ID NO: 1523319 - DNA, 13 bp, Homo sapiens
ctagaaatttttc

SEQ ID NO: 1523320 - DNA, 23 bp, Homo sapiens
ctagaaatttttcagatgcttct

SEQ ID NO: 1523321 - DNA, 14 bp, Homo sapiens
ctagaacacaggca

SEQ ID NO: 1523322 - DNA, 15 bp, Homo sapiens
ctagaacatgcacat

SEQ ID NO: 1523323 - DNA, 16 bp, Homo sapiens
ctagaaccaagcttca

SEQ ID NO: 1523324 - DNA, 18 bp, Homo sapiens
ctagaaccaagcttcaga

SEQ ID NO: 1523325 - DNA, 19 bp, Homo sapiens
ctagaaccaagcttcagag

SEQ ID NO: 1523326 - DNA, 21 bp, Homo sapiens
ctagaaccaagcttcagagcc

SEQ ID NO: 1523327 - DNA, 22 bp, Homo sapiens
ctagaaccaagcttcagagcct

SEQ ID NO: 1523328 - DNA, 23 bp, Homo sapiens
ctagaacgtgcatccttgtaata

SEQ ID NO: 1523329 - DNA, 18 bp, Homo sapiens
ctagaactctccatctta

SEQ ID NO: 1523330 - DNA, 16 bp, Homo sapiens
ctagaagaaccaaata

SEQ ID NO: 1523331 - DNA, 20 bp, Homo sapiens
ctagaagaaccaaatacctc

SEQ ID NO: 1523332 - DNA, 21 bp, Homo sapiens
ctagaagatgaatacaaacaa

SEQ ID NO: 1523333 - DNA, 18 bp, Homo sapiens
ctagaagatgtgtaaaca

SEQ ID NO: 1523334 - DNA, 18 bp, Homo sapiens
ctagaagattagaaacta

SEQ ID NO: 1523335 - DNA, 22 bp, Homo sapiens
ctagaagattttgaaattttta

SEQ ID NO: 1523336 - DNA, 12 bp, Homo sapiens
ctagaagcacat

SEQ ID NO: 1523337 - DNA, 13 bp, Homo sapiens
ctagaagcacatg

SEQ ID NO: 1523338 - DNA, 12 bp, Homo sapiens
ctagaagccaag

SEQ ID NO: 1523339 - DNA, 16 bp, Homo sapiens
ctagaagccaagggaa

SEQ ID NO: 1523340 - DNA, 22 bp, Homo sapiens
ctagaaggcgtccatgtttatt

SEQ ID NO: 1523341 - DNA, 17 bp, Homo sapiens
ctagaaggcttctctcc

SEQ ID NO: 1523342 - DNA, 23 bp, Homo sapiens
ctagaagggccagtcctgcctgg

SEQ ID NO: 1523343 - DNA, 15 bp, Homo sapiens
ctagaagtaagaaga

SEQ ID NO: 1523344 - DNA, 23 bp, Homo sapiens
ctagaagtaagaagaggagcctc

SEQ ID NO: 1523345 - DNA, 23 bp, Homo sapiens
ctagaagtctccctgcacagcct

SEQ ID NO: 1523346 - DNA, 17 bp, Homo sapiens
ctagaagtgggccagga

SEQ ID NO: 1523347 - DNA, 19 bp, Homo sapiens
ctagaagtgggccaggaca

SEQ ID NO: 1523348 - DNA, 21 bp, Homo sapiens
ctagaagtgggccaggacagg

SEQ ID NO: 1523349 - DNA, 19 bp, Homo sapiens
ctagaagttactgaatgca

SEQ ID NO: 1523350 - DNA, 21 bp, Homo sapiens
ctagaatgtcagatttctggt

SEQ ID NO: 1523351 - DNA, 14 bp, Homo sapiens
ctagaattttaagc

SEQ ID NO: 1523352 - DNA, 15 bp, Homo sapiens
ctagaattttaagcc

SEQ ID NO: 1523353 - DNA, 15 bp, Homo sapiens
ctagacaagatattg

SEQ ID NO: 1523354 - DNA, 23 bp, Homo sapiens
ctagacacaatttcatttccagc

SEQ ID NO: 1523355 - DNA, 16 bp, Homo sapiens
ctagacaccaaagttc

SEQ ID NO: 1523356 - DNA, 17 bp, Homo sapiens
ctagacaccaaagttct

SEQ ID NO: 1523357 - DNA, 19 bp, Homo sapiens
ctagacaccaaagttctaa

SEQ ID NO: 1523358 - DNA, 21 bp, Homo sapiens
ctagacaccaaagttctaata

SEQ ID NO: 1523359 - DNA, 19 bp, Homo sapiens
ctagacagaaaccaagcca

SEQ ID NO: 1523360 - DNA, 19 bp, Homo sapiens
ctagacatggaggttctaa

SEQ ID NO: 1523361 - DNA, 20 bp, Homo sapiens
ctagacatggaggttctaag

SEQ ID NO: 1523362 - DNA, 22 bp, Homo sapiens
ctagacatggaggttctaaggc

SEQ ID NO: 1523363 - DNA, 23 bp, Homo sapiens
ctagacatggaggttctaaggcc

SEQ ID NO: 1523364 - DNA, 14 bp, Homo sapiens
ctagacccaggtgg

SEQ ID NO: 1523365 - DNA, 16 bp, Homo sapiens
ctagacgcccctccca

SEQ ID NO: 1523366 - DNA, 17 bp, Homo sapiens
ctagactcaaaacctgg

SEQ ID NO: 1523367 - DNA, 19 bp, Homo sapiens
ctagactcaaaacctggag

SEQ ID NO: 1523368 - DNA, 20 bp, Homo sapiens
ctagactcaaaacctggaga

SEQ ID NO: 1523369 - DNA, 19 bp, Homo sapiens
ctagactggagtgaggctt

SEQ ID NO: 1523370 - DNA, 24 bp, Homo sapiens
ctagactggagtgaggcttccagg

SEQ ID NO: 1523371 - DNA, 15 bp, Homo sapiens
ctagactggcctagg

SEQ ID NO: 1523372 - DNA, 15 bp, Homo sapiens
ctagactgttacttt

SEQ ID NO: 1523373 - DNA, 16 bp, Homo sapiens
ctagactgttactttg

SEQ ID NO: 1523374 - DNA, 20 bp, Homo sapiens
ctagactgttactttggcaa

SEQ ID NO: 1523375 - DNA, 14 bp, Homo sapiens
ctagacttccccat

SEQ ID NO: 1523376 - DNA, 15 bp, Homo sapiens
ctagacttccccatc

SEQ ID NO: 1523377 - DNA, 21 bp, Homo sapiens
ctagacttccccatcccgaag

SEQ ID NO: 1523378 - DNA, 20 bp, Homo sapiens
ctagactttaaatttaaagt

SEQ ID NO: 1523379 - DNA, 13 bp, Homo sapiens
ctagagagaataa

SEQ ID NO: 1523380 - DNA, 19 bp, Homo sapiens
ctagagagaataaattgga

SEQ ID NO: 1523381 - DNA, 23 bp, Homo sapiens
ctagagagccttaacttcttaaa

SEQ ID NO: 1523382 - DNA, 17 bp, Homo sapiens
ctagagatatggcagcg

SEQ ID NO: 1523383 - DNA, 14 bp, Homo sapiens
ctagagatattctt

SEQ ID NO: 1523384 - DNA, 14 bp, Homo sapiens
ctagagcaacccct

SEQ ID NO: 1523385 - DNA, 15 bp, Homo sapiens
ctagagcagggatta

SEQ ID NO: 1523386 - DNA, 23 bp, Homo sapiens
ctagagcagttggccaagcagaa

SEQ ID NO: 1523387 - DNA, 14 bp, Homo sapiens
ctagagccgagggg

SEQ ID NO: 1523388 - DNA, 14 bp, Homo sapiens
ctagaggcagggag

SEQ ID NO: 1523389 - DNA, 18 bp, Homo sapiens
ctagaggcagggagggga

SEQ ID NO: 1523390 - DNA, 19 bp, Homo sapiens
ctagaggccacctatgcca

SEQ ID NO: 1523391 - DNA, 23 bp, Homo sapiens
ctagaggccagccccacccagga

SEQ ID NO: 1523392 - DNA, 17 bp, Homo sapiens
ctagaggcgagccaggc

SEQ ID NO: 1523393 - DNA, 22 bp, Homo sapiens
ctagaggcttgcataataagct

SEQ ID NO: 1523394 - DNA, 19 bp, Homo sapiens
ctagagggcccatcaggca

SEQ ID NO: 1523395 - DNA, 21 bp, Homo sapiens
ctagagggcccatcaggcagt

SEQ ID NO: 1523396 - DNA, 21 bp, Homo sapiens
ctagaggtgggcagctgggcc

SEQ ID NO: 1523397 - DNA, 23 bp, Homo sapiens
ctagaggttgcagcatgagactt

SEQ ID NO: 1523398 - DNA, 15 bp, Homo sapiens
ctagagtccaaggtt

SEQ ID NO: 1523399 - DNA, 16 bp, Homo sapiens
ctagagtctgaacagc

SEQ ID NO: 1523400 - DNA, 19 bp, Homo sapiens
ctagagtctgaacagctgt

SEQ ID NO: 1523401 - DNA, 20 bp, Homo sapiens
ctagagtctgaacagctgta

SEQ ID NO: 1523402 - DNA, 16 bp, Homo sapiens
ctagagtgtagcctaa

SEQ ID NO: 1523403 - DNA, 20 bp, Homo sapiens
ctagagttcggtctgacagt

SEQ ID NO: 1523404 - DNA, 17 bp, Homo sapiens
ctagagtttatacagtg

SEQ ID NO: 1523405 - DNA, 18 bp, Homo sapiens
ctagatacgaaatcagtt

SEQ ID NO: 1523406 - DNA, 21 bp, Homo sapiens
ctagatatcgacttgtttttg

SEQ ID NO: 1523407 - DNA, 19 bp, Homo sapiens
ctagatcaaggagcccaga

SEQ ID NO: 1523408 - DNA, 21 bp, Homo sapiens
acgtgcacctgtactcaggag

SEQ ID NO: 1523409 - DNA, 16 bp, Homo sapiens
acgtgccagctctagt

SEQ ID NO: 1523410 - DNA, 13 bp, Homo sapiens
acgtgccaggccc

SEQ ID NO: 1523411 - DNA, 21 bp, Homo sapiens
acgtgcgtgtctctgccatgt

SEQ ID NO: 1523412 - DNA, 12 bp, Homo sapiens
acgtgcttcttt

SEQ ID NO: 1523413 - DNA, 14 bp, Homo sapiens
acgtgcttctttgt

SEQ ID NO: 1523414 - DNA, 17 bp, Homo sapiens
acgtggacatgcctcaa

SEQ ID NO: 1523415 - DNA, 15 bp, Homo sapiens
acgtggagagctggt

SEQ ID NO: 1523416 - DNA, 16 bp, Homo sapiens
acgtggagagctggtg

SEQ ID NO: 1523417 - DNA, 18 bp, Homo sapiens
acgtggagagctggtgcc

SEQ ID NO: 1523418 - DNA, 19 bp, Homo sapiens
acgtggagagctggtgccc

SEQ ID NO: 1523419 - DNA, 13 bp, Homo sapiens
acgtggcactggt

SEQ ID NO: 1523420 - DNA, 20 bp, Homo sapiens
acgtggcctccgcagtgtct

SEQ ID NO: 1523421 - DNA, 11 bp, Homo sapiens
acgtggggctc

SEQ ID NO: 1523422 - DNA, 15 bp, Homo sapiens
acgtggtcaccttcg

SEQ ID NO: 1523423 - DNA, 18 bp, Homo sapiens
acgtggttggggccctgc

SEQ ID NO: 1523424 - DNA, 16 bp, Homo sapiens
acgtgtatagtatctg

SEQ ID NO: 1523425 - DNA, 21 bp, Homo sapiens
acgtgtccgtccacccttcca

SEQ ID NO: 1523426 - DNA, 15 bp, Homo sapiens
acgtgtgcatgtgtc

SEQ ID NO: 1523427 - DNA, 16 bp, Homo sapiens
acgtgtgcatgtgtct

SEQ ID NO: 1523428 - DNA, 19 bp, Homo sapiens
acgttaggcatttcctgct

SEQ ID NO: 1523429 - DNA, 16 bp, Homo sapiens
acgttgagcccctgga

SEQ ID NO: 1523430 - DNA, 21 bp, Homo sapiens
acgttggacttttcgttaaca

SEQ ID NO: 1523431 - DNA, 16 bp, Homo sapiens
acgtttacttatctta

SEQ ID NO: 1523432 - DNA, 17 bp, Homo sapiens
acgtttctcaaatctgc

SEQ ID NO: 1523433 - DNA, 18 bp, Homo sapiens
acgtttcttctttctaga

SEQ ID NO: 1523434 - DNA, 15 bp, Homo sapiens
acgtttgtgcagaat

SEQ ID NO: 1523435 - DNA, 12 bp, Homo sapiens
acgttttcttct

SEQ ID NO: 1523436 - DNA, 13 bp, Homo sapiens
acgttttcttctt

SEQ ID NO: 1523437 - DNA, 15 bp, Homo sapiens
acgttttcttctttc

SEQ ID NO: 1523438 - DNA, 19 bp, Homo sapiens
acgttttcttctttccctg

SEQ ID NO: 1523439 - DNA, 20 bp, Homo sapiens
acgtttttaatataaagcct

SEQ ID NO: 1523440 - DNA, 17 bp, Homo sapiens
actaaaaaaaagatgaa

SEQ ID NO: 1523441 - DNA, 12 bp, Homo sapiens
actaaaaataca

SEQ ID NO: 1523442 - DNA, 14 bp, Homo sapiens
actaaaatatttat

SEQ ID NO: 1523443 - DNA, 20 bp, Homo sapiens
actaaaattcaacaaatgat

SEQ ID NO: 1523444 - DNA, 13 bp, Homo sapiens
actaaacaaataa

SEQ ID NO: 1523445 - DNA, 13 bp, Homo sapiens
actaaacattttg

SEQ ID NO: 1523446 - DNA, 16 bp, Homo sapiens
actaaactcatttata

SEQ ID NO: 1523447 - DNA, 22 bp, Homo sapiens
actaaactttttttctgtacca

SEQ ID NO: 1523448 - DNA, 12 bp, Homo sapiens
actaaagagaga

SEQ ID NO: 1523449 - DNA, 21 bp, Homo sapiens
actaaagagagaatgtagata

SEQ ID NO: 1523450 - DNA, 18 bp, Homo sapiens
actaaagagtgaatgcca

SEQ ID NO: 1523451 - DNA, 21 bp, Homo sapiens
actaaagatatcagagctctt

SEQ ID NO: 1523452 - DNA, 17 bp, Homo sapiens
actaaagcagtagaaat

SEQ ID NO: 1523453 - DNA, 20 bp, Homo sapiens
actaaagttgtactttaaaa

SEQ ID NO: 1523454 - DNA, 14 bp, Homo sapiens
actaaatgtaaaat

SEQ ID NO: 1523455 - DNA, 12 bp, Homo sapiens
actaaattatta

SEQ ID NO: 1523456 - DNA, 21 bp, Homo sapiens
actaaattattagcatttgtt

SEQ ID NO: 1523457 - DNA, 18 bp, Homo sapiens
actaaattcaaagaagta

SEQ ID NO: 1523458 - DNA, 20 bp, Homo sapiens
actaaattgtatacattttg

SEQ ID NO: 1523459 - DNA, 15 bp, Homo sapiens
actaaattttaaagc

SEQ ID NO: 1523460 - DNA, 16 bp, Homo sapiens
actaaattttctaatt

SEQ ID NO: 1523461 - DNA, 13 bp, Homo sapiens
actaacaagaatg

SEQ ID NO: 1523462 - DNA, 17 bp, Homo sapiens
actaacataaaatctgt

SEQ ID NO: 1523463 - DNA, 17 bp, Homo sapiens
actaacatataatgttg

SEQ ID NO: 1523464 - DNA, 15 bp, Homo sapiens
actaaccaagctgag

SEQ ID NO: 1523465 - DNA, 18 bp, Homo sapiens
actaaccaagctgagttt

SEQ ID NO: 1523466 - DNA, 14 bp, Homo sapiens
actaaccatcccca

SEQ ID NO: 1523467 - DNA, 23 bp, Homo sapiens
actaactatgcatggtgccccag

SEQ ID NO: 1523468 - DNA, 12 bp, Homo sapiens
actaactgctgg

SEQ ID NO: 1523469 - DNA, 13 bp, Homo sapiens
actaactggcagg

SEQ ID NO: 1523470 - DNA, 17 bp, Homo sapiens
actaacttgacttttaa

SEQ ID NO: 1523471 - DNA, 20 bp, Homo sapiens
actaagaataaataaagaag

SEQ ID NO: 1523472 - DNA, 21 bp, Homo sapiens
actaagaatgtccttattctt

SEQ ID NO: 1523473 - DNA, 14 bp, Homo sapiens
actaagagaaactg

SEQ ID NO: 1523474 - DNA, 15 bp, Homo sapiens
actaagagaaactgt

SEQ ID NO: 1523475 - DNA, 15 bp, Homo sapiens
actaagcaatttccc

SEQ ID NO: 1523476 - DNA, 13 bp, Homo sapiens
actaagccctgtc

SEQ ID NO: 1523477 - DNA, 16 bp, Homo sapiens
actaagccctgtcgag

SEQ ID NO: 1523478 - DNA, 18 bp, Homo sapiens
actaaggtgaagaatctt

SEQ ID NO: 1523479 - DNA, 17 bp, Homo sapiens
actaatagaataaaggc

SEQ ID NO: 1523480 - DNA, 12 bp, Homo sapiens
actaatatatat

SEQ ID NO: 1523481 - DNA, 18 bp, Homo sapiens
actaatatatttaaaaat

SEQ ID NO: 1523482 - DNA, 19 bp, Homo sapiens
actaatatatttaaaaata

SEQ ID NO: 1523483 - DNA, 19 bp, Homo sapiens
actaatcttaaccctgtgc

SEQ ID NO: 1523484 - DNA, 20 bp, Homo sapiens
actaatcttaaccctgtgct

SEQ ID NO: 1523485 - DNA, 15 bp, Homo sapiens
actaatgatgctttt

SEQ ID NO: 1523486 - DNA, 13 bp, Homo sapiens
actaatgatgttt

SEQ ID NO: 1523487 - DNA, 24 bp, Homo sapiens
actaatgccttactcttcttgaaa

SEQ ID NO: 1523488 - DNA, 23 bp, Homo sapiens
actaatgctaagaaatgctgaaa

SEQ ID NO: 1523489 - DNA, 13 bp, Homo sapiens
actaatgcttttt

SEQ ID NO: 1523490 - DNA, 17 bp, Homo sapiens
actaatgctttttagaa

SEQ ID NO: 1523491 - DNA, 19 bp, Homo sapiens
actaatgtttgaacaaagc

SEQ ID NO: 1523492 - DNA, 12 bp, Homo sapiens
actaatttcata

SEQ ID NO: 1523493 - DNA, 14 bp, Homo sapiens
actaatttcttctt

SEQ ID NO: 1523494 - DNA, 12 bp, Homo sapiens
actaatttgtgg

SEQ ID NO: 1523495 - DNA, 21 bp, Homo sapiens
actaattttacatgtttataa

SEQ ID NO: 1523496 - DNA, 18 bp, Homo sapiens
actaatttttgtattatt

SEQ ID NO: 1523497 - DNA, 13 bp, Homo sapiens
actacaaaatttg

SEQ ID NO: 1523498 - DNA, 18 bp, Homo sapiens
actacaaaatttgaaatt

SEQ ID NO: 1523499 - DNA, 17 bp, Homo sapiens
actacaaagctttgcta

SEQ ID NO: 1523500 - DNA, 18 bp, Homo sapiens
actacaaagctttgctac

SEQ ID NO: 1523501 - DNA, 20 bp, Homo sapiens
actacacagcacaccagccg

SEQ ID NO: 1523502 - DNA, 18 bp, Homo sapiens
actacactcaactaattt

SEQ ID NO: 1523503 - DNA, 19 bp, Homo sapiens
actacaggcgcctgccagc

SEQ ID NO: 1523504 - DNA, 21 bp, Homo sapiens
actacaggctcatgccatcat

SEQ ID NO: 1523505 - DNA, 23 bp, Homo sapiens
actacataattaaattttaatgt

SEQ ID NO: 1523506 - DNA, 21 bp, Homo sapiens
actacattttgaggttttgta

SEQ ID NO: 1523507 - DNA, 21 bp, Homo sapiens
actacccacgttctcacaccc

SEQ ID NO: 1523508 - DNA, 21 bp, Homo sapiens
actacccgagcccagctacat

SEQ ID NO: 1523509 - DNA, 16 bp, Homo sapiens
actaccctgattcttg

SEQ ID NO: 1523510 - DNA, 20 bp, Homo sapiens
actacccttctcctttcctt

SEQ ID NO: 1523511 - DNA, 21 bp, Homo sapiens
actacccttctcctttccttc

SEQ ID NO: 1523512 - DNA, 14 bp, Homo sapiens
actaccgtggacca

SEQ ID NO: 1523513 - DNA, 19 bp, Homo sapiens
actaccgtggaccacctag

SEQ ID NO: 1523514 - DNA, 21 bp, Homo sapiens
actacctacgtttgcaccgcc

SEQ ID NO: 1523515 - DNA, 12 bp, Homo sapiens
actacctctgga

SEQ ID NO: 1523516 - DNA, 14 bp, Homo sapiens
actacctcttttga

SEQ ID NO: 1523517 - DNA, 13 bp, Homo sapiens
actacgcctggct

SEQ ID NO: 1523518 - DNA, 20 bp, Homo sapiens
actacgggggggagaaggaa

SEQ ID NO: 1523519 - DNA, 15 bp, Homo sapiens
actacgtgactgtgg

SEQ ID NO: 1523520 - DNA, 19 bp, Homo sapiens
actactagatgtctttagg

SEQ ID NO: 1523521 - DNA, 14 bp, Homo sapiens
actactcgagccca

SEQ ID NO: 1523522 - DNA, 14 bp, Homo sapiens
actactctctgttt

SEQ ID NO: 1523523 - DNA, 17 bp, Homo sapiens
actactgaaacagattt

SEQ ID NO: 1523524 - DNA, 18 bp, Homo sapiens
actactgaacacatgtgt

SEQ ID NO: 1523525 - DNA, 18 bp, Homo sapiens
cgtgcaggacagctcttg

SEQ ID NO: 1523526 - DNA, 17 bp, Homo sapiens
cgtgcagggacaaagag

SEQ ID NO: 1523527 - DNA, 16 bp, Homo sapiens
cgtgcagtacaggcaa

SEQ ID NO: 1523528 - DNA, 17 bp, Homo sapiens
cgtgcatccttgtaata

SEQ ID NO: 1523529 - DNA, 14 bp, Homo sapiens
cgtgcatggctcct

SEQ ID NO: 1523530 - DNA, 20 bp, Homo sapiens
cgtgcatggctcctgtctgg

SEQ ID NO: 1523531 - DNA, 22 bp, Homo sapiens
cgtgcattggaagaccccaccc

SEQ ID NO: 1523532 - DNA, 23 bp, Homo sapiens
cgtgccacccgtaggcagcctct

SEQ ID NO: 1523533 - DNA, 19 bp, Homo sapiens
cgtgccagcagcctcgcac

SEQ ID NO: 1523534 - DNA, 21 bp, Homo sapiens
cgtgccagcagcctcgcacag

SEQ ID NO: 1523535 - DNA, 17 bp, Homo sapiens
cgtgccagctctagttt

SEQ ID NO: 1523536 - DNA, 15 bp, Homo sapiens
cgtgccagtcctggg

SEQ ID NO: 1523537 - DNA, 16 bp, Homo sapiens
cgtgcccccctcctcc

SEQ ID NO: 1523538 - DNA, 18 bp, Homo sapiens
cgtgcccccctcctccag

SEQ ID NO: 1523539 - DNA, 15 bp, Homo sapiens
cgtgccgcctgcact

SEQ ID NO: 1523540 - DNA, 22 bp, Homo sapiens
cgtgccggcggcagccccactt

SEQ ID NO: 1523541 - DNA, 13 bp, Homo sapiens
cgtgcctccacca

SEQ ID NO: 1523542 - DNA, 22 bp, Homo sapiens
cgtgcctccaccaccactggcc

SEQ ID NO: 1523543 - DNA, 14 bp, Homo sapiens
cgtgcctgtgtcca

SEQ ID NO: 1523544 - DNA, 15 bp, Homo sapiens
cgtgcctgtgtccat

SEQ ID NO: 1523545 - DNA, 18 bp, Homo sapiens
cgtgccttcagctctaca

SEQ ID NO: 1523546 - DNA, 21 bp, Homo sapiens
cgtgccttttgcacccctccc

SEQ ID NO: 1523547 - DNA, 16 bp, Homo sapiens
cgtgcgacagagagag

SEQ ID NO: 1523548 - DNA, 21 bp, Homo sapiens
cgtgcgcccgtggggtctgcg

SEQ ID NO: 1523549 - DNA, 22 bp, Homo sapiens
cgtgcgctggttccgccaggcg

SEQ ID NO: 1523550 - DNA, 19 bp, Homo sapiens
cgtgcgtgtgtgtgtgttt

SEQ ID NO: 1523551 - DNA, 18 bp, Homo sapiens
cgtgctccttttctcttt

SEQ ID NO: 1523552 - DNA, 15 bp, Homo sapiens
cgtgctgtgggcctc

SEQ ID NO: 1523553 - DNA, 11 bp, Homo sapiens
cgtggacaggc

SEQ ID NO: 1523554 - DNA, 16 bp, Homo sapiens
cgtggacaggcccagc

SEQ ID NO: 1523555 - DNA, 16 bp, Homo sapiens
cgtggacatgcctcaa

SEQ ID NO: 1523556 - DNA, 13 bp, Homo sapiens
cgtggacctgcct

SEQ ID NO: 1523557 - DNA, 16 bp, Homo sapiens
cgtggactcctcttgg

SEQ ID NO: 1523558 - DNA, 21 bp, Homo sapiens
cgtggactgagtgggaagccc

SEQ ID NO: 1523559 - DNA, 14 bp, Homo sapiens
cgtggactgcagtc

SEQ ID NO: 1523560 - DNA, 16 bp, Homo sapiens
cgtggagccagggagc

SEQ ID NO: 1523561 - DNA, 17 bp, Homo sapiens
cgtggaggaggaaggca

SEQ ID NO: 1523562 - DNA, 15 bp, Homo sapiens
cgtggagggaggccc

SEQ ID NO: 1523563 - DNA, 20 bp, Homo sapiens
cgtggatcgagtgtagctgt

SEQ ID NO: 1523564 - DNA, 23 bp, Homo sapiens
cgtggatcgagtgtagctgtgaa

SEQ ID NO: 1523565 - DNA, 13 bp, Homo sapiens
cgtggatctcctt

SEQ ID NO: 1523566 - DNA, 17 bp, Homo sapiens
cgtggatctccttccct

SEQ ID NO: 1523567 - DNA, 18 bp, Homo sapiens
cgtggatgcgcagtgcct

SEQ ID NO: 1523568 - DNA, 13 bp, Homo sapiens
cgtggatttgtac

SEQ ID NO: 1523569 - DNA, 18 bp, Homo sapiens
cgtggcacgtattgctgt

SEQ ID NO: 1523570 - DNA, 20 bp, Homo sapiens
cgtggcatgtggcctgtggc

SEQ ID NO: 1523571 - DNA, 15 bp, Homo sapiens
cgtggccacaaaaac

SEQ ID NO: 1523572 - DNA, 21 bp, Homo sapiens
cgtggccacgggggcagtgtg

SEQ ID NO: 1523573 - DNA, 13 bp, Homo sapiens
cgtggccagcccg

SEQ ID NO: 1523574 - DNA, 21 bp, Homo sapiens
cgtggcctcgtgaggggcaag

SEQ ID NO: 1523575 - DNA, 23 bp, Homo sapiens
cgtggcctcgtgaggggcaagct

SEQ ID NO: 1523576 - DNA, 16 bp, Homo sapiens
cgtggcctcttgagca

SEQ ID NO: 1523577 - DNA, 15 bp, Homo sapiens
cgtggcgcaggtgcc

SEQ ID NO: 1523578 - DNA, 18 bp, Homo sapiens
cgtggcgcaggtgccatg

SEQ ID NO: 1523579 - DNA, 21 bp, Homo sapiens
cgtggcgcaggtgccatgcct

SEQ ID NO: 1523580 - DNA, 17 bp, Homo sapiens
cgtggctgtggcacaga

SEQ ID NO: 1523581 - DNA, 18 bp, Homo sapiens
cgtggcttcccgctcagc

SEQ ID NO: 1523582 - DNA, 19 bp, Homo sapiens
cgtggcttcccgctcagcc

SEQ ID NO: 1523583 - DNA, 16 bp, Homo sapiens
cgtggcttccctgtcc

SEQ ID NO: 1523584 - DNA, 22 bp, Homo sapiens
cgtggcttggggattgtacacg

SEQ ID NO: 1523585 - DNA, 20 bp, Homo sapiens
cgtgggacggtgcccaagcc

SEQ ID NO: 1523586 - DNA, 13 bp, Homo sapiens
cgtgggaggctga

SEQ ID NO: 1523587 - DNA, 14 bp, Homo sapiens
cgtgggcagtgcca

SEQ ID NO: 1523588 - DNA, 18 bp, Homo sapiens
cgtgggcgcaaaggtgcc

SEQ ID NO: 1523589 - DNA, 19 bp, Homo sapiens
cgtgggcgcaaaggtgcct

SEQ ID NO: 1523590 - DNA, 21 bp, Homo sapiens
cgtgggcgcaaaggtgcctca

SEQ ID NO: 1523591 - DNA, 22 bp, Homo sapiens
cgtgggcgcaaaggtgcctcat

SEQ ID NO: 1523592 - DNA, 16 bp, Homo sapiens
cgtggggcagggagct

SEQ ID NO: 1523593 - DNA, 15 bp, Homo sapiens
cgtggggtgctgccc

SEQ ID NO: 1523594 - DNA, 17 bp, Homo sapiens
cgtggggtgtgctggga

SEQ ID NO: 1523595 - DNA, 19 bp, Homo sapiens
cgtgggtcctgaggcctgc

SEQ ID NO: 1523596 - DNA, 19 bp, Homo sapiens
cgtgggtgccctctccaaa

SEQ ID NO: 1523597 - DNA, 15 bp, Homo sapiens
cgtggtatgtctgcc

SEQ ID NO: 1523598 - DNA, 17 bp, Homo sapiens
cgtggtatgtctgccat

SEQ ID NO: 1523599 - DNA, 17 bp, Homo sapiens
cgtggtcagagtgccac

SEQ ID NO: 1523600 - DNA, 19 bp, Homo sapiens
cgtggtccaaccaggagct

SEQ ID NO: 1523601 - DNA, 14 bp, Homo sapiens
cgtggtccagctct

SEQ ID NO: 1523602 - DNA, 21 bp, Homo sapiens
cgtggtgatcaattaaatgta

SEQ ID NO: 1523603 - DNA, 18 bp, Homo sapiens
cgtggtgtgtccctggac

SEQ ID NO: 1523604 - DNA, 20 bp, Homo sapiens
cgtggtgtgtccctggacac

SEQ ID NO: 1523605 - DNA, 21 bp, Homo sapiens
cgtggtttgcctgaggctgta

SEQ ID NO: 1523606 - DNA, 19 bp, Homo sapiens
cgtgtaaaaagcctccttg

SEQ ID NO: 1523607 - DNA, 22 bp, Homo sapiens
cgtgtagctatggaagttgcat

SEQ ID NO: 1523608 - DNA, 17 bp, Homo sapiens
cgtgtaggagtgagaag

SEQ ID NO: 1523609 - DNA, 23 bp, Homo sapiens
cgtgtagtggaagagcagcctga

SEQ ID NO: 1523610 - DNA, 22 bp, Homo sapiens
cgtgtatagtgcctaaaattgt

SEQ ID NO: 1523611 - DNA, 15 bp, Homo sapiens
cgtgtatcctggggc

SEQ ID NO: 1523612 - DNA, 22 bp, Homo sapiens
cgtgtattgagatttcttaaat

SEQ ID NO: 1523613 - DNA, 17 bp, Homo sapiens
cgtgtcaagctgctctg

SEQ ID NO: 1523614 - DNA, 15 bp, Homo sapiens
cgtgtccagcacaga

SEQ ID NO: 1523615 - DNA, 18 bp, Homo sapiens
cgtgtcccgcggtgctga

SEQ ID NO: 1523616 - DNA, 16 bp, Homo sapiens
cgtgtccgtccaccct

SEQ ID NO: 1523617 - DNA, 23 bp, Homo sapiens
cgtgtctctcccaccccggcctc

SEQ ID NO: 1523618 - DNA, 13 bp, Homo sapiens
cgtgtctctgcca

SEQ ID NO: 1523619 - DNA, 21 bp, Homo sapiens
cgtgtctctgccatgtggcag

SEQ ID NO: 1523620 - DNA, 18 bp, Homo sapiens
cgtgtgacctccatactg

SEQ ID NO: 1523621 - DNA, 23 bp, Homo sapiens
cgtgtgagaagtgaatgctggga

SEQ ID NO: 1523622 - DNA, 15 bp, Homo sapiens
cgtgtgcctgtgtgc

SEQ ID NO: 1523623 - DNA, 16 bp, Homo sapiens
cgtgtgctgaagacat

SEQ ID NO: 1523624 - DNA, 18 bp, Homo sapiens
cgtgtggagcagagctct

SEQ ID NO: 1523625 - DNA, 15 bp, Homo sapiens
cgtgtgtatatttgt

SEQ ID NO: 1523626 - DNA, 18 bp, Homo sapiens
cgtgtgtcccagatgctg

SEQ ID NO: 1523627 - DNA, 17 bp, Homo sapiens
cgtgtgtgacactgatg

SEQ ID NO: 1523628 - DNA, 16 bp, Homo sapiens
cgtgtgtggctgggac

SEQ ID NO: 1523629 - DNA, 22 bp, Homo sapiens
cgtgtgtgtgtgtgtgtgtgca

SEQ ID NO: 1523630 - DNA, 19 bp, Homo sapiens
cgtgttagtgtgtgtgcat

SEQ ID NO: 1523631 - DNA, 16 bp, Homo sapiens
cgtgttctccttttcc

SEQ ID NO: 1523632 - DNA, 20 bp, Homo sapiens
cgtgtttctgactctgagct

SEQ ID NO: 1523633 - DNA, 21 bp, Homo sapiens
cgtgttttattcctgtatgtt

SEQ ID NO: 1523634 - DNA, 11 bp, Homo sapiens
cgttaacattg

SEQ ID NO: 1523635 - DNA, 22 bp, Homo sapiens
cgttaacattgaccaagaactg

SEQ ID NO: 1523636 - DNA, 12 bp, Homo sapiens
cgttacctgccg

SEQ ID NO: 1523637 - DNA, 14 bp, Homo sapiens
cgttagctcctgtg

SEQ ID NO: 1523638 - DNA, 17 bp, Homo sapiens
cgttagctcctgtggcc

SEQ ID NO: 1523639 - DNA, 19 bp, Homo sapiens
cgttaggcatttcctgctg

SEQ ID NO: 1523640 - DNA, 11 bp, Homo sapiens
cgttatattaa

SEQ ID NO: 1523641 - DNA, 23 bp, Homo sapiens
cgttcaagacttgagcggagccc

SEQ ID NO: 1523642 - DNA, 23 bp, Homo sapiens
cgttcacctccaagcatttcatg

SEQ ID NO: 1523643 - DNA, 15 bp, Homo sapiens
cgttcagcctgtctc

SEQ ID NO: 1523644 - DNA, 21 bp, Homo sapiens
cgttccaccccaagagaactc

SEQ ID NO: 1523645 - DNA, 14 bp, Homo sapiens
cgttccccttggct

SEQ ID NO: 1523646 - DNA, 18 bp, Homo sapiens
cgttccccttggcttcct

SEQ ID NO: 1523647 - DNA, 19 bp, Homo sapiens
cgttccccttggcttcctc

SEQ ID NO: 1523648 - DNA, 21 bp, Homo sapiens
cgttccccttggcttcctccg

SEQ ID NO: 1523649 - DNA, 16 bp, Homo sapiens
cgttcctggccttctg

SEQ ID NO: 1523650 - DNA, 22 bp, Homo sapiens
cgttcgtacgcccaggacagct

SEQ ID NO: 1523651 - DNA, 20 bp, Homo sapiens
cgttctaggtaggaagagcc

SEQ ID NO: 1523652 - DNA, 18 bp, Homo sapiens
cgttctcaagaatctaga

SEQ ID NO: 1523653 - DNA, 18 bp, Homo sapiens
cgttctcacacccaccgt

SEQ ID NO: 1523654 - DNA, 22 bp, Homo sapiens
cgttctccacccaccagtcagg

SEQ ID NO: 1523655 - DNA, 12 bp, Homo sapiens
cgttctctgcct

SEQ ID NO: 1523656 - DNA, 20 bp, Homo sapiens
cgttctctgtcctacttctg

SEQ ID NO: 1523657 - DNA, 18 bp, Homo sapiens
cgttctgctgcccctgca

SEQ ID NO: 1523658 - DNA, 22 bp, Homo sapiens
cgttctgttccaacctcctgct

SEQ ID NO: 1523659 - DNA, 18 bp, Homo sapiens
cgttgaagaggaagggca

SEQ ID NO: 1523660 - DNA, 16 bp, Homo sapiens
cgttgaggatgaggcc

SEQ ID NO: 1523661 - DNA, 14 bp, Homo sapiens
cgttggagagcagc

SEQ ID NO: 1523662 - DNA, 12 bp, Homo sapiens
cgttggagccac

SEQ ID NO: 1523663 - DNA, 13 bp, Homo sapiens
cgttggagccact

SEQ ID NO: 1523664 - DNA, 13 bp, Homo sapiens
cgttgggagccta

SEQ ID NO: 1523665 - DNA, 12 bp, Homo sapiens
cgttgtgagctg

SEQ ID NO: 1523666 - DNA, 19 bp, Homo sapiens
cgtttagtttctagaggcc

SEQ ID NO: 1523667 - DNA, 15 bp, Homo sapiens
cgtttattttcaaga

SEQ ID NO: 1523668 - DNA, 11 bp, Homo sapiens
cgtttccatca

SEQ ID NO: 1523669 - DNA, 13 bp, Homo sapiens
cgtttcccctcct

SEQ ID NO: 1523670 - DNA, 20 bp, Homo sapiens
cgtttcctgagaagtgtcta

SEQ ID NO: 1523671 - DNA, 11 bp, Homo sapiens
cgtttctggaa

SEQ ID NO: 1523672 - DNA, 19 bp, Homo sapiens
cgtttgatttcaaagcaag

SEQ ID NO: 1523673 - DNA, 18 bp, Homo sapiens
cgtttgcaccgcctgccc

SEQ ID NO: 1523674 - DNA, 17 bp, Homo sapiens
cgtttggaggcccctgg

SEQ ID NO: 1523675 - DNA, 14 bp, Homo sapiens
cgtttgtatgtgtg

SEQ ID NO: 1523676 - DNA, 16 bp, Homo sapiens
cgtttgtgcatatctg

SEQ ID NO: 1523677 - DNA, 13 bp, Homo sapiens
cgttttaaaaaag

SEQ ID NO: 1523678 - DNA, 23 bp, Homo sapiens
cgttttcttctttccctggacag

SEQ ID NO: 1523679 - DNA, 16 bp, Homo sapiens
cgttttgcaaggtaaa

SEQ ID NO: 1523680 - DNA, 13 bp, Homo sapiens
cgttttgcacatt

SEQ ID NO: 1523681 - DNA, 15 bp, Homo sapiens
cgttttggaagctct

SEQ ID NO: 1523682 - DNA, 11 bp, Homo sapiens
cgttttgtcac

SEQ ID NO: 1523683 - DNA, 21 bp, Homo sapiens
cgtttttgtattttcatgaaa

SEQ ID NO: 1523684 - DNA, 20 bp, Homo sapiens
cgtttttttttttttattgt

SEQ ID NO: 1523685 - DNA, 20 bp, Homo sapiens
ctaaaaaaaatgcatattaa

SEQ ID NO: 1523686 - DNA, 13 bp, Homo sapiens
ctaaaaaataact

SEQ ID NO: 1523687 - DNA, 18 bp, Homo sapiens
ctaaaaaataactgtgca

SEQ ID NO: 1523688 - DNA, 20 bp, Homo sapiens
ctaaaaataaaatgcattta

SEQ ID NO: 1523689 - DNA, 22 bp, Homo sapiens
ctaaaaataactgtaattattt

SEQ ID NO: 1523690 - DNA, 23 bp, Homo sapiens
ctaaaaatacaaaattagctggg

SEQ ID NO: 1523691 - DNA, 13 bp, Homo sapiens
ctaaaaatgcaac

SEQ ID NO: 1523692 - DNA, 14 bp, Homo sapiens
ctaaaaattggtgt

SEQ ID NO: 1523693 - DNA, 16 bp, Homo sapiens
ctaaaacaataaagat

SEQ ID NO: 1523694 - DNA, 23 bp, Homo sapiens
ctaaaacattctttaacatacat

SEQ ID NO: 1523695 - DNA, 17 bp, Homo sapiens
ctaaaactctttcggta

SEQ ID NO: 1523696 - DNA, 18 bp, Homo sapiens
ctaaaagagatttcaaga

SEQ ID NO: 1523697 - DNA, 15 bp, Homo sapiens
ctaaaagatcctttt

SEQ ID NO: 1523698 - DNA, 16 bp, Homo sapiens
ctaaaagttgaaaagc

SEQ ID NO: 1523699 - DNA, 14 bp, Homo sapiens
ctaaaataaaaatg

SEQ ID NO: 1523700 - DNA, 18 bp, Homo sapiens
ctaaaataaaaatgaaaa

SEQ ID NO: 1523701 - DNA, 22 bp, Homo sapiens
ctaaaatactcaccaaaatata

SEQ ID NO: 1523702 - DNA, 10 bp, Homo sapiens
ctaaaatatt

SEQ ID NO: 1523703 - DNA, 21 bp, Homo sapiens
ctaaaatatttatgaagaaaa

SEQ ID NO: 1523704 - DNA, 23 bp, Homo sapiens
ctaaaatatttattttttttaag

SEQ ID NO: 1523705 - DNA, 18 bp, Homo sapiens
ctaaaattcaaaaacaaa

SEQ ID NO: 1523706 - DNA, 15 bp, Homo sapiens
ctaaaattcaacaaa

SEQ ID NO: 1523707 - DNA, 14 bp, Homo sapiens
ctaaaattctagtc

SEQ ID NO: 1523708 - DNA, 22 bp, Homo sapiens
ctaaaattctagtctctgattt

SEQ ID NO: 1523709 - DNA, 18 bp, Homo sapiens
ctaaaattgtatgaaaat

SEQ ID NO: 1523710 - DNA, 23 bp, Homo sapiens
ctaaaatttaatttcttttttcc

SEQ ID NO: 1523711 - DNA, 12 bp, Homo sapiens
ctaaaatttgta

SEQ ID NO: 1523712 - DNA, 13 bp, Homo sapiens
ctaaaatttgtaa

SEQ ID NO: 1523713 - DNA, 16 bp, Homo sapiens
ctaaaatttgtaatat

SEQ ID NO: 1523714 - DNA, 23 bp, Homo sapiens
ctaaacaagattttaaagacatg

SEQ ID NO: 1523715 - DNA, 19 bp, Homo sapiens
ctaaacaatgctgatttgg

SEQ ID NO: 1523716 - DNA, 12 bp, Homo sapiens
ctaaacagatat

SEQ ID NO: 1523717 - DNA, 16 bp, Homo sapiens
ctaaacagatgtaatg

SEQ ID NO: 1523718 - DNA, 11 bp, Homo sapiens
ctaaacataat

SEQ ID NO: 1523719 - DNA, 17 bp, Homo sapiens
ctaaacattttgttatt

SEQ ID NO: 1523720 - DNA, 15 bp, Homo sapiens
ctaaaccaaaacaga

SEQ ID NO: 1523721 - DNA, 19 bp, Homo sapiens
ctaaaccaaggactgagca

SEQ ID NO: 1523722 - DNA, 20 bp, Homo sapiens
ctaaaccaaggactgagcac

SEQ ID NO: 1523723 - DNA, 23 bp, Homo sapiens
ctaaaccaaggactgagcaccct

SEQ ID NO: 1523724 - DNA, 16 bp, Homo sapiens
ctaaactgtgaaaaat

SEQ ID NO: 1523725 - DNA, 12 bp, Homo sapiens
ctaaagaaaaat

SEQ ID NO: 1523726 - DNA, 23 bp, Homo sapiens
ctaaagaaaaatatcttggccta

SEQ ID NO: 1523727 - DNA, 18 bp, Homo sapiens
ctaaagagagaatgtaga

SEQ ID NO: 1523728 - DNA, 15 bp, Homo sapiens
ctaaagagcccttgc

SEQ ID NO: 1523729 - DNA, 17 bp, Homo sapiens
ctaaagagcccttgcct

SEQ ID NO: 1523730 - DNA, 18 bp, Homo sapiens
ctaaagagcccttgcctc

SEQ ID NO: 1523731 - DNA, 20 bp, Homo sapiens
ctaaagagcccttgcctccc

SEQ ID NO: 1523732 - DNA, 17 bp, Homo sapiens
ctaaagatggaaaagaa

SEQ ID NO: 1523733 - DNA, 14 bp, Homo sapiens
ctaaagattctata

SEQ ID NO: 1523734 - DNA, 18 bp, Homo sapiens
ctaaagattctatagttc

SEQ ID NO: 1523735 - DNA, 20 bp, Homo sapiens
ctaaagcactttgcacttaa

SEQ ID NO: 1523736 - DNA, 21 bp, Homo sapiens
ctaaagcactttgcacttaat

SEQ ID NO: 1523737 - DNA, 14 bp, Homo sapiens
ctaaagcagaggca

SEQ ID NO: 1523738 - DNA, 14 bp, Homo sapiens
ctaaagcatgaaat

SEQ ID NO: 1523739 - DNA, 18 bp, Homo sapiens
ctaaagccaaccagcctt

SEQ ID NO: 1523740 - DNA, 15 bp, Homo sapiens
ctaaagcttcagact

SEQ ID NO: 1523741 - DNA, 17 bp, Homo sapiens
ctaaaggggttccaaat

SEQ ID NO: 1523742 - DNA, 19 bp, Homo sapiens
ctaaaggtccacaggtcta

SEQ ID NO: 1523743 - DNA, 16 bp, Homo sapiens
ctaaaggtgtatttaa

SEQ ID NO: 1523744 - DNA, 14 bp, Homo sapiens
ctaaagtaattggt

SEQ ID NO: 1523745 - DNA, 18 bp, Homo sapiens
ctaaagtatacaactgcc

SEQ ID NO: 1523746 - DNA, 19 bp, Homo sapiens
ctaaagtatacaactgcct

SEQ ID NO: 1523747 - DNA, 23 bp, Homo sapiens
ctaaagtcatcatgaactggctt

SEQ ID NO: 1523748 - DNA, 15 bp, Homo sapiens
ctaaagtcctggccc

SEQ ID NO: 1523749 - DNA, 12 bp, Homo sapiens
ctaaagttctaa

SEQ ID NO: 1523750 - DNA, 15 bp, Homo sapiens
ctaaagttctaagat

SEQ ID NO: 1523751 - DNA, 19 bp, Homo sapiens
ctaaagttctaagattctg

SEQ ID NO: 1523752 - DNA, 15 bp, Homo sapiens
ctaaagttgtacttt

SEQ ID NO: 1523753 - DNA, 20 bp, Homo sapiens
ctaaagttgtactttaaaaa

SEQ ID NO: 1523754 - DNA, 15 bp, Homo sapiens
ctaaataaaaatatg

SEQ ID NO: 1523755 - DNA, 18 bp, Homo sapiens
ctaaataaaaatatgtaa

SEQ ID NO: 1523756 - DNA, 12 bp, Homo sapiens
ctaaataaacat

SEQ ID NO: 1523757 - DNA, 18 bp, Homo sapiens
ctaaataagaaaataaca

SEQ ID NO: 1523758 - DNA, 19 bp, Homo sapiens
acctttcaccctcatgaaa

SEQ ID NO: 1523759 - DNA, 18 bp, Homo sapiens
acctttccaccacagcca

SEQ ID NO: 1523760 - DNA, 18 bp, Homo sapiens
acctttcccatcttccaa

SEQ ID NO: 1523761 - DNA, 15 bp, Homo sapiens
acctttctccactgg

SEQ ID NO: 1523762 - DNA, 13 bp, Homo sapiens
acctttctctctc

SEQ ID NO: 1523763 - DNA, 19 bp, Homo sapiens
acctttgagagatataata

SEQ ID NO: 1523764 - DNA, 20 bp, Homo sapiens
acctttgagtagatccattt

SEQ ID NO: 1523765 - DNA, 14 bp, Homo sapiens
acctttgctatgta

SEQ ID NO: 1523766 - DNA, 15 bp, Homo sapiens
acctttgctatgtaa

SEQ ID NO: 1523767 - DNA, 19 bp, Homo sapiens
acctttgggttctttctgg

SEQ ID NO: 1523768 - DNA, 14 bp, Homo sapiens
acctttggtgcaga

SEQ ID NO: 1523769 - DNA, 16 bp, Homo sapiens
acctttggtgcagagg

SEQ ID NO: 1523770 - DNA, 16 bp, Homo sapiens
acctttgtaagacatt

SEQ ID NO: 1523771 - DNA, 13 bp, Homo sapiens
accttttacattg

SEQ ID NO: 1523772 - DNA, 20 bp, Homo sapiens
accttttatgaatcaaatat

SEQ ID NO: 1523773 - DNA, 13 bp, Homo sapiens
accttttcaggaa

SEQ ID NO: 1523774 - DNA, 13 bp, Homo sapiens
accttttctcttt

SEQ ID NO: 1523775 - DNA, 17 bp, Homo sapiens
accttttgaggagcccc

SEQ ID NO: 1523776 - DNA, 23 bp, Homo sapiens
accttttgtagttttatttgtat

SEQ ID NO: 1523777 - DNA, 14 bp, Homo sapiens
acctttttaataaa

SEQ ID NO: 1523778 - DNA, 15 bp, Homo sapiens
acctttttccttcct

SEQ ID NO: 1523779 - DNA, 19 bp, Homo sapiens
acctttttcttgatcttaa

SEQ ID NO: 1523780 - DNA, 24 bp, Homo sapiens
acctttttttatcgtttttgtatt

SEQ ID NO: 1523781 - DNA, 13 bp, Homo sapiens
acgaaacccactc

SEQ ID NO: 1523782 - DNA, 22 bp, Homo sapiens
acgaaactccatctcaaaacaa

SEQ ID NO: 1523783 - DNA, 13 bp, Homo sapiens
acgaaatgttatt

SEQ ID NO: 1523784 - DNA, 19 bp, Homo sapiens
acgaacctacagttttaac

SEQ ID NO: 1523785 - DNA, 11 bp, Homo sapiens
acgaagaaaaa

SEQ ID NO: 1523786 - DNA, 19 bp, Homo sapiens
acgaagacaaagtcccaga

SEQ ID NO: 1523787 - DNA, 20 bp, Homo sapiens
acgaagagtatttttgacag

SEQ ID NO: 1523788 - DNA, 17 bp, Homo sapiens
acgaagccatctttctt

SEQ ID NO: 1523789 - DNA, 19 bp, Homo sapiens
acgaagcggagagagccaa

SEQ ID NO: 1523790 - DNA, 16 bp, Homo sapiens
acgaagctcattccca

SEQ ID NO: 1523791 - DNA, 15 bp, Homo sapiens
acgaatctcatccct

SEQ ID NO: 1523792 - DNA, 21 bp, Homo sapiens
acgaatctcatccctcaactg

SEQ ID NO: 1523793 - DNA, 13 bp, Homo sapiens
acgacaaaatgaa

SEQ ID NO: 1523794 - DNA, 15 bp, Homo sapiens
acgagacccccatcc

SEQ ID NO: 1523795 - DNA, 19 bp, Homo sapiens
acgagaccctacaggagag

SEQ ID NO: 1523796 - DNA, 19 bp, Homo sapiens
acgagatcaagagatcaag

SEQ ID NO: 1523797 - DNA, 11 bp, Homo sapiens
acgagatttgc

SEQ ID NO: 1523798 - DNA, 19 bp, Homo sapiens
acgagcacctccagcctga

SEQ ID NO: 1523799 - DNA, 15 bp, Homo sapiens
acgagcactggccag

SEQ ID NO: 1523800 - DNA, 22 bp, Homo sapiens
acgagcagcccagggcctagag

SEQ ID NO: 1523801 - DNA, 15 bp, Homo sapiens
acgagccacaagctg

SEQ ID NO: 1523802 - DNA, 20 bp, Homo sapiens
acgagccacaagctgcactg

SEQ ID NO: 1523803 - DNA, 21 bp, Homo sapiens
acgagccttctcaccccagga

SEQ ID NO: 1523804 - DNA, 21 bp, Homo sapiens
acgagggctgatggaggaaaa

SEQ ID NO: 1523805 - DNA, 11 bp, Homo sapiens
acgagggctgg

SEQ ID NO: 1523806 - DNA, 16 bp, Homo sapiens
acgagggctggctggc

SEQ ID NO: 1523807 - DNA, 20 bp, Homo sapiens
acgagggctggctggcctca

SEQ ID NO: 1523808 - DNA, 16 bp, Homo sapiens
acgagtaatttattgt

SEQ ID NO: 1523809 - DNA, 14 bp, Homo sapiens
acgagtcacctgca

SEQ ID NO: 1523810 - DNA, 20 bp, Homo sapiens
acgatgcatttaataaagat

SEQ ID NO: 1523811 - DNA, 23 bp, Homo sapiens
acgatgcatttaataaagatgag

SEQ ID NO: 1523812 - DNA, 16 bp, Homo sapiens
acgatgtggccctggc

SEQ ID NO: 1523813 - DNA, 17 bp, Homo sapiens
acgatgtggccctggcc

SEQ ID NO: 1523814 - DNA, 22 bp, Homo sapiens
acgatgtggccctggcctgctg

SEQ ID NO: 1523815 - DNA, 13 bp, Homo sapiens
acgattccactga

SEQ ID NO: 1523816 - DNA, 21 bp, Homo sapiens
acgatttgcaggattcccttc

SEQ ID NO: 1523817 - DNA, 20 bp, Homo sapiens
acgcaagggcatcaggcact

SEQ ID NO: 1523818 - DNA, 21 bp, Homo sapiens
acgcaagggcatcaggcactg

SEQ ID NO: 1523819 - DNA, 14 bp, Homo sapiens
acgcacgcacacac

SEQ ID NO: 1523820 - DNA, 15 bp, Homo sapiens
acgcacgcacacaca

SEQ ID NO: 1523821 - DNA, 21 bp, Homo sapiens
acgcactctccccgctcaggg

SEQ ID NO: 1523822 - DNA, 20 bp, Homo sapiens
acgcactgggccacggagga

SEQ ID NO: 1523823 - DNA, 19 bp, Homo sapiens
acgcacttgcctgttggct

SEQ ID NO: 1523824 - DNA, 21 bp, Homo sapiens
acgcagcagctgggacccctc

SEQ ID NO: 1523825 - DNA, 22 bp, Homo sapiens
acgcagcagctgggacccctcc

SEQ ID NO: 1523826 - DNA, 14 bp, Homo sapiens
acgcagccggaggg

SEQ ID NO: 1523827 - DNA, 13 bp, Homo sapiens
acgcagcctgctc

SEQ ID NO: 1523828 - DNA, 18 bp, Homo sapiens
acgcagcctgctctggag

SEQ ID NO: 1523829 - DNA, 19 bp, Homo sapiens
acgcaggcccccaggtgcc

SEQ ID NO: 1523830 - DNA, 18 bp, Homo sapiens
acgcaggctgagtccaga

SEQ ID NO: 1523831 - DNA, 18 bp, Homo sapiens
acgcagggccatccactg

SEQ ID NO: 1523832 - DNA, 18 bp, Homo sapiens
acgcatacacacatgccc

SEQ ID NO: 1523833 - DNA, 14 bp, Homo sapiens
acgcatccagcaag

SEQ ID NO: 1523834 - DNA, 15 bp, Homo sapiens
acgcatccagcaaga

SEQ ID NO: 1523835 - DNA, 20 bp, Homo sapiens
acgcatctcaaaacagaggg

SEQ ID NO: 1523836 - DNA, 23 bp, Homo sapiens
acgcatctcaaaacagagggctg

SEQ ID NO: 1523837 - DNA, 15 bp, Homo sapiens
acgcatctgtagttc

SEQ ID NO: 1523838 - DNA, 14 bp, Homo sapiens
acgccactgcactc

SEQ ID NO: 1523839 - DNA, 20 bp, Homo sapiens
acgccattgtactccagcct

SEQ ID NO: 1523840 - DNA, 23 bp, Homo sapiens
acgcccctcccaagcgttcctgg

SEQ ID NO: 1523841 - DNA, 16 bp, Homo sapiens
acgcccgtcctgcctg

SEQ ID NO: 1523842 - DNA, 17 bp, Homo sapiens
acgccctactccactgc

SEQ ID NO: 1523843 - DNA, 14 bp, Homo sapiens
acgccctccctctc

SEQ ID NO: 1523844 - DNA, 22 bp, Homo sapiens
acgccctccctctcccaggccc

SEQ ID NO: 1523845 - DNA, 19 bp, Homo sapiens
acgccctgcgttggagcca

SEQ ID NO: 1523846 - DNA, 17 bp, Homo sapiens
acgccctttcctcctca

SEQ ID NO: 1523847 - DNA, 21 bp, Homo sapiens
acgccgccttggccttgcagc

SEQ ID NO: 1523848 - DNA, 17 bp, Homo sapiens
acgccgtaattctttct

SEQ ID NO: 1523849 - DNA, 18 bp, Homo sapiens
acgcctcactgaaacatg

SEQ ID NO: 1523850 - DNA, 22 bp, Homo sapiens
acgcctcactgaaacatggctg

SEQ ID NO: 1523851 - DNA, 18 bp, Homo sapiens
acgcctcttctgtccctg

SEQ ID NO: 1523852 - DNA, 24 bp, Homo sapiens
acgcctcttgaccaggctgcctcc

SEQ ID NO: 1523853 - DNA, 19 bp, Homo sapiens
acgcctgaggcaattagac

SEQ ID NO: 1523854 - DNA, 21 bp, Homo sapiens
acgcctgtaatcccagcactt

SEQ ID NO: 1523855 - DNA, 16 bp, Homo sapiens
acgccttccaggtcag

SEQ ID NO: 1523856 - DNA, 20 bp, Homo sapiens
acgctaaagagcccttgcct

SEQ ID NO: 1523857 - DNA, 18 bp, Homo sapiens
acgctaacaatttctcat

SEQ ID NO: 1523858 - DNA, 16 bp, Homo sapiens
acgctatccagttgca

SEQ ID NO: 1523859 - DNA, 19 bp, Homo sapiens
acgctatccagttgcaggt

SEQ ID NO: 1523860 - DNA, 18 bp, Homo sapiens
acgctcatgtcctgtcct

SEQ ID NO: 1523861 - DNA, 21 bp, Homo sapiens
acgctcatgtcctgtcctggt

SEQ ID NO: 1523862 - DNA, 19 bp, Homo sapiens
acgctccagctgccccggc

SEQ ID NO: 1523863 - DNA, 21 bp, Homo sapiens
acgctcccccgcagtccccag

SEQ ID NO: 1523864 - DNA, 14 bp, Homo sapiens
acgctccctggaag

SEQ ID NO: 1523865 - DNA, 13 bp, Homo sapiens
acgctcctttgtg

SEQ ID NO: 1523866 - DNA, 21 bp, Homo sapiens
acgctcctttgtgtgtgtgtc

SEQ ID NO: 1523867 - DNA, 22 bp, Homo sapiens
acgctgaccatgcgtcaggggc

SEQ ID NO: 1523868 - DNA, 23 bp, Homo sapiens
acgctgaccatgcgtcaggggcc

SEQ ID NO: 1523869 - DNA, 14 bp, Homo sapiens
acgctgcctggtct

SEQ ID NO: 1523870 - DNA, 22 bp, Homo sapiens
acgctgcctggtctgtctggat

SEQ ID NO: 1523871 - DNA, 12 bp, Homo sapiens
acgctgctgtca

SEQ ID NO: 1523872 - DNA, 14 bp, Homo sapiens
acgctggctactgt

SEQ ID NO: 1523873 - DNA, 11 bp, Homo sapiens
acgctggctcc

SEQ ID NO: 1523874 - DNA, 18 bp, Homo sapiens
acgctggctccccaaagg

SEQ ID NO: 1523875 - DNA, 18 bp, Homo sapiens
acgcttactagatgtgag

SEQ ID NO: 1523876 - DNA, 21 bp, Homo sapiens
acgcttgtagaactcactctg

SEQ ID NO: 1523877 - DNA, 16 bp, Homo sapiens
acgcttgtgacagtgc

SEQ ID NO: 1523878 - DNA, 18 bp, Homo sapiens
acgctttcctgaatccaa

SEQ ID NO: 1523879 - DNA, 16 bp, Homo sapiens
acgcttttaattctca

SEQ ID NO: 1523880 - DNA, 14 bp, Homo sapiens
acgcttttctttgt

SEQ ID NO: 1523881 - DNA, 16 bp, Homo sapiens
acggaaaatgcttaaa

SEQ ID NO: 1523882 - DNA, 18 bp, Homo sapiens
acggaagccccctcttcc

SEQ ID NO: 1523883 - DNA, 12 bp, Homo sapiens
acggagaagaat

SEQ ID NO: 1523884 - DNA, 12 bp, Homo sapiens
acggagagaaaa

SEQ ID NO: 1523885 - DNA, 16 bp, Homo sapiens
acggagagtgcttggg

SEQ ID NO: 1523886 - DNA, 22 bp, Homo sapiens
acggaggaggggaaggggctga

SEQ ID NO: 1523887 - DNA, 21 bp, Homo sapiens
acggagtctcactctgtcacc

SEQ ID NO: 1523888 - DNA, 16 bp, Homo sapiens
acggatgattggatta

SEQ ID NO: 1523889 - DNA, 14 bp, Homo sapiens
acggcaacagcatg

SEQ ID NO: 1523890 - DNA, 18 bp, Homo sapiens
acggcaacgtagcctggg

SEQ ID NO: 1523891 - DNA, 22 bp, Homo sapiens
acggcaacgtagcctgggctca

SEQ ID NO: 1523892 - DNA, 18 bp, Homo sapiens
acggcacgcacttgcctg

SEQ ID NO: 1523893 - DNA, 15 bp, Homo sapiens
acggcaggctcactg

SEQ ID NO: 1523894 - DNA, 20 bp, Homo sapiens
acggcaggctcactgccagg

SEQ ID NO: 1523895 - DNA, 16 bp, Homo sapiens
acggccaagaatgtac

SEQ ID NO: 1523896 - DNA, 19 bp, Homo sapiens
acggccaatggtgcttccc

SEQ ID NO: 1523897 - DNA, 20 bp, Homo sapiens
acggccaatggtgcttcccc

SEQ ID NO: 1523898 - DNA, 11 bp, Homo sapiens
acggccaccct

SEQ ID NO: 1523899 - DNA, 12 bp, Homo sapiens
acggccaccctc

SEQ ID NO: 1523900 - DNA, 18 bp, Homo sapiens
acggccaccctccttccc

SEQ ID NO: 1523901 - DNA, 18 bp, Homo sapiens
acggccagggagaagctc

SEQ ID NO: 1523902 - DNA, 23 bp, Homo sapiens
acggccagggagaagctcctctc

SEQ ID NO: 1523903 - DNA, 12 bp, Homo sapiens
acggccagggtt

SEQ ID NO: 1523904 - DNA, 19 bp, Homo sapiens
acggcctgatgctccctcc

SEQ ID NO: 1523905 - DNA, 22 bp, Homo sapiens
acggcctgatgctccctcccct

SEQ ID NO: 1523906 - DNA, 22 bp, Homo sapiens
acggcctgcccagtcgacccca

SEQ ID NO: 1523907 - DNA, 22 bp, Homo sapiens
acggcctggctggtgggaaggc

SEQ ID NO: 1523908 - DNA, 23 bp, Homo sapiens
acggcctggctggtgggaaggcc

SEQ ID NO: 1523909 - DNA, 16 bp, Homo sapiens
acggcgcccccagtgt

SEQ ID NO: 1523910 - DNA, 18 bp, Homo sapiens
acggcggccaggcacagg

SEQ ID NO: 1523911 - DNA, 19 bp, Homo sapiens
acggcggccaggcacaggg

SEQ ID NO: 1523912 - DNA, 21 bp, Homo sapiens
acggcgtggtgtgtccctgga

SEQ ID NO: 1523913 - DNA, 15 bp, Homo sapiens
acggctcactgcagc

SEQ ID NO: 1523914 - DNA, 16 bp, Homo sapiens
acggctgcgcactgtg

SEQ ID NO: 1523915 - DNA, 22 bp, Homo sapiens
acggctgggtgtttcagtttga

SEQ ID NO: 1523916 - DNA, 17 bp, Homo sapiens
acggctggtcactctgc

SEQ ID NO: 1523917 - DNA, 20 bp, Homo sapiens
acggctggtcactctgccct

SEQ ID NO: 1523918 - DNA, 19 bp, Homo sapiens
acggctgtgacgcagccgg

SEQ ID NO: 1523919 - DNA, 23 bp, Homo sapiens
acggctgtggaccgtggacaggc

SEQ ID NO: 1523920 - DNA, 23 bp, Homo sapiens
acggctgttcccctcacccaaaa

SEQ ID NO: 1523921 - DNA, 23 bp, Homo sapiens
acggcttagacttcgactcagga

SEQ ID NO: 1523922 - DNA, 22 bp, Homo sapiens
acggcttcactgaccagcggct

SEQ ID NO: 1523923 - DNA, 19 bp, Homo sapiens
acgggacatcacagggtgg

SEQ ID NO: 1523924 - DNA, 19 bp, Homo sapiens
acgggagcattggcccctg

SEQ ID NO: 1523925 - DNA, 22 bp, Homo sapiens
acgggatggttctggctgtttg

SEQ ID NO: 1523926 - DNA, 17 bp, Homo sapiens
acgggcagcctggctcc

SEQ ID NO: 1523927 - DNA, 18 bp, Homo sapiens
acgggcgctgcagcctcc

SEQ ID NO: 1523928 - DNA, 14 bp, Homo sapiens
acgggctccttccc

SEQ ID NO: 1523929 - DNA, 16 bp, Homo sapiens
acgggctccttcccct

SEQ ID NO: 1523930 - DNA, 18 bp, Homo sapiens
acgggctccttcccctgc

SEQ ID NO: 1523931 - DNA, 14 bp, Homo sapiens
acgggctgccctgc

SEQ ID NO: 1523932 - DNA, 15 bp, Homo sapiens
acggggactcagccc

SEQ ID NO: 1523933 - DNA, 14 bp, Homo sapiens
acgggggcagtgtg

SEQ ID NO: 1523934 - DNA, 16 bp, Homo sapiens
acgggggctgcttctc

SEQ ID NO: 1523935 - DNA, 17 bp, Homo sapiens
acgggggctgcttctcc

SEQ ID NO: 1523936 - DNA, 23 bp, Homo sapiens
acgggttcaccatgttgcccagg

SEQ ID NO: 1523937 - DNA, 14 bp, Homo sapiens
acgggttgaaagac

SEQ ID NO: 1523938 - DNA, 18 bp, Homo sapiens
acgggttgaaagacatca

SEQ ID NO: 1523939 - DNA, 20 bp, Homo sapiens
acgggttgaaagacatcaat

SEQ ID NO: 1523940 - DNA, 14 bp, Homo sapiens
acggtaagtgttct

SEQ ID NO: 1523941 - DNA, 18 bp, Homo sapiens
acggtaagtgttctcatg

SEQ ID NO: 1523942 - DNA, 16 bp, Homo sapiens
acggtctggggaagag

SEQ ID NO: 1523943 - DNA, 17 bp, Homo sapiens
acggtgccaagggcccc

SEQ ID NO: 1523944 - DNA, 14 bp, Homo sapiens
acggtgcccaagcc

SEQ ID NO: 1523945 - DNA, 19 bp, Homo sapiens
acggtgctgtgagggaggg

SEQ ID NO: 1523946 - DNA, 23 bp, Homo sapiens
acggtggagaagatcgcatggca

SEQ ID NO: 1523947 - DNA, 18 bp, Homo sapiens
acggtgggcatttgtgag

SEQ ID NO: 1523948 - DNA, 16 bp, Homo sapiens
acggtgttaattttgc

SEQ ID NO: 1523949 - DNA, 15 bp, Homo sapiens
acggtgttttgccat

SEQ ID NO: 1523950 - DNA, 17 bp, Homo sapiens
acggtgttttgccatgt

SEQ ID NO: 1523951 - DNA, 23 bp, Homo sapiens
acggtttttttctttggctgcag

SEQ ID NO: 1523952 - DNA, 22 bp, Homo sapiens
acgtaaaacatttgtttccccc

SEQ ID NO: 1523953 - DNA, 13 bp, Homo sapiens
acgtaaagaattt

SEQ ID NO: 1523954 - DNA, 19 bp, Homo sapiens
acgtaaagaattttcatcc

SEQ ID NO: 1523955 - DNA, 13 bp, Homo sapiens
acgtaattaaatc

SEQ ID NO: 1523956 - DNA, 17 bp, Homo sapiens
acgtaattaaatccaac

SEQ ID NO: 1523957 - DNA, 16 bp, Homo sapiens
acgtacttagcagcta

SEQ ID NO: 1523958 - DNA, 12 bp, Homo sapiens
acgtagcctggg

SEQ ID NO: 1523959 - DNA, 14 bp, Homo sapiens
acgtagctctctta

SEQ ID NO: 1523960 - DNA, 15 bp, Homo sapiens
acgtataaatatcag

SEQ ID NO: 1523961 - DNA, 13 bp, Homo sapiens
acgtatacaataa

SEQ ID NO: 1523962 - DNA, 18 bp, Homo sapiens
acgtatattgtatcattt

SEQ ID NO: 1523963 - DNA, 17 bp, Homo sapiens
acgtattgctgtgtctc

SEQ ID NO: 1523964 - DNA, 22 bp, Homo sapiens
acgtatttatatttggaaagag

SEQ ID NO: 1523965 - DNA, 16 bp, Homo sapiens
acgtatttcacagagc

SEQ ID NO: 1523966 - DNA, 18 bp, Homo sapiens
acgtcagacttggctcag

SEQ ID NO: 1523967 - DNA, 22 bp, Homo sapiens
acgtcagcctcttaccttcccg

SEQ ID NO: 1523968 - DNA, 14 bp, Homo sapiens
acgtcatctcaggg

SEQ ID NO: 1523969 - DNA, 12 bp, Homo sapiens
acgtcatgtatt

SEQ ID NO: 1523970 - DNA, 18 bp, Homo sapiens
acgtcccagcatccctgg

SEQ ID NO: 1523971 - DNA, 23 bp, Homo sapiens
acgtccgtgtgtcccagatgctg

SEQ ID NO: 1523972 - DNA, 18 bp, Homo sapiens
acgtctcctcctcgaagc

SEQ ID NO: 1523973 - DNA, 14 bp, Homo sapiens
acgtctctgccgcc

SEQ ID NO: 1523974 - DNA, 19 bp, Homo sapiens
acgtctctgccgcctgcgt

SEQ ID NO: 1523975 - DNA, 12 bp, Homo sapiens
acgtctgccagg

SEQ ID NO: 1523976 - DNA, 13 bp, Homo sapiens
acgtctgccaggc

SEQ ID NO: 1523977 - DNA, 16 bp, Homo sapiens
acgtctgccaggccca

SEQ ID NO: 1523978 - DNA, 20 bp, Homo sapiens
acgtctgccaggcccatctc

SEQ ID NO: 1523979 - DNA, 14 bp, Homo sapiens
acgtctggggtgtg

SEQ ID NO: 1523980 - DNA, 23 bp, Homo sapiens
acgtgaaatacttcgatgatgat

SEQ ID NO: 1523981 - DNA, 13 bp, Homo sapiens
acgtgaaattcta

SEQ ID NO: 1523982 - DNA, 16 bp, Homo sapiens
acgtgacagtgcctgg

SEQ ID NO: 1523983 - DNA, 17 bp, Homo sapiens
acgtgacagtgcctggg

SEQ ID NO: 1523984 - DNA, 18 bp, Homo sapiens
acgtgactgccccaactc

SEQ ID NO: 1523985 - DNA, 20 bp, Homo sapiens
acgtgactgccccaactcct

SEQ ID NO: 1523986 - DNA, 15 bp, Homo sapiens
acgtgagagaaagag

SEQ ID NO: 1523987 - DNA, 18 bp, Homo sapiens
acgtgagagaatctgcct

SEQ ID NO: 1523988 - DNA, 20 bp, Homo sapiens
acgtgatcctctcacctcag

SEQ ID NO: 1523989 - DNA, 13 bp, Homo sapiens
acgtgcaaagcca

SEQ ID NO: 1523990 - DNA, 14 bp, Homo sapiens
attgaacccaggag

SEQ ID NO: 1523991 - DNA, 14 bp, Homo sapiens
attgaacttaaatg

SEQ ID NO: 1523992 - DNA, 13 bp, Homo sapiens
attgaagacaatt

SEQ ID NO: 1523993 - DNA, 19 bp, Homo sapiens
attgaagacaatttgatac

SEQ ID NO: 1523994 - DNA, 17 bp, Homo sapiens
attgaagatgctgcctg

SEQ ID NO: 1523995 - DNA, 22 bp, Homo sapiens
attgaagccgactctggccctg

SEQ ID NO: 1523996 - DNA, 15 bp, Homo sapiens
attgaaggagaaaat

SEQ ID NO: 1523997 - DNA, 15 bp, Homo sapiens
attgaagtaaacttt

SEQ ID NO: 1523998 - DNA, 22 bp, Homo sapiens
attgaagtaaactttttgttct

SEQ ID NO: 1523999 - DNA, 16 bp, Homo sapiens
attgaagtaatgaatt

SEQ ID NO: 1524000 - DNA, 13 bp, Homo sapiens
attgaagtttcaa

SEQ ID NO: 1524001 - DNA, 19 bp, Homo sapiens
attgaataaagttgaagct

SEQ ID NO: 1524002 - DNA, 16 bp, Homo sapiens
attgaatatatatgat

SEQ ID NO: 1524003 - DNA, 16 bp, Homo sapiens
attgaatattgtaagt

SEQ ID NO: 1524004 - DNA, 14 bp, Homo sapiens
attgaatgttatat

SEQ ID NO: 1524005 - DNA, 14 bp, Homo sapiens
attgaattaaatcc

SEQ ID NO: 1524006 - DNA, 15 bp, Homo sapiens
attgacaagtcattt

SEQ ID NO: 1524007 - DNA, 15 bp, Homo sapiens
attgacactgaactt

SEQ ID NO: 1524008 - DNA, 16 bp, Homo sapiens
attgacactgaactta

SEQ ID NO: 1524009 - DNA, 18 bp, Homo sapiens
attgacatttgtagttga

SEQ ID NO: 1524010 - DNA, 14 bp, Homo sapiens
attgaccagctctc

SEQ ID NO: 1524011 - DNA, 18 bp, Homo sapiens
attgaccgtgctggcccc

SEQ ID NO: 1524012 - DNA, 20 bp, Homo sapiens
attgacctcagctgcacatt

SEQ ID NO: 1524013 - DNA, 20 bp, Homo sapiens
attgaccttctccctcactc

SEQ ID NO: 1524014 - DNA, 21 bp, Homo sapiens
attgacgacaagtgctgaaca

SEQ ID NO: 1524015 - DNA, 14 bp, Homo sapiens
attgactcaaacca

SEQ ID NO: 1524016 - DNA, 15 bp, Homo sapiens
attgactcaaaccat

SEQ ID NO: 1524017 - DNA, 17 bp, Homo sapiens
attgactgtctttccta

SEQ ID NO: 1524018 - DNA, 22 bp, Homo sapiens
attgacttcttggtttggggag

SEQ ID NO: 1524019 - DNA, 13 bp, Homo sapiens
attgactttatgt

SEQ ID NO: 1524020 - DNA, 15 bp, Homo sapiens
attgacttttataaa

SEQ ID NO: 1524021 - DNA, 15 bp, Homo sapiens
attgagaaactgaat

SEQ ID NO: 1524022 - DNA, 17 bp, Homo sapiens
attgagaaagatgttcc

SEQ ID NO: 1524023 - DNA, 13 bp, Homo sapiens
attgagaaatgtg

SEQ ID NO: 1524024 - DNA, 16 bp, Homo sapiens
attgagagttttgtct

SEQ ID NO: 1524025 - DNA, 21 bp, Homo sapiens
attgagataatatctgtgagg

SEQ ID NO: 1524026 - DNA, 22 bp, Homo sapiens
attgagcagttagctcatttga

SEQ ID NO: 1524027 - DNA, 22 bp, Homo sapiens
attgagctgctttttttgaaac

SEQ ID NO: 1524028 - DNA, 18 bp, Homo sapiens
attgaggagctgcactga

SEQ ID NO: 1524029 - DNA, 20 bp, Homo sapiens
attgagtacctactgtgtgc

SEQ ID NO: 1524030 - DNA, 13 bp, Homo sapiens
attgagtattgtt

SEQ ID NO: 1524031 - DNA, 15 bp, Homo sapiens
attgagtattgttta

SEQ ID NO: 1524032 - DNA, 23 bp, Homo sapiens
attgagtattgtttaaaatgtaa

SEQ ID NO: 1524033 - DNA, 16 bp, Homo sapiens
attgataagttcatac

SEQ ID NO: 1524034 - DNA, 19 bp, Homo sapiens
attgataagttcatacatt

SEQ ID NO: 1524035 - DNA, 18 bp, Homo sapiens
attgataattcaacattt

SEQ ID NO: 1524036 - DNA, 21 bp, Homo sapiens
attgatatacacggatgactt

SEQ ID NO: 1524037 - DNA, 17 bp, Homo sapiens
attgatcacacagtgtt

SEQ ID NO: 1524038 - DNA, 16 bp, Homo sapiens
attgatggatgtcttc

SEQ ID NO: 1524039 - DNA, 19 bp, Homo sapiens
attgatgtgtttatttata

SEQ ID NO: 1524040 - DNA, 16 bp, Homo sapiens
attgatgttaacaaga

SEQ ID NO: 1524041 - DNA, 14 bp, Homo sapiens
attgattcagtctt

SEQ ID NO: 1524042 - DNA, 18 bp, Homo sapiens
attgattcagtcttctgg

SEQ ID NO: 1524043 - DNA, 20 bp, Homo sapiens
attgattcagtcttctggat

SEQ ID NO: 1524044 - DNA, 14 bp, Homo sapiens
attgattgaattaa

SEQ ID NO: 1524045 - DNA, 14 bp, Homo sapiens
attgattgaatttt

SEQ ID NO: 1524046 - DNA, 20 bp, Homo sapiens
attgattgggaaaacatttg

SEQ ID NO: 1524047 - DNA, 21 bp, Homo sapiens
attgattgggaaaacatttgc

SEQ ID NO: 1524048 - DNA, 22 bp, Homo sapiens
attgattgggaaaacatttgct

SEQ ID NO: 1524049 - DNA, 20 bp, Homo sapiens
attgatttaaagtgaacaca

SEQ ID NO: 1524050 - DNA, 13 bp, Homo sapiens
attgatttcaaga

SEQ ID NO: 1524051 - DNA, 19 bp, Homo sapiens
attgatttttataaatact

SEQ ID NO: 1524052 - DNA, 18 bp, Homo sapiens
attgatttttctcttcat

SEQ ID NO: 1524053 - DNA, 20 bp, Homo sapiens
attgcaactcttttaagtgc

SEQ ID NO: 1524054 - DNA, 14 bp, Homo sapiens
attgcaataaagta

SEQ ID NO: 1524055 - DNA, 15 bp, Homo sapiens
attgcaataaagtat

SEQ ID NO: 1524056 - DNA, 17 bp, Homo sapiens
attgcaataaagtataa

SEQ ID NO: 1524057 - DNA, 14 bp, Homo sapiens
attgcaatatctga

SEQ ID NO: 1524058 - DNA, 16 bp, Homo sapiens
attgcaatatctgaag

SEQ ID NO: 1524059 - DNA, 13 bp, Homo sapiens
attgcaattaaac

SEQ ID NO: 1524060 - DNA, 13 bp, Homo sapiens
attgcacaatatt

SEQ ID NO: 1524061 - DNA, 14 bp, Homo sapiens
attgcacctgcagg

SEQ ID NO: 1524062 - DNA, 16 bp, Homo sapiens
attgcacgtggcctct

SEQ ID NO: 1524063 - DNA, 17 bp, Homo sapiens
attgcactccagcctgg

SEQ ID NO: 1524064 - DNA, 15 bp, Homo sapiens
attgcactccagtct

SEQ ID NO: 1524065 - DNA, 20 bp, Homo sapiens
attgcactgctgttcctgct

SEQ ID NO: 1524066 - DNA, 16 bp, Homo sapiens
attgcagaaaggagag

SEQ ID NO: 1524067 - DNA, 22 bp, Homo sapiens
attgcagaactaaactcattta

SEQ ID NO: 1524068 - DNA, 20 bp, Homo sapiens
attgcagaattgtttagatt

SEQ ID NO: 1524069 - DNA, 17 bp, Homo sapiens
attgcagactgttctta

SEQ ID NO: 1524070 - DNA, 21 bp, Homo sapiens
attgcagagactcatttcaca

SEQ ID NO: 1524071 - DNA, 19 bp, Homo sapiens
atttgccttctactcccct

SEQ ID NO: 1524072 - DNA, 14 bp, Homo sapiens
atttgctaattttt

SEQ ID NO: 1524073 - DNA, 19 bp, Homo sapiens
atttgctagttctgctgcc

SEQ ID NO: 1524074 - DNA, 22 bp, Homo sapiens
atttgctagttctgctgccctc

SEQ ID NO: 1524075 - DNA, 16 bp, Homo sapiens
atttgctatgagctgg

SEQ ID NO: 1524076 - DNA, 18 bp, Homo sapiens
atttgctcttcagatgcc

SEQ ID NO: 1524077 - DNA, 21 bp, Homo sapiens
atttgctgaactcagcacatt

SEQ ID NO: 1524078 - DNA, 19 bp, Homo sapiens
atttgctgtattgccccca

SEQ ID NO: 1524079 - DNA, 15 bp, Homo sapiens
atttggaaataaagt

SEQ ID NO: 1524080 - DNA, 17 bp, Homo sapiens
atttggaaataaagtca

SEQ ID NO: 1524081 - DNA, 16 bp, Homo sapiens
atttggaaccttgttt

SEQ ID NO: 1524082 - DNA, 11 bp, Homo sapiens
atttggagact

SEQ ID NO: 1524083 - DNA, 17 bp, Homo sapiens
atttggagagaaatatt

SEQ ID NO: 1524084 - DNA, 16 bp, Homo sapiens
atttggagcataactg

SEQ ID NO: 1524085 - DNA, 20 bp, Homo sapiens
atttggagcctgccaagagg

SEQ ID NO: 1524086 - DNA, 21 bp, Homo sapiens
atttggaggaaaaaaagcatg

SEQ ID NO: 1524087 - DNA, 23 bp, Homo sapiens
atttggagtaaatatatatgtca

SEQ ID NO: 1524088 - DNA, 15 bp, Homo sapiens
atttggatcctgtgt

SEQ ID NO: 1524089 - DNA, 18 bp, Homo sapiens
atttggccttaagaactg

SEQ ID NO: 1524090 - DNA, 15 bp, Homo sapiens
atttggctttcacat

SEQ ID NO: 1524091 - DNA, 16 bp, Homo sapiens
atttgggccaaggtgt

SEQ ID NO: 1524092 - DNA, 21 bp, Homo sapiens
atttggggtataggtctcatc

SEQ ID NO: 1524093 - DNA, 22 bp, Homo sapiens
atttggggtttgtgtttgattg

SEQ ID NO: 1524094 - DNA, 21 bp, Homo sapiens
atttgggttatgatgtcaaac

SEQ ID NO: 1524095 - DNA, 14 bp, Homo sapiens
atttggtattaaac

SEQ ID NO: 1524096 - DNA, 20 bp, Homo sapiens
atttggtccaaaaaaaggaa

SEQ ID NO: 1524097 - DNA, 21 bp, Homo sapiens
atttggtccaaaaaaaggaaa

SEQ ID NO: 1524098 - DNA, 14 bp, Homo sapiens
atttggtctcaggc

SEQ ID NO: 1524099 - DNA, 23 bp, Homo sapiens
atttggtctcaggcagcaccaca

SEQ ID NO: 1524100 - DNA, 17 bp, Homo sapiens
atttggtgttcctggaa

SEQ ID NO: 1524101 - DNA, 18 bp, Homo sapiens
atttggttttacacagga

SEQ ID NO: 1524102 - DNA, 19 bp, Homo sapiens
atttggttttacacaggaa

SEQ ID NO: 1524103 - DNA, 23 bp, Homo sapiens
atttgtaaaagaacagtaaacat

SEQ ID NO: 1524104 - DNA, 16 bp, Homo sapiens
atttgtaaatctgcca

SEQ ID NO: 1524105 - DNA, 18 bp, Homo sapiens
atttgtaaatttatgtga

SEQ ID NO: 1524106 - DNA, 15 bp, Homo sapiens
atttgtaagtgtaaa

SEQ ID NO: 1524107 - DNA, 18 bp, Homo sapiens
atttgtaataaagtatat

SEQ ID NO: 1524108 - DNA, 13 bp, Homo sapiens
atttgtaattaaa

SEQ ID NO: 1524109 - DNA, 19 bp, Homo sapiens
atttgtaattgcttacatt

SEQ ID NO: 1524110 - DNA, 23 bp, Homo sapiens
atttgtaattgcttacattttta

SEQ ID NO: 1524111 - DNA, 17 bp, Homo sapiens
atttgtacaaataaacc

SEQ ID NO: 1524112 - DNA, 18 bp, Homo sapiens
atttgtacaaataaacct

SEQ ID NO: 1524113 - DNA, 22 bp, Homo sapiens
atttgtacaaataaacctgagg

SEQ ID NO: 1524114 - DNA, 12 bp, Homo sapiens
atttgtacaagg

SEQ ID NO: 1524115 - DNA, 18 bp, Homo sapiens
atttgtacaatggtttat

SEQ ID NO: 1524116 - DNA, 13 bp, Homo sapiens
atttgtacaattt

SEQ ID NO: 1524117 - DNA, 18 bp, Homo sapiens
atttgtacaattttaaag

SEQ ID NO: 1524118 - DNA, 19 bp, Homo sapiens
atttgtacatatgtaaaat

SEQ ID NO: 1524119 - DNA, 17 bp, Homo sapiens
atttgtactatttaact

SEQ ID NO: 1524120 - DNA, 19 bp, Homo sapiens
atttgtactatttaactga

SEQ ID NO: 1524121 - DNA, 20 bp, Homo sapiens
atttgtactatttaactgac

SEQ ID NO: 1524122 - DNA, 11 bp, Homo sapiens
atttgtacttc

SEQ ID NO: 1524123 - DNA, 16 bp, Homo sapiens
atttgtacttcttatt

SEQ ID NO: 1524124 - DNA, 19 bp, Homo sapiens
atttgtacttcttattgca

SEQ ID NO: 1524125 - DNA, 22 bp, Homo sapiens
atttgtactttctgttaaaatg

SEQ ID NO: 1524126 - DNA, 24 bp, Homo sapiens
atttgtactttctgttaaaatgca

SEQ ID NO: 1524127 - DNA, 16 bp, Homo sapiens
atttgtagctttgccc

SEQ ID NO: 1524128 - DNA, 16 bp, Homo sapiens
atttgtatagttgctt

SEQ ID NO: 1524129 - DNA, 14 bp, Homo sapiens
atttgtatatcatg

SEQ ID NO: 1524130 - DNA, 16 bp, Homo sapiens
atttgtatatcatgaa

SEQ ID NO: 1524131 - DNA, 18 bp, Homo sapiens
attgtgaccaatacattt

SEQ ID NO: 1524132 - DNA, 23 bp, Homo sapiens
attgtgaccaatacatttgtatt

SEQ ID NO: 1524133 - DNA, 23 bp, Homo sapiens
attgtgaccactgaattcactcc

SEQ ID NO: 1524134 - DNA, 20 bp, Homo sapiens
attgtgactgtgtttgcatt

SEQ ID NO: 1524135 - DNA, 14 bp, Homo sapiens
attgtgacttcact

SEQ ID NO: 1524136 - DNA, 16 bp, Homo sapiens
attgtgacttcactgt

SEQ ID NO: 1524137 - DNA, 18 bp, Homo sapiens
attgtgacttcactgtat

SEQ ID NO: 1524138 - DNA, 19 bp, Homo sapiens
attgtgacttcactgtata

SEQ ID NO: 1524139 - DNA, 20 bp, Homo sapiens
attgtgacttcactgtatat

SEQ ID NO: 1524140 - DNA, 23 bp, Homo sapiens
attgtgatcagaccataatgtta

SEQ ID NO: 1524141 - DNA, 15 bp, Homo sapiens
attgtgattggcctg

SEQ ID NO: 1524142 - DNA, 16 bp, Homo sapiens
attgtgattggcctgt

SEQ ID NO: 1524143 - DNA, 19 bp, Homo sapiens
attgtgcccacccagggaa

SEQ ID NO: 1524144 - DNA, 15 bp, Homo sapiens
attgtgctgccattt

SEQ ID NO: 1524145 - DNA, 20 bp, Homo sapiens
attgtgcttcacagtagagc

SEQ ID NO: 1524146 - DNA, 15 bp, Homo sapiens
attgtgctttcacca

SEQ ID NO: 1524147 - DNA, 21 bp, Homo sapiens
attgtgctttcaccagaattt

SEQ ID NO: 1524148 - DNA, 20 bp, Homo sapiens
attgtggaaaaccaggaaaa

SEQ ID NO: 1524149 - DNA, 16 bp, Homo sapiens
attgtggatgtgttca

SEQ ID NO: 1524150 - DNA, 17 bp, Homo sapiens
attgtggatgtgttcat

SEQ ID NO: 1524151 - DNA, 16 bp, Homo sapiens
attgtggattataaaa

SEQ ID NO: 1524152 - DNA, 18 bp, Homo sapiens
attgtggattataaaaaa

SEQ ID NO: 1524153 - DNA, 20 bp, Homo sapiens
attgtggctcctatctgtgt

SEQ ID NO: 1524154 - DNA, 13 bp, Homo sapiens
attgtggctttat

SEQ ID NO: 1524155 - DNA, 23 bp, Homo sapiens
attgtgtaacaattttaatgcta

SEQ ID NO: 1524156 - DNA, 23 bp, Homo sapiens
attgtgtagccccttttctttgg

SEQ ID NO: 1524157 - DNA, 16 bp, Homo sapiens
attgtgtagccttttt

SEQ ID NO: 1524158 - DNA, 12 bp, Homo sapiens
attgtgtgaatt

SEQ ID NO: 1524159 - DNA, 16 bp, Homo sapiens
attgtgtgcgctgcct

SEQ ID NO: 1524160 - DNA, 21 bp, Homo sapiens
attgtgtgcgctgcctggcca

SEQ ID NO: 1524161 - DNA, 19 bp, Homo sapiens
attgtgtggattctttaaa

SEQ ID NO: 1524162 - DNA, 19 bp, Homo sapiens
attgtgtgtgcaagaaaac

SEQ ID NO: 1524163 - DNA, 19 bp, Homo sapiens
attgtgttgatttctttcc

SEQ ID NO: 1524164 - DNA, 17 bp, Homo sapiens
attgtgttgtgaatgtt

SEQ ID NO: 1524165 - DNA, 14 bp, Homo sapiens
attgtgtttgctaa

SEQ ID NO: 1524166 - DNA, 17 bp, Homo sapiens
attgtgtttgttcataa

SEQ ID NO: 1524167 - DNA, 18 bp, Homo sapiens
attgtgtttgttcataat

SEQ ID NO: 1524168 - DNA, 13 bp, Homo sapiens
attgttaaaataa

SEQ ID NO: 1524169 - DNA, 20 bp, Homo sapiens
attgttaaacaaatgatttc

SEQ ID NO: 1524170 - DNA, 22 bp, Homo sapiens
attgttaagtctaaatatttcc

SEQ ID NO: 1524171 - DNA, 23 bp, Homo sapiens
attgttaatacaaggtataataa

SEQ ID NO: 1524172 - DNA, 12 bp, Homo sapiens
attgttacaagt

SEQ ID NO: 1524173 - DNA, 14 bp, Homo sapiens
attgttacaagtgt

SEQ ID NO: 1524174 - DNA, 19 bp, Homo sapiens
attgttacaagtgttctta

SEQ ID NO: 1524175 - DNA, 16 bp, Homo sapiens
attgttacaatagaat

SEQ ID NO: 1524176 - DNA, 18 bp, Homo sapiens
attgttagggtcagccat

SEQ ID NO: 1524177 - DNA, 14 bp, Homo sapiens
attgttatttaata

SEQ ID NO: 1524178 - DNA, 12 bp, Homo sapiens
attgttcatttt

SEQ ID NO: 1524179 - DNA, 14 bp, Homo sapiens
attgttcccttcct

SEQ ID NO: 1524180 - DNA, 23 bp, Homo sapiens
attgttcccttcctcttcctgcc

SEQ ID NO: 1524181 - DNA, 20 bp, Homo sapiens
attgttcgatgcctgcatgc

SEQ ID NO: 1524182 - DNA, 14 bp, Homo sapiens
attgttctcagaat

SEQ ID NO: 1524183 - DNA, 19 bp, Homo sapiens
attgttgaaaaagtttgtt

SEQ ID NO: 1524184 - DNA, 20 bp, Homo sapiens
attgttgaaaaagtttgttt

SEQ ID NO: 1524185 - DNA, 20 bp, Homo sapiens
attgttgacaactgtgactg

SEQ ID NO: 1524186 - DNA, 13 bp, Homo sapiens
attgttgggaaag

SEQ ID NO: 1524187 - DNA, 15 bp, Homo sapiens
attgttgggaaagga

SEQ ID NO: 1524188 - DNA, 21 bp, Homo sapiens
attgttggtgaattttcaagg

SEQ ID NO: 1524189 - DNA, 22 bp, Homo sapiens
attgttgtccggtttactttaa

SEQ ID NO: 1524190 - DNA, 15 bp, Homo sapiens
attgttgtgggcttt

SEQ ID NO: 1524191 - DNA, 19 bp, Homo sapiens
attgttgtttgccatactt

SEQ ID NO: 1524192 - DNA, 15 bp, Homo sapiens
attgtttaaaatcat

SEQ ID NO: 1524193 - DNA, 19 bp, Homo sapiens
attgtttaaaatcatttct

SEQ ID NO: 1524194 - DNA, 16 bp, Homo sapiens
attgtttaaaatgtaa

SEQ ID NO: 1524195 - DNA, 17 bp, Homo sapiens
attgtttaaaatgtaat

SEQ ID NO: 1524196 - DNA, 15 bp, Homo sapiens
attgtttaatctttt

SEQ ID NO: 1524197 - DNA, 13 bp, Homo sapiens
attgtttatgtaa

SEQ ID NO: 1524198 - DNA, 23 bp, Homo sapiens
attgtttatgtgttatgaacatc

SEQ ID NO: 1524199 - DNA, 17 bp, Homo sapiens
attgtttatttatcagt

SEQ ID NO: 1524200 - DNA, 22 bp, Homo sapiens
attgtttcattgcgaatctttt

SEQ ID NO: 1524201 - DNA, 19 bp, Homo sapiens
attgtttccaacttgtctg

SEQ ID NO: 1524202 - DNA, 19 bp, Homo sapiens
attgtttctttaagaaagt

SEQ ID NO: 1524203 - DNA, 17 bp, Homo sapiens
atttatcaatcagtata

SEQ ID NO: 1524204 - DNA, 16 bp, Homo sapiens
atttatcacacttctg

SEQ ID NO: 1524205 - DNA, 14 bp, Homo sapiens
atttatcagtgaca

SEQ ID NO: 1524206 - DNA, 15 bp, Homo sapiens
atttatcagtgacag

SEQ ID NO: 1524207 - DNA, 18 bp, Homo sapiens
atttatcagtgacagagt

SEQ ID NO: 1524208 - DNA, 16 bp, Homo sapiens
atttatcctagtattc

SEQ ID NO: 1524209 - DNA, 21 bp, Homo sapiens
atttatcctgaaatttcagat

SEQ ID NO: 1524210 - DNA, 10 bp, Homo sapiens
atttatctat

SEQ ID NO: 1524211 - DNA, 11 bp, Homo sapiens
atttatctata

SEQ ID NO: 1524212 - DNA, 15 bp, Homo sapiens
atttatctataattt

SEQ ID NO: 1524213 - DNA, 12 bp, Homo sapiens
atttatcttgaa

SEQ ID NO: 1524214 - DNA, 19 bp, Homo sapiens
atttatcttgaaggaaaaa

SEQ ID NO: 1524215 - DNA, 20 bp, Homo sapiens
atttatcttgaaggaaaaat

SEQ ID NO: 1524216 - DNA, 15 bp, Homo sapiens
atttatctttaccaa

SEQ ID NO: 1524217 - DNA, 20 bp, Homo sapiens
atttatgaacagaaatattg

SEQ ID NO: 1524218 - DNA, 15 bp, Homo sapiens
atttatgagtttttg

SEQ ID NO: 1524219 - DNA, 13 bp, Homo sapiens
atttatgcatttc

SEQ ID NO: 1524220 - DNA, 14 bp, Homo sapiens
atttatgcatttca

SEQ ID NO: 1524221 - DNA, 15 bp, Homo sapiens
atttatgggcccctg

SEQ ID NO: 1524222 - DNA, 19 bp, Homo sapiens
atttatgggcccctggcac

SEQ ID NO: 1524223 - DNA, 16 bp, Homo sapiens
atttatgggtggattt

SEQ ID NO: 1524224 - DNA, 18 bp, Homo sapiens
atttatggtcaacactta

SEQ ID NO: 1524225 - DNA, 16 bp, Homo sapiens
atttatgtgtatatgg

SEQ ID NO: 1524226 - DNA, 13 bp, Homo sapiens
atttatgtgtgag

SEQ ID NO: 1524227 - DNA, 18 bp, Homo sapiens
atttatgtgtgaggagct

SEQ ID NO: 1524228 - DNA, 19 bp, Homo sapiens
atttatgtgtgaggagctg

SEQ ID NO: 1524229 - DNA, 13 bp, Homo sapiens
atttatgtttgca

SEQ ID NO: 1524230 - DNA, 22 bp, Homo sapiens
atttattaactgctcagtgttt

SEQ ID NO: 1524231 - DNA, 16 bp, Homo sapiens
atttattaagtctggg

SEQ ID NO: 1524232 - DNA, 15 bp, Homo sapiens
atttattaatattta

SEQ ID NO: 1524233 - DNA, 23 bp, Homo sapiens
atttattaatatttaacattatt

SEQ ID NO: 1524234 - DNA, 14 bp, Homo sapiens
atttattacctctg

SEQ ID NO: 1524235 - DNA, 15 bp, Homo sapiens
atttattacctctga

SEQ ID NO: 1524236 - DNA, 16 bp, Homo sapiens
atttattagccaactg

SEQ ID NO: 1524237 - DNA, 21 bp, Homo sapiens
atttattagtttaaaatgcag

SEQ ID NO: 1524238 - DNA, 11 bp, Homo sapiens
atttattattt

SEQ ID NO: 1524239 - DNA, 18 bp, Homo sapiens
atttattcaattcctctg

SEQ ID NO: 1524240 - DNA, 16 bp, Homo sapiens
atttattcactgtaag

SEQ ID NO: 1524241 - DNA, 18 bp, Homo sapiens
atttattcataatgaatt

SEQ ID NO: 1524242 - DNA, 14 bp, Homo sapiens
atttattgaaattt

SEQ ID NO: 1524243 - DNA, 22 bp, Homo sapiens
atttattgagtacctactgtgt

SEQ ID NO: 1524244 - DNA, 14 bp, Homo sapiens
atttattgagtttt

SEQ ID NO: 1524245 - DNA, 12 bp, Homo sapiens
atttattgatta

SEQ ID NO: 1524246 - DNA, 23 bp, Homo sapiens
atttattgattccttttttcaaa

SEQ ID NO: 1524247 - DNA, 14 bp, Homo sapiens
atttattgccatat

SEQ ID NO: 1524248 - DNA, 22 bp, Homo sapiens
atttattgctgtgtaacactgt

SEQ ID NO: 1524249 - DNA, 14 bp, Homo sapiens
atttattgtctgtc

SEQ ID NO: 1524250 - DNA, 19 bp, Homo sapiens
atttattgtctgtctacat

SEQ ID NO: 1524251 - DNA, 14 bp, Homo sapiens
atttattgttagaa

SEQ ID NO: 1524252 - DNA, 18 bp, Homo sapiens
atttattgttagaaaatg

SEQ ID NO: 1524253 - DNA, 19 bp, Homo sapiens
atttattgtttatttatca

SEQ ID NO: 1524254 - DNA, 20 bp, Homo sapiens
atttattgtttatttatcag

SEQ ID NO: 1524255 - DNA, 22 bp, Homo sapiens
atttattgtttatttatcagtg

SEQ ID NO: 1524256 - DNA, 20 bp, Homo sapiens
atttatttaaaatttcgttg

SEQ ID NO: 1524257 - DNA, 18 bp, Homo sapiens
atttatttaatatttaat

SEQ ID NO: 1524258 - DNA, 13 bp, Homo sapiens
atttatttaattt

SEQ ID NO: 1524259 - DNA, 15 bp, Homo sapiens
atttatttaattttc

SEQ ID NO: 1524260 - DNA, 15 bp, Homo sapiens
atttatttacactct

SEQ ID NO: 1524261 - DNA, 16 bp, Homo sapiens
atttatttacactctt

SEQ ID NO: 1524262 - DNA, 13 bp, Homo sapiens
atttatttacaga

SEQ ID NO: 1524263 - DNA, 15 bp, Homo sapiens
atttatttatgaaaa

SEQ ID NO: 1524264 - DNA, 16 bp, Homo sapiens
atttatttatgtactt

SEQ ID NO: 1524265 - DNA, 13 bp, Homo sapiens
atttatttattat

SEQ ID NO: 1524266 - DNA, 13 bp, Homo sapiens
atttatttccaga

SEQ ID NO: 1524267 - DNA, 13 bp, Homo sapiens
atttatttcttaa

SEQ ID NO: 1524268 - DNA, 22 bp, Homo sapiens
atttatttggagtggaggcatt

SEQ ID NO: 1524269 - DNA, 18 bp, Homo sapiens
atttctaatgttggacac

SEQ ID NO: 1524270 - DNA, 13 bp, Homo sapiens
atttctaattgca

SEQ ID NO: 1524271 - DNA, 14 bp, Homo sapiens
atttctagactcaa

SEQ ID NO: 1524272 - DNA, 14 bp, Homo sapiens
atttctagcagagt

SEQ ID NO: 1524273 - DNA, 17 bp, Homo sapiens
atttctagtaggcagca

SEQ ID NO: 1524274 - DNA, 21 bp, Homo sapiens
atttctagtccaaaattacaa

SEQ ID NO: 1524275 - DNA, 12 bp, Homo sapiens
atttctatactt

SEQ ID NO: 1524276 - DNA, 16 bp, Homo sapiens
atttctatactttaca

SEQ ID NO: 1524277 - DNA, 18 bp, Homo sapiens
atttctatactttacagg

SEQ ID NO: 1524278 - DNA, 22 bp, Homo sapiens
atttctatcagccttgctaaag

SEQ ID NO: 1524279 - DNA, 15 bp, Homo sapiens
atttctatctgcaaa

SEQ ID NO: 1524280 - DNA, 16 bp, Homo sapiens
atttctatgacaaatt

SEQ ID NO: 1524281 - DNA, 14 bp, Homo sapiens
atttctatgagaaa

SEQ ID NO: 1524282 - DNA, 17 bp, Homo sapiens
atttctatgagaaaaga

SEQ ID NO: 1524283 - DNA, 15 bp, Homo sapiens
atttctatgtcattt

SEQ ID NO: 1524284 - DNA, 21 bp, Homo sapiens
atttctatgtcatttttaatg

SEQ ID NO: 1524285 - DNA, 14 bp, Homo sapiens
atttctattattaa

SEQ ID NO: 1524286 - DNA, 13 bp, Homo sapiens
atttctatttatt

SEQ ID NO: 1524287 - DNA, 17 bp, Homo sapiens
atttctatttatttact

SEQ ID NO: 1524288 - DNA, 20 bp, Homo sapiens
atttctcaaagatctgaatt

SEQ ID NO: 1524289 - DNA, 16 bp, Homo sapiens
atttctcaatcagtgc

SEQ ID NO: 1524290 - DNA, 22 bp, Homo sapiens
atttctcactatatatatttct

SEQ ID NO: 1524291 - DNA, 19 bp, Homo sapiens
atttctcataattttgcaa

SEQ ID NO: 1524292 - DNA, 15 bp, Homo sapiens
atttctccatacgca

SEQ ID NO: 1524293 - DNA, 21 bp, Homo sapiens
atttctcctttgataaaataa

SEQ ID NO: 1524294 - DNA, 13 bp, Homo sapiens
atttctctgagca

SEQ ID NO: 1524295 - DNA, 14 bp, Homo sapiens
atttctcttcctaa

SEQ ID NO: 1524296 - DNA, 13 bp, Homo sapiens
atttctcttgtcc

SEQ ID NO: 1524297 - DNA, 17 bp, Homo sapiens
atttctgaactgttaca

SEQ ID NO: 1524298 - DNA, 21 bp, Homo sapiens
atttctgataaagttccttaa

SEQ ID NO: 1524299 - DNA, 20 bp, Homo sapiens
atttctgctaaatatcacct

SEQ ID NO: 1524300 - DNA, 21 bp, Homo sapiens
atttctgctaaatatcaccta

SEQ ID NO: 1524301 - DNA, 21 bp, Homo sapiens
atttctgctctggaataaagt

SEQ ID NO: 1524302 - DNA, 18 bp, Homo sapiens
atttctggaagattctta

SEQ ID NO: 1524303 - DNA, 19 bp, Homo sapiens
atttctggctgggtcacca

SEQ ID NO: 1524304 - DNA, 16 bp, Homo sapiens
atttctgggtcttttg

SEQ ID NO: 1524305 - DNA, 20 bp, Homo sapiens
atttctgggtcttttgctac

SEQ ID NO: 1524306 - DNA, 16 bp, Homo sapiens
atttctggtgtatatt

SEQ ID NO: 1524307 - DNA, 15 bp, Homo sapiens
atttctggttgattt

SEQ ID NO: 1524308 - DNA, 13 bp, Homo sapiens
atttctgtgtcca

SEQ ID NO: 1524309 - DNA, 11 bp, Homo sapiens
atttctgtgtt

SEQ ID NO: 1524310 - DNA, 12 bp, Homo sapiens
atttctgttctc

SEQ ID NO: 1524311 - DNA, 14 bp, Homo sapiens
atttcttaatgtaa

SEQ ID NO: 1524312 - DNA, 14 bp, Homo sapiens
atttcttactagta

SEQ ID NO: 1524313 - DNA, 20 bp, Homo sapiens
atttcttactagtactattt

SEQ ID NO: 1524314 - DNA, 22 bp, Homo sapiens
atttcttatacgcttttctttg

SEQ ID NO: 1524315 - DNA, 21 bp, Homo sapiens
atttcttatatatgtgaacat

SEQ ID NO: 1524316 - DNA, 13 bp, Homo sapiens
atttcttatgtga

SEQ ID NO: 1524317 - DNA, 16 bp, Homo sapiens
atttcttatgtgacat

SEQ ID NO: 1524318 - DNA, 12 bp, Homo sapiens
atttcttccctg

SEQ ID NO: 1524319 - DNA, 22 bp, Homo sapiens
atttcttccctgctttgcatct

SEQ ID NO: 1524320 - DNA, 16 bp, Homo sapiens
atttcttcgctgctct

SEQ ID NO: 1524321 - DNA, 17 bp, Homo sapiens
atttcttcgctgctcta

SEQ ID NO: 1524322 - DNA, 21 bp, Homo sapiens
atttcttcgctgctctagctg

SEQ ID NO: 1524323 - DNA, 22 bp, Homo sapiens
atttcttcgctgctctagctgg

SEQ ID NO: 1524324 - DNA, 23 bp, Homo sapiens
atttcttcgctgctctagctggc

SEQ ID NO: 1524325 - DNA, 15 bp, Homo sapiens
caaagctgcccactg

SEQ ID NO: 1524326 - DNA, 21 bp, Homo sapiens
caaagctgcctgtccctaccc

SEQ ID NO: 1524327 - DNA, 18 bp, Homo sapiens
caaagcttattttgtaag

SEQ ID NO: 1524328 - DNA, 21 bp, Homo sapiens
caaagcttctatcccaggagg

SEQ ID NO: 1524329 - DNA, 14 bp, Homo sapiens
caaagcttgaagat

SEQ ID NO: 1524330 - DNA, 21 bp, Homo sapiens
caaagctttactactgtggaa

SEQ ID NO: 1524331 - DNA, 13 bp, Homo sapiens
caaagctttcctg

SEQ ID NO: 1524332 - DNA, 14 bp, Homo sapiens
caaagctttcctgc

SEQ ID NO: 1524333 - DNA, 21 bp, Homo sapiens
caaagctttgctacaaattta

SEQ ID NO: 1524334 - DNA, 23 bp, Homo sapiens
caaagctttgctacaaatttatg

SEQ ID NO: 1524335 - DNA, 15 bp, Homo sapiens
caaagctttggctga

SEQ ID NO: 1524336 - DNA, 19 bp, Homo sapiens
caaagcttttgcctgcaag

SEQ ID NO: 1524337 - DNA, 21 bp, Homo sapiens
caaagcttttgcctgcaagag

SEQ ID NO: 1524338 - DNA, 18 bp, Homo sapiens
caaaggaaactttgcaga

SEQ ID NO: 1524339 - DNA, 19 bp, Homo sapiens
caaaggaacattgtgtcta

SEQ ID NO: 1524340 - DNA, 19 bp, Homo sapiens
caaaggaactttctggtcc

SEQ ID NO: 1524341 - DNA, 21 bp, Homo sapiens
caaaggaactttctggtccct

SEQ ID NO: 1524342 - DNA, 17 bp, Homo sapiens
caaaggaaggtggatgg

SEQ ID NO: 1524343 - DNA, 20 bp, Homo sapiens
caaaggaataacctttctgg

SEQ ID NO: 1524344 - DNA, 22 bp, Homo sapiens
caaaggaatctccagttttcag

SEQ ID NO: 1524345 - DNA, 19 bp, Homo sapiens
caaaggagctcgaaggata

SEQ ID NO: 1524346 - DNA, 16 bp, Homo sapiens
caaaggaggaatttac

SEQ ID NO: 1524347 - DNA, 22 bp, Homo sapiens
caaaggatagtgcgatgtttca

SEQ ID NO: 1524348 - DNA, 12 bp, Homo sapiens
caaaggatgaag

SEQ ID NO: 1524349 - DNA, 21 bp, Homo sapiens
caaaggatgaagaacacagca

SEQ ID NO: 1524350 - DNA, 21 bp, Homo sapiens
caaaggcagctaagatagaaa

SEQ ID NO: 1524351 - DNA, 17 bp, Homo sapiens
caaaggcatccaggcca

SEQ ID NO: 1524352 - DNA, 23 bp, Homo sapiens
caaaccacttctccatgctgcaa

SEQ ID NO: 1524353 - DNA, 12 bp, Homo sapiens
caaaccagcctt

SEQ ID NO: 1524354 - DNA, 17 bp, Homo sapiens
caaaccagccttcggag

SEQ ID NO: 1524355 - DNA, 17 bp, Homo sapiens
caaaccatgagaatttg

SEQ ID NO: 1524356 - DNA, 13 bp, Homo sapiens
caaacccatgagg

SEQ ID NO: 1524357 - DNA, 21 bp, Homo sapiens
caaaccctcccagaaacatct

SEQ ID NO: 1524358 - DNA, 23 bp, Homo sapiens
caaaccctcccagaaacatctct

SEQ ID NO: 1524359 - DNA, 14 bp, Homo sapiens
caaaccctcctggg

SEQ ID NO: 1524360 - DNA, 17 bp, Homo sapiens
caaaccgccagcgaact

SEQ ID NO: 1524361 - DNA, 21 bp, Homo sapiens
caaaccgccagcgaacttgac

SEQ ID NO: 1524362 - DNA, 22 bp, Homo sapiens
caaacctaagtccttccacctg

SEQ ID NO: 1524363 - DNA, 17 bp, Homo sapiens
caaacctaccaaaatgg

SEQ ID NO: 1524364 - DNA, 16 bp, Homo sapiens
caaacctcactgagag

SEQ ID NO: 1524365 - DNA, 16 bp, Homo sapiens
caaacctccagcctcc

SEQ ID NO: 1524366 - DNA, 19 bp, Homo sapiens
caaacctccagcctccctg

SEQ ID NO: 1524367 - DNA, 15 bp, Homo sapiens
caaacctcctcttct

SEQ ID NO: 1524368 - DNA, 19 bp, Homo sapiens
caaacctgacccctgctca

SEQ ID NO: 1524369 - DNA, 19 bp, Homo sapiens
caaacctgtttaaatattt

SEQ ID NO: 1524370 - DNA, 15 bp, Homo sapiens
caaacctttgagtag

SEQ ID NO: 1524371 - DNA, 15 bp, Homo sapiens
caaacgaataaagat

SEQ ID NO: 1524372 - DNA, 14 bp, Homo sapiens
caaacgcctcccct

SEQ ID NO: 1524373 - DNA, 15 bp, Homo sapiens
caaacggagcccctg

SEQ ID NO: 1524374 - DNA, 16 bp, Homo sapiens
caaacggagcccctga

SEQ ID NO: 1524375 - DNA, 14 bp, Homo sapiens
caaacggaggaagc

SEQ ID NO: 1524376 - DNA, 17 bp, Homo sapiens
caaacggaggaagccca

SEQ ID NO: 1524377 - DNA, 13 bp, Homo sapiens
caaacgtttctca

SEQ ID NO: 1524378 - DNA, 18 bp, Homo sapiens
caaactacagaataatgt

SEQ ID NO: 1524379 - DNA, 16 bp, Homo sapiens
caaactacatgtaatc

SEQ ID NO: 1524380 - DNA, 13 bp, Homo sapiens
caaactacctctg

SEQ ID NO: 1524381 - DNA, 16 bp, Homo sapiens
caaactactgaatgaa

SEQ ID NO: 1524382 - DNA, 21 bp, Homo sapiens
caaactcagttccaaagtcac

SEQ ID NO: 1524383 - DNA, 13 bp, Homo sapiens
caaactcttcagt

SEQ ID NO: 1524384 - DNA, 22 bp, Homo sapiens
caaactcttcagttaattctta

SEQ ID NO: 1524385 - DNA, 17 bp, Homo sapiens
caaactcttttttaaaa

SEQ ID NO: 1524386 - DNA, 16 bp, Homo sapiens
caaactgaaaagctga

SEQ ID NO: 1524387 - DNA, 19 bp, Homo sapiens
caaactgaaattcagagca

SEQ ID NO: 1524388 - DNA, 17 bp, Homo sapiens
caaactgaagcagcctc

SEQ ID NO: 1524389 - DNA, 23 bp, Homo sapiens
caaactgatggaccgggtgggcc

SEQ ID NO: 1524390 - DNA, 22 bp, Homo sapiens
caaactgcacacacagctcctc

SEQ ID NO: 1524391 - DNA, 23 bp, Homo sapiens
caaactgcctaagccctccgcca

SEQ ID NO: 1524392 - DNA, 19 bp, Homo sapiens
caaactgccttggcttcag

SEQ ID NO: 1524393 - DNA, 13 bp, Homo sapiens
caaactgctccaa

SEQ ID NO: 1524394 - DNA, 13 bp, Homo sapiens
caaactgctgcat

SEQ ID NO: 1524395 - DNA, 12 bp, Homo sapiens
caaactggcagg

SEQ ID NO: 1524396 - DNA, 15 bp, Homo sapiens
caaactggggcctcc

SEQ ID NO: 1524397 - DNA, 16 bp, Homo sapiens
caaactggggcctcca

SEQ ID NO: 1524398 - DNA, 17 bp, Homo sapiens
caaactggggcctccct

SEQ ID NO: 1524399 - DNA, 17 bp, Homo sapiens
caaactgtagatgaaga

SEQ ID NO: 1524400 - DNA, 18 bp, Homo sapiens
caaactgtgaaaatagtg

SEQ ID NO: 1524401 - DNA, 15 bp, Homo sapiens
caaacttaaacaaaa

SEQ ID NO: 1524402 - DNA, 17 bp, Homo sapiens
caaacttaaacaaaaaa

SEQ ID NO: 1524403 - DNA, 15 bp, Homo sapiens
caaacttactatttt

SEQ ID NO: 1524404 - DNA, 13 bp, Homo sapiens
caaagaaacaagc

SEQ ID NO: 1524405 - DNA, 16 bp, Homo sapiens
caaagaaagtgtattg

SEQ ID NO: 1524406 - DNA, 18 bp, Homo sapiens
caaagaacttgctgctgc

SEQ ID NO: 1524407 - DNA, 17 bp, Homo sapiens
caaagaaggaattctag

SEQ ID NO: 1524408 - DNA, 21 bp, Homo sapiens
caaagaaggcatttgcagggt

SEQ ID NO: 1524409 - DNA, 14 bp, Homo sapiens
caaagaagtcggaa

SEQ ID NO: 1524410 - DNA, 13 bp, Homo sapiens
caaagaatagact

SEQ ID NO: 1524411 - DNA, 22 bp, Homo sapiens
caaagacaaagtgtgtaattat

SEQ ID NO: 1524412 - DNA, 20 bp, Homo sapiens
caaagacaaattctgtttct

SEQ ID NO: 1524413 - DNA, 17 bp, Homo sapiens
caaagactatttcaaaa

SEQ ID NO: 1524414 - DNA, 16 bp, Homo sapiens
caaagactctggaggt

SEQ ID NO: 1524415 - DNA, 13 bp, Homo sapiens
caaagactgcaga

SEQ ID NO: 1524416 - DNA, 21 bp, Homo sapiens
caaagactgtgaacagcttgc

SEQ ID NO: 1524417 - DNA, 22 bp, Homo sapiens
caaagactgtgaacagcttgct

SEQ ID NO: 1524418 - DNA, 16 bp, Homo sapiens
caaagacttagtatat

SEQ ID NO: 1524419 - DNA, 19 bp, Homo sapiens
caaagacttagtatatttt

SEQ ID NO: 1524420 - DNA, 20 bp, Homo sapiens
caaagacttagtatattttc

SEQ ID NO: 1524421 - DNA, 20 bp, Homo sapiens
caaagagaaaaagaaatgca

SEQ ID NO: 1524422 - DNA, 20 bp, Homo sapiens
caaagagaaatcacaggggc

SEQ ID NO: 1524423 - DNA, 20 bp, Homo sapiens
caaagagaatcccacattag

SEQ ID NO: 1524424 - DNA, 16 bp, Homo sapiens
caaagagagaaaataa

SEQ ID NO: 1524425 - DNA, 19 bp, Homo sapiens
caaagagattcgaatgacg

SEQ ID NO: 1524426 - DNA, 16 bp, Homo sapiens
caaagagcctttccaa

SEQ ID NO: 1524427 - DNA, 23 bp, Homo sapiens
caaagaggctgcccctctcacca

SEQ ID NO: 1524428 - DNA, 16 bp, Homo sapiens
caaagagggcttcctc

SEQ ID NO: 1524429 - DNA, 18 bp, Homo sapiens
caaagagggcttcctcta

SEQ ID NO: 1524430 - DNA, 22 bp, Homo sapiens
caaagagggcttcctctagaag

SEQ ID NO: 1524431 - DNA, 16 bp, Homo sapiens
caaagagttaatatat

SEQ ID NO: 1524432 - DNA, 13 bp, Homo sapiens
caaagatcaaaat

SEQ ID NO: 1524433 - DNA, 14 bp, Homo sapiens
caaagatcaaaata

SEQ ID NO: 1524434 - DNA, 23 bp, Homo sapiens
caaagatctgaattaaataaata

SEQ ID NO: 1524435 - DNA, 20 bp, Homo sapiens
caaagatctgtcctcagcct

SEQ ID NO: 1524436 - DNA, 21 bp, Homo sapiens
caaagatctgtcctcagcctt

SEQ ID NO: 1524437 - DNA, 17 bp, Homo sapiens
caaagatgcattttgag

SEQ ID NO: 1524438 - DNA, 11 bp, Homo sapiens
caaagatgctg

SEQ ID NO: 1524439 - DNA, 16 bp, Homo sapiens
caaagatgtttgtcag

SEQ ID NO: 1524440 - DNA, 21 bp, Homo sapiens
caaagattaaatgtgtcattg

SEQ ID NO: 1524441 - DNA, 21 bp, Homo sapiens
caaagattcaaaattgacatt

SEQ ID NO: 1524442 - DNA, 13 bp, Homo sapiens
caaagattcatga

SEQ ID NO: 1524443 - DNA, 16 bp, Homo sapiens
caaagatttaatctgc

SEQ ID NO: 1524444 - DNA, 13 bp, Homo sapiens
caaagcaaagaaa

SEQ ID NO: 1524445 - DNA, 15 bp, Homo sapiens
caaagcaaatttcta

SEQ ID NO: 1524446 - DNA, 17 bp, Homo sapiens
caaagcaagggctccag

SEQ ID NO: 1524447 - DNA, 19 bp, Homo sapiens
caaagcaagggctccagca

SEQ ID NO: 1524448 - DNA, 17 bp, Homo sapiens
caaagcaatcggacata

SEQ ID NO: 1524449 - DNA, 17 bp, Homo sapiens
caaagcacagctgggca

SEQ ID NO: 1524450 - DNA, 16 bp, Homo sapiens
caaagcacagtttgaa

SEQ ID NO: 1524451 - DNA, 18 bp, Homo sapiens
caaagcacattgaaagag

SEQ ID NO: 1524452 - DNA, 20 bp, Homo sapiens
caaagcacgaaatgttattt

SEQ ID NO: 1524453 - DNA, 22 bp, Homo sapiens
caaagcacttttaaaaaaattt

SEQ ID NO: 1524454 - DNA, 17 bp, Homo sapiens
caaagcatgttttgcat

SEQ ID NO: 1524455 - DNA, 17 bp, Homo sapiens
caaagccaaactctgcc

SEQ ID NO: 1524456 - DNA, 12 bp, Homo sapiens
caaagccaaggc

SEQ ID NO: 1524457 - DNA, 15 bp, Homo sapiens
caaagccactggaag

SEQ ID NO: 1524458 - DNA, 12 bp, Homo sapiens
caaagccagaac

SEQ ID NO: 1524459 - DNA, 18 bp, Homo sapiens
caaagccctgcctctgtg

SEQ ID NO: 1524460 - DNA, 22 bp, Homo sapiens
caaagcccttggaacaccctgg

SEQ ID NO: 1524461 - DNA, 21 bp, Homo sapiens
caaagcctagacaacctttct

SEQ ID NO: 1524462 - DNA, 13 bp, Homo sapiens
caaagcctcttca

SEQ ID NO: 1524463 - DNA, 20 bp, Homo sapiens
caaagcgtttctttacttct

SEQ ID NO: 1524464 - DNA, 22 bp, Homo sapiens
caaagctcaagatgacagctct

SEQ ID NO: 1524465 - DNA, 23 bp, Homo sapiens
caaagctgaagaccatggatttc

SEQ ID NO: 1524466 - DNA, 12 bp, Homo sapiens
caaagctgagcc

SEQ ID NO: 1524467 - DNA, 14 bp, Homo sapiens
caaagctgagcctg

SEQ ID NO: 1524468 - DNA, 24 bp, Homo sapiens
caaagctgagcctgcagggaagcc

SEQ ID NO: 1524469 - DNA, 18 bp, Homo sapiens
caaaacctgatgttaaaa

SEQ ID NO: 1524470 - DNA, 21 bp, Homo sapiens
caaaacctgatgttaaaattc

SEQ ID NO: 1524471 - DNA, 19 bp, Homo sapiens
caaaacctgtgccaggctg

SEQ ID NO: 1524472 - DNA, 20 bp, Homo sapiens
caaaacctgtgccaggctga

SEQ ID NO: 1524473 - DNA, 15 bp, Homo sapiens
caaaaccttccttcc

SEQ ID NO: 1524474 - DNA, 22 bp, Homo sapiens
caaaacgatgaagttatgctgt

SEQ ID NO: 1524475 - DNA, 16 bp, Homo sapiens
caaaactcctgtcttt

SEQ ID NO: 1524476 - DNA, 16 bp, Homo sapiens
caaaactctgtagctt

SEQ ID NO: 1524477 - DNA, 21 bp, Homo sapiens
caaaactgtaaataaaatgtg

SEQ ID NO: 1524478 - DNA, 19 bp, Homo sapiens
caaaacttccaaggccctg

SEQ ID NO: 1524479 - DNA, 17 bp, Homo sapiens
caaaagaaaattgatat

SEQ ID NO: 1524480 - DNA, 20 bp, Homo sapiens
caaaagaaaattgatatttt

SEQ ID NO: 1524481 - DNA, 23 bp, Homo sapiens
caaaagaaaattgatatttttat

SEQ ID NO: 1524482 - DNA, 15 bp, Homo sapiens
caaaagaatcagaaa

SEQ ID NO: 1524483 - DNA, 19 bp, Homo sapiens
caaaagaatcagaaacagg

SEQ ID NO: 1524484 - DNA, 15 bp, Homo sapiens
caaaagacaaaaatc

SEQ ID NO: 1524485 - DNA, 21 bp, Homo sapiens
caaaagacaaaaatcaaagaa

SEQ ID NO: 1524486 - DNA, 18 bp, Homo sapiens
caaaagacttgagccatc

SEQ ID NO: 1524487 - DNA, 21 bp, Homo sapiens
caaaagagaaatacataaaaa

SEQ ID NO: 1524488 - DNA, 17 bp, Homo sapiens
caaaagaggttacttta

SEQ ID NO: 1524489 - DNA, 21 bp, Homo sapiens
caaaagaggttactttagtta

SEQ ID NO: 1524490 - DNA, 22 bp, Homo sapiens
caaaagaggttactttagttag

SEQ ID NO: 1524491 - DNA, 21 bp, Homo sapiens
caaaagatgtgcaaaatcact

SEQ ID NO: 1524492 - DNA, 19 bp, Homo sapiens
caaaagattgctgaaattt

SEQ ID NO: 1524493 - DNA, 17 bp, Homo sapiens
caaaagatttattgtaa

SEQ ID NO: 1524494 - DNA, 14 bp, Homo sapiens
caaaagcaaagatg

SEQ ID NO: 1524495 - DNA, 17 bp, Homo sapiens
caaaagcaaagatgcat

SEQ ID NO: 1524496 - DNA, 14 bp, Homo sapiens
caaaagcaagactg

SEQ ID NO: 1524497 - DNA, 23 bp, Homo sapiens
caaaagcaagactgttgctcaaa

SEQ ID NO: 1524498 - DNA, 20 bp, Homo sapiens
caaaagcaagggaccttcat

SEQ ID NO: 1524499 - DNA, 18 bp, Homo sapiens
caaaagcagctaaatgta

SEQ ID NO: 1524500 - DNA, 17 bp, Homo sapiens
caaaagcttcaaattaa

SEQ ID NO: 1524501 - DNA, 11 bp, Homo sapiens
caaaaggaaag

SEQ ID NO: 1524502 - DNA, 20 bp, Homo sapiens
caaaaggaaagctgtgttta

SEQ ID NO: 1524503 - DNA, 23 bp, Homo sapiens
caaaagggtgtatagtgttcaca

SEQ ID NO: 1524504 - DNA, 13 bp, Homo sapiens
caaaaggtgcctg

SEQ ID NO: 1524505 - DNA, 16 bp, Homo sapiens
attttgtgcattcttt

SEQ ID NO: 1524506 - DNA, 17 bp, Homo sapiens
attttgtgcattctttg

SEQ ID NO: 1524507 - DNA, 22 bp, Homo sapiens
attttgtgcattctttggtaat

SEQ ID NO: 1524508 - DNA, 19 bp, Homo sapiens
attttgtgggctggttgct

SEQ ID NO: 1524509 - DNA, 20 bp, Homo sapiens
attttgtgtaaatttctcaa

SEQ ID NO: 1524510 - DNA, 13 bp, Homo sapiens
attttgtgtgaga

SEQ ID NO: 1524511 - DNA, 17 bp, Homo sapiens
attttgtgtttattctt

SEQ ID NO: 1524512 - DNA, 20 bp, Homo sapiens
attttgtgtttattcttgat

SEQ ID NO: 1524513 - DNA, 16 bp, Homo sapiens
attttgttatagaata

SEQ ID NO: 1524514 - DNA, 16 bp, Homo sapiens
attttgttctctggga

SEQ ID NO: 1524515 - DNA, 22 bp, Homo sapiens
attttgttctctgggagaaaat

SEQ ID NO: 1524516 - DNA, 12 bp, Homo sapiens
attttgttctgt

SEQ ID NO: 1524517 - DNA, 19 bp, Homo sapiens
attttgttgctgttttgat

SEQ ID NO: 1524518 - DNA, 21 bp, Homo sapiens
attttgttggcatagctctgg

SEQ ID NO: 1524519 - DNA, 17 bp, Homo sapiens
attttgtttaaaaaatc

SEQ ID NO: 1524520 - DNA, 17 bp, Homo sapiens
attttgtttctgtatat

SEQ ID NO: 1524521 - DNA, 17 bp, Homo sapiens
attttgttttgctctga

SEQ ID NO: 1524522 - DNA, 19 bp, Homo sapiens
attttgttttttaagtaag

SEQ ID NO: 1524523 - DNA, 15 bp, Homo sapiens
atttttaaaaaatat

SEQ ID NO: 1524524 - DNA, 18 bp, Homo sapiens
atttttaaaaaatatttt

SEQ ID NO: 1524525 - DNA, 23 bp, Homo sapiens
atttttaaaaaatattttctctg

SEQ ID NO: 1524526 - DNA, 16 bp, Homo sapiens
atttttaaaatattta

SEQ ID NO: 1524527 - DNA, 21 bp, Homo sapiens
atttttaaacttgaaatatat

SEQ ID NO: 1524528 - DNA, 15 bp, Homo sapiens
atttttaaaggcatt

SEQ ID NO: 1524529 - DNA, 17 bp, Homo sapiens
atttttaaagtatatat

SEQ ID NO: 1524530 - DNA, 11 bp, Homo sapiens
atttttaaatg

SEQ ID NO: 1524531 - DNA, 19 bp, Homo sapiens
atttttaaatgcagttaca

SEQ ID NO: 1524532 - DNA, 13 bp, Homo sapiens
atttttaaattct

SEQ ID NO: 1524533 - DNA, 21 bp, Homo sapiens
atttttaagcaaaatattatt

SEQ ID NO: 1524534 - DNA, 15 bp, Homo sapiens
atttttaatcatgaa

SEQ ID NO: 1524535 - DNA, 12 bp, Homo sapiens
atttttaatggg

SEQ ID NO: 1524536 - DNA, 15 bp, Homo sapiens
atttttaatgtatct

SEQ ID NO: 1524537 - DNA, 22 bp, Homo sapiens
atttttaatgtatctatttgta

SEQ ID NO: 1524538 - DNA, 14 bp, Homo sapiens
atttttacaataaa

SEQ ID NO: 1524539 - DNA, 19 bp, Homo sapiens
atttttacaataaataatc

SEQ ID NO: 1524540 - DNA, 14 bp, Homo sapiens
atttttacagcaaa

SEQ ID NO: 1524541 - DNA, 17 bp, Homo sapiens
atttttacagcaaaaga

SEQ ID NO: 1524542 - DNA, 15 bp, Homo sapiens
atttttactaatata

SEQ ID NO: 1524543 - DNA, 21 bp, Homo sapiens
atttttagaattaaaaaagca

SEQ ID NO: 1524544 - DNA, 18 bp, Homo sapiens
atttttagactatttctt

SEQ ID NO: 1524545 - DNA, 20 bp, Homo sapiens
atttttagccccaaatctct

SEQ ID NO: 1524546 - DNA, 15 bp, Homo sapiens
atttttataaattac

SEQ ID NO: 1524547 - DNA, 15 bp, Homo sapiens
atttttatacggaaa

SEQ ID NO: 1524548 - DNA, 14 bp, Homo sapiens
atttttatgcagac

SEQ ID NO: 1524549 - DNA, 13 bp, Homo sapiens
atttttatgtaaa

SEQ ID NO: 1524550 - DNA, 22 bp, Homo sapiens
atttttattaattttagttttt

SEQ ID NO: 1524551 - DNA, 14 bp, Homo sapiens
atttttatttatga

SEQ ID NO: 1524552 - DNA, 17 bp, Homo sapiens
atttttatttgtaaagt

SEQ ID NO: 1524553 - DNA, 22 bp, Homo sapiens
atttttcaacatttttttttct

SEQ ID NO: 1524554 - DNA, 22 bp, Homo sapiens
atttttcaatagcacatatgga

SEQ ID NO: 1524555 - DNA, 14 bp, Homo sapiens
atttttccatttat

SEQ ID NO: 1524556 - DNA, 16 bp, Homo sapiens
atttttccatttgtat

SEQ ID NO: 1524557 - DNA, 19 bp, Homo sapiens
atttttcctctgttcacaa

SEQ ID NO: 1524558 - DNA, 14 bp, Homo sapiens
atttttcctgcatg

SEQ ID NO: 1524559 - DNA, 17 bp, Homo sapiens
atttttctaaaaaaaga

SEQ ID NO: 1524560 - DNA, 18 bp, Homo sapiens
atttttctaaccttgaat

SEQ ID NO: 1524561 - DNA, 17 bp, Homo sapiens
atttttctataaatcag

SEQ ID NO: 1524562 - DNA, 19 bp, Homo sapiens
atttttctataaatcagta

SEQ ID NO: 1524563 - DNA, 18 bp, Homo sapiens
atttttctcccaagaaac

SEQ ID NO: 1524564 - DNA, 20 bp, Homo sapiens
atttttctcccaagaaacct

SEQ ID NO: 1524565 - DNA, 13 bp, Homo sapiens
atttttctcttca

SEQ ID NO: 1524566 - DNA, 14 bp, Homo sapiens
atttttctcttcat

SEQ ID NO: 1524567 - DNA, 15 bp, Homo sapiens
atttttctcttcatt

SEQ ID NO: 1524568 - DNA, 17 bp, Homo sapiens
atttttctcttgtacca

SEQ ID NO: 1524569 - DNA, 18 bp, Homo sapiens
atttttctcttgtaccat

SEQ ID NO: 1524570 - DNA, 19 bp, Homo sapiens
atttttctgaggtccttat

SEQ ID NO: 1524571 - DNA, 15 bp, Homo sapiens
atttttcttatttca

SEQ ID NO: 1524572 - DNA, 19 bp, Homo sapiens
atttttgaagcaaagaagg

SEQ ID NO: 1524573 - DNA, 18 bp, Homo sapiens
atttttgacatggaaatg

SEQ ID NO: 1524574 - DNA, 13 bp, Homo sapiens
atttttgaggaat

SEQ ID NO: 1524575 - DNA, 19 bp, Homo sapiens
atttttgaggaattatcat

SEQ ID NO: 1524576 - DNA, 20 bp, Homo sapiens
atttttgattaacaatgtat

SEQ ID NO: 1524577 - DNA, 11 bp, Homo sapiens
atttttgcaaa

SEQ ID NO: 1524578 - DNA, 21 bp, Homo sapiens
caagaggggtggagactgctt

SEQ ID NO: 1524579 - DNA, 15 bp, Homo sapiens
caagaggtctgagcc

SEQ ID NO: 1524580 - DNA, 18 bp, Homo sapiens
caagaggtctgagccctg

SEQ ID NO: 1524581 - DNA, 16 bp, Homo sapiens
caagaggtgggagggc

SEQ ID NO: 1524582 - DNA, 22 bp, Homo sapiens
caagagtccggatttctaacag

SEQ ID NO: 1524583 - DNA, 15 bp, Homo sapiens
caagagtctaaagat

SEQ ID NO: 1524584 - DNA, 14 bp, Homo sapiens
caagagtgttcttt

SEQ ID NO: 1524585 - DNA, 13 bp, Homo sapiens
caagagtttcttg

SEQ ID NO: 1524586 - DNA, 14 bp, Homo sapiens
caagagttttaaca

SEQ ID NO: 1524587 - DNA, 21 bp, Homo sapiens
caagatattcaggtggccaga

SEQ ID NO: 1524588 - DNA, 17 bp, Homo sapiens
caagatattgtacataa

SEQ ID NO: 1524589 - DNA, 19 bp, Homo sapiens
caagatcctgtctttaagg

SEQ ID NO: 1524590 - DNA, 16 bp, Homo sapiens
caagatcttgtctcca

SEQ ID NO: 1524591 - DNA, 19 bp, Homo sapiens
caagatgagagaactggag

SEQ ID NO: 1524592 - DNA, 23 bp, Homo sapiens
caagatgagattggcatggcttt

SEQ ID NO: 1524593 - DNA, 19 bp, Homo sapiens
caagatgcaaatgttttga

SEQ ID NO: 1524594 - DNA, 18 bp, Homo sapiens
caagatggacacgagcca

SEQ ID NO: 1524595 - DNA, 13 bp, Homo sapiens
caagatgggacag

SEQ ID NO: 1524596 - DNA, 18 bp, Homo sapiens
caagatgggcatcttttg

SEQ ID NO: 1524597 - DNA, 20 bp, Homo sapiens
caagatgggcatcttttgta

SEQ ID NO: 1524598 - DNA, 21 bp, Homo sapiens
caagatgggcatcttttgtat

SEQ ID NO: 1524599 - DNA, 19 bp, Homo sapiens
caagatgggggcagggctg

SEQ ID NO: 1524600 - DNA, 20 bp, Homo sapiens
caagatgttttgtataaaat

SEQ ID NO: 1524601 - DNA, 14 bp, Homo sapiens
caagattaaatgta

SEQ ID NO: 1524602 - DNA, 17 bp, Homo sapiens
caagattcacacctgac

SEQ ID NO: 1524603 - DNA, 18 bp, Homo sapiens
caagattcacacctgact

SEQ ID NO: 1524604 - DNA, 13 bp, Homo sapiens
caagattcccaga

SEQ ID NO: 1524605 - DNA, 18 bp, Homo sapiens
caagattctaaagctcaa

SEQ ID NO: 1524606 - DNA, 16 bp, Homo sapiens
caagattgagctctct

SEQ ID NO: 1524607 - DNA, 17 bp, Homo sapiens
caagattgagctctctg

SEQ ID NO: 1524608 - DNA, 13 bp, Homo sapiens
caagattgcttaa

SEQ ID NO: 1524609 - DNA, 16 bp, Homo sapiens
caagattgcttaaaat

SEQ ID NO: 1524610 - DNA, 13 bp, Homo sapiens
caagatttccttg

SEQ ID NO: 1524611 - DNA, 18 bp, Homo sapiens
caagattttaaagacatg

SEQ ID NO: 1524612 - DNA, 22 bp, Homo sapiens
caagattttagggcttttattt

SEQ ID NO: 1524613 - DNA, 18 bp, Homo sapiens
caagattttccacaagat

SEQ ID NO: 1524614 - DNA, 17 bp, Homo sapiens
caagattttctactttt

SEQ ID NO: 1524615 - DNA, 19 bp, Homo sapiens
caagcaaaggtgaagagac

SEQ ID NO: 1524616 - DNA, 14 bp, Homo sapiens
caagcaatcctccc

SEQ ID NO: 1524617 - DNA, 17 bp, Homo sapiens
caagcacactggaatat

SEQ ID NO: 1524618 - DNA, 22 bp, Homo sapiens
caagcacactggaatataaaac

SEQ ID NO: 1524619 - DNA, 17 bp, Homo sapiens
caagcacagtgcctgca

SEQ ID NO: 1524620 - DNA, 17 bp, Homo sapiens
caagcacatctgcattt

SEQ ID NO: 1524621 - DNA, 15 bp, Homo sapiens
caagcactattttat

SEQ ID NO: 1524622 - DNA, 18 bp, Homo sapiens
caagcactattttatatt

SEQ ID NO: 1524623 - DNA, 21 bp, Homo sapiens
caagcactcgagaccatcctg

SEQ ID NO: 1524624 - DNA, 12 bp, Homo sapiens
caagcagaaaaa

SEQ ID NO: 1524625 - DNA, 20 bp, Homo sapiens
caagcagagtgcacagctgt

SEQ ID NO: 1524626 - DNA, 15 bp, Homo sapiens
caagcagccagccag

SEQ ID NO: 1524627 - DNA, 16 bp, Homo sapiens
caagcagccagccagt

SEQ ID NO: 1524628 - DNA, 22 bp, Homo sapiens
caagcagccagccagtcttgcc

SEQ ID NO: 1524629 - DNA, 14 bp, Homo sapiens
caagcagcccttgc

SEQ ID NO: 1524630 - DNA, 15 bp, Homo sapiens
caagcagctggtcag

SEQ ID NO: 1524631 - DNA, 19 bp, Homo sapiens
caagcagggaaagctccac

SEQ ID NO: 1524632 - DNA, 23 bp, Homo sapiens
caagcagggaaagctccacggtg

SEQ ID NO: 1524633 - DNA, 16 bp, Homo sapiens
caagcagtcgtgcctg

SEQ ID NO: 1524634 - DNA, 16 bp, Homo sapiens
caagcataccaacacg

SEQ ID NO: 1524635 - DNA, 21 bp, Homo sapiens
caagcataccaacacgagcag

SEQ ID NO: 1524636 - DNA, 16 bp, Homo sapiens
caagcatcactgcccg

SEQ ID NO: 1524637 - DNA, 21 bp, Homo sapiens
caagcatcttgggggggtggc

SEQ ID NO: 1524638 - DNA, 22 bp, Homo sapiens
caagcatgatcttgttactgtg

SEQ ID NO: 1524639 - DNA, 16 bp, Homo sapiens
caagcatgtctctctg

SEQ ID NO: 1524640 - DNA, 18 bp, Homo sapiens
caagcatgtctctctgcc

SEQ ID NO: 1524641 - DNA, 20 bp, Homo sapiens
caagcatgtctctctgccaa

SEQ ID NO: 1524642 - DNA, 13 bp, Homo sapiens
caagcatttcatg

SEQ ID NO: 1524643 - DNA, 16 bp, Homo sapiens
caagcatttcatgaaa

SEQ ID NO: 1524644 - DNA, 18 bp, Homo sapiens
caagccaaaatgggagca

SEQ ID NO: 1524645 - DNA, 19 bp, Homo sapiens
caagccaaacattcttatt

SEQ ID NO: 1524646 - DNA, 19 bp, Homo sapiens
caagccaacgacaaagcca

SEQ ID NO: 1524647 - DNA, 15 bp, Homo sapiens
caagccaacttgtaa

SEQ ID NO: 1524648 - DNA, 14 bp, Homo sapiens
caagccaatcccct

SEQ ID NO: 1524649 - DNA, 20 bp, Homo sapiens
caagccacaagctgacccct

SEQ ID NO: 1524650 - DNA, 19 bp, Homo sapiens
caagccacaagtcttccag

SEQ ID NO: 1524651 - DNA, 20 bp, Homo sapiens
caagccacaagtcttccaga

SEQ ID NO: 1524652 - DNA, 13 bp, Homo sapiens
caagccaggctca

SEQ ID NO: 1524653 - DNA, 14 bp, Homo sapiens
caagcccaggcttc

SEQ ID NO: 1524654 - DNA, 15 bp, Homo sapiens
caagccccagggcct

SEQ ID NO: 1524655 - DNA, 17 bp, Homo sapiens
caagccccagggcctgg

SEQ ID NO: 1524656 - DNA, 19 bp, Homo sapiens
caagccccagggcctgggg

SEQ ID NO: 1524657 - DNA, 18 bp, Homo sapiens
caagccccatctcatcct

SEQ ID NO: 1524658 - DNA, 20 bp, Homo sapiens
caagccccatctcatcctgg

SEQ ID NO: 1524659 - DNA, 14 bp, Homo sapiens
caagcccctcagcc

SEQ ID NO: 1524660 - DNA, 18 bp, Homo sapiens
caagcccctcagcccttg

SEQ ID NO: 1524661 - DNA, 19 bp, Homo sapiens
caagcccctcagcccttgc

SEQ ID NO: 1524662 - DNA, 21 bp, Homo sapiens
caagcccgacttgctgttttg

SEQ ID NO: 1524663 - DNA, 14 bp, Homo sapiens
caagccctgagagt

SEQ ID NO: 1524664 - DNA, 15 bp, Homo sapiens
caagccctggcaaca

SEQ ID NO: 1524665 - DNA, 14 bp, Homo sapiens
caagccgcaagctc

SEQ ID NO: 1524666 - DNA, 14 bp, Homo sapiens
caagccgggagcca

SEQ ID NO: 1524667 - DNA, 17 bp, Homo sapiens
caagcctcatattttct

SEQ ID NO: 1524668 - DNA, 19 bp, Homo sapiens
caagcctcatattttctgt

SEQ ID NO: 1524669 - DNA, 13 bp, Homo sapiens
caagcctccacag

SEQ ID NO: 1524670 - DNA, 15 bp, Homo sapiens
caagcctccacagcg

SEQ ID NO: 1524671 - DNA, 19 bp, Homo sapiens
caagcctcttattccagga

SEQ ID NO: 1524672 - DNA, 16 bp, Homo sapiens
caagcctcttctgaag

SEQ ID NO: 1524673 - DNA, 23 bp, Homo sapiens
caagcctgcacaataaaaatgtt

SEQ ID NO: 1524674 - DNA, 16 bp, Homo sapiens
caagcctgctggctgc

SEQ ID NO: 1524675 - DNA, 15 bp, Homo sapiens
caagcctggaaaaaa

SEQ ID NO: 1524676 - DNA, 17 bp, Homo sapiens
caagccttggctctacc

SEQ ID NO: 1524677 - DNA, 17 bp, Homo sapiens
caagcctttatggctgc

SEQ ID NO: 1524678 - DNA, 18 bp, Homo sapiens
caagcctttatggctgct

SEQ ID NO: 1524679 - DNA, 17 bp, Homo sapiens
caagcgaggtcaacaga

SEQ ID NO: 1524680 - DNA, 23 bp, Homo sapiens
caagcgattctcccgcctcagcc

SEQ ID NO: 1524681 - DNA, 19 bp, Homo sapiens
caagcgattctcctgtctc

SEQ ID NO: 1524682 - DNA, 15 bp, Homo sapiens
caagcgcttctgctg

SEQ ID NO: 1524683 - DNA, 17 bp, Homo sapiens
caagcgcttctgctgaa

SEQ ID NO: 1524684 - DNA, 14 bp, Homo sapiens
caagcgttcctggc

SEQ ID NO: 1524685 - DNA, 15 bp, Homo sapiens
caagcgttcctggcc

SEQ ID NO: 1524686 - DNA, 16 bp, Homo sapiens
caacttccgcctcctg

SEQ ID NO: 1524687 - DNA, 17 bp, Homo sapiens
caacttccgcctcctgt

SEQ ID NO: 1524688 - DNA, 22 bp, Homo sapiens
caacttcctcccttacagagca

SEQ ID NO: 1524689 - DNA, 23 bp, Homo sapiens
caacttcgctagaaaaaaaaaac

SEQ ID NO: 1524690 - DNA, 18 bp, Homo sapiens
caacttcttcctgtgaag

SEQ ID NO: 1524691 - DNA, 18 bp, Homo sapiens
caacttgacaccactaag

SEQ ID NO: 1524692 - DNA, 9 bp, Homo sapiens
caacttgag

SEQ ID NO: 1524693 - DNA, 21 bp, Homo sapiens
caacttgatgttccacctgcc

SEQ ID NO: 1524694 - DNA, 15 bp, Homo sapiens
caacttggcatttct

SEQ ID NO: 1524695 - DNA, 19 bp, Homo sapiens
caacttggttctgcttcaa

SEQ ID NO: 1524696 - DNA, 16 bp, Homo sapiens
caacttgtaaatacac

SEQ ID NO: 1524697 - DNA, 18 bp, Homo sapiens
caacttgtagcagctata

SEQ ID NO: 1524698 - DNA, 16 bp, Homo sapiens
caacttgtatttccaa

SEQ ID NO: 1524699 - DNA, 18 bp, Homo sapiens
caactttagctagtatct

SEQ ID NO: 1524700 - DNA, 19 bp, Homo sapiens
caactttatcatggaattt

SEQ ID NO: 1524701 - DNA, 19 bp, Homo sapiens
caactttattgattgaatt

SEQ ID NO: 1524702 - DNA, 13 bp, Homo sapiens
caactttcacttc

SEQ ID NO: 1524703 - DNA, 16 bp, Homo sapiens
caactttcacttcttc

SEQ ID NO: 1524704 - DNA, 19 bp, Homo sapiens
caactttcacttcttccta

SEQ ID NO: 1524705 - DNA, 21 bp, Homo sapiens
caacttttaatgggatttcat

SEQ ID NO: 1524706 - DNA, 15 bp, Homo sapiens
caagaaaaaaaggga

SEQ ID NO: 1524707 - DNA, 15 bp, Homo sapiens
caagaaaacaacttc

SEQ ID NO: 1524708 - DNA, 18 bp, Homo sapiens
caagaaaacaacttcaat

SEQ ID NO: 1524709 - DNA, 10 bp, Homo sapiens
caagaaaagg

SEQ ID NO: 1524710 - DNA, 20 bp, Homo sapiens
caagaaacaaacaaaagctg

SEQ ID NO: 1524711 - DNA, 12 bp, Homo sapiens
caagaaacagcc

SEQ ID NO: 1524712 - DNA, 13 bp, Homo sapiens
caagaaacagcca

SEQ ID NO: 1524713 - DNA, 18 bp, Homo sapiens
caagaaacagccagcaag

SEQ ID NO: 1524714 - DNA, 19 bp, Homo sapiens
caagaaacagccagcaaga

SEQ ID NO: 1524715 - DNA, 18 bp, Homo sapiens
caagaaactgaggaattt

SEQ ID NO: 1524716 - DNA, 18 bp, Homo sapiens
caagaaagaaatggcttt

SEQ ID NO: 1524717 - DNA, 20 bp, Homo sapiens
caagaaagctcactgtagct

SEQ ID NO: 1524718 - DNA, 19 bp, Homo sapiens
caagaaagcttcttcagag

SEQ ID NO: 1524719 - DNA, 16 bp, Homo sapiens
caagaaaggcagacac

SEQ ID NO: 1524720 - DNA, 22 bp, Homo sapiens
caagaaatatactctcccagat

SEQ ID NO: 1524721 - DNA, 16 bp, Homo sapiens
caagaacccaagtgcc

SEQ ID NO: 1524722 - DNA, 17 bp, Homo sapiens
caagaacccaagtgcct

SEQ ID NO: 1524723 - DNA, 15 bp, Homo sapiens
caagaacctggaaaa

SEQ ID NO: 1524724 - DNA, 18 bp, Homo sapiens
caagaactctaaccagtg

SEQ ID NO: 1524725 - DNA, 20 bp, Homo sapiens
caagaactctaaccagtgta

SEQ ID NO: 1524726 - DNA, 14 bp, Homo sapiens
caagaactctgggc

SEQ ID NO: 1524727 - DNA, 22 bp, Homo sapiens
caagaagaatttattacaaatc

SEQ ID NO: 1524728 - DNA, 12 bp, Homo sapiens
caagaagacatg

SEQ ID NO: 1524729 - DNA, 14 bp, Homo sapiens
caagaagattctaa

SEQ ID NO: 1524730 - DNA, 19 bp, Homo sapiens
caagaagattctaaaacat

SEQ ID NO: 1524731 - DNA, 15 bp, Homo sapiens
caagaagcaggaagg

SEQ ID NO: 1524732 - DNA, 18 bp, Homo sapiens
caagaagcagtggcctta

SEQ ID NO: 1524733 - DNA, 14 bp, Homo sapiens
caagaagggctgca

SEQ ID NO: 1524734 - DNA, 23 bp, Homo sapiens
caagaagggttttccaccctgga

SEQ ID NO: 1524735 - DNA, 21 bp, Homo sapiens
caagaagtcatacctttttct

SEQ ID NO: 1524736 - DNA, 14 bp, Homo sapiens
caagaagtgaagaa

SEQ ID NO: 1524737 - DNA, 14 bp, Homo sapiens
caagaagtgattag

SEQ ID NO: 1524738 - DNA, 13 bp, Homo sapiens
caagaatacttga

SEQ ID NO: 1524739 - DNA, 23 bp, Homo sapiens
caagaatattgtatgttaaagca

SEQ ID NO: 1524740 - DNA, 19 bp, Homo sapiens
caagaatcagaagaaaggc

SEQ ID NO: 1524741 - DNA, 18 bp, Homo sapiens
caagaatccacatttcta

SEQ ID NO: 1524742 - DNA, 21 bp, Homo sapiens
caagaatccacatttctaaaa

SEQ ID NO: 1524743 - DNA, 22 bp, Homo sapiens
caagaatccacatttctaaaat

SEQ ID NO: 1524744 - DNA, 18 bp, Homo sapiens
caagaatctagaagatgt

SEQ ID NO: 1524745 - DNA, 19 bp, Homo sapiens
caagaatgaaaaatataat

SEQ ID NO: 1524746 - DNA, 21 bp, Homo sapiens
caagaatgaaggtttttgtaa

SEQ ID NO: 1524747 - DNA, 15 bp, Homo sapiens
caagaatggaagcct

SEQ ID NO: 1524748 - DNA, 21 bp, Homo sapiens
caagaatggatcacaagatgg

SEQ ID NO: 1524749 - DNA, 20 bp, Homo sapiens
caagaatgtacgtccagcct

SEQ ID NO: 1524750 - DNA, 23 bp, Homo sapiens
caagaattgttacctgtcatttt

SEQ ID NO: 1524751 - DNA, 18 bp, Homo sapiens
caagacaaggctggcaaa

SEQ ID NO: 1524752 - DNA, 19 bp, Homo sapiens
caagacagaaaagtgcctg

SEQ ID NO: 1524753 - DNA, 20 bp, Homo sapiens
caagacagaaaagtgcctga

SEQ ID NO: 1524754 - DNA, 22 bp, Homo sapiens
caagacagaaaagtgcctgagc

SEQ ID NO: 1524755 - DNA, 22 bp, Homo sapiens
caagacagagacgcaggaatgg

SEQ ID NO: 1524756 - DNA, 11 bp, Homo sapiens
caagacagagt

SEQ ID NO: 1524757 - DNA, 16 bp, Homo sapiens
caagacagatgcccca

SEQ ID NO: 1524758 - DNA, 19 bp, Homo sapiens
caagacagtgtcatggtgc

SEQ ID NO: 1524759 - DNA, 13 bp, Homo sapiens
caagacatttgct

SEQ ID NO: 1524760 - DNA, 18 bp, Homo sapiens
caagaccaaaatgacaat

SEQ ID NO: 1524761 - DNA, 22 bp, Homo sapiens
caagaccaggctgcagcctcca

SEQ ID NO: 1524762 - DNA, 13 bp, Homo sapiens
caagacccccagc

SEQ ID NO: 1524763 - DNA, 15 bp, Homo sapiens
caagaccctgtgttc

SEQ ID NO: 1524764 - DNA, 17 bp, Homo sapiens
caagaccgccccagggc

SEQ ID NO: 1524765 - DNA, 18 bp, Homo sapiens
caagaccgccccagggct

SEQ ID NO: 1524766 - DNA, 17 bp, Homo sapiens
caagacctcatctgtgg

SEQ ID NO: 1524767 - DNA, 20 bp, Homo sapiens
caagacctcttccctctggg

SEQ ID NO: 1524768 - DNA, 14 bp, Homo sapiens
caagacgaggggca

SEQ ID NO: 1524769 - DNA, 17 bp, Homo sapiens
caagacgaggggcaggg

SEQ ID NO: 1524770 - DNA, 20 bp, Homo sapiens
caagacgaggggcagggaag

SEQ ID NO: 1524771 - DNA, 22 bp, Homo sapiens
caagacgaggggcagggaagga

SEQ ID NO: 1524772 - DNA, 23 bp, Homo sapiens
caagacggaggaggggaaggggc

SEQ ID NO: 1524773 - DNA, 17 bp, Homo sapiens
caagactctagagtcca

SEQ ID NO: 1524774 - DNA, 21 bp, Homo sapiens
caagactctagagtccaaggt

SEQ ID NO: 1524775 - DNA, 22 bp, Homo sapiens
caagactctttatgatctggcc

SEQ ID NO: 1524776 - DNA, 22 bp, Homo sapiens
caagactttagcttttccttcc

SEQ ID NO: 1524777 - DNA, 22 bp, Homo sapiens
caagagaaggtggacctggcag

SEQ ID NO: 1524778 - DNA, 12 bp, Homo sapiens
caagagaatctg

SEQ ID NO: 1524779 - DNA, 17 bp, Homo sapiens
caagagagaaagaagta

SEQ ID NO: 1524780 - DNA, 21 bp, Homo sapiens
caagagagatgtatgtgtcac

SEQ ID NO: 1524781 - DNA, 13 bp, Homo sapiens
caagagaggatga

SEQ ID NO: 1524782 - DNA, 15 bp, Homo sapiens
caagagatttaatta

SEQ ID NO: 1524783 - DNA, 15 bp, Homo sapiens
caagagcagcctgtg

SEQ ID NO: 1524784 - DNA, 22 bp, Homo sapiens
caagagcatcgtgacccttcag

SEQ ID NO: 1524785 - DNA, 12 bp, Homo sapiens
caagagccaagt

SEQ ID NO: 1524786 - DNA, 17 bp, Homo sapiens
caagagcccctgcccct

SEQ ID NO: 1524787 - DNA, 16 bp, Homo sapiens
caagagccctgtggcc

SEQ ID NO: 1524788 - DNA, 21 bp, Homo sapiens
caagagccctgtggccgccac

SEQ ID NO: 1524789 - DNA, 22 bp, Homo sapiens
caagagccttggtgtccacctg

SEQ ID NO: 1524790 - DNA, 19 bp, Homo sapiens
caagagctagaaaaataaa

SEQ ID NO: 1524791 - DNA, 13 bp, Homo sapiens
caagagctgctgt

SEQ ID NO: 1524792 - DNA, 15 bp, Homo sapiens
caagagctgctgtcc

SEQ ID NO: 1524793 - DNA, 15 bp, Homo sapiens
caagaggaatctgtt

SEQ ID NO: 1524794 - DNA, 15 bp, Homo sapiens
caagaggcaagctga

SEQ ID NO: 1524795 - DNA, 22 bp, Homo sapiens
caagaggccacttagggaaaga

SEQ ID NO: 1524796 - DNA, 19 bp, Homo sapiens
caagaggctgtagaaaggg

SEQ ID NO: 1524797 - DNA, 20 bp, Homo sapiens
caagaggctgttcccaccag

SEQ ID NO: 1524798 - DNA, 13 bp, Homo sapiens
caagagggcactg

SEQ ID NO: 1524799 - DNA, 20 bp, Homo sapiens
caagagggcactggtggccc

SEQ ID NO: 1524800 - DNA, 18 bp, Homo sapiens
caagagggggtggagggg

SEQ ID NO: 1524801 - DNA, 21 bp, Homo sapiens
caagagggggtggaggggtgt

SEQ ID NO: 1524802 - DNA, 14 bp, Homo sapiens
caaataggtcatca

SEQ ID NO: 1524803 - DNA, 16 bp, Homo sapiens
caaatagtagacattt

SEQ ID NO: 1524804 - DNA, 23 bp, Homo sapiens
caaatagtagacatttgtgtgga

SEQ ID NO: 1524805 - DNA, 21 bp, Homo sapiens
caaatagtgtgaaatatatta

SEQ ID NO: 1524806 - DNA, 20 bp, Homo sapiens
caaatagtttataaatgtga

SEQ ID NO: 1524807 - DNA, 18 bp, Homo sapiens
caaatatagtatattaac

SEQ ID NO: 1524808 - DNA, 19 bp, Homo sapiens
caaatatagttgaacaaga

SEQ ID NO: 1524809 - DNA, 17 bp, Homo sapiens
caaatatgcaaagcact

SEQ ID NO: 1524810 - DNA, 13 bp, Homo sapiens
caaatatgtcctg

SEQ ID NO: 1524811 - DNA, 14 bp, Homo sapiens
caaatatgtcctgg

SEQ ID NO: 1524812 - DNA, 18 bp, Homo sapiens
caaatattaaaattgtta

SEQ ID NO: 1524813 - DNA, 12 bp, Homo sapiens
caaatattaaag

SEQ ID NO: 1524814 - DNA, 18 bp, Homo sapiens
caaatattcactggcccc

SEQ ID NO: 1524815 - DNA, 15 bp, Homo sapiens
caaatatttattttc

SEQ ID NO: 1524816 - DNA, 14 bp, Homo sapiens
caaatcaatacact

SEQ ID NO: 1524817 - DNA, 16 bp, Homo sapiens
caaatcaattactggt

SEQ ID NO: 1524818 - DNA, 16 bp, Homo sapiens
caaatcaattctagtc

SEQ ID NO: 1524819 - DNA, 14 bp, Homo sapiens
caaatcacatattt

SEQ ID NO: 1524820 - DNA, 18 bp, Homo sapiens
caaatcacatattttaaa

SEQ ID NO: 1524821 - DNA, 13 bp, Homo sapiens
caaatcagctgct

SEQ ID NO: 1524822 - DNA, 16 bp, Homo sapiens
caaatcagctgctact

SEQ ID NO: 1524823 - DNA, 13 bp, Homo sapiens
caaatcaggcttt

SEQ ID NO: 1524824 - DNA, 23 bp, Homo sapiens
caaatcagtcagtgcaaatgtca

SEQ ID NO: 1524825 - DNA, 15 bp, Homo sapiens
caaatcagtgatcta

SEQ ID NO: 1524826 - DNA, 16 bp, Homo sapiens
caaatcagtgatctat

SEQ ID NO: 1524827 - DNA, 22 bp, Homo sapiens
caaatcagttactaagaagaaa

SEQ ID NO: 1524828 - DNA, 18 bp, Homo sapiens
caaatcagtttgactact

SEQ ID NO: 1524829 - DNA, 17 bp, Homo sapiens
caaatccagtggtgggt

SEQ ID NO: 1524830 - DNA, 21 bp, Homo sapiens
caaatcctggaaggacacagt

SEQ ID NO: 1524831 - DNA, 21 bp, Homo sapiens
caaatccttggagtcccaggg

SEQ ID NO: 1524832 - DNA, 16 bp, Homo sapiens
caaatcgatttagtaa

SEQ ID NO: 1524833 - DNA, 20 bp, Homo sapiens
caaatctaaaatttaaaatt

SEQ ID NO: 1524834 - DNA, 18 bp, Homo sapiens
caaatctaatctcttatt

SEQ ID NO: 1524835 - DNA, 14 bp, Homo sapiens
caaatctattcaga

SEQ ID NO: 1524836 - DNA, 16 bp, Homo sapiens
caaatctattcagaca

SEQ ID NO: 1524837 - DNA, 21 bp, Homo sapiens
caaatctcaatgaagccagct

SEQ ID NO: 1524838 - DNA, 21 bp, Homo sapiens
caaatctcagttgtttgcttc

SEQ ID NO: 1524839 - DNA, 15 bp, Homo sapiens
caaatctctcatatt

SEQ ID NO: 1524840 - DNA, 13 bp, Homo sapiens
caaatctgtcctc

SEQ ID NO: 1524841 - DNA, 17 bp, Homo sapiens
caaatctgtcctctgta

SEQ ID NO: 1524842 - DNA, 18 bp, Homo sapiens
caaatctgtcctctgtag

SEQ ID NO: 1524843 - DNA, 19 bp, Homo sapiens
caaatctgtcctctgtagt

SEQ ID NO: 1524844 - DNA, 14 bp, Homo sapiens
caaatcttaagaaa

SEQ ID NO: 1524845 - DNA, 20 bp, Homo sapiens
caaatctttccatatccata

SEQ ID NO: 1524846 - DNA, 17 bp, Homo sapiens
caaatgaaaaatctcaa

SEQ ID NO: 1524847 - DNA, 12 bp, Homo sapiens
caaatgaagaaa

SEQ ID NO: 1524848 - DNA, 10 bp, Homo sapiens
caaatgacat

SEQ ID NO: 1524849 - DNA, 15 bp, Homo sapiens
caaatgacatgcact

SEQ ID NO: 1524850 - DNA, 21 bp, Homo sapiens
caaatgacatgcactgaccct

SEQ ID NO: 1524851 - DNA, 22 bp, Homo sapiens
caaatgaccagcagattcaaat

SEQ ID NO: 1524852 - DNA, 17 bp, Homo sapiens
caaatgaccgagccctg

SEQ ID NO: 1524853 - DNA, 19 bp, Homo sapiens
caaatgaccgagccctgga

SEQ ID NO: 1524854 - DNA, 21 bp, Homo sapiens
caaatgaccgagccctggaga

SEQ ID NO: 1524855 - DNA, 18 bp, Homo sapiens
caaatgagtaacatttgc

SEQ ID NO: 1524856 - DNA, 19 bp, Homo sapiens
caaatgagtaacatttgct

SEQ ID NO: 1524857 - DNA, 21 bp, Homo sapiens
caaatgagtttaaaaaaataa

SEQ ID NO: 1524858 - DNA, 22 bp, Homo sapiens
caaatgatcctagtaattgcct

SEQ ID NO: 1524859 - DNA, 18 bp, Homo sapiens
caaatgatcctcccacct

SEQ ID NO: 1524860 - DNA, 15 bp, Homo sapiens
caaatgcaaaaataa

SEQ ID NO: 1524861 - DNA, 15 bp, Homo sapiens
caaatgcaatttgat

SEQ ID NO: 1524862 - DNA, 18 bp, Homo sapiens
caaatgcacatttgtcac

SEQ ID NO: 1524863 - DNA, 15 bp, Homo sapiens
caaatgcagggaggg

SEQ ID NO: 1524864 - DNA, 20 bp, Homo sapiens
caaatgcagggaggggaggc

SEQ ID NO: 1524865 - DNA, 23 bp, Homo sapiens
caaatgcagggattgctgccact

SEQ ID NO: 1524866 - DNA, 17 bp, Homo sapiens
caaatgcataaatgcat

SEQ ID NO: 1524867 - DNA, 21 bp, Homo sapiens
caaatgctagaaaaattgtta

SEQ ID NO: 1524868 - DNA, 15 bp, Homo sapiens
caaatggctgagatg

SEQ ID NO: 1524869 - DNA, 11 bp, Homo sapiens
caaatgggact

SEQ ID NO: 1524870 - DNA, 13 bp, Homo sapiens
caaatgggactga

SEQ ID NO: 1524871 - DNA, 18 bp, Homo sapiens
caaatgggactgatgtca

SEQ ID NO: 1524872 - DNA, 14 bp, Homo sapiens
caaatggggccaga

SEQ ID NO: 1524873 - DNA, 16 bp, Homo sapiens
caaatggggccagatc

SEQ ID NO: 1524874 - DNA, 12 bp, Homo sapiens
caaatgtaaatc

SEQ ID NO: 1524875 - DNA, 18 bp, Homo sapiens
caaatgtaattgaataaa

SEQ ID NO: 1524876 - DNA, 20 bp, Homo sapiens
caaatgtcagatacaatgta

SEQ ID NO: 1524877 - DNA, 13 bp, Homo sapiens
caaatgtcattgt

SEQ ID NO: 1524878 - DNA, 16 bp, Homo sapiens
caaatgtcattgtcta

SEQ ID NO: 1524879 - DNA, 17 bp, Homo sapiens
caaatgtcattgtctac

SEQ ID NO: 1524880 - DNA, 16 bp, Homo sapiens
caaatgtctattttct

SEQ ID NO: 1524881 - DNA, 13 bp, Homo sapiens
caaatgtgtaata

SEQ ID NO: 1524882 - DNA, 15 bp, Homo sapiens
caaatgtgtcagaat

SEQ ID NO: 1524883 - DNA, 21 bp, Homo sapiens
caaatgtgtttttctatatag

SEQ ID NO: 1524884 - DNA, 14 bp, Homo sapiens
caaatgttctaagt

SEQ ID NO: 1524885 - DNA, 21 bp, Homo sapiens
caaatgttctaagtttctaag

SEQ ID NO: 1524886 - DNA, 15 bp, Homo sapiens
caaatgtttccttaa

SEQ ID NO: 1524887 - DNA, 19 bp, Homo sapiens
caaatgtttccttaaacat

SEQ ID NO: 1524888 - DNA, 12 bp, Homo sapiens
caaatgtttcta

SEQ ID NO: 1524889 - DNA, 15 bp, Homo sapiens
caaattaaaacaaat

SEQ ID NO: 1524890 - DNA, 19 bp, Homo sapiens
caaattaaaacaaatatac

SEQ ID NO: 1524891 - DNA, 16 bp, Homo sapiens
caaattactctttctc

SEQ ID NO: 1524892 - DNA, 15 bp, Homo sapiens
caaattagaagacat

SEQ ID NO: 1524893 - DNA, 13 bp, Homo sapiens
caaattataatgt

SEQ ID NO: 1524894 - DNA, 18 bp, Homo sapiens
caaattataatgtattca

SEQ ID NO: 1524895 - DNA, 13 bp, Homo sapiens
caaattattctag

SEQ ID NO: 1524896 - DNA, 16 bp, Homo sapiens
caaattattctagtca

SEQ ID NO: 1524897 - DNA, 22 bp, Homo sapiens
caaattattttaatattttgta

SEQ ID NO: 1524898 - DNA, 21 bp, Homo sapiens
caaattcaagagcctcccctg

SEQ ID NO: 1524899 - DNA, 22 bp, Homo sapiens
caaattcaagagctagaaaaat

SEQ ID NO: 1524900 - DNA, 20 bp, Homo sapiens
caaattcatttcatggtgac

SEQ ID NO: 1524901 - DNA, 14 bp, Homo sapiens
caaattcattttta

SEQ ID NO: 1524902 - DNA, 14 bp, Homo sapiens
caaattcatttttt

SEQ ID NO: 1524903 - DNA, 22 bp, Homo sapiens
caaattctgcttgcttgctttt

SEQ ID NO: 1524904 - DNA, 14 bp, Homo sapiens
caaattctgtttct

SEQ ID NO: 1524905 - DNA, 15 bp, Homo sapiens
caaattctttagtac

SEQ ID NO: 1524906 - DNA, 20 bp, Homo sapiens
caaattctttagtactcaat

SEQ ID NO: 1524907 - DNA, 22 bp, Homo sapiens
caaattgatcaagatattaaaa

SEQ ID NO: 1524908 - DNA, 16 bp, Homo sapiens
caaattgccttcagcc

SEQ ID NO: 1524909 - DNA, 21 bp, Homo sapiens
caaattgctgcatatttgtgc

SEQ ID NO: 1524910 - DNA, 13 bp, Homo sapiens
caaattgctgctt

SEQ ID NO: 1524911 - DNA, 22 bp, Homo sapiens
caaattgcttttttccaaaaca

SEQ ID NO: 1524912 - DNA, 18 bp, Homo sapiens
caaattgtgcagtacttt

SEQ ID NO: 1524913 - DNA, 13 bp, Homo sapiens
caaatttatgcat

SEQ ID NO: 1524914 - DNA, 21 bp, Homo sapiens
caaatttatgcatttcattca

SEQ ID NO: 1524915 - DNA, 13 bp, Homo sapiens
caaatttcctgtt

SEQ ID NO: 1524916 - DNA, 18 bp, Homo sapiens
caaatttggccttaagaa

SEQ ID NO: 1524917 - DNA, 24 bp, Homo sapiens
caaatttggccttaagaactgtgt

SEQ ID NO: 1524918 - DNA, 19 bp, Homo sapiens
caaatttgtacaggactgt

SEQ ID NO: 1524919 - DNA, 18 bp, Homo sapiens
cacaacttgatggctgcg

SEQ ID NO: 1524920 - DNA, 13 bp, Homo sapiens
cacaagaatggat

SEQ ID NO: 1524921 - DNA, 21 bp, Homo sapiens
cacaagagcccagcagggcct

SEQ ID NO: 1524922 - DNA, 14 bp, Homo sapiens
cacaagattcccag

SEQ ID NO: 1524923 - DNA, 22 bp, Homo sapiens
cacaagcaaaaaaaaaaaaaag

SEQ ID NO: 1524924 - DNA, 12 bp, Homo sapiens
cacaagccaggg

SEQ ID NO: 1524925 - DNA, 18 bp, Homo sapiens
cacaagcctcttctgaag

SEQ ID NO: 1524926 - DNA, 23 bp, Homo sapiens
cacaagcctcttctgaagatgga

SEQ ID NO: 1524927 - DNA, 17 bp, Homo sapiens
cacaagctgtccctgca

SEQ ID NO: 1524928 - DNA, 18 bp, Homo sapiens
cacaagctgtccctgcag

SEQ ID NO: 1524929 - DNA, 20 bp, Homo sapiens
cacaagctgtccctgcaggg

SEQ ID NO: 1524930 - DNA, 19 bp, Homo sapiens
cacaaggaaaaggaggagg

SEQ ID NO: 1524931 - DNA, 14 bp, Homo sapiens
cacaaggaaataaa

SEQ ID NO: 1524932 - DNA, 19 bp, Homo sapiens
cacaaggacgctggctact

SEQ ID NO: 1524933 - DNA, 12 bp, Homo sapiens
cacaaggacttc

SEQ ID NO: 1524934 - DNA, 14 bp, Homo sapiens
cacaaggacttcct

SEQ ID NO: 1524935 - DNA, 22 bp, Homo sapiens
cacaaggatagatgctggccca

SEQ ID NO: 1524936 - DNA, 19 bp, Homo sapiens
cacaaggctgaccaagaga

SEQ ID NO: 1524937 - DNA, 21 bp, Homo sapiens
cacaaggctgaccaagagaga

SEQ ID NO: 1524938 - DNA, 17 bp, Homo sapiens
cacaagggatataaaat

SEQ ID NO: 1524939 - DNA, 18 bp, Homo sapiens
cacaagggatataaaatg

SEQ ID NO: 1524940 - DNA, 17 bp, Homo sapiens
caagggctgtcattgca

SEQ ID NO: 1524941 - DNA, 18 bp, Homo sapiens
caagggcttctgcaccct

SEQ ID NO: 1524942 - DNA, 19 bp, Homo sapiens
caagggcttctgcaccctc

SEQ ID NO: 1524943 - DNA, 15 bp, Homo sapiens
caaggggctcagaac

SEQ ID NO: 1524944 - DNA, 20 bp, Homo sapiens
caaggggtggccgggcacag

SEQ ID NO: 1524945 - DNA, 15 bp, Homo sapiens
caagggtcctcaccc

SEQ ID NO: 1524946 - DNA, 23 bp, Homo sapiens
caagggtgatgggaaagcattgt

SEQ ID NO: 1524947 - DNA, 19 bp, Homo sapiens
caagggttcagagactcag

SEQ ID NO: 1524948 - DNA, 20 bp, Homo sapiens
caagggttcagagactcagg

SEQ ID NO: 1524949 - DNA, 20 bp, Homo sapiens
caagggtttcgactggtcca

SEQ ID NO: 1524950 - DNA, 22 bp, Homo sapiens
caagggtttcgactggtccagc

SEQ ID NO: 1524951 - DNA, 19 bp, Homo sapiens
caaggtaccgatttctgct

SEQ ID NO: 1524952 - DNA, 15 bp, Homo sapiens
caaggtagccatccc

SEQ ID NO: 1524953 - DNA, 20 bp, Homo sapiens
caaggtcacttaaagggtct

SEQ ID NO: 1524954 - DNA, 23 bp, Homo sapiens
caaggtccattattttgtattct

SEQ ID NO: 1524955 - DNA, 15 bp, Homo sapiens
caaggtcctctcagt

SEQ ID NO: 1524956 - DNA, 10 bp, Homo sapiens
caaggtcctg

SEQ ID NO: 1524957 - DNA, 23 bp, Homo sapiens
caaggtctccttactctgagccc

SEQ ID NO: 1524958 - DNA, 18 bp, Homo sapiens
caaggtgatttcagactg

SEQ ID NO: 1524959 - DNA, 12 bp, Homo sapiens
caaggtgctaac

SEQ ID NO: 1524960 - DNA, 16 bp, Homo sapiens
caaggtggagggaagg

SEQ ID NO: 1524961 - DNA, 16 bp, Homo sapiens
caaggtggcctctgcc

SEQ ID NO: 1524962 - DNA, 18 bp, Homo sapiens
caaggtggcctctgcctg

SEQ ID NO: 1524963 - DNA, 22 bp, Homo sapiens
caaggtgggccttgctacctca

SEQ ID NO: 1524964 - DNA, 19 bp, Homo sapiens
caaggtggggattgcccct

SEQ ID NO: 1524965 - DNA, 21 bp, Homo sapiens
caaggtgggtgattcctccca

SEQ ID NO: 1524966 - DNA, 17 bp, Homo sapiens
caaggtggtcagtaaat

SEQ ID NO: 1524967 - DNA, 17 bp, Homo sapiens
caaggtgtccctgcctt

SEQ ID NO: 1524968 - DNA, 21 bp, Homo sapiens
caaggtgtttccatttctcaa

SEQ ID NO: 1524969 - DNA, 20 bp, Homo sapiens
caaggttactgggagtgtgg

SEQ ID NO: 1524970 - DNA, 17 bp, Homo sapiens
caaggttataatttttt

SEQ ID NO: 1524971 - DNA, 21 bp, Homo sapiens
caaggttatatgcactttctc

SEQ ID NO: 1524972 - DNA, 18 bp, Homo sapiens
caaggtttaaagagtcta

SEQ ID NO: 1524973 - DNA, 21 bp, Homo sapiens
caaggtttaaagagtctagat

SEQ ID NO: 1524974 - DNA, 17 bp, Homo sapiens
caaggtttacactgcgg

SEQ ID NO: 1524975 - DNA, 19 bp, Homo sapiens
caaggtttatgccaccagg

SEQ ID NO: 1524976 - DNA, 13 bp, Homo sapiens
caaggttttaggt

SEQ ID NO: 1524977 - DNA, 20 bp, Homo sapiens
caaggttttaggttctaaag

SEQ ID NO: 1524978 - DNA, 10 bp, Homo sapiens
caagtaaaaa

SEQ ID NO: 1524979 - DNA, 22 bp, Homo sapiens
caagtaatccacctgcctcggc

SEQ ID NO: 1524980 - DNA, 23 bp, Homo sapiens
caagtaatttcagtgtaaagtgt

SEQ ID NO: 1524981 - DNA, 15 bp, Homo sapiens
caagtacactgagag

SEQ ID NO: 1524982 - DNA, 16 bp, Homo sapiens
caagtactgctgtaaa

SEQ ID NO: 1524983 - DNA, 19 bp, Homo sapiens
caagtagctgggactacag

SEQ ID NO: 1524984 - DNA, 15 bp, Homo sapiens
caagtagctttccac

SEQ ID NO: 1524985 - DNA, 17 bp, Homo sapiens
caagtagctttccacat

SEQ ID NO: 1524986 - DNA, 18 bp, Homo sapiens
caagtatatgtcatttac

SEQ ID NO: 1524987 - DNA, 16 bp, Homo sapiens
caagtatcttctattt

SEQ ID NO: 1524988 - DNA, 17 bp, Homo sapiens
caagtatcttctatttt

SEQ ID NO: 1524989 - DNA, 21 bp, Homo sapiens
caagtatgaataaagacacct

SEQ ID NO: 1524990 - DNA, 15 bp, Homo sapiens
caagtatgccttaag

SEQ ID NO: 1524991 - DNA, 17 bp, Homo sapiens
caagtattgagaacctg

SEQ ID NO: 1524992 - DNA, 13 bp, Homo sapiens
caagtcacagctg

SEQ ID NO: 1524993 - DNA, 16 bp, Homo sapiens
caagtcacagctgcag

SEQ ID NO: 1524994 - DNA, 22 bp, Homo sapiens
caagtcacagctgcagctgggc

SEQ ID NO: 1524995 - DNA, 22 bp, Homo sapiens
caagtcactagaagtcctgctg

SEQ ID NO: 1524996 - DNA, 18 bp, Homo sapiens
caagtcatagccataaat

SEQ ID NO: 1524997 - DNA, 14 bp, Homo sapiens
caagtcatttttgt

SEQ ID NO: 1524998 - DNA, 16 bp, Homo sapiens
caagtcatttttgtat

SEQ ID NO: 1524999 - DNA, 17 bp, Homo sapiens
caagtcatttttgtatt

SEQ ID NO: 1525000 - DNA, 22 bp, Homo sapiens
caagtccattatgtaatagtga

SEQ ID NO: 1525001 - DNA, 14 bp, Homo sapiens
caagtccccaagat

SEQ ID NO: 1525002 - DNA, 23 bp, Homo sapiens
caagtccctgactctctgtgacc

SEQ ID NO: 1525003 - DNA, 21 bp, Homo sapiens
caagtccctgttttctgagcc

SEQ ID NO: 1525004 - DNA, 22 bp, Homo sapiens
caagtccctgttttctgagccc

SEQ ID NO: 1525005 - DNA, 14 bp, Homo sapiens
caagtcctgaagag

SEQ ID NO: 1525006 - DNA, 16 bp, Homo sapiens
caagtcctgaagaggc

SEQ ID NO: 1525007 - DNA, 20 bp, Homo sapiens
caagtcctgaagaggcgggc

SEQ ID NO: 1525008 - DNA, 12 bp, Homo sapiens
caagtcctggct

SEQ ID NO: 1525009 - DNA, 15 bp, Homo sapiens
caagtcctggctaca

SEQ ID NO: 1525010 - DNA, 17 bp, Homo sapiens
caagtcctggctacatc

SEQ ID NO: 1525011 - DNA, 22 bp, Homo sapiens
caagtcctggctacatcccagc

SEQ ID NO: 1525012 - DNA, 18 bp, Homo sapiens
caagtccttgacctctat

SEQ ID NO: 1525013 - DNA, 18 bp, Homo sapiens
caagtctaatgaagagaa

SEQ ID NO: 1525014 - DNA, 17 bp, Homo sapiens
caagtctccttcccctt

SEQ ID NO: 1525015 - DNA, 22 bp, Homo sapiens
caagtctgatccatatttaata

SEQ ID NO: 1525016 - DNA, 14 bp, Homo sapiens
caagtctttccaga

SEQ ID NO: 1525017 - DNA, 22 bp, Homo sapiens
caagtgaagaacactactgcta

SEQ ID NO: 1525018 - DNA, 14 bp, Homo sapiens
caagtgaagaatct

SEQ ID NO: 1525019 - DNA, 19 bp, Homo sapiens
caagtgactgtatctgtgt

SEQ ID NO: 1525020 - DNA, 14 bp, Homo sapiens
caagtgagcagaga

SEQ ID NO: 1525021 - DNA, 23 bp, Homo sapiens
caagtgataattttatttataaa

SEQ ID NO: 1525022 - DNA, 21 bp, Homo sapiens
caagtgatctgccgcctcagc

SEQ ID NO: 1525023 - DNA, 19 bp, Homo sapiens
caagtgattgaaaatagta

SEQ ID NO: 1525024 - DNA, 14 bp, Homo sapiens
caagtgcacggggc

SEQ ID NO: 1525025 - DNA, 17 bp, Homo sapiens
caagtgcatgctctctg

SEQ ID NO: 1525026 - DNA, 20 bp, Homo sapiens
caagtgccagtcttgtgtct

SEQ ID NO: 1525027 - DNA, 15 bp, Homo sapiens
caagtgcccagtgga

SEQ ID NO: 1525028 - DNA, 15 bp, Homo sapiens
caagtgcctagactg

SEQ ID NO: 1525029 - DNA, 20 bp, Homo sapiens
caagtgcctagactgttact

SEQ ID NO: 1525030 - DNA, 21 bp, Homo sapiens
caagtgcctagactgttactt

SEQ ID NO: 1525031 - DNA, 16 bp, Homo sapiens
caagtgcctgctttta

SEQ ID NO: 1525032 - DNA, 14 bp, Homo sapiens
caagtgctgaacag

SEQ ID NO: 1525033 - DNA, 17 bp, Homo sapiens
caagtgctgaacagtgg

SEQ ID NO: 1525034 - DNA, 13 bp, Homo sapiens
caagtgctggccc

SEQ ID NO: 1525035 - DNA, 21 bp, Homo sapiens
caagtgctggcccacccagtc

SEQ ID NO: 1525036 - DNA, 12 bp, Homo sapiens
caagtggacctt

SEQ ID NO: 1525037 - DNA, 21 bp, Homo sapiens
caagtggaccttaggccttcc

SEQ ID NO: 1525038 - DNA, 22 bp, Homo sapiens
caagtggaccttaggccttcct

SEQ ID NO: 1525039 - DNA, 15 bp, Homo sapiens
caagtggatgggaat

SEQ ID NO: 1525040 - DNA, 17 bp, Homo sapiens
caagtggcatgtgctgt

SEQ ID NO: 1525041 - DNA, 20 bp, Homo sapiens
caagtggggcctccttgtcc

SEQ ID NO: 1525042 - DNA, 22 bp, Homo sapiens
caatattataatttttttcaat

SEQ ID NO: 1525043 - DNA, 13 bp, Homo sapiens
caatattcctgaa

SEQ ID NO: 1525044 - DNA, 15 bp, Homo sapiens
caatattctgtaact

SEQ ID NO: 1525045 - DNA, 23 bp, Homo sapiens
caatattgattgggaaaacattt

SEQ ID NO: 1525046 - DNA, 13 bp, Homo sapiens
caatatttagaaa

SEQ ID NO: 1525047 - DNA, 14 bp, Homo sapiens
caatatttagaaaa

SEQ ID NO: 1525048 - DNA, 12 bp, Homo sapiens
caatatttatta

SEQ ID NO: 1525049 - DNA, 19 bp, Homo sapiens
caatcaaagaattacagta

SEQ ID NO: 1525050 - DNA, 23 bp, Homo sapiens
caatcaaataagtatttataata

SEQ ID NO: 1525051 - DNA, 22 bp, Homo sapiens
caatcaacagcatgtctactgc

SEQ ID NO: 1525052 - DNA, 19 bp, Homo sapiens
caatcaaggttataatttt

SEQ ID NO: 1525053 - DNA, 12 bp, Homo sapiens
caatcactgcca

SEQ ID NO: 1525054 - DNA, 14 bp, Homo sapiens
caatcagcactgaa

SEQ ID NO: 1525055 - DNA, 15 bp, Homo sapiens
caatcagcactgaaa

SEQ ID NO: 1525056 - DNA, 20 bp, Homo sapiens
caatcagcttttgttctaga

SEQ ID NO: 1525057 - DNA, 15 bp, Homo sapiens
caatcagtcccctcc

SEQ ID NO: 1525058 - DNA, 18 bp, Homo sapiens
cacacctcagttcccttg

SEQ ID NO: 1525059 - DNA, 15 bp, Homo sapiens
cacacctccccctgc

SEQ ID NO: 1525060 - DNA, 13 bp, Homo sapiens
cacacctctgcca

SEQ ID NO: 1525061 - DNA, 14 bp, Homo sapiens
cacacctctgccac

SEQ ID NO: 1525062 - DNA, 15 bp, Homo sapiens
cacacctctgccacc

SEQ ID NO: 1525063 - DNA, 12 bp, Homo sapiens
cacacctgcctg

SEQ ID NO: 1525064 - DNA, 15 bp, Homo sapiens
cacacctgcctgcgt

SEQ ID NO: 1525065 - DNA, 12 bp, Homo sapiens
cacacctggtgg

SEQ ID NO: 1525066 - DNA, 16 bp, Homo sapiens
cacacctgtagcactt

SEQ ID NO: 1525067 - DNA, 19 bp, Homo sapiens
cacacctgtagtcccagct

SEQ ID NO: 1525068 - DNA, 17 bp, Homo sapiens
cacaccttccagggccc

SEQ ID NO: 1525069 - DNA, 16 bp, Homo sapiens
cacaccttttccccag

SEQ ID NO: 1525070 - DNA, 23 bp, Homo sapiens
cacacgagcaaacccagaggtgg

SEQ ID NO: 1525071 - DNA, 17 bp, Homo sapiens
cacacgcacgcacacac

SEQ ID NO: 1525072 - DNA, 19 bp, Homo sapiens
cacacgcacgcacacacac

SEQ ID NO: 1525073 - DNA, 19 bp, Homo sapiens
cacacgctccctggaagct

SEQ ID NO: 1525074 - DNA, 14 bp, Homo sapiens
cacacgcttttgaa

SEQ ID NO: 1525075 - DNA, 22 bp, Homo sapiens
cacacgtatttatatttggaaa

SEQ ID NO: 1525076 - DNA, 16 bp, Homo sapiens
cacacgtggctggcgg

SEQ ID NO: 1525077 - DNA, 17 bp, Homo sapiens
cacacgtttaatcccag

SEQ ID NO: 1525078 - DNA, 18 bp, Homo sapiens
cacactattaccatgaga

SEQ ID NO: 1525079 - DNA, 19 bp, Homo sapiens
cacactattaccatgagaa

SEQ ID NO: 1525080 - DNA, 13 bp, Homo sapiens
cacactcagtccc

SEQ ID NO: 1525081 - DNA, 20 bp, Homo sapiens
cacactcagtcccccaccac

SEQ ID NO: 1525082 - DNA, 13 bp, Homo sapiens
cacactcagtgca

SEQ ID NO: 1525083 - DNA, 21 bp, Homo sapiens
cacactcatacacatgtgcac

SEQ ID NO: 1525084 - DNA, 19 bp, Homo sapiens
cacactcatgcacacagat

SEQ ID NO: 1525085 - DNA, 17 bp, Homo sapiens
caagctcatctatttgg

SEQ ID NO: 1525086 - DNA, 19 bp, Homo sapiens
caagctcatctatttggaa

SEQ ID NO: 1525087 - DNA, 13 bp, Homo sapiens
caagctccaagcc

SEQ ID NO: 1525088 - DNA, 19 bp, Homo sapiens
caagctccaagccccatct

SEQ ID NO: 1525089 - DNA, 23 bp, Homo sapiens
caagctctcagcaagtgcccagt

SEQ ID NO: 1525090 - DNA, 15 bp, Homo sapiens
caagctgagtttcct

SEQ ID NO: 1525091 - DNA, 16 bp, Homo sapiens
caagctgagtttccta

SEQ ID NO: 1525092 - DNA, 15 bp, Homo sapiens
caagctgcactgtga

SEQ ID NO: 1525093 - DNA, 16 bp, Homo sapiens
caagctgcctctgggc

SEQ ID NO: 1525094 - DNA, 18 bp, Homo sapiens
caagctgcctctgggcca

SEQ ID NO: 1525095 - DNA, 15 bp, Homo sapiens
caagctgctctgagc

SEQ ID NO: 1525096 - DNA, 12 bp, Homo sapiens
caagctgtcccc

SEQ ID NO: 1525097 - DNA, 13 bp, Homo sapiens
caagctgtccctg

SEQ ID NO: 1525098 - DNA, 14 bp, Homo sapiens
caagctgtccctgc

SEQ ID NO: 1525099 - DNA, 18 bp, Homo sapiens
caagctgtccctgcaggg

SEQ ID NO: 1525100 - DNA, 20 bp, Homo sapiens
caagctgtccctgcagggcc

SEQ ID NO: 1525101 - DNA, 11 bp, Homo sapiens
caagctgtctc

SEQ ID NO: 1525102 - DNA, 14 bp, Homo sapiens
caagctgttttctt

SEQ ID NO: 1525103 - DNA, 23 bp, Homo sapiens
caagcttcaaccctcagccttga

SEQ ID NO: 1525104 - DNA, 13 bp, Homo sapiens
caagcttcagagc

SEQ ID NO: 1525105 - DNA, 15 bp, Homo sapiens
caagcttcagagcct

SEQ ID NO: 1525106 - DNA, 16 bp, Homo sapiens
caagcttcagagccta

SEQ ID NO: 1525107 - DNA, 20 bp, Homo sapiens
caagcttcagagcctagcca

SEQ ID NO: 1525108 - DNA, 12 bp, Homo sapiens
caagcttccctc

SEQ ID NO: 1525109 - DNA, 13 bp, Homo sapiens
caagcttctttta

SEQ ID NO: 1525110 - DNA, 14 bp, Homo sapiens
caagcttgaggcca

SEQ ID NO: 1525111 - DNA, 13 bp, Homo sapiens
caagcttggcagc

SEQ ID NO: 1525112 - DNA, 20 bp, Homo sapiens
caagcttggcagccgagctc

SEQ ID NO: 1525113 - DNA, 14 bp, Homo sapiens
caagctttaaatta

SEQ ID NO: 1525114 - DNA, 15 bp, Homo sapiens
caaggaaacatttta

SEQ ID NO: 1525115 - DNA, 20 bp, Homo sapiens
caaggaaagccccagcacta

SEQ ID NO: 1525116 - DNA, 19 bp, Homo sapiens
caaggaaaggggagaaggg

SEQ ID NO: 1525117 - DNA, 13 bp, Homo sapiens
caaggaagcagcc

SEQ ID NO: 1525118 - DNA, 14 bp, Homo sapiens
caaggaagccaaag

SEQ ID NO: 1525119 - DNA, 18 bp, Homo sapiens
caaggaagccaaagtttt

SEQ ID NO: 1525120 - DNA, 21 bp, Homo sapiens
caaggaatgcctgtgccaata

SEQ ID NO: 1525121 - DNA, 15 bp, Homo sapiens
caaggaatttcttaa

SEQ ID NO: 1525122 - DNA, 16 bp, Homo sapiens
caaggaatttcttaac

SEQ ID NO: 1525123 - DNA, 21 bp, Homo sapiens
caaggaatttcttaacttctt

SEQ ID NO: 1525124 - DNA, 15 bp, Homo sapiens
caaggacagggctgg

SEQ ID NO: 1525125 - DNA, 20 bp, Homo sapiens
caaggacattgtatgcaggg

SEQ ID NO: 1525126 - DNA, 21 bp, Homo sapiens
caaggacattgtatgcaggga

SEQ ID NO: 1525127 - DNA, 20 bp, Homo sapiens
caaggaccaggactccctcc

SEQ ID NO: 1525128 - DNA, 21 bp, Homo sapiens
caaggaccaggactccctcct

SEQ ID NO: 1525129 - DNA, 13 bp, Homo sapiens
caaggactgagca

SEQ ID NO: 1525130 - DNA, 12 bp, Homo sapiens
caaggactgagg

SEQ ID NO: 1525131 - DNA, 17 bp, Homo sapiens
caaggactgagggcagt

SEQ ID NO: 1525132 - DNA, 18 bp, Homo sapiens
caaggactgtttcagtgt

SEQ ID NO: 1525133 - DNA, 19 bp, Homo sapiens
caaggactgtttcagtgtg

SEQ ID NO: 1525134 - DNA, 19 bp, Homo sapiens
caaggacttcctgtccagc

SEQ ID NO: 1525135 - DNA, 23 bp, Homo sapiens
caaggacttcctgtccagctcca

SEQ ID NO: 1525136 - DNA, 16 bp, Homo sapiens
caaggactttgcagcc

SEQ ID NO: 1525137 - DNA, 15 bp, Homo sapiens
caaggactttgtaca

SEQ ID NO: 1525138 - DNA, 16 bp, Homo sapiens
caaggactttgtacat

SEQ ID NO: 1525139 - DNA, 19 bp, Homo sapiens
caaggagaaacagagacag

SEQ ID NO: 1525140 - DNA, 13 bp, Homo sapiens
caaggagatttct

SEQ ID NO: 1525141 - DNA, 16 bp, Homo sapiens
caaggagatttcttag

SEQ ID NO: 1525142 - DNA, 16 bp, Homo sapiens
caaggagcacaagcca

SEQ ID NO: 1525143 - DNA, 14 bp, Homo sapiens
caaggagctcaccc

SEQ ID NO: 1525144 - DNA, 20 bp, Homo sapiens
caaggagctgatttccaggc

SEQ ID NO: 1525145 - DNA, 23 bp, Homo sapiens
caaggagctgatttccaggcccc

SEQ ID NO: 1525146 - DNA, 13 bp, Homo sapiens
caaggaggaaaaa

SEQ ID NO: 1525147 - DNA, 20 bp, Homo sapiens
caaggagggcacaggtgtct

SEQ ID NO: 1525148 - DNA, 22 bp, Homo sapiens
caaggagtttaaatgagactag

SEQ ID NO: 1525149 - DNA, 22 bp, Homo sapiens
caaggatagatgctggcccagg

SEQ ID NO: 1525150 - DNA, 22 bp, Homo sapiens
caaggatgaattctttcaattc

SEQ ID NO: 1525151 - DNA, 14 bp, Homo sapiens
caaggcaagcattt

SEQ ID NO: 1525152 - DNA, 15 bp, Homo sapiens
caaggcaaggcaggt

SEQ ID NO: 1525153 - DNA, 15 bp, Homo sapiens
caaggcaatggaaac

SEQ ID NO: 1525154 - DNA, 15 bp, Homo sapiens
caaggcactctagat

SEQ ID NO: 1525155 - DNA, 17 bp, Homo sapiens
caaggcactctagattc

SEQ ID NO: 1525156 - DNA, 19 bp, Homo sapiens
caaggcagaggcctgggct

SEQ ID NO: 1525157 - DNA, 15 bp, Homo sapiens
caaggcagcctccag

SEQ ID NO: 1525158 - DNA, 18 bp, Homo sapiens
caaggcagcctccagagc

SEQ ID NO: 1525159 - DNA, 24 bp, Homo sapiens
caaggcagcctccagagccagcct

SEQ ID NO: 1525160 - DNA, 16 bp, Homo sapiens
caaggcagcgacccca

SEQ ID NO: 1525161 - DNA, 23 bp, Homo sapiens
caaggcaggtagatcgcttgagc

SEQ ID NO: 1525162 - DNA, 14 bp, Homo sapiens
caaggcaggtgcct

SEQ ID NO: 1525163 - DNA, 22 bp, Homo sapiens
caaggcaggtgcctccaggtgt

SEQ ID NO: 1525164 - DNA, 12 bp, Homo sapiens
caaggccacctc

SEQ ID NO: 1525165 - DNA, 16 bp, Homo sapiens
caaggccacctctgcc

SEQ ID NO: 1525166 - DNA, 17 bp, Homo sapiens
caaggccagagtggcct

SEQ ID NO: 1525167 - DNA, 18 bp, Homo sapiens
caaggccagagtggcctg

SEQ ID NO: 1525168 - DNA, 13 bp, Homo sapiens
caaggcccaggag

SEQ ID NO: 1525169 - DNA, 16 bp, Homo sapiens
caaggcccaggagacc

SEQ ID NO: 1525170 - DNA, 13 bp, Homo sapiens
caaggccctgctt

SEQ ID NO: 1525171 - DNA, 14 bp, Homo sapiens
caaggccctttcct

SEQ ID NO: 1525172 - DNA, 17 bp, Homo sapiens
caaggccgaagctctgg

SEQ ID NO: 1525173 - DNA, 14 bp, Homo sapiens
caaggcctctctct

SEQ ID NO: 1525174 - DNA, 18 bp, Homo sapiens
caaggcctctctctgcct

SEQ ID NO: 1525175 - DNA, 22 bp, Homo sapiens
caaggccttcagtttatttcca

SEQ ID NO: 1525176 - DNA, 19 bp, Homo sapiens
caaggcgggagcatctctt

SEQ ID NO: 1525177 - DNA, 17 bp, Homo sapiens
caaggcgggagggcctg

SEQ ID NO: 1525178 - DNA, 14 bp, Homo sapiens
caaggctatgtgat

SEQ ID NO: 1525179 - DNA, 19 bp, Homo sapiens
caaggctgaccaagagaga

SEQ ID NO: 1525180 - DNA, 17 bp, Homo sapiens
caagggaaaggcaagct

SEQ ID NO: 1525181 - DNA, 23 bp, Homo sapiens
caagggaaaggcaagcttgaggc

SEQ ID NO: 1525182 - DNA, 14 bp, Homo sapiens
caagggaaaggggt

SEQ ID NO: 1525183 - DNA, 17 bp, Homo sapiens
caagggaagaaacactc

SEQ ID NO: 1525184 - DNA, 13 bp, Homo sapiens
caagggacagcaa

SEQ ID NO: 1525185 - DNA, 20 bp, Homo sapiens
caagggacagcaagtgagca

SEQ ID NO: 1525186 - DNA, 15 bp, Homo sapiens
caagggacagcccac

SEQ ID NO: 1525187 - DNA, 19 bp, Homo sapiens
caagggacagcccacggtc

SEQ ID NO: 1525188 - DNA, 10 bp, Homo sapiens
caagggagaa

SEQ ID NO: 1525189 - DNA, 14 bp, Homo sapiens
caagggagaaaaga

SEQ ID NO: 1525190 - DNA, 17 bp, Homo sapiens
caagggagaaaagagaa

SEQ ID NO: 1525191 - DNA, 15 bp, Homo sapiens
caagggaggcagtgg

SEQ ID NO: 1525192 - DNA, 17 bp, Homo sapiens
caagggaggcagtggct

SEQ ID NO: 1525193 - DNA, 17 bp, Homo sapiens
caactgtttccctgctg

SEQ ID NO: 1525194 - DNA, 19 bp, Homo sapiens
caactgtttccctgctgaa

SEQ ID NO: 1525195 - DNA, 15 bp, Homo sapiens
caacttaacatgggc

SEQ ID NO: 1525196 - DNA, 15 bp, Homo sapiens
caacttagctcaggt

SEQ ID NO: 1525197 - DNA, 18 bp, Homo sapiens
caacttcaagtgcatgct

SEQ ID NO: 1525198 - DNA, 22 bp, Homo sapiens
caacttcaccaccccctgtccc

SEQ ID NO: 1525199 - DNA, 15 bp, Homo sapiens
caacttcatttgaca

SEQ ID NO: 1525200 - DNA, 18 bp, Homo sapiens
caatgtgaggggtcccta

SEQ ID NO: 1525201 - DNA, 20 bp, Homo sapiens
caatgtgaggggtccctagc

SEQ ID NO: 1525202 - DNA, 14 bp, Homo sapiens
caatgtgagtccca

SEQ ID NO: 1525203 - DNA, 19 bp, Homo sapiens
caatgtgagtcccagagcc

SEQ ID NO: 1525204 - DNA, 14 bp, Homo sapiens
caatgtgccttgat

SEQ ID NO: 1525205 - DNA, 16 bp, Homo sapiens
caatgtgccttgattg

SEQ ID NO: 1525206 - DNA, 13 bp, Homo sapiens
caatgtgctctcg

SEQ ID NO: 1525207 - DNA, 17 bp, Homo sapiens
caatgtggagcagcagc

SEQ ID NO: 1525208 - DNA, 20 bp, Homo sapiens
caatgtggtgacacctcccc

SEQ ID NO: 1525209 - DNA, 23 bp, Homo sapiens
caatgtgttttttcggacatgct

SEQ ID NO: 1525210 - DNA, 14 bp, Homo sapiens
caatgttgagaagt

SEQ ID NO: 1525211 - DNA, 18 bp, Homo sapiens
caatgttggttactaaat

SEQ ID NO: 1525212 - DNA, 13 bp, Homo sapiens
caatgttggtttt

SEQ ID NO: 1525213 - DNA, 19 bp, Homo sapiens
caatgttgtccaacaataa

SEQ ID NO: 1525214 - DNA, 20 bp, Homo sapiens
caatgttgtccaacaataaa

SEQ ID NO: 1525215 - DNA, 20 bp, Homo sapiens
caatgtttatgcaaggaagg

SEQ ID NO: 1525216 - DNA, 19 bp, Homo sapiens
caatgtttcttcatttctc

SEQ ID NO: 1525217 - DNA, 22 bp, Homo sapiens
caatgtttcttcatttctctgc

SEQ ID NO: 1525218 - DNA, 22 bp, Homo sapiens
caattaaaaaaaattaaaacca

SEQ ID NO: 1525219 - DNA, 16 bp, Homo sapiens
caattaagaaattcca

SEQ ID NO: 1525220 - DNA, 16 bp, Homo sapiens
cagccccgacttcctg

SEQ ID NO: 1525221 - DNA, 18 bp, Homo sapiens
cagccccgacttcctgac

SEQ ID NO: 1525222 - DNA, 16 bp, Homo sapiens
cagcccctactgctgt

SEQ ID NO: 1525223 - DNA, 20 bp, Homo sapiens
cagcccctactgctgtgaac

SEQ ID NO: 1525224 - DNA, 16 bp, Homo sapiens
cagcccctcaaaggga

SEQ ID NO: 1525225 - DNA, 17 bp, Homo sapiens
cagcccctcctctgcca

SEQ ID NO: 1525226 - DNA, 13 bp, Homo sapiens
cagcccctctggt

SEQ ID NO: 1525227 - DNA, 21 bp, Homo sapiens
cagcccctcttggagaagtct

SEQ ID NO: 1525228 - DNA, 14 bp, Homo sapiens
cagcccctgcccct

SEQ ID NO: 1525229 - DNA, 21 bp, Homo sapiens
cagccccttctggccggtgct

SEQ ID NO: 1525230 - DNA, 18 bp, Homo sapiens
cagccccttgagaaacct

SEQ ID NO: 1525231 - DNA, 14 bp, Homo sapiens
cagcccgcacacct

SEQ ID NO: 1525232 - DNA, 19 bp, Homo sapiens
cagcccgcccactgggtaa

SEQ ID NO: 1525233 - DNA, 15 bp, Homo sapiens
cagcccgctctctgg

SEQ ID NO: 1525234 - DNA, 16 bp, Homo sapiens
cagcccgctctctggc

SEQ ID NO: 1525235 - DNA, 17 bp, Homo sapiens
cagcccgctctctggct

SEQ ID NO: 1525236 - DNA, 21 bp, Homo sapiens
cagcccgctctctggctgtct

SEQ ID NO: 1525237 - DNA, 14 bp, Homo sapiens
cagcccgctgagtg

SEQ ID NO: 1525238 - DNA, 15 bp, Homo sapiens
cagcccgctgagtgg

SEQ ID NO: 1525239 - DNA, 13 bp, Homo sapiens
cagcccgcttggc

SEQ ID NO: 1525240 - DNA, 14 bp, Homo sapiens
cagcccgcttggcc

SEQ ID NO: 1525241 - DNA, 15 bp, Homo sapiens
cagcccgcttggcca

SEQ ID NO: 1525242 - DNA, 17 bp, Homo sapiens
cagcccgcttggccacc

SEQ ID NO: 1525243 - DNA, 18 bp, Homo sapiens
cagcccggaccttggcag

SEQ ID NO: 1525244 - DNA, 12 bp, Homo sapiens
cagcccggcctg

SEQ ID NO: 1525245 - DNA, 19 bp, Homo sapiens
cagcccggctggttttgta

SEQ ID NO: 1525246 - DNA, 19 bp, Homo sapiens
cagcccgtgaagcagtgcc

SEQ ID NO: 1525247 - DNA, 23 bp, Homo sapiens
cagccctagaggcgagccaggca

SEQ ID NO: 1525248 - DNA, 14 bp, Homo sapiens
cagccctagctgtc

SEQ ID NO: 1525249 - DNA, 22 bp, Homo sapiens
cagccctagctgtcccatgggg

SEQ ID NO: 1525250 - DNA, 18 bp, Homo sapiens
cagccctcacccctggtt

SEQ ID NO: 1525251 - DNA, 12 bp, Homo sapiens
cagccctcacct

SEQ ID NO: 1525252 - DNA, 13 bp, Homo sapiens
cagccctccactt

SEQ ID NO: 1525253 - DNA, 16 bp, Homo sapiens
cagccctccctgtcct

SEQ ID NO: 1525254 - DNA, 17 bp, Homo sapiens
cagccctgagtgtccca

SEQ ID NO: 1525255 - DNA, 22 bp, Homo sapiens
cagccctgagtgtcccaagccg

SEQ ID NO: 1525256 - DNA, 22 bp, Homo sapiens
cagccaaggccgaagctctggc

SEQ ID NO: 1525257 - DNA, 16 bp, Homo sapiens
cagccaagggtcctca

SEQ ID NO: 1525258 - DNA, 19 bp, Homo sapiens
cagccacactgggcctgga

SEQ ID NO: 1525259 - DNA, 13 bp, Homo sapiens
cagccacagaccc

SEQ ID NO: 1525260 - DNA, 17 bp, Homo sapiens
cagccacagacccctgg

SEQ ID NO: 1525261 - DNA, 22 bp, Homo sapiens
cagccacagacccctgggagct

SEQ ID NO: 1525262 - DNA, 13 bp, Homo sapiens
cagccacaggcca

SEQ ID NO: 1525263 - DNA, 12 bp, Homo sapiens
cagccacatgcc

SEQ ID NO: 1525264 - DNA, 11 bp, Homo sapiens
cagccacccaa

SEQ ID NO: 1525265 - DNA, 15 bp, Homo sapiens
cagccacccaagcct

SEQ ID NO: 1525266 - DNA, 17 bp, Homo sapiens
cagccacccaagcctgc

SEQ ID NO: 1525267 - DNA, 16 bp, Homo sapiens
cagccaccctgagttg

SEQ ID NO: 1525268 - DNA, 16 bp, Homo sapiens
cagccaccgtttcttc

SEQ ID NO: 1525269 - DNA, 22 bp, Homo sapiens
cagccaccgtttcttcctgcca

SEQ ID NO: 1525270 - DNA, 23 bp, Homo sapiens
cagccacgcagggccatccactg

SEQ ID NO: 1525271 - DNA, 20 bp, Homo sapiens
cagccacggacgctggctcc

SEQ ID NO: 1525272 - DNA, 13 bp, Homo sapiens
cagccactcaaag

SEQ ID NO: 1525273 - DNA, 14 bp, Homo sapiens
cagccactgcacag

SEQ ID NO: 1525274 - DNA, 12 bp, Homo sapiens
cagccactggct

SEQ ID NO: 1525275 - DNA, 16 bp, Homo sapiens
cagccacttaggacaa

SEQ ID NO: 1525276 - DNA, 13 bp, Homo sapiens
cagccacttggtt

SEQ ID NO: 1525277 - DNA, 20 bp, Homo sapiens
cagccagaaagcactacaat

SEQ ID NO: 1525278 - DNA, 18 bp, Homo sapiens
cagccagaccccacgctg

SEQ ID NO: 1525279 - DNA, 15 bp, Homo sapiens
cagccagacttgctt

SEQ ID NO: 1525280 - DNA, 18 bp, Homo sapiens
cagccagacttgcttcct

SEQ ID NO: 1525281 - DNA, 13 bp, Homo sapiens
cagccagagctgt

SEQ ID NO: 1525282 - DNA, 19 bp, Homo sapiens
cagccagaggcatctgagg

SEQ ID NO: 1525283 - DNA, 20 bp, Homo sapiens
cagccagcaatgatgtccag

SEQ ID NO: 1525284 - DNA, 23 bp, Homo sapiens
cagccagcaatgatgtccagaag

SEQ ID NO: 1525285 - DNA, 14 bp, Homo sapiens
cagccagcaccacc

SEQ ID NO: 1525286 - DNA, 14 bp, Homo sapiens
cagccagcagaggg

SEQ ID NO: 1525287 - DNA, 17 bp, Homo sapiens
cagcaacagaaaaatgg

SEQ ID NO: 1525288 - DNA, 21 bp, Homo sapiens
cagcaacccttcctgctgctg

SEQ ID NO: 1525289 - DNA, 23 bp, Homo sapiens
cagcaacgcaggcccccaggtgc

SEQ ID NO: 1525290 - DNA, 18 bp, Homo sapiens
cagcaactgcccttccag

SEQ ID NO: 1525291 - DNA, 20 bp, Homo sapiens
cagcaacttgtctttttctg

SEQ ID NO: 1525292 - DNA, 20 bp, Homo sapiens
cagcaaggcgcctgccttgg

SEQ ID NO: 1525293 - DNA, 14 bp, Homo sapiens
cagcaaggggctct

SEQ ID NO: 1525294 - DNA, 19 bp, Homo sapiens
cagcaagggtgatgggaaa

SEQ ID NO: 1525295 - DNA, 23 bp, Homo sapiens
cagcaagggtgatgggaaagcat

SEQ ID NO: 1525296 - DNA, 20 bp, Homo sapiens
cagcaagttagagaatctgg

SEQ ID NO: 1525297 - DNA, 19 bp, Homo sapiens
cagcaatatattaccagca

SEQ ID NO: 1525298 - DNA, 18 bp, Homo sapiens
cagcaatgatgtccagaa

SEQ ID NO: 1525299 - DNA, 19 bp, Homo sapiens
cagcaatgccatttcagtg

SEQ ID NO: 1525300 - DNA, 22 bp, Homo sapiens
cagcacaaggccttgcctggcc

SEQ ID NO: 1525301 - DNA, 15 bp, Homo sapiens
cagcacaagggcaca

SEQ ID NO: 1525302 - DNA, 22 bp, Homo sapiens
cagcacaccaagtggctgggtg

SEQ ID NO: 1525303 - DNA, 23 bp, Homo sapiens
cagcacaccaagtggctgggtgc

SEQ ID NO: 1525304 - DNA, 17 bp, Homo sapiens
cagcacaccagccgctg

SEQ ID NO: 1525305 - DNA, 14 bp, Homo sapiens
cagcacacctcagc

SEQ ID NO: 1525306 - DNA, 17 bp, Homo sapiens
cagcacacctcagcccc

SEQ ID NO: 1525307 - DNA, 15 bp, Homo sapiens
cagatatctgcatgt

SEQ ID NO: 1525308 - DNA, 18 bp, Homo sapiens
cagatatgatatgtaaac

SEQ ID NO: 1525309 - DNA, 18 bp, Homo sapiens
cagatatgggactgattc

SEQ ID NO: 1525310 - DNA, 22 bp, Homo sapiens
cagatatgggactgattctgtg

SEQ ID NO: 1525311 - DNA, 23 bp, Homo sapiens
cagatatttccatttcttcctca

SEQ ID NO: 1525312 - DNA, 20 bp, Homo sapiens
cagatattttttcagaaata

SEQ ID NO: 1525313 - DNA, 22 bp, Homo sapiens
cagatcacagcttcagccagga

SEQ ID NO: 1525314 - DNA, 21 bp, Homo sapiens
cagatcaccagcccggcctgc

SEQ ID NO: 1525315 - DNA, 15 bp, Homo sapiens
cagatcactgccaca

SEQ ID NO: 1525316 - DNA, 13 bp, Homo sapiens
cagatcaggaagc

SEQ ID NO: 1525317 - DNA, 18 bp, Homo sapiens
cagatcatcttggaactg

SEQ ID NO: 1525318 - DNA, 23 bp, Homo sapiens
cagatcattatcagcctgtgcca

SEQ ID NO: 1525319 - DNA, 14 bp, Homo sapiens
cagatccagcctgg

SEQ ID NO: 1525320 - DNA, 13 bp, Homo sapiens
cagatccaggact

SEQ ID NO: 1525321 - DNA, 14 bp, Homo sapiens
cagatccagggaca

SEQ ID NO: 1525322 - DNA, 16 bp, Homo sapiens
cagagcaaaataattt

SEQ ID NO: 1525323 - DNA, 19 bp, Homo sapiens
cagagcaaaatgctcttgt

SEQ ID NO: 1525324 - DNA, 21 bp, Homo sapiens
cagagcaaaatgctcttgtcc

SEQ ID NO: 1525325 - DNA, 19 bp, Homo sapiens
cagagcaaatgagggaggg

SEQ ID NO: 1525326 - DNA, 17 bp, Homo sapiens
cagagcaagaccccatc

SEQ ID NO: 1525327 - DNA, 13 bp, Homo sapiens
cagacaaaaacaa

SEQ ID NO: 1525328 - DNA, 14 bp, Homo sapiens
cagactatttgcta

SEQ ID NO: 1525329 - DNA, 15 bp, Homo sapiens
cagaactcactgggg

SEQ ID NO: 1525330 - DNA, 12 bp, Homo sapiens
cagaactcctgt

SEQ ID NO: 1525331 - DNA, 20 bp, Homo sapiens
cagaactcctgtgtgtggaa

SEQ ID NO: 1525332 - DNA, 21 bp, Homo sapiens
cagaactgaaccggctttacc

SEQ ID NO: 1525333 - DNA, 17 bp, Homo sapiens
cagaacttcagaaagac

SEQ ID NO: 1525334 - DNA, 17 bp, Homo sapiens
cagaacttgctgctgtc

SEQ ID NO: 1525335 - DNA, 16 bp, Homo sapiens
cagaagaaaacttttg

SEQ ID NO: 1525336 - DNA, 18 bp, Homo sapiens
cactggccaccaggctgg

SEQ ID NO: 1525337 - DNA, 21 bp, Homo sapiens
cactggccaccaggctggcgc

SEQ ID NO: 1525338 - DNA, 11 bp, Homo sapiens
cactggccaga

SEQ ID NO: 1525339 - DNA, 20 bp, Homo sapiens
cactggccagagagggccca

SEQ ID NO: 1525340 - DNA, 22 bp, Homo sapiens
cactggccagagagggcccagc

SEQ ID NO: 1525341 - DNA, 12 bp, Homo sapiens
cactggcctggg

SEQ ID NO: 1525342 - DNA, 13 bp, Homo sapiens
cactggcgccttc

SEQ ID NO: 1525343 - DNA, 16 bp, Homo sapiens
cactggcgccttctcg

SEQ ID NO: 1525344 - DNA, 17 bp, Homo sapiens
cactggctggcctgagc

SEQ ID NO: 1525345 - DNA, 18 bp, Homo sapiens
cactggctggcctgagca

SEQ ID NO: 1525346 - DNA, 16 bp, Homo sapiens
cactggctggggcaga

SEQ ID NO: 1525347 - DNA, 18 bp, Homo sapiens
cactggctggggcagagg

SEQ ID NO: 1525348 - DNA, 23 bp, Homo sapiens
cactggctggggcagaggggcag

SEQ ID NO: 1525349 - DNA, 21 bp, Homo sapiens
cactgggaagaagcaagggca

SEQ ID NO: 1525350 - DNA, 15 bp, Homo sapiens
cactgggacagctgg

SEQ ID NO: 1525351 - DNA, 17 bp, Homo sapiens
cactgggacagctggct

SEQ ID NO: 1525352 - DNA, 23 bp, Homo sapiens
cactgggacagctggctgggcct

SEQ ID NO: 1525353 - DNA, 14 bp, Homo sapiens
cactgggcacctgc

SEQ ID NO: 1525354 - DNA, 14 bp, Homo sapiens
cactgggcagcaag

SEQ ID NO: 1525355 - DNA, 17 bp, Homo sapiens
cactgggcagcaaggct

SEQ ID NO: 1525356 - DNA, 16 bp, Homo sapiens
cactgggccacggagg

SEQ ID NO: 1525357 - DNA, 13 bp, Homo sapiens
cactgggcctgga

SEQ ID NO: 1525358 - DNA, 21 bp, Homo sapiens
cactggggagcccgtctcagt

SEQ ID NO: 1525359 - DNA, 14 bp, Homo sapiens
cactggggcctaca

SEQ ID NO: 1525360 - DNA, 19 bp, Homo sapiens
cactggggtcctggggcct

SEQ ID NO: 1525361 - DNA, 13 bp, Homo sapiens
cactggggtgggg

SEQ ID NO: 1525362 - DNA, 19 bp, Homo sapiens
cactgggtctcactcctga

SEQ ID NO: 1525363 - DNA, 21 bp, Homo sapiens
cactgggtctcactcctgagt

SEQ ID NO: 1525364 - DNA, 13 bp, Homo sapiens
cactgggtgagag

SEQ ID NO: 1525365 - DNA, 19 bp, Homo sapiens
cactgggtgcgtctccagt

SEQ ID NO: 1525366 - DNA, 18 bp, Homo sapiens
cactgggtggggtgagga

SEQ ID NO: 1525367 - DNA, 23 bp, Homo sapiens
cactgggtggggtgaggaccact

SEQ ID NO: 1525368 - DNA, 18 bp, Homo sapiens
cactgggtggtggcctgg

SEQ ID NO: 1525369 - DNA, 20 bp, Homo sapiens
cactgggtggtggcctggtc

SEQ ID NO: 1525370 - DNA, 15 bp, Homo sapiens
cactggtaaatgtta

SEQ ID NO: 1525371 - DNA, 22 bp, Homo sapiens
cactggtaggttgggacaccag

SEQ ID NO: 1525372 - DNA, 20 bp, Homo sapiens
cactggtccaggtcttcagt

SEQ ID NO: 1525373 - DNA, 17 bp, Homo sapiens
cactggtctaatgtttg

SEQ ID NO: 1525374 - DNA, 14 bp, Homo sapiens
cactggtggcatcg

SEQ ID NO: 1525375 - DNA, 13 bp, Homo sapiens
cactggtggcccg

SEQ ID NO: 1525376 - DNA, 22 bp, Homo sapiens
cactggtggcccgacagcctgg

SEQ ID NO: 1525377 - DNA, 21 bp, Homo sapiens
cactggttaaaataaagccta

SEQ ID NO: 1525378 - DNA, 15 bp, Homo sapiens
cactggttaaattaa

SEQ ID NO: 1525379 - DNA, 16 bp, Homo sapiens
cactggttaaattaac

SEQ ID NO: 1525380 - DNA, 15 bp, Homo sapiens
cactggtttctcaga

SEQ ID NO: 1525381 - DNA, 16 bp, Homo sapiens
cactggtttctcagaa

SEQ ID NO: 1525382 - DNA, 17 bp, Homo sapiens
cactggtttgccaggcc

SEQ ID NO: 1525383 - DNA, 18 bp, Homo sapiens
cactggtttgccaggcca

SEQ ID NO: 1525384 - DNA, 19 bp, Homo sapiens
cactggtttgccaggccaa

SEQ ID NO: 1525385 - DNA, 12 bp, Homo sapiens
cactgtaaaatg

SEQ ID NO: 1525386 - DNA, 14 bp, Homo sapiens
cactgtaaaatgaa

SEQ ID NO: 1525387 - DNA, 18 bp, Homo sapiens
cactgtaaaatgaaatta

SEQ ID NO: 1525388 - DNA, 13 bp, Homo sapiens
cactgtaaagaca

SEQ ID NO: 1525389 - DNA, 14 bp, Homo sapiens
cactgtaaagacaa

SEQ ID NO: 1525390 - DNA, 20 bp, Homo sapiens
cactgtaaagacaaataaat

SEQ ID NO: 1525391 - DNA, 18 bp, Homo sapiens
cactgtaacctgattcat

SEQ ID NO: 1525392 - DNA, 14 bp, Homo sapiens
cactgtaagtttat

SEQ ID NO: 1525393 - DNA, 17 bp, Homo sapiens
cactgtaatgaggaaaa

SEQ ID NO: 1525394 - DNA, 22 bp, Homo sapiens
cactgtaatgaggaaaaaatgg

SEQ ID NO: 1525395 - DNA, 21 bp, Homo sapiens
cactgtagcattacagtgggt

SEQ ID NO: 1525396 - DNA, 15 bp, Homo sapiens
cactgtagttctaag

SEQ ID NO: 1525397 - DNA, 18 bp, Homo sapiens
cactgtagttctaagact

SEQ ID NO: 1525398 - DNA, 21 bp, Homo sapiens
cactgtagtttttgaaaatta

SEQ ID NO: 1525399 - DNA, 22 bp, Homo sapiens
cactgtagtttttgaaaattat

SEQ ID NO: 1525400 - DNA, 16 bp, Homo sapiens
cactgtatataaacat

SEQ ID NO: 1525401 - DNA, 18 bp, Homo sapiens
cactgtatataaacatat

SEQ ID NO: 1525402 - DNA, 14 bp, Homo sapiens
cactgtatccaggt

SEQ ID NO: 1525403 - DNA, 15 bp, Homo sapiens
cactgtatgatttat

SEQ ID NO: 1525404 - DNA, 18 bp, Homo sapiens
cactgtatgctggacggc

SEQ ID NO: 1525405 - DNA, 13 bp, Homo sapiens
cactgtcactgcc

SEQ ID NO: 1525406 - DNA, 22 bp, Homo sapiens
cactgtcccagtagccaaggcc

SEQ ID NO: 1525407 - DNA, 15 bp, Homo sapiens
cactgtcctgggcct

SEQ ID NO: 1525408 - DNA, 16 bp, Homo sapiens
cactgtcctgggcgcc

SEQ ID NO: 1525409 - DNA, 21 bp, Homo sapiens
cactgtcctgggcgccctgga

SEQ ID NO: 1525410 - DNA, 13 bp, Homo sapiens
cactgtcctgtga

SEQ ID NO: 1525411 - DNA, 20 bp, Homo sapiens
cactgtccttccctgccact

SEQ ID NO: 1525412 - DNA, 18 bp, Homo sapiens
cactgtcgcccaggctgg

SEQ ID NO: 1525413 - DNA, 17 bp, Homo sapiens
cactgtctagagcaact

SEQ ID NO: 1525414 - DNA, 12 bp, Homo sapiens
cactgtctcagt

SEQ ID NO: 1525415 - DNA, 13 bp, Homo sapiens
cactgtgaagagc

SEQ ID NO: 1525416 - DNA, 17 bp, Homo sapiens
cactgtgaaggaccctt

SEQ ID NO: 1525417 - DNA, 17 bp, Homo sapiens
cactgtgaatcctggca

SEQ ID NO: 1525418 - DNA, 18 bp, Homo sapiens
cactgtgccctggtggag

SEQ ID NO: 1525419 - DNA, 20 bp, Homo sapiens
cactgtgcctcagagaccag

SEQ ID NO: 1525420 - DNA, 14 bp, Homo sapiens
cactgtgctcagcc

SEQ ID NO: 1525421 - DNA, 15 bp, Homo sapiens
cactgtgctcagcca

SEQ ID NO: 1525422 - DNA, 18 bp, Homo sapiens
cactgtgctccaacctga

SEQ ID NO: 1525423 - DNA, 17 bp, Homo sapiens
cactgtggccacagccc

SEQ ID NO: 1525424 - DNA, 13 bp, Homo sapiens
cactgtggtggca

SEQ ID NO: 1525425 - DNA, 15 bp, Homo sapiens
cactgtggtttcaga

SEQ ID NO: 1525426 - DNA, 16 bp, Homo sapiens
cactgtggtttcagat

SEQ ID NO: 1525427 - DNA, 20 bp, Homo sapiens
cactgtgtcacccagactgg

SEQ ID NO: 1525428 - DNA, 22 bp, Homo sapiens
cactgtgtgctgactgaacatt

SEQ ID NO: 1525429 - DNA, 18 bp, Homo sapiens
cactgttccctctggctt

SEQ ID NO: 1525430 - DNA, 17 bp, Homo sapiens
cactgttgagccccagt

SEQ ID NO: 1525431 - DNA, 20 bp, Homo sapiens
cactgttgagccccagtgct

SEQ ID NO: 1525432 - DNA, 20 bp, Homo sapiens
cactgttgcagtggcctggc

SEQ ID NO: 1525433 - DNA, 11 bp, Homo sapiens
cactgtttaag

SEQ ID NO: 1525434 - DNA, 19 bp, Homo sapiens
cactgtttatacactgtgt

SEQ ID NO: 1525435 - DNA, 22 bp, Homo sapiens
cactgtttctcttgagctggcc

SEQ ID NO: 1525436 - DNA, 14 bp, Homo sapiens
cacagccgcagcct

SEQ ID NO: 1525437 - DNA, 22 bp, Homo sapiens
cacagccgcagcctccctctga

SEQ ID NO: 1525438 - DNA, 14 bp, Homo sapiens
cacagcctcccccg

SEQ ID NO: 1525439 - DNA, 16 bp, Homo sapiens
cacagcctccttctgt

SEQ ID NO: 1525440 - DNA, 14 bp, Homo sapiens
cacagcctgggccc

SEQ ID NO: 1525441 - DNA, 16 bp, Homo sapiens
cacagcgagggcagct

SEQ ID NO: 1525442 - DNA, 18 bp, Homo sapiens
cacagcgagggcagctgc

SEQ ID NO: 1525443 - DNA, 16 bp, Homo sapiens
cacagcggaggagacc

SEQ ID NO: 1525444 - DNA, 22 bp, Homo sapiens
cacagcgtccctagcagtgaac

SEQ ID NO: 1525445 - DNA, 14 bp, Homo sapiens
cacagcgtccctgg

SEQ ID NO: 1525446 - DNA, 15 bp, Homo sapiens
cacagcgtctgctca

SEQ ID NO: 1525447 - DNA, 16 bp, Homo sapiens
cacagcgtctgctcat

SEQ ID NO: 1525448 - DNA, 15 bp, Homo sapiens
cacagctacctcttc

SEQ ID NO: 1525449 - DNA, 21 bp, Homo sapiens
cacagctactcagtggggctg

SEQ ID NO: 1525450 - DNA, 23 bp, Homo sapiens
cacagctactcagtggggctggc

SEQ ID NO: 1525451 - DNA, 19 bp, Homo sapiens
cacagctcagctgcccatc

SEQ ID NO: 1525452 - DNA, 20 bp, Homo sapiens
cacagctccgagctgtagga

SEQ ID NO: 1525453 - DNA, 22 bp, Homo sapiens
cacagctcctcttaccgtagcc

SEQ ID NO: 1525454 - DNA, 14 bp, Homo sapiens
cacagctcctgcca

SEQ ID NO: 1525455 - DNA, 17 bp, Homo sapiens
cacagctcctgccaggg

SEQ ID NO: 1525456 - DNA, 14 bp, Homo sapiens
cacagctcttcatt

SEQ ID NO: 1525457 - DNA, 20 bp, Homo sapiens
cacagctcttcattccattg

SEQ ID NO: 1525458 - DNA, 16 bp, Homo sapiens
cacagctgagcactta

SEQ ID NO: 1525459 - DNA, 12 bp, Homo sapiens
cacagctgccct

SEQ ID NO: 1525460 - DNA, 21 bp, Homo sapiens
cacagctgccctagctgaccc

SEQ ID NO: 1525461 - DNA, 15 bp, Homo sapiens
cacagctgctggaga

SEQ ID NO: 1525462 - DNA, 22 bp, Homo sapiens
cacagctgcttgtcctgctctc

SEQ ID NO: 1525463 - DNA, 23 bp, Homo sapiens
cacagctggaaagttgggcccct

SEQ ID NO: 1525464 - DNA, 12 bp, Homo sapiens
cacagctgggca

SEQ ID NO: 1525465 - DNA, 13 bp, Homo sapiens
cacagctgggcat

SEQ ID NO: 1525466 - DNA, 23 bp, Homo sapiens
cacagctgggcatgccatgtctg

SEQ ID NO: 1525467 - DNA, 19 bp, Homo sapiens
cacagcttcagccaggagc

SEQ ID NO: 1525468 - DNA, 13 bp, Homo sapiens
cacagcttctcca

SEQ ID NO: 1525469 - DNA, 22 bp, Homo sapiens
cacagcttgacctgaggctgtg

SEQ ID NO: 1525470 - DNA, 14 bp, Homo sapiens
cacagcttttgcaa

SEQ ID NO: 1525471 - DNA, 12 bp, Homo sapiens
cacaggaaaagg

SEQ ID NO: 1525472 - DNA, 16 bp, Homo sapiens
cacaggaagctcagcc

SEQ ID NO: 1525473 - DNA, 17 bp, Homo sapiens
cacaggaagctcagcct

SEQ ID NO: 1525474 - DNA, 15 bp, Homo sapiens
cacaggacagcggga

SEQ ID NO: 1525475 - DNA, 21 bp, Homo sapiens
cacaggaggcaggcatggccc

SEQ ID NO: 1525476 - DNA, 15 bp, Homo sapiens
cacaggagggccagc

SEQ ID NO: 1525477 - DNA, 20 bp, Homo sapiens
cacaggagtcttcagaccca

SEQ ID NO: 1525478 - DNA, 20 bp, Homo sapiens
cacaggagtgtcctcttccc

SEQ ID NO: 1525479 - DNA, 16 bp, Homo sapiens
cacaggcaaaatcctt

SEQ ID NO: 1525480 - DNA, 13 bp, Homo sapiens
cacaggcaactga

SEQ ID NO: 1525481 - DNA, 18 bp, Homo sapiens
cacaggcaactgaggcag

SEQ ID NO: 1525482 - DNA, 22 bp, Homo sapiens
cacaggcaactgaggcagacag

SEQ ID NO: 1525483 - DNA, 23 bp, Homo sapiens
cacaggcaactgaggcagacagc

SEQ ID NO: 1525484 - DNA, 16 bp, Homo sapiens
cacaggcagtgcatgt

SEQ ID NO: 1525485 - DNA, 23 bp, Homo sapiens
cacaggccaaatccttggagtcc

SEQ ID NO: 1525486 - DNA, 21 bp, Homo sapiens
cacaggccccccgcagcaccc

SEQ ID NO: 1525487 - DNA, 23 bp, Homo sapiens
cacaggccccccgcagcaccctg

SEQ ID NO: 1525488 - DNA, 21 bp, Homo sapiens
cacaggcccccttgagtgggg

SEQ ID NO: 1525489 - DNA, 14 bp, Homo sapiens
cacaggccctagct

SEQ ID NO: 1525490 - DNA, 12 bp, Homo sapiens
cacaggccctgg

SEQ ID NO: 1525491 - DNA, 23 bp, Homo sapiens
cacaggcccttcctctccactgc

SEQ ID NO: 1525492 - DNA, 14 bp, Homo sapiens
cacaggcctctgcc

SEQ ID NO: 1525493 - DNA, 15 bp, Homo sapiens
cacaggcctctgcct

SEQ ID NO: 1525494 - DNA, 16 bp, Homo sapiens
cacaggcctctgcctg

SEQ ID NO: 1525495 - DNA, 23 bp, Homo sapiens
cacaggcctctgcctgctgggga

SEQ ID NO: 1525496 - DNA, 13 bp, Homo sapiens
cacaggcctgaga

SEQ ID NO: 1525497 - DNA, 22 bp, Homo sapiens
cacaggcctgagatttcatctg

SEQ ID NO: 1525498 - DNA, 12 bp, Homo sapiens
cacagggaccag

SEQ ID NO: 1525499 - DNA, 17 bp, Homo sapiens
cacagggaccagggcca

SEQ ID NO: 1525500 - DNA, 19 bp, Homo sapiens
cacagggcaccagaggccg

SEQ ID NO: 1525501 - DNA, 20 bp, Homo sapiens
cacagggcaccagaggccga

SEQ ID NO: 1525502 - DNA, 14 bp, Homo sapiens
cacagggccccaga

SEQ ID NO: 1525503 - DNA, 22 bp, Homo sapiens
cacagggcccggccacacccag

SEQ ID NO: 1525504 - DNA, 21 bp, Homo sapiens
cacagggcggtaccttgtgcc

SEQ ID NO: 1525505 - DNA, 23 bp, Homo sapiens
cacagggcggtaccttgtgccca

SEQ ID NO: 1525506 - DNA, 13 bp, Homo sapiens
cacagggctcttt

SEQ ID NO: 1525507 - DNA, 23 bp, Homo sapiens
cacagggctctttgatggaccca

SEQ ID NO: 1525508 - DNA, 15 bp, Homo sapiens
cacaggggcaggcct

SEQ ID NO: 1525509 - DNA, 19 bp, Homo sapiens
cacaggggcaggcctggga

SEQ ID NO: 1525510 - DNA, 20 bp, Homo sapiens
cacaggggcaggcctgggac

SEQ ID NO: 1525511 - DNA, 15 bp, Homo sapiens
cacaggggccccaga

SEQ ID NO: 1525512 - DNA, 16 bp, Homo sapiens
cacaggggcggggcag

SEQ ID NO: 1525513 - DNA, 16 bp, Homo sapiens
cacagggtctgctctt

SEQ ID NO: 1525514 - DNA, 19 bp, Homo sapiens
cacagggtctgctctttct

SEQ ID NO: 1525515 - DNA, 17 bp, Homo sapiens
cacagggtgtggtatga

SEQ ID NO: 1525516 - DNA, 22 bp, Homo sapiens
cacagggttgggcccagatctg

SEQ ID NO: 1525517 - DNA, 23 bp, Homo sapiens
cacagggttgggcccagatctgg

SEQ ID NO: 1525518 - DNA, 19 bp, Homo sapiens
cacaggtgcaacagacttg

SEQ ID NO: 1525519 - DNA, 18 bp, Homo sapiens
cacaggtgccgccagctg

SEQ ID NO: 1525520 - DNA, 21 bp, Homo sapiens
cacaggtgccgccagctgccg

SEQ ID NO: 1525521 - DNA, 23 bp, Homo sapiens
cacaggtgccgccagctgccgca

SEQ ID NO: 1525522 - DNA, 20 bp, Homo sapiens
cacaggttttttcaatttat

SEQ ID NO: 1525523 - DNA, 18 bp, Homo sapiens
cacagtacaataatgtac

SEQ ID NO: 1525524 - DNA, 14 bp, Homo sapiens
cacagtacatatgt

SEQ ID NO: 1525525 - DNA, 19 bp, Homo sapiens
cacagtacgaacctacagt

SEQ ID NO: 1525526 - DNA, 15 bp, Homo sapiens
cacagtactttccag

SEQ ID NO: 1525527 - DNA, 15 bp, Homo sapiens
cacagtagagccagc

SEQ ID NO: 1525528 - DNA, 22 bp, Homo sapiens
cacagtatgagaagaaaaatgg

SEQ ID NO: 1525529 - DNA, 16 bp, Homo sapiens
cacagtcactgatgta

SEQ ID NO: 1525530 - DNA, 19 bp, Homo sapiens
cacagtcactgatgtacaa

SEQ ID NO: 1525531 - DNA, 15 bp, Homo sapiens
cacagtcagaaggac

SEQ ID NO: 1525532 - DNA, 17 bp, Homo sapiens
cacagtcattctaggat

SEQ ID NO: 1525533 - DNA, 14 bp, Homo sapiens
cacagtctctggaa

SEQ ID NO: 1525534 - DNA, 15 bp, Homo sapiens
cacagtctctggaaa

SEQ ID NO: 1525535 - DNA, 15 bp, Homo sapiens
cacagtgacactgga

SEQ ID NO: 1525536 - DNA, 21 bp, Homo sapiens
cacagtgactttacaggaggt

SEQ ID NO: 1525537 - DNA, 19 bp, Homo sapiens
cacagtgatgaatgtacta

SEQ ID NO: 1525538 - DNA, 14 bp, Homo sapiens
cacagtgcatctca

SEQ ID NO: 1525539 - DNA, 18 bp, Homo sapiens
cacagtgcatctcagccc

SEQ ID NO: 1525540 - DNA, 17 bp, Homo sapiens
cacagtgccttcaataa

SEQ ID NO: 1525541 - DNA, 18 bp, Homo sapiens
cacagtgccttcaataaa

SEQ ID NO: 1525542 - DNA, 18 bp, Homo sapiens
cacagtgctcttttctcc

SEQ ID NO: 1525543 - DNA, 11 bp, Homo sapiens
cacagtgctgc

SEQ ID NO: 1525544 - DNA, 18 bp, Homo sapiens
cacagtggactcagcagt

SEQ ID NO: 1525545 - DNA, 19 bp, Homo sapiens
cacagtggactcagcagtg

SEQ ID NO: 1525546 - DNA, 20 bp, Homo sapiens
cacagtggactcagcagtga

SEQ ID NO: 1525547 - DNA, 21 bp, Homo sapiens
cacagtggattccagtgcatg

SEQ ID NO: 1525548 - DNA, 17 bp, Homo sapiens
cacagtggctcacgcct

SEQ ID NO: 1525549 - DNA, 18 bp, Homo sapiens
cacagtgggagccagggc

SEQ ID NO: 1525550 - DNA, 19 bp, Homo sapiens
cacagtgggatgaaccagc

SEQ ID NO: 1525551 - DNA, 19 bp, Homo sapiens
cacagtgggcctgtgtgtg

SEQ ID NO: 1525552 - DNA, 22 bp, Homo sapiens
cacagtgggcctgtgtgtgtgc

SEQ ID NO: 1525553 - DNA, 17 bp, Homo sapiens
cacagtgggtggcacct

SEQ ID NO: 1525554 - DNA, 20 bp, Homo sapiens
cacagtgggtggcacctcct

SEQ ID NO: 1525555 - DNA, 22 bp, Homo sapiens
cacagtgggtggcacctcctga

SEQ ID NO: 1525556 - DNA, 23 bp, Homo sapiens
cacagtgggtggcacctcctgag

SEQ ID NO: 1525557 - DNA, 20 bp, Homo sapiens
cacagtgtctgttcagcaaa

SEQ ID NO: 1525558 - DNA, 19 bp, Homo sapiens
cacagtgttgcccaggctg

SEQ ID NO: 1525559 - DNA, 10 bp, Homo sapiens
cacagtgttt

SEQ ID NO: 1525560 - DNA, 14 bp, Homo sapiens
cacagttcctggga

SEQ ID NO: 1525561 - DNA, 18 bp, Homo sapiens
cacagttctttgggccag

SEQ ID NO: 1525562 - DNA, 21 bp, Homo sapiens
cacagttctttgggccagaca

SEQ ID NO: 1525563 - DNA, 18 bp, Homo sapiens
cacagttgggacccaaaa

SEQ ID NO: 1525564 - DNA, 22 bp, Homo sapiens
cacagttttagaataaggagga

SEQ ID NO: 1525565 - DNA, 14 bp, Homo sapiens
cacagttttctgag

SEQ ID NO: 1525566 - DNA, 16 bp, Homo sapiens
cacagttttctgagaa

SEQ ID NO: 1525567 - DNA, 17 bp, Homo sapiens
cacagttttctgagaaa

SEQ ID NO: 1525568 - DNA, 19 bp, Homo sapiens
cacagttttctgagaaaga

SEQ ID NO: 1525569 - DNA, 17 bp, Homo sapiens
cacagttttgaaagaaa

SEQ ID NO: 1525570 - DNA, 21 bp, Homo sapiens
cacagttttgaaagaaaaata

SEQ ID NO: 1525571 - DNA, 12 bp, Homo sapiens
cacataaaactt

SEQ ID NO: 1525572 - DNA, 18 bp, Homo sapiens
cacataaaagccccagct

SEQ ID NO: 1525573 - DNA, 19 bp, Homo sapiens
cacataaatctgtctgatt

SEQ ID NO: 1525574 - DNA, 14 bp, Homo sapiens
cacataagaaggca

SEQ ID NO: 1525575 - DNA, 19 bp, Homo sapiens
cacataagcccagttcatc

SEQ ID NO: 1525576 - DNA, 19 bp, Homo sapiens
cacataagctcagaatcca

SEQ ID NO: 1525577 - DNA, 22 bp, Homo sapiens
cacatacaacacaaagagaaaa

SEQ ID NO: 1525578 - DNA, 15 bp, Homo sapiens
cacataccttcatgt

SEQ ID NO: 1525579 - DNA, 16 bp, Homo sapiens
cacatacgtgcacagg

SEQ ID NO: 1525580 - DNA, 23 bp, Homo sapiens
cacatacgtgttaggaggctgca

SEQ ID NO: 1525581 - DNA, 21 bp, Homo sapiens
cacatagattaatggcactga

SEQ ID NO: 1525582 - DNA, 22 bp, Homo sapiens
cacatagattaatggcactgat

SEQ ID NO: 1525583 - DNA, 21 bp, Homo sapiens
cacatagcaggggcaccttcc

SEQ ID NO: 1525584 - DNA, 18 bp, Homo sapiens
cacatagcatgtaatggt

SEQ ID NO: 1525585 - DNA, 16 bp, Homo sapiens
cacatagctgtctaga

SEQ ID NO: 1525586 - DNA, 14 bp, Homo sapiens
cacatataacatgc

SEQ ID NO: 1525587 - DNA, 22 bp, Homo sapiens
cacatatgcaccttgtgtctgt

SEQ ID NO: 1525588 - DNA, 16 bp, Homo sapiens
cacatatttgaagggt

SEQ ID NO: 1525589 - DNA, 12 bp, Homo sapiens
cacatattttaa

SEQ ID NO: 1525590 - DNA, 18 bp, Homo sapiens
cacatcaaataagaaata

SEQ ID NO: 1525591 - DNA, 17 bp, Homo sapiens
cacatcagtgaggaggg

SEQ ID NO: 1525592 - DNA, 16 bp, Homo sapiens
cacatccagccttgga

SEQ ID NO: 1525593 - DNA, 12 bp, Homo sapiens
cacatccatccc

SEQ ID NO: 1525594 - DNA, 12 bp, Homo sapiens
cacatcccagga

SEQ ID NO: 1525595 - DNA, 16 bp, Homo sapiens
cacatcccattgggac

SEQ ID NO: 1525596 - DNA, 20 bp, Homo sapiens
cacatcccggcctcttccac

SEQ ID NO: 1525597 - DNA, 19 bp, Homo sapiens
cacatccgcgtgtgcctgt

SEQ ID NO: 1525598 - DNA, 15 bp, Homo sapiens
cacatctaattaaat

SEQ ID NO: 1525599 - DNA, 16 bp, Homo sapiens
cacatctaattaaatg

SEQ ID NO: 1525600 - DNA, 13 bp, Homo sapiens
cacatctgctcta

SEQ ID NO: 1525601 - DNA, 13 bp, Homo sapiens
cacatctggccct

SEQ ID NO: 1525602 - DNA, 14 bp, Homo sapiens
cacatctggccctg

SEQ ID NO: 1525603 - DNA, 16 bp, Homo sapiens
cacatctggccctgac

SEQ ID NO: 1525604 - DNA, 16 bp, Homo sapiens
cacatctttactcagg

SEQ ID NO: 1525605 - DNA, 15 bp, Homo sapiens
cacatctttatctgt

SEQ ID NO: 1525606 - DNA, 21 bp, Homo sapiens
cacatctttcacacttccacc

SEQ ID NO: 1525607 - DNA, 21 bp, Homo sapiens
cacatctttcctcaagtatct

SEQ ID NO: 1525608 - DNA, 21 bp, Homo sapiens
cacatgaaacctacacactgt

SEQ ID NO: 1525609 - DNA, 22 bp, Homo sapiens
cacatgaacagcttgccaggga

SEQ ID NO: 1525610 - DNA, 14 bp, Homo sapiens
cacatgaataattt

SEQ ID NO: 1525611 - DNA, 16 bp, Homo sapiens
cacatgaataatttca

SEQ ID NO: 1525612 - DNA, 15 bp, Homo sapiens
cacatgaggccatct

SEQ ID NO: 1525613 - DNA, 21 bp, Homo sapiens
cacatgaggccatctcaggag

SEQ ID NO: 1525614 - DNA, 13 bp, Homo sapiens
cacatgccctcct

SEQ ID NO: 1525615 - DNA, 16 bp, Homo sapiens
cacatgccctcctgga

SEQ ID NO: 1525616 - DNA, 21 bp, Homo sapiens
cacatgccgcgggcggccagg

SEQ ID NO: 1525617 - DNA, 23 bp, Homo sapiens
cacatgccttgcaatggatcagc

SEQ ID NO: 1525618 - DNA, 21 bp, Homo sapiens
cacatgctatgttctgtcttc

SEQ ID NO: 1525619 - DNA, 17 bp, Homo sapiens
cacatgctgtctggccc

SEQ ID NO: 1525620 - DNA, 15 bp, Homo sapiens
cacatggacagactt

SEQ ID NO: 1525621 - DNA, 22 bp, Homo sapiens
cacatggagccccctctgccgg

SEQ ID NO: 1525622 - DNA, 20 bp, Homo sapiens
cacatggccatagaggccca

SEQ ID NO: 1525623 - DNA, 21 bp, Homo sapiens
cacatggccatagaggcccag

SEQ ID NO: 1525624 - DNA, 22 bp, Homo sapiens
cacatggggcctggcccacgcc

SEQ ID NO: 1525625 - DNA, 16 bp, Homo sapiens
cacatggggttcctgg

SEQ ID NO: 1525626 - DNA, 17 bp, Homo sapiens
cacatggggttcctggt

SEQ ID NO: 1525627 - DNA, 15 bp, Homo sapiens
cacatgtaaaatatg

SEQ ID NO: 1525628 - DNA, 19 bp, Homo sapiens
cacatgtgtccatcccagc

SEQ ID NO: 1525629 - DNA, 16 bp, Homo sapiens
cacatgttgttctcat

SEQ ID NO: 1525630 - DNA, 17 bp, Homo sapiens
cacattaactccctcca

SEQ ID NO: 1525631 - DNA, 24 bp, Homo sapiens
cacattaactccctccaccagcct

SEQ ID NO: 1525632 - DNA, 18 bp, Homo sapiens
cacattaatatttgctga

SEQ ID NO: 1525633 - DNA, 20 bp, Homo sapiens
cacattactagagttggcat

SEQ ID NO: 1525634 - DNA, 20 bp, Homo sapiens
cacattagattttattttac

SEQ ID NO: 1525635 - DNA, 15 bp, Homo sapiens
cacattaggctgttg

SEQ ID NO: 1525636 - DNA, 13 bp, Homo sapiens
cacattatttgca

SEQ ID NO: 1525637 - DNA, 14 bp, Homo sapiens
cacattatttgcat

SEQ ID NO: 1525638 - DNA, 16 bp, Homo sapiens
cacattccacatctgt

SEQ ID NO: 1525639 - DNA, 23 bp, Homo sapiens
cacattcctggccccgggctctg

SEQ ID NO: 1525640 - DNA, 18 bp, Homo sapiens
cacattcgggaccaatat

SEQ ID NO: 1525641 - DNA, 20 bp, Homo sapiens
cacattcgggaccaatatat

SEQ ID NO: 1525642 - DNA, 13 bp, Homo sapiens
cacattcttggct

SEQ ID NO: 1525643 - DNA, 23 bp, Homo sapiens
cacattgatgtaaggactgtaaa

SEQ ID NO: 1525644 - DNA, 13 bp, Homo sapiens
cacattgccttct

SEQ ID NO: 1525645 - DNA, 16 bp, Homo sapiens
cacattgccttctgga

SEQ ID NO: 1525646 - DNA, 13 bp, Homo sapiens
cacattgctggct

SEQ ID NO: 1525647 - DNA, 17 bp, Homo sapiens
cacattgttgttttttt

SEQ ID NO: 1525648 - DNA, 15 bp, Homo sapiens
cacattgttttaaaa

SEQ ID NO: 1525649 - DNA, 16 bp, Homo sapiens
cacattgttttaaaaa

SEQ ID NO: 1525650 - DNA, 18 bp, Homo sapiens
cacatttaccctttggcc

SEQ ID NO: 1525651 - DNA, 14 bp, Homo sapiens
cacatttatatata

SEQ ID NO: 1525652 - DNA, 13 bp, Homo sapiens
cacatttctaaaa

SEQ ID NO: 1525653 - DNA, 19 bp, Homo sapiens
cacatttctttgcattcca

SEQ ID NO: 1525654 - DNA, 13 bp, Homo sapiens
cacatttcttttt

SEQ ID NO: 1525655 - DNA, 14 bp, Homo sapiens
cacatttgatgtac

SEQ ID NO: 1525656 - DNA, 18 bp, Homo sapiens
cacatttgatgtacatgt

SEQ ID NO: 1525657 - DNA, 18 bp, Homo sapiens
cacatttgggctcagggt

SEQ ID NO: 1525658 - DNA, 20 bp, Homo sapiens
cacatttggtaatgttttta

SEQ ID NO: 1525659 - DNA, 20 bp, Homo sapiens
cacatttgtcactgaataat

SEQ ID NO: 1525660 - DNA, 17 bp, Homo sapiens
cacatttgtcagtattt

SEQ ID NO: 1525661 - DNA, 19 bp, Homo sapiens
cacatttgtcagtattttt

SEQ ID NO: 1525662 - DNA, 22 bp, Homo sapiens
cacatttgtcagtatttttgcc

SEQ ID NO: 1525663 - DNA, 12 bp, Homo sapiens
cacattttgtat

SEQ ID NO: 1525664 - DNA, 13 bp, Homo sapiens
caccaaaaaatat

SEQ ID NO: 1525665 - DNA, 16 bp, Homo sapiens
caccaaactgcacaca

SEQ ID NO: 1525666 - DNA, 21 bp, Homo sapiens
caccaaactgcacacacagct

SEQ ID NO: 1525667 - DNA, 13 bp, Homo sapiens
caccaaagctgcc

SEQ ID NO: 1525668 - DNA, 14 bp, Homo sapiens
caccagccccccgc

SEQ ID NO: 1525669 - DNA, 16 bp, Homo sapiens
caccagccccccgcgc

SEQ ID NO: 1525670 - DNA, 16 bp, Homo sapiens
caccagcccggcctgc

SEQ ID NO: 1525671 - DNA, 14 bp, Homo sapiens
caccagcctaagaa

SEQ ID NO: 1525672 - DNA, 13 bp, Homo sapiens
caccagcctgcac

SEQ ID NO: 1525673 - DNA, 16 bp, Homo sapiens
caccagcctgctgaca

SEQ ID NO: 1525674 - DNA, 21 bp, Homo sapiens
caccagcctgctgacagacac

SEQ ID NO: 1525675 - DNA, 11 bp, Homo sapiens
caccagctctg

SEQ ID NO: 1525676 - DNA, 17 bp, Homo sapiens
caccagctctgtggcct

SEQ ID NO: 1525677 - DNA, 23 bp, Homo sapiens
caccagctctgtggcctgtgtcc

SEQ ID NO: 1525678 - DNA, 12 bp, Homo sapiens
caccagctgctc

SEQ ID NO: 1525679 - DNA, 16 bp, Homo sapiens
caccagctgctctgcc

SEQ ID NO: 1525680 - DNA, 14 bp, Homo sapiens
caccagctgctgtg

SEQ ID NO: 1525681 - DNA, 15 bp, Homo sapiens
caccagctgctgtgc

SEQ ID NO: 1525682 - DNA, 13 bp, Homo sapiens
caccagctggggt

SEQ ID NO: 1525683 - DNA, 21 bp, Homo sapiens
caccaggaatgttaaagtcag

SEQ ID NO: 1525684 - DNA, 16 bp, Homo sapiens
caccaggactggctgt

SEQ ID NO: 1525685 - DNA, 14 bp, Homo sapiens
caccaggagacaga

SEQ ID NO: 1525686 - DNA, 15 bp, Homo sapiens
caccaggagcagcag

SEQ ID NO: 1525687 - DNA, 18 bp, Homo sapiens
caccaggagcagcagcca

SEQ ID NO: 1525688 - DNA, 19 bp, Homo sapiens
caccaggagcagcagccag

SEQ ID NO: 1525689 - DNA, 24 bp, Homo sapiens
caccaggcacgaacccacctgctg

SEQ ID NO: 1525690 - DNA, 14 bp, Homo sapiens
caccaggccacctc

SEQ ID NO: 1525691 - DNA, 15 bp, Homo sapiens
caccaggccacctcc

SEQ ID NO: 1525692 - DNA, 19 bp, Homo sapiens
caccaggccacctccccag

SEQ ID NO: 1525693 - DNA, 17 bp, Homo sapiens
caccaggcctggcctct

SEQ ID NO: 1525694 - DNA, 18 bp, Homo sapiens
caccaggcctggcctctg

SEQ ID NO: 1525695 - DNA, 21 bp, Homo sapiens
caccaggcctggcctctgggc

SEQ ID NO: 1525696 - DNA, 17 bp, Homo sapiens
caccaggcgctaattca

SEQ ID NO: 1525697 - DNA, 16 bp, Homo sapiens
caccaggctggcgcag

SEQ ID NO: 1525698 - DNA, 17 bp, Homo sapiens
caccaggctggcgcagc

SEQ ID NO: 1525699 - DNA, 18 bp, Homo sapiens
caccaggctggcgcagcc

SEQ ID NO: 1525700 - DNA, 15 bp, Homo sapiens
caccaggggaggagc

SEQ ID NO: 1525701 - DNA, 17 bp, Homo sapiens
caccaggggaggagcct

SEQ ID NO: 1525702 - DNA, 19 bp, Homo sapiens
caccagggtccgcaccagc

SEQ ID NO: 1525703 - DNA, 20 bp, Homo sapiens
caccagggtccgcaccagct

SEQ ID NO: 1525704 - DNA, 22 bp, Homo sapiens
caccagggtccgcaccagctgc

SEQ ID NO: 1525705 - DNA, 21 bp, Homo sapiens
caccagtcacctcgtctccct

SEQ ID NO: 1525706 - DNA, 21 bp, Homo sapiens
caccagtcagggacagcagcc

SEQ ID NO: 1525707 - DNA, 11 bp, Homo sapiens
caccagtgcct

SEQ ID NO: 1525708 - DNA, 23 bp, Homo sapiens
caccagtgtcctcccctcaagga

SEQ ID NO: 1525709 - DNA, 20 bp, Homo sapiens
caccagttctcatgggtggc

SEQ ID NO: 1525710 - DNA, 19 bp, Homo sapiens
caccatactccttgcttcc

SEQ ID NO: 1525711 - DNA, 19 bp, Homo sapiens
caccatagtgtcacagaga

SEQ ID NO: 1525712 - DNA, 14 bp, Homo sapiens
cacctcttcctctg

SEQ ID NO: 1525713 - DNA, 16 bp, Homo sapiens
cacctcttcctctggt

SEQ ID NO: 1525714 - DNA, 20 bp, Homo sapiens
cacctctttaaaaactcact

SEQ ID NO: 1525715 - DNA, 16 bp, Homo sapiens
cacctgaaccccagag

SEQ ID NO: 1525716 - DNA, 20 bp, Homo sapiens
cacctgaaccccagaggcag

SEQ ID NO: 1525717 - DNA, 21 bp, Homo sapiens
cacctgaaccccagaggcaga

SEQ ID NO: 1525718 - DNA, 23 bp, Homo sapiens
cacctgaaccccatgggcttgga

SEQ ID NO: 1525719 - DNA, 19 bp, Homo sapiens
cacctgacaatggcagcta

SEQ ID NO: 1525720 - DNA, 17 bp, Homo sapiens
cacctgacacaccaggc

SEQ ID NO: 1525721 - DNA, 20 bp, Homo sapiens
cacctgacacaccaggcgct

SEQ ID NO: 1525722 - DNA, 15 bp, Homo sapiens
cacctgactctgaaa

SEQ ID NO: 1525723 - DNA, 23 bp, Homo sapiens
cacctgactctgaaatctgaaga

SEQ ID NO: 1525724 - DNA, 18 bp, Homo sapiens
cacctgagaccctactga

SEQ ID NO: 1525725 - DNA, 14 bp, Homo sapiens
cacctgaggaactg

SEQ ID NO: 1525726 - DNA, 11 bp, Homo sapiens
cacctgaggtc

SEQ ID NO: 1525727 - DNA, 21 bp, Homo sapiens
cacctgaggtgggctggggct

SEQ ID NO: 1525728 - DNA, 18 bp, Homo sapiens
cacctgaggttaggagtt

SEQ ID NO: 1525729 - DNA, 13 bp, Homo sapiens
cacctgcaagccc

SEQ ID NO: 1525730 - DNA, 17 bp, Homo sapiens
cacctgcaagccccagg

SEQ ID NO: 1525731 - DNA, 18 bp, Homo sapiens
cacctgcaagccccaggg

SEQ ID NO: 1525732 - DNA, 15 bp, Homo sapiens
cacctgcacctcccc

SEQ ID NO: 1525733 - DNA, 21 bp, Homo sapiens
cacctgcactaacagagtggc

SEQ ID NO: 1525734 - DNA, 13 bp, Homo sapiens
cacctgcagtgcc

SEQ ID NO: 1525735 - DNA, 17 bp, Homo sapiens
cacctgcagtgccagct

SEQ ID NO: 1525736 - DNA, 18 bp, Homo sapiens
cacctgcagtgccagctc

SEQ ID NO: 1525737 - DNA, 22 bp, Homo sapiens
cacctgcagtgccagctccctc

SEQ ID NO: 1525738 - DNA, 22 bp, Homo sapiens
cacctgcatccgtagttccctg

SEQ ID NO: 1525739 - DNA, 17 bp, Homo sapiens
cacctgcatctggggcc

SEQ ID NO: 1525740 - DNA, 22 bp, Homo sapiens
cacctgccagcctggcttctgg

SEQ ID NO: 1525741 - DNA, 14 bp, Homo sapiens
cacctgccccctgg

SEQ ID NO: 1525742 - DNA, 15 bp, Homo sapiens
cacctgccccctggt

SEQ ID NO: 1525743 - DNA, 13 bp, Homo sapiens
cacctgccgacct

SEQ ID NO: 1525744 - DNA, 17 bp, Homo sapiens
cacctgcctgcagagca

SEQ ID NO: 1525745 - DNA, 18 bp, Homo sapiens
cacctgcctggtgcattg

SEQ ID NO: 1525746 - DNA, 14 bp, Homo sapiens
cacctgcgcacagg

SEQ ID NO: 1525747 - DNA, 15 bp, Homo sapiens
cacctgcgcacaggt

SEQ ID NO: 1525748 - DNA, 16 bp, Homo sapiens
cacctgcgcacaggtg

SEQ ID NO: 1525749 - DNA, 22 bp, Homo sapiens
cacctgcgcacaggtgggagga

SEQ ID NO: 1525750 - DNA, 14 bp, Homo sapiens
cacctgctccagaa

SEQ ID NO: 1525751 - DNA, 13 bp, Homo sapiens
cacctgctcccag

SEQ ID NO: 1525752 - DNA, 19 bp, Homo sapiens
cacctgctgagagacccaa

SEQ ID NO: 1525753 - DNA, 15 bp, Homo sapiens
cacctgctgcgtccc

SEQ ID NO: 1525754 - DNA, 21 bp, Homo sapiens
caccgcccccaccccttcccc

SEQ ID NO: 1525755 - DNA, 19 bp, Homo sapiens
caccgcctccccacctcca

SEQ ID NO: 1525756 - DNA, 21 bp, Homo sapiens
caccgcctctggccgccaccc

SEQ ID NO: 1525757 - DNA, 17 bp, Homo sapiens
caccgcggccaggcacc

SEQ ID NO: 1525758 - DNA, 17 bp, Homo sapiens
caccgctgccagcacag

SEQ ID NO: 1525759 - DNA, 12 bp, Homo sapiens
caccgctgccta

SEQ ID NO: 1525760 - DNA, 22 bp, Homo sapiens
caccgctgcctaagtggctgct

SEQ ID NO: 1525761 - DNA, 19 bp, Homo sapiens
caccggaggtcactccacc

SEQ ID NO: 1525762 - DNA, 19 bp, Homo sapiens
caccggcctgtgggtctct

SEQ ID NO: 1525763 - DNA, 18 bp, Homo sapiens
caccgggaccccctcacc

SEQ ID NO: 1525764 - DNA, 13 bp, Homo sapiens
caccgggcctgga

SEQ ID NO: 1525765 - DNA, 15 bp, Homo sapiens
caccggtccagctgg

SEQ ID NO: 1525766 - DNA, 15 bp, Homo sapiens
caccgtcatggctta

SEQ ID NO: 1525767 - DNA, 15 bp, Homo sapiens
caccgtccaggcccc

SEQ ID NO: 1525768 - DNA, 15 bp, Homo sapiens
caccgtcccagggct

SEQ ID NO: 1525769 - DNA, 16 bp, Homo sapiens
caccgtcccagggctc

SEQ ID NO: 1525770 - DNA, 16 bp, Homo sapiens
caccgtccctcagtga

SEQ ID NO: 1525771 - DNA, 15 bp, Homo sapiens
caccgtccgccctgc

SEQ ID NO: 1525772 - DNA, 19 bp, Homo sapiens
caccgtccgccctgctcct

SEQ ID NO: 1525773 - DNA, 14 bp, Homo sapiens
caccgtctgtctca

SEQ ID NO: 1525774 - DNA, 17 bp, Homo sapiens
caccgtggaggaggaag

SEQ ID NO: 1525775 - DNA, 20 bp, Homo sapiens
caccgtggctaccattgtca

SEQ ID NO: 1525776 - DNA, 23 bp, Homo sapiens
caccgtgtcaagctgctctgagc

SEQ ID NO: 1525777 - DNA, 17 bp, Homo sapiens
caccgtgttagccagga

SEQ ID NO: 1525778 - DNA, 21 bp, Homo sapiens
caccgttaggattcaggcagc

SEQ ID NO: 1525779 - DNA, 20 bp, Homo sapiens
caccgtttagaaaaaacaat

SEQ ID NO: 1525780 - DNA, 14 bp, Homo sapiens
cacctaaagcagcc

SEQ ID NO: 1525781 - DNA, 17 bp, Homo sapiens
cacctaaagcagccagc

SEQ ID NO: 1525782 - DNA, 22 bp, Homo sapiens
cacctaaagcctaccctattct

SEQ ID NO: 1525783 - DNA, 20 bp, Homo sapiens
cacctaatccaggcagatcc

SEQ ID NO: 1525784 - DNA, 14 bp, Homo sapiens
cacctaatgtttat

SEQ ID NO: 1525785 - DNA, 14 bp, Homo sapiens
cacctacacccctg

SEQ ID NO: 1525786 - DNA, 19 bp, Homo sapiens
cacctacatccccaggtct

SEQ ID NO: 1525787 - DNA, 21 bp, Homo sapiens
cacctacatccccaggtctct

SEQ ID NO: 1525788 - DNA, 12 bp, Homo sapiens
cacctactgagt

SEQ ID NO: 1525789 - DNA, 19 bp, Homo sapiens
cacctacttgtgactgaag

SEQ ID NO: 1525790 - DNA, 21 bp, Homo sapiens
cacctacttgtgactgaaggg

SEQ ID NO: 1525791 - DNA, 22 bp, Homo sapiens
cacctacttttctttcctcaga

SEQ ID NO: 1525792 - DNA, 23 bp, Homo sapiens
cacctagaacgtgcatccttgta

SEQ ID NO: 1525793 - DNA, 16 bp, Homo sapiens
cacctagaagtctccc

SEQ ID NO: 1525794 - DNA, 20 bp, Homo sapiens
cacctagaagtctccctgca

SEQ ID NO: 1525795 - DNA, 21 bp, Homo sapiens
cacctagaagtctccctgcac

SEQ ID NO: 1525796 - DNA, 22 bp, Homo sapiens
cacctagaagtctccctgcaca

SEQ ID NO: 1525797 - DNA, 14 bp, Homo sapiens
cacctagcagcctc

SEQ ID NO: 1525798 - DNA, 16 bp, Homo sapiens
cacctagctttattct

SEQ ID NO: 1525799 - DNA, 18 bp, Homo sapiens
cacctaggccactcctcc

SEQ ID NO: 1525800 - DNA, 19 bp, Homo sapiens
cacctaggccactcctcca

SEQ ID NO: 1525801 - DNA, 18 bp, Homo sapiens
cacccagtgctgccatgc

SEQ ID NO: 1525802 - DNA, 21 bp, Homo sapiens
cacccatcgtccaccccagtg

SEQ ID NO: 1525803 - DNA, 11 bp, Homo sapiens
cacccatctgt

SEQ ID NO: 1525804 - DNA, 18 bp, Homo sapiens
cacccatctgtctgccaa

SEQ ID NO: 1525805 - DNA, 20 bp, Homo sapiens
cacccatcttcctgctgctg

SEQ ID NO: 1525806 - DNA, 21 bp, Homo sapiens
cacccatcttcctgctgctgt

SEQ ID NO: 1525807 - DNA, 22 bp, Homo sapiens
cacccatcttcctgctgctgta

SEQ ID NO: 1525808 - DNA, 22 bp, Homo sapiens
cacccatgaagacaggacagtg

SEQ ID NO: 1525809 - DNA, 18 bp, Homo sapiens
cacccatgatactccact

SEQ ID NO: 1525810 - DNA, 23 bp, Homo sapiens
cacccatgatactccactcccag

SEQ ID NO: 1525811 - DNA, 24 bp, Homo sapiens
cacccatgtgggcgcccaccctgg

SEQ ID NO: 1525812 - DNA, 21 bp, Homo sapiens
cacccattcccccatgtggct

SEQ ID NO: 1525813 - DNA, 22 bp, Homo sapiens
cacccattcccccatgtggctg

SEQ ID NO: 1525814 - DNA, 15 bp, Homo sapiens
caccccaactctccc

SEQ ID NO: 1525815 - DNA, 16 bp, Homo sapiens
caccccacacctgcag

SEQ ID NO: 1525816 - DNA, 16 bp, Homo sapiens
caccccaccccacccc

SEQ ID NO: 1525817 - DNA, 14 bp, Homo sapiens
caccccacccttcc

SEQ ID NO: 1525818 - DNA, 18 bp, Homo sapiens
caccccacgccttatccc

SEQ ID NO: 1525819 - DNA, 12 bp, Homo sapiens
caccccactcca

SEQ ID NO: 1525820 - DNA, 22 bp, Homo sapiens
caccccactgcaatcctgtctt

SEQ ID NO: 1525821 - DNA, 13 bp, Homo sapiens
caccccagcattc

SEQ ID NO: 1525822 - DNA, 12 bp, Homo sapiens
caccccatccca

SEQ ID NO: 1525823 - DNA, 22 bp, Homo sapiens
caccccatgtgggtgaccaggt

SEQ ID NO: 1525824 - DNA, 14 bp, Homo sapiens
cacccccaacttca

SEQ ID NO: 1525825 - DNA, 13 bp, Homo sapiens
cacccccagctca

SEQ ID NO: 1525826 - DNA, 13 bp, Homo sapiens
cacccccatcttc

SEQ ID NO: 1525827 - DNA, 13 bp, Homo sapiens
caccccccagaac

SEQ ID NO: 1525828 - DNA, 19 bp, Homo sapiens
caccccccagaacctgtcc

SEQ ID NO: 1525829 - DNA, 16 bp, Homo sapiens
cacccccctctctttc

SEQ ID NO: 1525830 - DNA, 16 bp, Homo sapiens
cacccccctctgctgc

SEQ ID NO: 1525831 - DNA, 17 bp, Homo sapiens
cacccccctctgctgcc

SEQ ID NO: 1525832 - DNA, 11 bp, Homo sapiens
caccccctccc

SEQ ID NO: 1525833 - DNA, 14 bp, Homo sapiens
caccccctccccag

SEQ ID NO: 1525834 - DNA, 11 bp, Homo sapiens
caccccctcct

SEQ ID NO: 1525835 - DNA, 18 bp, Homo sapiens
caccccctcctcccccag

SEQ ID NO: 1525836 - DNA, 16 bp, Homo sapiens
caccccctgccctgca

SEQ ID NO: 1525837 - DNA, 17 bp, Homo sapiens
caccccctgccctgcac

SEQ ID NO: 1525838 - DNA, 22 bp, Homo sapiens
caccccctgctccaccagcagc

SEQ ID NO: 1525839 - DNA, 22 bp, Homo sapiens
caccccctgtcccattctagat

SEQ ID NO: 1525840 - DNA, 14 bp, Homo sapiens
cacccccttccccc

SEQ ID NO: 1525841 - DNA, 13 bp, Homo sapiens
cacccccttccct

SEQ ID NO: 1525842 - DNA, 17 bp, Homo sapiens
cacccccttccctggga

SEQ ID NO: 1525843 - DNA, 17 bp, Homo sapiens
cacccccttctctgctc

SEQ ID NO: 1525844 - DNA, 18 bp, Homo sapiens
cacccccttctctgctcc

SEQ ID NO: 1525845 - DNA, 22 bp, Homo sapiens
cacccccttctctgctccacca

SEQ ID NO: 1525846 - DNA, 14 bp, Homo sapiens
caccccctttcctg

SEQ ID NO: 1525847 - DNA, 14 bp, Homo sapiens
caccccgcctgcct

SEQ ID NO: 1525848 - DNA, 16 bp, Homo sapiens
caccccgcctgcctcc

SEQ ID NO: 1525849 - DNA, 15 bp, Homo sapiens
caccccgctgatgga

SEQ ID NO: 1525850 - DNA, 12 bp, Homo sapiens
cacactccactc

SEQ ID NO: 1525851 - DNA, 18 bp, Homo sapiens
cacactccactctgattc

SEQ ID NO: 1525852 - DNA, 11 bp, Homo sapiens
cacactccagt

SEQ ID NO: 1525853 - DNA, 23 bp, Homo sapiens
cacactcccaaggttggagccca

SEQ ID NO: 1525854 - DNA, 17 bp, Homo sapiens
cacactcccctgcactg

SEQ ID NO: 1525855 - DNA, 23 bp, Homo sapiens
cacactctcctgggccccaagga

SEQ ID NO: 1525856 - DNA, 22 bp, Homo sapiens
cacactcttcagtgactcctgc

SEQ ID NO: 1525857 - DNA, 19 bp, Homo sapiens
cacactgatggctcaagac

SEQ ID NO: 1525858 - DNA, 16 bp, Homo sapiens
cacactgcaagagcct

SEQ ID NO: 1525859 - DNA, 17 bp, Homo sapiens
cacactgcaagagcctt

SEQ ID NO: 1525860 - DNA, 18 bp, Homo sapiens
cacactgcaagagccttg

SEQ ID NO: 1525861 - DNA, 20 bp, Homo sapiens
cacactgcaagagccttggt

SEQ ID NO: 1525862 - DNA, 17 bp, Homo sapiens
cacactgccagaagaga

SEQ ID NO: 1525863 - DNA, 22 bp, Homo sapiens
cacactgcgcaggtctcttctg

SEQ ID NO: 1525864 - DNA, 18 bp, Homo sapiens
cacactggaatataaaac

SEQ ID NO: 1525865 - DNA, 23 bp, Homo sapiens
cacactgggcctggagccctggg

SEQ ID NO: 1525866 - DNA, 20 bp, Homo sapiens
cacactggtttgccaggcca

SEQ ID NO: 1525867 - DNA, 21 bp, Homo sapiens
cacactggtttgccaggccaa

SEQ ID NO: 1525868 - DNA, 15 bp, Homo sapiens
cacactgtaaatatg

SEQ ID NO: 1525869 - DNA, 21 bp, Homo sapiens
cacactgtcatgcttcatcat

SEQ ID NO: 1525870 - DNA, 22 bp, Homo sapiens
cacactgtcatgcttcatcatt

SEQ ID NO: 1525871 - DNA, 16 bp, Homo sapiens
cacactgtgtcctggt

SEQ ID NO: 1525872 - DNA, 20 bp, Homo sapiens
cacactgtgtcctggtgctc

SEQ ID NO: 1525873 - DNA, 21 bp, Homo sapiens
cacacttatattttatgaaca

SEQ ID NO: 1525874 - DNA, 23 bp, Homo sapiens
cacacttatattttatgaacatt

SEQ ID NO: 1525875 - DNA, 20 bp, Homo sapiens
cacacttcaggctcttctcc

SEQ ID NO: 1525876 - DNA, 20 bp, Homo sapiens
cacacttcattgtaaatcac

SEQ ID NO: 1525877 - DNA, 21 bp, Homo sapiens
cacacttcattgtaaatcact

SEQ ID NO: 1525878 - DNA, 14 bp, Homo sapiens
cacacttccccatc

SEQ ID NO: 1525879 - DNA, 22 bp, Homo sapiens
cacacttctgtgagacccccac

SEQ ID NO: 1525880 - DNA, 22 bp, Homo sapiens
cacacttgaagcctaaatttgt

SEQ ID NO: 1525881 - DNA, 19 bp, Homo sapiens
cacacttgtgtgtgggctg

SEQ ID NO: 1525882 - DNA, 23 bp, Homo sapiens
cacacttgtgtgtgggctgtgag

SEQ ID NO: 1525883 - DNA, 19 bp, Homo sapiens
cacacttgttccagctctt

SEQ ID NO: 1525884 - DNA, 21 bp, Homo sapiens
cacactttccatctctgcctg

SEQ ID NO: 1525885 - DNA, 14 bp, Homo sapiens
cacactttgaagca

SEQ ID NO: 1525886 - DNA, 19 bp, Homo sapiens
cacactttgaagcaaatac

SEQ ID NO: 1525887 - DNA, 17 bp, Homo sapiens
cacagaaaataaggcac

SEQ ID NO: 1525888 - DNA, 18 bp, Homo sapiens
cacagaaacactgccttt

SEQ ID NO: 1525889 - DNA, 20 bp, Homo sapiens
cacagaaacactgccttttt

SEQ ID NO: 1525890 - DNA, 21 bp, Homo sapiens
cacagaaagctccttccagac

SEQ ID NO: 1525891 - DNA, 21 bp, Homo sapiens
cacagaactgcttactagccc

SEQ ID NO: 1525892 - DNA, 19 bp, Homo sapiens
cacagaagacttcccagct

SEQ ID NO: 1525893 - DNA, 20 bp, Homo sapiens
cacagaagacttcccagctt

SEQ ID NO: 1525894 - DNA, 20 bp, Homo sapiens
cacagaaggaatctgtgcag

SEQ ID NO: 1525895 - DNA, 14 bp, Homo sapiens
cacagaatgctcag

SEQ ID NO: 1525896 - DNA, 14 bp, Homo sapiens
cacagacaagcagc

SEQ ID NO: 1525897 - DNA, 21 bp, Homo sapiens
cacagacaagcagcccttgct

SEQ ID NO: 1525898 - DNA, 22 bp, Homo sapiens
cacagacaagcagcccttgctt

SEQ ID NO: 1525899 - DNA, 17 bp, Homo sapiens
cacagacacacacacgc

SEQ ID NO: 1525900 - DNA, 18 bp, Homo sapiens
cacagacacacacacgca

SEQ ID NO: 1525901 - DNA, 17 bp, Homo sapiens
cacagacattttgtgtg

SEQ ID NO: 1525902 - DNA, 18 bp, Homo sapiens
cacagacattttgtgtga

SEQ ID NO: 1525903 - DNA, 21 bp, Homo sapiens
cacagacattttgtgtgagac

SEQ ID NO: 1525904 - DNA, 20 bp, Homo sapiens
cacagaccacctgcttctga

SEQ ID NO: 1525905 - DNA, 20 bp, Homo sapiens
cacagacctggagcccctgg

SEQ ID NO: 1525906 - DNA, 21 bp, Homo sapiens
cacagacgggcacacagactg

SEQ ID NO: 1525907 - DNA, 13 bp, Homo sapiens
cacagactatttt

SEQ ID NO: 1525908 - DNA, 17 bp, Homo sapiens
cacagacttctggaagg

SEQ ID NO: 1525909 - DNA, 22 bp, Homo sapiens
cacagacttgcactgaagccgg

SEQ ID NO: 1525910 - DNA, 23 bp, Homo sapiens
cacagagaagtttgtagccaggt

SEQ ID NO: 1525911 - DNA, 10 bp, Homo sapiens
cacagagaga

SEQ ID NO: 1525912 - DNA, 20 bp, Homo sapiens
cacagagagacagacttgag

SEQ ID NO: 1525913 - DNA, 14 bp, Homo sapiens
cacagagcacgcct

SEQ ID NO: 1525914 - DNA, 17 bp, Homo sapiens
cacagagcacgcctgcc

SEQ ID NO: 1525915 - DNA, 21 bp, Homo sapiens
cacagagcacgcctgccatct

SEQ ID NO: 1525916 - DNA, 23 bp, Homo sapiens
cacagagctaactgggttacagt

SEQ ID NO: 1525917 - DNA, 21 bp, Homo sapiens
cacagagctttggtctgtgtg

SEQ ID NO: 1525918 - DNA, 16 bp, Homo sapiens
cacagaggaagagcag

SEQ ID NO: 1525919 - DNA, 17 bp, Homo sapiens
cacagaggaagagcagg

SEQ ID NO: 1525920 - DNA, 13 bp, Homo sapiens
cacagaggctgcc

SEQ ID NO: 1525921 - DNA, 17 bp, Homo sapiens
cacagagtcaaggcctg

SEQ ID NO: 1525922 - DNA, 17 bp, Homo sapiens
cacagagtgagactcca

SEQ ID NO: 1525923 - DNA, 17 bp, Homo sapiens
cacagagtgagccagtg

SEQ ID NO: 1525924 - DNA, 16 bp, Homo sapiens
cacagatacacacaca

SEQ ID NO: 1525925 - DNA, 14 bp, Homo sapiens
cacagatcacagct

SEQ ID NO: 1525926 - DNA, 22 bp, Homo sapiens
cacagatcacagcttcagccag

SEQ ID NO: 1525927 - DNA, 20 bp, Homo sapiens
cacagatggatttgcctgtg

SEQ ID NO: 1525928 - DNA, 23 bp, Homo sapiens
cacagatggatttgcctgtgcca

SEQ ID NO: 1525929 - DNA, 21 bp, Homo sapiens
cacagatggctttcagggcag

SEQ ID NO: 1525930 - DNA, 19 bp, Homo sapiens
cacagattatgttcctgct

SEQ ID NO: 1525931 - DNA, 20 bp, Homo sapiens
cacagcacaaacacacctct

SEQ ID NO: 1525932 - DNA, 21 bp, Homo sapiens
cacagcacaaacacacctctg

SEQ ID NO: 1525933 - DNA, 21 bp, Homo sapiens
cacagcagcacctcctccatg

SEQ ID NO: 1525934 - DNA, 13 bp, Homo sapiens
cacagcagcttca

SEQ ID NO: 1525935 - DNA, 21 bp, Homo sapiens
cacagcagcttcaccagagca

SEQ ID NO: 1525936 - DNA, 17 bp, Homo sapiens
cacagcagtgtcccctg

SEQ ID NO: 1525937 - DNA, 20 bp, Homo sapiens
cacagcagtgtcccctgccc

SEQ ID NO: 1525938 - DNA, 21 bp, Homo sapiens
cacagcagtgtcccctgcccc

SEQ ID NO: 1525939 - DNA, 23 bp, Homo sapiens
cacagcagtgtcccctgccccag

SEQ ID NO: 1525940 - DNA, 21 bp, Homo sapiens
cacagcagttgaaaagactcc

SEQ ID NO: 1525941 - DNA, 14 bp, Homo sapiens
cacagcatgcctta

SEQ ID NO: 1525942 - DNA, 17 bp, Homo sapiens
cacagcatggaggagga

SEQ ID NO: 1525943 - DNA, 20 bp, Homo sapiens
cacagcatggaggaggaggg

SEQ ID NO: 1525944 - DNA, 12 bp, Homo sapiens
cacagcatgtgc

SEQ ID NO: 1525945 - DNA, 16 bp, Homo sapiens
cacagccaacgagaca

SEQ ID NO: 1525946 - DNA, 18 bp, Homo sapiens
cacagccaacgagacaca

SEQ ID NO: 1525947 - DNA, 19 bp, Homo sapiens
cacagccaacgagacacat

SEQ ID NO: 1525948 - DNA, 15 bp, Homo sapiens
cacagccacccgtgg

SEQ ID NO: 1525949 - DNA, 22 bp, Homo sapiens
cacagccacccgtggggtgctg

SEQ ID NO: 1525950 - DNA, 17 bp, Homo sapiens
cacagccagcacctggc

SEQ ID NO: 1525951 - DNA, 20 bp, Homo sapiens
cacagccagcacctggcatc

SEQ ID NO: 1525952 - DNA, 22 bp, Homo sapiens
cacagccagggggatgccactc

SEQ ID NO: 1525953 - DNA, 18 bp, Homo sapiens
cacagcccaaaatttgat

SEQ ID NO: 1525954 - DNA, 23 bp, Homo sapiens
cacagcccaagaggactgagact

SEQ ID NO: 1525955 - DNA, 23 bp, Homo sapiens
cacagcccagccacggacgctgg

SEQ ID NO: 1525956 - DNA, 19 bp, Homo sapiens
cacagcccagttcccgtga

SEQ ID NO: 1525957 - DNA, 17 bp, Homo sapiens
cacagcccccttgccct

SEQ ID NO: 1525958 - DNA, 20 bp, Homo sapiens
cacagcccctcaaagacttt

SEQ ID NO: 1525959 - DNA, 17 bp, Homo sapiens
cacagcccgctctctgg

SEQ ID NO: 1525960 - DNA, 14 bp, Homo sapiens
cacagccctccgac

SEQ ID NO: 1525961 - DNA, 23 bp, Homo sapiens
cacagccctccgaccctcatggc

SEQ ID NO: 1525962 - DNA, 12 bp, Homo sapiens
cacagccctggg

SEQ ID NO: 1525963 - DNA, 14 bp, Homo sapiens
cacagccctgggag

SEQ ID NO: 1525964 - DNA, 17 bp, Homo sapiens
catgcagttcctggccc

SEQ ID NO: 1525965 - DNA, 18 bp, Homo sapiens
catgcatagtcccagcta

SEQ ID NO: 1525966 - DNA, 14 bp, Homo sapiens
catgcatcttactg

SEQ ID NO: 1525967 - DNA, 16 bp, Homo sapiens
catgcatcttactgaa

SEQ ID NO: 1525968 - DNA, 17 bp, Homo sapiens
catgcatcttactgaag

SEQ ID NO: 1525969 - DNA, 15 bp, Homo sapiens
catgcattatatacc

SEQ ID NO: 1525970 - DNA, 17 bp, Homo sapiens
catgcatttgaggtcaa

SEQ ID NO: 1525971 - DNA, 19 bp, Homo sapiens
catgcattttgcagcagtg

SEQ ID NO: 1525972 - DNA, 22 bp, Homo sapiens
catgccaaccccgccctaggcc

SEQ ID NO: 1525973 - DNA, 16 bp, Homo sapiens
catgccaaccctgggc

SEQ ID NO: 1525974 - DNA, 20 bp, Homo sapiens
catgccaaccctgggctatt

SEQ ID NO: 1525975 - DNA, 17 bp, Homo sapiens
catgccacaaggacttc

SEQ ID NO: 1525976 - DNA, 15 bp, Homo sapiens
catgccacctggcaa

SEQ ID NO: 1525977 - DNA, 16 bp, Homo sapiens
catgccacctggcaaa

SEQ ID NO: 1525978 - DNA, 21 bp, Homo sapiens
catgccacgccccgtgtctgg

SEQ ID NO: 1525979 - DNA, 13 bp, Homo sapiens
catgccactgcca

SEQ ID NO: 1525980 - DNA, 20 bp, Homo sapiens
catgccactgccaggcacct

SEQ ID NO: 1525981 - DNA, 23 bp, Homo sapiens
catgccactgccaggcacctggc

SEQ ID NO: 1525982 - DNA, 18 bp, Homo sapiens
catgccagacccactgaa

SEQ ID NO: 1525983 - DNA, 21 bp, Homo sapiens
catgccagctacttcctcctc

SEQ ID NO: 1525984 - DNA, 13 bp, Homo sapiens
catgccaggaacc

SEQ ID NO: 1525985 - DNA, 16 bp, Homo sapiens
catgccatctgttttc

SEQ ID NO: 1525986 - DNA, 14 bp, Homo sapiens
catgccatgaatga

SEQ ID NO: 1525987 - DNA, 15 bp, Homo sapiens
catgcccaccccctg

SEQ ID NO: 1525988 - DNA, 17 bp, Homo sapiens
catgcccaccccctgcc

SEQ ID NO: 1525989 - DNA, 18 bp, Homo sapiens
catgcccaccccctgccc

SEQ ID NO: 1525990 - DNA, 21 bp, Homo sapiens
catgcccaccccctgccctgc

SEQ ID NO: 1525991 - DNA, 13 bp, Homo sapiens
catgcccacctgc

SEQ ID NO: 1525992 - DNA, 20 bp, Homo sapiens
catgcccagctaatttttgt

SEQ ID NO: 1525993 - DNA, 14 bp, Homo sapiens
catgcccagctctc

SEQ ID NO: 1525994 - DNA, 15 bp, Homo sapiens
catgccccagctctg

SEQ ID NO: 1525995 - DNA, 20 bp, Homo sapiens
catgccccagctctggatga

SEQ ID NO: 1525996 - DNA, 15 bp, Homo sapiens
catgccccaggctct

SEQ ID NO: 1525997 - DNA, 12 bp, Homo sapiens
catgccccagtc

SEQ ID NO: 1525998 - DNA, 13 bp, Homo sapiens
catgccccagtcg

SEQ ID NO: 1525999 - DNA, 13 bp, Homo sapiens
catgcccccctca

SEQ ID NO: 1526000 - DNA, 23 bp, Homo sapiens
catgcccccctcaaacctcctct

SEQ ID NO: 1526001 - DNA, 14 bp, Homo sapiens
catgccccctgcag

SEQ ID NO: 1526002 - DNA, 14 bp, Homo sapiens
catgccccgatgtc

SEQ ID NO: 1526003 - DNA, 22 bp, Homo sapiens
catgccctccactccactgcct

SEQ ID NO: 1526004 - DNA, 11 bp, Homo sapiens
catgccctcct

SEQ ID NO: 1526005 - DNA, 20 bp, Homo sapiens
catgccctgccttgtccctc

SEQ ID NO: 1526006 - DNA, 14 bp, Homo sapiens
catgcccttctgat

SEQ ID NO: 1526007 - DNA, 18 bp, Homo sapiens
catgccgcgggcggccag

SEQ ID NO: 1526008 - DNA, 19 bp, Homo sapiens
catgccgcgggcggccagg

SEQ ID NO: 1526009 - DNA, 20 bp, Homo sapiens
catgccgcgggcggccaggc

SEQ ID NO: 1526010 - DNA, 18 bp, Homo sapiens
catggcccccaggggcag

SEQ ID NO: 1526011 - DNA, 19 bp, Homo sapiens
catggcccccaggggcagg

SEQ ID NO: 1526012 - DNA, 18 bp, Homo sapiens
catggcccctctgacctg

SEQ ID NO: 1526013 - DNA, 21 bp, Homo sapiens
catggccgaagccccttggag

SEQ ID NO: 1526014 - DNA, 21 bp, Homo sapiens
catggcctattatattaaaat

SEQ ID NO: 1526015 - DNA, 22 bp, Homo sapiens
catggcctggactgactgcagc

SEQ ID NO: 1526016 - DNA, 22 bp, Homo sapiens
catggcctgtgctgggccagtg

SEQ ID NO: 1526017 - DNA, 22 bp, Homo sapiens
catggcgtaatgggcctgccca

SEQ ID NO: 1526018 - DNA, 14 bp, Homo sapiens
catggcgtgtccct

SEQ ID NO: 1526019 - DNA, 18 bp, Homo sapiens
catggctagcctttcttg

SEQ ID NO: 1526020 - DNA, 12 bp, Homo sapiens
catggctcaggc

SEQ ID NO: 1526021 - DNA, 15 bp, Homo sapiens
catggctgaagctgg

SEQ ID NO: 1526022 - DNA, 22 bp, Homo sapiens
catggctgaagctggagcagcg

SEQ ID NO: 1526023 - DNA, 12 bp, Homo sapiens
catggctggcct

SEQ ID NO: 1526024 - DNA, 13 bp, Homo sapiens
catggctggcctg

SEQ ID NO: 1526025 - DNA, 16 bp, Homo sapiens
catggctggcctggta

SEQ ID NO: 1526026 - DNA, 19 bp, Homo sapiens
catggctggcctggtaagg

SEQ ID NO: 1526027 - DNA, 20 bp, Homo sapiens
catggctgtgtttgcagcct

SEQ ID NO: 1526028 - DNA, 17 bp, Homo sapiens
catggcttaatgtttat

SEQ ID NO: 1526029 - DNA, 19 bp, Homo sapiens
catggcttttgctttccct

SEQ ID NO: 1526030 - DNA, 20 bp, Homo sapiens
catgggaaagtattctcttt

SEQ ID NO: 1526031 - DNA, 21 bp, Homo sapiens
catgggaaagtattctctttt

SEQ ID NO: 1526032 - DNA, 18 bp, Homo sapiens
catgggactttccttccc

SEQ ID NO: 1526033 - DNA, 15 bp, Homo sapiens
catgggccagagcct

SEQ ID NO: 1526034 - DNA, 19 bp, Homo sapiens
catgggcctcccactcctg

SEQ ID NO: 1526035 - DNA, 13 bp, Homo sapiens
catgggcctggcc

SEQ ID NO: 1526036 - DNA, 12 bp, Homo sapiens
catgggcctggg

SEQ ID NO: 1526037 - DNA, 13 bp, Homo sapiens
catgggcctgggc

SEQ ID NO: 1526038 - DNA, 19 bp, Homo sapiens
catgggcctgggcctgctt

SEQ ID NO: 1526039 - DNA, 19 bp, Homo sapiens
catgggctagtgtgagtgg

SEQ ID NO: 1526040 - DNA, 22 bp, Homo sapiens
catgggctagtgtgagtggcag

SEQ ID NO: 1526041 - DNA, 14 bp, Homo sapiens
catgggctgagtgg

SEQ ID NO: 1526042 - DNA, 22 bp, Homo sapiens
catgggctgagtggggagcagt

SEQ ID NO: 1526043 - DNA, 13 bp, Homo sapiens
catgggctgtgtc

SEQ ID NO: 1526044 - DNA, 23 bp, Homo sapiens
catgggcttggacttcctggggc

SEQ ID NO: 1526045 - DNA, 14 bp, Homo sapiens
catggggaggcagc

SEQ ID NO: 1526046 - DNA, 20 bp, Homo sapiens
catggggaggcagcagagcg

SEQ ID NO: 1526047 - DNA, 21 bp, Homo sapiens
catggggaggcagcagagcgg

SEQ ID NO: 1526048 - DNA, 11 bp, Homo sapiens
catggggaggg

SEQ ID NO: 1526049 - DNA, 20 bp, Homo sapiens
catggggagggattctggtt

SEQ ID NO: 1526050 - DNA, 15 bp, Homo sapiens
catggggcatgtcct

SEQ ID NO: 1526051 - DNA, 15 bp, Homo sapiens
catggggcccctggc

SEQ ID NO: 1526052 - DNA, 18 bp, Homo sapiens
catggggcccctggccca

SEQ ID NO: 1526053 - DNA, 19 bp, Homo sapiens
catggggcccctggcccag

SEQ ID NO: 1526054 - DNA, 16 bp, Homo sapiens
catgggggctgccagc

SEQ ID NO: 1526055 - DNA, 20 bp, Homo sapiens
catgggggctgccagcgtct

SEQ ID NO: 1526056 - DNA, 11 bp, Homo sapiens
catggggggag

SEQ ID NO: 1526057 - DNA, 16 bp, Homo sapiens
catgggggtgagaccc

SEQ ID NO: 1526058 - DNA, 15 bp, Homo sapiens
catggggttcctggt

SEQ ID NO: 1526059 - DNA, 16 bp, Homo sapiens
catggggttcgagact

SEQ ID NO: 1526060 - DNA, 17 bp, Homo sapiens
catggggttcgagactc

SEQ ID NO: 1526061 - DNA, 21 bp, Homo sapiens
catggggttcgagactccatc

SEQ ID NO: 1526062 - DNA, 23 bp, Homo sapiens
catgggtaatccgttcatagaaa

SEQ ID NO: 1526063 - DNA, 22 bp, Homo sapiens
catgggtatttttataacaata

SEQ ID NO: 1526064 - DNA, 14 bp, Homo sapiens
catgggtcaagaga

SEQ ID NO: 1526065 - DNA, 22 bp, Homo sapiens
catgggtcccttgaaggaagag

SEQ ID NO: 1526066 - DNA, 21 bp, Homo sapiens
catgggtccttgatgccagag

SEQ ID NO: 1526067 - DNA, 22 bp, Homo sapiens
catgggtccttgatgccagagg

SEQ ID NO: 1526068 - DNA, 18 bp, Homo sapiens
catgggtgtgcccttggg

SEQ ID NO: 1526069 - DNA, 20 bp, Homo sapiens
catggtagagaatctctccc

SEQ ID NO: 1526070 - DNA, 18 bp, Homo sapiens
catggtcaagttcccaac

SEQ ID NO: 1526071 - DNA, 17 bp, Homo sapiens
catggtcatcaccaccc

SEQ ID NO: 1526072 - DNA, 20 bp, Homo sapiens
catggtccggtgtccttttc

SEQ ID NO: 1526073 - DNA, 17 bp, Homo sapiens
catggtctctgcaccca

SEQ ID NO: 1526074 - DNA, 21 bp, Homo sapiens
catggtgaaacccccatctct

SEQ ID NO: 1526075 - DNA, 13 bp, Homo sapiens
catggtgaaactc

SEQ ID NO: 1526076 - DNA, 17 bp, Homo sapiens
catggtgccccaggacc

SEQ ID NO: 1526077 - DNA, 14 bp, Homo sapiens
catggtgcctatat

SEQ ID NO: 1526078 - DNA, 18 bp, Homo sapiens
catggtgcctgagaggca

SEQ ID NO: 1526079 - DNA, 17 bp, Homo sapiens
catggtgctaggaagag

SEQ ID NO: 1526080 - DNA, 13 bp, Homo sapiens
catggtggaaggg

SEQ ID NO: 1526081 - DNA, 18 bp, Homo sapiens
catggtggcgcaagcctg

SEQ ID NO: 1526082 - DNA, 16 bp, Homo sapiens
catggtgggagagact

SEQ ID NO: 1526083 - DNA, 22 bp, Homo sapiens
catggtgtgaaagtcagatgcc

SEQ ID NO: 1526084 - DNA, 19 bp, Homo sapiens
catggttaagagtccaaga

SEQ ID NO: 1526085 - DNA, 16 bp, Homo sapiens
catggttccttccctg

SEQ ID NO: 1526086 - DNA, 12 bp, Homo sapiens
aaaaacaaacaa

SEQ ID NO: 1526087 - DNA, 11 bp, Homo sapiens
aaaaacaaagc

SEQ ID NO: 1526088 - DNA, 17 bp, Homo sapiens
aaaaacaatttttgaaa

SEQ ID NO: 1526089 - DNA, 13 bp, Homo sapiens
aaaaacacagcaa

SEQ ID NO: 1526090 - DNA, 18 bp, Homo sapiens
aaaaacacagcaagggtg

SEQ ID NO: 1526091 - DNA, 14 bp, Homo sapiens
aaaaacagcagctc

SEQ ID NO: 1526092 - DNA, 17 bp, Homo sapiens
aaaaacagcagctcata

SEQ ID NO: 1526093 - DNA, 17 bp, Homo sapiens
aaaaacagcgtcttcct

SEQ ID NO: 1526094 - DNA, 18 bp, Homo sapiens
aaaaacaggtatatactt

SEQ ID NO: 1526095 - DNA, 21 bp, Homo sapiens
aaaaacaggtatatactttga

SEQ ID NO: 1526096 - DNA, 13 bp, Homo sapiens
aaaaacataacat

SEQ ID NO: 1526097 - DNA, 16 bp, Homo sapiens
aaaaacatagaaaaat

SEQ ID NO: 1526098 - DNA, 11 bp, Homo sapiens
aaaaacatgtc

SEQ ID NO: 1526099 - DNA, 14 bp, Homo sapiens
aaaaacatgtcatg

SEQ ID NO: 1526100 - DNA, 15 bp, Homo sapiens
aaaaacatgtcatgt

SEQ ID NO: 1526101 - DNA, 22 bp, Homo sapiens
aaaaacattttatttttaaaat

SEQ ID NO: 1526102 - DNA, 14 bp, Homo sapiens
aaaaaccaaaactg

SEQ ID NO: 1526103 - DNA, 22 bp, Homo sapiens
aaaaaccttgtaaaaaaagcaa

SEQ ID NO: 1526104 - DNA, 18 bp, Homo sapiens
aaaaactctctcccagga

SEQ ID NO: 1526105 - DNA, 22 bp, Homo sapiens
aaaaactgatcaaaaataaact

SEQ ID NO: 1526106 - DNA, 16 bp, Homo sapiens
aaaaactgtactgtgt

SEQ ID NO: 1526107 - DNA, 19 bp, Homo sapiens
aaaaacttcagtaagtacg

SEQ ID NO: 1526108 - DNA, 18 bp, Homo sapiens
aaaaagaaaaagagataa

SEQ ID NO: 1526109 - DNA, 20 bp, Homo sapiens
aaaaagaaaatggctaataa

SEQ ID NO: 1526110 - DNA, 14 bp, Homo sapiens
aaaaagaaacaaga

SEQ ID NO: 1526111 - DNA, 12 bp, Homo sapiens
aaaaagaaatga

SEQ ID NO: 1526112 - DNA, 14 bp, Homo sapiens
aaaaagaagccaca

SEQ ID NO: 1526113 - DNA, 12 bp, Homo sapiens
aaaaagactatt

SEQ ID NO: 1526114 - DNA, 14 bp, Homo sapiens
aaaaagactgaaca

SEQ ID NO: 1526115 - DNA, 14 bp, Homo sapiens
aaaaagaggagctt

SEQ ID NO: 1526116 - DNA, 10 bp, Homo sapiens
aaaaagatat

SEQ ID NO: 1526117 - DNA, 14 bp, Homo sapiens
aaaaagatcccaaa

SEQ ID NO: 1526118 - DNA, 22 bp, Homo sapiens
aaaaagatggcctttgcttatg

SEQ ID NO: 1526119 - DNA, 23 bp, Homo sapiens
aaaaagattttcagaaaatatta

SEQ ID NO: 1526120 - DNA, 15 bp, Homo sapiens
aaaaagcaaaaatga

SEQ ID NO: 1526121 - DNA, 16 bp, Homo sapiens
aaaaagcagtcctctt

SEQ ID NO: 1526122 - DNA, 17 bp, Homo sapiens
aaaaagcataaaaacat

SEQ ID NO: 1526123 - DNA, 17 bp, Homo sapiens
aaaaagcatatataact

SEQ ID NO: 1526124 - DNA, 23 bp, Homo sapiens
aaaaagcctccaagggtttcgac

SEQ ID NO: 1526125 - DNA, 20 bp, Homo sapiens
aaaaagcctgcaatttcata

SEQ ID NO: 1526126 - DNA, 17 bp, Homo sapiens
aaaaagctaatgtgcag

SEQ ID NO: 1526127 - DNA, 15 bp, Homo sapiens
aaaaaggaaacttcc

SEQ ID NO: 1526128 - DNA, 13 bp, Homo sapiens
aaaaaggaaatat

SEQ ID NO: 1526129 - DNA, 19 bp, Homo sapiens
aaaaaggaaatttgtttgt

SEQ ID NO: 1526130 - DNA, 20 bp, Homo sapiens
aaaaaggaaatttgtttgta

SEQ ID NO: 1526131 - DNA, 14 bp, Homo sapiens
aaaaaggcaaatat

SEQ ID NO: 1526132 - DNA, 15 bp, Homo sapiens
aaaaaggcaaatatt

SEQ ID NO: 1526133 - DNA, 14 bp, Homo sapiens
aaaaaggccaaaga

SEQ ID NO: 1526134 - DNA, 16 bp, Homo sapiens
aaaaaggccaaagata

SEQ ID NO: 1526135 - DNA, 18 bp, Homo sapiens
aaaaaggccaaagataaa

SEQ ID NO: 1526136 - DNA, 18 bp, Homo sapiens
aaaaaggggcctgagtgg

SEQ ID NO: 1526137 - DNA, 19 bp, Homo sapiens
aaaaagtacaatgaactgc

SEQ ID NO: 1526138 - DNA, 21 bp, Homo sapiens
aaaaagtacaatgaactgctt

SEQ ID NO: 1526139 - DNA, 21 bp, Homo sapiens
aaaaagtatgttctaaaatta

SEQ ID NO: 1526140 - DNA, 13 bp, Homo sapiens
aaaaagtgacaca

SEQ ID NO: 1526141 - DNA, 15 bp, Homo sapiens
aaaaagtgacacagc

SEQ ID NO: 1526142 - DNA, 16 bp, Homo sapiens
aaaaagtgacacagca

SEQ ID NO: 1526143 - DNA, 20 bp, Homo sapiens
aaaaagtgacacagcagctt

SEQ ID NO: 1526144 - DNA, 23 bp, Homo sapiens
aaaaagtgacacagcagcttcac

SEQ ID NO: 1526145 - DNA, 13 bp, Homo sapiens
aaaaagtggctgc

SEQ ID NO: 1526146 - DNA, 22 bp, Homo sapiens
aaaaagtgggttttttagttga

SEQ ID NO: 1526147 - DNA, 13 bp, Homo sapiens
aaaaagttgaagg

SEQ ID NO: 1526148 - DNA, 13 bp, Homo sapiens
aaaaagttgttct

SEQ ID NO: 1526149 - DNA, 14 bp, Homo sapiens
aaaaagtttccata

SEQ ID NO: 1526150 - DNA, 18 bp, Homo sapiens
aaaaagtttgccagaagt

SEQ ID NO: 1526151 - DNA, 13 bp, Homo sapiens
aaaaagttttgat

SEQ ID NO: 1526152 - DNA, 16 bp, Homo sapiens
aaaaataaaatgcatt

SEQ ID NO: 1526153 - DNA, 13 bp, Homo sapiens
aaaaataaaatgt

SEQ ID NO: 1526154 - DNA, 16 bp, Homo sapiens
aaaaataaaattacct

SEQ ID NO: 1526155 - DNA, 18 bp, Homo sapiens
aaaaataaatatatctac

SEQ ID NO: 1526156 - DNA, 21 bp, Homo sapiens
aaaaataaatttggttctaat

SEQ ID NO: 1526157 - DNA, 18 bp, Homo sapiens
aaaaataagtcaacagta

SEQ ID NO: 1526158 - DNA, 13 bp, Homo sapiens
aaaaataatacaa

SEQ ID NO: 1526159 - DNA, 17 bp, Homo sapiens
aaaaataatcaagattt

SEQ ID NO: 1526160 - DNA, 19 bp, Homo sapiens
aaaaataatctatttctat

SEQ ID NO: 1526161 - DNA, 13 bp, Homo sapiens
aaaaataattgga

SEQ ID NO: 1526162 - DNA, 15 bp, Homo sapiens
aaaaatagcagtatt

SEQ ID NO: 1526163 - DNA, 14 bp, Homo sapiens
aaaaatataactta

SEQ ID NO: 1526164 - DNA, 16 bp, Homo sapiens
aaaaatataatgttga

SEQ ID NO: 1526165 - DNA, 12 bp, Homo sapiens
aaaaatatacat

SEQ ID NO: 1526166 - DNA, 18 bp, Homo sapiens
aaaaatatacatgtttat

SEQ ID NO: 1526167 - DNA, 13 bp, Homo sapiens
aaaaatatattta

SEQ ID NO: 1526168 - DNA, 16 bp, Homo sapiens
aaaaatattataactt

SEQ ID NO: 1526169 - DNA, 20 bp, Homo sapiens
aaaaatcatgccagtatttt

SEQ ID NO: 1526170 - DNA, 21 bp, Homo sapiens
aaaaatcatgccagtattttt

SEQ ID NO: 1526171 - DNA, 15 bp, Homo sapiens
aaaaatctagttttt

SEQ ID NO: 1526172 - DNA, 19 bp, Homo sapiens
aaaaatctcaattgaaagc

SEQ ID NO: 1526173 - DNA, 13 bp, Homo sapiens
aaaaatctgagaa

SEQ ID NO: 1526174 - DNA, 17 bp, Homo sapiens
aaaaatgacagatgttg

SEQ ID NO: 1526175 - DNA, 14 bp, Homo sapiens
aaaaatgaggaata

SEQ ID NO: 1526176 - DNA, 23 bp, Homo sapiens
aaaaatggatattattagaaatt

SEQ ID NO: 1526177 - DNA, 17 bp, Homo sapiens
aaaaatgggagccagga

SEQ ID NO: 1526178 - DNA, 13 bp, Homo sapiens
aaaaatggtaatt

SEQ ID NO: 1526179 - DNA, 19 bp, Homo sapiens
aaaaatggtataaaaggtt

SEQ ID NO: 1526180 - DNA, 14 bp, Homo sapiens
aaaaatggttgatg

SEQ ID NO: 1526181 - DNA, 19 bp, Homo sapiens
aaaaatggttgatggaaaa

SEQ ID NO: 1526182 - DNA, 13 bp, Homo sapiens
aaaaatgtaaata

SEQ ID NO: 1526183 - DNA, 16 bp, Homo sapiens
aaaaatgtaacatcat

SEQ ID NO: 1526184 - DNA, 21 bp, Homo sapiens
aaaaatgtaacatcataatta

SEQ ID NO: 1526185 - DNA, 14 bp, Homo sapiens
aaaaattaactttt

SEQ ID NO: 1526186 - DNA, 22 bp, Homo sapiens
aaaaattcagcaaaccattttt

SEQ ID NO: 1526187 - DNA, 13 bp, Homo sapiens
aaaaattccagaa

SEQ ID NO: 1526188 - DNA, 13 bp, Homo sapiens
aaaaattgaaata

SEQ ID NO: 1526189 - DNA, 17 bp, Homo sapiens
aaaaattgaaataaata

SEQ ID NO: 1526190 - DNA, 21 bp, Homo sapiens
aaaaatttgacgcttgcttag

SEQ ID NO: 1526191 - DNA, 22 bp, Homo sapiens
aaaaattttataaaattaagca

SEQ ID NO: 1526192 - DNA, 14 bp, Homo sapiens
aaaacaaaacaaaa

SEQ ID NO: 1526193 - DNA, 20 bp, Homo sapiens
aaaacaaaaccaagccttgg

SEQ ID NO: 1526194 - DNA, 15 bp, Homo sapiens
aaaacaaaaccagct

SEQ ID NO: 1526195 - DNA, 22 bp, Homo sapiens
aaaacaaaatttgactaatttt

SEQ ID NO: 1526196 - DNA, 12 bp, Homo sapiens
aaaacaaagaag

SEQ ID NO: 1526197 - DNA, 23 bp, Homo sapiens
aaaacaaccaacagaaaacatcc

SEQ ID NO: 1526198 - DNA, 17 bp, Homo sapiens
aaaacaactttcacttc

SEQ ID NO: 1526199 - DNA, 18 bp, Homo sapiens
aaaacaactttcacttct

SEQ ID NO: 1526200 - DNA, 16 bp, Homo sapiens
aaaacaatattacttt

SEQ ID NO: 1526201 - DNA, 17 bp, Homo sapiens
aaaacaatattgtttct

SEQ ID NO: 1526202 - DNA, 12 bp, Homo sapiens
aaaacaatgcca

SEQ ID NO: 1526203 - DNA, 20 bp, Homo sapiens
aaaacaatgccatgaacaaa

SEQ ID NO: 1526204 - DNA, 14 bp, Homo sapiens
catggttgagaaat

SEQ ID NO: 1526205 - DNA, 14 bp, Homo sapiens
catggttgtttttt

SEQ ID NO: 1526206 - DNA, 19 bp, Homo sapiens
catggttttgtgccatctg

SEQ ID NO: 1526207 - DNA, 24 bp, Homo sapiens
catggttttgtgccatctgtagct

SEQ ID NO: 1526208 - DNA, 16 bp, Homo sapiens
catgtaaaagcggaaa

SEQ ID NO: 1526209 - DNA, 21 bp, Homo sapiens
catgtaaatccccactgggac

SEQ ID NO: 1526210 - DNA, 12 bp, Homo sapiens
catgtaacattg

SEQ ID NO: 1526211 - DNA, 21 bp, Homo sapiens
catgtaactatttcttcagag

SEQ ID NO: 1526212 - DNA, 15 bp, Homo sapiens
catgtaagaaaatgt

SEQ ID NO: 1526213 - DNA, 20 bp, Homo sapiens
catgtaaggttgtgcagggt

SEQ ID NO: 1526214 - DNA, 21 bp, Homo sapiens
catgtaaggttgtgcagggtg

SEQ ID NO: 1526215 - DNA, 23 bp, Homo sapiens
catgtaatatatttcagacattt

SEQ ID NO: 1526216 - DNA, 19 bp, Homo sapiens
catgtaatgttaatgttat

SEQ ID NO: 1526217 - DNA, 23 bp, Homo sapiens
catgtacaaaatcgattggcttt

SEQ ID NO: 1526218 - DNA, 17 bp, Homo sapiens
catgtacatagtaaagt

SEQ ID NO: 1526219 - DNA, 20 bp, Homo sapiens
catgtacatagtaaagtatt

SEQ ID NO: 1526220 - DNA, 20 bp, Homo sapiens
catgtacatgaagaagctaa

SEQ ID NO: 1526221 - DNA, 21 bp, Homo sapiens
catgtaccatcaataaagtac

SEQ ID NO: 1526222 - DNA, 14 bp, Homo sapiens
catgtactacagct

SEQ ID NO: 1526223 - DNA, 17 bp, Homo sapiens
catgtactacagctata

SEQ ID NO: 1526224 - DNA, 14 bp, Homo sapiens
catgtactatctta

SEQ ID NO: 1526225 - DNA, 20 bp, Homo sapiens
catgtactccagagggacag

SEQ ID NO: 1526226 - DNA, 13 bp, Homo sapiens
catgtacttgttt

SEQ ID NO: 1526227 - DNA, 21 bp, Homo sapiens
catgtagccccctggcctctg

SEQ ID NO: 1526228 - DNA, 22 bp, Homo sapiens
catgtagccccctggcctctgt

SEQ ID NO: 1526229 - DNA, 22 bp, Homo sapiens
catgtaggttgtctaaaaataa

SEQ ID NO: 1526230 - DNA, 15 bp, Homo sapiens
catgtatgaatgtaa

SEQ ID NO: 1526231 - DNA, 22 bp, Homo sapiens
catgtatgtcagaagtgcagaa

SEQ ID NO: 1526232 - DNA, 13 bp, Homo sapiens
catgtatgtcttg

SEQ ID NO: 1526233 - DNA, 21 bp, Homo sapiens
catgtatgtcttggacactgt

SEQ ID NO: 1526234 - DNA, 22 bp, Homo sapiens
catgtatgtcttggacactgta

SEQ ID NO: 1526235 - DNA, 22 bp, Homo sapiens
catgtattaaattacatttgta

SEQ ID NO: 1526236 - DNA, 15 bp, Homo sapiens
catgtattagctcac

SEQ ID NO: 1526237 - DNA, 15 bp, Homo sapiens
catgtattatttcat

SEQ ID NO: 1526238 - DNA, 17 bp, Homo sapiens
catgtattggcctggag

SEQ ID NO: 1526239 - DNA, 22 bp, Homo sapiens
catgtatttgttatatataata

SEQ ID NO: 1526240 - DNA, 16 bp, Homo sapiens
aaaactatcaactaca

SEQ ID NO: 1526241 - DNA, 12 bp, Homo sapiens
aaaactatggtt

SEQ ID NO: 1526242 - DNA, 19 bp, Homo sapiens
aaaactctacttaatccaa

SEQ ID NO: 1526243 - DNA, 15 bp, Homo sapiens
aaaactctttcggta

SEQ ID NO: 1526244 - DNA, 12 bp, Homo sapiens
aaaactctttga

SEQ ID NO: 1526245 - DNA, 16 bp, Homo sapiens
aaaactgacttaatgc

SEQ ID NO: 1526246 - DNA, 19 bp, Homo sapiens
aaaactgatcaaaaataaa

SEQ ID NO: 1526247 - DNA, 20 bp, Homo sapiens
aaaactgatcaaaaataaac

SEQ ID NO: 1526248 - DNA, 11 bp, Homo sapiens
aaaactgctcc

SEQ ID NO: 1526249 - DNA, 22 bp, Homo sapiens
aaaactgctcctcctcctgtat

SEQ ID NO: 1526250 - DNA, 12 bp, Homo sapiens
aaaactgctttt

SEQ ID NO: 1526251 - DNA, 16 bp, Homo sapiens
aaaactggacctgtat

SEQ ID NO: 1526252 - DNA, 20 bp, Homo sapiens
aaaactggatatttcaatct

SEQ ID NO: 1526253 - DNA, 22 bp, Homo sapiens
aaaactgtaaataaaatgtgta

SEQ ID NO: 1526254 - DNA, 20 bp, Homo sapiens
aaaactgtacatttaaaatt

SEQ ID NO: 1526255 - DNA, 14 bp, Homo sapiens
aaaactgttgtcac

SEQ ID NO: 1526256 - DNA, 19 bp, Homo sapiens
aaaacttaaaaattaatat

SEQ ID NO: 1526257 - DNA, 21 bp, Homo sapiens
aaaacttcattctaaaccaaa

SEQ ID NO: 1526258 - DNA, 12 bp, Homo sapiens
aaaacttctttt

SEQ ID NO: 1526259 - DNA, 14 bp, Homo sapiens
aaaacttgaaagaa

SEQ ID NO: 1526260 - DNA, 22 bp, Homo sapiens
aaaacttgatgtgttatctctt

SEQ ID NO: 1526261 - DNA, 17 bp, Homo sapiens
aaaacttgtaaatgctg

SEQ ID NO: 1526262 - DNA, 20 bp, Homo sapiens
aaaactttcctcgcctgaca

SEQ ID NO: 1526263 - DNA, 17 bp, Homo sapiens
aaaactttgactttgcc

SEQ ID NO: 1526264 - DNA, 11 bp, Homo sapiens
aaaactttgga

SEQ ID NO: 1526265 - DNA, 17 bp, Homo sapiens
aaaactttggaaccaga

SEQ ID NO: 1526266 - DNA, 15 bp, Homo sapiens
aaaacttttctcaga

SEQ ID NO: 1526267 - DNA, 15 bp, Homo sapiens
aaaacttttctgctg

SEQ ID NO: 1526268 - DNA, 22 bp, Homo sapiens
aaaacttttgtttagagccctc

SEQ ID NO: 1526269 - DNA, 17 bp, Homo sapiens
aaaagaaaaaaaaaaga

SEQ ID NO: 1526270 - DNA, 22 bp, Homo sapiens
aaaagaaaatctttataaatgt

SEQ ID NO: 1526271 - DNA, 11 bp, Homo sapiens
aaaagaaacta

SEQ ID NO: 1526272 - DNA, 11 bp, Homo sapiens
aaaagaaatat

SEQ ID NO: 1526273 - DNA, 21 bp, Homo sapiens
aaaagaaatcaatagttgaat

SEQ ID NO: 1526274 - DNA, 12 bp, Homo sapiens
aaaagaaatgaa

SEQ ID NO: 1526275 - DNA, 13 bp, Homo sapiens
aaaagaaatgatg

SEQ ID NO: 1526276 - DNA, 11 bp, Homo sapiens
aaaagaaggaa

SEQ ID NO: 1526277 - DNA, 16 bp, Homo sapiens
aaaagaagtttcagtt

SEQ ID NO: 1526278 - DNA, 14 bp, Homo sapiens
aaaagaccagggct

SEQ ID NO: 1526279 - DNA, 13 bp, Homo sapiens
aaaagactccaaa

SEQ ID NO: 1526280 - DNA, 13 bp, Homo sapiens
aaaagactgaaca

SEQ ID NO: 1526281 - DNA, 16 bp, Homo sapiens
aaaagactgaacatgt

SEQ ID NO: 1526282 - DNA, 11 bp, Homo sapiens
aaaagagaaac

SEQ ID NO: 1526283 - DNA, 15 bp, Homo sapiens
aaaagagaaacaagt

SEQ ID NO: 1526284 - DNA, 18 bp, Homo sapiens
aaaagagctcagacattt

SEQ ID NO: 1526285 - DNA, 17 bp, Homo sapiens
aaaagaggttactttag

SEQ ID NO: 1526286 - DNA, 13 bp, Homo sapiens
aaaagagtaattt

SEQ ID NO: 1526287 - DNA, 17 bp, Homo sapiens
aaaagagtcttccaatt

SEQ ID NO: 1526288 - DNA, 22 bp, Homo sapiens
aaaagagttccctgcaaccaat

SEQ ID NO: 1526289 - DNA, 22 bp, Homo sapiens
aaaagatacaaaagctttttaa

SEQ ID NO: 1526290 - DNA, 10 bp, Homo sapiens
aaaagatccc

SEQ ID NO: 1526291 - DNA, 22 bp, Homo sapiens
aaaagatccccaagaccccctg

SEQ ID NO: 1526292 - DNA, 16 bp, Homo sapiens
aaaagatcctttttaa

SEQ ID NO: 1526293 - DNA, 17 bp, Homo sapiens
aaaagatgaaaatattt

SEQ ID NO: 1526294 - DNA, 19 bp, Homo sapiens
aaaagatggttgtagcatt

SEQ ID NO: 1526295 - DNA, 14 bp, Homo sapiens
aaaagatgtatcct

SEQ ID NO: 1526296 - DNA, 13 bp, Homo sapiens
aaaagattcattt

SEQ ID NO: 1526297 - DNA, 21 bp, Homo sapiens
aaaagattgaagtattttgct

SEQ ID NO: 1526298 - DNA, 16 bp, Homo sapiens
aaaagattgctgaaat

SEQ ID NO: 1526299 - DNA, 18 bp, Homo sapiens
aaaagattgctgaaattt

SEQ ID NO: 1526300 - DNA, 21 bp, Homo sapiens
aaaagattttcagaaaatatt

SEQ ID NO: 1526301 - DNA, 14 bp, Homo sapiens
aaaagcaaaagaga

SEQ ID NO: 1526302 - DNA, 14 bp, Homo sapiens
aaaagcaaatgaga

SEQ ID NO: 1526303 - DNA, 12 bp, Homo sapiens
aaaagcaagact

SEQ ID NO: 1526304 - DNA, 14 bp, Homo sapiens
aaaagcagaatttt

SEQ ID NO: 1526305 - DNA, 20 bp, Homo sapiens
aaaagcagaattttaatgtg

SEQ ID NO: 1526306 - DNA, 20 bp, Homo sapiens
aaaagcagctaaatgtaact

SEQ ID NO: 1526307 - DNA, 23 bp, Homo sapiens
aaaagcagctaaatgtaacttat

SEQ ID NO: 1526308 - DNA, 22 bp, Homo sapiens
aaaagcagtcctcttattccta

SEQ ID NO: 1526309 - DNA, 13 bp, Homo sapiens
aaaagcataaatg

SEQ ID NO: 1526310 - DNA, 20 bp, Homo sapiens
aaaagcatgatgggaaaata

SEQ ID NO: 1526311 - DNA, 17 bp, Homo sapiens
aaaagcatttttcaata

SEQ ID NO: 1526312 - DNA, 21 bp, Homo sapiens
aaaagcatttttcaatatatt

SEQ ID NO: 1526313 - DNA, 11 bp, Homo sapiens
aaaagccaaag

SEQ ID NO: 1526314 - DNA, 13 bp, Homo sapiens
aaaagccaaaggt

SEQ ID NO: 1526315 - DNA, 17 bp, Homo sapiens
aaaagccattattatga

SEQ ID NO: 1526316 - DNA, 18 bp, Homo sapiens
aaaagccattattatgat

SEQ ID NO: 1526317 - DNA, 16 bp, Homo sapiens
aaaagcctaatcacag

SEQ ID NO: 1526318 - DNA, 15 bp, Homo sapiens
aaaagcctccttgtg

SEQ ID NO: 1526319 - DNA, 19 bp, Homo sapiens
aaaagcctccttgtgcaat

SEQ ID NO: 1526320 - DNA, 15 bp, Homo sapiens
aaaagccttattcta

SEQ ID NO: 1526321 - DNA, 13 bp, Homo sapiens
aaaagccttattt

SEQ ID NO: 1526322 - DNA, 19 bp, Homo sapiens
catgttaaaaatagcagta

SEQ ID NO: 1526323 - DNA, 20 bp, Homo sapiens
catgttactacagaggaaag

SEQ ID NO: 1526324 - DNA, 14 bp, Homo sapiens
catgttaggaaaat

SEQ ID NO: 1526325 - DNA, 14 bp, Homo sapiens
catgttagttacct

SEQ ID NO: 1526326 - DNA, 15 bp, Homo sapiens
catgttcccagaaag

SEQ ID NO: 1526327 - DNA, 13 bp, Homo sapiens
catgttcctcaaa

SEQ ID NO: 1526328 - DNA, 13 bp, Homo sapiens
catgttcctcctt

SEQ ID NO: 1526329 - DNA, 19 bp, Homo sapiens
catgttctaccgtggattt

SEQ ID NO: 1526330 - DNA, 22 bp, Homo sapiens
catgttctaccgtggatttgta

SEQ ID NO: 1526331 - DNA, 20 bp, Homo sapiens
catgttgacgagactggtct

SEQ ID NO: 1526332 - DNA, 15 bp, Homo sapiens
catgttgagccagtg

SEQ ID NO: 1526333 - DNA, 17 bp, Homo sapiens
catgttgatcatgtact

SEQ ID NO: 1526334 - DNA, 15 bp, Homo sapiens
catgttgggaaactt

SEQ ID NO: 1526335 - DNA, 12 bp, Homo sapiens
catgttgtaatg

SEQ ID NO: 1526336 - DNA, 20 bp, Homo sapiens
catgtttaaatagcctaaat

SEQ ID NO: 1526337 - DNA, 23 bp, Homo sapiens
catgtttaaatagcctaaatgat

SEQ ID NO: 1526338 - DNA, 12 bp, Homo sapiens
catgtttaatgg

SEQ ID NO: 1526339 - DNA, 23 bp, Homo sapiens
catgtttataaatcttatgctct

SEQ ID NO: 1526340 - DNA, 22 bp, Homo sapiens
catgtttattgttttttaaaga

SEQ ID NO: 1526341 - DNA, 23 bp, Homo sapiens
catgtttatttatttccagtggt

SEQ ID NO: 1526342 - DNA, 13 bp, Homo sapiens
catgtttcctcta

SEQ ID NO: 1526343 - DNA, 17 bp, Homo sapiens
catgtttctcacattgc

SEQ ID NO: 1526344 - DNA, 20 bp, Homo sapiens
catgtttgagctcagacccc

SEQ ID NO: 1526345 - DNA, 14 bp, Homo sapiens
catgtttgcctaga

SEQ ID NO: 1526346 - DNA, 18 bp, Homo sapiens
catgtttgcctagacagc

SEQ ID NO: 1526347 - DNA, 14 bp, Homo sapiens
catgttttagcatt

SEQ ID NO: 1526348 - DNA, 21 bp, Homo sapiens
catgttttctttgtttcctgg

SEQ ID NO: 1526349 - DNA, 20 bp, Homo sapiens
catgttttgatgagaaaaaa

SEQ ID NO: 1526350 - DNA, 16 bp, Homo sapiens
catgttttttcttcaa

SEQ ID NO: 1526351 - DNA, 21 bp, Homo sapiens
cattaaaaaatcagttgtaca

SEQ ID NO: 1526352 - DNA, 19 bp, Homo sapiens
cattaaaaagttgttcttt

SEQ ID NO: 1526353 - DNA, 22 bp, Homo sapiens
cattaaaacaatattgtttcta

SEQ ID NO: 1526354 - DNA, 16 bp, Homo sapiens
cattaaaactgctttt

SEQ ID NO: 1526355 - DNA, 17 bp, Homo sapiens
cattaaacttgaagcag

SEQ ID NO: 1526356 - DNA, 15 bp, Homo sapiens
cattgagctgtgcaa

SEQ ID NO: 1526357 - DNA, 15 bp, Homo sapiens
cattgagtattgttt

SEQ ID NO: 1526358 - DNA, 14 bp, Homo sapiens
cattgccaccagga

SEQ ID NO: 1526359 - DNA, 15 bp, Homo sapiens
cattgccaccaggag

SEQ ID NO: 1526360 - DNA, 17 bp, Homo sapiens
cattgccaccaggagaa

SEQ ID NO: 1526361 - DNA, 20 bp, Homo sapiens
cattgccaccaggagaacca

SEQ ID NO: 1526362 - DNA, 24 bp, Homo sapiens
cattgcccctccgatgctgaggcc

SEQ ID NO: 1526363 - DNA, 18 bp, Homo sapiens
cattgcctcctgttctgc

SEQ ID NO: 1526364 - DNA, 13 bp, Homo sapiens
cattgcctggact

SEQ ID NO: 1526365 - DNA, 15 bp, Homo sapiens
cattgcctggactga

SEQ ID NO: 1526366 - DNA, 14 bp, Homo sapiens
cattgcctgttctg

SEQ ID NO: 1526367 - DNA, 17 bp, Homo sapiens
cattgcctgttctgctt

SEQ ID NO: 1526368 - DNA, 18 bp, Homo sapiens
cattgcctgttctgcttc

SEQ ID NO: 1526369 - DNA, 21 bp, Homo sapiens
cattgccttaactggagcccc

SEQ ID NO: 1526370 - DNA, 17 bp, Homo sapiens
cattgccttctggagct

SEQ ID NO: 1526371 - DNA, 21 bp, Homo sapiens
cattgcgctctagcctgggca

SEQ ID NO: 1526372 - DNA, 14 bp, Homo sapiens
cattgctaaaaaat

SEQ ID NO: 1526373 - DNA, 16 bp, Homo sapiens
cattgctaaaaaataa

SEQ ID NO: 1526374 - DNA, 17 bp, Homo sapiens
cattgctaaaaaataaa

SEQ ID NO: 1526375 - DNA, 15 bp, Homo sapiens
cattgctaccacaga

SEQ ID NO: 1526376 - DNA, 21 bp, Homo sapiens
cattgctaccacagacttgca

SEQ ID NO: 1526377 - DNA, 17 bp, Homo sapiens
cattgctcagcccgctt

SEQ ID NO: 1526378 - DNA, 21 bp, Homo sapiens
cattgctcagcccgcttggcc

SEQ ID NO: 1526379 - DNA, 17 bp, Homo sapiens
cattgctctatgtctgc

SEQ ID NO: 1526380 - DNA, 17 bp, Homo sapiens
cattgctctctgggctt

SEQ ID NO: 1526381 - DNA, 21 bp, Homo sapiens
cattgctgccaaggtggaggg

SEQ ID NO: 1526382 - DNA, 18 bp, Homo sapiens
cattgctgctgctaccag

SEQ ID NO: 1526383 - DNA, 22 bp, Homo sapiens
cattgctggtagagacccccag

SEQ ID NO: 1526384 - DNA, 15 bp, Homo sapiens
cattgctggttctat

SEQ ID NO: 1526385 - DNA, 21 bp, Homo sapiens
cattgctggttctatttaatg

SEQ ID NO: 1526386 - DNA, 23 bp, Homo sapiens
cattgctgtgtgaatccaggagg

SEQ ID NO: 1526387 - DNA, 18 bp, Homo sapiens
cattgctttcgtgtaaat

SEQ ID NO: 1526388 - DNA, 19 bp, Homo sapiens
cattgctttcgtgtaaatt

SEQ ID NO: 1526389 - DNA, 15 bp, Homo sapiens
cattggaagacccca

SEQ ID NO: 1526390 - DNA, 16 bp, Homo sapiens
cattggaagaccccac

SEQ ID NO: 1526391 - DNA, 17 bp, Homo sapiens
cattggaagaccccacc

SEQ ID NO: 1526392 - DNA, 20 bp, Homo sapiens
cattggaagaccccacccaa

SEQ ID NO: 1526393 - DNA, 13 bp, Homo sapiens
cattggaagccat

SEQ ID NO: 1526394 - DNA, 22 bp, Homo sapiens
cattggaataaggcatggctca

SEQ ID NO: 1526395 - DNA, 12 bp, Homo sapiens
cattggagctga

SEQ ID NO: 1526396 - DNA, 22 bp, Homo sapiens
cattggagctgactgttcttgg

SEQ ID NO: 1526397 - DNA, 14 bp, Homo sapiens
cattggatctgcaa

SEQ ID NO: 1526398 - DNA, 15 bp, Homo sapiens
cattggcacaatgta

SEQ ID NO: 1526399 - DNA, 21 bp, Homo sapiens
cattggcacctaatccaggca

SEQ ID NO: 1526400 - DNA, 16 bp, Homo sapiens
cattggcccctgagcc

SEQ ID NO: 1526401 - DNA, 21 bp, Homo sapiens
cattggcccctgagcccagag

SEQ ID NO: 1526402 - DNA, 17 bp, Homo sapiens
cattggcctggcctcca

SEQ ID NO: 1526403 - DNA, 16 bp, Homo sapiens
cattgggaccctccag

SEQ ID NO: 1526404 - DNA, 20 bp, Homo sapiens
cattgggaccctccagtgct

SEQ ID NO: 1526405 - DNA, 13 bp, Homo sapiens
cattggtccaaga

SEQ ID NO: 1526406 - DNA, 14 bp, Homo sapiens
cattggtccaagat

SEQ ID NO: 1526407 - DNA, 17 bp, Homo sapiens
cattggttggaagctac

SEQ ID NO: 1526408 - DNA, 16 bp, Homo sapiens
cattgtaaaataattc

SEQ ID NO: 1526409 - DNA, 14 bp, Homo sapiens
cattgtaaatcact

SEQ ID NO: 1526410 - DNA, 15 bp, Homo sapiens
cattgtaaatcactt

SEQ ID NO: 1526411 - DNA, 13 bp, Homo sapiens
cattgtaatgttg

SEQ ID NO: 1526412 - DNA, 19 bp, Homo sapiens
cattgtaatgttgtgaata

SEQ ID NO: 1526413 - DNA, 17 bp, Homo sapiens
cattgtactccagcctg

SEQ ID NO: 1526414 - DNA, 18 bp, Homo sapiens
cattgtactgttgcttta

SEQ ID NO: 1526415 - DNA, 21 bp, Homo sapiens
cattgtactgttgctttaata

SEQ ID NO: 1526416 - DNA, 21 bp, Homo sapiens
cattgtagaaacacagttttg

SEQ ID NO: 1526417 - DNA, 14 bp, Homo sapiens
cattgtatatgtga

SEQ ID NO: 1526418 - DNA, 15 bp, Homo sapiens
cattgtatgcaggga

SEQ ID NO: 1526419 - DNA, 17 bp, Homo sapiens
cattgtatgcagggagc

SEQ ID NO: 1526420 - DNA, 19 bp, Homo sapiens
cattgtccctgaagagaag

SEQ ID NO: 1526421 - DNA, 20 bp, Homo sapiens
cattgtcctccttttcactt

SEQ ID NO: 1526422 - DNA, 22 bp, Homo sapiens
cattgtctactcctagaagaac

SEQ ID NO: 1526423 - DNA, 15 bp, Homo sapiens
cattgtctttgctgt

SEQ ID NO: 1526424 - DNA, 16 bp, Homo sapiens
cattgtctttgctgta

SEQ ID NO: 1526425 - DNA, 21 bp, Homo sapiens
cattgtctttgctgtactctt

SEQ ID NO: 1526426 - DNA, 17 bp, Homo sapiens
cattgtgagctctggtt

SEQ ID NO: 1526427 - DNA, 18 bp, Homo sapiens
cattgtgattggcctgta

SEQ ID NO: 1526428 - DNA, 21 bp, Homo sapiens
cattgtggtgtgagcttcaga

SEQ ID NO: 1526429 - DNA, 17 bp, Homo sapiens
cattgtgtcagaaacat

SEQ ID NO: 1526430 - DNA, 22 bp, Homo sapiens
cattgtgtcagaaacatgaaat

SEQ ID NO: 1526431 - DNA, 16 bp, Homo sapiens
cattgttatttataca

SEQ ID NO: 1526432 - DNA, 14 bp, Homo sapiens
cattgttcccttcc

SEQ ID NO: 1526433 - DNA, 13 bp, Homo sapiens
cattgttttaaaa

SEQ ID NO: 1526434 - DNA, 23 bp, Homo sapiens
cattgttttaaaaagaaacaaga

SEQ ID NO: 1526435 - DNA, 12 bp, Homo sapiens
catttaaaaaaa

SEQ ID NO: 1526436 - DNA, 21 bp, Homo sapiens
catttaaaaaaaaaatttgtt

SEQ ID NO: 1526437 - DNA, 12 bp, Homo sapiens
catttaaaacag

SEQ ID NO: 1526438 - DNA, 17 bp, Homo sapiens
catttaaaacagacact

SEQ ID NO: 1526439 - DNA, 23 bp, Homo sapiens
catttaaaacagacactggcatg

SEQ ID NO: 1526440 - DNA, 22 bp, Homo sapiens
catttaaaagcataaggccgga

SEQ ID NO: 1526441 - DNA, 12 bp, Homo sapiens
catttaaaatga

SEQ ID NO: 1526442 - DNA, 15 bp, Homo sapiens
catttaaaatgatta

SEQ ID NO: 1526443 - DNA, 16 bp, Homo sapiens
catttaaaatgattag

SEQ ID NO: 1526444 - DNA, 19 bp, Homo sapiens
catttaaaattgctatgtt

SEQ ID NO: 1526445 - DNA, 20 bp, Homo sapiens
aaaattctgatgtttctgtg

SEQ ID NO: 1526446 - DNA, 20 bp, Homo sapiens
aaaattctgtaggttctgtg

SEQ ID NO: 1526447 - DNA, 20 bp, Homo sapiens
aaaattgaatgtggctgaag

SEQ ID NO: 1526448 - DNA, 13 bp, Homo sapiens
aaaattgatatta

SEQ ID NO: 1526449 - DNA, 17 bp, Homo sapiens
aaaattgatattatatt

SEQ ID NO: 1526450 - DNA, 23 bp, Homo sapiens
aaaattgatattatattaaacat

SEQ ID NO: 1526451 - DNA, 13 bp, Homo sapiens
aaaattgatattt

SEQ ID NO: 1526452 - DNA, 21 bp, Homo sapiens
aaaattgatgtgtttatttat

SEQ ID NO: 1526453 - DNA, 20 bp, Homo sapiens
aaaattgatttccatatttt

SEQ ID NO: 1526454 - DNA, 12 bp, Homo sapiens
aaaattgatttt

SEQ ID NO: 1526455 - DNA, 20 bp, Homo sapiens
aaaattgatttttctcttca

SEQ ID NO: 1526456 - DNA, 12 bp, Homo sapiens
aaaattgccttt

SEQ ID NO: 1526457 - DNA, 20 bp, Homo sapiens
aaaattgtctgggttccaaa

SEQ ID NO: 1526458 - DNA, 15 bp, Homo sapiens
aaaattgttgtgctt

SEQ ID NO: 1526459 - DNA, 21 bp, Homo sapiens
aaaatttactacaatatgtac

SEQ ID NO: 1526460 - DNA, 22 bp, Homo sapiens
aaaatttatggttttggtattt

SEQ ID NO: 1526461 - DNA, 13 bp, Homo sapiens
aaaatttcacatt

SEQ ID NO: 1526462 - DNA, 20 bp, Homo sapiens
aaaatttcacattaatattt

SEQ ID NO: 1526463 - DNA, 19 bp, Homo sapiens
aaaatttccttcaggtttt

SEQ ID NO: 1526464 - DNA, 18 bp, Homo sapiens
aaaatttcgttgtccaat

SEQ ID NO: 1526465 - DNA, 18 bp, Homo sapiens
aaaatttgaaatttagct

SEQ ID NO: 1526466 - DNA, 19 bp, Homo sapiens
aaaatttgatggactaatt

SEQ ID NO: 1526467 - DNA, 19 bp, Homo sapiens
aaaatttgtttgaaatctt

SEQ ID NO: 1526468 - DNA, 17 bp, Homo sapiens
aaaattttaaaaatcta

SEQ ID NO: 1526469 - DNA, 16 bp, Homo sapiens
aaaattttgcttttaa

SEQ ID NO: 1526470 - DNA, 22 bp, Homo sapiens
aaacagttggtaacttttgtga

SEQ ID NO: 1526471 - DNA, 14 bp, Homo sapiens
aaacataaaaactg

SEQ ID NO: 1526472 - DNA, 15 bp, Homo sapiens
aaacataaaaagcag

SEQ ID NO: 1526473 - DNA, 17 bp, Homo sapiens
aaacataaagaaaagat

SEQ ID NO: 1526474 - DNA, 17 bp, Homo sapiens
aaacataacataaattt

SEQ ID NO: 1526475 - DNA, 20 bp, Homo sapiens
aaacataatcttctgccttc

SEQ ID NO: 1526476 - DNA, 10 bp, Homo sapiens
aaacataatt

SEQ ID NO: 1526477 - DNA, 21 bp, Homo sapiens
aaacataattcttgtatatta

SEQ ID NO: 1526478 - DNA, 14 bp, Homo sapiens
aaacataattgtgg

SEQ ID NO: 1526479 - DNA, 12 bp, Homo sapiens
aaacatacagag

SEQ ID NO: 1526480 - DNA, 14 bp, Homo sapiens
aaacatatttttat

SEQ ID NO: 1526481 - DNA, 19 bp, Homo sapiens
aaacatatttttatacttt

SEQ ID NO: 1526482 - DNA, 20 bp, Homo sapiens
aaacatatttttatacttta

SEQ ID NO: 1526483 - DNA, 23 bp, Homo sapiens
aaacatatttttatactttattg

SEQ ID NO: 1526484 - DNA, 20 bp, Homo sapiens
aaacatccttcaagaactct

SEQ ID NO: 1526485 - DNA, 17 bp, Homo sapiens
aaacatgacactgacct

SEQ ID NO: 1526486 - DNA, 12 bp, Homo sapiens
aaacatgcacac

SEQ ID NO: 1526487 - DNA, 13 bp, Homo sapiens
aaacatggagaaa

SEQ ID NO: 1526488 - DNA, 14 bp, Homo sapiens
aaacatggagaaat

SEQ ID NO: 1526489 - DNA, 17 bp, Homo sapiens
aaacatggagaaatcta

SEQ ID NO: 1526490 - DNA, 17 bp, Homo sapiens
aaacatggtttgactct

SEQ ID NO: 1526491 - DNA, 12 bp, Homo sapiens
aaacatgtatgt

SEQ ID NO: 1526492 - DNA, 12 bp, Homo sapiens
aaacatgtcatg

SEQ ID NO: 1526493 - DNA, 21 bp, Homo sapiens
aaacatgttaatgacaatatt

SEQ ID NO: 1526494 - DNA, 21 bp, Homo sapiens
aaacatgtttaaatagcctaa

SEQ ID NO: 1526495 - DNA, 19 bp, Homo sapiens
aaacatgtttccactattg

SEQ ID NO: 1526496 - DNA, 12 bp, Homo sapiens
aaacattaaaca

SEQ ID NO: 1526497 - DNA, 21 bp, Homo sapiens
aaacattaaacactgtaatct

SEQ ID NO: 1526498 - DNA, 21 bp, Homo sapiens
aaacattaatagcagcctttc

SEQ ID NO: 1526499 - DNA, 18 bp, Homo sapiens
aaacattaattttgtgca

SEQ ID NO: 1526500 - DNA, 22 bp, Homo sapiens
aaacattaattttgtgcattct

SEQ ID NO: 1526501 - DNA, 23 bp, Homo sapiens
aaacattaattttgtgcattctt

SEQ ID NO: 1526502 - DNA, 20 bp, Homo sapiens
aaacattgaagtaatgaatt

SEQ ID NO: 1526503 - DNA, 22 bp, Homo sapiens
aaacatttacaataaatattct

SEQ ID NO: 1526504 - DNA, 15 bp, Homo sapiens
aaacatttgttcctg

SEQ ID NO: 1526505 - DNA, 16 bp, Homo sapiens
aaacatttgttcctgg

SEQ ID NO: 1526506 - DNA, 16 bp, Homo sapiens
aaacattttctggcca

SEQ ID NO: 1526507 - DNA, 21 bp, Homo sapiens
aaacattttgtggtcattaag

SEQ ID NO: 1526508 - DNA, 22 bp, Homo sapiens
aaacattttttaagaaaacatt

SEQ ID NO: 1526509 - DNA, 14 bp, Homo sapiens
aaacattttttagt

SEQ ID NO: 1526510 - DNA, 17 bp, Homo sapiens
aaacattttttcttcaa

SEQ ID NO: 1526511 - DNA, 18 bp, Homo sapiens
aaacattttttcttctga

SEQ ID NO: 1526512 - DNA, 22 bp, Homo sapiens
aaacattttttcttctgaagat

SEQ ID NO: 1526513 - DNA, 13 bp, Homo sapiens
aaaccaaaacaga

SEQ ID NO: 1526514 - DNA, 17 bp, Homo sapiens
aaaccaaagagggcttc

SEQ ID NO: 1526515 - DNA, 19 bp, Homo sapiens
aaaccaaagagggcttcct

SEQ ID NO: 1526516 - DNA, 21 bp, Homo sapiens
aaaccaaagagggcttcctct

SEQ ID NO: 1526517 - DNA, 17 bp, Homo sapiens
aaaccaacaataaatat

SEQ ID NO: 1526518 - DNA, 14 bp, Homo sapiens
aaaccaagccgtgg

SEQ ID NO: 1526519 - DNA, 14 bp, Homo sapiens
aaaccaagccttgg

SEQ ID NO: 1526520 - DNA, 14 bp, Homo sapiens
aaaccaaggactga

SEQ ID NO: 1526521 - DNA, 21 bp, Homo sapiens
aaaccacaactgacacaggaa

SEQ ID NO: 1526522 - DNA, 14 bp, Homo sapiens
aaaccacacaaaga

SEQ ID NO: 1526523 - DNA, 14 bp, Homo sapiens
aaaccacagtcagt

SEQ ID NO: 1526524 - DNA, 15 bp, Homo sapiens
aaaccactagaaagt

SEQ ID NO: 1526525 - DNA, 16 bp, Homo sapiens
aaaccactagaactct

SEQ ID NO: 1526526 - DNA, 16 bp, Homo sapiens
aaaccactgaaaaaat

SEQ ID NO: 1526527 - DNA, 17 bp, Homo sapiens
aaaccactgaaaaaata

SEQ ID NO: 1526528 - DNA, 16 bp, Homo sapiens
aaaccacttgagccta

SEQ ID NO: 1526529 - DNA, 15 bp, Homo sapiens
aaaccagccaggcag

SEQ ID NO: 1526530 - DNA, 12 bp, Homo sapiens
aaaccagccttc

SEQ ID NO: 1526531 - DNA, 16 bp, Homo sapiens
aaaccagccttcggag

SEQ ID NO: 1526532 - DNA, 12 bp, Homo sapiens
aaaccagctgct

SEQ ID NO: 1526533 - DNA, 16 bp, Homo sapiens
aaaccaggaccctgtc

SEQ ID NO: 1526534 - DNA, 16 bp, Homo sapiens
aaaccatcagatattt

SEQ ID NO: 1526535 - DNA, 20 bp, Homo sapiens
aaaccatcagatatttctta

SEQ ID NO: 1526536 - DNA, 15 bp, Homo sapiens
aaaccatgagaattt

SEQ ID NO: 1526537 - DNA, 21 bp, Homo sapiens
aaaccatgttgcgttcaaaga

SEQ ID NO: 1526538 - DNA, 23 bp, Homo sapiens
aaacccaccagcctaagaagctc

SEQ ID NO: 1526539 - DNA, 14 bp, Homo sapiens
aaacccagactgtc

SEQ ID NO: 1526540 - DNA, 12 bp, Homo sapiens
aaacccagagag

SEQ ID NO: 1526541 - DNA, 13 bp, Homo sapiens
aaacccagggcaa

SEQ ID NO: 1526542 - DNA, 16 bp, Homo sapiens
aaacccatacaatgta

SEQ ID NO: 1526543 - DNA, 23 bp, Homo sapiens
aaacccatacaatgtatgtacaa

SEQ ID NO: 1526544 - DNA, 22 bp, Homo sapiens
aaacccatattgtaaaacaggt

SEQ ID NO: 1526545 - DNA, 18 bp, Homo sapiens
aaaccctagccttgcttg

SEQ ID NO: 1526546 - DNA, 20 bp, Homo sapiens
aaaccctcccagaaacatct

SEQ ID NO: 1526547 - DNA, 17 bp, Homo sapiens
aaaccctggcttgcttg

SEQ ID NO: 1526548 - DNA, 11 bp, Homo sapiens
aaaccctggtt

SEQ ID NO: 1526549 - DNA, 16 bp, Homo sapiens
aaacccttgctttcct

SEQ ID NO: 1526550 - DNA, 20 bp, Homo sapiens
aaaccgcctagtttactgtt

SEQ ID NO: 1526551 - DNA, 16 bp, Homo sapiens
aaacctaagtccttcc

SEQ ID NO: 1526552 - DNA, 17 bp, Homo sapiens
aaacctaagtccttcca

SEQ ID NO: 1526553 - DNA, 11 bp, Homo sapiens
aaacctaggtc

SEQ ID NO: 1526554 - DNA, 16 bp, Homo sapiens
aaacctagtactgccc

SEQ ID NO: 1526555 - DNA, 22 bp, Homo sapiens
aaacctcaaaatgtctaagata

SEQ ID NO: 1526556 - DNA, 15 bp, Homo sapiens
aaacctcacatttgt

SEQ ID NO: 1526557 - DNA, 22 bp, Homo sapiens
aaacctgactcaattatttgca

SEQ ID NO: 1526558 - DNA, 19 bp, Homo sapiens
aaacctgatgttaaaattc

SEQ ID NO: 1526559 - DNA, 17 bp, Homo sapiens
aaacctgccctgcctga

SEQ ID NO: 1526560 - DNA, 14 bp, Homo sapiens
aaacctgcttcctt

SEQ ID NO: 1526561 - DNA, 22 bp, Homo sapiens
aaacctggagatgcagctactg

SEQ ID NO: 1526562 - DNA, 16 bp, Homo sapiens
aaacctgtttaaatat

SEQ ID NO: 1526563 - DNA, 19 bp, Homo sapiens
aaacctgtttaaatatttc

SEQ ID NO: 1526564 - DNA, 21 bp, Homo sapiens
aaacctgtttaaatatttcaa

SEQ ID NO: 1526565 - DNA, 20 bp, Homo sapiens
aaaccttattttttcccaaa

SEQ ID NO: 1526566 - DNA, 23 bp, Homo sapiens
aaaccttccacccagtgctgaat

SEQ ID NO: 1526567 - DNA, 14 bp, Homo sapiens
catttgtaacttta

SEQ ID NO: 1526568 - DNA, 19 bp, Homo sapiens
catttgtaagtgtaaaaaa

SEQ ID NO: 1526569 - DNA, 14 bp, Homo sapiens
catttgtaatttaa

SEQ ID NO: 1526570 - DNA, 12 bp, Homo sapiens
catttgtacaag

SEQ ID NO: 1526571 - DNA, 16 bp, Homo sapiens
catttgtataaagaaa

SEQ ID NO: 1526572 - DNA, 11 bp, Homo sapiens
catttgtatat

SEQ ID NO: 1526573 - DNA, 12 bp, Homo sapiens
catttgtatatt

SEQ ID NO: 1526574 - DNA, 14 bp, Homo sapiens
catttgtatattgt

SEQ ID NO: 1526575 - DNA, 13 bp, Homo sapiens
catttgtattgct

SEQ ID NO: 1526576 - DNA, 17 bp, Homo sapiens
catttgtattgcttatt

SEQ ID NO: 1526577 - DNA, 12 bp, Homo sapiens
catttgtatttt

SEQ ID NO: 1526578 - DNA, 18 bp, Homo sapiens
catttgtctctacttttc

SEQ ID NO: 1526579 - DNA, 11 bp, Homo sapiens
catttgtgagg

SEQ ID NO: 1526580 - DNA, 12 bp, Homo sapiens
catttgtgaggc

SEQ ID NO: 1526581 - DNA, 15 bp, Homo sapiens
catttgtgccagagg

SEQ ID NO: 1526582 - DNA, 20 bp, Homo sapiens
catttgtgctccattttttc

SEQ ID NO: 1526583 - DNA, 23 bp, Homo sapiens
catttgtggtaatctacaccaat

SEQ ID NO: 1526584 - DNA, 19 bp, Homo sapiens
catttgtgtacacagtcag

SEQ ID NO: 1526585 - DNA, 13 bp, Homo sapiens
catttgttcctgc

SEQ ID NO: 1526586 - DNA, 16 bp, Homo sapiens
ccaaaccaggaccctg

SEQ ID NO: 1526587 - DNA, 16 bp, Homo sapiens
ccaaacccatgaggca

SEQ ID NO: 1526588 - DNA, 13 bp, Homo sapiens
ccaaacccctaga

SEQ ID NO: 1526589 - DNA, 14 bp, Homo sapiens
ccaaaccctgtctg

SEQ ID NO: 1526590 - DNA, 14 bp, Homo sapiens
ccaaacctgtcttg

SEQ ID NO: 1526591 - DNA, 16 bp, Homo sapiens
ccaaactcaggcccag

SEQ ID NO: 1526592 - DNA, 14 bp, Homo sapiens
ccaaactcagttca

SEQ ID NO: 1526593 - DNA, 17 bp, Homo sapiens
ccaaactgatccagtat

SEQ ID NO: 1526594 - DNA, 19 bp, Homo sapiens
ccaaactgccaaaaacaag

SEQ ID NO: 1526595 - DNA, 20 bp, Homo sapiens
ccaaagaaaaagggctgccg

SEQ ID NO: 1526596 - DNA, 12 bp, Homo sapiens
ccaaagaaagtt

SEQ ID NO: 1526597 - DNA, 13 bp, Homo sapiens
ccaaagaattgta

SEQ ID NO: 1526598 - DNA, 16 bp, Homo sapiens
ccaaagacctgcctgt

SEQ ID NO: 1526599 - DNA, 21 bp, Homo sapiens
ccaaagactatttcaaaatgt

SEQ ID NO: 1526600 - DNA, 15 bp, Homo sapiens
ccaaagagccttcag

SEQ ID NO: 1526601 - DNA, 16 bp, Homo sapiens
ccaaagagcctttcca

SEQ ID NO: 1526602 - DNA, 20 bp, Homo sapiens
ccaaagaggctgcccctctc

SEQ ID NO: 1526603 - DNA, 23 bp, Homo sapiens
ccaaagagggatgtttggaaaaa

SEQ ID NO: 1526604 - DNA, 19 bp, Homo sapiens
ccaaagatagacaggtcct

SEQ ID NO: 1526605 - DNA, 17 bp, Homo sapiens
ccaaagcaaagaaaata

SEQ ID NO: 1526606 - DNA, 21 bp, Homo sapiens
ccaaagcaaccacaaatgcat

SEQ ID NO: 1526607 - DNA, 19 bp, Homo sapiens
ccaaagcattgcctgccag

SEQ ID NO: 1526608 - DNA, 22 bp, Homo sapiens
ccaaagccaccagactgacaaa

SEQ ID NO: 1526609 - DNA, 23 bp, Homo sapiens
ccaaagctagggtggcccttgca

SEQ ID NO: 1526610 - DNA, 15 bp, Homo sapiens
ccaaagctgagcctg

SEQ ID NO: 1526611 - DNA, 20 bp, Homo sapiens
ccaaagctgagcctgcaggg

SEQ ID NO: 1526612 - DNA, 16 bp, Homo sapiens
ccaaagctttcctgcc

SEQ ID NO: 1526613 - DNA, 14 bp, Homo sapiens
ccaaaggaacactg

SEQ ID NO: 1526614 - DNA, 17 bp, Homo sapiens
ccaaaggaacactgaca

SEQ ID NO: 1526615 - DNA, 13 bp, Homo sapiens
ccaaaggaaggaa

SEQ ID NO: 1526616 - DNA, 14 bp, Homo sapiens
ccaaaggaaggaac

SEQ ID NO: 1526617 - DNA, 15 bp, Homo sapiens
ccaaaggaaggaacg

SEQ ID NO: 1526618 - DNA, 18 bp, Homo sapiens
ccaaaggaagtctaggag

SEQ ID NO: 1526619 - DNA, 15 bp, Homo sapiens
ccaaaggaggctggc

SEQ ID NO: 1526620 - DNA, 17 bp, Homo sapiens
ccaaaggaggctggcag

SEQ ID NO: 1526621 - DNA, 12 bp, Homo sapiens
ccaaaggcagct

SEQ ID NO: 1526622 - DNA, 22 bp, Homo sapiens
ccaaaggcagctaagatagaaa

SEQ ID NO: 1526623 - DNA, 18 bp, Homo sapiens
ccaaaggcggggtggcgg

SEQ ID NO: 1526624 - DNA, 12 bp, Homo sapiens
ccaaaggctggt

SEQ ID NO: 1526625 - DNA, 23 bp, Homo sapiens
ccaaagggtgaagctatttatct

SEQ ID NO: 1526626 - DNA, 17 bp, Homo sapiens
ccaaaggtcaaacaggc

SEQ ID NO: 1526627 - DNA, 11 bp, Homo sapiens
ccaaaggttcc

SEQ ID NO: 1526628 - DNA, 22 bp, Homo sapiens
ccaaagtacagaatttgaatta

SEQ ID NO: 1526629 - DNA, 17 bp, Homo sapiens
ccaaagtcacaggaaga

SEQ ID NO: 1526630 - DNA, 15 bp, Homo sapiens
ccaaagtctctaatt

SEQ ID NO: 1526631 - DNA, 16 bp, Homo sapiens
ccaaagtggggaggga

SEQ ID NO: 1526632 - DNA, 19 bp, Homo sapiens
ccaaagttgttgtaacctg

SEQ ID NO: 1526633 - DNA, 18 bp, Homo sapiens
ccaaagttttcaaactgc

SEQ ID NO: 1526634 - DNA, 14 bp, Homo sapiens
ccaaatagccccag

SEQ ID NO: 1526635 - DNA, 19 bp, Homo sapiens
ccaaatagccccagactgg

SEQ ID NO: 1526636 - DNA, 19 bp, Homo sapiens
ccaaatagtgtgaaatata

SEQ ID NO: 1526637 - DNA, 18 bp, Homo sapiens
ccaaatatgtattttcct

SEQ ID NO: 1526638 - DNA, 21 bp, Homo sapiens
ccaaatcctggaaggacacag

SEQ ID NO: 1526639 - DNA, 22 bp, Homo sapiens
ccaaatccttggagtcccaggg

SEQ ID NO: 1526640 - DNA, 22 bp, Homo sapiens
ccaaatctcaatgaagccagct

SEQ ID NO: 1526641 - DNA, 22 bp, Homo sapiens
ccaaatctcagttgtttgcttc

SEQ ID NO: 1526642 - DNA, 14 bp, Homo sapiens
ccaaatctgtcctc

SEQ ID NO: 1526643 - DNA, 15 bp, Homo sapiens
ccaaatctgtcctct

SEQ ID NO: 1526644 - DNA, 16 bp, Homo sapiens
ccaaatctgtcctctg

SEQ ID NO: 1526645 - DNA, 15 bp, Homo sapiens
ccaaatgaccgagcc

SEQ ID NO: 1526646 - DNA, 23 bp, Homo sapiens
ccaaatgaccgagccctggagag

SEQ ID NO: 1526647 - DNA, 19 bp, Homo sapiens
ccaaatgatagaactgtac

SEQ ID NO: 1526648 - DNA, 21 bp, Homo sapiens
ccaaatgcacaagctcagaat

SEQ ID NO: 1526649 - DNA, 21 bp, Homo sapiens
ccaaatgcagggaggggaggc

SEQ ID NO: 1526650 - DNA, 16 bp, Homo sapiens
ccaaatgcagttcatt

SEQ ID NO: 1526651 - DNA, 14 bp, Homo sapiens
ccaaatgtgtcaga

SEQ ID NO: 1526652 - DNA, 16 bp, Homo sapiens
ccaaatgttcatcctc

SEQ ID NO: 1526653 - DNA, 19 bp, Homo sapiens
ccaaattatcctggtcttt

SEQ ID NO: 1526654 - DNA, 23 bp, Homo sapiens
ccaaattccttggcatgccttcc

SEQ ID NO: 1526655 - DNA, 15 bp, Homo sapiens
ccaaattctttcagt

SEQ ID NO: 1526656 - DNA, 11 bp, Homo sapiens
ccaaatttaaa

SEQ ID NO: 1526657 - DNA, 22 bp, Homo sapiens
ccaaatttcctgtttgaaatat

SEQ ID NO: 1526658 - DNA, 19 bp, Homo sapiens
ccaacaaagaacactaact

SEQ ID NO: 1526659 - DNA, 17 bp, Homo sapiens
ccaacaactctgccttt

SEQ ID NO: 1526660 - DNA, 21 bp, Homo sapiens
ccaacaagattgcttaataaa

SEQ ID NO: 1526661 - DNA, 16 bp, Homo sapiens
ccaacaataaacagga

SEQ ID NO: 1526662 - DNA, 21 bp, Homo sapiens
ccaacaataaacaggaatttt

SEQ ID NO: 1526663 - DNA, 22 bp, Homo sapiens
ccaacaataaacaggaatttta

SEQ ID NO: 1526664 - DNA, 16 bp, Homo sapiens
ccaacaatggggtggg

SEQ ID NO: 1526665 - DNA, 21 bp, Homo sapiens
ccaacaatggggtgggcccat

SEQ ID NO: 1526666 - DNA, 17 bp, Homo sapiens
ccaacacagttgggacc

SEQ ID NO: 1526667 - DNA, 18 bp, Homo sapiens
ccaacaccacagacacac

SEQ ID NO: 1526668 - DNA, 21 bp, Homo sapiens
ccaacaccacagacacacaca

SEQ ID NO: 1526669 - DNA, 22 bp, Homo sapiens
ccaacacccaaagcatggacta

SEQ ID NO: 1526670 - DNA, 15 bp, Homo sapiens
ccaacaccccatatg

SEQ ID NO: 1526671 - DNA, 15 bp, Homo sapiens
ccaacaccccgcctg

SEQ ID NO: 1526672 - DNA, 17 bp, Homo sapiens
ccaacaccccgcctgcc

SEQ ID NO: 1526673 - DNA, 18 bp, Homo sapiens
ccaacaccccgcctgcct

SEQ ID NO: 1526674 - DNA, 19 bp, Homo sapiens
ccaacaccccgcctgcctc

SEQ ID NO: 1526675 - DNA, 22 bp, Homo sapiens
ccaacaccccgcctgcctcctg

SEQ ID NO: 1526676 - DNA, 20 bp, Homo sapiens
ccaacactgtccttccctgc

SEQ ID NO: 1526677 - DNA, 19 bp, Homo sapiens
ccaacactgtgccctggtg

SEQ ID NO: 1526678 - DNA, 19 bp, Homo sapiens
ccaacagaaaccttttatt

SEQ ID NO: 1526679 - DNA, 22 bp, Homo sapiens
ccaacagaaaccttttattttt

SEQ ID NO: 1526680 - DNA, 22 bp, Homo sapiens
ccaacagagtggactcttccct

SEQ ID NO: 1526681 - DNA, 17 bp, Homo sapiens
ccaacagcaaaggaact

SEQ ID NO: 1526682 - DNA, 22 bp, Homo sapiens
ccaacagcacttttcctcttct

SEQ ID NO: 1526683 - DNA, 15 bp, Homo sapiens
ccaacagccatgccc

SEQ ID NO: 1526684 - DNA, 22 bp, Homo sapiens
ccaacaggctgttctgcactga

SEQ ID NO: 1526685 - DNA, 22 bp, Homo sapiens
ccaacaggtgctgaactgtgca

SEQ ID NO: 1526686 - DNA, 23 bp, Homo sapiens
ccaacaggtgctgaactgtgcat

SEQ ID NO: 1526687 - DNA, 13 bp, Homo sapiens
aaagaaaaggatt

SEQ ID NO: 1526688 - DNA, 13 bp, Homo sapiens
aaagaaacaagct

SEQ ID NO: 1526689 - DNA, 14 bp, Homo sapiens
aaagaaacaagctg

SEQ ID NO: 1526690 - DNA, 20 bp, Homo sapiens
aaagaaacaagctgtgcagg

SEQ ID NO: 1526691 - DNA, 15 bp, Homo sapiens
aaagaaacatttcct

SEQ ID NO: 1526692 - DNA, 10 bp, Homo sapiens
aaagaaagtg

SEQ ID NO: 1526693 - DNA, 18 bp, Homo sapiens
aaagaaatatattttttg

SEQ ID NO: 1526694 - DNA, 13 bp, Homo sapiens
aaagaaatgcaaa

SEQ ID NO: 1526695 - DNA, 15 bp, Homo sapiens
aaagaaatgtaaggg

SEQ ID NO: 1526696 - DNA, 12 bp, Homo sapiens
aaagaacagatg

SEQ ID NO: 1526697 - DNA, 15 bp, Homo sapiens
aaagaacagtaaaca

SEQ ID NO: 1526698 - DNA, 21 bp, Homo sapiens
aaagaacatggacttgtatat

SEQ ID NO: 1526699 - DNA, 22 bp, Homo sapiens
aaagaacatggacttgtatatt

SEQ ID NO: 1526700 - DNA, 17 bp, Homo sapiens
aaagcaagggagaaaag

SEQ ID NO: 1526701 - DNA, 13 bp, Homo sapiens
aaagcaagggcca

SEQ ID NO: 1526702 - DNA, 22 bp, Homo sapiens
aaagcaagggctccagcatcca

SEQ ID NO: 1526703 - DNA, 15 bp, Homo sapiens
aaagcaataaatgaa

SEQ ID NO: 1526704 - DNA, 16 bp, Homo sapiens
aaagcaattctgactg

SEQ ID NO: 1526705 - DNA, 14 bp, Homo sapiens
aaagcaattgccct

SEQ ID NO: 1526706 - DNA, 18 bp, Homo sapiens
aaagcacaagtacttttg

SEQ ID NO: 1526707 - DNA, 13 bp, Homo sapiens
aaagcacaataac

SEQ ID NO: 1526708 - DNA, 16 bp, Homo sapiens
aaagcacagtttgaac

SEQ ID NO: 1526709 - DNA, 13 bp, Homo sapiens
aaagcacctgccg

SEQ ID NO: 1526710 - DNA, 20 bp, Homo sapiens
aaagcactacaatcatggtc

SEQ ID NO: 1526711 - DNA, 13 bp, Homo sapiens
aaagcagaaggag

SEQ ID NO: 1526712 - DNA, 17 bp, Homo sapiens
aaagcagaattttaatg

SEQ ID NO: 1526713 - DNA, 21 bp, Homo sapiens
aaagcagaattttaatgtgaa

SEQ ID NO: 1526714 - DNA, 17 bp, Homo sapiens
aaagcagagtggactgc

SEQ ID NO: 1526715 - DNA, 21 bp, Homo sapiens
aaagcagagtggactgcattt

SEQ ID NO: 1526716 - DNA, 13 bp, Homo sapiens
aaagcagcatctg

SEQ ID NO: 1526717 - DNA, 19 bp, Homo sapiens
aaagcagctttaaaaaaat

SEQ ID NO: 1526718 - DNA, 17 bp, Homo sapiens
aaagcaggagcagctgt

SEQ ID NO: 1526719 - DNA, 16 bp, Homo sapiens
aaagcagtatttttct

SEQ ID NO: 1526720 - DNA, 18 bp, Homo sapiens
aaagcagtcccattcata

SEQ ID NO: 1526721 - DNA, 22 bp, Homo sapiens
aaagcagtcccattcatattaa

SEQ ID NO: 1526722 - DNA, 14 bp, Homo sapiens
aaagcataaaaaca

SEQ ID NO: 1526723 - DNA, 15 bp, Homo sapiens
aaagcataaaacttt

SEQ ID NO: 1526724 - DNA, 21 bp, Homo sapiens
aaagcatatgggttagatgtt

SEQ ID NO: 1526725 - DNA, 17 bp, Homo sapiens
aaagcatcacctcaggc

SEQ ID NO: 1526726 - DNA, 12 bp, Homo sapiens
aaagcatccctc

SEQ ID NO: 1526727 - DNA, 24 bp, Homo sapiens
aaagcatccctcacccatcctaga

SEQ ID NO: 1526728 - DNA, 20 bp, Homo sapiens
aaagcatgatgggaaaatat

SEQ ID NO: 1526729 - DNA, 21 bp, Homo sapiens
aaagcatgatgggaaaatatt

SEQ ID NO: 1526730 - DNA, 15 bp, Homo sapiens
aaagcatggacattt

SEQ ID NO: 1526731 - DNA, 13 bp, Homo sapiens
aaagcatgtctca

SEQ ID NO: 1526732 - DNA, 22 bp, Homo sapiens
aaagcatgttcacccttatagt

SEQ ID NO: 1526733 - DNA, 16 bp, Homo sapiens
aaagcatgttttgcat

SEQ ID NO: 1526734 - DNA, 17 bp, Homo sapiens
aaagcatgttttgcatg

SEQ ID NO: 1526735 - DNA, 15 bp, Homo sapiens
aaagcattctttaac

SEQ ID NO: 1526736 - DNA, 15 bp, Homo sapiens
aaagcattgtaaatg

SEQ ID NO: 1526737 - DNA, 19 bp, Homo sapiens
aaagcattgtaaatgtgct

SEQ ID NO: 1526738 - DNA, 18 bp, Homo sapiens
aaagcatttaggagaata

SEQ ID NO: 1526739 - DNA, 18 bp, Homo sapiens
aaagcattttcagtcttg

SEQ ID NO: 1526740 - DNA, 21 bp, Homo sapiens
aaagcattttcagtcttgtag

SEQ ID NO: 1526741 - DNA, 15 bp, Homo sapiens
aaagccaaccagcct

SEQ ID NO: 1526742 - DNA, 16 bp, Homo sapiens
aaagccaagaagaatt

SEQ ID NO: 1526743 - DNA, 23 bp, Homo sapiens
aaagccaagtttatatacaatta

SEQ ID NO: 1526744 - DNA, 19 bp, Homo sapiens
aaagccacaaccacataca

SEQ ID NO: 1526745 - DNA, 15 bp, Homo sapiens
aaagccactggaagg

SEQ ID NO: 1526746 - DNA, 19 bp, Homo sapiens
aaagccactggaaggagca

SEQ ID NO: 1526747 - DNA, 21 bp, Homo sapiens
aaagccactggaaggagcaca

SEQ ID NO: 1526748 - DNA, 14 bp, Homo sapiens
aaagccacttctgg

SEQ ID NO: 1526749 - DNA, 17 bp, Homo sapiens
aaagccattttggtttt

SEQ ID NO: 1526750 - DNA, 23 bp, Homo sapiens
aaagcccattttcaactgctttg

SEQ ID NO: 1526751 - DNA, 18 bp, Homo sapiens
aaagccccagcttggctc

SEQ ID NO: 1526752 - DNA, 13 bp, Homo sapiens
aaagccctgcctc

SEQ ID NO: 1526753 - DNA, 14 bp, Homo sapiens
aaagccctgcctct

SEQ ID NO: 1526754 - DNA, 13 bp, Homo sapiens
aaagccctgtcct

SEQ ID NO: 1526755 - DNA, 17 bp, Homo sapiens
aaagcctaccctattct

SEQ ID NO: 1526756 - DNA, 20 bp, Homo sapiens
aaagcctcaaggttttaggt

SEQ ID NO: 1526757 - DNA, 15 bp, Homo sapiens
aaagcctccaagggt

SEQ ID NO: 1526758 - DNA, 13 bp, Homo sapiens
aaagcctctctct

SEQ ID NO: 1526759 - DNA, 14 bp, Homo sapiens
aaagcctctctctc

SEQ ID NO: 1526760 - DNA, 17 bp, Homo sapiens
aaagcctctctctccct

SEQ ID NO: 1526761 - DNA, 16 bp, Homo sapiens
aaagcctctgctgcca

SEQ ID NO: 1526762 - DNA, 22 bp, Homo sapiens
aaagcctctggccgtcacacgt

SEQ ID NO: 1526763 - DNA, 12 bp, Homo sapiens
aaagcctgctca

SEQ ID NO: 1526764 - DNA, 14 bp, Homo sapiens
aaagccttaaaaat

SEQ ID NO: 1526765 - DNA, 10 bp, Homo sapiens
aaagccttcc

SEQ ID NO: 1526766 - DNA, 18 bp, Homo sapiens
aaagcctttcattttgct

SEQ ID NO: 1526767 - DNA, 19 bp, Homo sapiens
aaagcgagatcccatctct

SEQ ID NO: 1526768 - DNA, 18 bp, Homo sapiens
aaagcgcccacccaggtc

SEQ ID NO: 1526769 - DNA, 16 bp, Homo sapiens
aaagcggggggagggt

SEQ ID NO: 1526770 - DNA, 18 bp, Homo sapiens
aaagcggggggagggttg

SEQ ID NO: 1526771 - DNA, 19 bp, Homo sapiens
aaagctaaattttgttact

SEQ ID NO: 1526772 - DNA, 14 bp, Homo sapiens
aaagctaatgtgca

SEQ ID NO: 1526773 - DNA, 16 bp, Homo sapiens
aaagctaatgtgcagg

SEQ ID NO: 1526774 - DNA, 20 bp, Homo sapiens
aaagctacctgtggtgatgt

SEQ ID NO: 1526775 - DNA, 19 bp, Homo sapiens
aaagctagaacactgccaa

SEQ ID NO: 1526776 - DNA, 20 bp, Homo sapiens
aaagctagtgtacctcctct

SEQ ID NO: 1526777 - DNA, 12 bp, Homo sapiens
aaagctataaag

SEQ ID NO: 1526778 - DNA, 17 bp, Homo sapiens
aaagctatataagacaa

SEQ ID NO: 1526779 - DNA, 17 bp, Homo sapiens
aaagctcaaaggtttgg

SEQ ID NO: 1526780 - DNA, 23 bp, Homo sapiens
aaagctcaaaggtttggaaggag

SEQ ID NO: 1526781 - DNA, 18 bp, Homo sapiens
aaagctcaaatgaaatgt

SEQ ID NO: 1526782 - DNA, 14 bp, Homo sapiens
aaagctcaggaggg

SEQ ID NO: 1526783 - DNA, 14 bp, Homo sapiens
aaagctctagaatc

SEQ ID NO: 1526784 - DNA, 14 bp, Homo sapiens
aaagctctgaccac

SEQ ID NO: 1526785 - DNA, 12 bp, Homo sapiens
aaagctgaagac

SEQ ID NO: 1526786 - DNA, 18 bp, Homo sapiens
aaagctgaatttatattt

SEQ ID NO: 1526787 - DNA, 13 bp, Homo sapiens
aaagctgagcctg

SEQ ID NO: 1526788 - DNA, 23 bp, Homo sapiens
aaagctgatgatgtctcttgtag

SEQ ID NO: 1526789 - DNA, 12 bp, Homo sapiens
aaagctggactg

SEQ ID NO: 1526790 - DNA, 17 bp, Homo sapiens
aaagctgttattcttgt

SEQ ID NO: 1526791 - DNA, 18 bp, Homo sapiens
aaagctgttattcttgtt

SEQ ID NO: 1526792 - DNA, 14 bp, Homo sapiens
aaagcttatagaat

SEQ ID NO: 1526793 - DNA, 17 bp, Homo sapiens
aaagcttattttgtaag

SEQ ID NO: 1526794 - DNA, 18 bp, Homo sapiens
aaagcttatttttctgtg

SEQ ID NO: 1526795 - DNA, 16 bp, Homo sapiens
aaagcttcaaagttta

SEQ ID NO: 1526796 - DNA, 21 bp, Homo sapiens
aaagcttctatcccaggaggt

SEQ ID NO: 1526797 - DNA, 12 bp, Homo sapiens
aaagcttctgtg

SEQ ID NO: 1526798 - DNA, 13 bp, Homo sapiens
aaagcttctgtgg

SEQ ID NO: 1526799 - DNA, 19 bp, Homo sapiens
aaagcttgcaacaaaattc

SEQ ID NO: 1526800 - DNA, 15 bp, Homo sapiens
aaagcttgttaagat

SEQ ID NO: 1526801 - DNA, 23 bp, Homo sapiens
aaagctttcctgccccaggcctg

SEQ ID NO: 1526802 - DNA, 19 bp, Homo sapiens
aaagctttgaatactgtga

SEQ ID NO: 1526803 - DNA, 22 bp, Homo sapiens
aaagctttgctacaaatttatg

SEQ ID NO: 1526804 - DNA, 19 bp, Homo sapiens
aaagctttggctgagacct

SEQ ID NO: 1526805 - DNA, 20 bp, Homo sapiens
aaagctttgtttgttcttgt

SEQ ID NO: 1526806 - DNA, 14 bp, Homo sapiens
aaagcttttctttt

SEQ ID NO: 1526807 - DNA, 23 bp, Homo sapiens
aaaggaaaaggttgttgttaatg

SEQ ID NO: 1526808 - DNA, 23 bp, Homo sapiens
ccaagctgcctcccctctccttc

SEQ ID NO: 1526809 - DNA, 18 bp, Homo sapiens
ccaagctgcctctgggcc

SEQ ID NO: 1526810 - DNA, 20 bp, Homo sapiens
ccaagctgcctctgggccat

SEQ ID NO: 1526811 - DNA, 15 bp, Homo sapiens
ccaagcttcaaccct

SEQ ID NO: 1526812 - DNA, 18 bp, Homo sapiens
ccaagcttcaaccctcag

SEQ ID NO: 1526813 - DNA, 19 bp, Homo sapiens
ccaagcttcaaccctcagc

SEQ ID NO: 1526814 - DNA, 22 bp, Homo sapiens
ccaagcttcaaccctcagcctt

SEQ ID NO: 1526815 - DNA, 17 bp, Homo sapiens
aaaggaacattgtgtct

SEQ ID NO: 1526816 - DNA, 19 bp, Homo sapiens
aaaggaagagctaataaat

SEQ ID NO: 1526817 - DNA, 22 bp, Homo sapiens
aaaggaagcattgtaaaataat

SEQ ID NO: 1526818 - DNA, 13 bp, Homo sapiens
aaaggaaggaaaa

SEQ ID NO: 1526819 - DNA, 22 bp, Homo sapiens
aaaggacaacagttctgagctg

SEQ ID NO: 1526820 - DNA, 15 bp, Homo sapiens
aaaggacaatttcaa

SEQ ID NO: 1526821 - DNA, 19 bp, Homo sapiens
aaaggacagagtatgaaca

SEQ ID NO: 1526822 - DNA, 21 bp, Homo sapiens
aaaggaccaactggcttctgt

SEQ ID NO: 1526823 - DNA, 13 bp, Homo sapiens
aaaggactcagtg

SEQ ID NO: 1526824 - DNA, 13 bp, Homo sapiens
aaaggactgtgat

SEQ ID NO: 1526825 - DNA, 12 bp, Homo sapiens
aaaggagaaaaa

SEQ ID NO: 1526826 - DNA, 16 bp, Homo sapiens
aaaggagagaagaaag

SEQ ID NO: 1526827 - DNA, 17 bp, Homo sapiens
aaaggagagaagaaagt

SEQ ID NO: 1526828 - DNA, 16 bp, Homo sapiens
aaaggaggcatgcctc

SEQ ID NO: 1526829 - DNA, 16 bp, Homo sapiens
aaaggatatttaagaa

SEQ ID NO: 1526830 - DNA, 19 bp, Homo sapiens
aaaggatatttaagaaaat

SEQ ID NO: 1526831 - DNA, 19 bp, Homo sapiens
aaaggatgaagaacacagc

SEQ ID NO: 1526832 - DNA, 21 bp, Homo sapiens
aaaggatggtggttattttaa

SEQ ID NO: 1526833 - DNA, 20 bp, Homo sapiens
aaaggatgtaaacagtgcct

SEQ ID NO: 1526834 - DNA, 21 bp, Homo sapiens
aaaggatgtaaacagtgcctg

SEQ ID NO: 1526835 - DNA, 17 bp, Homo sapiens
aaaggatttaagcaaag

SEQ ID NO: 1526836 - DNA, 13 bp, Homo sapiens
aaaggcaaataat

SEQ ID NO: 1526837 - DNA, 13 bp, Homo sapiens
aaaggcaaatatt

SEQ ID NO: 1526838 - DNA, 14 bp, Homo sapiens
aaaggcaaatattg

SEQ ID NO: 1526839 - DNA, 16 bp, Homo sapiens
aaaggcaaatgtgtac

SEQ ID NO: 1526840 - DNA, 18 bp, Homo sapiens
aaaggcaatggtttgtgt

SEQ ID NO: 1526841 - DNA, 20 bp, Homo sapiens
aaaggcaatggtttgtgtca

SEQ ID NO: 1526842 - DNA, 16 bp, Homo sapiens
aaaggcagccctcacc

SEQ ID NO: 1526843 - DNA, 22 bp, Homo sapiens
aaaggcagccctcacctctgag

SEQ ID NO: 1526844 - DNA, 14 bp, Homo sapiens
aaaggcagctgcct

SEQ ID NO: 1526845 - DNA, 15 bp, Homo sapiens
aaaggcagctgcctc

SEQ ID NO: 1526846 - DNA, 23 bp, Homo sapiens
aaaggcagtttgcaaaaaatgtt

SEQ ID NO: 1526847 - DNA, 21 bp, Homo sapiens
aaaggcatccttgtcttttga

SEQ ID NO: 1526848 - DNA, 15 bp, Homo sapiens
aaaggccaaagataa

SEQ ID NO: 1526849 - DNA, 11 bp, Homo sapiens
aaaggcctgga

SEQ ID NO: 1526850 - DNA, 20 bp, Homo sapiens
aaaggcctgtggggagccga

SEQ ID NO: 1526851 - DNA, 21 bp, Homo sapiens
aaaggctcagtctcaggagca

SEQ ID NO: 1526852 - DNA, 15 bp, Homo sapiens
aaaggctgaaaagaa

SEQ ID NO: 1526853 - DNA, 13 bp, Homo sapiens
aaaggctgagaag

SEQ ID NO: 1526854 - DNA, 14 bp, Homo sapiens
aaaggctgagaagg

SEQ ID NO: 1526855 - DNA, 18 bp, Homo sapiens
aaaggctgttaaatacag

SEQ ID NO: 1526856 - DNA, 20 bp, Homo sapiens
aaaggctgttaaatacagga

SEQ ID NO: 1526857 - DNA, 16 bp, Homo sapiens
aaaggcttgaagctgt

SEQ ID NO: 1526858 - DNA, 17 bp, Homo sapiens
aaaggcttgaagctgtg

SEQ ID NO: 1526859 - DNA, 13 bp, Homo sapiens
aaaggcttggctg

SEQ ID NO: 1526860 - DNA, 14 bp, Homo sapiens
aaagggaaactatt

SEQ ID NO: 1526861 - DNA, 15 bp, Homo sapiens
aaagggaaactggga

SEQ ID NO: 1526862 - DNA, 20 bp, Homo sapiens
aaagggagaatggtgctgtt

SEQ ID NO: 1526863 - DNA, 15 bp, Homo sapiens
aaagggaggaacact

SEQ ID NO: 1526864 - DNA, 13 bp, Homo sapiens
aaagggagggagg

SEQ ID NO: 1526865 - DNA, 13 bp, Homo sapiens
aaagggatatttt

SEQ ID NO: 1526866 - DNA, 21 bp, Homo sapiens
aaagggattgaggagttgcct

SEQ ID NO: 1526867 - DNA, 12 bp, Homo sapiens
aaagggcagggc

SEQ ID NO: 1526868 - DNA, 15 bp, Homo sapiens
aaagggcagggccca

SEQ ID NO: 1526869 - DNA, 20 bp, Homo sapiens
aaagggcagggcccacgtgt

SEQ ID NO: 1526870 - DNA, 19 bp, Homo sapiens
aaagggcccaatgaattat

SEQ ID NO: 1526871 - DNA, 14 bp, Homo sapiens
aaagggcctggcca

SEQ ID NO: 1526872 - DNA, 15 bp, Homo sapiens
aaagggcggaagagt

SEQ ID NO: 1526873 - DNA, 21 bp, Homo sapiens
aaagggcggaagagttacaat

SEQ ID NO: 1526874 - DNA, 13 bp, Homo sapiens
aaagggctgagag

SEQ ID NO: 1526875 - DNA, 14 bp, Homo sapiens
aaagggctggctgc

SEQ ID NO: 1526876 - DNA, 17 bp, Homo sapiens
aaaggggacaaggaagg

SEQ ID NO: 1526877 - DNA, 16 bp, Homo sapiens
aaaggggagagcctgc

SEQ ID NO: 1526878 - DNA, 19 bp, Homo sapiens
aaaggggagttgagtcaca

SEQ ID NO: 1526879 - DNA, 23 bp, Homo sapiens
aaaggggcattttgtactcttgt

SEQ ID NO: 1526880 - DNA, 18 bp, Homo sapiens
aaaggggcgagggagggg

SEQ ID NO: 1526881 - DNA, 13 bp, Homo sapiens
aaaggggctgctg

SEQ ID NO: 1526882 - DNA, 14 bp, Homo sapiens
aaaggggctgctgg

SEQ ID NO: 1526883 - DNA, 15 bp, Homo sapiens
aaaggggctgctggg

SEQ ID NO: 1526884 - DNA, 14 bp, Homo sapiens
aaaggggggagggg

SEQ ID NO: 1526885 - DNA, 16 bp, Homo sapiens
aaagggggtcccagtg

SEQ ID NO: 1526886 - DNA, 23 bp, Homo sapiens
aaagggggtcccagtgggagggg

SEQ ID NO: 1526887 - DNA, 10 bp, Homo sapiens
aaagggtgaa

SEQ ID NO: 1526888 - DNA, 18 bp, Homo sapiens
aaagggtgtaggggccac

SEQ ID NO: 1526889 - DNA, 21 bp, Homo sapiens
aaagggtgtaggggccacctc

SEQ ID NO: 1526890 - DNA, 23 bp, Homo sapiens
aaagggtgtaggggccacctcct

SEQ ID NO: 1526891 - DNA, 20 bp, Homo sapiens
aaaggtattatacatgtgat

SEQ ID NO: 1526892 - DNA, 18 bp, Homo sapiens
aaaggtattttgaatacc

SEQ ID NO: 1526893 - DNA, 19 bp, Homo sapiens
aaaggtccacaggtctaga

SEQ ID NO: 1526894 - DNA, 23 bp, Homo sapiens
aaaggtcttggtgcctctgcagt

SEQ ID NO: 1526895 - DNA, 23 bp, Homo sapiens
aaaggtgagtttgagctgccttc

SEQ ID NO: 1526896 - DNA, 22 bp, Homo sapiens
aaaggtgcctcatagcatagcc

SEQ ID NO: 1526897 - DNA, 16 bp, Homo sapiens
aaaggtggaataaaca

SEQ ID NO: 1526898 - DNA, 21 bp, Homo sapiens
aaaggtggaataaacattaat

SEQ ID NO: 1526899 - DNA, 13 bp, Homo sapiens
aaaggtggtaaat

SEQ ID NO: 1526900 - DNA, 15 bp, Homo sapiens
aaaggtggtaaattc

SEQ ID NO: 1526901 - DNA, 18 bp, Homo sapiens
aaaggtggtaaattcaga

SEQ ID NO: 1526902 - DNA, 20 bp, Homo sapiens
aaaggtggtaaattcagaca

SEQ ID NO: 1526903 - DNA, 18 bp, Homo sapiens
aaaggtggtgaggcaata

SEQ ID NO: 1526904 - DNA, 15 bp, Homo sapiens
aaaggtgtatttaaa

SEQ ID NO: 1526905 - DNA, 17 bp, Homo sapiens
aaaggttcactaaagca

SEQ ID NO: 1526906 - DNA, 21 bp, Homo sapiens
aaaggttctaggtttcaaaga

SEQ ID NO: 1526907 - DNA, 21 bp, Homo sapiens
aaaggttcttcatccctttcc

SEQ ID NO: 1526908 - DNA, 16 bp, Homo sapiens
aaaggttgaataatat

SEQ ID NO: 1526909 - DNA, 19 bp, Homo sapiens
aaaggttgttttgaaactg

SEQ ID NO: 1526910 - DNA, 20 bp, Homo sapiens
aaaggtttaagaaatagaat

SEQ ID NO: 1526911 - DNA, 14 bp, Homo sapiens
aaagtaaaaattaa

SEQ ID NO: 1526912 - DNA, 15 bp, Homo sapiens
aaagtaacaaggtgt

SEQ ID NO: 1526913 - DNA, 19 bp, Homo sapiens
aaagtaacaaggtgtcttt

SEQ ID NO: 1526914 - DNA, 14 bp, Homo sapiens
aaagtaacaatcta

SEQ ID NO: 1526915 - DNA, 15 bp, Homo sapiens
aaagtaactcatttg

SEQ ID NO: 1526916 - DNA, 18 bp, Homo sapiens
aaagtaactcatttgtta

SEQ ID NO: 1526917 - DNA, 20 bp, Homo sapiens
aaagtaactcatttgttaaa

SEQ ID NO: 1526918 - DNA, 16 bp, Homo sapiens
aaagtaactgtgagaa

SEQ ID NO: 1526919 - DNA, 21 bp, Homo sapiens
aaagtaaggtgcttggagttt

SEQ ID NO: 1526920 - DNA, 23 bp, Homo sapiens
aaagtaatagtaaaatgcttaca

SEQ ID NO: 1526921 - DNA, 23 bp, Homo sapiens
aaagtaatgatttcttgataatt

SEQ ID NO: 1526922 - DNA, 17 bp, Homo sapiens
aaagtacaaatgaagaa

SEQ ID NO: 1526923 - DNA, 13 bp, Homo sapiens
aaagtacagaatt

SEQ ID NO: 1526924 - DNA, 20 bp, Homo sapiens
aaagtacattgtaaaataaa

SEQ ID NO: 1526925 - DNA, 15 bp, Homo sapiens
aaagtacattttttg

SEQ ID NO: 1526926 - DNA, 14 bp, Homo sapiens
aaagtactttaaaa

SEQ ID NO: 1526927 - DNA, 20 bp, Homo sapiens
aaagtactttaaaaaggaaa

SEQ ID NO: 1526928 - DNA, 20 bp, Homo sapiens
aaagtagaagagggttttag

SEQ ID NO: 1526929 - DNA, 22 bp, Homo sapiens
aaagtagaagtcttagatgtat

SEQ ID NO: 1526930 - DNA, 23 bp, Homo sapiens
ccacaggcatctacacagcctgg

SEQ ID NO: 1526931 - DNA, 12 bp, Homo sapiens
aaataaattagt

SEQ ID NO: 1526932 - DNA, 11 bp, Homo sapiens
aaataaattat

SEQ ID NO: 1526933 - DNA, 22 bp, Homo sapiens
aaataaatttcccagttaaaga

SEQ ID NO: 1526934 - DNA, 14 bp, Homo sapiens
aaataaatttgact

SEQ ID NO: 1526935 - DNA, 14 bp, Homo sapiens
aaataacaatgtgc

SEQ ID NO: 1526936 - DNA, 17 bp, Homo sapiens
aaataacaatgtgctct

SEQ ID NO: 1526937 - DNA, 13 bp, Homo sapiens
aaataacacacat

SEQ ID NO: 1526938 - DNA, 20 bp, Homo sapiens
aaataacaggcatttgttca

SEQ ID NO: 1526939 - DNA, 12 bp, Homo sapiens
aaataacagtat

SEQ ID NO: 1526940 - DNA, 20 bp, Homo sapiens
aaataacatattcttgcttt

SEQ ID NO: 1526941 - DNA, 19 bp, Homo sapiens
aaataacatctgaaaagaa

SEQ ID NO: 1526942 - DNA, 14 bp, Homo sapiens
aaataactgaattt

SEQ ID NO: 1526943 - DNA, 22 bp, Homo sapiens
aaataactgatctcaagtatat

SEQ ID NO: 1526944 - DNA, 17 bp, Homo sapiens
aaataactgatgaagga

SEQ ID NO: 1526945 - DNA, 13 bp, Homo sapiens
aaataactggaaa

SEQ ID NO: 1526946 - DNA, 16 bp, Homo sapiens
aaataactggaaaaca

SEQ ID NO: 1526947 - DNA, 21 bp, Homo sapiens
aaataactgtaattatttgaa

SEQ ID NO: 1526948 - DNA, 15 bp, Homo sapiens
aaataacttgcatct

SEQ ID NO: 1526949 - DNA, 19 bp, Homo sapiens
aaataagacaaaaataata

SEQ ID NO: 1526950 - DNA, 12 bp, Homo sapiens
aaataagagaga

SEQ ID NO: 1526951 - DNA, 12 bp, Homo sapiens
aaataagattct

SEQ ID NO: 1526952 - DNA, 22 bp, Homo sapiens
aaataagcaggtggatctattt

SEQ ID NO: 1526953 - DNA, 20 bp, Homo sapiens
aaataagccccctcaactac

SEQ ID NO: 1526954 - DNA, 18 bp, Homo sapiens
aaataagctcgagtgaat

SEQ ID NO: 1526955 - DNA, 17 bp, Homo sapiens
aaataaggacagcagct

SEQ ID NO: 1526956 - DNA, 19 bp, Homo sapiens
aaataaggcacccatctgt

SEQ ID NO: 1526957 - DNA, 22 bp, Homo sapiens
aaataaggcacccatctgtctg

SEQ ID NO: 1526958 - DNA, 14 bp, Homo sapiens
aaataagtatttat

SEQ ID NO: 1526959 - DNA, 15 bp, Homo sapiens
aaataagtatttata

SEQ ID NO: 1526960 - DNA, 21 bp, Homo sapiens
aaataagtggattttgtattt

SEQ ID NO: 1526961 - DNA, 17 bp, Homo sapiens
aaataataaagatgctc

SEQ ID NO: 1526962 - DNA, 15 bp, Homo sapiens
aaataataataatgt

SEQ ID NO: 1526963 - DNA, 19 bp, Homo sapiens
aaataataccttagaaggt

SEQ ID NO: 1526964 - DNA, 12 bp, Homo sapiens
aaataatatgca

SEQ ID NO: 1526965 - DNA, 14 bp, Homo sapiens
aaataatatgcatt

SEQ ID NO: 1526966 - DNA, 15 bp, Homo sapiens
aaataatcaagattt

SEQ ID NO: 1526967 - DNA, 18 bp, Homo sapiens
aaataatcaagattttag

SEQ ID NO: 1526968 - DNA, 21 bp, Homo sapiens
aaataatgcttcagatattat

SEQ ID NO: 1526969 - DNA, 12 bp, Homo sapiens
aaataatgtctc

SEQ ID NO: 1526970 - DNA, 18 bp, Homo sapiens
aaataatgttctgtcacg

SEQ ID NO: 1526971 - DNA, 23 bp, Homo sapiens
aaataatgttctgtcacgtgaaa

SEQ ID NO: 1526972 - DNA, 22 bp, Homo sapiens
aaataattatataactgtattt

SEQ ID NO: 1526973 - DNA, 17 bp, Homo sapiens
aaataattgatttcaag

SEQ ID NO: 1526974 - DNA, 21 bp, Homo sapiens
aaataatttgaatgtatttga

SEQ ID NO: 1526975 - DNA, 12 bp, Homo sapiens
aaataattttaa

SEQ ID NO: 1526976 - DNA, 23 bp, Homo sapiens
aaataattttccaagtaaagtga

SEQ ID NO: 1526977 - DNA, 22 bp, Homo sapiens
aaatacaaaaagcaaaacaaaa

SEQ ID NO: 1526978 - DNA, 17 bp, Homo sapiens
aaatacaacacatctaa

SEQ ID NO: 1526979 - DNA, 13 bp, Homo sapiens
aaatacaataaac

SEQ ID NO: 1526980 - DNA, 15 bp, Homo sapiens
aaatacaataaacta

SEQ ID NO: 1526981 - DNA, 23 bp, Homo sapiens
aaatacaatcagcccagtgcaaa

SEQ ID NO: 1526982 - DNA, 16 bp, Homo sapiens
aaatacaattcacagc

SEQ ID NO: 1526983 - DNA, 18 bp, Homo sapiens
aaatacaatttgtacttt

SEQ ID NO: 1526984 - DNA, 18 bp, Homo sapiens
aaatacacatagcatgta

SEQ ID NO: 1526985 - DNA, 22 bp, Homo sapiens
aaatacaccacctcactcctgt

SEQ ID NO: 1526986 - DNA, 18 bp, Homo sapiens
aaatacaccgtttagaaa

SEQ ID NO: 1526987 - DNA, 14 bp, Homo sapiens
aaatacagacacta

SEQ ID NO: 1526988 - DNA, 11 bp, Homo sapiens
aaatacagata

SEQ ID NO: 1526989 - DNA, 14 bp, Homo sapiens
aaatacagataatt

SEQ ID NO: 1526990 - DNA, 22 bp, Homo sapiens
aaatacagataattcatttgta

SEQ ID NO: 1526991 - DNA, 23 bp, Homo sapiens
aaatacagataattcatttgtat

SEQ ID NO: 1526992 - DNA, 15 bp, Homo sapiens
aaatacagtactgtt

SEQ ID NO: 1526993 - DNA, 18 bp, Homo sapiens
aaatacagttatttcatc

SEQ ID NO: 1526994 - DNA, 19 bp, Homo sapiens
aaatacatgccacatcaaa

SEQ ID NO: 1526995 - DNA, 13 bp, Homo sapiens
aaatacattcttt

SEQ ID NO: 1526996 - DNA, 19 bp, Homo sapiens
aaatacattctttttgctc

SEQ ID NO: 1526997 - DNA, 13 bp, Homo sapiens
aaataccagagcc

SEQ ID NO: 1526998 - DNA, 22 bp, Homo sapiens
aaataccagagccttcaagtgc

SEQ ID NO: 1526999 - DNA, 21 bp, Homo sapiens
aaataccatgccatttaaagc

SEQ ID NO: 1527000 - DNA, 17 bp, Homo sapiens
aaataccattattatca

SEQ ID NO: 1527001 - DNA, 11 bp, Homo sapiens
aaatacctcaa

SEQ ID NO: 1527002 - DNA, 16 bp, Homo sapiens
aaatacctcaattttt

SEQ ID NO: 1527003 - DNA, 22 bp, Homo sapiens
aaatactatttaagatgtgaaa

SEQ ID NO: 1527004 - DNA, 14 bp, Homo sapiens
aaatactcaccaaa

SEQ ID NO: 1527005 - DNA, 15 bp, Homo sapiens
aaatactcatgtgca

SEQ ID NO: 1527006 - DNA, 23 bp, Homo sapiens
aaatactgctctgaatattttgt

SEQ ID NO: 1527007 - DNA, 17 bp, Homo sapiens
aaatactggactcagga

SEQ ID NO: 1527008 - DNA, 18 bp, Homo sapiens
aaatactggactcaggaa

SEQ ID NO: 1527009 - DNA, 22 bp, Homo sapiens
aaatactggactcaggaacttt

SEQ ID NO: 1527010 - DNA, 16 bp, Homo sapiens
aaatactgtgaaatac

SEQ ID NO: 1527011 - DNA, 19 bp, Homo sapiens
aaatacttaaatgttatgt

SEQ ID NO: 1527012 - DNA, 16 bp, Homo sapiens
aaatagaaccactatg

SEQ ID NO: 1527013 - DNA, 16 bp, Homo sapiens
aaatagaataattctt

SEQ ID NO: 1527014 - DNA, 15 bp, Homo sapiens
aaatagaatacattt

SEQ ID NO: 1527015 - DNA, 17 bp, Homo sapiens
aaatagaatacattttg

SEQ ID NO: 1527016 - DNA, 19 bp, Homo sapiens
aaatagacaaaaagtatat

SEQ ID NO: 1527017 - DNA, 15 bp, Homo sapiens
aaatagacagtatat

SEQ ID NO: 1527018 - DNA, 14 bp, Homo sapiens
aaatagacatcttt

SEQ ID NO: 1527019 - DNA, 15 bp, Homo sapiens
aaatagagcttttaa

SEQ ID NO: 1527020 - DNA, 20 bp, Homo sapiens
aaatagagcttttaaaaatg

SEQ ID NO: 1527021 - DNA, 17 bp, Homo sapiens
aaatagagtatatgcac

SEQ ID NO: 1527022 - DNA, 19 bp, Homo sapiens
aaatagagtatatgcactt

SEQ ID NO: 1527023 - DNA, 14 bp, Homo sapiens
aaatagatataaat

SEQ ID NO: 1527024 - DNA, 13 bp, Homo sapiens
aaatagattaggt

SEQ ID NO: 1527025 - DNA, 13 bp, Homo sapiens
aaatagcagaaag

SEQ ID NO: 1527026 - DNA, 18 bp, Homo sapiens
aaatagccaaaaaggcaa

SEQ ID NO: 1527027 - DNA, 21 bp, Homo sapiens
aaatagccaaaaaggcaaata

SEQ ID NO: 1527028 - DNA, 14 bp, Homo sapiens
aaatagccccagac

SEQ ID NO: 1527029 - DNA, 23 bp, Homo sapiens
aaatagcctaaatgatggtgctt

SEQ ID NO: 1527030 - DNA, 16 bp, Homo sapiens
aaatagcgatgtgcag

SEQ ID NO: 1527031 - DNA, 18 bp, Homo sapiens
aaatagcgctgtttttgt

SEQ ID NO: 1527032 - DNA, 16 bp, Homo sapiens
aaataggcagaatgga

SEQ ID NO: 1527033 - DNA, 19 bp, Homo sapiens
aaatagggaagatggagac

SEQ ID NO: 1527034 - DNA, 16 bp, Homo sapiens
aaatagggtctaactc

SEQ ID NO: 1527035 - DNA, 16 bp, Homo sapiens
aaataggtcatcatga

SEQ ID NO: 1527036 - DNA, 16 bp, Homo sapiens
aaataggttcagattt

SEQ ID NO: 1527037 - DNA, 19 bp, Homo sapiens
aaataggtttatattattg

SEQ ID NO: 1527038 - DNA, 12 bp, Homo sapiens
aaatagtaaaca

SEQ ID NO: 1527039 - DNA, 23 bp, Homo sapiens
aaatagtctctttaaaaggaaag

SEQ ID NO: 1527040 - DNA, 21 bp, Homo sapiens
aaatagtgtaagaactgtaca

SEQ ID NO: 1527041 - DNA, 15 bp, Homo sapiens
aaatagttctatttc

SEQ ID NO: 1527042 - DNA, 16 bp, Homo sapiens
aaatagttctatttct

SEQ ID NO: 1527043 - DNA, 17 bp, Homo sapiens
aaatagttctatttcta

SEQ ID NO: 1527044 - DNA, 23 bp, Homo sapiens
aaatagttctgtgactaggaaaa

SEQ ID NO: 1527045 - DNA, 13 bp, Homo sapiens
ccaccccaagaga

SEQ ID NO: 1527046 - DNA, 15 bp, Homo sapiens
ccaccccaagagaac

SEQ ID NO: 1527047 - DNA, 12 bp, Homo sapiens
ccaccccacact

SEQ ID NO: 1527048 - DNA, 17 bp, Homo sapiens
ccaccccacccccttca

SEQ ID NO: 1527049 - DNA, 16 bp, Homo sapiens
ccaccccactccagcc

SEQ ID NO: 1527050 - DNA, 18 bp, Homo sapiens
aaatataattctgtaaat

SEQ ID NO: 1527051 - DNA, 19 bp, Homo sapiens
aaatataattctgtaaatg

SEQ ID NO: 1527052 - DNA, 13 bp, Homo sapiens
aaatatacatgtt

SEQ ID NO: 1527053 - DNA, 14 bp, Homo sapiens
aaatatacatgttt

SEQ ID NO: 1527054 - DNA, 17 bp, Homo sapiens
aaatatacatgtttatg

SEQ ID NO: 1527055 - DNA, 18 bp, Homo sapiens
aaatatacatgtttatgt

SEQ ID NO: 1527056 - DNA, 19 bp, Homo sapiens
aaatatacatgtttatgta

SEQ ID NO: 1527057 - DNA, 21 bp, Homo sapiens
aaatatacatgtttatgtaaa

SEQ ID NO: 1527058 - DNA, 15 bp, Homo sapiens
aaatatacattttct

SEQ ID NO: 1527059 - DNA, 15 bp, Homo sapiens
aaatatactatgaaa

SEQ ID NO: 1527060 - DNA, 14 bp, Homo sapiens
aaatatacttaaat

SEQ ID NO: 1527061 - DNA, 16 bp, Homo sapiens
aaatatagagacagga

SEQ ID NO: 1527062 - DNA, 15 bp, Homo sapiens
aaatatagtatatta

SEQ ID NO: 1527063 - DNA, 21 bp, Homo sapiens
aaatatataaaaagaaaagat

SEQ ID NO: 1527064 - DNA, 14 bp, Homo sapiens
aaatatataatatt

SEQ ID NO: 1527065 - DNA, 23 bp, Homo sapiens
aaatatatacccccccatgcagt

SEQ ID NO: 1527066 - DNA, 13 bp, Homo sapiens
aaatatatatgtc

SEQ ID NO: 1527067 - DNA, 14 bp, Homo sapiens
aaatatatatgtca

SEQ ID NO: 1527068 - DNA, 16 bp, Homo sapiens
aaatatatatgtcaat

SEQ ID NO: 1527069 - DNA, 17 bp, Homo sapiens
aaatatatatgtcaata

SEQ ID NO: 1527070 - DNA, 23 bp, Homo sapiens
aaatatatatgtgtgtgtatgtt

SEQ ID NO: 1527071 - DNA, 15 bp, Homo sapiens
aaatatatattttgt

SEQ ID NO: 1527072 - DNA, 12 bp, Homo sapiens
aaatatatttaa

SEQ ID NO: 1527073 - DNA, 22 bp, Homo sapiens
aaatatatttaagataattata

SEQ ID NO: 1527074 - DNA, 14 bp, Homo sapiens
aaatatatttaatg

SEQ ID NO: 1527075 - DNA, 17 bp, Homo sapiens
aaatatattttcagtac

SEQ ID NO: 1527076 - DNA, 17 bp, Homo sapiens
aaatatcagtattctga

SEQ ID NO: 1527077 - DNA, 19 bp, Homo sapiens
aaatatcagtattctgaca

SEQ ID NO: 1527078 - DNA, 21 bp, Homo sapiens
aaatatcagtattctgacatg

SEQ ID NO: 1527079 - DNA, 20 bp, Homo sapiens
aaatatcagttactcagccc

SEQ ID NO: 1527080 - DNA, 13 bp, Homo sapiens
aaatatcataaag

SEQ ID NO: 1527081 - DNA, 16 bp, Homo sapiens
aaatatcatttactct

SEQ ID NO: 1527082 - DNA, 14 bp, Homo sapiens
aaatatctgaaaat

SEQ ID NO: 1527083 - DNA, 19 bp, Homo sapiens
aaatatctgaaaatgtatg

SEQ ID NO: 1527084 - DNA, 12 bp, Homo sapiens
aaatatctgtat

SEQ ID NO: 1527085 - DNA, 13 bp, Homo sapiens
aaatatgaaccta

SEQ ID NO: 1527086 - DNA, 14 bp, Homo sapiens
aaatatgaatgaac

SEQ ID NO: 1527087 - DNA, 16 bp, Homo sapiens
aaatatgaatgaacaa

SEQ ID NO: 1527088 - DNA, 13 bp, Homo sapiens
aaatatgcaaagc

SEQ ID NO: 1527089 - DNA, 14 bp, Homo sapiens
aaatatgtaaaact

SEQ ID NO: 1527090 - DNA, 19 bp, Homo sapiens
aaatatgtaatttcaaaat

SEQ ID NO: 1527091 - DNA, 18 bp, Homo sapiens
aaatatgtatatgacatt

SEQ ID NO: 1527092 - DNA, 12 bp, Homo sapiens
aaatatgtatta

SEQ ID NO: 1527093 - DNA, 15 bp, Homo sapiens
aaatatgtttgtgcc

SEQ ID NO: 1527094 - DNA, 15 bp, Homo sapiens
aaatattcagaaatt

SEQ ID NO: 1527095 - DNA, 23 bp, Homo sapiens
aaatattctacacatgtaaaata

SEQ ID NO: 1527096 - DNA, 13 bp, Homo sapiens
aaatattctatat

SEQ ID NO: 1527097 - DNA, 21 bp, Homo sapiens
aaatattgaaaggcaaacatt

SEQ ID NO: 1527098 - DNA, 15 bp, Homo sapiens
aaatattgaagttgt

SEQ ID NO: 1527099 - DNA, 23 bp, Homo sapiens
aaatattgctgtgtcttcatttt

SEQ ID NO: 1527100 - DNA, 20 bp, Homo sapiens
aaatattgtgttgtgaatgt

SEQ ID NO: 1527101 - DNA, 12 bp, Homo sapiens
aaatattgttaa

SEQ ID NO: 1527102 - DNA, 17 bp, Homo sapiens
aaatatttaagtatata

SEQ ID NO: 1527103 - DNA, 19 bp, Homo sapiens
aaatatttaagtatatagt

SEQ ID NO: 1527104 - DNA, 16 bp, Homo sapiens
aaatatttaagtgaag

SEQ ID NO: 1527105 - DNA, 13 bp, Homo sapiens
aaatatttaatat

SEQ ID NO: 1527106 - DNA, 16 bp, Homo sapiens
aaatatttaatatcaa

SEQ ID NO: 1527107 - DNA, 22 bp, Homo sapiens
aaatatttatgaagaaaatact

SEQ ID NO: 1527108 - DNA, 15 bp, Homo sapiens
aaatatttatttatt

SEQ ID NO: 1527109 - DNA, 15 bp, Homo sapiens
aaatatttcagatat

SEQ ID NO: 1527110 - DNA, 16 bp, Homo sapiens
aaatatttcagatatc

SEQ ID NO: 1527111 - DNA, 14 bp, Homo sapiens
aaatatttctcaac

SEQ ID NO: 1527112 - DNA, 12 bp, Homo sapiens
aaatatttggag

SEQ ID NO: 1527113 - DNA, 15 bp, Homo sapiens
aaatatttgtacata

SEQ ID NO: 1527114 - DNA, 19 bp, Homo sapiens
aaatatttgtctttaaaca

SEQ ID NO: 1527115 - DNA, 21 bp, Homo sapiens
aaatattttaatttttaaatg

SEQ ID NO: 1527116 - DNA, 11 bp, Homo sapiens
aaatattttct

SEQ ID NO: 1527117 - DNA, 13 bp, Homo sapiens
aaatattttctat

SEQ ID NO: 1527118 - DNA, 14 bp, Homo sapiens
aaatattttctatt

SEQ ID NO: 1527119 - DNA, 15 bp, Homo sapiens
aaatattttctattt

SEQ ID NO: 1527120 - DNA, 12 bp, Homo sapiens
aaatattttgct

SEQ ID NO: 1527121 - DNA, 22 bp, Homo sapiens
aaatattttttatatatacagt

SEQ ID NO: 1527122 - DNA, 18 bp, Homo sapiens
aaatatttttttctagct

SEQ ID NO: 1527123 - DNA, 14 bp, Homo sapiens
aaatcaaatatgca

SEQ ID NO: 1527124 - DNA, 15 bp, Homo sapiens
aaatcaaatatgcaa

SEQ ID NO: 1527125 - DNA, 18 bp, Homo sapiens
aaatcaaatatgcaaagc

SEQ ID NO: 1527126 - DNA, 17 bp, Homo sapiens
aaatcaaatgtaaatca

SEQ ID NO: 1527127 - DNA, 16 bp, Homo sapiens
aaatcaaatgtatgta

SEQ ID NO: 1527128 - DNA, 20 bp, Homo sapiens
aaatcaaatgtatgtatcat

SEQ ID NO: 1527129 - DNA, 17 bp, Homo sapiens
aaatcaaccctctcctg

SEQ ID NO: 1527130 - DNA, 12 bp, Homo sapiens
aaatcaaggaaa

SEQ ID NO: 1527131 - DNA, 13 bp, Homo sapiens
aaatcaaggaaag

SEQ ID NO: 1527132 - DNA, 17 bp, Homo sapiens
aaatcaatacactagtt

SEQ ID NO: 1527133 - DNA, 22 bp, Homo sapiens
aaatcaatacactagttgtttc

SEQ ID NO: 1527134 - DNA, 15 bp, Homo sapiens
aaatcaatagttgaa

SEQ ID NO: 1527135 - DNA, 19 bp, Homo sapiens
aaatcaattactggtccaa

SEQ ID NO: 1527136 - DNA, 14 bp, Homo sapiens
aaatcactttcata

SEQ ID NO: 1527137 - DNA, 16 bp, Homo sapiens
aaatcagaaagtaaca

SEQ ID NO: 1527138 - DNA, 18 bp, Homo sapiens
aaatcagaagtcatcttg

SEQ ID NO: 1527139 - DNA, 16 bp, Homo sapiens
aaatcagagacaaaat

SEQ ID NO: 1527140 - DNA, 22 bp, Homo sapiens
aaatcagagacaaaatatttcc

SEQ ID NO: 1527141 - DNA, 20 bp, Homo sapiens
aaatcagaggagagacggtg

SEQ ID NO: 1527142 - DNA, 19 bp, Homo sapiens
aaatcagctattttgtgaa

SEQ ID NO: 1527143 - DNA, 11 bp, Homo sapiens
aaatcagtaag

SEQ ID NO: 1527144 - DNA, 15 bp, Homo sapiens
aaatcagtaagaggt

SEQ ID NO: 1527145 - DNA, 12 bp, Homo sapiens
aaatcagtattt

SEQ ID NO: 1527146 - DNA, 22 bp, Homo sapiens
aaatcagtatttttttttaatt

SEQ ID NO: 1527147 - DNA, 13 bp, Homo sapiens
aaatcagtgatct

SEQ ID NO: 1527148 - DNA, 17 bp, Homo sapiens
aaatcagttactaagaa

SEQ ID NO: 1527149 - DNA, 16 bp, Homo sapiens
aaatcataaagtcagt

SEQ ID NO: 1527150 - DNA, 19 bp, Homo sapiens
aaatcatagttaaatgtta

SEQ ID NO: 1527151 - DNA, 18 bp, Homo sapiens
aaatcatcaagaagggct

SEQ ID NO: 1527152 - DNA, 20 bp, Homo sapiens
aaatcatctgcattcctgat

SEQ ID NO: 1527153 - DNA, 18 bp, Homo sapiens
aaatcatgccagtatttt

SEQ ID NO: 1527154 - DNA, 15 bp, Homo sapiens
aaatcatgggccaga

SEQ ID NO: 1527155 - DNA, 19 bp, Homo sapiens
aaatcattaatactcttct

SEQ ID NO: 1527156 - DNA, 11 bp, Homo sapiens
aaatcatttct

SEQ ID NO: 1527157 - DNA, 17 bp, Homo sapiens
aaatccaaatattgtta

SEQ ID NO: 1527158 - DNA, 12 bp, Homo sapiens
aaatccaacttt

SEQ ID NO: 1527159 - DNA, 14 bp, Homo sapiens
aaatccagaaagaa

SEQ ID NO: 1527160 - DNA, 15 bp, Homo sapiens
aaatccagtggtggg

SEQ ID NO: 1527161 - DNA, 22 bp, Homo sapiens
ccacctgttaaaatgtacactg

SEQ ID NO: 1527162 - DNA, 16 bp, Homo sapiens
ccaccttcccacccct

SEQ ID NO: 1527163 - DNA, 12 bp, Homo sapiens
ccaccttcccag

SEQ ID NO: 1527164 - DNA, 14 bp, Homo sapiens
ccaccttcccagct

SEQ ID NO: 1527165 - DNA, 13 bp, Homo sapiens
ccaccttgctctt

SEQ ID NO: 1527166 - DNA, 15 bp, Homo sapiens
ccaccttgtcctggc

SEQ ID NO: 1527167 - DNA, 14 bp, Homo sapiens
ccaccttgtctgct

SEQ ID NO: 1527168 - DNA, 18 bp, Homo sapiens
ccaccttgttggagcctg

SEQ ID NO: 1527169 - DNA, 21 bp, Homo sapiens
ccaccttgttggagcctgcag

SEQ ID NO: 1527170 - DNA, 20 bp, Homo sapiens
aaatcctggaaaattctatg

SEQ ID NO: 1527171 - DNA, 16 bp, Homo sapiens
aaatcctttactgtta

SEQ ID NO: 1527172 - DNA, 17 bp, Homo sapiens
aaatccttttacctttt

SEQ ID NO: 1527173 - DNA, 22 bp, Homo sapiens
aaatcggatctggggctctggg

SEQ ID NO: 1527174 - DNA, 23 bp, Homo sapiens
aaatcggatctggggctctggga

SEQ ID NO: 1527175 - DNA, 20 bp, Homo sapiens
aaatctaaatctatttatta

SEQ ID NO: 1527176 - DNA, 21 bp, Homo sapiens
aaatctaagcagcttattgtt

SEQ ID NO: 1527177 - DNA, 13 bp, Homo sapiens
aaatctaccactg

SEQ ID NO: 1527178 - DNA, 13 bp, Homo sapiens
aaatctagagttt

SEQ ID NO: 1527179 - DNA, 11 bp, Homo sapiens
aaatctatatt

SEQ ID NO: 1527180 - DNA, 13 bp, Homo sapiens
aaatctattcaga

SEQ ID NO: 1527181 - DNA, 22 bp, Homo sapiens
aaatctcagaattccttttcta

SEQ ID NO: 1527182 - DNA, 15 bp, Homo sapiens
aaatctcagttgttt

SEQ ID NO: 1527183 - DNA, 17 bp, Homo sapiens
aaatctcctcttttgta

SEQ ID NO: 1527184 - DNA, 12 bp, Homo sapiens
aaatctgaattt

SEQ ID NO: 1527185 - DNA, 22 bp, Homo sapiens
aaatctgaattttgcaatgtat

SEQ ID NO: 1527186 - DNA, 14 bp, Homo sapiens
aaatctgacccagt

SEQ ID NO: 1527187 - DNA, 20 bp, Homo sapiens
aaatctgacccagtgccccc

SEQ ID NO: 1527188 - DNA, 23 bp, Homo sapiens
aaatctgcaaagcatgttttgca

SEQ ID NO: 1527189 - DNA, 11 bp, Homo sapiens
aaatctgccac

SEQ ID NO: 1527190 - DNA, 19 bp, Homo sapiens
aaatctgccacaaaaacag

SEQ ID NO: 1527191 - DNA, 19 bp, Homo sapiens
aaatctgctgcaccttgta

SEQ ID NO: 1527192 - DNA, 23 bp, Homo sapiens
aaatctgcttcatccaatgtgaa

SEQ ID NO: 1527193 - DNA, 12 bp, Homo sapiens
aaatctgcttta

SEQ ID NO: 1527194 - DNA, 20 bp, Homo sapiens
aaatctgctttagtttcaca

SEQ ID NO: 1527195 - DNA, 22 bp, Homo sapiens
aaatctggtcttgttagaaaac

SEQ ID NO: 1527196 - DNA, 19 bp, Homo sapiens
aaatctgtatatgttgtaa

SEQ ID NO: 1527197 - DNA, 22 bp, Homo sapiens
aaatctgtcagcatctggctgt

SEQ ID NO: 1527198 - DNA, 18 bp, Homo sapiens
aaatctgtcataagcatt

SEQ ID NO: 1527199 - DNA, 16 bp, Homo sapiens
aaatctgtcctctgta

SEQ ID NO: 1527200 - DNA, 17 bp, Homo sapiens
aaatctgtcctctgtag

SEQ ID NO: 1527201 - DNA, 19 bp, Homo sapiens
aaatctgtctgattctatg

SEQ ID NO: 1527202 - DNA, 23 bp, Homo sapiens
aaatctgtctgattctatgcctg

SEQ ID NO: 1527203 - DNA, 23 bp, Homo sapiens
aaatctgtgatgatcctcatatg

SEQ ID NO: 1527204 - DNA, 16 bp, Homo sapiens
aaatctgtttttctca

SEQ ID NO: 1527205 - DNA, 22 bp, Homo sapiens
aaatcttaaacaatgtataaag

SEQ ID NO: 1527206 - DNA, 12 bp, Homo sapiens
aaatcttaagaa

SEQ ID NO: 1527207 - DNA, 16 bp, Homo sapiens
aaatcttaagaaataa

SEQ ID NO: 1527208 - DNA, 15 bp, Homo sapiens
aaatcttaatactgt

SEQ ID NO: 1527209 - DNA, 17 bp, Homo sapiens
aaatcttaatactgtta

SEQ ID NO: 1527210 - DNA, 19 bp, Homo sapiens
aaatcttaatactgttatt

SEQ ID NO: 1527211 - DNA, 19 bp, Homo sapiens
aaatcttatagttctaggc

SEQ ID NO: 1527212 - DNA, 13 bp, Homo sapiens
aaatcttccttgt

SEQ ID NO: 1527213 - DNA, 19 bp, Homo sapiens
aaatcttgtcatgtgtata

SEQ ID NO: 1527214 - DNA, 20 bp, Homo sapiens
aaatcttgtgctagaatact

SEQ ID NO: 1527215 - DNA, 21 bp, Homo sapiens
aaatcttgttaatgtcattgc

SEQ ID NO: 1527216 - DNA, 18 bp, Homo sapiens
aaatctttccatatccat

SEQ ID NO: 1527217 - DNA, 16 bp, Homo sapiens
aaatctttttgcttct

SEQ ID NO: 1527218 - DNA, 14 bp, Homo sapiens
aaatgaaaatttta

SEQ ID NO: 1527219 - DNA, 11 bp, Homo sapiens
aaatgaaaggg

SEQ ID NO: 1527220 - DNA, 14 bp, Homo sapiens
aaatgaaagggaaa

SEQ ID NO: 1527221 - DNA, 16 bp, Homo sapiens
aaatgaaagggaaact

SEQ ID NO: 1527222 - DNA, 22 bp, Homo sapiens
aaatgaaatccgtgaagtcaca

SEQ ID NO: 1527223 - DNA, 18 bp, Homo sapiens
aaatgaacatctcttgaa

SEQ ID NO: 1527224 - DNA, 19 bp, Homo sapiens
aaatgaacatctcttgaaa

SEQ ID NO: 1527225 - DNA, 18 bp, Homo sapiens
aaatgaacctgctactta

SEQ ID NO: 1527226 - DNA, 23 bp, Homo sapiens
aaatgaacgatatgtagcagaaa

SEQ ID NO: 1527227 - DNA, 13 bp, Homo sapiens
aaatgaagaaagt

SEQ ID NO: 1527228 - DNA, 14 bp, Homo sapiens
aaatgaagaaagtc

SEQ ID NO: 1527229 - DNA, 18 bp, Homo sapiens
aaatgaagcagctttaaa

SEQ ID NO: 1527230 - DNA, 19 bp, Homo sapiens
aaatgaaggttaggattta

SEQ ID NO: 1527231 - DNA, 16 bp, Homo sapiens
aaatgaatatctatta

SEQ ID NO: 1527232 - DNA, 18 bp, Homo sapiens
aaatgaattgaaaaacaa

SEQ ID NO: 1527233 - DNA, 19 bp, Homo sapiens
aaatgaattgaaaaacaat

SEQ ID NO: 1527234 - DNA, 16 bp, Homo sapiens
aaatgacaacagaaaa

SEQ ID NO: 1527235 - DNA, 19 bp, Homo sapiens
aaatgacaacagaaaaaca

SEQ ID NO: 1527236 - DNA, 14 bp, Homo sapiens
aaatgacagatgtt

SEQ ID NO: 1527237 - DNA, 13 bp, Homo sapiens
aaatgacagattt

SEQ ID NO: 1527238 - DNA, 16 bp, Homo sapiens
aaatgacagatttctg

SEQ ID NO: 1527239 - DNA, 14 bp, Homo sapiens
aaatgacatgcact

SEQ ID NO: 1527240 - DNA, 13 bp, Homo sapiens
aaatgaccaaaga

SEQ ID NO: 1527241 - DNA, 19 bp, Homo sapiens
aaatgactaaaaaacaaag

SEQ ID NO: 1527242 - DNA, 17 bp, Homo sapiens
aaatgactaaaaatatt

SEQ ID NO: 1527243 - DNA, 20 bp, Homo sapiens
aaatgacttatttctgctct

SEQ ID NO: 1527244 - DNA, 13 bp, Homo sapiens
aaatgacttttct

SEQ ID NO: 1527245 - DNA, 20 bp, Homo sapiens
aaatgagaattttatattct

SEQ ID NO: 1527246 - DNA, 20 bp, Homo sapiens
aaatgagaccctcgtggcct

SEQ ID NO: 1527247 - DNA, 20 bp, Homo sapiens
aaatgagagggcagtgtttc

SEQ ID NO: 1527248 - DNA, 19 bp, Homo sapiens
aaatgaggaatccaaaaga

SEQ ID NO: 1527249 - DNA, 21 bp, Homo sapiens
aaatgaggaatccaaaagaca

SEQ ID NO: 1527250 - DNA, 22 bp, Homo sapiens
aaatgagggctgcacattgcct

SEQ ID NO: 1527251 - DNA, 18 bp, Homo sapiens
aaatgagtaaaaactaga

SEQ ID NO: 1527252 - DNA, 18 bp, Homo sapiens
aaatgagtaacatttgct

SEQ ID NO: 1527253 - DNA, 16 bp, Homo sapiens
aaatgagtcactgagc

SEQ ID NO: 1527254 - DNA, 21 bp, Homo sapiens
aaatgagtttaaaaaaataac

SEQ ID NO: 1527255 - DNA, 22 bp, Homo sapiens
aaatgatccccaagtgtgaaca

SEQ ID NO: 1527256 - DNA, 18 bp, Homo sapiens
aaatgatgattatgagtt

SEQ ID NO: 1527257 - DNA, 23 bp, Homo sapiens
aaatgatgttcatttagattgaa

SEQ ID NO: 1527258 - DNA, 18 bp, Homo sapiens
aaatgattatattcacag

SEQ ID NO: 1527259 - DNA, 21 bp, Homo sapiens
aaatgattcaaattgctgctt

SEQ ID NO: 1527260 - DNA, 16 bp, Homo sapiens
aaatgatttccacaaa

SEQ ID NO: 1527261 - DNA, 13 bp, Homo sapiens
aaatgcaaagctg

SEQ ID NO: 1527262 - DNA, 14 bp, Homo sapiens
aaatgcaataactc

SEQ ID NO: 1527263 - DNA, 17 bp, Homo sapiens
aaatgcagttacaaatt

SEQ ID NO: 1527264 - DNA, 16 bp, Homo sapiens
aaatgcatattaaata

SEQ ID NO: 1527265 - DNA, 22 bp, Homo sapiens
aaatgcatccattcctcaggga

SEQ ID NO: 1527266 - DNA, 21 bp, Homo sapiens
aaatgcattgaacatcttgca

SEQ ID NO: 1527267 - DNA, 17 bp, Homo sapiens
aaatgccagagccaacc

SEQ ID NO: 1527268 - DNA, 19 bp, Homo sapiens
aaatgccagagccaacctg

SEQ ID NO: 1527269 - DNA, 21 bp, Homo sapiens
aaatgccagagccaacctgga

SEQ ID NO: 1527270 - DNA, 23 bp, Homo sapiens
aaatgccagagccaacctggact

SEQ ID NO: 1527271 - DNA, 22 bp, Homo sapiens
aaatgccctcttctcgtgcctc

SEQ ID NO: 1527272 - DNA, 13 bp, Homo sapiens
aaatgcctcttaa

SEQ ID NO: 1527273 - DNA, 19 bp, Homo sapiens
aaatgcctgtctctagctg

SEQ ID NO: 1527274 - DNA, 15 bp, Homo sapiens
aaatgccttgtataa

SEQ ID NO: 1527275 - DNA, 13 bp, Homo sapiens
aacatgtaaaatc

SEQ ID NO: 1527276 - DNA, 12 bp, Homo sapiens
aacatgtaatat

SEQ ID NO: 1527277 - DNA, 21 bp, Homo sapiens
aacatgtactacagctatatt

SEQ ID NO: 1527278 - DNA, 22 bp, Homo sapiens
aacatgtcatgtaggttgtcta

SEQ ID NO: 1527279 - DNA, 19 bp, Homo sapiens
aacatgtcctgcctattat

SEQ ID NO: 1527280 - DNA, 20 bp, Homo sapiens
aacatgtcctgcctattatc

SEQ ID NO: 1527281 - DNA, 18 bp, Homo sapiens
aacatgtgccttttctga

SEQ ID NO: 1527282 - DNA, 17 bp, Homo sapiens
aacatgttactgaccag

SEQ ID NO: 1527283 - DNA, 14 bp, Homo sapiens
aacatgttctccat

SEQ ID NO: 1527284 - DNA, 21 bp, Homo sapiens
aacatgtttacaggtttgaat

SEQ ID NO: 1527285 - DNA, 22 bp, Homo sapiens
aacatgtttacaggtttgaatt

SEQ ID NO: 1527286 - DNA, 14 bp, Homo sapiens
aacatgtttctgtt

SEQ ID NO: 1527287 - DNA, 19 bp, Homo sapiens
aacattaatagcagccttt

SEQ ID NO: 1527288 - DNA, 20 bp, Homo sapiens
aacattaatagcagcctttc

SEQ ID NO: 1527289 - DNA, 21 bp, Homo sapiens
aacattaatatttaccaaagt

SEQ ID NO: 1527290 - DNA, 18 bp, Homo sapiens
aacattaattttgtgcat

SEQ ID NO: 1527291 - DNA, 19 bp, Homo sapiens
aacattaattttgtgcatt

SEQ ID NO: 1527292 - DNA, 20 bp, Homo sapiens
aacattaggaccttagaatt

SEQ ID NO: 1527293 - DNA, 15 bp, Homo sapiens
aacattagttgcact

SEQ ID NO: 1527294 - DNA, 18 bp, Homo sapiens
aacattatgatctaataa

SEQ ID NO: 1527295 - DNA, 23 bp, Homo sapiens
aacattatgatctaataaacttt

SEQ ID NO: 1527296 - DNA, 15 bp, Homo sapiens
aacattcagctctgg

SEQ ID NO: 1527297 - DNA, 18 bp, Homo sapiens
aacattcagctctggaga

SEQ ID NO: 1527298 - DNA, 17 bp, Homo sapiens
aacattccaagactcta

SEQ ID NO: 1527299 - DNA, 19 bp, Homo sapiens
aacattcctcatgaatgta

SEQ ID NO: 1527300 - DNA, 21 bp, Homo sapiens
aacattcctcatgaatgtaaa

SEQ ID NO: 1527301 - DNA, 21 bp, Homo sapiens
aacattcgatctcattcagta

SEQ ID NO: 1527302 - DNA, 17 bp, Homo sapiens
ccagaggccctggaggt

SEQ ID NO: 1527303 - DNA, 21 bp, Homo sapiens
ccagaggccgaaggtgcctca

SEQ ID NO: 1527304 - DNA, 18 bp, Homo sapiens
ccagaggctcccaatcag

SEQ ID NO: 1527305 - DNA, 15 bp, Homo sapiens
ccagaggctgggttc

SEQ ID NO: 1527306 - DNA, 13 bp, Homo sapiens
ccagagggacagg

SEQ ID NO: 1527307 - DNA, 16 bp, Homo sapiens
ccagagggagctgtgg

SEQ ID NO: 1527308 - DNA, 18 bp, Homo sapiens
ccagagggcatgctgaat

SEQ ID NO: 1527309 - DNA, 13 bp, Homo sapiens
ccagagggccagc

SEQ ID NO: 1527310 - DNA, 14 bp, Homo sapiens
ccagagggccagca

SEQ ID NO: 1527311 - DNA, 15 bp, Homo sapiens
ccagagggccagcag

SEQ ID NO: 1527312 - DNA, 18 bp, Homo sapiens
ccagagggccagcaggct

SEQ ID NO: 1527313 - DNA, 19 bp, Homo sapiens
ccagagggccagcaggctc

SEQ ID NO: 1527314 - DNA, 21 bp, Homo sapiens
ccagagggccagcaggctcct

SEQ ID NO: 1527315 - DNA, 13 bp, Homo sapiens
ccagagggcccag

SEQ ID NO: 1527316 - DNA, 18 bp, Homo sapiens
ccagagggcccaggcagg

SEQ ID NO: 1527317 - DNA, 15 bp, Homo sapiens
ccagaggtcctccgt

SEQ ID NO: 1527318 - DNA, 22 bp, Homo sapiens
ccagaggtgggatcctccctca

SEQ ID NO: 1527319 - DNA, 16 bp, Homo sapiens
ccagaggtgggcaggt

SEQ ID NO: 1527320 - DNA, 17 bp, Homo sapiens
ccagagtctgagccccc

SEQ ID NO: 1527321 - DNA, 18 bp, Homo sapiens
ccagagtctgagcccccg

SEQ ID NO: 1527322 - DNA, 23 bp, Homo sapiens
ccagagtctgagcccccggctag

SEQ ID NO: 1527323 - DNA, 16 bp, Homo sapiens
ccagagtgattctagt

SEQ ID NO: 1527324 - DNA, 17 bp, Homo sapiens
ccagagtggagtctgag

SEQ ID NO: 1527325 - DNA, 22 bp, Homo sapiens
ccagagtggcctggccaggagc

SEQ ID NO: 1527326 - DNA, 23 bp, Homo sapiens
ccagagtggcctggccaggagct

SEQ ID NO: 1527327 - DNA, 18 bp, Homo sapiens
ccagagtgtgggaaggga

SEQ ID NO: 1527328 - DNA, 12 bp, Homo sapiens
ccagagttgctg

SEQ ID NO: 1527329 - DNA, 15 bp, Homo sapiens
ccagagttgctggga

SEQ ID NO: 1527330 - DNA, 16 bp, Homo sapiens
ccagagttgctgtgcc

SEQ ID NO: 1527331 - DNA, 21 bp, Homo sapiens
ccagataactaaggtgaagaa

SEQ ID NO: 1527332 - DNA, 18 bp, Homo sapiens
ccagataactctctttcc

SEQ ID NO: 1527333 - DNA, 14 bp, Homo sapiens
ccagataagaatgc

SEQ ID NO: 1527334 - DNA, 21 bp, Homo sapiens
ccagatacttcccattttgga

SEQ ID NO: 1527335 - DNA, 17 bp, Homo sapiens
ccagatagtgtagctga

SEQ ID NO: 1527336 - DNA, 21 bp, Homo sapiens
ccagatataactgtcttgttt

SEQ ID NO: 1527337 - DNA, 13 bp, Homo sapiens
ccagatctgcctg

SEQ ID NO: 1527338 - DNA, 15 bp, Homo sapiens
ccagatctgcctggg

SEQ ID NO: 1527339 - DNA, 17 bp, Homo sapiens
ccagatctgcctgggcc

SEQ ID NO: 1527340 - DNA, 18 bp, Homo sapiens
ccagatctgcctgggcct

SEQ ID NO: 1527341 - DNA, 20 bp, Homo sapiens
ccagatctgcctgggcctgt

SEQ ID NO: 1527342 - DNA, 21 bp, Homo sapiens
ccagatctgcctgggcctgtg

SEQ ID NO: 1527343 - DNA, 24 bp, Homo sapiens
ccagatctgcctgggcctgtgcag

SEQ ID NO: 1527344 - DNA, 21 bp, Homo sapiens
ccagatctttcagaaatataa

SEQ ID NO: 1527345 - DNA, 13 bp, Homo sapiens
ccagatctttctc

SEQ ID NO: 1527346 - DNA, 14 bp, Homo sapiens
ccagatctttctct

SEQ ID NO: 1527347 - DNA, 15 bp, Homo sapiens
ccagatctttctctt

SEQ ID NO: 1527348 - DNA, 20 bp, Homo sapiens
ccagatgacacataaatctg

SEQ ID NO: 1527349 - DNA, 19 bp, Homo sapiens
ccagatgatcccagtcact

SEQ ID NO: 1527350 - DNA, 16 bp, Homo sapiens
ccagatgccttctaga

SEQ ID NO: 1527351 - DNA, 18 bp, Homo sapiens
ccagatggaaaaataaca

SEQ ID NO: 1527352 - DNA, 16 bp, Homo sapiens
ccagatggtcatccag

SEQ ID NO: 1527353 - DNA, 18 bp, Homo sapiens
ccagatggtcatccagac

SEQ ID NO: 1527354 - DNA, 20 bp, Homo sapiens
ccagatgtccgtctctcttg

SEQ ID NO: 1527355 - DNA, 20 bp, Homo sapiens
ccagatgttgttcctggcta

SEQ ID NO: 1527356 - DNA, 21 bp, Homo sapiens
ccagatgttgttcctggctag

SEQ ID NO: 1527357 - DNA, 17 bp, Homo sapiens
ccagattagagcctgta

SEQ ID NO: 1527358 - DNA, 13 bp, Homo sapiens
ccagattctgatg

SEQ ID NO: 1527359 - DNA, 12 bp, Homo sapiens
ccagattcttca

SEQ ID NO: 1527360 - DNA, 14 bp, Homo sapiens
ccagattcttcagc

SEQ ID NO: 1527361 - DNA, 19 bp, Homo sapiens
ccagattgacgacaagtgc

SEQ ID NO: 1527362 - DNA, 20 bp, Homo sapiens
ccagattggctcacactgag

SEQ ID NO: 1527363 - DNA, 12 bp, Homo sapiens
ccagattgtgta

SEQ ID NO: 1527364 - DNA, 17 bp, Homo sapiens
ccagatttgaggctggt

SEQ ID NO: 1527365 - DNA, 15 bp, Homo sapiens
ccagatttgtctttt

SEQ ID NO: 1527366 - DNA, 23 bp, Homo sapiens
ccagatttgtctttttgttgtaa

SEQ ID NO: 1527367 - DNA, 15 bp, Homo sapiens
ccagcaacacagcct

SEQ ID NO: 1527368 - DNA, 10 bp, Homo sapiens
ccagcaacat

SEQ ID NO: 1527369 - DNA, 19 bp, Homo sapiens
ccagcaacatctcgagccc

SEQ ID NO: 1527370 - DNA, 23 bp, Homo sapiens
ccagcaacatctcgagccccctg

SEQ ID NO: 1527371 - DNA, 22 bp, Homo sapiens
ccagcaacgcccctccaaacct

SEQ ID NO: 1527372 - DNA, 23 bp, Homo sapiens
ccagcaacttcttctccatccct

SEQ ID NO: 1527373 - DNA, 18 bp, Homo sapiens
ccagcaacttgtcttttt

SEQ ID NO: 1527374 - DNA, 21 bp, Homo sapiens
ccagcaacttgtctttttctg

SEQ ID NO: 1527375 - DNA, 19 bp, Homo sapiens
ccagcaagaataaaaaaga

SEQ ID NO: 1527376 - DNA, 23 bp, Homo sapiens
ccagcaagacctcatctgtggag

SEQ ID NO: 1527377 - DNA, 18 bp, Homo sapiens
ccagcaagagcacaagag

SEQ ID NO: 1527378 - DNA, 17 bp, Homo sapiens
ccagcaagcgggagccc

SEQ ID NO: 1527379 - DNA, 20 bp, Homo sapiens
ccagcaagcgggagcccgtg

SEQ ID NO: 1527380 - DNA, 15 bp, Homo sapiens
ccagcaaggggaccc

SEQ ID NO: 1527381 - DNA, 20 bp, Homo sapiens
ccagcaaggggaccccgaga

SEQ ID NO: 1527382 - DNA, 23 bp, Homo sapiens
ccagcacagaaggaatctgtgca

SEQ ID NO: 1527383 - DNA, 14 bp, Homo sapiens
ccagcacagagcgt

SEQ ID NO: 1527384 - DNA, 12 bp, Homo sapiens
ccagcacagggg

SEQ ID NO: 1527385 - DNA, 13 bp, Homo sapiens
ccagcacaggggc

SEQ ID NO: 1527386 - DNA, 14 bp, Homo sapiens
ccagcacaggggcc

SEQ ID NO: 1527387 - DNA, 17 bp, Homo sapiens
ccagcacaggggcccca

SEQ ID NO: 1527388 - DNA, 18 bp, Homo sapiens
ccagcacagtaggtcccg

SEQ ID NO: 1527389 - DNA, 23 bp, Homo sapiens
ccagcacatggccatagaggccc

SEQ ID NO: 1527390 - DNA, 21 bp, Homo sapiens
ccagcaccacctacacaggag

SEQ ID NO: 1527391 - DNA, 14 bp, Homo sapiens
ccagcacccacctg

SEQ ID NO: 1527392 - DNA, 18 bp, Homo sapiens
ccagcacctcagcctgca

SEQ ID NO: 1527393 - DNA, 17 bp, Homo sapiens
ccagcacctgctcccag

SEQ ID NO: 1527394 - DNA, 14 bp, Homo sapiens
ccagcaccttgtgc

SEQ ID NO: 1527395 - DNA, 15 bp, Homo sapiens
ccagcaccttgtgcc

SEQ ID NO: 1527396 - DNA, 21 bp, Homo sapiens
ccagcacggtgactctgtcca

SEQ ID NO: 1527397 - DNA, 12 bp, Homo sapiens
ccagcactaacg

SEQ ID NO: 1527398 - DNA, 21 bp, Homo sapiens
ccagcactagtaaaggaggaa

SEQ ID NO: 1527399 - DNA, 15 bp, Homo sapiens
ccagcactcagcctc

SEQ ID NO: 1527400 - DNA, 16 bp, Homo sapiens
ccagcactcagcctca

SEQ ID NO: 1527401 - DNA, 18 bp, Homo sapiens
ccagcactggaggggccc

SEQ ID NO: 1527402 - DNA, 17 bp, Homo sapiens
ccagcactgtgaagacc

SEQ ID NO: 1527403 - DNA, 17 bp, Homo sapiens
ccagcacttccatggga

SEQ ID NO: 1527404 - DNA, 19 bp, Homo sapiens
ccagcactttgagaggctg

SEQ ID NO: 1527405 - DNA, 20 bp, Homo sapiens
ccagcactttgagaggctga

SEQ ID NO: 1527406 - DNA, 17 bp, Homo sapiens
ccagcactttgggaggc

SEQ ID NO: 1527407 - DNA, 19 bp, Homo sapiens
ccagcactttgggaggcag

SEQ ID NO: 1527408 - DNA, 20 bp, Homo sapiens
ccagcactttgggaggcagg

SEQ ID NO: 1527409 - DNA, 21 bp, Homo sapiens
ccagcactttgggaggccaag

SEQ ID NO: 1527410 - DNA, 13 bp, Homo sapiens
ccagcagacagag

SEQ ID NO: 1527411 - DNA, 17 bp, Homo sapiens
ccagcagacagagccag

SEQ ID NO: 1527412 - DNA, 19 bp, Homo sapiens
ccagcagacagagccagga

SEQ ID NO: 1527413 - DNA, 15 bp, Homo sapiens
ccagcagatcccagc

SEQ ID NO: 1527414 - DNA, 16 bp, Homo sapiens
ccagcagatcccagct

SEQ ID NO: 1527415 - DNA, 17 bp, Homo sapiens
ccagcagatcccagctc

SEQ ID NO: 1527416 - DNA, 19 bp, Homo sapiens
ccagcagatcccagctcac

SEQ ID NO: 1527417 - DNA, 18 bp, Homo sapiens
ccagcagatttccagcct

SEQ ID NO: 1527418 - DNA, 18 bp, Homo sapiens
aacattcgtgagctgggg

SEQ ID NO: 1527419 - DNA, 16 bp, Homo sapiens
aacattctgatttgga

SEQ ID NO: 1527420 - DNA, 18 bp, Homo sapiens
aacattctgatttggaaa

SEQ ID NO: 1527421 - DNA, 18 bp, Homo sapiens
aacattctttaacataca

SEQ ID NO: 1527422 - DNA, 19 bp, Homo sapiens
aacattctttttctgttga

SEQ ID NO: 1527423 - DNA, 17 bp, Homo sapiens
aacattgaccaagaact

SEQ ID NO: 1527424 - DNA, 19 bp, Homo sapiens
aacattgaccaagaactgc

SEQ ID NO: 1527425 - DNA, 21 bp, Homo sapiens
aacattgaccaagaactgcat

SEQ ID NO: 1527426 - DNA, 19 bp, Homo sapiens
aacattgacttcttggttt

SEQ ID NO: 1527427 - DNA, 13 bp, Homo sapiens
aacattgtactgt

SEQ ID NO: 1527428 - DNA, 12 bp, Homo sapiens
aacattgtatta

SEQ ID NO: 1527429 - DNA, 19 bp, Homo sapiens
aacatttacaataaatatt

SEQ ID NO: 1527430 - DNA, 24 bp, Homo sapiens
aacatttacaataaatattctgca

SEQ ID NO: 1527431 - DNA, 14 bp, Homo sapiens
aacatttacatgta

SEQ ID NO: 1527432 - DNA, 13 bp, Homo sapiens
aacatttatgacc

SEQ ID NO: 1527433 - DNA, 14 bp, Homo sapiens
aacatttatgacct

SEQ ID NO: 1527434 - DNA, 22 bp, Homo sapiens
aacatttatgtgaggtaattat

SEQ ID NO: 1527435 - DNA, 20 bp, Homo sapiens
aacatttccaaaagtggcta

SEQ ID NO: 1527436 - DNA, 15 bp, Homo sapiens
aacatttctctccac

SEQ ID NO: 1527437 - DNA, 23 bp, Homo sapiens
aacatttctttcttgctggctct

SEQ ID NO: 1527438 - DNA, 12 bp, Homo sapiens
aacatttgatat

SEQ ID NO: 1527439 - DNA, 19 bp, Homo sapiens
aacatttgatatttttcca

SEQ ID NO: 1527440 - DNA, 13 bp, Homo sapiens
aacatttgctgcc

SEQ ID NO: 1527441 - DNA, 15 bp, Homo sapiens
aacatttgttcctgg

SEQ ID NO: 1527442 - DNA, 16 bp, Homo sapiens
aacatttgtttccccc

SEQ ID NO: 1527443 - DNA, 23 bp, Homo sapiens
aacatttgtttcccccacagttt

SEQ ID NO: 1527444 - DNA, 22 bp, Homo sapiens
aacattttaaaaacatagaaaa

SEQ ID NO: 1527445 - DNA, 23 bp, Homo sapiens
aacattttatcattaaaaattac

SEQ ID NO: 1527446 - DNA, 12 bp, Homo sapiens
aacattttctgg

SEQ ID NO: 1527447 - DNA, 16 bp, Homo sapiens
aacattttctggccag

SEQ ID NO: 1527448 - DNA, 19 bp, Homo sapiens
aacattttgaaggaaaatt

SEQ ID NO: 1527449 - DNA, 22 bp, Homo sapiens
aacattttgtggtcattaagca

SEQ ID NO: 1527450 - DNA, 19 bp, Homo sapiens
aacattttttaagaaaaca

SEQ ID NO: 1527451 - DNA, 21 bp, Homo sapiens
aacatttttttttctccataa

SEQ ID NO: 1527452 - DNA, 15 bp, Homo sapiens
aaccaaaaatagaaa

SEQ ID NO: 1527453 - DNA, 16 bp, Homo sapiens
aaccaaaaatagaaat

SEQ ID NO: 1527454 - DNA, 22 bp, Homo sapiens
aaccaaaagggaggctctctgt

SEQ ID NO: 1527455 - DNA, 13 bp, Homo sapiens
aaccaaatacctc

SEQ ID NO: 1527456 - DNA, 15 bp, Homo sapiens
aaccaaatacctcaa

SEQ ID NO: 1527457 - DNA, 15 bp, Homo sapiens
aaccaaatctggaag

SEQ ID NO: 1527458 - DNA, 13 bp, Homo sapiens
aaccaacacccaa

SEQ ID NO: 1527459 - DNA, 13 bp, Homo sapiens
aaccaacatcttt

SEQ ID NO: 1527460 - DNA, 15 bp, Homo sapiens
aaccaaccctgtggg

SEQ ID NO: 1527461 - DNA, 17 bp, Homo sapiens
aaccaactacaaccaag

SEQ ID NO: 1527462 - DNA, 21 bp, Homo sapiens
aaccaacttggttctgcttca

SEQ ID NO: 1527463 - DNA, 13 bp, Homo sapiens
aaccaagccttgg

SEQ ID NO: 1527464 - DNA, 15 bp, Homo sapiens
aaccaagccttggct

SEQ ID NO: 1527465 - DNA, 17 bp, Homo sapiens
aaccaagctctctgcat

SEQ ID NO: 1527466 - DNA, 14 bp, Homo sapiens
aaccaagcttcaga

SEQ ID NO: 1527467 - DNA, 17 bp, Homo sapiens
aaccaagcttcagagcc

SEQ ID NO: 1527468 - DNA, 15 bp, Homo sapiens
aaccaaggaatttaa

SEQ ID NO: 1527469 - DNA, 14 bp, Homo sapiens
aaccaaggcagcct

SEQ ID NO: 1527470 - DNA, 15 bp, Homo sapiens
aaccaatgaagaaga

SEQ ID NO: 1527471 - DNA, 17 bp, Homo sapiens
aaccaatgaagaagaca

SEQ ID NO: 1527472 - DNA, 18 bp, Homo sapiens
aaccaatgaagaagacaa

SEQ ID NO: 1527473 - DNA, 21 bp, Homo sapiens
aaccaatgaagaagacaaagt

SEQ ID NO: 1527474 - DNA, 21 bp, Homo sapiens
aaccaattgaaaagtgttctg

SEQ ID NO: 1527475 - DNA, 16 bp, Homo sapiens
aaccacaactgacaca

SEQ ID NO: 1527476 - DNA, 16 bp, Homo sapiens
aaccacaatgtttctt

SEQ ID NO: 1527477 - DNA, 15 bp, Homo sapiens
aaccacagtcagtgg

SEQ ID NO: 1527478 - DNA, 19 bp, Homo sapiens
aaccacctcagaaaggatt

SEQ ID NO: 1527479 - DNA, 21 bp, Homo sapiens
aaccactcccaccacaggcat

SEQ ID NO: 1527480 - DNA, 16 bp, Homo sapiens
aaccactgaaaaaata

SEQ ID NO: 1527481 - DNA, 21 bp, Homo sapiens
aaccactgtgcgtcttggtgt

SEQ ID NO: 1527482 - DNA, 13 bp, Homo sapiens
aaccacttctcca

SEQ ID NO: 1527483 - DNA, 20 bp, Homo sapiens
aaccacttctccatgctgca

SEQ ID NO: 1527484 - DNA, 15 bp, Homo sapiens
aaccagaaaagcaat

SEQ ID NO: 1527485 - DNA, 18 bp, Homo sapiens
aaccagaacgtggtttgc

SEQ ID NO: 1527486 - DNA, 15 bp, Homo sapiens
aaccagagtgctgaa

SEQ ID NO: 1527487 - DNA, 21 bp, Homo sapiens
aaccagatttgaggctggttt

SEQ ID NO: 1527488 - DNA, 14 bp, Homo sapiens
aaccagcattccct

SEQ ID NO: 1527489 - DNA, 15 bp, Homo sapiens
aaccagccaggcaga

SEQ ID NO: 1527490 - DNA, 19 bp, Homo sapiens
aaccagcccgacagtgcca

SEQ ID NO: 1527491 - DNA, 20 bp, Homo sapiens
aaccagcccgacagtgccat

SEQ ID NO: 1527492 - DNA, 20 bp, Homo sapiens
aaccagccgtattttacatg

SEQ ID NO: 1527493 - DNA, 13 bp, Homo sapiens
aaccaggaaaagg

SEQ ID NO: 1527494 - DNA, 20 bp, Homo sapiens
aaccaggccttcatcctcct

SEQ ID NO: 1527495 - DNA, 18 bp, Homo sapiens
aaccaggtccagatgtgc

SEQ ID NO: 1527496 - DNA, 22 bp, Homo sapiens
aaccagtgtacaggtcacccat

SEQ ID NO: 1527497 - DNA, 17 bp, Homo sapiens
aaccagttataaataca

SEQ ID NO: 1527498 - DNA, 18 bp, Homo sapiens
aaccagtttcaggtgttt

SEQ ID NO: 1527499 - DNA, 14 bp, Homo sapiens
aaccataaattcaa

SEQ ID NO: 1527500 - DNA, 18 bp, Homo sapiens
aaccataacaacttcata

SEQ ID NO: 1527501 - DNA, 14 bp, Homo sapiens
aaccatagaactgt

SEQ ID NO: 1527502 - DNA, 18 bp, Homo sapiens
aaccataggtaatgatta

SEQ ID NO: 1527503 - DNA, 17 bp, Homo sapiens
aaccatagttactgtaa

SEQ ID NO: 1527504 - DNA, 13 bp, Homo sapiens
aaccatatgatac

SEQ ID NO: 1527505 - DNA, 17 bp, Homo sapiens
aaccatgagaatttgca

SEQ ID NO: 1527506 - DNA, 22 bp, Homo sapiens
aaccatgagaccactgttatca

SEQ ID NO: 1527507 - DNA, 13 bp, Homo sapiens
aaccattaaagtc

SEQ ID NO: 1527508 - DNA, 14 bp, Homo sapiens
aaccattaaagtca

SEQ ID NO: 1527509 - DNA, 15 bp, Homo sapiens
aaccattccaacttc

SEQ ID NO: 1527510 - DNA, 22 bp, Homo sapiens
aaccattcgaagtcagctaatt

SEQ ID NO: 1527511 - DNA, 17 bp, Homo sapiens
aaccatttcaagacaga

SEQ ID NO: 1527512 - DNA, 22 bp, Homo sapiens
aaccatttttgctgaattcatc

SEQ ID NO: 1527513 - DNA, 14 bp, Homo sapiens
aacccaaaacctca

SEQ ID NO: 1527514 - DNA, 23 bp, Homo sapiens
aacccaagcctcatattttctgt

SEQ ID NO: 1527515 - DNA, 14 bp, Homo sapiens
aacccaagtgctgc

SEQ ID NO: 1527516 - DNA, 19 bp, Homo sapiens
aacccacagctcagctgcc

SEQ ID NO: 1527517 - DNA, 14 bp, Homo sapiens
aacccacctctcct

SEQ ID NO: 1527518 - DNA, 16 bp, Homo sapiens
aacccacctctcctgc

SEQ ID NO: 1527519 - DNA, 19 bp, Homo sapiens
aacccacctctcctgccct

SEQ ID NO: 1527520 - DNA, 21 bp, Homo sapiens
aacccacctctcctgccctgt

SEQ ID NO: 1527521 - DNA, 15 bp, Homo sapiens
aacccacctctctgg

SEQ ID NO: 1527522 - DNA, 22 bp, Homo sapiens
aacccaccttgttggagcctgc

SEQ ID NO: 1527523 - DNA, 15 bp, Homo sapiens
aacccagactcagac

SEQ ID NO: 1527524 - DNA, 21 bp, Homo sapiens
aacccagactgtctccacggc

SEQ ID NO: 1527525 - DNA, 22 bp, Homo sapiens
aacccagaggtggatgttatga

SEQ ID NO: 1527526 - DNA, 22 bp, Homo sapiens
aacccagggcaacaagcccgtt

SEQ ID NO: 1527527 - DNA, 13 bp, Homo sapiens
aacccagtggctg

SEQ ID NO: 1527528 - DNA, 22 bp, Homo sapiens
aacccatacaatgtatgtacaa

SEQ ID NO: 1527529 - DNA, 17 bp, Homo sapiens
aacccatattgtaaaac

SEQ ID NO: 1527530 - DNA, 15 bp, Homo sapiens
aacccatcagaagga

SEQ ID NO: 1527531 - DNA, 17 bp, Homo sapiens
aacccatcagaaggaga

SEQ ID NO: 1527532 - DNA, 19 bp, Homo sapiens
aacccatttttgagccaag

SEQ ID NO: 1527533 - DNA, 18 bp, Homo sapiens
aaccccaacgcacaggaa

SEQ ID NO: 1527534 - DNA, 19 bp, Homo sapiens
aaccccaacgcacaggaaa

SEQ ID NO: 1527535 - DNA, 14 bp, Homo sapiens
caggggaacctgcc

SEQ ID NO: 1527536 - DNA, 15 bp, Homo sapiens
caggggaacctgcca

SEQ ID NO: 1527537 - DNA, 20 bp, Homo sapiens
caggggaaggaaggagggca

SEQ ID NO: 1527538 - DNA, 21 bp, Homo sapiens
caggggaattccctccccctc

SEQ ID NO: 1527539 - DNA, 22 bp, Homo sapiens
caggggaattccctccccctcc

SEQ ID NO: 1527540 - DNA, 17 bp, Homo sapiens
caggggaccacacctcc

SEQ ID NO: 1527541 - DNA, 23 bp, Homo sapiens
caggggactcagccctgaggtga

SEQ ID NO: 1527542 - DNA, 16 bp, Homo sapiens
caggggactgtctcag

SEQ ID NO: 1527543 - DNA, 18 bp, Homo sapiens
caggggagacaggagcct

SEQ ID NO: 1527544 - DNA, 19 bp, Homo sapiens
caggggagaggcattgcct

SEQ ID NO: 1527545 - DNA, 21 bp, Homo sapiens
caggggagagggtctggagaa

SEQ ID NO: 1527546 - DNA, 17 bp, Homo sapiens
caggtcagttgtaataa

SEQ ID NO: 1527547 - DNA, 19 bp, Homo sapiens
caggtcagttgtaataaat

SEQ ID NO: 1527548 - DNA, 20 bp, Homo sapiens
caggtcagttgtaataaatc

SEQ ID NO: 1527549 - DNA, 22 bp, Homo sapiens
caggtcatcagatgcctgcttg

SEQ ID NO: 1527550 - DNA, 19 bp, Homo sapiens
caggtcatgcagttcctgg

SEQ ID NO: 1527551 - DNA, 13 bp, Homo sapiens
caggtccagctct

SEQ ID NO: 1527552 - DNA, 17 bp, Homo sapiens
caggtccagctctggag

SEQ ID NO: 1527553 - DNA, 19 bp, Homo sapiens
caggtccagctctggaggg

SEQ ID NO: 1527554 - DNA, 20 bp, Homo sapiens
caggtcccagccccttttcc

SEQ ID NO: 1527555 - DNA, 17 bp, Homo sapiens
caggtcccccgactgcc

SEQ ID NO: 1527556 - DNA, 16 bp, Homo sapiens
caggtccctccccttc

SEQ ID NO: 1527557 - DNA, 17 bp, Homo sapiens
caggtccctggaccagc

SEQ ID NO: 1527558 - DNA, 19 bp, Homo sapiens
caggtccctggaccagcct

SEQ ID NO: 1527559 - DNA, 15 bp, Homo sapiens
caggtcctcagagaa

SEQ ID NO: 1527560 - DNA, 22 bp, Homo sapiens
caggtcctgctccgctgcctgg

SEQ ID NO: 1527561 - DNA, 17 bp, Homo sapiens
caggtcctggtgggtca

SEQ ID NO: 1527562 - DNA, 23 bp, Homo sapiens
caggtcctggtgggtcagcccag

SEQ ID NO: 1527563 - DNA, 18 bp, Homo sapiens
caggtcggagtgcctgga

SEQ ID NO: 1527564 - DNA, 19 bp, Homo sapiens
caggtcgggcagtggaggc

SEQ ID NO: 1527565 - DNA, 15 bp, Homo sapiens
caggtctcctcttaa

SEQ ID NO: 1527566 - DNA, 17 bp, Homo sapiens
caggtctcctcttaaaa

SEQ ID NO: 1527567 - DNA, 14 bp, Homo sapiens
caggtctctccact

SEQ ID NO: 1527568 - DNA, 15 bp, Homo sapiens
caggtgagaacccag

SEQ ID NO: 1527569 - DNA, 17 bp, Homo sapiens
caggtgagaacccagag

SEQ ID NO: 1527570 - DNA, 18 bp, Homo sapiens
caggtgagaacccagaga

SEQ ID NO: 1527571 - DNA, 15 bp, Homo sapiens
caggtgagcaggcag

SEQ ID NO: 1527572 - DNA, 16 bp, Homo sapiens
caggtgagcaggcagg

SEQ ID NO: 1527573 - DNA, 20 bp, Homo sapiens
caggtgaggcccaagagccc

SEQ ID NO: 1527574 - DNA, 20 bp, Homo sapiens
caggtgattggaccaggcca

SEQ ID NO: 1527575 - DNA, 13 bp, Homo sapiens
caggtgcagacct

SEQ ID NO: 1527576 - DNA, 17 bp, Homo sapiens
caggtgcagaccttggg

SEQ ID NO: 1527577 - DNA, 13 bp, Homo sapiens
caggtgcagaggt

SEQ ID NO: 1527578 - DNA, 16 bp, Homo sapiens
caggtgcagaggtacc

SEQ ID NO: 1527579 - DNA, 18 bp, Homo sapiens
caggtgcagatgggctgt

SEQ ID NO: 1527580 - DNA, 12 bp, Homo sapiens
caggtgcagtgg

SEQ ID NO: 1527581 - DNA, 13 bp, Homo sapiens
caggtgccactcc

SEQ ID NO: 1527582 - DNA, 20 bp, Homo sapiens
caggtgccactccctgagct

SEQ ID NO: 1527583 - DNA, 14 bp, Homo sapiens
caggtgccatgcct

SEQ ID NO: 1527584 - DNA, 15 bp, Homo sapiens
caggtgccatgcctg

SEQ ID NO: 1527585 - DNA, 16 bp, Homo sapiens
caggtgccatgcctgc

SEQ ID NO: 1527586 - DNA, 18 bp, Homo sapiens
caggtgccatgcctgctc

SEQ ID NO: 1527587 - DNA, 22 bp, Homo sapiens
caggtgccatgcctgctccctg

SEQ ID NO: 1527588 - DNA, 23 bp, Homo sapiens
caggtgccatgcctgctccctgt

SEQ ID NO: 1527589 - DNA, 13 bp, Homo sapiens
caggtgcctccag

SEQ ID NO: 1527590 - DNA, 17 bp, Homo sapiens
caggtgcctccaggtgt

SEQ ID NO: 1527591 - DNA, 19 bp, Homo sapiens
caggtgcctccaggtgtgc

SEQ ID NO: 1527592 - DNA, 15 bp, Homo sapiens
caggtgcctgaacta

SEQ ID NO: 1527593 - DNA, 19 bp, Homo sapiens
caggtgctacaacatgtga

SEQ ID NO: 1527594 - DNA, 14 bp, Homo sapiens
caggtgctgggctg

SEQ ID NO: 1527595 - DNA, 20 bp, Homo sapiens
caggtgctgggctggactgg

SEQ ID NO: 1527596 - DNA, 15 bp, Homo sapiens
caggtgctggtcccg

SEQ ID NO: 1527597 - DNA, 16 bp, Homo sapiens
caggtgcttttgatgt

SEQ ID NO: 1527598 - DNA, 15 bp, Homo sapiens
caggtggactgactg

SEQ ID NO: 1527599 - DNA, 18 bp, Homo sapiens
caggtggactgactgtgt

SEQ ID NO: 1527600 - DNA, 23 bp, Homo sapiens
caggtggagggcacagccctccg

SEQ ID NO: 1527601 - DNA, 11 bp, Homo sapiens
caggtggccac

SEQ ID NO: 1527602 - DNA, 16 bp, Homo sapiens
caggtggccactccag

SEQ ID NO: 1527603 - DNA, 13 bp, Homo sapiens
caggtggccgccc

SEQ ID NO: 1527604 - DNA, 21 bp, Homo sapiens
caggtggccgcccctgaggct

SEQ ID NO: 1527605 - DNA, 15 bp, Homo sapiens
caggtggcctggagg

SEQ ID NO: 1527606 - DNA, 22 bp, Homo sapiens
caggtggctctgaggtgcctgt

SEQ ID NO: 1527607 - DNA, 14 bp, Homo sapiens
caggtggctgaccc

SEQ ID NO: 1527608 - DNA, 16 bp, Homo sapiens
caggtggctgacccag

SEQ ID NO: 1527609 - DNA, 23 bp, Homo sapiens
caggtggctgacccagtccctgg

SEQ ID NO: 1527610 - DNA, 13 bp, Homo sapiens
caggtgggagctg

SEQ ID NO: 1527611 - DNA, 12 bp, Homo sapiens
caggtgggctgg

SEQ ID NO: 1527612 - DNA, 22 bp, Homo sapiens
caggtgggctggacttctacct

SEQ ID NO: 1527613 - DNA, 23 bp, Homo sapiens
caggtgggctggacttctacctg

SEQ ID NO: 1527614 - DNA, 22 bp, Homo sapiens
caggtgggtgtgggacacctgg

SEQ ID NO: 1527615 - DNA, 15 bp, Homo sapiens
caggtggtgaatttt

SEQ ID NO: 1527616 - DNA, 19 bp, Homo sapiens
caggtggtggcactgagcc

SEQ ID NO: 1527617 - DNA, 13 bp, Homo sapiens
caggtgtgcacgt

SEQ ID NO: 1527618 - DNA, 23 bp, Homo sapiens
caggtgtgcacgtggcatgtggc

SEQ ID NO: 1527619 - DNA, 15 bp, Homo sapiens
caggtgtgcctgtgc

SEQ ID NO: 1527620 - DNA, 13 bp, Homo sapiens
caggtgtggtggc

SEQ ID NO: 1527621 - DNA, 17 bp, Homo sapiens
caggtgtggtggctcat

SEQ ID NO: 1527622 - DNA, 19 bp, Homo sapiens
caggtgttaacattccaag

SEQ ID NO: 1527623 - DNA, 15 bp, Homo sapiens
caggtgttctgctga

SEQ ID NO: 1527624 - DNA, 12 bp, Homo sapiens
caggtgttcttc

SEQ ID NO: 1527625 - DNA, 20 bp, Homo sapiens
caggtgttgggacctgctgc

SEQ ID NO: 1527626 - DNA, 21 bp, Homo sapiens
caggtgttgggacctgctgct

SEQ ID NO: 1527627 - DNA, 22 bp, Homo sapiens
caggtgttgggacctgctgctc

SEQ ID NO: 1527628 - DNA, 17 bp, Homo sapiens
caggtgttttcaagcac

SEQ ID NO: 1527629 - DNA, 14 bp, Homo sapiens
caggttaagaaaat

SEQ ID NO: 1527630 - DNA, 21 bp, Homo sapiens
caggttatgtcagcagctctg

SEQ ID NO: 1527631 - DNA, 12 bp, Homo sapiens
caggttccagaa

SEQ ID NO: 1527632 - DNA, 15 bp, Homo sapiens
caggttccatccacc

SEQ ID NO: 1527633 - DNA, 16 bp, Homo sapiens
caggttccatccacca

SEQ ID NO: 1527634 - DNA, 14 bp, Homo sapiens
caggttccccaagg

SEQ ID NO: 1527635 - DNA, 17 bp, Homo sapiens
caggttccccaagggcc

SEQ ID NO: 1527636 - DNA, 16 bp, Homo sapiens
caggttccctcccaga

SEQ ID NO: 1527637 - DNA, 23 bp, Homo sapiens
caggttccctcccagaggagcca

SEQ ID NO: 1527638 - DNA, 14 bp, Homo sapiens
caggttcctttttc

SEQ ID NO: 1527639 - DNA, 18 bp, Homo sapiens
caggttctgaaagagtct

SEQ ID NO: 1527640 - DNA, 23 bp, Homo sapiens
caggttctgaaagagtctttctt

SEQ ID NO: 1527641 - DNA, 18 bp, Homo sapiens
caggttcttgatgtcatg

SEQ ID NO: 1527642 - DNA, 23 bp, Homo sapiens
caggttgacaccattctcctgcc

SEQ ID NO: 1527643 - DNA, 15 bp, Homo sapiens
caggttgaccgggac

SEQ ID NO: 1527644 - DNA, 20 bp, Homo sapiens
caggttgaggggctcctgga

SEQ ID NO: 1527645 - DNA, 21 bp, Homo sapiens
caggttgaggggctcctggaa

SEQ ID NO: 1527646 - DNA, 13 bp, Homo sapiens
caggttgcagctg

SEQ ID NO: 1527647 - DNA, 16 bp, Homo sapiens
caggttgcagctgctc

SEQ ID NO: 1527648 - DNA, 21 bp, Homo sapiens
caggttgggaacatgctggaa

SEQ ID NO: 1527649 - DNA, 22 bp, Homo sapiens
caggttgtctgaagtcactgca

SEQ ID NO: 1527650 - DNA, 22 bp, Homo sapiens
caggtttactggacaaaatcaa

SEQ ID NO: 1527651 - DNA, 19 bp, Homo sapiens
cagtaaaaaaaaaaaatgg

SEQ ID NO: 1527652 - DNA, 21 bp, Homo sapiens
cagtaaaaacttgtactatgt

SEQ ID NO: 1527653 - DNA, 22 bp, Homo sapiens
cagtaaaaacttgtactatgtt

SEQ ID NO: 1527654 - DNA, 16 bp, Homo sapiens
cagtaaaccactgaaa

SEQ ID NO: 1527655 - DNA, 15 bp, Homo sapiens
cagtaaagcacttgc

SEQ ID NO: 1527656 - DNA, 18 bp, Homo sapiens
cagtaaataactggaaaa

SEQ ID NO: 1527657 - DNA, 15 bp, Homo sapiens
cactttcataatctt

SEQ ID NO: 1527658 - DNA, 20 bp, Homo sapiens
cactttccatctctgcctgt

SEQ ID NO: 1527659 - DNA, 13 bp, Homo sapiens
cactttcctgagc

SEQ ID NO: 1527660 - DNA, 16 bp, Homo sapiens
cactttcctgagctgt

SEQ ID NO: 1527661 - DNA, 21 bp, Homo sapiens
cactttcctgagctgtcgctg

SEQ ID NO: 1527662 - DNA, 19 bp, Homo sapiens
cactttctcagttttcata

SEQ ID NO: 1527663 - DNA, 17 bp, Homo sapiens
cactttgaaaagttgga

SEQ ID NO: 1527664 - DNA, 14 bp, Homo sapiens
cactttgaagggca

SEQ ID NO: 1527665 - DNA, 17 bp, Homo sapiens
cactttgagcctgggaa

SEQ ID NO: 1527666 - DNA, 16 bp, Homo sapiens
cactttgctttctgaa

SEQ ID NO: 1527667 - DNA, 18 bp, Homo sapiens
cactttgctttctgaatt

SEQ ID NO: 1527668 - DNA, 19 bp, Homo sapiens
cactttggcttctcctgtg

SEQ ID NO: 1527669 - DNA, 22 bp, Homo sapiens
cactttggcttctcctgtgacc

SEQ ID NO: 1527670 - DNA, 22 bp, Homo sapiens
cagtaaataactggaaaacaga

SEQ ID NO: 1527671 - DNA, 14 bp, Homo sapiens
cagtaaatttgcta

SEQ ID NO: 1527672 - DNA, 15 bp, Homo sapiens
cagtaaatttgctag

SEQ ID NO: 1527673 - DNA, 14 bp, Homo sapiens
cagtaacccaaatc

SEQ ID NO: 1527674 - DNA, 17 bp, Homo sapiens
cagtaacctagtgaatt

SEQ ID NO: 1527675 - DNA, 19 bp, Homo sapiens
cagtaacgcgtcttcctga

SEQ ID NO: 1527676 - DNA, 9 bp, Homo sapiens
cagtaactg

SEQ ID NO: 1527677 - DNA, 16 bp, Homo sapiens
cagtaactttatgtgt

SEQ ID NO: 1527678 - DNA, 18 bp, Homo sapiens
cagtaactttatgtgtaa

SEQ ID NO: 1527679 - DNA, 16 bp, Homo sapiens
cagtaacttttttgtg

SEQ ID NO: 1527680 - DNA, 19 bp, Homo sapiens
cagtaacttttttgtgtat

SEQ ID NO: 1527681 - DNA, 20 bp, Homo sapiens
cagtaagatatctcaatgaa

SEQ ID NO: 1527682 - DNA, 18 bp, Homo sapiens
cagtaatacattccattg

SEQ ID NO: 1527683 - DNA, 14 bp, Homo sapiens
cagtaatctaggtg

SEQ ID NO: 1527684 - DNA, 20 bp, Homo sapiens
cagtaatctaggtgtggctg

SEQ ID NO: 1527685 - DNA, 20 bp, Homo sapiens
cagtacaataatgtactcac

SEQ ID NO: 1527686 - DNA, 18 bp, Homo sapiens
cagtacacccaattttaa

SEQ ID NO: 1527687 - DNA, 14 bp, Homo sapiens
cagtacagaaggca

SEQ ID NO: 1527688 - DNA, 14 bp, Homo sapiens
cagtacatatgtaa

SEQ ID NO: 1527689 - DNA, 15 bp, Homo sapiens
cagtacatgggaaag

SEQ ID NO: 1527690 - DNA, 19 bp, Homo sapiens
cagtacattctaaagagag

SEQ ID NO: 1527691 - DNA, 22 bp, Homo sapiens
cagtacattctaaagagagtga

SEQ ID NO: 1527692 - DNA, 15 bp, Homo sapiens
cagtacatttaaatt

SEQ ID NO: 1527693 - DNA, 20 bp, Homo sapiens
cagtacatttaaattttttg

SEQ ID NO: 1527694 - DNA, 16 bp, Homo sapiens
cagtaccctctcagct

SEQ ID NO: 1527695 - DNA, 24 bp, Homo sapiens
cagtaccctctcagctccaggtgg

SEQ ID NO: 1527696 - DNA, 20 bp, Homo sapiens
cagtacctagctggctctgt

SEQ ID NO: 1527697 - DNA, 18 bp, Homo sapiens
cagtacctcgtttctaca

SEQ ID NO: 1527698 - DNA, 16 bp, Homo sapiens
cagtacctgattgtat

SEQ ID NO: 1527699 - DNA, 20 bp, Homo sapiens
cagtacctgattgtattttt

SEQ ID NO: 1527700 - DNA, 18 bp, Homo sapiens
cagtacctgggaaaggac

SEQ ID NO: 1527701 - DNA, 17 bp, Homo sapiens
cagtaccttgttgcaga

SEQ ID NO: 1527702 - DNA, 17 bp, Homo sapiens
cagtacgtcccgctgct

SEQ ID NO: 1527703 - DNA, 15 bp, Homo sapiens
cagtactaaaattaa

SEQ ID NO: 1527704 - DNA, 19 bp, Homo sapiens
cagtactgactttctgatt

SEQ ID NO: 1527705 - DNA, 16 bp, Homo sapiens
cagtactttattgtac

SEQ ID NO: 1527706 - DNA, 14 bp, Homo sapiens
cagtactttccagc

SEQ ID NO: 1527707 - DNA, 19 bp, Homo sapiens
cagtactttccagcagtca

SEQ ID NO: 1527708 - DNA, 16 bp, Homo sapiens
cagtactttgtgcatt

SEQ ID NO: 1527709 - DNA, 21 bp, Homo sapiens
cagtacttttttaaatatttt

SEQ ID NO: 1527710 - DNA, 14 bp, Homo sapiens
cagtagaactccag

SEQ ID NO: 1527711 - DNA, 14 bp, Homo sapiens
cagtagagccagct

SEQ ID NO: 1527712 - DNA, 16 bp, Homo sapiens
cagtagagccagcttg

SEQ ID NO: 1527713 - DNA, 17 bp, Homo sapiens
cagtagagccagcttgg

SEQ ID NO: 1527714 - DNA, 22 bp, Homo sapiens
cagtagctgctacctaaaaaaa

SEQ ID NO: 1527715 - DNA, 19 bp, Homo sapiens
cagtagtgtcatcactctt

SEQ ID NO: 1527716 - DNA, 21 bp, Homo sapiens
cagtagtttgagaccagcctg

SEQ ID NO: 1527717 - DNA, 23 bp, Homo sapiens
cagtagtttgagaccagcctggc

SEQ ID NO: 1527718 - DNA, 20 bp, Homo sapiens
cagtagtttgcatttcagaa

SEQ ID NO: 1527719 - DNA, 15 bp, Homo sapiens
cagtagttttcaaaa

SEQ ID NO: 1527720 - DNA, 18 bp, Homo sapiens
cagtagttttcaaaacac

SEQ ID NO: 1527721 - DNA, 19 bp, Homo sapiens
cagtataattctgtactga

SEQ ID NO: 1527722 - DNA, 22 bp, Homo sapiens
cagtataattctgtactgattt

SEQ ID NO: 1527723 - DNA, 15 bp, Homo sapiens
cagtatactgtgtgg

SEQ ID NO: 1527724 - DNA, 12 bp, Homo sapiens
cagtatcccaca

SEQ ID NO: 1527725 - DNA, 19 bp, Homo sapiens
cagtatctatatatgtgta

SEQ ID NO: 1527726 - DNA, 15 bp, Homo sapiens
cagtatctcttcagt

SEQ ID NO: 1527727 - DNA, 22 bp, Homo sapiens
cagtatctcttcagtctctata

SEQ ID NO: 1527728 - DNA, 21 bp, Homo sapiens
cagtatgaaaatcagcatgcc

SEQ ID NO: 1527729 - DNA, 14 bp, Homo sapiens
cagtatgagaagaa

SEQ ID NO: 1527730 - DNA, 17 bp, Homo sapiens
cagtatgatgaaaataa

SEQ ID NO: 1527731 - DNA, 18 bp, Homo sapiens
cagtatgctttccctgag

SEQ ID NO: 1527732 - DNA, 20 bp, Homo sapiens
cagtatgctttccctgagga

SEQ ID NO: 1527733 - DNA, 19 bp, Homo sapiens
cagtatgtgggatattgaa

SEQ ID NO: 1527734 - DNA, 14 bp, Homo sapiens
cagtattacagtgt

SEQ ID NO: 1527735 - DNA, 22 bp, Homo sapiens
cagtattatgcatatataagtt

SEQ ID NO: 1527736 - DNA, 15 bp, Homo sapiens
cagtatttcagactg

SEQ ID NO: 1527737 - DNA, 18 bp, Homo sapiens
cagtattttgtgtcctcc

SEQ ID NO: 1527738 - DNA, 17 bp, Homo sapiens
cagtatttttaaaggca

SEQ ID NO: 1527739 - DNA, 18 bp, Homo sapiens
cagtatttttaaaggcat

SEQ ID NO: 1527740 - DNA, 13 bp, Homo sapiens
cagtatttttgcc

SEQ ID NO: 1527741 - DNA, 22 bp, Homo sapiens
cagtatttttttttaattttga

SEQ ID NO: 1527742 - DNA, 19 bp, Homo sapiens
cagtcaaaacagagatgtg

SEQ ID NO: 1527743 - DNA, 21 bp, Homo sapiens
cagtcaaaggaacgccttccc

SEQ ID NO: 1527744 - DNA, 17 bp, Homo sapiens
cagtcaaatctgggctc

SEQ ID NO: 1527745 - DNA, 16 bp, Homo sapiens
cagtcaacaaactatt

SEQ ID NO: 1527746 - DNA, 13 bp, Homo sapiens
cagtcaacagatt

SEQ ID NO: 1527747 - DNA, 15 bp, Homo sapiens
cagtcaacagattca

SEQ ID NO: 1527748 - DNA, 16 bp, Homo sapiens
cagtcaacagattcag

SEQ ID NO: 1527749 - DNA, 14 bp, Homo sapiens
cagtcaacagttca

SEQ ID NO: 1527750 - DNA, 20 bp, Homo sapiens
cagtcaacagttcaaagaag

SEQ ID NO: 1527751 - DNA, 13 bp, Homo sapiens
cagtcaagaagaa

SEQ ID NO: 1527752 - DNA, 14 bp, Homo sapiens
cagtcaagaagaaa

SEQ ID NO: 1527753 - DNA, 22 bp, Homo sapiens
cagtcacctcgtctccctggtg

SEQ ID NO: 1527754 - DNA, 13 bp, Homo sapiens
cagtcactcctct

SEQ ID NO: 1527755 - DNA, 19 bp, Homo sapiens
cagtcactcctctctaggg

SEQ ID NO: 1527756 - DNA, 23 bp, Homo sapiens
cagtcactggaggttgaagccaa

SEQ ID NO: 1527757 - DNA, 15 bp, Homo sapiens
cagtcagggacagca

SEQ ID NO: 1527758 - DNA, 21 bp, Homo sapiens
cagtcagggacagcagcctcc

SEQ ID NO: 1527759 - DNA, 19 bp, Homo sapiens
cagtcagttcccggagcac

SEQ ID NO: 1527760 - DNA, 21 bp, Homo sapiens
cagtcagttcccggagcacag

SEQ ID NO: 1527761 - DNA, 23 bp, Homo sapiens
cagtcagttcccggagcacagcc

SEQ ID NO: 1527762 - DNA, 18 bp, Homo sapiens
cagtcataaatactgtca

SEQ ID NO: 1527763 - DNA, 24 bp, Homo sapiens
cagtcatggcaccaaagccaccag

SEQ ID NO: 1527764 - DNA, 21 bp, Homo sapiens
cagtcatggcctgagatgcag

SEQ ID NO: 1527765 - DNA, 13 bp, Homo sapiens
cagtcattatgag

SEQ ID NO: 1527766 - DNA, 14 bp, Homo sapiens
cagtccacaggggc

SEQ ID NO: 1527767 - DNA, 20 bp, Homo sapiens
cagtccacctgaggaactgt

SEQ ID NO: 1527768 - DNA, 23 bp, Homo sapiens
cagtccacctgaggaactgtctc

SEQ ID NO: 1527769 - DNA, 12 bp, Homo sapiens
cagtccactgtt

SEQ ID NO: 1527770 - DNA, 13 bp, Homo sapiens
cagtccagccagc

SEQ ID NO: 1527771 - DNA, 16 bp, Homo sapiens
cagtccagccagctcc

SEQ ID NO: 1527772 - DNA, 15 bp, Homo sapiens
cagtccaggctgccg

SEQ ID NO: 1527773 - DNA, 18 bp, Homo sapiens
cagtccaggctgccgtgg

SEQ ID NO: 1527774 - DNA, 13 bp, Homo sapiens
cagtccatgctcc

SEQ ID NO: 1527775 - DNA, 12 bp, Homo sapiens
cagtcccacacc

SEQ ID NO: 1527776 - DNA, 15 bp, Homo sapiens
cagtcccacaccgct

SEQ ID NO: 1527777 - DNA, 17 bp, Homo sapiens
cagtcccagggaaggtg

SEQ ID NO: 1527778 - DNA, 13 bp, Homo sapiens
cagtcccaggggc

SEQ ID NO: 1527779 - DNA, 12 bp, Homo sapiens
cagtccccaccc

SEQ ID NO: 1527780 - DNA, 20 bp, Homo sapiens
cagtccccacccctgccccc

SEQ ID NO: 1527781 - DNA, 15 bp, Homo sapiens
cagtccccagccctt

SEQ ID NO: 1527782 - DNA, 13 bp, Homo sapiens
cagtccccgagga

SEQ ID NO: 1527783 - DNA, 20 bp, Homo sapiens
cagtccccgaggagctgggc

SEQ ID NO: 1527784 - DNA, 18 bp, Homo sapiens
cagtccccgtgccccgcc

SEQ ID NO: 1527785 - DNA, 12 bp, Homo sapiens
cagtcccctccc

SEQ ID NO: 1527786 - DNA, 16 bp, Homo sapiens
cagtcccctcccatct

SEQ ID NO: 1527787 - DNA, 21 bp, Homo sapiens
cagccctgattgtgccagtgc

SEQ ID NO: 1527788 - DNA, 22 bp, Homo sapiens
cagccctgattgtgccagtgca

SEQ ID NO: 1527789 - DNA, 15 bp, Homo sapiens
cagccctgcaccatg

SEQ ID NO: 1527790 - DNA, 23 bp, Homo sapiens
cagccctgcaccatgctgctggg

SEQ ID NO: 1527791 - DNA, 13 bp, Homo sapiens
cagccctgcagcc

SEQ ID NO: 1527792 - DNA, 11 bp, Homo sapiens
cagccctgctg

SEQ ID NO: 1527793 - DNA, 11 bp, Homo sapiens
cagccctgctt

SEQ ID NO: 1527794 - DNA, 20 bp, Homo sapiens
cagccctgctttgggctgcc

SEQ ID NO: 1527795 - DNA, 16 bp, Homo sapiens
cagccctggccctgcc

SEQ ID NO: 1527796 - DNA, 18 bp, Homo sapiens
cagccctggccctgccca

SEQ ID NO: 1527797 - DNA, 19 bp, Homo sapiens
cagccctggccctgcccag

SEQ ID NO: 1527798 - DNA, 12 bp, Homo sapiens
cagccctgggcc

SEQ ID NO: 1527799 - DNA, 13 bp, Homo sapiens
cagccctgggccc

SEQ ID NO: 1527800 - DNA, 20 bp, Homo sapiens
cagccctgggccccaccacc

SEQ ID NO: 1527801 - DNA, 18 bp, Homo sapiens
cagccctgtcacgccggg

SEQ ID NO: 1527802 - DNA, 15 bp, Homo sapiens
cagcccttctgcctt

SEQ ID NO: 1527803 - DNA, 12 bp, Homo sapiens
cagcccttgctt

SEQ ID NO: 1527804 - DNA, 19 bp, Homo sapiens
cagccctttgggaggctga

SEQ ID NO: 1527805 - DNA, 19 bp, Homo sapiens
cagccgagccgggcctggg

SEQ ID NO: 1527806 - DNA, 22 bp, Homo sapiens
cagccgagctcgtgtatcctgg

SEQ ID NO: 1527807 - DNA, 13 bp, Homo sapiens
cagccgaggcctg

SEQ ID NO: 1527808 - DNA, 17 bp, Homo sapiens
cagccgaggcctggcca

SEQ ID NO: 1527809 - DNA, 18 bp, Homo sapiens
cagccgaggcctggccaa

SEQ ID NO: 1527810 - DNA, 16 bp, Homo sapiens
cagccgcagcctccct

SEQ ID NO: 1527811 - DNA, 19 bp, Homo sapiens
cagccgcagcctccctctg

SEQ ID NO: 1527812 - DNA, 19 bp, Homo sapiens
cagccgccattgccaccag

SEQ ID NO: 1527813 - DNA, 21 bp, Homo sapiens
cagccgccattgccaccagga

SEQ ID NO: 1527814 - DNA, 20 bp, Homo sapiens
cagccgctgcagggctccca

SEQ ID NO: 1527815 - DNA, 21 bp, Homo sapiens
cagccgctgcagggctcccat

SEQ ID NO: 1527816 - DNA, 22 bp, Homo sapiens
cagccgctgcagggctcccatg

SEQ ID NO: 1527817 - DNA, 18 bp, Homo sapiens
cagccggcacagggtctg

SEQ ID NO: 1527818 - DNA, 14 bp, Homo sapiens
cagccggcctctct

SEQ ID NO: 1527819 - DNA, 22 bp, Homo sapiens
cagccggcctctctggcctccc

SEQ ID NO: 1527820 - DNA, 13 bp, Homo sapiens
cagccggtgcctg

SEQ ID NO: 1527821 - DNA, 15 bp, Homo sapiens
cagccgtattttaca

SEQ ID NO: 1527822 - DNA, 18 bp, Homo sapiens
cagccgtcagccaaatgt

SEQ ID NO: 1527823 - DNA, 23 bp, Homo sapiens
cagccgtcccgcgttcaagactt

SEQ ID NO: 1527824 - DNA, 19 bp, Homo sapiens
cagccgtgatgctcaggct

SEQ ID NO: 1527825 - DNA, 20 bp, Homo sapiens
cagccgtgccttcagctcta

SEQ ID NO: 1527826 - DNA, 23 bp, Homo sapiens
cagccgtggtccaaccaggagct

SEQ ID NO: 1527827 - DNA, 23 bp, Homo sapiens
cagcctaagaagctctggcccca

SEQ ID NO: 1527828 - DNA, 15 bp, Homo sapiens
cagcctaccatgaga

SEQ ID NO: 1527829 - DNA, 17 bp, Homo sapiens
cagcctagccgacctca

SEQ ID NO: 1527830 - DNA, 21 bp, Homo sapiens
cagcctagccgacctcagcct

SEQ ID NO: 1527831 - DNA, 21 bp, Homo sapiens
cagcctagggctgagctgggg

SEQ ID NO: 1527832 - DNA, 12 bp, Homo sapiens
cagcctccaaag

SEQ ID NO: 1527833 - DNA, 22 bp, Homo sapiens
cagcctccaaagtggagctggg

SEQ ID NO: 1527834 - DNA, 12 bp, Homo sapiens
cagcctccaatg

SEQ ID NO: 1527835 - DNA, 24 bp, Homo sapiens
cagcctccaatgcattggcctctg

SEQ ID NO: 1527836 - DNA, 17 bp, Homo sapiens
cagcctccacttccctc

SEQ ID NO: 1527837 - DNA, 12 bp, Homo sapiens
cagcctccagag

SEQ ID NO: 1527838 - DNA, 13 bp, Homo sapiens
cagcctccagagc

SEQ ID NO: 1527839 - DNA, 14 bp, Homo sapiens
cagcctccagagcc

SEQ ID NO: 1527840 - DNA, 15 bp, Homo sapiens
cagcctccagagcca

SEQ ID NO: 1527841 - DNA, 18 bp, Homo sapiens
cagcctccagagccagcc

SEQ ID NO: 1527842 - DNA, 19 bp, Homo sapiens
cagcctccagagccagcct

SEQ ID NO: 1527843 - DNA, 23 bp, Homo sapiens
cagcctccagagccagcctggga

SEQ ID NO: 1527844 - DNA, 15 bp, Homo sapiens
cagcctccagggcat

SEQ ID NO: 1527845 - DNA, 22 bp, Homo sapiens
cagcctccagggcattgctcag

SEQ ID NO: 1527846 - DNA, 21 bp, Homo sapiens
cagcctcccaaagtgctgaga

SEQ ID NO: 1527847 - DNA, 18 bp, Homo sapiens
cagcctcccaaccccagg

SEQ ID NO: 1527848 - DNA, 20 bp, Homo sapiens
cagcctcccaattagcttgg

SEQ ID NO: 1527849 - DNA, 12 bp, Homo sapiens
cagcctcccaca

SEQ ID NO: 1527850 - DNA, 13 bp, Homo sapiens
cagcctcccacaa

SEQ ID NO: 1527851 - DNA, 14 bp, Homo sapiens
cagcctcccacccc

SEQ ID NO: 1527852 - DNA, 21 bp, Homo sapiens
cagcctcccccgccagcccca

SEQ ID NO: 1527853 - DNA, 22 bp, Homo sapiens
cagcctccctctgacctgcagg

SEQ ID NO: 1527854 - DNA, 14 bp, Homo sapiens
cagcctccctgaag

SEQ ID NO: 1527855 - DNA, 15 bp, Homo sapiens
cagcctccctgtcac

SEQ ID NO: 1527856 - DNA, 16 bp, Homo sapiens
cagcctccctgtcact

SEQ ID NO: 1527857 - DNA, 22 bp, Homo sapiens
cagcctccctgtcactcagctg

SEQ ID NO: 1527858 - DNA, 17 bp, Homo sapiens
cagcctccgagagggag

SEQ ID NO: 1527859 - DNA, 21 bp, Homo sapiens
cagcctcctctggacggcagg

SEQ ID NO: 1527860 - DNA, 22 bp, Homo sapiens
cagcctcctctggacggcaggc

SEQ ID NO: 1527861 - DNA, 18 bp, Homo sapiens
cagcctcctgagtagctg

SEQ ID NO: 1527862 - DNA, 23 bp, Homo sapiens
caggatgttagaaagtgctgata

SEQ ID NO: 1527863 - DNA, 19 bp, Homo sapiens
caggattaatctctaaaat

SEQ ID NO: 1527864 - DNA, 23 bp, Homo sapiens
caggattaatctctaaaattcta

SEQ ID NO: 1527865 - DNA, 14 bp, Homo sapiens
caggattcccccag

SEQ ID NO: 1527866 - DNA, 14 bp, Homo sapiens
caggattcccttct

SEQ ID NO: 1527867 - DNA, 14 bp, Homo sapiens
caggattcttcccg

SEQ ID NO: 1527868 - DNA, 12 bp, Homo sapiens
caggattgagca

SEQ ID NO: 1527869 - DNA, 20 bp, Homo sapiens
caggatttaaaaactggaac

SEQ ID NO: 1527870 - DNA, 22 bp, Homo sapiens
caggatttcaccagaagttaca

SEQ ID NO: 1527871 - DNA, 23 bp, Homo sapiens
caggcaaacattttctcttagaa

SEQ ID NO: 1527872 - DNA, 13 bp, Homo sapiens
caggcaaatcagt

SEQ ID NO: 1527873 - DNA, 14 bp, Homo sapiens
caggcaacctccca

SEQ ID NO: 1527874 - DNA, 15 bp, Homo sapiens
caggcaacctcccat

SEQ ID NO: 1527875 - DNA, 19 bp, Homo sapiens
caggcaacgcagaccaaca

SEQ ID NO: 1527876 - DNA, 23 bp, Homo sapiens
caggcaacgtgcgtgtctctgcc

SEQ ID NO: 1527877 - DNA, 22 bp, Homo sapiens
caggcaactgaggcagacagca

SEQ ID NO: 1527878 - DNA, 13 bp, Homo sapiens
caggcaagcagct

SEQ ID NO: 1527879 - DNA, 19 bp, Homo sapiens
caggcaagcccctcagccc

SEQ ID NO: 1527880 - DNA, 20 bp, Homo sapiens
caggcaagcccctcagccct

SEQ ID NO: 1527881 - DNA, 21 bp, Homo sapiens
caggcaagcccctcagccctt

SEQ ID NO: 1527882 - DNA, 24 bp, Homo sapiens
caggcaagcccctcagcccttgcc

SEQ ID NO: 1527883 - DNA, 23 bp, Homo sapiens
caggcaaggtttacactgcggaa

SEQ ID NO: 1527884 - DNA, 16 bp, Homo sapiens
caggcacacaccacca

SEQ ID NO: 1527885 - DNA, 13 bp, Homo sapiens
caggcacacagct

SEQ ID NO: 1527886 - DNA, 23 bp, Homo sapiens
caggcacacagctactctcccca

SEQ ID NO: 1527887 - DNA, 15 bp, Homo sapiens
caggcacacagggcc

SEQ ID NO: 1527888 - DNA, 22 bp, Homo sapiens
caggcacatacacctcgtcaag

SEQ ID NO: 1527889 - DNA, 16 bp, Homo sapiens
caggcaccaccaggag

SEQ ID NO: 1527890 - DNA, 17 bp, Homo sapiens
caggcaccaccaggagc

SEQ ID NO: 1527891 - DNA, 22 bp, Homo sapiens
caggcaccaccaggagcagcag

SEQ ID NO: 1527892 - DNA, 20 bp, Homo sapiens
caggcaccaggactagggct

SEQ ID NO: 1527893 - DNA, 15 bp, Homo sapiens
caggcacccatgtgg

SEQ ID NO: 1527894 - DNA, 13 bp, Homo sapiens
caggcaccgagaa

SEQ ID NO: 1527895 - DNA, 16 bp, Homo sapiens
caggcaccgagaatgt

SEQ ID NO: 1527896 - DNA, 17 bp, Homo sapiens
caggcacctggcctgct

SEQ ID NO: 1527897 - DNA, 19 bp, Homo sapiens
caggcacctggcctgctgg

SEQ ID NO: 1527898 - DNA, 20 bp, Homo sapiens
caggcacctggcctgctggg

SEQ ID NO: 1527899 - DNA, 20 bp, Homo sapiens
caggcacgaacccacctgct

SEQ ID NO: 1527900 - DNA, 18 bp, Homo sapiens
caggcacgggtggtcccc

SEQ ID NO: 1527901 - DNA, 19 bp, Homo sapiens
caggcacgggtggtccccg

SEQ ID NO: 1527902 - DNA, 14 bp, Homo sapiens
caggcacggtttgg

SEQ ID NO: 1527903 - DNA, 18 bp, Homo sapiens
caggcactgttcatctca

SEQ ID NO: 1527904 - DNA, 21 bp, Homo sapiens
caggcacttaagcacaagcag

SEQ ID NO: 1527905 - DNA, 19 bp, Homo sapiens
caggcagacaagagctgct

SEQ ID NO: 1527906 - DNA, 14 bp, Homo sapiens
caggcagagaatca

SEQ ID NO: 1527907 - DNA, 13 bp, Homo sapiens
caggcagagctga

SEQ ID NO: 1527908 - DNA, 17 bp, Homo sapiens
caggcagagctgagggc

SEQ ID NO: 1527909 - DNA, 19 bp, Homo sapiens
caggcagagctgagggccc

SEQ ID NO: 1527910 - DNA, 22 bp, Homo sapiens
caggcagagctgagggccctgt

SEQ ID NO: 1527911 - DNA, 14 bp, Homo sapiens
caggcagatccagg

SEQ ID NO: 1527912 - DNA, 17 bp, Homo sapiens
caggcagatctgtgccc

SEQ ID NO: 1527913 - DNA, 18 bp, Homo sapiens
caggcagatctgtgcccc

SEQ ID NO: 1527914 - DNA, 19 bp, Homo sapiens
caggcagatctgtgcccca

SEQ ID NO: 1527915 - DNA, 20 bp, Homo sapiens
caggcagcaccacactgggt

SEQ ID NO: 1527916 - DNA, 17 bp, Homo sapiens
caggcagctccctcctg

SEQ ID NO: 1527917 - DNA, 18 bp, Homo sapiens
caggcagctggatgagac

SEQ ID NO: 1527918 - DNA, 22 bp, Homo sapiens
caggcagctgtcactgctgctt

SEQ ID NO: 1527919 - DNA, 20 bp, Homo sapiens
caggcaggaacaaacagggc

SEQ ID NO: 1527920 - DNA, 14 bp, Homo sapiens
caggcaggagccct

SEQ ID NO: 1527921 - DNA, 20 bp, Homo sapiens
caggcaggccaggctgcctc

SEQ ID NO: 1527922 - DNA, 18 bp, Homo sapiens
caggcagggagtgtctgc

SEQ ID NO: 1527923 - DNA, 21 bp, Homo sapiens
caggcagggagtgtctgcagt

SEQ ID NO: 1527924 - DNA, 22 bp, Homo sapiens
caggcagggagtgtctgcagtc

SEQ ID NO: 1527925 - DNA, 18 bp, Homo sapiens
caggcagggctgggccag

SEQ ID NO: 1527926 - DNA, 19 bp, Homo sapiens
caggcagggctgggccagg

SEQ ID NO: 1527927 - DNA, 12 bp, Homo sapiens
caggcaggggtg

SEQ ID NO: 1527928 - DNA, 20 bp, Homo sapiens
caggcaggtctgcaagggcc

SEQ ID NO: 1527929 - DNA, 22 bp, Homo sapiens
caggcaggtctgcaagggccca

SEQ ID NO: 1527930 - DNA, 16 bp, Homo sapiens
caggcaggtggactga

SEQ ID NO: 1527931 - DNA, 13 bp, Homo sapiens
caggcaggtttgc

SEQ ID NO: 1527932 - DNA, 19 bp, Homo sapiens
caggcagtcgggggctggc

SEQ ID NO: 1527933 - DNA, 21 bp, Homo sapiens
caggcagtctttgctcagtgg

SEQ ID NO: 1527934 - DNA, 17 bp, Homo sapiens
caggcagttaggtgctg

SEQ ID NO: 1527935 - DNA, 18 bp, Homo sapiens
caggcagttaggtgctga

SEQ ID NO: 1527936 - DNA, 16 bp, Homo sapiens
caggcagttctagaag

SEQ ID NO: 1527937 - DNA, 14 bp, Homo sapiens
caggcatagaggct

SEQ ID NO: 1527938 - DNA, 17 bp, Homo sapiens
caggcataggcctgggt

SEQ ID NO: 1527939 - DNA, 18 bp, Homo sapiens
caggcataggcctgggtg

SEQ ID NO: 1527940 - DNA, 15 bp, Homo sapiens
caggcatctacacag

SEQ ID NO: 1527941 - DNA, 17 bp, Homo sapiens
caggcatctacacagcc

SEQ ID NO: 1527942 - DNA, 20 bp, Homo sapiens
caggcatctacacagcctgg

SEQ ID NO: 1527943 - DNA, 15 bp, Homo sapiens
caggcatggccctgg

SEQ ID NO: 1527944 - DNA, 16 bp, Homo sapiens
caggcatggccctggg

SEQ ID NO: 1527945 - DNA, 17 bp, Homo sapiens
caggcatggccctgggc

SEQ ID NO: 1527946 - DNA, 23 bp, Homo sapiens
caggcatgggtgcaaggaaaatt

SEQ ID NO: 1527947 - DNA, 21 bp, Homo sapiens
caggcattcctgaagggaact

SEQ ID NO: 1527948 - DNA, 15 bp, Homo sapiens
caggcattggatatt

SEQ ID NO: 1527949 - DNA, 19 bp, Homo sapiens
caggcattggctcagcccg

SEQ ID NO: 1527950 - DNA, 15 bp, Homo sapiens
caggcatttgccaag

SEQ ID NO: 1527951 - DNA, 18 bp, Homo sapiens
caggccaagagcagaggc

SEQ ID NO: 1527952 - DNA, 19 bp, Homo sapiens
caggccaagagcagaggca

SEQ ID NO: 1527953 - DNA, 23 bp, Homo sapiens
caggccaatgttgctgatggccc

SEQ ID NO: 1527954 - DNA, 17 bp, Homo sapiens
caggccacccccatgga

SEQ ID NO: 1527955 - DNA, 19 bp, Homo sapiens
caggccaccccgctgatgg

SEQ ID NO: 1527956 - DNA, 12 bp, Homo sapiens
caggccactgtg

SEQ ID NO: 1527957 - DNA, 16 bp, Homo sapiens
caggccactgtggcca

SEQ ID NO: 1527958 - DNA, 19 bp, Homo sapiens
caggccactgtggccagag

SEQ ID NO: 1527959 - DNA, 15 bp, Homo sapiens
caggccagcccagcc

SEQ ID NO: 1527960 - DNA, 17 bp, Homo sapiens
caggccagcccagccag

SEQ ID NO: 1527961 - DNA, 18 bp, Homo sapiens
caggccagcccagccagg

SEQ ID NO: 1527962 - DNA, 15 bp, Homo sapiens
caggccagcctccga

SEQ ID NO: 1527963 - DNA, 16 bp, Homo sapiens
caggccagcctccgag

SEQ ID NO: 1527964 - DNA, 12 bp, Homo sapiens
caggccaggctc

SEQ ID NO: 1527965 - DNA, 21 bp, Homo sapiens
caggccaggctccttcctgtc

SEQ ID NO: 1527966 - DNA, 17 bp, Homo sapiens
caggccaggctgcctcg

SEQ ID NO: 1527967 - DNA, 15 bp, Homo sapiens
caggccagggctcct

SEQ ID NO: 1527968 - DNA, 17 bp, Homo sapiens
caggccattatgcctgg

SEQ ID NO: 1527969 - DNA, 22 bp, Homo sapiens
caggcccaactgtgagcaagga

SEQ ID NO: 1527970 - DNA, 16 bp, Homo sapiens
caggcccaaggctccc

SEQ ID NO: 1527971 - DNA, 17 bp, Homo sapiens
caggcccaaggctcccg

SEQ ID NO: 1527972 - DNA, 22 bp, Homo sapiens
caggcccacagcgtgggaactc

SEQ ID NO: 1527973 - DNA, 13 bp, Homo sapiens
caggcccaccatc

SEQ ID NO: 1527974 - DNA, 23 bp, Homo sapiens
caggcccaccatcaccaccgcct

SEQ ID NO: 1527975 - DNA, 12 bp, Homo sapiens
caggcccactcc

SEQ ID NO: 1527976 - DNA, 14 bp, Homo sapiens
caggcccactcccc

SEQ ID NO: 1527977 - DNA, 19 bp, Homo sapiens
caggcccactccccagccc

SEQ ID NO: 1527978 - DNA, 15 bp, Homo sapiens
caggcccagagaagc

SEQ ID NO: 1527979 - DNA, 11 bp, Homo sapiens
caggcccagca

SEQ ID NO: 1527980 - DNA, 16 bp, Homo sapiens
caggcccagcatgcag

SEQ ID NO: 1527981 - DNA, 14 bp, Homo sapiens
caggcccagcgcgg

SEQ ID NO: 1527982 - DNA, 18 bp, Homo sapiens
caggcccagcgcggccag

SEQ ID NO: 1527983 - DNA, 19 bp, Homo sapiens
caggcccatctcaggtgcc

SEQ ID NO: 1527984 - DNA, 20 bp, Homo sapiens
caggcccatctcaggtgcca

SEQ ID NO: 1527985 - DNA, 18 bp, Homo sapiens
caggccccaccggccagg

SEQ ID NO: 1527986 - DNA, 20 bp, Homo sapiens
caggccccaccggccaggcc

SEQ ID NO: 1527987 - DNA, 22 bp, Homo sapiens
caggccccaccggccaggccgc

SEQ ID NO: 1527988 - DNA, 16 bp, Homo sapiens
caggccccccgcagca

SEQ ID NO: 1527989 - DNA, 22 bp, Homo sapiens
caggccccccgcagcaccctgc

SEQ ID NO: 1527990 - DNA, 18 bp, Homo sapiens
caggccccgcttgtccag

SEQ ID NO: 1527991 - DNA, 22 bp, Homo sapiens
caggccccgcttgtccagcgcc

SEQ ID NO: 1527992 - DNA, 18 bp, Homo sapiens
caggccccgggcttccct

SEQ ID NO: 1527993 - DNA, 19 bp, Homo sapiens
caggccccgggcttccctt

SEQ ID NO: 1527994 - DNA, 18 bp, Homo sapiens
caggcccctgaggactgg

SEQ ID NO: 1527995 - DNA, 23 bp, Homo sapiens
caggcccgagatgtgacccacca

SEQ ID NO: 1527996 - DNA, 22 bp, Homo sapiens
caggcccgcaccccggcctcag

SEQ ID NO: 1527997 - DNA, 24 bp, Homo sapiens
caggcccgcaccccggcctcaggg

SEQ ID NO: 1527998 - DNA, 16 bp, Homo sapiens
caggcccggcagggcg

SEQ ID NO: 1527999 - DNA, 15 bp, Homo sapiens
caggcccggggctgg

SEQ ID NO: 1528000 - DNA, 20 bp, Homo sapiens
caggcccgtcggagctgcct

SEQ ID NO: 1528001 - DNA, 22 bp, Homo sapiens
caggcccgtcggagctgcctgc

SEQ ID NO: 1528002 - DNA, 16 bp, Homo sapiens
caggccctcctctccc

SEQ ID NO: 1528003 - DNA, 12 bp, Homo sapiens
caggccctgggt

SEQ ID NO: 1528004 - DNA, 13 bp, Homo sapiens
caggccctgggtc

SEQ ID NO: 1528005 - DNA, 14 bp, Homo sapiens
caggccctgggtct

SEQ ID NO: 1528006 - DNA, 14 bp, Homo sapiens
caggcccttggctg

SEQ ID NO: 1528007 - DNA, 13 bp, Homo sapiens
caggccctttggc

SEQ ID NO: 1528008 - DNA, 21 bp, Homo sapiens
caggccgcaccatttctgtca

SEQ ID NO: 1528009 - DNA, 18 bp, Homo sapiens
caggccgcagctcttgcc

SEQ ID NO: 1528010 - DNA, 13 bp, Homo sapiens
caggccgcgccca

SEQ ID NO: 1528011 - DNA, 16 bp, Homo sapiens
caggccgcgcccagca

SEQ ID NO: 1528012 - DNA, 14 bp, Homo sapiens
caggccggagccca

SEQ ID NO: 1528013 - DNA, 16 bp, Homo sapiens
caggccggagcccaga

SEQ ID NO: 1528014 - DNA, 18 bp, Homo sapiens
caggccgggcttgggccc

SEQ ID NO: 1528015 - DNA, 19 bp, Homo sapiens
caggccggtgtgggctgtg

SEQ ID NO: 1528016 - DNA, 22 bp, Homo sapiens
caggccggtgtgggctgtgtcg

SEQ ID NO: 1528017 - DNA, 18 bp, Homo sapiens
caggccgtcctcccgggc

SEQ ID NO: 1528018 - DNA, 18 bp, Homo sapiens
caggccgttccccttggc

SEQ ID NO: 1528019 - DNA, 19 bp, Homo sapiens
caggcctaatctcatacct

SEQ ID NO: 1528020 - DNA, 20 bp, Homo sapiens
caggcctccaacgcccctgt

SEQ ID NO: 1528021 - DNA, 24 bp, Homo sapiens
caggcctccaacgcccctgtggcc

SEQ ID NO: 1528022 - DNA, 14 bp, Homo sapiens
caggcctccagcct

SEQ ID NO: 1528023 - DNA, 12 bp, Homo sapiens
caggcctccctc

SEQ ID NO: 1528024 - DNA, 15 bp, Homo sapiens
caggcctccctctct

SEQ ID NO: 1528025 - DNA, 16 bp, Homo sapiens
caggcctccctctctc

SEQ ID NO: 1528026 - DNA, 23 bp, Homo sapiens
caggcctccctctctcttctgct

SEQ ID NO: 1528027 - DNA, 17 bp, Homo sapiens
caggcctccctgcagac

SEQ ID NO: 1528028 - DNA, 19 bp, Homo sapiens
caggcctccctgcagactc

SEQ ID NO: 1528029 - DNA, 13 bp, Homo sapiens
caggcctctccat

SEQ ID NO: 1528030 - DNA, 17 bp, Homo sapiens
caggcctctccatttgc

SEQ ID NO: 1528031 - DNA, 15 bp, Homo sapiens
caggcctctgcctgc

SEQ ID NO: 1528032 - DNA, 22 bp, Homo sapiens
caggcctctgcctgctggggat

SEQ ID NO: 1528033 - DNA, 15 bp, Homo sapiens
caggcctgaaagagg

SEQ ID NO: 1528034 - DNA, 22 bp, Homo sapiens
caggcctgaaagaggctgaggc

SEQ ID NO: 1528035 - DNA, 15 bp, Homo sapiens
caggcctgactctca

SEQ ID NO: 1528036 - DNA, 15 bp, Homo sapiens
caggcctgagaatga

SEQ ID NO: 1528037 - DNA, 22 bp, Homo sapiens
caggcctgagaatgagtgggaa

SEQ ID NO: 1528038 - DNA, 18 bp, Homo sapiens
caggcctgagatttcatc

SEQ ID NO: 1528039 - DNA, 21 bp, Homo sapiens
caggcctgagatttcatctgc

SEQ ID NO: 1528040 - DNA, 12 bp, Homo sapiens
caggcctgcagg

SEQ ID NO: 1528041 - DNA, 13 bp, Homo sapiens
caggcctgcctcc

SEQ ID NO: 1528042 - DNA, 14 bp, Homo sapiens
caggcctgcctgca

SEQ ID NO: 1528043 - DNA, 18 bp, Homo sapiens
caggcctgcgtgcgctgg

SEQ ID NO: 1528044 - DNA, 22 bp, Homo sapiens
caggcctgcgtgcgctggttcc

SEQ ID NO: 1528045 - DNA, 20 bp, Homo sapiens
caggcctggcaagtgggtga

SEQ ID NO: 1528046 - DNA, 14 bp, Homo sapiens
caggcctggcctct

SEQ ID NO: 1528047 - DNA, 17 bp, Homo sapiens
caggcctggcctctggg

SEQ ID NO: 1528048 - DNA, 18 bp, Homo sapiens
caggcctggcctctgggc

SEQ ID NO: 1528049 - DNA, 22 bp, Homo sapiens
caggcctggcctctgggcagtg

SEQ ID NO: 1528050 - DNA, 14 bp, Homo sapiens
caggcctgtatgag

SEQ ID NO: 1528051 - DNA, 12 bp, Homo sapiens
caggcctgtcca

SEQ ID NO: 1528052 - DNA, 21 bp, Homo sapiens
caggcctgtccaccctgccaa

SEQ ID NO: 1528053 - DNA, 22 bp, Homo sapiens
caggccttcatcctcctcccca

SEQ ID NO: 1528054 - DNA, 16 bp, Homo sapiens
caggcgatccacctgt

SEQ ID NO: 1528055 - DNA, 20 bp, Homo sapiens
caggcgcctataatcccagc

SEQ ID NO: 1528056 - DNA, 20 bp, Homo sapiens
catctgcattttcaccccac

SEQ ID NO: 1528057 - DNA, 21 bp, Homo sapiens
catctgcccaggggtgccccc

SEQ ID NO: 1528058 - DNA, 23 bp, Homo sapiens
catctgcccaggggtgccccctc

SEQ ID NO: 1528059 - DNA, 14 bp, Homo sapiens
catctgcccctccc

SEQ ID NO: 1528060 - DNA, 19 bp, Homo sapiens
catctgcccctcccccaac

SEQ ID NO: 1528061 - DNA, 18 bp, Homo sapiens
catctgccttaaaaccaa

SEQ ID NO: 1528062 - DNA, 12 bp, Homo sapiens
catctgctaata

SEQ ID NO: 1528063 - DNA, 14 bp, Homo sapiens
catctgctctcctt

SEQ ID NO: 1528064 - DNA, 14 bp, Homo sapiens
catctgctggtccg

SEQ ID NO: 1528065 - DNA, 14 bp, Homo sapiens
catctggaaagggg

SEQ ID NO: 1528066 - DNA, 21 bp, Homo sapiens
catctggagggttctaagtgg

SEQ ID NO: 1528067 - DNA, 18 bp, Homo sapiens
catctggatgtaaatcct

SEQ ID NO: 1528068 - DNA, 13 bp, Homo sapiens
catctggccctga

SEQ ID NO: 1528069 - DNA, 14 bp, Homo sapiens
catctggctctaat

SEQ ID NO: 1528070 - DNA, 17 bp, Homo sapiens
catctggctgtctagaa

SEQ ID NO: 1528071 - DNA, 21 bp, Homo sapiens
catctggctgtctagaatgtg

SEQ ID NO: 1528072 - DNA, 17 bp, Homo sapiens
catctggctttttctgc

SEQ ID NO: 1528073 - DNA, 21 bp, Homo sapiens
catctggctttttctgccact

SEQ ID NO: 1528074 - DNA, 22 bp, Homo sapiens
catctggctttttctgccactg

SEQ ID NO: 1528075 - DNA, 19 bp, Homo sapiens
catctgggagtcccctttt

SEQ ID NO: 1528076 - DNA, 23 bp, Homo sapiens
catctggtgtaggaagttttttc

SEQ ID NO: 1528077 - DNA, 22 bp, Homo sapiens
catctggttgaactctggtggc

SEQ ID NO: 1528078 - DNA, 19 bp, Homo sapiens
catctgtaagagcttgctc

SEQ ID NO: 1528079 - DNA, 23 bp, Homo sapiens
catctgtaagagcttgctccaga

SEQ ID NO: 1528080 - DNA, 18 bp, Homo sapiens
catctgtcttgccagcca

SEQ ID NO: 1528081 - DNA, 19 bp, Homo sapiens
catctgtcttgccagccag

SEQ ID NO: 1528082 - DNA, 20 bp, Homo sapiens
catctgtcttgccagccaga

SEQ ID NO: 1528083 - DNA, 16 bp, Homo sapiens
catctgtgactataaa

SEQ ID NO: 1528084 - DNA, 22 bp, Homo sapiens
catctgtgactataaagctgtt

SEQ ID NO: 1528085 - DNA, 14 bp, Homo sapiens
catctgtggagctg

SEQ ID NO: 1528086 - DNA, 19 bp, Homo sapiens
catctgtggagctgccaca

SEQ ID NO: 1528087 - DNA, 22 bp, Homo sapiens
catctgtggagctgccacagag

SEQ ID NO: 1528088 - DNA, 12 bp, Homo sapiens
catctgtgtatt

SEQ ID NO: 1528089 - DNA, 17 bp, Homo sapiens
catctgtgtgcagcaac

SEQ ID NO: 1528090 - DNA, 15 bp, Homo sapiens
catctgttagggcct

SEQ ID NO: 1528091 - DNA, 17 bp, Homo sapiens
catctgttatcctgcta

SEQ ID NO: 1528092 - DNA, 13 bp, Homo sapiens
catcttaaactaa

SEQ ID NO: 1528093 - DNA, 13 bp, Homo sapiens
catcttactgaag

SEQ ID NO: 1528094 - DNA, 23 bp, Homo sapiens
catcttagagcaaagagccagca

SEQ ID NO: 1528095 - DNA, 14 bp, Homo sapiens
catcttcaaagctt

SEQ ID NO: 1528096 - DNA, 13 bp, Homo sapiens
catcttcaatatg

SEQ ID NO: 1528097 - DNA, 16 bp, Homo sapiens
catcttcactgcaatt

SEQ ID NO: 1528098 - DNA, 11 bp, Homo sapiens
catcttcagga

SEQ ID NO: 1528099 - DNA, 13 bp, Homo sapiens
catcttccacctg

SEQ ID NO: 1528100 - DNA, 20 bp, Homo sapiens
catcttccacctgtgccctc

SEQ ID NO: 1528101 - DNA, 21 bp, Homo sapiens
catcttcccagcagggccact

SEQ ID NO: 1528102 - DNA, 13 bp, Homo sapiens
catcttcctgctg

SEQ ID NO: 1528103 - DNA, 14 bp, Homo sapiens
catcttcctgctgc

SEQ ID NO: 1528104 - DNA, 14 bp, Homo sapiens
catcttcctgtgtc

SEQ ID NO: 1528105 - DNA, 17 bp, Homo sapiens
catcttcctgtgtcctg

SEQ ID NO: 1528106 - DNA, 22 bp, Homo sapiens
catcttctccccgaggctgccc

SEQ ID NO: 1528107 - DNA, 13 bp, Homo sapiens
catcttctgcctt

SEQ ID NO: 1528108 - DNA, 12 bp, Homo sapiens
catcttctggaa

SEQ ID NO: 1528109 - DNA, 14 bp, Homo sapiens
catcttctggaata

SEQ ID NO: 1528110 - DNA, 14 bp, Homo sapiens
catcttctggcttg

SEQ ID NO: 1528111 - DNA, 15 bp, Homo sapiens
catcttcttccctta

SEQ ID NO: 1528112 - DNA, 17 bp, Homo sapiens
catccattaggccagca

SEQ ID NO: 1528113 - DNA, 17 bp, Homo sapiens
catccattcctcaggga

SEQ ID NO: 1528114 - DNA, 23 bp, Homo sapiens
catccatttcatctatttctgag

SEQ ID NO: 1528115 - DNA, 20 bp, Homo sapiens
catcccacccccgaccctgc

SEQ ID NO: 1528116 - DNA, 21 bp, Homo sapiens
catcccagacaggtccctccc

SEQ ID NO: 1528117 - DNA, 16 bp, Homo sapiens
catcccagaccagcca

SEQ ID NO: 1528118 - DNA, 16 bp, Homo sapiens
catcccagcctgtggt

SEQ ID NO: 1528119 - DNA, 12 bp, Homo sapiens
catcccatcatc

SEQ ID NO: 1528120 - DNA, 17 bp, Homo sapiens
catcccatgaacacact

SEQ ID NO: 1528121 - DNA, 13 bp, Homo sapiens
catcccattgccc

SEQ ID NO: 1528122 - DNA, 20 bp, Homo sapiens
catccccaactccatggggt

SEQ ID NO: 1528123 - DNA, 14 bp, Homo sapiens
catccccaccccac

SEQ ID NO: 1528124 - DNA, 16 bp, Homo sapiens
catccccacccttgga

SEQ ID NO: 1528125 - DNA, 14 bp, Homo sapiens
catccccagagccc

SEQ ID NO: 1528126 - DNA, 18 bp, Homo sapiens
catccccagagcccagct

SEQ ID NO: 1528127 - DNA, 23 bp, Homo sapiens
catccccagagcccagctcttgc

SEQ ID NO: 1528128 - DNA, 11 bp, Homo sapiens
catccccaggg

SEQ ID NO: 1528129 - DNA, 21 bp, Homo sapiens
catccccaggggtcccagcca

SEQ ID NO: 1528130 - DNA, 14 bp, Homo sapiens
catccccagtttat

SEQ ID NO: 1528131 - DNA, 14 bp, Homo sapiens
catcccccctgctg

SEQ ID NO: 1528132 - DNA, 20 bp, Homo sapiens
catcccccctgctgcccagt

SEQ ID NO: 1528133 - DNA, 12 bp, Homo sapiens
catccccctgcc

SEQ ID NO: 1528134 - DNA, 20 bp, Homo sapiens
catcccctcgtcctgtccca

SEQ ID NO: 1528135 - DNA, 18 bp, Homo sapiens
catcccgatacctcagcc

SEQ ID NO: 1528136 - DNA, 13 bp, Homo sapiens
catcccggcctct

SEQ ID NO: 1528137 - DNA, 16 bp, Homo sapiens
catcccggcctcttcc

SEQ ID NO: 1528138 - DNA, 21 bp, Homo sapiens
catcccggcctcttccaccca

SEQ ID NO: 1528139 - DNA, 16 bp, Homo sapiens
catcccgtgttctcct

SEQ ID NO: 1528140 - DNA, 17 bp, Homo sapiens
catcccgtgttctcctt

SEQ ID NO: 1528141 - DNA, 14 bp, Homo sapiens
catccctaccccct

SEQ ID NO: 1528142 - DNA, 20 bp, Homo sapiens
catccctcacccatcctaga

SEQ ID NO: 1528143 - DNA, 20 bp, Homo sapiens
catccctccattcatccttc

SEQ ID NO: 1528144 - DNA, 14 bp, Homo sapiens
catccctccccagt

SEQ ID NO: 1528145 - DNA, 23 bp, Homo sapiens
catccctccctcccgtccttccc

SEQ ID NO: 1528146 - DNA, 16 bp, Homo sapiens
catccctgactggcca

SEQ ID NO: 1528147 - DNA, 20 bp, Homo sapiens
catccctgactggccaaacc

SEQ ID NO: 1528148 - DNA, 24 bp, Homo sapiens
catccctgagcaggaaagtttacc

SEQ ID NO: 1528149 - DNA, 17 bp, Homo sapiens
catccctgaggagccag

SEQ ID NO: 1528150 - DNA, 13 bp, Homo sapiens
catccctgcagag

SEQ ID NO: 1528151 - DNA, 20 bp, Homo sapiens
catccctggagcaggagccc

SEQ ID NO: 1528152 - DNA, 22 bp, Homo sapiens
catcccttcctggaaacagcat

SEQ ID NO: 1528153 - DNA, 16 bp, Homo sapiens
catccctttttttaca

SEQ ID NO: 1528154 - DNA, 21 bp, Homo sapiens
catccctttttttacatttca

SEQ ID NO: 1528155 - DNA, 13 bp, Homo sapiens
catccgaggcagg

SEQ ID NO: 1528156 - DNA, 14 bp, Homo sapiens
catccgaggcaggg

SEQ ID NO: 1528157 - DNA, 22 bp, Homo sapiens
catccgaggcagggtcaggaga

SEQ ID NO: 1528158 - DNA, 15 bp, Homo sapiens
catccgcctgtgggc

SEQ ID NO: 1528159 - DNA, 15 bp, Homo sapiens
catccggcagcctgg

SEQ ID NO: 1528160 - DNA, 11 bp, Homo sapiens
aacgaatgaag

SEQ ID NO: 1528161 - DNA, 19 bp, Homo sapiens
aacgaatggtctttgctcc

SEQ ID NO: 1528162 - DNA, 14 bp, Homo sapiens
aacgacaaaatgaa

SEQ ID NO: 1528163 - DNA, 23 bp, Homo sapiens
aacgacaaagccaaactctgcca

SEQ ID NO: 1528164 - DNA, 13 bp, Homo sapiens
aacgaccaaactc

SEQ ID NO: 1528165 - DNA, 15 bp, Homo sapiens
aacgagcagcccagg

SEQ ID NO: 1528166 - DNA, 19 bp, Homo sapiens
aacgagggcaacagggagc

SEQ ID NO: 1528167 - DNA, 22 bp, Homo sapiens
aacgagggctgatggaggaaaa

SEQ ID NO: 1528168 - DNA, 12 bp, Homo sapiens
aacgatttagaa

SEQ ID NO: 1528169 - DNA, 11 bp, Homo sapiens
aacgcagccct

SEQ ID NO: 1528170 - DNA, 12 bp, Homo sapiens
aacgcagccctg

SEQ ID NO: 1528171 - DNA, 13 bp, Homo sapiens
aacgccagtctcc

SEQ ID NO: 1528172 - DNA, 23 bp, Homo sapiens
aacgccagtctcccaggccccct

SEQ ID NO: 1528173 - DNA, 13 bp, Homo sapiens
aacgcccctccaa

SEQ ID NO: 1528174 - DNA, 22 bp, Homo sapiens
aacgcccctccaaacctccagc

SEQ ID NO: 1528175 - DNA, 12 bp, Homo sapiens
aacgcccctgtg

SEQ ID NO: 1528176 - DNA, 15 bp, Homo sapiens
aacgcccctgtggcc

SEQ ID NO: 1528177 - DNA, 16 bp, Homo sapiens
aacgcccctgtggcca

SEQ ID NO: 1528178 - DNA, 17 bp, Homo sapiens
aacgcccctgtggccaa

SEQ ID NO: 1528179 - DNA, 22 bp, Homo sapiens
aacgccgccttggccttgcagc

SEQ ID NO: 1528180 - DNA, 16 bp, Homo sapiens
aacgcgtgtgtacacg

SEQ ID NO: 1528181 - DNA, 17 bp, Homo sapiens
aacgctaaagagccctt

SEQ ID NO: 1528182 - DNA, 21 bp, Homo sapiens
aacgctaaagagcccttgcct

SEQ ID NO: 1528183 - DNA, 22 bp, Homo sapiens
aacgctaaagagcccttgcctc

SEQ ID NO: 1528184 - DNA, 15 bp, Homo sapiens
aacgctacctctctg

SEQ ID NO: 1528185 - DNA, 18 bp, Homo sapiens
aacgctgaactgacaatg

SEQ ID NO: 1528186 - DNA, 23 bp, Homo sapiens
aacgcttgtagaactcactctgg

SEQ ID NO: 1528187 - DNA, 21 bp, Homo sapiens
aacggaccaaagcaagaccct

SEQ ID NO: 1528188 - DNA, 16 bp, Homo sapiens
aacggaggcagatgga

SEQ ID NO: 1528189 - DNA, 17 bp, Homo sapiens
aacgggaacatgccccc

SEQ ID NO: 1528190 - DNA, 21 bp, Homo sapiens
aacgggaccccctggccctgc

SEQ ID NO: 1528191 - DNA, 19 bp, Homo sapiens
aacggtttaattctgtctt

SEQ ID NO: 1528192 - DNA, 20 bp, Homo sapiens
aacgtaactctttctatgcc

SEQ ID NO: 1528193 - DNA, 13 bp, Homo sapiens
aacgtagcctggg

SEQ ID NO: 1528194 - DNA, 19 bp, Homo sapiens
aacgtccactagcttactg

SEQ ID NO: 1528195 - DNA, 18 bp, Homo sapiens
aacgtcccacactttgaa

SEQ ID NO: 1528196 - DNA, 11 bp, Homo sapiens
aacgtccccag

SEQ ID NO: 1528197 - DNA, 20 bp, Homo sapiens
aacgtgagagaaagagagaa

SEQ ID NO: 1528198 - DNA, 23 bp, Homo sapiens
aacgtgagagaaagagagaagcc

SEQ ID NO: 1528199 - DNA, 20 bp, Homo sapiens
aacgtgatgatcagctgttt

SEQ ID NO: 1528200 - DNA, 14 bp, Homo sapiens
aacgtgcaaagcca

SEQ ID NO: 1528201 - DNA, 14 bp, Homo sapiens
aacgtgcttctttg

SEQ ID NO: 1528202 - DNA, 16 bp, Homo sapiens
aacgtgcttctttgta

SEQ ID NO: 1528203 - DNA, 17 bp, Homo sapiens
aacgtgcttctttgtaa

SEQ ID NO: 1528204 - DNA, 17 bp, Homo sapiens
aacgtgtaaccagttat

SEQ ID NO: 1528205 - DNA, 17 bp, Homo sapiens
aacgtgtatagtgccta

SEQ ID NO: 1528206 - DNA, 13 bp, Homo sapiens
aacgttttcttct

SEQ ID NO: 1528207 - DNA, 19 bp, Homo sapiens
aacgttttcttctttccct

SEQ ID NO: 1528208 - DNA, 20 bp, Homo sapiens
aacgttttcttctttccctg

SEQ ID NO: 1528209 - DNA, 17 bp, Homo sapiens
aactaaaattcaacaaa

SEQ ID NO: 1528210 - DNA, 20 bp, Homo sapiens
aactaaaattcaacaaatga

SEQ ID NO: 1528211 - DNA, 13 bp, Homo sapiens
aactaaatgataa

SEQ ID NO: 1528212 - DNA, 14 bp, Homo sapiens
aactaaattttaaa

SEQ ID NO: 1528213 - DNA, 11 bp, Homo sapiens
aactaacatgt

SEQ ID NO: 1528214 - DNA, 15 bp, Homo sapiens
aactaacatgtcctg

SEQ ID NO: 1528215 - DNA, 18 bp, Homo sapiens
aactaacctggtatttta

SEQ ID NO: 1528216 - DNA, 12 bp, Homo sapiens
aactaagagaaa

SEQ ID NO: 1528217 - DNA, 23 bp, Homo sapiens
aactaagaggcccagccctcaga

SEQ ID NO: 1528218 - DNA, 16 bp, Homo sapiens
aactaagctctttgag

SEQ ID NO: 1528219 - DNA, 17 bp, Homo sapiens
aactaagctctttgaga

SEQ ID NO: 1528220 - DNA, 14 bp, Homo sapiens
aactaataaaagca

SEQ ID NO: 1528221 - DNA, 12 bp, Homo sapiens
aactaatgcctt

SEQ ID NO: 1528222 - DNA, 15 bp, Homo sapiens
aactaatgccttact

SEQ ID NO: 1528223 - DNA, 18 bp, Homo sapiens
aactaatgtttgaacaaa

SEQ ID NO: 1528224 - DNA, 20 bp, Homo sapiens
aactaatgtttgaacaaagc

SEQ ID NO: 1528225 - DNA, 19 bp, Homo sapiens
aactaatttgaatgtggtt

SEQ ID NO: 1528226 - DNA, 14 bp, Homo sapiens
aactaatttttgta

SEQ ID NO: 1528227 - DNA, 18 bp, Homo sapiens
aactacaaagctttgcta

SEQ ID NO: 1528228 - DNA, 13 bp, Homo sapiens
aactaccaaatta

SEQ ID NO: 1528229 - DNA, 13 bp, Homo sapiens
aactacctctgga

SEQ ID NO: 1528230 - DNA, 21 bp, Homo sapiens
aactactaagaataaataaag

SEQ ID NO: 1528231 - DNA, 17 bp, Homo sapiens
aactactaatagaataa

SEQ ID NO: 1528232 - DNA, 18 bp, Homo sapiens
aactactgaataatgcta

SEQ ID NO: 1528233 - DNA, 15 bp, Homo sapiens
aactactgtactttg

SEQ ID NO: 1528234 - DNA, 15 bp, Homo sapiens
aactactttataact

SEQ ID NO: 1528235 - DNA, 17 bp, Homo sapiens
aactactttttatactc

SEQ ID NO: 1528236 - DNA, 16 bp, Homo sapiens
aactagaaaattctaa

SEQ ID NO: 1528237 - DNA, 12 bp, Homo sapiens
aactagaattag

SEQ ID NO: 1528238 - DNA, 20 bp, Homo sapiens
aactagacaccaaagttcta

SEQ ID NO: 1528239 - DNA, 13 bp, Homo sapiens
aactagatacaga

SEQ ID NO: 1528240 - DNA, 16 bp, Homo sapiens
aactagatacagaata

SEQ ID NO: 1528241 - DNA, 20 bp, Homo sapiens
aactagatcaaggagcccag

SEQ ID NO: 1528242 - DNA, 23 bp, Homo sapiens
aactagatcaaggagcccagaaa

SEQ ID NO: 1528243 - DNA, 20 bp, Homo sapiens
aactagcaatgcctgtgaaa

SEQ ID NO: 1528244 - DNA, 21 bp, Homo sapiens
aactagccaaaccaggaccct

SEQ ID NO: 1528245 - DNA, 18 bp, Homo sapiens
aactagccagacaaaatt

SEQ ID NO: 1528246 - DNA, 15 bp, Homo sapiens
aactaggctgagcaa

SEQ ID NO: 1528247 - DNA, 17 bp, Homo sapiens
aactagtaataccaaag

SEQ ID NO: 1528248 - DNA, 13 bp, Homo sapiens
aactagtttccag

SEQ ID NO: 1528249 - DNA, 14 bp, Homo sapiens
aactagtttccagt

SEQ ID NO: 1528250 - DNA, 13 bp, Homo sapiens
aactataaactta

SEQ ID NO: 1528251 - DNA, 23 bp, Homo sapiens
aactataaacttaagggcaagga

SEQ ID NO: 1528252 - DNA, 20 bp, Homo sapiens
aactatacttgatagtttgg

SEQ ID NO: 1528253 - DNA, 20 bp, Homo sapiens
aactatattcatttccactc

SEQ ID NO: 1528254 - DNA, 19 bp, Homo sapiens
aactatcctgattccaaat

SEQ ID NO: 1528255 - DNA, 18 bp, Homo sapiens
aactatgatatggtaaaa

SEQ ID NO: 1528256 - DNA, 17 bp, Homo sapiens
aactatgcctatgtagt

SEQ ID NO: 1528257 - DNA, 22 bp, Homo sapiens
aactatggttcccaataaaagt

SEQ ID NO: 1528258 - DNA, 23 bp, Homo sapiens
aactatggttcccaataaaagtg

SEQ ID NO: 1528259 - DNA, 21 bp, Homo sapiens
aactatgttcctaacaaaatg

SEQ ID NO: 1528260 - DNA, 20 bp, Homo sapiens
aactattagagtatttccct

SEQ ID NO: 1528261 - DNA, 12 bp, Homo sapiens
aactatttactt

SEQ ID NO: 1528262 - DNA, 13 bp, Homo sapiens
aactatttatctg

SEQ ID NO: 1528263 - DNA, 16 bp, Homo sapiens
aactatttctacacag

SEQ ID NO: 1528264 - DNA, 17 bp, Homo sapiens
aactatttcttatatat

SEQ ID NO: 1528265 - DNA, 20 bp, Homo sapiens
aactatttcttatatatgtg

SEQ ID NO: 1528266 - DNA, 16 bp, Homo sapiens
aactattttaaataaa

SEQ ID NO: 1528267 - DNA, 18 bp, Homo sapiens
aactattttaaataaaat

SEQ ID NO: 1528268 - DNA, 17 bp, Homo sapiens
aactattttcaaagact

SEQ ID NO: 1528269 - DNA, 18 bp, Homo sapiens
aactattttcaaagactt

SEQ ID NO: 1528270 - DNA, 14 bp, Homo sapiens
aactatttttgtat

SEQ ID NO: 1528271 - DNA, 16 bp, Homo sapiens
aactatttttgtatag

SEQ ID NO: 1528272 - DNA, 23 bp, Homo sapiens
aactcaaatggggccagatccag

SEQ ID NO: 1528273 - DNA, 12 bp, Homo sapiens
aactcaagctgc

SEQ ID NO: 1528274 - DNA, 13 bp, Homo sapiens
aactcacagagct

SEQ ID NO: 1528275 - DNA, 15 bp, Homo sapiens
aactcacagagcttt

SEQ ID NO: 1528276 - DNA, 14 bp, Homo sapiens
aactcacagcttct

SEQ ID NO: 1528277 - DNA, 18 bp, Homo sapiens
aaccccagaggcagaggt

SEQ ID NO: 1528278 - DNA, 12 bp, Homo sapiens
aaccccagctcc

SEQ ID NO: 1528279 - DNA, 17 bp, Homo sapiens
aaccccatgtcctcagc

SEQ ID NO: 1528280 - DNA, 18 bp, Homo sapiens
aaccccatgtcctcagca

SEQ ID NO: 1528281 - DNA, 11 bp, Homo sapiens
aacccccaccc

SEQ ID NO: 1528282 - DNA, 13 bp, Homo sapiens
aacccccacccca

SEQ ID NO: 1528283 - DNA, 11 bp, Homo sapiens
aaccccccagc

SEQ ID NO: 1528284 - DNA, 20 bp, Homo sapiens
aacccccctcctgctcctcc

SEQ ID NO: 1528285 - DNA, 23 bp, Homo sapiens
aacccccctcctgctcctccctg

SEQ ID NO: 1528286 - DNA, 20 bp, Homo sapiens
aacccccgccacctcagggc

SEQ ID NO: 1528287 - DNA, 20 bp, Homo sapiens
aaccccctccctgtcccagg

SEQ ID NO: 1528288 - DNA, 20 bp, Homo sapiens
aaccccgcggtgctctggcg

SEQ ID NO: 1528289 - DNA, 14 bp, Homo sapiens
aacccctctcttag

SEQ ID NO: 1528290 - DNA, 13 bp, Homo sapiens
aacccctggccag

SEQ ID NO: 1528291 - DNA, 13 bp, Homo sapiens
aacccctgtaccc

SEQ ID NO: 1528292 - DNA, 17 bp, Homo sapiens
aacccctgtacccagct

SEQ ID NO: 1528293 - DNA, 15 bp, Homo sapiens
aacccgaggcccgca

SEQ ID NO: 1528294 - DNA, 16 bp, Homo sapiens
aacccgaggcccgcat

SEQ ID NO: 1528295 - DNA, 16 bp, Homo sapiens
aacccgggggacagag

SEQ ID NO: 1528296 - DNA, 18 bp, Homo sapiens
aacccggtgctccctctg

SEQ ID NO: 1528297 - DNA, 22 bp, Homo sapiens
aaccctaatctttcacttgaaa

SEQ ID NO: 1528298 - DNA, 20 bp, Homo sapiens
aaccctactttgcttccgcc

SEQ ID NO: 1528299 - DNA, 21 bp, Homo sapiens
aaccctatactgtagtattct

SEQ ID NO: 1528300 - DNA, 15 bp, Homo sapiens
aaccctatctcctga

SEQ ID NO: 1528301 - DNA, 16 bp, Homo sapiens
aaccctatctcctgac

SEQ ID NO: 1528302 - DNA, 19 bp, Homo sapiens
aaccctcagagccacccct

SEQ ID NO: 1528303 - DNA, 15 bp, Homo sapiens
aaccctcagccttga

SEQ ID NO: 1528304 - DNA, 16 bp, Homo sapiens
aaccctcagccttgaa

SEQ ID NO: 1528305 - DNA, 11 bp, Homo sapiens
aaccctcctgg

SEQ ID NO: 1528306 - DNA, 23 bp, Homo sapiens
aaccctcctgggaaggccacctc

SEQ ID NO: 1528307 - DNA, 17 bp, Homo sapiens
aaccctctcctgtctgc

SEQ ID NO: 1528308 - DNA, 22 bp, Homo sapiens
aaccctgagcagggtccacagc

SEQ ID NO: 1528309 - DNA, 14 bp, Homo sapiens
aaccctgctgaaca

SEQ ID NO: 1528310 - DNA, 20 bp, Homo sapiens
aaccctgctgaacacagtgt

SEQ ID NO: 1528311 - DNA, 13 bp, Homo sapiens
aaccctgcttctg

SEQ ID NO: 1528312 - DNA, 20 bp, Homo sapiens
aaccctgcttctgctgccct

SEQ ID NO: 1528313 - DNA, 22 bp, Homo sapiens
aaccctgcttctgctgccctga

SEQ ID NO: 1528314 - DNA, 16 bp, Homo sapiens
aaccctggggaaggag

SEQ ID NO: 1528315 - DNA, 12 bp, Homo sapiens
aaccctgtgctg

SEQ ID NO: 1528316 - DNA, 21 bp, Homo sapiens
aaccctgtgctggtgtcctga

SEQ ID NO: 1528317 - DNA, 16 bp, Homo sapiens
aaccctgttttatact

SEQ ID NO: 1528318 - DNA, 21 bp, Homo sapiens
aacccttaccccttagcctcc

SEQ ID NO: 1528319 - DNA, 22 bp, Homo sapiens
aacccttcatcttcctgtgtcc

SEQ ID NO: 1528320 - DNA, 18 bp, Homo sapiens
aaccctttaaatgtaaaa

SEQ ID NO: 1528321 - DNA, 19 bp, Homo sapiens
aaccctttaaatgtaaaat

SEQ ID NO: 1528322 - DNA, 19 bp, Homo sapiens
aaccgccctgcagcatccc

SEQ ID NO: 1528323 - DNA, 18 bp, Homo sapiens
aaccgtggtatgtctgcc

SEQ ID NO: 1528324 - DNA, 17 bp, Homo sapiens
aaccgtgtccagcacag

SEQ ID NO: 1528325 - DNA, 17 bp, Homo sapiens
aacctaaaactctttcg

SEQ ID NO: 1528326 - DNA, 15 bp, Homo sapiens
aacctaacccctttc

SEQ ID NO: 1528327 - DNA, 22 bp, Homo sapiens
aacctaagtccttccacctgcc

SEQ ID NO: 1528328 - DNA, 18 bp, Homo sapiens
aacctacacactgtcatg

SEQ ID NO: 1528329 - DNA, 18 bp, Homo sapiens
aacctacctcccacactc

SEQ ID NO: 1528330 - DNA, 19 bp, Homo sapiens
aacctactgcccacatttg

SEQ ID NO: 1528331 - DNA, 20 bp, Homo sapiens
aacctactgcccacatttgg

SEQ ID NO: 1528332 - DNA, 14 bp, Homo sapiens
aacctactgtctaa

SEQ ID NO: 1528333 - DNA, 13 bp, Homo sapiens
aacctagaatgtc

SEQ ID NO: 1528334 - DNA, 15 bp, Homo sapiens
aacctagaatgtcag

SEQ ID NO: 1528335 - DNA, 20 bp, Homo sapiens
aacctagatgtttaacaaat

SEQ ID NO: 1528336 - DNA, 23 bp, Homo sapiens
aacctagatgtttaacaaatcta

SEQ ID NO: 1528337 - DNA, 21 bp, Homo sapiens
aacctagtactctctgctcta

SEQ ID NO: 1528338 - DNA, 20 bp, Homo sapiens
aacctagttaaagaaaggaa

SEQ ID NO: 1528339 - DNA, 21 bp, Homo sapiens
aacctattttcatttgtacaa

SEQ ID NO: 1528340 - DNA, 15 bp, Homo sapiens
aacctcaaagtgact

SEQ ID NO: 1528341 - DNA, 18 bp, Homo sapiens
aacctcaatgccctgcca

SEQ ID NO: 1528342 - DNA, 16 bp, Homo sapiens
aacctcacatttgtga

SEQ ID NO: 1528343 - DNA, 18 bp, Homo sapiens
aacctcagattcttcatt

SEQ ID NO: 1528344 - DNA, 11 bp, Homo sapiens
aacctcagcct

SEQ ID NO: 1528345 - DNA, 14 bp, Homo sapiens
aacctcagcctggc

SEQ ID NO: 1528346 - DNA, 16 bp, Homo sapiens
aacctcagcctggcca

SEQ ID NO: 1528347 - DNA, 18 bp, Homo sapiens
aacctcagggctcccagg

SEQ ID NO: 1528348 - DNA, 19 bp, Homo sapiens
aacctcatgacagccagag

SEQ ID NO: 1528349 - DNA, 18 bp, Homo sapiens
aacctccagcctccctgt

SEQ ID NO: 1528350 - DNA, 17 bp, Homo sapiens
aacctcccatcccaccc

SEQ ID NO: 1528351 - DNA, 13 bp, Homo sapiens
aacctcctgctct

SEQ ID NO: 1528352 - DNA, 15 bp, Homo sapiens
aacctcctgctctgg

SEQ ID NO: 1528353 - DNA, 16 bp, Homo sapiens
aacctctcgccatgat

SEQ ID NO: 1528354 - DNA, 22 bp, Homo sapiens
aacctctcgccatgatcagaca

SEQ ID NO: 1528355 - DNA, 21 bp, Homo sapiens
aacctctcgcttcctcagcct

SEQ ID NO: 1528356 - DNA, 12 bp, Homo sapiens
aacctctgcctt

SEQ ID NO: 1528357 - DNA, 11 bp, Homo sapiens
aacctcttccc

SEQ ID NO: 1528358 - DNA, 14 bp, Homo sapiens
aacctcttccccag

SEQ ID NO: 1528359 - DNA, 16 bp, Homo sapiens
aacctcttttctgcat

SEQ ID NO: 1528360 - DNA, 20 bp, Homo sapiens
aacctgaaggtcccctggca

SEQ ID NO: 1528361 - DNA, 13 bp, Homo sapiens
aacctgcacacag

SEQ ID NO: 1528362 - DNA, 19 bp, Homo sapiens
aacctgcacacaggacagc

SEQ ID NO: 1528363 - DNA, 18 bp, Homo sapiens
aacctgcctaaattaaat

SEQ ID NO: 1528364 - DNA, 15 bp, Homo sapiens
aacctggaaatgatg

SEQ ID NO: 1528365 - DNA, 17 bp, Homo sapiens
aacctggaaatgatgtt

SEQ ID NO: 1528366 - DNA, 15 bp, Homo sapiens
aacctggacttcctg

SEQ ID NO: 1528367 - DNA, 14 bp, Homo sapiens
aacctggagatatt

SEQ ID NO: 1528368 - DNA, 21 bp, Homo sapiens
aacctgggaaagagatttaaa

SEQ ID NO: 1528369 - DNA, 12 bp, Homo sapiens
aacctggggggc

SEQ ID NO: 1528370 - DNA, 17 bp, Homo sapiens
aacctggtgtgtttctt

SEQ ID NO: 1528371 - DNA, 15 bp, Homo sapiens
aacctgtacttcaag

SEQ ID NO: 1528372 - DNA, 15 bp, Homo sapiens
aacctgtcctaagga

SEQ ID NO: 1528373 - DNA, 16 bp, Homo sapiens
aacctgttacactggg

SEQ ID NO: 1528374 - DNA, 21 bp, Homo sapiens
aacctgttacctactttgact

SEQ ID NO: 1528375 - DNA, 23 bp, Homo sapiens
aacctgttcttagagtgtagctg

SEQ ID NO: 1528376 - DNA, 19 bp, Homo sapiens
aacctgtttaaatatttca

SEQ ID NO: 1528377 - DNA, 13 bp, Homo sapiens
aaccttaagacct

SEQ ID NO: 1528378 - DNA, 16 bp, Homo sapiens
aaccttattgtacctc

SEQ ID NO: 1528379 - DNA, 13 bp, Homo sapiens
aaccttccaccca

SEQ ID NO: 1528380 - DNA, 17 bp, Homo sapiens
aaccttccatctcgcca

SEQ ID NO: 1528381 - DNA, 14 bp, Homo sapiens
aaccttccttccct

SEQ ID NO: 1528382 - DNA, 15 bp, Homo sapiens
aaccttccttccctg

SEQ ID NO: 1528383 - DNA, 17 bp, Homo sapiens
aaccttccttccctggc

SEQ ID NO: 1528384 - DNA, 19 bp, Homo sapiens
aaccttccttcctgcttga

SEQ ID NO: 1528385 - DNA, 15 bp, Homo sapiens
aaccttcgtcctttt

SEQ ID NO: 1528386 - DNA, 14 bp, Homo sapiens
aaccttgaatgctg

SEQ ID NO: 1528387 - DNA, 15 bp, Homo sapiens
aaccttggaccactc

SEQ ID NO: 1528388 - DNA, 20 bp, Homo sapiens
aaccttgtaaaaaaagcaaa

SEQ ID NO: 1528389 - DNA, 21 bp, Homo sapiens
aaccttgtaaaaaaagcaaaa

SEQ ID NO: 1528390 - DNA, 12 bp, Homo sapiens
aacctttctgtg

SEQ ID NO: 1528391 - DNA, 11 bp, Homo sapiens
aacctttgcta

SEQ ID NO: 1528392 - DNA, 14 bp, Homo sapiens
aacctttttcttga

SEQ ID NO: 1528393 - DNA, 14 bp, Homo sapiens
aacgaaacccactc

SEQ ID NO: 1528394 - DNA, 10 bp, Homo sapiens
catcaactga

SEQ ID NO: 1528395 - DNA, 14 bp, Homo sapiens
catcaactgaatga

SEQ ID NO: 1528396 - DNA, 14 bp, Homo sapiens
catcaacttaaaag

SEQ ID NO: 1528397 - DNA, 17 bp, Homo sapiens
catcaagaagggctgca

SEQ ID NO: 1528398 - DNA, 19 bp, Homo sapiens
catcaagcacttcccagga

SEQ ID NO: 1528399 - DNA, 20 bp, Homo sapiens
catcaagcaggaattatgtc

SEQ ID NO: 1528400 - DNA, 20 bp, Homo sapiens
catcaatatccctcttgtaa

SEQ ID NO: 1528401 - DNA, 24 bp, Homo sapiens
catcaatatccctcttgtaagtca

SEQ ID NO: 1528402 - DNA, 19 bp, Homo sapiens
catcaatcaaataagtatt

SEQ ID NO: 1528403 - DNA, 21 bp, Homo sapiens
catcaatcctggtaaccaaat

SEQ ID NO: 1528404 - DNA, 14 bp, Homo sapiens
catcacacttatat

SEQ ID NO: 1528405 - DNA, 20 bp, Homo sapiens
catcacacttatattttatg

SEQ ID NO: 1528406 - DNA, 22 bp, Homo sapiens
catcacaggacacggggcagtg

SEQ ID NO: 1528407 - DNA, 14 bp, Homo sapiens
catcacagggtggg

SEQ ID NO: 1528408 - DNA, 19 bp, Homo sapiens
catcacagggttgggccca

SEQ ID NO: 1528409 - DNA, 19 bp, Homo sapiens
catcaccaccgcctctggc

SEQ ID NO: 1528410 - DNA, 13 bp, Homo sapiens
catcacccaagcc

SEQ ID NO: 1528411 - DNA, 14 bp, Homo sapiens
catcacctatttaa

SEQ ID NO: 1528412 - DNA, 18 bp, Homo sapiens
catcacctcaggccaggt

SEQ ID NO: 1528413 - DNA, 20 bp, Homo sapiens
catcacctctttgcccccga

SEQ ID NO: 1528414 - DNA, 14 bp, Homo sapiens
catcacgcctgtgc

SEQ ID NO: 1528415 - DNA, 19 bp, Homo sapiens
catcacgttagctgtccca

SEQ ID NO: 1528416 - DNA, 17 bp, Homo sapiens
catcactagaagaaaag

SEQ ID NO: 1528417 - DNA, 23 bp, Homo sapiens
catcactagaagaaaagcccatt

SEQ ID NO: 1528418 - DNA, 15 bp, Homo sapiens
catcactagtgacaa

SEQ ID NO: 1528419 - DNA, 14 bp, Homo sapiens
catcactccctgga

SEQ ID NO: 1528420 - DNA, 18 bp, Homo sapiens
catcactggactgcatgg

SEQ ID NO: 1528421 - DNA, 13 bp, Homo sapiens
catcactgtaaag

SEQ ID NO: 1528422 - DNA, 15 bp, Homo sapiens
catcactgtaaagac

SEQ ID NO: 1528423 - DNA, 18 bp, Homo sapiens
catcactgtaaagacaaa

SEQ ID NO: 1528424 - DNA, 21 bp, Homo sapiens
catcactgtaaagacaaataa

SEQ ID NO: 1528425 - DNA, 12 bp, Homo sapiens
catcactgtatc

SEQ ID NO: 1528426 - DNA, 14 bp, Homo sapiens
catcacttgtacaa

SEQ ID NO: 1528427 - DNA, 15 bp, Homo sapiens
catcagaaagcttta

SEQ ID NO: 1528428 - DNA, 22 bp, Homo sapiens
catcagaaagctttattttgag

SEQ ID NO: 1528429 - DNA, 11 bp, Homo sapiens
catcagaaagg

SEQ ID NO: 1528430 - DNA, 20 bp, Homo sapiens
catcagacctgtcttccaag

SEQ ID NO: 1528431 - DNA, 18 bp, Homo sapiens
catcagactctagaaaaa

SEQ ID NO: 1528432 - DNA, 11 bp, Homo sapiens
catcagatgcc

SEQ ID NO: 1528433 - DNA, 23 bp, Homo sapiens
catcagcaaatgtgtacgtgcat

SEQ ID NO: 1528434 - DNA, 12 bp, Homo sapiens
catcagcctgct

SEQ ID NO: 1528435 - DNA, 15 bp, Homo sapiens
catacctggccctgt

SEQ ID NO: 1528436 - DNA, 14 bp, Homo sapiens
cataccttccttcc

SEQ ID NO: 1528437 - DNA, 16 bp, Homo sapiens
cataccttccttccct

SEQ ID NO: 1528438 - DNA, 23 bp, Homo sapiens
cataccttccttccctgggctgt

SEQ ID NO: 1528439 - DNA, 18 bp, Homo sapiens
cataccttttctcttttc

SEQ ID NO: 1528440 - DNA, 16 bp, Homo sapiens
catacgaaacacaaac

SEQ ID NO: 1528441 - DNA, 14 bp, Homo sapiens
catacgtgcacagg

SEQ ID NO: 1528442 - DNA, 16 bp, Homo sapiens
catacgtgtgcatgtg

SEQ ID NO: 1528443 - DNA, 17 bp, Homo sapiens
catactacctagaagta

SEQ ID NO: 1528444 - DNA, 19 bp, Homo sapiens
catactacctagaagtaag

SEQ ID NO: 1528445 - DNA, 13 bp, Homo sapiens
catactaggtgcc

SEQ ID NO: 1528446 - DNA, 14 bp, Homo sapiens
catactaggtgcct

SEQ ID NO: 1528447 - DNA, 16 bp, Homo sapiens
catactaggtgccttt

SEQ ID NO: 1528448 - DNA, 14 bp, Homo sapiens
catactcaaggtga

SEQ ID NO: 1528449 - DNA, 19 bp, Homo sapiens
catactccttgcttcctga

SEQ ID NO: 1528450 - DNA, 11 bp, Homo sapiens
catactctgct

SEQ ID NO: 1528451 - DNA, 13 bp, Homo sapiens
catactctgtgta

SEQ ID NO: 1528452 - DNA, 19 bp, Homo sapiens
catactctgtgtaatctct

SEQ ID NO: 1528453 - DNA, 22 bp, Homo sapiens
catacttaaaatatctctaaaa

SEQ ID NO: 1528454 - DNA, 15 bp, Homo sapiens
catacttcctggatt

SEQ ID NO: 1528455 - DNA, 20 bp, Homo sapiens
catacttcctggattttctt

SEQ ID NO: 1528456 - DNA, 16 bp, Homo sapiens
catacttctctcagat

SEQ ID NO: 1528457 - DNA, 18 bp, Homo sapiens
catacttgaagggccaga

SEQ ID NO: 1528458 - DNA, 21 bp, Homo sapiens
catacttgaagggccagagcc

SEQ ID NO: 1528459 - DNA, 17 bp, Homo sapiens
catactttgacaaggaa

SEQ ID NO: 1528460 - DNA, 18 bp, Homo sapiens
catactttgacaaggaaa

SEQ ID NO: 1528461 - DNA, 19 bp, Homo sapiens
catactttgacaaggaaaa

SEQ ID NO: 1528462 - DNA, 17 bp, Homo sapiens
catactttgtattttga

SEQ ID NO: 1528463 - DNA, 12 bp, Homo sapiens
catactttgtct

SEQ ID NO: 1528464 - DNA, 16 bp, Homo sapiens
catactttttaaatgt

SEQ ID NO: 1528465 - DNA, 13 bp, Homo sapiens
catagaaaaatgt

SEQ ID NO: 1528466 - DNA, 17 bp, Homo sapiens
catagaaacatgacact

SEQ ID NO: 1528467 - DNA, 18 bp, Homo sapiens
catagaaaccactagaaa

SEQ ID NO: 1528468 - DNA, 20 bp, Homo sapiens
catagaaatggaaattttgc

SEQ ID NO: 1528469 - DNA, 23 bp, Homo sapiens
catagaaatgtaacttttgtaag

SEQ ID NO: 1528470 - DNA, 23 bp, Homo sapiens
catagaaatgtaggtcctcagaa

SEQ ID NO: 1528471 - DNA, 21 bp, Homo sapiens
catagaacaggacctctgctt

SEQ ID NO: 1528472 - DNA, 23 bp, Homo sapiens
catagaactgtcccacaaaatat

SEQ ID NO: 1528473 - DNA, 22 bp, Homo sapiens
catagaccctctttcttgtttg

SEQ ID NO: 1528474 - DNA, 15 bp, Homo sapiens
catagagctttttaa

SEQ ID NO: 1528475 - DNA, 14 bp, Homo sapiens
catagaggcccagg

SEQ ID NO: 1528476 - DNA, 16 bp, Homo sapiens
catagaggcccaggca

SEQ ID NO: 1528477 - DNA, 20 bp, Homo sapiens
catagaggcttctccgccag

SEQ ID NO: 1528478 - DNA, 21 bp, Homo sapiens
catagaggcttctccgccagc

SEQ ID NO: 1528479 - DNA, 22 bp, Homo sapiens
catagataatattgtttggtaa

SEQ ID NO: 1528480 - DNA, 23 bp, Homo sapiens
catagatcagcaaaccggggcct

SEQ ID NO: 1528481 - DNA, 13 bp, Homo sapiens
catagatcttctg

SEQ ID NO: 1528482 - DNA, 15 bp, Homo sapiens
catagatcttctgaa

SEQ ID NO: 1528483 - DNA, 16 bp, Homo sapiens
catagattaatggcac

SEQ ID NO: 1528484 - DNA, 20 bp, Homo sapiens
catagattaatggcactgat

SEQ ID NO: 1528485 - DNA, 23 bp, Homo sapiens
catagattattataaactataaa

SEQ ID NO: 1528486 - DNA, 20 bp, Homo sapiens
catagatttaagtgaataca

SEQ ID NO: 1528487 - DNA, 17 bp, Homo sapiens
catagcagatctgtttt

SEQ ID NO: 1528488 - DNA, 16 bp, Homo sapiens
catagcagattttaat

SEQ ID NO: 1528489 - DNA, 12 bp, Homo sapiens
catagcagcttt

SEQ ID NO: 1528490 - DNA, 19 bp, Homo sapiens
catagcaggggcaccttcc

SEQ ID NO: 1528491 - DNA, 16 bp, Homo sapiens
catagcatagccagca

SEQ ID NO: 1528492 - DNA, 19 bp, Homo sapiens
catagcatagccagcattc

SEQ ID NO: 1528493 - DNA, 18 bp, Homo sapiens
catagcatgcttcctttc

SEQ ID NO: 1528494 - DNA, 11 bp, Homo sapiens
catagcattca

SEQ ID NO: 1528495 - DNA, 15 bp, Homo sapiens
catagccaaagccag

SEQ ID NO: 1528496 - DNA, 17 bp, Homo sapiens
catagccaactctccca

SEQ ID NO: 1528497 - DNA, 22 bp, Homo sapiens
catagccagcattcagcacaca

SEQ ID NO: 1528498 - DNA, 15 bp, Homo sapiens
catagcccagtagac

SEQ ID NO: 1528499 - DNA, 18 bp, Homo sapiens
catagctcaagaattgtt

SEQ ID NO: 1528500 - DNA, 18 bp, Homo sapiens
cataggaaaagtacattt

SEQ ID NO: 1528501 - DNA, 19 bp, Homo sapiens
cataggaaaagtacattta

SEQ ID NO: 1528502 - DNA, 14 bp, Homo sapiens
cataggaattaaat

SEQ ID NO: 1528503 - DNA, 15 bp, Homo sapiens
cataggacctgcatc

SEQ ID NO: 1528504 - DNA, 16 bp, Homo sapiens
cataggacctgcatcc

SEQ ID NO: 1528505 - DNA, 20 bp, Homo sapiens
cataggacctgcatccttcc

SEQ ID NO: 1528506 - DNA, 16 bp, Homo sapiens
cataggacctttccac

SEQ ID NO: 1528507 - DNA, 17 bp, Homo sapiens
cataggactaccgcagg

SEQ ID NO: 1528508 - DNA, 19 bp, Homo sapiens
cataggactaccgcaggcc

SEQ ID NO: 1528509 - DNA, 20 bp, Homo sapiens
cataggactaccgcaggccc

SEQ ID NO: 1528510 - DNA, 17 bp, Homo sapiens
cataggagtttggagga

SEQ ID NO: 1528511 - DNA, 19 bp, Homo sapiens
cataggagtttggaggaag

SEQ ID NO: 1528512 - DNA, 19 bp, Homo sapiens
cataggcggtcatgtgtgc

SEQ ID NO: 1528513 - DNA, 18 bp, Homo sapiens
cataggctggtggccttg

SEQ ID NO: 1528514 - DNA, 21 bp, Homo sapiens
cataggctggtggccttgggc

SEQ ID NO: 1528515 - DNA, 18 bp, Homo sapiens
catagggtcactttgcca

SEQ ID NO: 1528516 - DNA, 15 bp, Homo sapiens
catagggtctcttca

SEQ ID NO: 1528517 - DNA, 17 bp, Homo sapiens
cataggtcactggctct

SEQ ID NO: 1528518 - DNA, 21 bp, Homo sapiens
cataggtcactggctctccaa

SEQ ID NO: 1528519 - DNA, 15 bp, Homo sapiens
cataggttactacct

SEQ ID NO: 1528520 - DNA, 14 bp, Homo sapiens
catagtaagattga

SEQ ID NO: 1528521 - DNA, 17 bp, Homo sapiens
catagtagtttttacag

SEQ ID NO: 1528522 - DNA, 20 bp, Homo sapiens
catagtagtttttacagctg

SEQ ID NO: 1528523 - DNA, 14 bp, Homo sapiens
catagtcaatgatg

SEQ ID NO: 1528524 - DNA, 22 bp, Homo sapiens
catagtcaatgatggtttaata

SEQ ID NO: 1528525 - DNA, 13 bp, Homo sapiens
catagtcacatgg

SEQ ID NO: 1528526 - DNA, 21 bp, Homo sapiens
catagtcctgttactatggta

SEQ ID NO: 1528527 - DNA, 18 bp, Homo sapiens
catagtcttgaaatgaaa

SEQ ID NO: 1528528 - DNA, 22 bp, Homo sapiens
cagtcccctcccatctgggagt

SEQ ID NO: 1528529 - DNA, 13 bp, Homo sapiens
cagtccctccaca

SEQ ID NO: 1528530 - DNA, 16 bp, Homo sapiens
cagtccctcgccgtcc

SEQ ID NO: 1528531 - DNA, 21 bp, Homo sapiens
cagtccctcgccgtccctccc

SEQ ID NO: 1528532 - DNA, 12 bp, Homo sapiens
cagtccctggag

SEQ ID NO: 1528533 - DNA, 22 bp, Homo sapiens
cagtccctggagaaggcatgtt

SEQ ID NO: 1528534 - DNA, 13 bp, Homo sapiens
cagtccctggagc

SEQ ID NO: 1528535 - DNA, 15 bp, Homo sapiens
cagtccctggagctg

SEQ ID NO: 1528536 - DNA, 12 bp, Homo sapiens
cagtccctgggg

SEQ ID NO: 1528537 - DNA, 21 bp, Homo sapiens
cagtccctgggggaagccctg

SEQ ID NO: 1528538 - DNA, 16 bp, Homo sapiens
cagtccctttaaagaa

SEQ ID NO: 1528539 - DNA, 22 bp, Homo sapiens
cagtccgcctggccggctccag

SEQ ID NO: 1528540 - DNA, 19 bp, Homo sapiens
cagtcctaagaaagaggag

SEQ ID NO: 1528541 - DNA, 20 bp, Homo sapiens
cagtcctcccaccttggcct

SEQ ID NO: 1528542 - DNA, 21 bp, Homo sapiens
cagtcctctcccaagtccaca

SEQ ID NO: 1528543 - DNA, 17 bp, Homo sapiens
cagtcctcttattccta

SEQ ID NO: 1528544 - DNA, 13 bp, Homo sapiens
cagtcctgcctgg

SEQ ID NO: 1528545 - DNA, 18 bp, Homo sapiens
cagtcctgcctggccagg

SEQ ID NO: 1528546 - DNA, 22 bp, Homo sapiens
cagtcctggaagccagctttcc

SEQ ID NO: 1528547 - DNA, 22 bp, Homo sapiens
cagtcctgggagaacctcaggc

SEQ ID NO: 1528548 - DNA, 23 bp, Homo sapiens
cagtcctgggagaacctcaggct

SEQ ID NO: 1528549 - DNA, 15 bp, Homo sapiens
cagtccttgctttgg

SEQ ID NO: 1528550 - DNA, 20 bp, Homo sapiens
cagtcgcaggatccgctgcc

SEQ ID NO: 1528551 - DNA, 23 bp, Homo sapiens
cagtcgcaggatccgctgccacc

SEQ ID NO: 1528552 - DNA, 18 bp, Homo sapiens
cagtcggcatgccaggac

SEQ ID NO: 1528553 - DNA, 14 bp, Homo sapiens
cagtcggccccatc

SEQ ID NO: 1528554 - DNA, 17 bp, Homo sapiens
cagtcgggggctggcct

SEQ ID NO: 1528555 - DNA, 15 bp, Homo sapiens
cagtcgtgatgtgga

SEQ ID NO: 1528556 - DNA, 18 bp, Homo sapiens
cagtcgtgatgtggagga

SEQ ID NO: 1528557 - DNA, 15 bp, Homo sapiens
cagtcgtgcctgtgt

SEQ ID NO: 1528558 - DNA, 17 bp, Homo sapiens
cagtcgtgcctgtgtcc

SEQ ID NO: 1528559 - DNA, 14 bp, Homo sapiens
cagtcgttgtgctt

SEQ ID NO: 1528560 - DNA, 14 bp, Homo sapiens
cagtcgttttagtg

SEQ ID NO: 1528561 - DNA, 20 bp, Homo sapiens
cagtcgttttagtgtctgac

SEQ ID NO: 1528562 - DNA, 23 bp, Homo sapiens
cagtcgttttagtgtctgaccta

SEQ ID NO: 1528563 - DNA, 19 bp, Homo sapiens
cagtctaaaatgcttcagt

SEQ ID NO: 1528564 - DNA, 13 bp, Homo sapiens
cagtctagttcct

SEQ ID NO: 1528565 - DNA, 15 bp, Homo sapiens
cagtctatttccatt

SEQ ID NO: 1528566 - DNA, 21 bp, Homo sapiens
cagtctcaagaggcagagttc

SEQ ID NO: 1528567 - DNA, 14 bp, Homo sapiens
cagtctcacagaga

SEQ ID NO: 1528568 - DNA, 22 bp, Homo sapiens
cagtctcacagagaagctcctg

SEQ ID NO: 1528569 - DNA, 18 bp, Homo sapiens
cagtctcagagaccagca

SEQ ID NO: 1528570 - DNA, 14 bp, Homo sapiens
cagtctcagctgct

SEQ ID NO: 1528571 - DNA, 14 bp, Homo sapiens
cagtctcaggagca

SEQ ID NO: 1528572 - DNA, 18 bp, Homo sapiens
cagtctcaggagcatggg

SEQ ID NO: 1528573 - DNA, 13 bp, Homo sapiens
cagtctcccaggc

SEQ ID NO: 1528574 - DNA, 18 bp, Homo sapiens
cagtctcccaggccccct

SEQ ID NO: 1528575 - DNA, 18 bp, Homo sapiens
cagtctccttcagcacgg

SEQ ID NO: 1528576 - DNA, 20 bp, Homo sapiens
cagtctctataccaataaag

SEQ ID NO: 1528577 - DNA, 22 bp, Homo sapiens
cagtctctcttctctccagctg

SEQ ID NO: 1528578 - DNA, 14 bp, Homo sapiens
cagtctctggaaaa

SEQ ID NO: 1528579 - DNA, 21 bp, Homo sapiens
cagtctctggaaaagctgggg

SEQ ID NO: 1528580 - DNA, 16 bp, Homo sapiens
cagtctgataaactga

SEQ ID NO: 1528581 - DNA, 15 bp, Homo sapiens
cagtctgatctgtga

SEQ ID NO: 1528582 - DNA, 15 bp, Homo sapiens
cagtctggagaaggt

SEQ ID NO: 1528583 - DNA, 12 bp, Homo sapiens
cagtctgtcatg

SEQ ID NO: 1528584 - DNA, 23 bp, Homo sapiens
cagtctgtcatgaacatgttcct

SEQ ID NO: 1528585 - DNA, 19 bp, Homo sapiens
cagtctgtgatccttggtg

SEQ ID NO: 1528586 - DNA, 21 bp, Homo sapiens
cagtctgttatgcactgtggt

SEQ ID NO: 1528587 - DNA, 18 bp, Homo sapiens
cagtcttcctgacacttt

SEQ ID NO: 1528588 - DNA, 21 bp, Homo sapiens
cagtcttctctctggctcagg

SEQ ID NO: 1528589 - DNA, 12 bp, Homo sapiens
cagtcttctgga

SEQ ID NO: 1528590 - DNA, 13 bp, Homo sapiens
cagtcttgcctag

SEQ ID NO: 1528591 - DNA, 17 bp, Homo sapiens
cagtcttggtggttcta

SEQ ID NO: 1528592 - DNA, 14 bp, Homo sapiens
cagtctttgctcag

SEQ ID NO: 1528593 - DNA, 21 bp, Homo sapiens
cagtgaacattcccagcccag

SEQ ID NO: 1528594 - DNA, 23 bp, Homo sapiens
cagtgaacttacacttggagccc

SEQ ID NO: 1528595 - DNA, 13 bp, Homo sapiens
cagtgaagatgca

SEQ ID NO: 1528596 - DNA, 19 bp, Homo sapiens
cagtgaagatgcaatcaga

SEQ ID NO: 1528597 - DNA, 18 bp, Homo sapiens
cagtgaagatgctgtaaa

SEQ ID NO: 1528598 - DNA, 19 bp, Homo sapiens
cagtgaagatgctgtaaat

SEQ ID NO: 1528599 - DNA, 22 bp, Homo sapiens
cagtgaaggagccacgtgaatg

SEQ ID NO: 1528600 - DNA, 18 bp, Homo sapiens
cagtgaatgctagacaga

SEQ ID NO: 1528601 - DNA, 14 bp, Homo sapiens
cagtgacaaaccat

SEQ ID NO: 1528602 - DNA, 13 bp, Homo sapiens
cagtgacaacatc

SEQ ID NO: 1528603 - DNA, 17 bp, Homo sapiens
cagtgacactggaccag

SEQ ID NO: 1528604 - DNA, 16 bp, Homo sapiens
cagtgacagagttcac

SEQ ID NO: 1528605 - DNA, 18 bp, Homo sapiens
cagtgacctctctctctg

SEQ ID NO: 1528606 - DNA, 14 bp, Homo sapiens
cagtgactcctgct

SEQ ID NO: 1528607 - DNA, 14 bp, Homo sapiens
cagtgactggcagg

SEQ ID NO: 1528608 - DNA, 15 bp, Homo sapiens
cagtgacttctgaga

SEQ ID NO: 1528609 - DNA, 22 bp, Homo sapiens
cagtgactttttctgagctttt

SEQ ID NO: 1528610 - DNA, 21 bp, Homo sapiens
cagtgagaactctctccctgg

SEQ ID NO: 1528611 - DNA, 23 bp, Homo sapiens
cagtgagagacgccctatttcta

SEQ ID NO: 1528612 - DNA, 18 bp, Homo sapiens
cagtgagccagaaattga

SEQ ID NO: 1528613 - DNA, 17 bp, Homo sapiens
cagtgagccgagatggc

SEQ ID NO: 1528614 - DNA, 19 bp, Homo sapiens
cagtgagccgcatcttctc

SEQ ID NO: 1528615 - DNA, 12 bp, Homo sapiens
cagtgagcctga

SEQ ID NO: 1528616 - DNA, 19 bp, Homo sapiens
cagtgaggagggatgtggg

SEQ ID NO: 1528617 - DNA, 21 bp, Homo sapiens
cagtgaggagggatgtgggta

SEQ ID NO: 1528618 - DNA, 17 bp, Homo sapiens
cagtgaggcaggagaag

SEQ ID NO: 1528619 - DNA, 23 bp, Homo sapiens
cagtgagggtcttcttacatgca

SEQ ID NO: 1528620 - DNA, 17 bp, Homo sapiens
cagtgagtctcttcaga

SEQ ID NO: 1528621 - DNA, 21 bp, Homo sapiens
cagtgagtggccccacctgtg

SEQ ID NO: 1528622 - DNA, 23 bp, Homo sapiens
cagtgatacatgtactccagagg

SEQ ID NO: 1528623 - DNA, 14 bp, Homo sapiens
cagtgatctatgtt

SEQ ID NO: 1528624 - DNA, 17 bp, Homo sapiens
cagtgatgaatgtacta

SEQ ID NO: 1528625 - DNA, 16 bp, Homo sapiens
cagtgatgacttgctg

SEQ ID NO: 1528626 - DNA, 14 bp, Homo sapiens
cagtgatgcctgcc

SEQ ID NO: 1528627 - DNA, 22 bp, Homo sapiens
cagtgatgcttttagttttaaa

SEQ ID NO: 1528628 - DNA, 21 bp, Homo sapiens
cagtgatggcgcgggaggcac

SEQ ID NO: 1528629 - DNA, 19 bp, Homo sapiens
cagtgatttttttcttgta

SEQ ID NO: 1528630 - DNA, 22 bp, Homo sapiens
cagtgcaatggtataaatttca

SEQ ID NO: 1528631 - DNA, 14 bp, Homo sapiens
cagtgcactgaaag

SEQ ID NO: 1528632 - DNA, 15 bp, Homo sapiens
cagtgcagacaggcc

SEQ ID NO: 1528633 - DNA, 21 bp, Homo sapiens
cagtgcagacaggccatgtga

SEQ ID NO: 1528634 - DNA, 13 bp, Homo sapiens
cagtgcagcaata

SEQ ID NO: 1528635 - DNA, 15 bp, Homo sapiens
cagtgcagcagagga

SEQ ID NO: 1528636 - DNA, 23 bp, Homo sapiens
cagtgcatagttgtagacaaagt

SEQ ID NO: 1528637 - DNA, 17 bp, Homo sapiens
cagtgcatctcagccca

SEQ ID NO: 1528638 - DNA, 18 bp, Homo sapiens
cagtgcatctcagcccac

SEQ ID NO: 1528639 - DNA, 14 bp, Homo sapiens
cagtgcatggtggc

SEQ ID NO: 1528640 - DNA, 15 bp, Homo sapiens
ccagcctccctgtct

SEQ ID NO: 1528641 - DNA, 22 bp, Homo sapiens
ccagcctccctgtctccagctg

SEQ ID NO: 1528642 - DNA, 12 bp, Homo sapiens
ccagcctcctct

SEQ ID NO: 1528643 - DNA, 15 bp, Homo sapiens
ccagcctcctctgga

SEQ ID NO: 1528644 - DNA, 12 bp, Homo sapiens
ccagcctcctgg

SEQ ID NO: 1528645 - DNA, 20 bp, Homo sapiens
ccagcctcctgtttgcaggc

SEQ ID NO: 1528646 - DNA, 22 bp, Homo sapiens
ccagcctcgttggaagaggaac

SEQ ID NO: 1528647 - DNA, 16 bp, Homo sapiens
ccagcctctcccggct

SEQ ID NO: 1528648 - DNA, 22 bp, Homo sapiens
ccagcctctcccggctgcctgc

SEQ ID NO: 1528649 - DNA, 18 bp, Homo sapiens
ccagcctgaaagatacag

SEQ ID NO: 1528650 - DNA, 22 bp, Homo sapiens
ccagcctgaaagatacagggga

SEQ ID NO: 1528651 - DNA, 11 bp, Homo sapiens
ccagcctgagc

SEQ ID NO: 1528652 - DNA, 20 bp, Homo sapiens
ccagcctgctgacagacact

SEQ ID NO: 1528653 - DNA, 12 bp, Homo sapiens
ccagcctggcca

SEQ ID NO: 1528654 - DNA, 23 bp, Homo sapiens
ccagcctggctctgccccctccc

SEQ ID NO: 1528655 - DNA, 18 bp, Homo sapiens
ccagcctggcttctggag

SEQ ID NO: 1528656 - DNA, 21 bp, Homo sapiens
ccagcctggcttctggagccc

SEQ ID NO: 1528657 - DNA, 19 bp, Homo sapiens
ccagcctgggactcccagt

SEQ ID NO: 1528658 - DNA, 13 bp, Homo sapiens
ccagcctgggagc

SEQ ID NO: 1528659 - DNA, 18 bp, Homo sapiens
ccagcctgggagcccaga

SEQ ID NO: 1528660 - DNA, 23 bp, Homo sapiens
ccagcctgggcagccaggctgcc

SEQ ID NO: 1528661 - DNA, 16 bp, Homo sapiens
ccagcctgggcgacag

SEQ ID NO: 1528662 - DNA, 18 bp, Homo sapiens
ccagcctggggaccccac

SEQ ID NO: 1528663 - DNA, 19 bp, Homo sapiens
ccagcctggggaccccact

SEQ ID NO: 1528664 - DNA, 12 bp, Homo sapiens
ccagcctggggc

SEQ ID NO: 1528665 - DNA, 21 bp, Homo sapiens
ccagcctggggctccctctct

SEQ ID NO: 1528666 - DNA, 13 bp, Homo sapiens
ccagcctggggtc

SEQ ID NO: 1528667 - DNA, 12 bp, Homo sapiens
ccagcctgtcca

SEQ ID NO: 1528668 - DNA, 12 bp, Homo sapiens
ccagcctgtggt

SEQ ID NO: 1528669 - DNA, 15 bp, Homo sapiens
ccagcctgtgtgttc

SEQ ID NO: 1528670 - DNA, 13 bp, Homo sapiens
ccagccttccagg

SEQ ID NO: 1528671 - DNA, 22 bp, Homo sapiens
ccagccttcctctgcagctgac

SEQ ID NO: 1528672 - DNA, 17 bp, Homo sapiens
ccagccttgagccctgg

SEQ ID NO: 1528673 - DNA, 14 bp, Homo sapiens
ccagcctttccaag

SEQ ID NO: 1528674 - DNA, 18 bp, Homo sapiens
ccagcctttctcccaggc

SEQ ID NO: 1528675 - DNA, 19 bp, Homo sapiens
ccagcctttctcccaggcc

SEQ ID NO: 1528676 - DNA, 18 bp, Homo sapiens
ccagcctttgggtcctgg

SEQ ID NO: 1528677 - DNA, 15 bp, Homo sapiens
ccagcgagtggtcaa

SEQ ID NO: 1528678 - DNA, 19 bp, Homo sapiens
ccagcgatggtgctgccca

SEQ ID NO: 1528679 - DNA, 20 bp, Homo sapiens
ccagcgatggtgctgcccag

SEQ ID NO: 1528680 - DNA, 23 bp, Homo sapiens
ccagcgccaaatgttcatcctca

SEQ ID NO: 1528681 - DNA, 14 bp, Homo sapiens
ccagcgcccgctgg

SEQ ID NO: 1528682 - DNA, 16 bp, Homo sapiens
ccagcgcccgctgggc

SEQ ID NO: 1528683 - DNA, 17 bp, Homo sapiens
ccagcgcccgctgggct

SEQ ID NO: 1528684 - DNA, 13 bp, Homo sapiens
ccagcgcggccag

SEQ ID NO: 1528685 - DNA, 16 bp, Homo sapiens
ccagcgcggccagcgt

SEQ ID NO: 1528686 - DNA, 19 bp, Homo sapiens
ccagcgctctcctggacgc

SEQ ID NO: 1528687 - DNA, 20 bp, Homo sapiens
ccagcggccccccgcacagc

SEQ ID NO: 1528688 - DNA, 13 bp, Homo sapiens
ccagcggcccctc

SEQ ID NO: 1528689 - DNA, 13 bp, Homo sapiens
ccagcggctgagt

SEQ ID NO: 1528690 - DNA, 13 bp, Homo sapiens
ccagcggctgctc

SEQ ID NO: 1528691 - DNA, 17 bp, Homo sapiens
ccagcggctgctcaagc

SEQ ID NO: 1528692 - DNA, 13 bp, Homo sapiens
ccagcgggcacag

SEQ ID NO: 1528693 - DNA, 17 bp, Homo sapiens
ccagcgggcacagggca

SEQ ID NO: 1528694 - DNA, 21 bp, Homo sapiens
ccagcggtccaacgccgcctt

SEQ ID NO: 1528695 - DNA, 18 bp, Homo sapiens
ccagcggtttccacttgt

SEQ ID NO: 1528696 - DNA, 17 bp, Homo sapiens
ccagcgtcactccagtg

SEQ ID NO: 1528697 - DNA, 18 bp, Homo sapiens
ccagcgtcactccagtgc

SEQ ID NO: 1528698 - DNA, 20 bp, Homo sapiens
ccagcgtcactccagtgctc

SEQ ID NO: 1528699 - DNA, 22 bp, Homo sapiens
ccagcgtcactccagtgctcag

SEQ ID NO: 1528700 - DNA, 21 bp, Homo sapiens
ccagcgtcccagtctctggca

SEQ ID NO: 1528701 - DNA, 22 bp, Homo sapiens
ccagcgtcccagtctctggcag

SEQ ID NO: 1528702 - DNA, 14 bp, Homo sapiens
ccagcgtcccttgg

SEQ ID NO: 1528703 - DNA, 15 bp, Homo sapiens
ccagcgtctgttgtg

SEQ ID NO: 1528704 - DNA, 23 bp, Homo sapiens
ccagcgtggcgcagtggccctga

SEQ ID NO: 1528705 - DNA, 15 bp, Homo sapiens
ccagcgtgtggagca

SEQ ID NO: 1528706 - DNA, 23 bp, Homo sapiens
ccagcgtttagtttctagaggcc

SEQ ID NO: 1528707 - DNA, 17 bp, Homo sapiens
ccagctaagaacctgga

SEQ ID NO: 1528708 - DNA, 15 bp, Homo sapiens
ccagctaataaacca

SEQ ID NO: 1528709 - DNA, 16 bp, Homo sapiens
ccagctaataaaccag

SEQ ID NO: 1528710 - DNA, 21 bp, Homo sapiens
ccagctaatctgtagggctgg

SEQ ID NO: 1528711 - DNA, 14 bp, Homo sapiens
ccagctaattgaga

SEQ ID NO: 1528712 - DNA, 13 bp, Homo sapiens
ccagctacattcc

SEQ ID NO: 1528713 - DNA, 19 bp, Homo sapiens
ccagctacattcctcagct

SEQ ID NO: 1528714 - DNA, 21 bp, Homo sapiens
ccagctacattcctcagctgc

SEQ ID NO: 1528715 - DNA, 22 bp, Homo sapiens
ccagctaccctttttctccagc

SEQ ID NO: 1528716 - DNA, 20 bp, Homo sapiens
ccagctactcaagaggctga

SEQ ID NO: 1528717 - DNA, 14 bp, Homo sapiens
ccagctactcagaa

SEQ ID NO: 1528718 - DNA, 17 bp, Homo sapiens
ccagctactcagaagcc

SEQ ID NO: 1528719 - DNA, 13 bp, Homo sapiens
ccagctactcagg

SEQ ID NO: 1528720 - DNA, 14 bp, Homo sapiens
ccagctactcagga

SEQ ID NO: 1528721 - DNA, 15 bp, Homo sapiens
ccagctactcgggag

SEQ ID NO: 1528722 - DNA, 20 bp, Homo sapiens
ccagctactcgggaggctga

SEQ ID NO: 1528723 - DNA, 16 bp, Homo sapiens
ccagctactctgtcca

SEQ ID NO: 1528724 - DNA, 21 bp, Homo sapiens
ccagctactggggaggctgag

SEQ ID NO: 1528725 - DNA, 23 bp, Homo sapiens
ccagctaggaagagcaggactcc

SEQ ID NO: 1528726 - DNA, 22 bp, Homo sapiens
ccagctcaatggactggaaggg

SEQ ID NO: 1528727 - DNA, 14 bp, Homo sapiens
ccagctcagaggcc

SEQ ID NO: 1528728 - DNA, 15 bp, Homo sapiens
ccagctcagaggccc

SEQ ID NO: 1528729 - DNA, 17 bp, Homo sapiens
ccagctcagaggcccag

SEQ ID NO: 1528730 - DNA, 22 bp, Homo sapiens
ccagctcagtcccatcagagag

SEQ ID NO: 1528731 - DNA, 16 bp, Homo sapiens
ccagctcatgacactg

SEQ ID NO: 1528732 - DNA, 14 bp, Homo sapiens
ccagctccaacctg

SEQ ID NO: 1528733 - DNA, 20 bp, Homo sapiens
ccagctccaacctgcaaaga

SEQ ID NO: 1528734 - DNA, 16 bp, Homo sapiens
ccagctccagggccag

SEQ ID NO: 1528735 - DNA, 11 bp, Homo sapiens
ccagctcccaa

SEQ ID NO: 1528736 - DNA, 21 bp, Homo sapiens
ccagctcccactccctttcca

SEQ ID NO: 1528737 - DNA, 15 bp, Homo sapiens
ccagctccccaggac

SEQ ID NO: 1528738 - DNA, 16 bp, Homo sapiens
ccagctccccaggact

SEQ ID NO: 1528739 - DNA, 17 bp, Homo sapiens
ccagctccccaggactc

SEQ ID NO: 1528740 - DNA, 19 bp, Homo sapiens
ccagctccccaggactcac

SEQ ID NO: 1528741 - DNA, 21 bp, Homo sapiens
ccagctcccgctgtggccgca

SEQ ID NO: 1528742 - DNA, 14 bp, Homo sapiens
ccagctccctagga

SEQ ID NO: 1528743 - DNA, 17 bp, Homo sapiens
ccagctccgcctgctgg

SEQ ID NO: 1528744 - DNA, 15 bp, Homo sapiens
ccagctcctgggcag

SEQ ID NO: 1528745 - DNA, 18 bp, Homo sapiens
ccagctcctgggcagctt

SEQ ID NO: 1528746 - DNA, 21 bp, Homo sapiens
ccagctcgctggctttctctc

SEQ ID NO: 1528747 - DNA, 13 bp, Homo sapiens
ccagctctcagcc

SEQ ID NO: 1528748 - DNA, 13 bp, Homo sapiens
ccagctctcagta

SEQ ID NO: 1528749 - DNA, 21 bp, Homo sapiens
ccagctctccctctggccctg

SEQ ID NO: 1528750 - DNA, 17 bp, Homo sapiens
ccagctctcttcctgtc

SEQ ID NO: 1528751 - DNA, 13 bp, Homo sapiens
ccagctctgacat

SEQ ID NO: 1528752 - DNA, 14 bp, Homo sapiens
ccagctctgacatc

SEQ ID NO: 1528753 - DNA, 15 bp, Homo sapiens
ccagctctgacatcc

SEQ ID NO: 1528754 - DNA, 23 bp, Homo sapiens
ccagctctgacatcccttcctgg

SEQ ID NO: 1528755 - DNA, 12 bp, Homo sapiens
ccagctctgagg

SEQ ID NO: 1528756 - DNA, 12 bp, Homo sapiens
ccagctctgccc

SEQ ID NO: 1528757 - DNA, 14 bp, Homo sapiens
ccagctctgccccc

SEQ ID NO: 1528758 - DNA, 15 bp, Homo sapiens
ccagctctgcccccg

SEQ ID NO: 1528759 - DNA, 11 bp, Homo sapiens
ccagctctgga

SEQ ID NO: 1528760 - DNA, 12 bp, Homo sapiens
ccagctctggag

SEQ ID NO: 1528761 - DNA, 14 bp, Homo sapiens
ccagctctggaggg

SEQ ID NO: 1528762 - DNA, 19 bp, Homo sapiens
ccagctctggaggggaggg

SEQ ID NO: 1528763 - DNA, 21 bp, Homo sapiens
ccagctctggatgaaggcaaa

SEQ ID NO: 1528764 - DNA, 11 bp, Homo sapiens
ccagctctgtg

SEQ ID NO: 1528765 - DNA, 14 bp, Homo sapiens
ccagctctgtggcc

SEQ ID NO: 1528766 - DNA, 18 bp, Homo sapiens
ccagctctgtggcctgtg

SEQ ID NO: 1528767 - DNA, 19 bp, Homo sapiens
ccagctcttctcttcctag

SEQ ID NO: 1528768 - DNA, 22 bp, Homo sapiens
ccagctcttctcttcctagatc

SEQ ID NO: 1528769 - DNA, 12 bp, Homo sapiens
ccagctcttgct

SEQ ID NO: 1528770 - DNA, 15 bp, Homo sapiens
ccagctcttgctctc

SEQ ID NO: 1528771 - DNA, 19 bp, Homo sapiens
ccagctcttggcccctgtg

SEQ ID NO: 1528772 - DNA, 13 bp, Homo sapiens
ccagctgaaggca

SEQ ID NO: 1528773 - DNA, 15 bp, Homo sapiens
ccagctgaaggcagt

SEQ ID NO: 1528774 - DNA, 18 bp, Homo sapiens
ccagctgaaggcagtggc

SEQ ID NO: 1528775 - DNA, 21 bp, Homo sapiens
ccagctgagtctatgtaggtg

SEQ ID NO: 1528776 - DNA, 14 bp, Homo sapiens
ccagctgcactgat

SEQ ID NO: 1528777 - DNA, 12 bp, Homo sapiens
ccagctgcagat

SEQ ID NO: 1528778 - DNA, 21 bp, Homo sapiens
ccagctgccctatgggcctgc

SEQ ID NO: 1528779 - DNA, 17 bp, Homo sapiens
ccagctgccgcaccagc

SEQ ID NO: 1528780 - DNA, 18 bp, Homo sapiens
ccagctgccgcaccagcc

SEQ ID NO: 1528781 - DNA, 16 bp, Homo sapiens
ccagctgcgcttgctt

SEQ ID NO: 1528782 - DNA, 9 bp, Homo sapiens
ccagctgct

SEQ ID NO: 1528783 - DNA, 13 bp, Homo sapiens
ccagctgctctgc

SEQ ID NO: 1528784 - DNA, 14 bp, Homo sapiens
ccagctgctctgcc

SEQ ID NO: 1528785 - DNA, 16 bp, Homo sapiens
ccagctgctctgcccc

SEQ ID NO: 1528786 - DNA, 11 bp, Homo sapiens
ccagctgctgt

SEQ ID NO: 1528787 - DNA, 15 bp, Homo sapiens
ccagctgctgtgccc

SEQ ID NO: 1528788 - DNA, 21 bp, Homo sapiens
ccagctgctgtgccccaccac

SEQ ID NO: 1528789 - DNA, 13 bp, Homo sapiens
ccagctgcttttt

SEQ ID NO: 1528790 - DNA, 24 bp, Homo sapiens
ccagctggagaaatatggtactca

SEQ ID NO: 1528791 - DNA, 12 bp, Homo sapiens
ccagctggcctg

SEQ ID NO: 1528792 - DNA, 13 bp, Homo sapiens
ccagctggcctgg

SEQ ID NO: 1528793 - DNA, 22 bp, Homo sapiens
ccagctgggaggcaagaggggt

SEQ ID NO: 1528794 - DNA, 15 bp, Homo sapiens
ccagctgggcccagc

SEQ ID NO: 1528795 - DNA, 22 bp, Homo sapiens
ccagctgggcctcctgcctccg

SEQ ID NO: 1528796 - DNA, 16 bp, Homo sapiens
ccagctgggctctgca

SEQ ID NO: 1528797 - DNA, 19 bp, Homo sapiens
ccagctgggctctgcaatt

SEQ ID NO: 1528798 - DNA, 23 bp, Homo sapiens
ccagctgggctctgccaccctac

SEQ ID NO: 1528799 - DNA, 19 bp, Homo sapiens
ccagctggggcgtggggag

SEQ ID NO: 1528800 - DNA, 20 bp, Homo sapiens
ccagctgtagccatggctca

SEQ ID NO: 1528801 - DNA, 23 bp, Homo sapiens
ccagctgtagccatggctcaggc

SEQ ID NO: 1528802 - DNA, 16 bp, Homo sapiens
ccagcttaaaacactt

SEQ ID NO: 1528803 - DNA, 23 bp, Homo sapiens
ccagcttagagttcttctttctt

SEQ ID NO: 1528804 - DNA, 21 bp, Homo sapiens
ccagcttattgtgtgcgctgc

SEQ ID NO: 1528805 - DNA, 18 bp, Homo sapiens
ccagcttcaaatgcaaat

SEQ ID NO: 1528806 - DNA, 13 bp, Homo sapiens
ccagcttcctggt

SEQ ID NO: 1528807 - DNA, 15 bp, Homo sapiens
ccagcttctctctcc

SEQ ID NO: 1528808 - DNA, 20 bp, Homo sapiens
ccagcttctctctccagggt

SEQ ID NO: 1528809 - DNA, 13 bp, Homo sapiens
ccagcttggctca

SEQ ID NO: 1528810 - DNA, 16 bp, Homo sapiens
ccagcttggctcacaa

SEQ ID NO: 1528811 - DNA, 18 bp, Homo sapiens
ccagcttgggcccagctg

SEQ ID NO: 1528812 - DNA, 19 bp, Homo sapiens
ccagcttgggcccagctgg

SEQ ID NO: 1528813 - DNA, 21 bp, Homo sapiens
ccagcttgggcccagctgggc

SEQ ID NO: 1528814 - DNA, 24 bp, Homo sapiens
ccagcttgggcccagctgggctct

SEQ ID NO: 1528815 - DNA, 14 bp, Homo sapiens
ccagcttggggcca

SEQ ID NO: 1528816 - DNA, 15 bp, Homo sapiens
ccagcttgttattta

SEQ ID NO: 1528817 - DNA, 16 bp, Homo sapiens
ccagcttgttatttat

SEQ ID NO: 1528818 - DNA, 17 bp, Homo sapiens
ccagcttgttatttata

SEQ ID NO: 1528819 - DNA, 15 bp, Homo sapiens
ccaggaaaaaataaa

SEQ ID NO: 1528820 - DNA, 19 bp, Homo sapiens
ccaggaaaaaataaaaaga

SEQ ID NO: 1528821 - DNA, 19 bp, Homo sapiens
ccaggaaactccacatctg

SEQ ID NO: 1528822 - DNA, 13 bp, Homo sapiens
ccaggaaaggctt

SEQ ID NO: 1528823 - DNA, 16 bp, Homo sapiens
ccaggaaaggcttggc

SEQ ID NO: 1528824 - DNA, 18 bp, Homo sapiens
ccaggaacagcaaatgca

SEQ ID NO: 1528825 - DNA, 20 bp, Homo sapiens
ccaggaacgtttctgaacaa

SEQ ID NO: 1528826 - DNA, 14 bp, Homo sapiens
ccaggaagaagcag

SEQ ID NO: 1528827 - DNA, 16 bp, Homo sapiens
ccaggaagaagcaggg

SEQ ID NO: 1528828 - DNA, 13 bp, Homo sapiens
ccaggaaggcagc

SEQ ID NO: 1528829 - DNA, 17 bp, Homo sapiens
ccaggaaggcagctgct

SEQ ID NO: 1528830 - DNA, 18 bp, Homo sapiens
ccaggaaggtagcccagc

SEQ ID NO: 1528831 - DNA, 14 bp, Homo sapiens
ccaggaatatgaca

SEQ ID NO: 1528832 - DNA, 13 bp, Homo sapiens
ccaggaatattaa

SEQ ID NO: 1528833 - DNA, 14 bp, Homo sapiens
ccaggaatattaag

SEQ ID NO: 1528834 - DNA, 19 bp, Homo sapiens
ccaggaatgcctcctccct

SEQ ID NO: 1528835 - DNA, 22 bp, Homo sapiens
ccaggaattagagaagctgaaa

SEQ ID NO: 1528836 - DNA, 17 bp, Homo sapiens
ccaggaatttcccagga

SEQ ID NO: 1528837 - DNA, 18 bp, Homo sapiens
ccaggaatttcccaggac

SEQ ID NO: 1528838 - DNA, 19 bp, Homo sapiens
ccaggaatttcccaggacc

SEQ ID NO: 1528839 - DNA, 23 bp, Homo sapiens
ccaggaatttcccaggaccctga

SEQ ID NO: 1528840 - DNA, 14 bp, Homo sapiens
ccaggacaccgggc

SEQ ID NO: 1528841 - DNA, 19 bp, Homo sapiens
ccaggacactaccctgaga

SEQ ID NO: 1528842 - DNA, 14 bp, Homo sapiens
ccaggacaggacca

SEQ ID NO: 1528843 - DNA, 14 bp, Homo sapiens
ccaggaccaagcca

SEQ ID NO: 1528844 - DNA, 11 bp, Homo sapiens
ccaggaccagc

SEQ ID NO: 1528845 - DNA, 15 bp, Homo sapiens
ccaggaccagcctgt

SEQ ID NO: 1528846 - DNA, 16 bp, Homo sapiens
ccaggaccagctcagg

SEQ ID NO: 1528847 - DNA, 17 bp, Homo sapiens
ccaggaccagctcagga

SEQ ID NO: 1528848 - DNA, 20 bp, Homo sapiens
ccaggaccagctcaggacag

SEQ ID NO: 1528849 - DNA, 14 bp, Homo sapiens
ccaggaccagctgg

SEQ ID NO: 1528850 - DNA, 20 bp, Homo sapiens
ccaggaccatcctggagggc

SEQ ID NO: 1528851 - DNA, 15 bp, Homo sapiens
ccaggacccgccagc

SEQ ID NO: 1528852 - DNA, 18 bp, Homo sapiens
ccaggacccgccagcccc

SEQ ID NO: 1528853 - DNA, 19 bp, Homo sapiens
ccaggacctcggatgacca

SEQ ID NO: 1528854 - DNA, 18 bp, Homo sapiens
ccaggacctcttctggag

SEQ ID NO: 1528855 - DNA, 19 bp, Homo sapiens
ccaggacgtctggggtgtg

SEQ ID NO: 1528856 - DNA, 20 bp, Homo sapiens
ccaggacgtctggggtgtgg

SEQ ID NO: 1528857 - DNA, 23 bp, Homo sapiens
ccaggactccctcctcacctctg

SEQ ID NO: 1528858 - DNA, 13 bp, Homo sapiens
ccaggactgggcc

SEQ ID NO: 1528859 - DNA, 17 bp, Homo sapiens
ccaggactgggccactt

SEQ ID NO: 1528860 - DNA, 16 bp, Homo sapiens
ccaggagaagggggct

SEQ ID NO: 1528861 - DNA, 23 bp, Homo sapiens
ccaggagaagggggctctgcccc

SEQ ID NO: 1528862 - DNA, 18 bp, Homo sapiens
ccaggagaagtgctccct

SEQ ID NO: 1528863 - DNA, 23 bp, Homo sapiens
ccaggagacagaccacttgccac

SEQ ID NO: 1528864 - DNA, 16 bp, Homo sapiens
ccaggagagagccagg

SEQ ID NO: 1528865 - DNA, 17 bp, Homo sapiens
ccaggagagccagccct

SEQ ID NO: 1528866 - DNA, 18 bp, Homo sapiens
ccaggagcagatggacag

SEQ ID NO: 1528867 - DNA, 15 bp, Homo sapiens
ccaggagcagcagcc

SEQ ID NO: 1528868 - DNA, 22 bp, Homo sapiens
ccaggagcagcagccagcacca

SEQ ID NO: 1528869 - DNA, 16 bp, Homo sapiens
ccaggagcagcttttg

SEQ ID NO: 1528870 - DNA, 12 bp, Homo sapiens
ccaggagcctac

SEQ ID NO: 1528871 - DNA, 12 bp, Homo sapiens
ccaggagctagc

SEQ ID NO: 1528872 - DNA, 20 bp, Homo sapiens
ccaggagctagcccagtccc

SEQ ID NO: 1528873 - DNA, 12 bp, Homo sapiens
ccaggagctctg

SEQ ID NO: 1528874 - DNA, 19 bp, Homo sapiens
ccaggagctctgcgccagg

SEQ ID NO: 1528875 - DNA, 16 bp, Homo sapiens
aagaacacagcatgtg

SEQ ID NO: 1528876 - DNA, 18 bp, Homo sapiens
aagaacacattttaaata

SEQ ID NO: 1528877 - DNA, 21 bp, Homo sapiens
aagaacaccctatattttgca

SEQ ID NO: 1528878 - DNA, 22 bp, Homo sapiens
aagaacactggacctttgggtt

SEQ ID NO: 1528879 - DNA, 16 bp, Homo sapiens
aagaacatagaactct

SEQ ID NO: 1528880 - DNA, 18 bp, Homo sapiens
aagaacatccaaggagaa

SEQ ID NO: 1528881 - DNA, 15 bp, Homo sapiens
aagaaccaaatacct

SEQ ID NO: 1528882 - DNA, 17 bp, Homo sapiens
aagaaccaaatacctca

SEQ ID NO: 1528883 - DNA, 15 bp, Homo sapiens
aagaaccactgtcta

SEQ ID NO: 1528884 - DNA, 22 bp, Homo sapiens
aagaacctacagactccatctc

SEQ ID NO: 1528885 - DNA, 13 bp, Homo sapiens
aagaacctggaaa

SEQ ID NO: 1528886 - DNA, 21 bp, Homo sapiens
aagaacggggctcttctcatt

SEQ ID NO: 1528887 - DNA, 22 bp, Homo sapiens
aagaacggggctcttctcattt

SEQ ID NO: 1528888 - DNA, 13 bp, Homo sapiens
aagaactccttat

SEQ ID NO: 1528889 - DNA, 11 bp, Homo sapiens
aagaactctaa

SEQ ID NO: 1528890 - DNA, 23 bp, Homo sapiens
aagaactctaaccagtgtacagg

SEQ ID NO: 1528891 - DNA, 13 bp, Homo sapiens
aagaactctctgg

SEQ ID NO: 1528892 - DNA, 14 bp, Homo sapiens
aagaacttgctgct

SEQ ID NO: 1528893 - DNA, 24 bp, Homo sapiens
aagaactttaaagctcaggagggt

SEQ ID NO: 1528894 - DNA, 12 bp, Homo sapiens
aagaagaaaaag

SEQ ID NO: 1528895 - DNA, 13 bp, Homo sapiens
aagaagaaagcaa

SEQ ID NO: 1528896 - DNA, 12 bp, Homo sapiens
aagaagacattt

SEQ ID NO: 1528897 - DNA, 13 bp, Homo sapiens
aagaagacatttt

SEQ ID NO: 1528898 - DNA, 19 bp, Homo sapiens
aagaagagcgagagatcaa

SEQ ID NO: 1528899 - DNA, 14 bp, Homo sapiens
aagaagaggagcct

SEQ ID NO: 1528900 - DNA, 15 bp, Homo sapiens
aagaagaggagcctc

SEQ ID NO: 1528901 - DNA, 12 bp, Homo sapiens
aagaagatgagc

SEQ ID NO: 1528902 - DNA, 14 bp, Homo sapiens
aagaagatgagcct

SEQ ID NO: 1528903 - DNA, 17 bp, Homo sapiens
aagaagattcaagagga

SEQ ID NO: 1528904 - DNA, 14 bp, Homo sapiens
aagaagcaaatttt

SEQ ID NO: 1528905 - DNA, 18 bp, Homo sapiens
aagaagcaatctttgaaa

SEQ ID NO: 1528906 - DNA, 15 bp, Homo sapiens
aagaagcccccagct

SEQ ID NO: 1528907 - DNA, 16 bp, Homo sapiens
aagaagcccccagcta

SEQ ID NO: 1528908 - DNA, 19 bp, Homo sapiens
aagaagcccccagctaaga

SEQ ID NO: 1528909 - DNA, 17 bp, Homo sapiens
aagaagcctgcaggaga

SEQ ID NO: 1528910 - DNA, 22 bp, Homo sapiens
aagaagcctgtaacactcctct

SEQ ID NO: 1528911 - DNA, 16 bp, Homo sapiens
aagaagccttaatttg

SEQ ID NO: 1528912 - DNA, 19 bp, Homo sapiens
aagaagccttaatttgcac

SEQ ID NO: 1528913 - DNA, 15 bp, Homo sapiens
aagaagctgtgaata

SEQ ID NO: 1528914 - DNA, 14 bp, Homo sapiens
aagaagcttccaca

SEQ ID NO: 1528915 - DNA, 16 bp, Homo sapiens
aagaaggaaaatgatc

SEQ ID NO: 1528916 - DNA, 14 bp, Homo sapiens
aagaaggcaatatt

SEQ ID NO: 1528917 - DNA, 22 bp, Homo sapiens
aagaaggcaattttagtgtatt

SEQ ID NO: 1528918 - DNA, 17 bp, Homo sapiens
aagaagggagaagaaag

SEQ ID NO: 1528919 - DNA, 20 bp, Homo sapiens
aagaagggctgcatgatgtt

SEQ ID NO: 1528920 - DNA, 18 bp, Homo sapiens
aagaagggggccctgcta

SEQ ID NO: 1528921 - DNA, 14 bp, Homo sapiens
aagaagggggtggg

SEQ ID NO: 1528922 - DNA, 17 bp, Homo sapiens
aagaagggggtgggggg

SEQ ID NO: 1528923 - DNA, 15 bp, Homo sapiens
aagaagtaggcatga

SEQ ID NO: 1528924 - DNA, 18 bp, Homo sapiens
aagaagtcggaatgtcat

SEQ ID NO: 1528925 - DNA, 18 bp, Homo sapiens
aagaagtgtccgagaact

SEQ ID NO: 1528926 - DNA, 19 bp, Homo sapiens
aagaagtgtgtcaccctta

SEQ ID NO: 1528927 - DNA, 14 bp, Homo sapiens
aagaagtttgttat

SEQ ID NO: 1528928 - DNA, 19 bp, Homo sapiens
aagaagtttttctttgtgt

SEQ ID NO: 1528929 - DNA, 21 bp, Homo sapiens
aagaataatatgctgccaaat

SEQ ID NO: 1528930 - DNA, 22 bp, Homo sapiens
aagaataattcaattttaaaga

SEQ ID NO: 1528931 - DNA, 16 bp, Homo sapiens
aagaataattttggaa

SEQ ID NO: 1528932 - DNA, 14 bp, Homo sapiens
aagaatacagaaag

SEQ ID NO: 1528933 - DNA, 15 bp, Homo sapiens
aagaatacatcagaa

SEQ ID NO: 1528934 - DNA, 11 bp, Homo sapiens
aagaatagaac

SEQ ID NO: 1528935 - DNA, 19 bp, Homo sapiens
aagaatatcctttaaaatt

SEQ ID NO: 1528936 - DNA, 21 bp, Homo sapiens
aagaatatcctttaaaattta

SEQ ID NO: 1528937 - DNA, 16 bp, Homo sapiens
aagaatatctggcaaa

SEQ ID NO: 1528938 - DNA, 13 bp, Homo sapiens
aagaatattgtat

SEQ ID NO: 1528939 - DNA, 13 bp, Homo sapiens
aagaatattttaa

SEQ ID NO: 1528940 - DNA, 21 bp, Homo sapiens
aagaatatttttagactattt

SEQ ID NO: 1528941 - DNA, 17 bp, Homo sapiens
aagaatccacatttcta

SEQ ID NO: 1528942 - DNA, 18 bp, Homo sapiens
aagaatccacatttctaa

SEQ ID NO: 1528943 - DNA, 21 bp, Homo sapiens
aagaatccttatctataaaag

SEQ ID NO: 1528944 - DNA, 23 bp, Homo sapiens
aagaatccttatctataaaaggt

SEQ ID NO: 1528945 - DNA, 17 bp, Homo sapiens
aagaatctagaagatgt

SEQ ID NO: 1528946 - DNA, 19 bp, Homo sapiens
aagaatctagaagatgtgt

SEQ ID NO: 1528947 - DNA, 16 bp, Homo sapiens
aagaatctatctgctt

SEQ ID NO: 1528948 - DNA, 19 bp, Homo sapiens
aagaatctatctgcttatg

SEQ ID NO: 1528949 - DNA, 19 bp, Homo sapiens
aagaatgaaaaatataatg

SEQ ID NO: 1528950 - DNA, 22 bp, Homo sapiens
aagaatgaaaaatataatgttg

SEQ ID NO: 1528951 - DNA, 18 bp, Homo sapiens
aagaatgaaggtttttgt

SEQ ID NO: 1528952 - DNA, 23 bp, Homo sapiens
aagaatgaaggtttttgtaaaga

SEQ ID NO: 1528953 - DNA, 19 bp, Homo sapiens
aagaatgcacaagaatgga

SEQ ID NO: 1528954 - DNA, 23 bp, Homo sapiens
aagaatgcagattcctgggcctg

SEQ ID NO: 1528955 - DNA, 19 bp, Homo sapiens
aagaatgctggttttccta

SEQ ID NO: 1528956 - DNA, 15 bp, Homo sapiens
aagaatgctttgcca

SEQ ID NO: 1528957 - DNA, 17 bp, Homo sapiens
aagaatgtccttattct

SEQ ID NO: 1528958 - DNA, 15 bp, Homo sapiens
aagaatgtttctgga

SEQ ID NO: 1528959 - DNA, 19 bp, Homo sapiens
aagaattaagatacaaatt

SEQ ID NO: 1528960 - DNA, 12 bp, Homo sapiens
aagaattaatga

SEQ ID NO: 1528961 - DNA, 12 bp, Homo sapiens
aagaattacagt

SEQ ID NO: 1528962 - DNA, 13 bp, Homo sapiens
aagaattacagta

SEQ ID NO: 1528963 - DNA, 14 bp, Homo sapiens
aagaattacagtac

SEQ ID NO: 1528964 - DNA, 19 bp, Homo sapiens
aagaattctgattgatttg

SEQ ID NO: 1528965 - DNA, 15 bp, Homo sapiens
aagaattgaaaagtt

SEQ ID NO: 1528966 - DNA, 18 bp, Homo sapiens
aagaattgaaaagttttt

SEQ ID NO: 1528967 - DNA, 19 bp, Homo sapiens
aagaattgaacccaggagg

SEQ ID NO: 1528968 - DNA, 15 bp, Homo sapiens
aagaattgagtaatg

SEQ ID NO: 1528969 - DNA, 16 bp, Homo sapiens
aagaattgagtaatgg

SEQ ID NO: 1528970 - DNA, 21 bp, Homo sapiens
aagaattggccatcttaaaaa

SEQ ID NO: 1528971 - DNA, 14 bp, Homo sapiens
aagaatttcacaag

SEQ ID NO: 1528972 - DNA, 17 bp, Homo sapiens
aagaattttatttttct

SEQ ID NO: 1528973 - DNA, 20 bp, Homo sapiens
aagaatttttcattctcaga

SEQ ID NO: 1528974 - DNA, 20 bp, Homo sapiens
aagacaaagtgtgtaattat

SEQ ID NO: 1528975 - DNA, 13 bp, Homo sapiens
aagacaaataaat

SEQ ID NO: 1528976 - DNA, 21 bp, Homo sapiens
aagacaaataaatgattatat

SEQ ID NO: 1528977 - DNA, 18 bp, Homo sapiens
aagacaagtatgaatatt

SEQ ID NO: 1528978 - DNA, 23 bp, Homo sapiens
aagacaagtatgaatattactct

SEQ ID NO: 1528979 - DNA, 18 bp, Homo sapiens
aagacaataattacattg

SEQ ID NO: 1528980 - DNA, 19 bp, Homo sapiens
aagacaatttgatacataa

SEQ ID NO: 1528981 - DNA, 20 bp, Homo sapiens
aagacaatttgatacataat

SEQ ID NO: 1528982 - DNA, 17 bp, Homo sapiens
aagacacagcctccccc

SEQ ID NO: 1528983 - DNA, 21 bp, Homo sapiens
aagacaccttctgagtattct

SEQ ID NO: 1528984 - DNA, 12 bp, Homo sapiens
aagacactgcct

SEQ ID NO: 1528985 - DNA, 13 bp, Homo sapiens
aagacactgcctg

SEQ ID NO: 1528986 - DNA, 14 bp, Homo sapiens
aagacactgcctgg

SEQ ID NO: 1528987 - DNA, 13 bp, Homo sapiens
aagacagaaaagt

SEQ ID NO: 1528988 - DNA, 20 bp, Homo sapiens
aagacagaaaagtgcctgag

SEQ ID NO: 1528989 - DNA, 16 bp, Homo sapiens
aagacagagacgcagg

SEQ ID NO: 1528990 - DNA, 19 bp, Homo sapiens
aagacagagcaaagcgccc

SEQ ID NO: 1528991 - DNA, 12 bp, Homo sapiens
aagacatcaatg

SEQ ID NO: 1528992 - DNA, 16 bp, Homo sapiens
aagacatcagtctcca

SEQ ID NO: 1528993 - DNA, 16 bp, Homo sapiens
aagacatgtctgttct

SEQ ID NO: 1528994 - DNA, 19 bp, Homo sapiens
aagacatgtctgttctaca

SEQ ID NO: 1528995 - DNA, 23 bp, Homo sapiens
aagacatgtgaggaggaaaagga

SEQ ID NO: 1528996 - DNA, 21 bp, Homo sapiens
aagacattcttccaaaaagat

SEQ ID NO: 1528997 - DNA, 14 bp, Homo sapiens
aagacatttccttt

SEQ ID NO: 1528998 - DNA, 11 bp, Homo sapiens
aagacatttct

SEQ ID NO: 1528999 - DNA, 11 bp, Homo sapiens
aagacatttgt

SEQ ID NO: 1529000 - DNA, 17 bp, Homo sapiens
aagacatttgtatattg

SEQ ID NO: 1529001 - DNA, 13 bp, Homo sapiens
aagacattttgtt

SEQ ID NO: 1529002 - DNA, 20 bp, Homo sapiens
aagacattttgttacataag

SEQ ID NO: 1529003 - DNA, 19 bp, Homo sapiens
aagaccaaaatgacaatga

SEQ ID NO: 1529004 - DNA, 21 bp, Homo sapiens
aagaccagaattcccttgaat

SEQ ID NO: 1529005 - DNA, 22 bp, Homo sapiens
aagaccagaattcccttgaatt

SEQ ID NO: 1529006 - DNA, 17 bp, Homo sapiens
aagaccagcctgtccaa

SEQ ID NO: 1529007 - DNA, 15 bp, Homo sapiens
aagaccaggctgcag

SEQ ID NO: 1529008 - DNA, 13 bp, Homo sapiens
aagaccccaccca

SEQ ID NO: 1529009 - DNA, 16 bp, Homo sapiens
aagaccccacccaagc

SEQ ID NO: 1529010 - DNA, 22 bp, Homo sapiens
aagaccccacccaagcttggca

SEQ ID NO: 1529011 - DNA, 13 bp, Homo sapiens
aagaccccatctc

SEQ ID NO: 1529012 - DNA, 13 bp, Homo sapiens
aagaccctgtctc

SEQ ID NO: 1529013 - DNA, 17 bp, Homo sapiens
aagaccgccccagggct

SEQ ID NO: 1529014 - DNA, 18 bp, Homo sapiens
aagacctactgttctaaa

SEQ ID NO: 1529015 - DNA, 22 bp, Homo sapiens
aagacctactgttctaaagctc

SEQ ID NO: 1529016 - DNA, 16 bp, Homo sapiens
aagacctcatctgtgg

SEQ ID NO: 1529017 - DNA, 20 bp, Homo sapiens
aagacctcatctgtggagct

SEQ ID NO: 1529018 - DNA, 19 bp, Homo sapiens
aagacctcttccctctggg

SEQ ID NO: 1529019 - DNA, 17 bp, Homo sapiens
aagacctggcagctctg

SEQ ID NO: 1529020 - DNA, 21 bp, Homo sapiens
aagaccttctccaaatgagat

SEQ ID NO: 1529021 - DNA, 19 bp, Homo sapiens
aagacctttattcacccct

SEQ ID NO: 1529022 - DNA, 23 bp, Homo sapiens
aagacctttattcacccctgccc

SEQ ID NO: 1529023 - DNA, 14 bp, Homo sapiens
aagacgaggggcag

SEQ ID NO: 1529024 - DNA, 15 bp, Homo sapiens
aagacggaaaacaat

SEQ ID NO: 1529025 - DNA, 12 bp, Homo sapiens
aagacggaggag

SEQ ID NO: 1529026 - DNA, 22 bp, Homo sapiens
aagacggaggaggggaaggggc

SEQ ID NO: 1529027 - DNA, 15 bp, Homo sapiens
aagacgggtattgtt

SEQ ID NO: 1529028 - DNA, 22 bp, Homo sapiens
aagacgtaaagaattttcatcc

SEQ ID NO: 1529029 - DNA, 18 bp, Homo sapiens
aagacgtggactcctctt

SEQ ID NO: 1529030 - DNA, 20 bp, Homo sapiens
aagacgtggactcctcttgg

SEQ ID NO: 1529031 - DNA, 13 bp, Homo sapiens
aagactacctggg

SEQ ID NO: 1529032 - DNA, 13 bp, Homo sapiens
aagactattcaaa

SEQ ID NO: 1529033 - DNA, 14 bp, Homo sapiens
aagactcagtgttc

SEQ ID NO: 1529034 - DNA, 17 bp, Homo sapiens
aagactccaaagaaatg

SEQ ID NO: 1529035 - DNA, 12 bp, Homo sapiens
aagactccagta

SEQ ID NO: 1529036 - DNA, 15 bp, Homo sapiens
aagactctagagtcc

SEQ ID NO: 1529037 - DNA, 22 bp, Homo sapiens
aagactctggaggtcatctggc

SEQ ID NO: 1529038 - DNA, 19 bp, Homo sapiens
aagactgaacatgtttaca

SEQ ID NO: 1529039 - DNA, 22 bp, Homo sapiens
aagactgcagaacccccaggtg

SEQ ID NO: 1529040 - DNA, 15 bp, Homo sapiens
aagactgccaggtgg

SEQ ID NO: 1529041 - DNA, 16 bp, Homo sapiens
aagactgtacaaagta

SEQ ID NO: 1529042 - DNA, 17 bp, Homo sapiens
aagactgtgcagaagac

SEQ ID NO: 1529043 - DNA, 19 bp, Homo sapiens
aagactgtggaaatgccaa

SEQ ID NO: 1529044 - DNA, 24 bp, Homo sapiens
aagacttaaagggcccaatgaatt

SEQ ID NO: 1529045 - DNA, 15 bp, Homo sapiens
aagacttactctaag

SEQ ID NO: 1529046 - DNA, 19 bp, Homo sapiens
aagacttccaccctggaga

SEQ ID NO: 1529047 - DNA, 17 bp, Homo sapiens
aagagaaaaagaaatgc

SEQ ID NO: 1529048 - DNA, 23 bp, Homo sapiens
aagagaaaaaggctgaaaagaag

SEQ ID NO: 1529049 - DNA, 16 bp, Homo sapiens
aagagaaagaggccag

SEQ ID NO: 1529050 - DNA, 12 bp, Homo sapiens
aagagaaatttt

SEQ ID NO: 1529051 - DNA, 21 bp, Homo sapiens
aagagaaccgagcaaagatca

SEQ ID NO: 1529052 - DNA, 22 bp, Homo sapiens
aagagaaccgagcaaagatcaa

SEQ ID NO: 1529053 - DNA, 20 bp, Homo sapiens
aagagaagagggcccagccc

SEQ ID NO: 1529054 - DNA, 21 bp, Homo sapiens
aagagaagagggcccagccca

SEQ ID NO: 1529055 - DNA, 21 bp, Homo sapiens
aagagaaggtggacctggcag

SEQ ID NO: 1529056 - DNA, 17 bp, Homo sapiens
aagagaagtctcattcg

SEQ ID NO: 1529057 - DNA, 14 bp, Homo sapiens
aagagaagttattt

SEQ ID NO: 1529058 - DNA, 16 bp, Homo sapiens
aagagaatgagtcctt

SEQ ID NO: 1529059 - DNA, 19 bp, Homo sapiens
aagagacaaagatttcttc

SEQ ID NO: 1529060 - DNA, 16 bp, Homo sapiens
aagagacagcccagga

SEQ ID NO: 1529061 - DNA, 14 bp, Homo sapiens
aagagagaaaataa

SEQ ID NO: 1529062 - DNA, 15 bp, Homo sapiens
aagagagaagccagc

SEQ ID NO: 1529063 - DNA, 21 bp, Homo sapiens
aagagagagagagagaaagaa

SEQ ID NO: 1529064 - DNA, 15 bp, Homo sapiens
aagagagatgttttg

SEQ ID NO: 1529065 - DNA, 16 bp, Homo sapiens
aagagagggacaggca

SEQ ID NO: 1529066 - DNA, 22 bp, Homo sapiens
aagagagtatttttatacaaac

SEQ ID NO: 1529067 - DNA, 14 bp, Homo sapiens
aagagagtcataaa

SEQ ID NO: 1529068 - DNA, 17 bp, Homo sapiens
aagagagttaaaagcag

SEQ ID NO: 1529069 - DNA, 13 bp, Homo sapiens
aagagatagagac

SEQ ID NO: 1529070 - DNA, 23 bp, Homo sapiens
aagagatctgtgtggctcctggg

SEQ ID NO: 1529071 - DNA, 13 bp, Homo sapiens
aagagatgaagag

SEQ ID NO: 1529072 - DNA, 20 bp, Homo sapiens
aagagatgggcttgttttct

SEQ ID NO: 1529073 - DNA, 13 bp, Homo sapiens
aagagattcgaat

SEQ ID NO: 1529074 - DNA, 15 bp, Homo sapiens
aagagatttcaagag

SEQ ID NO: 1529075 - DNA, 14 bp, Homo sapiens
aagagcaaatcaat

SEQ ID NO: 1529076 - DNA, 13 bp, Homo sapiens
aagagcacactgc

SEQ ID NO: 1529077 - DNA, 12 bp, Homo sapiens
aagagcagcctg

SEQ ID NO: 1529078 - DNA, 13 bp, Homo sapiens
aagagcagcctga

SEQ ID NO: 1529079 - DNA, 17 bp, Homo sapiens
aagagcagcctgtggca

SEQ ID NO: 1529080 - DNA, 22 bp, Homo sapiens
aagagcatcagtacttgtttct

SEQ ID NO: 1529081 - DNA, 11 bp, Homo sapiens
aagagccacct

SEQ ID NO: 1529082 - DNA, 14 bp, Homo sapiens
aagagccacctgca

SEQ ID NO: 1529083 - DNA, 18 bp, Homo sapiens
aagagccacctgcaagat

SEQ ID NO: 1529084 - DNA, 20 bp, Homo sapiens
aagagccatataagtttgaa

SEQ ID NO: 1529085 - DNA, 18 bp, Homo sapiens
aagagcccagtctgttga

SEQ ID NO: 1529086 - DNA, 23 bp, Homo sapiens
aagagcccagtctgttgagttag

SEQ ID NO: 1529087 - DNA, 13 bp, Homo sapiens
aagagcccttgcc

SEQ ID NO: 1529088 - DNA, 18 bp, Homo sapiens
aagagcccttgcctcccc

SEQ ID NO: 1529089 - DNA, 15 bp, Homo sapiens
aagagccggtggtgc

SEQ ID NO: 1529090 - DNA, 17 bp, Homo sapiens
aagagccggtggtgccc

SEQ ID NO: 1529091 - DNA, 21 bp, Homo sapiens
aagagccttggtgtccacctg

SEQ ID NO: 1529092 - DNA, 15 bp, Homo sapiens
aagagcctttccaaa

SEQ ID NO: 1529093 - DNA, 20 bp, Homo sapiens
aagagctagaaaaataaaat

SEQ ID NO: 1529094 - DNA, 16 bp, Homo sapiens
aagagctagcgctgcc

SEQ ID NO: 1529095 - DNA, 17 bp, Homo sapiens
aagagctcagacatttt

SEQ ID NO: 1529096 - DNA, 23 bp, Homo sapiens
aagagctcccctccacagctgca

SEQ ID NO: 1529097 - DNA, 13 bp, Homo sapiens
aagagctgcctgg

SEQ ID NO: 1529098 - DNA, 13 bp, Homo sapiens
aagagctgctgtc

SEQ ID NO: 1529099 - DNA, 19 bp, Homo sapiens
aagagctgttcacagccag

SEQ ID NO: 1529100 - DNA, 14 bp, Homo sapiens
aagagcttaagaac

SEQ ID NO: 1529101 - DNA, 13 bp, Homo sapiens
aagagcttagaaa

SEQ ID NO: 1529102 - DNA, 21 bp, Homo sapiens
aagagcttagaaactggaaat

SEQ ID NO: 1529103 - DNA, 12 bp, Homo sapiens
aagagctttcct

SEQ ID NO: 1529104 - DNA, 20 bp, Homo sapiens
aagaggagcagagggcaggg

SEQ ID NO: 1529105 - DNA, 11 bp, Homo sapiens
aagaggagcct

SEQ ID NO: 1529106 - DNA, 20 bp, Homo sapiens
aagaggaggggaagaggcct

SEQ ID NO: 1529107 - DNA, 16 bp, Homo sapiens
aagaggcatcttttct

SEQ ID NO: 1529108 - DNA, 15 bp, Homo sapiens
aagaggccaatgccc

SEQ ID NO: 1529109 - DNA, 21 bp, Homo sapiens
aacttgaatttggtctgtata

SEQ ID NO: 1529110 - DNA, 22 bp, Homo sapiens
aacttgaccctgagcttaaata

SEQ ID NO: 1529111 - DNA, 12 bp, Homo sapiens
aacttgatatag

SEQ ID NO: 1529112 - DNA, 15 bp, Homo sapiens
aacttgatcacatgc

SEQ ID NO: 1529113 - DNA, 12 bp, Homo sapiens
aacttgatgttc

SEQ ID NO: 1529114 - DNA, 19 bp, Homo sapiens
aacttgatgttccacctgc

SEQ ID NO: 1529115 - DNA, 13 bp, Homo sapiens
aacttgattatat

SEQ ID NO: 1529116 - DNA, 10 bp, Homo sapiens
aacttgcatc

SEQ ID NO: 1529117 - DNA, 14 bp, Homo sapiens
aacttgcatcactt

SEQ ID NO: 1529118 - DNA, 21 bp, Homo sapiens
aacttgcatccaactccagga

SEQ ID NO: 1529119 - DNA, 15 bp, Homo sapiens
aacttgcatggagca

SEQ ID NO: 1529120 - DNA, 11 bp, Homo sapiens
aacttgccttt

SEQ ID NO: 1529121 - DNA, 15 bp, Homo sapiens
aacttgcctttgaag

SEQ ID NO: 1529122 - DNA, 16 bp, Homo sapiens
aacttgctgaatttca

SEQ ID NO: 1529123 - DNA, 20 bp, Homo sapiens
aacttgctgaatttcaggca

SEQ ID NO: 1529124 - DNA, 14 bp, Homo sapiens
aacttgctgctgcc

SEQ ID NO: 1529125 - DNA, 18 bp, Homo sapiens
aacttgcttaaatttctt

SEQ ID NO: 1529126 - DNA, 20 bp, Homo sapiens
aacttggaagggggagacag

SEQ ID NO: 1529127 - DNA, 17 bp, Homo sapiens
aacttggatgagttttg

SEQ ID NO: 1529128 - DNA, 14 bp, Homo sapiens
aacttggattctct

SEQ ID NO: 1529129 - DNA, 21 bp, Homo sapiens
aacttggcatttctatacttt

SEQ ID NO: 1529130 - DNA, 23 bp, Homo sapiens
aacttggccctcttgcgggcctg

SEQ ID NO: 1529131 - DNA, 21 bp, Homo sapiens
aacttggctcgaatctctgtg

SEQ ID NO: 1529132 - DNA, 11 bp, Homo sapiens
aacttgggagt

SEQ ID NO: 1529133 - DNA, 15 bp, Homo sapiens
aacttggggaggcaa

SEQ ID NO: 1529134 - DNA, 16 bp, Homo sapiens
aacttggttctgcttc

SEQ ID NO: 1529135 - DNA, 21 bp, Homo sapiens
aacttgtaaaaagggggctgc

SEQ ID NO: 1529136 - DNA, 22 bp, Homo sapiens
aacttgtaaaaagggggctgca

SEQ ID NO: 1529137 - DNA, 14 bp, Homo sapiens
aacttgtaaataca

SEQ ID NO: 1529138 - DNA, 14 bp, Homo sapiens
aacttgtagcagct

SEQ ID NO: 1529139 - DNA, 15 bp, Homo sapiens
aacttgtatttccaa

SEQ ID NO: 1529140 - DNA, 20 bp, Homo sapiens
aacttgtcaaaaaacaaaaa

SEQ ID NO: 1529141 - DNA, 16 bp, Homo sapiens
aacttgtgagcatcag

SEQ ID NO: 1529142 - DNA, 21 bp, Homo sapiens
aacttgtgtactgataaaata

SEQ ID NO: 1529143 - DNA, 18 bp, Homo sapiens
aacttgttactaaagaaa

SEQ ID NO: 1529144 - DNA, 17 bp, Homo sapiens
aacttgtttgctgtgaa

SEQ ID NO: 1529145 - DNA, 14 bp, Homo sapiens
aactttaatacagc

SEQ ID NO: 1529146 - DNA, 16 bp, Homo sapiens
aactttaatcaagttg

SEQ ID NO: 1529147 - DNA, 11 bp, Homo sapiens
aactttactgt

SEQ ID NO: 1529148 - DNA, 14 bp, Homo sapiens
aactttagacttcc

SEQ ID NO: 1529149 - DNA, 15 bp, Homo sapiens
aactttataaatcca

SEQ ID NO: 1529150 - DNA, 21 bp, Homo sapiens
aactttatcacattatttgca

SEQ ID NO: 1529151 - DNA, 14 bp, Homo sapiens
aactttatcactta

SEQ ID NO: 1529152 - DNA, 15 bp, Homo sapiens
aactttcaattgtca

SEQ ID NO: 1529153 - DNA, 17 bp, Homo sapiens
aactttcatttttttcc

SEQ ID NO: 1529154 - DNA, 23 bp, Homo sapiens
aactttcccaggttctgtttatg

SEQ ID NO: 1529155 - DNA, 17 bp, Homo sapiens
aactttgagtacagata

SEQ ID NO: 1529156 - DNA, 21 bp, Homo sapiens
aactttgcagcataccaatta

SEQ ID NO: 1529157 - DNA, 19 bp, Homo sapiens
aactttggaaccagactct

SEQ ID NO: 1529158 - DNA, 17 bp, Homo sapiens
aactttggcaacatctt

SEQ ID NO: 1529159 - DNA, 21 bp, Homo sapiens
aactttggcaacatcttggct

SEQ ID NO: 1529160 - DNA, 18 bp, Homo sapiens
aactttgtaaaaatcttt

SEQ ID NO: 1529161 - DNA, 15 bp, Homo sapiens
aacttttaaagaaaa

SEQ ID NO: 1529162 - DNA, 19 bp, Homo sapiens
aacttttctaacagaaagc

SEQ ID NO: 1529163 - DNA, 19 bp, Homo sapiens
aacttttgtactgaatttt

SEQ ID NO: 1529164 - DNA, 20 bp, Homo sapiens
aacttttgtgtaatgaaaat

SEQ ID NO: 1529165 - DNA, 20 bp, Homo sapiens
aacttttgtttagagccctc

SEQ ID NO: 1529166 - DNA, 14 bp, Homo sapiens
aactttttcctggc

SEQ ID NO: 1529167 - DNA, 23 bp, Homo sapiens
aactttttgttctggtccttttt

SEQ ID NO: 1529168 - DNA, 12 bp, Homo sapiens
aacttttttggt

SEQ ID NO: 1529169 - DNA, 13 bp, Homo sapiens
aacttttttgtgt

SEQ ID NO: 1529170 - DNA, 19 bp, Homo sapiens
aacttttttgtgtatgtac

SEQ ID NO: 1529171 - DNA, 22 bp, Homo sapiens
aactttttttctgtaccagtta

SEQ ID NO: 1529172 - DNA, 18 bp, Homo sapiens
aacttttttttctctctt

SEQ ID NO: 1529173 - DNA, 15 bp, Homo sapiens
aagaaaaaaaaaaga

SEQ ID NO: 1529174 - DNA, 16 bp, Homo sapiens
aagaaaaaaaaaatat

SEQ ID NO: 1529175 - DNA, 20 bp, Homo sapiens
aagaaaaaaaataacacaga

SEQ ID NO: 1529176 - DNA, 22 bp, Homo sapiens
aagaaaaaaatactatttaaga

SEQ ID NO: 1529177 - DNA, 13 bp, Homo sapiens
aagaaaaacatgt

SEQ ID NO: 1529178 - DNA, 14 bp, Homo sapiens
aagaaaaatcatgt

SEQ ID NO: 1529179 - DNA, 22 bp, Homo sapiens
aagaaaaatcatgtttgctctc

SEQ ID NO: 1529180 - DNA, 15 bp, Homo sapiens
aagaaaacaaagttc

SEQ ID NO: 1529181 - DNA, 13 bp, Homo sapiens
aagaaaacactgt

SEQ ID NO: 1529182 - DNA, 12 bp, Homo sapiens
aagaaaacagta

SEQ ID NO: 1529183 - DNA, 15 bp, Homo sapiens
aagaaaacagtacag

SEQ ID NO: 1529184 - DNA, 16 bp, Homo sapiens
aagaaaacatctattc

SEQ ID NO: 1529185 - DNA, 18 bp, Homo sapiens
aagaaaacatctattctc

SEQ ID NO: 1529186 - DNA, 14 bp, Homo sapiens
aagaaaacttttgt

SEQ ID NO: 1529187 - DNA, 13 bp, Homo sapiens
aagaaaagacctt

SEQ ID NO: 1529188 - DNA, 22 bp, Homo sapiens
aagaaaagcagacgcagcagct

SEQ ID NO: 1529189 - DNA, 18 bp, Homo sapiens
aagaaaagcattttcagt

SEQ ID NO: 1529190 - DNA, 24 bp, Homo sapiens
aagaaaagcattttcagtcttgta

SEQ ID NO: 1529191 - DNA, 12 bp, Homo sapiens
aagaaaataacc

SEQ ID NO: 1529192 - DNA, 18 bp, Homo sapiens
aagaaaatacaataaact

SEQ ID NO: 1529193 - DNA, 23 bp, Homo sapiens
aagaaaatcagatggagcatgaa

SEQ ID NO: 1529194 - DNA, 12 bp, Homo sapiens
aagaaaatgaag

SEQ ID NO: 1529195 - DNA, 16 bp, Homo sapiens
aagaaaatggctaata

SEQ ID NO: 1529196 - DNA, 14 bp, Homo sapiens
aagaaaattgagtt

SEQ ID NO: 1529197 - DNA, 14 bp, Homo sapiens
aagaaacaaagatg

SEQ ID NO: 1529198 - DNA, 13 bp, Homo sapiens
aagaaacaagctg

SEQ ID NO: 1529199 - DNA, 21 bp, Homo sapiens
aagaaaccaagtgcgctttgc

SEQ ID NO: 1529200 - DNA, 13 bp, Homo sapiens
aagaaactgaata

SEQ ID NO: 1529201 - DNA, 16 bp, Homo sapiens
aagaaactgaggaatt

SEQ ID NO: 1529202 - DNA, 15 bp, Homo sapiens
aagaaactggtccat

SEQ ID NO: 1529203 - DNA, 18 bp, Homo sapiens
aagaaactggtccatgta

SEQ ID NO: 1529204 - DNA, 14 bp, Homo sapiens
aagaaagaaggaag

SEQ ID NO: 1529205 - DNA, 14 bp, Homo sapiens
aagaaagatgtttg

SEQ ID NO: 1529206 - DNA, 21 bp, Homo sapiens
aagaaagatttgttactgtat

SEQ ID NO: 1529207 - DNA, 13 bp, Homo sapiens
aagaaagcagaat

SEQ ID NO: 1529208 - DNA, 16 bp, Homo sapiens
aagaaagcatagacat

SEQ ID NO: 1529209 - DNA, 20 bp, Homo sapiens
aagaaaggaagcattgtaaa

SEQ ID NO: 1529210 - DNA, 14 bp, Homo sapiens
aagaaagtctatgc

SEQ ID NO: 1529211 - DNA, 16 bp, Homo sapiens
aagaaagtctatgctt

SEQ ID NO: 1529212 - DNA, 17 bp, Homo sapiens
aagaaagtgggaggtca

SEQ ID NO: 1529213 - DNA, 23 bp, Homo sapiens
aagaaagtgggaggtcaggaaac

SEQ ID NO: 1529214 - DNA, 15 bp, Homo sapiens
aagaaagtgtatttg

SEQ ID NO: 1529215 - DNA, 16 bp, Homo sapiens
aagaaagttctacagt

SEQ ID NO: 1529216 - DNA, 19 bp, Homo sapiens
aagaaataatgctacaatt

SEQ ID NO: 1529217 - DNA, 13 bp, Homo sapiens
aagaaatagcaga

SEQ ID NO: 1529218 - DNA, 18 bp, Homo sapiens
aagaaatcacagaatcat

SEQ ID NO: 1529219 - DNA, 22 bp, Homo sapiens
aagaaatgattcaaattgctgc

SEQ ID NO: 1529220 - DNA, 11 bp, Homo sapiens
aagaaatggcg

SEQ ID NO: 1529221 - DNA, 22 bp, Homo sapiens
aagaaatggcgtctgctctggt

SEQ ID NO: 1529222 - DNA, 13 bp, Homo sapiens
aagaaatgtaagg

SEQ ID NO: 1529223 - DNA, 20 bp, Homo sapiens
aagaaattcaggtacagaaa

SEQ ID NO: 1529224 - DNA, 23 bp, Homo sapiens
aagaaattccatacttctctcag

SEQ ID NO: 1529225 - DNA, 12 bp, Homo sapiens
aagaacaaacac

SEQ ID NO: 1529226 - DNA, 14 bp, Homo sapiens
aagaacaacggcaa

SEQ ID NO: 1529227 - DNA, 17 bp, Homo sapiens
aactgcctaaggccctt

SEQ ID NO: 1529228 - DNA, 20 bp, Homo sapiens
aactgcctactccaaaatgt

SEQ ID NO: 1529229 - DNA, 15 bp, Homo sapiens
aactgcctctttcct

SEQ ID NO: 1529230 - DNA, 20 bp, Homo sapiens
aactgcgaggacatcaaagt

SEQ ID NO: 1529231 - DNA, 19 bp, Homo sapiens
aactgctaatctactttct

SEQ ID NO: 1529232 - DNA, 12 bp, Homo sapiens
aactgctgagcc

SEQ ID NO: 1529233 - DNA, 22 bp, Homo sapiens
aactgcttcccttactttgctg

SEQ ID NO: 1529234 - DNA, 14 bp, Homo sapiens
aactgcttcttgga

SEQ ID NO: 1529235 - DNA, 16 bp, Homo sapiens
aactgcttttcctcaa

SEQ ID NO: 1529236 - DNA, 22 bp, Homo sapiens
aactgcttttcctcaagcaata

SEQ ID NO: 1529237 - DNA, 22 bp, Homo sapiens
aactgcttttttttttccagca

SEQ ID NO: 1529238 - DNA, 21 bp, Homo sapiens
aactggaaaacagaacactta

SEQ ID NO: 1529239 - DNA, 17 bp, Homo sapiens
aactggacctgtatatt

SEQ ID NO: 1529240 - DNA, 15 bp, Homo sapiens
aactggactcaggat

SEQ ID NO: 1529241 - DNA, 21 bp, Homo sapiens
aactggactcaggatgcccag

SEQ ID NO: 1529242 - DNA, 22 bp, Homo sapiens
aactggactcaggatgcccagg

SEQ ID NO: 1529243 - DNA, 18 bp, Homo sapiens
aactggagcaagaaggaa

SEQ ID NO: 1529244 - DNA, 12 bp, Homo sapiens
aactggagcccc

SEQ ID NO: 1529245 - DNA, 16 bp, Homo sapiens
aactggatatttcaat

SEQ ID NO: 1529246 - DNA, 17 bp, Homo sapiens
aactggatatttcaatc

SEQ ID NO: 1529247 - DNA, 22 bp, Homo sapiens
aactggcaggggagacaggagc

SEQ ID NO: 1529248 - DNA, 17 bp, Homo sapiens
aactggcagttttccat

SEQ ID NO: 1529249 - DNA, 20 bp, Homo sapiens
aactggcatctgacacaaaa

SEQ ID NO: 1529250 - DNA, 18 bp, Homo sapiens
aactggcccgtggagact

SEQ ID NO: 1529251 - DNA, 14 bp, Homo sapiens
aactggctacagta

SEQ ID NO: 1529252 - DNA, 22 bp, Homo sapiens
aactggcttgtacatttttaaa

SEQ ID NO: 1529253 - DNA, 15 bp, Homo sapiens
aactgggctgggcct

SEQ ID NO: 1529254 - DNA, 20 bp, Homo sapiens
aactggggttcaagcccagg

SEQ ID NO: 1529255 - DNA, 22 bp, Homo sapiens
aactgggtcatcatttgtcctg

SEQ ID NO: 1529256 - DNA, 15 bp, Homo sapiens
aactgggtgactgga

SEQ ID NO: 1529257 - DNA, 21 bp, Homo sapiens
aactgggttaaatattttgct

SEQ ID NO: 1529258 - DNA, 22 bp, Homo sapiens
aactggtattctgttctggagg

SEQ ID NO: 1529259 - DNA, 23 bp, Homo sapiens
aactggttaaaaaacaaatgttc

SEQ ID NO: 1529260 - DNA, 14 bp, Homo sapiens
aactgtaaagatgt

SEQ ID NO: 1529261 - DNA, 14 bp, Homo sapiens
aactgtaaataaaa

SEQ ID NO: 1529262 - DNA, 16 bp, Homo sapiens
aactgtaaataaaatg

SEQ ID NO: 1529263 - DNA, 18 bp, Homo sapiens
aactgtaaatatgtttgt

SEQ ID NO: 1529264 - DNA, 21 bp, Homo sapiens
aactgtaaatatgtttgtgcc

SEQ ID NO: 1529265 - DNA, 11 bp, Homo sapiens
aactgtaaatc

SEQ ID NO: 1529266 - DNA, 15 bp, Homo sapiens
aactgtaattatttg

SEQ ID NO: 1529267 - DNA, 18 bp, Homo sapiens
aactgtaattatttgaat

SEQ ID NO: 1529268 - DNA, 11 bp, Homo sapiens
aactgtacatt

SEQ ID NO: 1529269 - DNA, 16 bp, Homo sapiens
aactgtagaaatgatg

SEQ ID NO: 1529270 - DNA, 19 bp, Homo sapiens
aactgtagaaatgatgatg

SEQ ID NO: 1529271 - DNA, 20 bp, Homo sapiens
aactgtagatgatgtatttt

SEQ ID NO: 1529272 - DNA, 23 bp, Homo sapiens
aactgtagcaagaactgcacggt

SEQ ID NO: 1529273 - DNA, 15 bp, Homo sapiens
aactgtagtctctga

SEQ ID NO: 1529274 - DNA, 19 bp, Homo sapiens
aactgtatcaaatctgtat

SEQ ID NO: 1529275 - DNA, 22 bp, Homo sapiens
aactgtcagtgtacacgtctgg

SEQ ID NO: 1529276 - DNA, 17 bp, Homo sapiens
aactgtcctgtcctgct

SEQ ID NO: 1529277 - DNA, 18 bp, Homo sapiens
aactgtcctgtcctgctc

SEQ ID NO: 1529278 - DNA, 14 bp, Homo sapiens
aactgtctcaaaag

SEQ ID NO: 1529279 - DNA, 22 bp, Homo sapiens
aactgtctgaatattctagaac

SEQ ID NO: 1529280 - DNA, 15 bp, Homo sapiens
aactgtcttcctcaa

SEQ ID NO: 1529281 - DNA, 16 bp, Homo sapiens
aactgtcttcctcaaa

SEQ ID NO: 1529282 - DNA, 12 bp, Homo sapiens
aactgtcttctg

SEQ ID NO: 1529283 - DNA, 23 bp, Homo sapiens
aactgtcttggctgtgagcaact

SEQ ID NO: 1529284 - DNA, 14 bp, Homo sapiens
aactgtgaaaaatc

SEQ ID NO: 1529285 - DNA, 16 bp, Homo sapiens
aactgtgaaaatagtg

SEQ ID NO: 1529286 - DNA, 20 bp, Homo sapiens
aactgtgaaaatagtgtaag

SEQ ID NO: 1529287 - DNA, 20 bp, Homo sapiens
aactgtgattcttttaggac

SEQ ID NO: 1529288 - DNA, 11 bp, Homo sapiens
aactgtggata

SEQ ID NO: 1529289 - DNA, 11 bp, Homo sapiens
aactgtggccg

SEQ ID NO: 1529290 - DNA, 20 bp, Homo sapiens
aactgtgtacataactgaaa

SEQ ID NO: 1529291 - DNA, 14 bp, Homo sapiens
aactgtgtactgtt

SEQ ID NO: 1529292 - DNA, 18 bp, Homo sapiens
aactgtgtggactgtgat

SEQ ID NO: 1529293 - DNA, 13 bp, Homo sapiens
aactgtgtggcag

SEQ ID NO: 1529294 - DNA, 19 bp, Homo sapiens
aactgttaaatgtggtttc

SEQ ID NO: 1529295 - DNA, 14 bp, Homo sapiens
aactgttacaactt

SEQ ID NO: 1529296 - DNA, 21 bp, Homo sapiens
aactgttatcacttatatata

SEQ ID NO: 1529297 - DNA, 19 bp, Homo sapiens
aactgttggctgctcccca

SEQ ID NO: 1529298 - DNA, 19 bp, Homo sapiens
aactgttgtagaagacaaa

SEQ ID NO: 1529299 - DNA, 16 bp, Homo sapiens
aactgtttccctgctg

SEQ ID NO: 1529300 - DNA, 19 bp, Homo sapiens
aactgtttccctgctgaat

SEQ ID NO: 1529301 - DNA, 13 bp, Homo sapiens
aacttaaataata

SEQ ID NO: 1529302 - DNA, 15 bp, Homo sapiens
aacttaaatgccccc

SEQ ID NO: 1529303 - DNA, 19 bp, Homo sapiens
aacttaaatgttattatct

SEQ ID NO: 1529304 - DNA, 16 bp, Homo sapiens
aacttaaattttaatt

SEQ ID NO: 1529305 - DNA, 15 bp, Homo sapiens
aacttaacatgggct

SEQ ID NO: 1529306 - DNA, 23 bp, Homo sapiens
aacttaaggtatatttagttgca

SEQ ID NO: 1529307 - DNA, 22 bp, Homo sapiens
aacttacaggtgattaacttgg

SEQ ID NO: 1529308 - DNA, 13 bp, Homo sapiens
aacttactgtata

SEQ ID NO: 1529309 - DNA, 20 bp, Homo sapiens
aacttagatcatcagtcacc

SEQ ID NO: 1529310 - DNA, 21 bp, Homo sapiens
aacttatctagaaagaaaaga

SEQ ID NO: 1529311 - DNA, 13 bp, Homo sapiens
aacttattatttt

SEQ ID NO: 1529312 - DNA, 13 bp, Homo sapiens
aacttattctgta

SEQ ID NO: 1529313 - DNA, 23 bp, Homo sapiens
aacttattctgtagattctgtgg

SEQ ID NO: 1529314 - DNA, 14 bp, Homo sapiens
aacttattttgctt

SEQ ID NO: 1529315 - DNA, 17 bp, Homo sapiens
aacttattttgctttaa

SEQ ID NO: 1529316 - DNA, 14 bp, Homo sapiens
aacttcaccacccc

SEQ ID NO: 1529317 - DNA, 15 bp, Homo sapiens
aacttcaccaccccc

SEQ ID NO: 1529318 - DNA, 21 bp, Homo sapiens
aacttcaccaccccctgtccc

SEQ ID NO: 1529319 - DNA, 22 bp, Homo sapiens
aacttcaggtgtgactctagca

SEQ ID NO: 1529320 - DNA, 16 bp, Homo sapiens
aacttcatgtaatttt

SEQ ID NO: 1529321 - DNA, 13 bp, Homo sapiens
aacttcatttgac

SEQ ID NO: 1529322 - DNA, 14 bp, Homo sapiens
aacttccaaagaaa

SEQ ID NO: 1529323 - DNA, 16 bp, Homo sapiens
aacttccaaagaaagt

SEQ ID NO: 1529324 - DNA, 17 bp, Homo sapiens
aacttccaaagaaagtt

SEQ ID NO: 1529325 - DNA, 13 bp, Homo sapiens
aacttccaattta

SEQ ID NO: 1529326 - DNA, 15 bp, Homo sapiens
aacttccacaagagt

SEQ ID NO: 1529327 - DNA, 23 bp, Homo sapiens
aacttccaggttccatccaccac

SEQ ID NO: 1529328 - DNA, 16 bp, Homo sapiens
aacttccgcctcctgt

SEQ ID NO: 1529329 - DNA, 12 bp, Homo sapiens
aacttcctgctg

SEQ ID NO: 1529330 - DNA, 19 bp, Homo sapiens
aacttcctgctgcaccctg

SEQ ID NO: 1529331 - DNA, 21 bp, Homo sapiens
aacttcctgctgcaccctgcg

SEQ ID NO: 1529332 - DNA, 23 bp, Homo sapiens
aacttccttattgggacttttct

SEQ ID NO: 1529333 - DNA, 23 bp, Homo sapiens
aacttccttggactcattttaaa

SEQ ID NO: 1529334 - DNA, 20 bp, Homo sapiens
aacttcgaaagcatcattat

SEQ ID NO: 1529335 - DNA, 18 bp, Homo sapiens
aacttctcttgaaaagtt

SEQ ID NO: 1529336 - DNA, 20 bp, Homo sapiens
aacttctgcaacaagcatgc

SEQ ID NO: 1529337 - DNA, 18 bp, Homo sapiens
aacttcttcctgtgaagt

SEQ ID NO: 1529338 - DNA, 21 bp, Homo sapiens
aacttcttctccatccctcta

SEQ ID NO: 1529339 - DNA, 18 bp, Homo sapiens
aacttcttgcttctttct

SEQ ID NO: 1529340 - DNA, 20 bp, Homo sapiens
aacttcttgcttctttctag

SEQ ID NO: 1529341 - DNA, 18 bp, Homo sapiens
aacttgaaatatataata

SEQ ID NO: 1529342 - DNA, 16 bp, Homo sapiens
aacttgaatttctgga

SEQ ID NO: 1529343 - DNA, 22 bp, Homo sapiens
aactcacagcttctccaagcat

SEQ ID NO: 1529344 - DNA, 16 bp, Homo sapiens
aactcaccatgtaaaa

SEQ ID NO: 1529345 - DNA, 21 bp, Homo sapiens
aactcaccatgtaaaagagtc

SEQ ID NO: 1529346 - DNA, 21 bp, Homo sapiens
aactcacctaatgtttatgag

SEQ ID NO: 1529347 - DNA, 23 bp, Homo sapiens
aactcagagaaaaatgctcccca

SEQ ID NO: 1529348 - DNA, 11 bp, Homo sapiens
aactcagatat

SEQ ID NO: 1529349 - DNA, 15 bp, Homo sapiens
aactcagatatccta

SEQ ID NO: 1529350 - DNA, 21 bp, Homo sapiens
aactcagatctgatcaagagt

SEQ ID NO: 1529351 - DNA, 20 bp, Homo sapiens
aactcagctattaagaaaat

SEQ ID NO: 1529352 - DNA, 21 bp, Homo sapiens
aactcagctattaagaaaatc

SEQ ID NO: 1529353 - DNA, 10 bp, Homo sapiens
aactcaggtt

SEQ ID NO: 1529354 - DNA, 19 bp, Homo sapiens
aactcagttcaaaccattt

SEQ ID NO: 1529355 - DNA, 18 bp, Homo sapiens
aactcagttttaactaga

SEQ ID NO: 1529356 - DNA, 16 bp, Homo sapiens
aactcatcataaaata

SEQ ID NO: 1529357 - DNA, 22 bp, Homo sapiens
aactcattcctgcctgtctcct

SEQ ID NO: 1529358 - DNA, 10 bp, Homo sapiens
aactccaaga

SEQ ID NO: 1529359 - DNA, 15 bp, Homo sapiens
aactccacatctgcc

SEQ ID NO: 1529360 - DNA, 16 bp, Homo sapiens
aactccacatctgcct

SEQ ID NO: 1529361 - DNA, 18 bp, Homo sapiens
aactccacatctgcctta

SEQ ID NO: 1529362 - DNA, 15 bp, Homo sapiens
aactccaccaaccca

SEQ ID NO: 1529363 - DNA, 23 bp, Homo sapiens
aactccaccaacccatcagaagg

SEQ ID NO: 1529364 - DNA, 23 bp, Homo sapiens
aactccaccgaccaactgcccta

SEQ ID NO: 1529365 - DNA, 16 bp, Homo sapiens
aactccaggccctcct

SEQ ID NO: 1529366 - DNA, 15 bp, Homo sapiens
aactccatacagcct

SEQ ID NO: 1529367 - DNA, 16 bp, Homo sapiens
aactccatacagcctc

SEQ ID NO: 1529368 - DNA, 19 bp, Homo sapiens
aactccatctcaaaacaaa

SEQ ID NO: 1529369 - DNA, 16 bp, Homo sapiens
aactccatgcaaacca

SEQ ID NO: 1529370 - DNA, 18 bp, Homo sapiens
aactcccaacttcttcct

SEQ ID NO: 1529371 - DNA, 19 bp, Homo sapiens
aactccccttcctcactgc

SEQ ID NO: 1529372 - DNA, 23 bp, Homo sapiens
aactccccttcctcactgcccaa

SEQ ID NO: 1529373 - DNA, 21 bp, Homo sapiens
aactccctccaccagcctgct

SEQ ID NO: 1529374 - DNA, 22 bp, Homo sapiens
aactccctccaccagcctgctg

SEQ ID NO: 1529375 - DNA, 17 bp, Homo sapiens
aactccctctctgtgca

SEQ ID NO: 1529376 - DNA, 23 bp, Homo sapiens
aactcctaattttaaataatttc

SEQ ID NO: 1529377 - DNA, 15 bp, Homo sapiens
aactcctgccattct

SEQ ID NO: 1529378 - DNA, 12 bp, Homo sapiens
aactcctggcct

SEQ ID NO: 1529379 - DNA, 13 bp, Homo sapiens
aactcctggcctc

SEQ ID NO: 1529380 - DNA, 14 bp, Homo sapiens
aactcctggcctca

SEQ ID NO: 1529381 - DNA, 17 bp, Homo sapiens
aactcctgtcccttttc

SEQ ID NO: 1529382 - DNA, 22 bp, Homo sapiens
aactcctgtcccttttccctta

SEQ ID NO: 1529383 - DNA, 13 bp, Homo sapiens
aactcctgtttct

SEQ ID NO: 1529384 - DNA, 13 bp, Homo sapiens
aactcgcctcagc

SEQ ID NO: 1529385 - DNA, 14 bp, Homo sapiens
aactcgcctcagcc

SEQ ID NO: 1529386 - DNA, 14 bp, Homo sapiens
aactctaaccagtg

SEQ ID NO: 1529387 - DNA, 15 bp, Homo sapiens
aactctaatagtgct

SEQ ID NO: 1529388 - DNA, 15 bp, Homo sapiens
aactctacccctgct

SEQ ID NO: 1529389 - DNA, 16 bp, Homo sapiens
aactctacccctgctc

SEQ ID NO: 1529390 - DNA, 15 bp, Homo sapiens
aactctattttttac

SEQ ID NO: 1529391 - DNA, 16 bp, Homo sapiens
aactctccctctggtc

SEQ ID NO: 1529392 - DNA, 16 bp, Homo sapiens
aactctctcccaggac

SEQ ID NO: 1529393 - DNA, 22 bp, Homo sapiens
aactctctccctggtctctgcc

SEQ ID NO: 1529394 - DNA, 13 bp, Homo sapiens
aactctctttcct

SEQ ID NO: 1529395 - DNA, 16 bp, Homo sapiens
aactctctttccttga

SEQ ID NO: 1529396 - DNA, 23 bp, Homo sapiens
aactctgaagctaattgtactaa

SEQ ID NO: 1529397 - DNA, 15 bp, Homo sapiens
aactctgacaagggc

SEQ ID NO: 1529398 - DNA, 21 bp, Homo sapiens
aactctgacaagggctgacct

SEQ ID NO: 1529399 - DNA, 22 bp, Homo sapiens
aactctgacaagggctgacctg

SEQ ID NO: 1529400 - DNA, 19 bp, Homo sapiens
aactctgatccctgggcct

SEQ ID NO: 1529401 - DNA, 15 bp, Homo sapiens
aactctgcactactc

SEQ ID NO: 1529402 - DNA, 16 bp, Homo sapiens
aactctgcactccatg

SEQ ID NO: 1529403 - DNA, 22 bp, Homo sapiens
aactctgcactccatggccacc

SEQ ID NO: 1529404 - DNA, 16 bp, Homo sapiens
aactctgcttgatttt

SEQ ID NO: 1529405 - DNA, 12 bp, Homo sapiens
aactctggtggc

SEQ ID NO: 1529406 - DNA, 13 bp, Homo sapiens
aactctggtggca

SEQ ID NO: 1529407 - DNA, 16 bp, Homo sapiens
aactctgtagcttaaa

SEQ ID NO: 1529408 - DNA, 21 bp, Homo sapiens
aactctgtgcaggtgctgcct

SEQ ID NO: 1529409 - DNA, 22 bp, Homo sapiens
aactctgtgcaggtgctgcctt

SEQ ID NO: 1529410 - DNA, 13 bp, Homo sapiens
aactcttcagaac

SEQ ID NO: 1529411 - DNA, 20 bp, Homo sapiens
aactcttcagttaattctta

SEQ ID NO: 1529412 - DNA, 11 bp, Homo sapiens
aactctttggt

SEQ ID NO: 1529413 - DNA, 16 bp, Homo sapiens
aactcttttctatttt

SEQ ID NO: 1529414 - DNA, 13 bp, Homo sapiens
aactcttttggac

SEQ ID NO: 1529415 - DNA, 12 bp, Homo sapiens
aactgaaaatgt

SEQ ID NO: 1529416 - DNA, 22 bp, Homo sapiens
aactgaaacatgcacattttgt

SEQ ID NO: 1529417 - DNA, 23 bp, Homo sapiens
aactgaacaccattgaaggctta

SEQ ID NO: 1529418 - DNA, 13 bp, Homo sapiens
aactgaagccaga

SEQ ID NO: 1529419 - DNA, 15 bp, Homo sapiens
aactgaatgaatcca

SEQ ID NO: 1529420 - DNA, 23 bp, Homo sapiens
aactgaatgaatccattggagaa

SEQ ID NO: 1529421 - DNA, 21 bp, Homo sapiens
aactgaatttgttcttaaaaa

SEQ ID NO: 1529422 - DNA, 12 bp, Homo sapiens
aactgacacagg

SEQ ID NO: 1529423 - DNA, 22 bp, Homo sapiens
aactgacgattcttaatcaaga

SEQ ID NO: 1529424 - DNA, 22 bp, Homo sapiens
aactgactattcttgatgtaaa

SEQ ID NO: 1529425 - DNA, 23 bp, Homo sapiens
aactgagatgtgaacacatcagc

SEQ ID NO: 1529426 - DNA, 12 bp, Homo sapiens
aactgagctggg

SEQ ID NO: 1529427 - DNA, 20 bp, Homo sapiens
aactgaggaattttctttgt

SEQ ID NO: 1529428 - DNA, 23 bp, Homo sapiens
aactgaggagaagctgatccagt

SEQ ID NO: 1529429 - DNA, 14 bp, Homo sapiens
aactgaggccttgt

SEQ ID NO: 1529430 - DNA, 13 bp, Homo sapiens
aactgagggccag

SEQ ID NO: 1529431 - DNA, 21 bp, Homo sapiens
aactgagggccagggacccag

SEQ ID NO: 1529432 - DNA, 19 bp, Homo sapiens
aactgagggctctgtttgt

SEQ ID NO: 1529433 - DNA, 20 bp, Homo sapiens
aactgagggctctgtttgtg

SEQ ID NO: 1529434 - DNA, 16 bp, Homo sapiens
aactgatcaaaaataa

SEQ ID NO: 1529435 - DNA, 15 bp, Homo sapiens
aactgatcctgctcc

SEQ ID NO: 1529436 - DNA, 18 bp, Homo sapiens
aactgatcctgctccagc

SEQ ID NO: 1529437 - DNA, 13 bp, Homo sapiens
aactgatctgtta

SEQ ID NO: 1529438 - DNA, 15 bp, Homo sapiens
aactgatctgttata

SEQ ID NO: 1529439 - DNA, 23 bp, Homo sapiens
aactgatggaccgggtgggcctg

SEQ ID NO: 1529440 - DNA, 21 bp, Homo sapiens
aactgattaaatatttgaaga

SEQ ID NO: 1529441 - DNA, 17 bp, Homo sapiens
aactgattacctgccaa

SEQ ID NO: 1529442 - DNA, 12 bp, Homo sapiens
aactgcaaaaaa

SEQ ID NO: 1529443 - DNA, 19 bp, Homo sapiens
aactgcaaaaaaagcctcc

SEQ ID NO: 1529444 - DNA, 22 bp, Homo sapiens
aactgcaaaaaaagcctccaag

SEQ ID NO: 1529445 - DNA, 14 bp, Homo sapiens
aactgcaaagcttt

SEQ ID NO: 1529446 - DNA, 22 bp, Homo sapiens
aactgcaaagctttggctgaga

SEQ ID NO: 1529447 - DNA, 17 bp, Homo sapiens
aactgcaatagagactg

SEQ ID NO: 1529448 - DNA, 19 bp, Homo sapiens
aactgcacacacagctcct

SEQ ID NO: 1529449 - DNA, 19 bp, Homo sapiens
aactgcaggccctggcctc

SEQ ID NO: 1529450 - DNA, 21 bp, Homo sapiens
aactgcaggccctggcctccc

SEQ ID NO: 1529451 - DNA, 23 bp, Homo sapiens
aactgcaggccctggcctcccct

SEQ ID NO: 1529452 - DNA, 18 bp, Homo sapiens
aactgcatacgttttggt

SEQ ID NO: 1529453 - DNA, 20 bp, Homo sapiens
aactgcattgagaactgcat

SEQ ID NO: 1529454 - DNA, 22 bp, Homo sapiens
aactgcattttaccagatgttt

SEQ ID NO: 1529455 - DNA, 15 bp, Homo sapiens
aactgccaagaaatt

SEQ ID NO: 1529456 - DNA, 18 bp, Homo sapiens
aactgccaggctgcctcc

SEQ ID NO: 1529457 - DNA, 18 bp, Homo sapiens
aactgcccttccaggtgg

SEQ ID NO: 1529458 - DNA, 18 bp, Homo sapiens
aactgccgtaatttaact

SEQ ID NO: 1529459 - DNA, 17 bp, Homo sapiens
ccagcagcacacctcag

SEQ ID NO: 1529460 - DNA, 22 bp, Homo sapiens
ccagcagcacacctcagcccca

SEQ ID NO: 1529461 - DNA, 14 bp, Homo sapiens
ccagcagcagagaa

SEQ ID NO: 1529462 - DNA, 22 bp, Homo sapiens
ccagcagcatagaacaggacct

SEQ ID NO: 1529463 - DNA, 23 bp, Homo sapiens
ccagcagcatagaacaggacctc

SEQ ID NO: 1529464 - DNA, 15 bp, Homo sapiens
ccagcagccagctct

SEQ ID NO: 1529465 - DNA, 16 bp, Homo sapiens
ccagcagccagctctc

SEQ ID NO: 1529466 - DNA, 15 bp, Homo sapiens
ccagcagcctcgcac

SEQ ID NO: 1529467 - DNA, 20 bp, Homo sapiens
ccagcagcctcgcacaggcc

SEQ ID NO: 1529468 - DNA, 17 bp, Homo sapiens
ccagcagcgcgcaggcc

SEQ ID NO: 1529469 - DNA, 19 bp, Homo sapiens
ccagcagcgcgcaggcctg

SEQ ID NO: 1529470 - DNA, 22 bp, Homo sapiens
ccagcagcgcgcaggcctgcgt

SEQ ID NO: 1529471 - DNA, 14 bp, Homo sapiens
ccagcagctcaaga

SEQ ID NO: 1529472 - DNA, 23 bp, Homo sapiens
ccagcaggagagactgagcagcc

SEQ ID NO: 1529473 - DNA, 12 bp, Homo sapiens
ccagcaggcagg

SEQ ID NO: 1529474 - DNA, 15 bp, Homo sapiens
ccagcaggcccagca

SEQ ID NO: 1529475 - DNA, 17 bp, Homo sapiens
ccagcaggcccagcatg

SEQ ID NO: 1529476 - DNA, 19 bp, Homo sapiens
ccagcaggcccagcatgca

SEQ ID NO: 1529477 - DNA, 23 bp, Homo sapiens
ccagcaggctcctggctgtgccc

SEQ ID NO: 1529478 - DNA, 16 bp, Homo sapiens
ccagcagggctgtgat

SEQ ID NO: 1529479 - DNA, 21 bp, Homo sapiens
ccagcaggggggctgtgccaa

SEQ ID NO: 1529480 - DNA, 17 bp, Homo sapiens
ccagcaggtcacactgg

SEQ ID NO: 1529481 - DNA, 14 bp, Homo sapiens
ccagcagtgaatgc

SEQ ID NO: 1529482 - DNA, 20 bp, Homo sapiens
ccagcagtgaatgctagaca

SEQ ID NO: 1529483 - DNA, 12 bp, Homo sapiens
ccagcagtttct

SEQ ID NO: 1529484 - DNA, 14 bp, Homo sapiens
ccagcatccagcct

SEQ ID NO: 1529485 - DNA, 15 bp, Homo sapiens
ccagcatccagcctg

SEQ ID NO: 1529486 - DNA, 16 bp, Homo sapiens
ccagcatccagcctgt

SEQ ID NO: 1529487 - DNA, 18 bp, Homo sapiens
ccagcatccagcctgtgt

SEQ ID NO: 1529488 - DNA, 14 bp, Homo sapiens
ccagcatccctgga

SEQ ID NO: 1529489 - DNA, 15 bp, Homo sapiens
ccagcatccctggag

SEQ ID NO: 1529490 - DNA, 11 bp, Homo sapiens
ccagcatctcc

SEQ ID NO: 1529491 - DNA, 16 bp, Homo sapiens
ccagcattccagcccc

SEQ ID NO: 1529492 - DNA, 22 bp, Homo sapiens
ccagcattccagctctgccccc

SEQ ID NO: 1529493 - DNA, 14 bp, Homo sapiens
ccagcattccctac

SEQ ID NO: 1529494 - DNA, 16 bp, Homo sapiens
ccagcatttagctggc

SEQ ID NO: 1529495 - DNA, 13 bp, Homo sapiens
ccagcatttggtt

SEQ ID NO: 1529496 - DNA, 18 bp, Homo sapiens
ccagccaaaccctgtctg

SEQ ID NO: 1529497 - DNA, 17 bp, Homo sapiens
ccagccaactctgggaa

SEQ ID NO: 1529498 - DNA, 10 bp, Homo sapiens
ccagccacag

SEQ ID NO: 1529499 - DNA, 16 bp, Homo sapiens
ccagccacagacccct

SEQ ID NO: 1529500 - DNA, 16 bp, Homo sapiens
ccagccacgcagggcc

SEQ ID NO: 1529501 - DNA, 16 bp, Homo sapiens
ccagccacttccccct

SEQ ID NO: 1529502 - DNA, 19 bp, Homo sapiens
ccagccagagttcctgcgg

SEQ ID NO: 1529503 - DNA, 14 bp, Homo sapiens
ccagccagcagcag

SEQ ID NO: 1529504 - DNA, 16 bp, Homo sapiens
ccagccagcagcagcc

SEQ ID NO: 1529505 - DNA, 20 bp, Homo sapiens
ccagccagcgtcccttggtg

SEQ ID NO: 1529506 - DNA, 13 bp, Homo sapiens
ccagccagctcct

SEQ ID NO: 1529507 - DNA, 13 bp, Homo sapiens
ccagccaggcaga

SEQ ID NO: 1529508 - DNA, 15 bp, Homo sapiens
ccagccaggccctgc

SEQ ID NO: 1529509 - DNA, 17 bp, Homo sapiens
ccagccaggcgggctca

SEQ ID NO: 1529510 - DNA, 18 bp, Homo sapiens
ccagccaggctcctacct

SEQ ID NO: 1529511 - DNA, 13 bp, Homo sapiens
ccagccaggtgca

SEQ ID NO: 1529512 - DNA, 16 bp, Homo sapiens
ccagccagtcttgcct

SEQ ID NO: 1529513 - DNA, 21 bp, Homo sapiens
ccagccattaccatggagaca

SEQ ID NO: 1529514 - DNA, 17 bp, Homo sapiens
ccagcccaataaaggtc

SEQ ID NO: 1529515 - DNA, 12 bp, Homo sapiens
ccagcccacatt

SEQ ID NO: 1529516 - DNA, 11 bp, Homo sapiens
ccagcccagag

SEQ ID NO: 1529517 - DNA, 16 bp, Homo sapiens
ccagcccagagccacc

SEQ ID NO: 1529518 - DNA, 17 bp, Homo sapiens
ccagcccagagccacct

SEQ ID NO: 1529519 - DNA, 14 bp, Homo sapiens
ccagcccagagccc

SEQ ID NO: 1529520 - DNA, 17 bp, Homo sapiens
ccagcccagagcccggt

SEQ ID NO: 1529521 - DNA, 12 bp, Homo sapiens
ccagcccagcca

SEQ ID NO: 1529522 - DNA, 17 bp, Homo sapiens
ccagcccatggccccca

SEQ ID NO: 1529523 - DNA, 17 bp, Homo sapiens
ccagcccattctctctc

SEQ ID NO: 1529524 - DNA, 19 bp, Homo sapiens
ccagcccattctctctcct

SEQ ID NO: 1529525 - DNA, 22 bp, Homo sapiens
ccagcccattctctctcctgtc

SEQ ID NO: 1529526 - DNA, 15 bp, Homo sapiens
ccagccccacccagg

SEQ ID NO: 1529527 - DNA, 13 bp, Homo sapiens
ccagccccactgc

SEQ ID NO: 1529528 - DNA, 18 bp, Homo sapiens
ccagccccactgccagca

SEQ ID NO: 1529529 - DNA, 20 bp, Homo sapiens
ccagccccactgccagcagc

SEQ ID NO: 1529530 - DNA, 22 bp, Homo sapiens
ccagccccagcaagagcacaag

SEQ ID NO: 1529531 - DNA, 16 bp, Homo sapiens
ccagccccccgcgcgc

SEQ ID NO: 1529532 - DNA, 15 bp, Homo sapiens
ccagccccctccagc

SEQ ID NO: 1529533 - DNA, 19 bp, Homo sapiens
ccagccccctccagctcat

SEQ ID NO: 1529534 - DNA, 13 bp, Homo sapiens
ccagccccctgga

SEQ ID NO: 1529535 - DNA, 14 bp, Homo sapiens
ccagccccctggat

SEQ ID NO: 1529536 - DNA, 23 bp, Homo sapiens
ccagccccctggatgggcattgg

SEQ ID NO: 1529537 - DNA, 17 bp, Homo sapiens
ccagccccggggtgagt

SEQ ID NO: 1529538 - DNA, 18 bp, Homo sapiens
ccagccccggtggctggg

SEQ ID NO: 1529539 - DNA, 14 bp, Homo sapiens
ccagcccctactgc

SEQ ID NO: 1529540 - DNA, 13 bp, Homo sapiens
ccagcccctccag

SEQ ID NO: 1529541 - DNA, 14 bp, Homo sapiens
ccagcccctctggt

SEQ ID NO: 1529542 - DNA, 17 bp, Homo sapiens
ccagcccctctggtcgc

SEQ ID NO: 1529543 - DNA, 15 bp, Homo sapiens
ccagcccctcttccc

SEQ ID NO: 1529544 - DNA, 21 bp, Homo sapiens
ccagcccctcttggagaagtc

SEQ ID NO: 1529545 - DNA, 15 bp, Homo sapiens
ccagcccctgcccct

SEQ ID NO: 1529546 - DNA, 14 bp, Homo sapiens
ccagccccttgaga

SEQ ID NO: 1529547 - DNA, 17 bp, Homo sapiens
ccagcccgaacaccatt

SEQ ID NO: 1529548 - DNA, 22 bp, Homo sapiens
ccagcccgacagtgccatcccc

SEQ ID NO: 1529549 - DNA, 14 bp, Homo sapiens
ccagcccggcctgc

SEQ ID NO: 1529550 - DNA, 17 bp, Homo sapiens
ccagcccggcctgctcc

SEQ ID NO: 1529551 - DNA, 20 bp, Homo sapiens
ccagcccggcctgctcccag

SEQ ID NO: 1529552 - DNA, 17 bp, Homo sapiens
ccagcccggctggtttt

SEQ ID NO: 1529553 - DNA, 17 bp, Homo sapiens
ccagccctagctgtccc

SEQ ID NO: 1529554 - DNA, 20 bp, Homo sapiens
ccagccctagctgtcccatg

SEQ ID NO: 1529555 - DNA, 21 bp, Homo sapiens
ccagccctccccgcagtggga

SEQ ID NO: 1529556 - DNA, 13 bp, Homo sapiens
ccagccctccctg

SEQ ID NO: 1529557 - DNA, 20 bp, Homo sapiens
ccagccctccctggctgtga

SEQ ID NO: 1529558 - DNA, 24 bp, Homo sapiens
ccagccctccctggctgtgagcag

SEQ ID NO: 1529559 - DNA, 20 bp, Homo sapiens
ccagccctccctgtcctcct

SEQ ID NO: 1529560 - DNA, 22 bp, Homo sapiens
ccagccctccctgtcctcctcg

SEQ ID NO: 1529561 - DNA, 13 bp, Homo sapiens
ccagccctgcagc

SEQ ID NO: 1529562 - DNA, 14 bp, Homo sapiens
ccagcccttctgcc

SEQ ID NO: 1529563 - DNA, 19 bp, Homo sapiens
ccagcccttctgcctttct

SEQ ID NO: 1529564 - DNA, 20 bp, Homo sapiens
ccagccggcctctctggcct

SEQ ID NO: 1529565 - DNA, 20 bp, Homo sapiens
ccagccgtgagtgcagaccc

SEQ ID NO: 1529566 - DNA, 18 bp, Homo sapiens
ccagccgtgatgctcagg

SEQ ID NO: 1529567 - DNA, 19 bp, Homo sapiens
ccagccgtgatgctcaggc

SEQ ID NO: 1529568 - DNA, 23 bp, Homo sapiens
ccagccgtgatgctcaggcttga

SEQ ID NO: 1529569 - DNA, 20 bp, Homo sapiens
ccagcctacaagctggcact

SEQ ID NO: 1529570 - DNA, 15 bp, Homo sapiens
ccagcctcagaaggc

SEQ ID NO: 1529571 - DNA, 19 bp, Homo sapiens
ccagcctcagatccaggca

SEQ ID NO: 1529572 - DNA, 15 bp, Homo sapiens
ccagcctcagtgcca

SEQ ID NO: 1529573 - DNA, 19 bp, Homo sapiens
ccagcctcagtgccacttg

SEQ ID NO: 1529574 - DNA, 13 bp, Homo sapiens
ccagcctccaggg

SEQ ID NO: 1529575 - DNA, 14 bp, Homo sapiens
ccagcctccagggc

SEQ ID NO: 1529576 - DNA, 21 bp, Homo sapiens
tatctgcaaatagtttcaaat

SEQ ID NO: 1529577 - DNA, 22 bp, Homo sapiens
tatctgcatgtgtcatgaagaa

SEQ ID NO: 1529578 - DNA, 21 bp, Homo sapiens
tatctgccaaattgagataat

SEQ ID NO: 1529579 - DNA, 12 bp, Homo sapiens
tatctgcctggc

SEQ ID NO: 1529580 - DNA, 15 bp, Homo sapiens
tatctgcctggcctg

SEQ ID NO: 1529581 - DNA, 18 bp, Homo sapiens
tatctgctgcctctgaaa

SEQ ID NO: 1529582 - DNA, 19 bp, Homo sapiens
tatctgctgcctctgaaaa

SEQ ID NO: 1529583 - DNA, 22 bp, Homo sapiens
tatctgctgcctctgaaaatat

SEQ ID NO: 1529584 - DNA, 22 bp, Homo sapiens
tatctggaacaacttgtagcag

SEQ ID NO: 1529585 - DNA, 22 bp, Homo sapiens
tatctggaatattgtgattctg

SEQ ID NO: 1529586 - DNA, 13 bp, Homo sapiens
tatctggcactgt

SEQ ID NO: 1529587 - DNA, 15 bp, Homo sapiens
tatctggcctctgct

SEQ ID NO: 1529588 - DNA, 23 bp, Homo sapiens
tatctgggattatggttttgtga

SEQ ID NO: 1529589 - DNA, 18 bp, Homo sapiens
tatctgtaaatttaactg

SEQ ID NO: 1529590 - DNA, 13 bp, Homo sapiens
tatctgtaatggt

SEQ ID NO: 1529591 - DNA, 18 bp, Homo sapiens
tatctgtgaggtgctgat

SEQ ID NO: 1529592 - DNA, 18 bp, Homo sapiens
tatctgttggagaaagaa

SEQ ID NO: 1529593 - DNA, 18 bp, Homo sapiens
tatcttaaagaaacagct

SEQ ID NO: 1529594 - DNA, 20 bp, Homo sapiens
tatcttaaagaaacagcttt

SEQ ID NO: 1529595 - DNA, 20 bp, Homo sapiens
tatcttaatatatacatttt

SEQ ID NO: 1529596 - DNA, 19 bp, Homo sapiens
tatcttagatgtttcacac

SEQ ID NO: 1529597 - DNA, 18 bp, Homo sapiens
tatcttatctcagatatt

SEQ ID NO: 1529598 - DNA, 23 bp, Homo sapiens
tatcttatctcagatatttgcac

SEQ ID NO: 1529599 - DNA, 15 bp, Homo sapiens
tatcttattttctca

SEQ ID NO: 1529600 - DNA, 14 bp, Homo sapiens
tatcttcaaacttt

SEQ ID NO: 1529601 - DNA, 13 bp, Homo sapiens
tatcttcagccca

SEQ ID NO: 1529602 - DNA, 18 bp, Homo sapiens
tatcttcagcccaggctt

SEQ ID NO: 1529603 - DNA, 23 bp, Homo sapiens
tatcttcagcccaggcttttgct

SEQ ID NO: 1529604 - DNA, 15 bp, Homo sapiens
tatcttctcaagttc

SEQ ID NO: 1529605 - DNA, 20 bp, Homo sapiens
tatcttctcaagttctaaga

SEQ ID NO: 1529606 - DNA, 14 bp, Homo sapiens
tatcttctgatttg

SEQ ID NO: 1529607 - DNA, 13 bp, Homo sapiens
tatcttctggatt

SEQ ID NO: 1529608 - DNA, 17 bp, Homo sapiens
tatcttctgtttcataa

SEQ ID NO: 1529609 - DNA, 19 bp, Homo sapiens
tatcttggacaaatcacat

SEQ ID NO: 1529610 - DNA, 17 bp, Homo sapiens
tatcttggactgacatt

SEQ ID NO: 1529611 - DNA, 20 bp, Homo sapiens
tatcttgggtgtattctctg

SEQ ID NO: 1529612 - DNA, 17 bp, Homo sapiens
tatcttgtctctgggct

SEQ ID NO: 1529613 - DNA, 20 bp, Homo sapiens
tatctttaaaaagcagtcct

SEQ ID NO: 1529614 - DNA, 14 bp, Homo sapiens
tatctttatgctgt

SEQ ID NO: 1529615 - DNA, 15 bp, Homo sapiens
tatctttatgctgta

SEQ ID NO: 1529616 - DNA, 16 bp, Homo sapiens
tatctttattaaaaca

SEQ ID NO: 1529617 - DNA, 20 bp, Homo sapiens
tatctttccatgggagccag

SEQ ID NO: 1529618 - DNA, 16 bp, Homo sapiens
tatctttctaaaactg

SEQ ID NO: 1529619 - DNA, 12 bp, Homo sapiens
tatctttgataa

SEQ ID NO: 1529620 - DNA, 17 bp, Homo sapiens
tatctttgattctcctt

SEQ ID NO: 1529621 - DNA, 21 bp, Homo sapiens
tatcttttgtaagacatttcc

SEQ ID NO: 1529622 - DNA, 15 bp, Homo sapiens
tatgaaaaaatatga

SEQ ID NO: 1529623 - DNA, 21 bp, Homo sapiens
tatgaaaatatagacattctc

SEQ ID NO: 1529624 - DNA, 22 bp, Homo sapiens
tatgaaaatatagacattctca

SEQ ID NO: 1529625 - DNA, 22 bp, Homo sapiens
tatgaacacagacaaagtgcta

SEQ ID NO: 1529626 - DNA, 13 bp, Homo sapiens
tatgaacagctgt

SEQ ID NO: 1529627 - DNA, 17 bp, Homo sapiens
tatgaacatattgttga

SEQ ID NO: 1529628 - DNA, 14 bp, Homo sapiens
tatgaacctatttt

SEQ ID NO: 1529629 - DNA, 18 bp, Homo sapiens
tatgaacctattttcatt

SEQ ID NO: 1529630 - DNA, 21 bp, Homo sapiens
tatgaagaaaaagtacaatga

SEQ ID NO: 1529631 - DNA, 14 bp, Homo sapiens
tatgaagaaaatac

SEQ ID NO: 1529632 - DNA, 21 bp, Homo sapiens
tatgaagctacctcaaacttc

SEQ ID NO: 1529633 - DNA, 14 bp, Homo sapiens
tatgaagtatataa

SEQ ID NO: 1529634 - DNA, 16 bp, Homo sapiens
tatgaagtatataatg

SEQ ID NO: 1529635 - DNA, 13 bp, Homo sapiens
tatgaagttgctg

SEQ ID NO: 1529636 - DNA, 20 bp, Homo sapiens
tatgaatctatgccaaagat

SEQ ID NO: 1529637 - DNA, 21 bp, Homo sapiens
tatgaatctatgccaaagatc

SEQ ID NO: 1529638 - DNA, 22 bp, Homo sapiens
tatgaatctatgccaaagatca

SEQ ID NO: 1529639 - DNA, 21 bp, Homo sapiens
tatgaatctattatactgtat

SEQ ID NO: 1529640 - DNA, 23 bp, Homo sapiens
tatgaatctgctcactttaaacc

SEQ ID NO: 1529641 - DNA, 22 bp, Homo sapiens
tatgaattgtacagaatatttc

SEQ ID NO: 1529642 - DNA, 19 bp, Homo sapiens
tatgaatttaaatataatt

SEQ ID NO: 1529643 - DNA, 21 bp, Homo sapiens
tatgaatttaaatataattct

SEQ ID NO: 1529644 - DNA, 13 bp, Homo sapiens
tatgacaaatgtt

SEQ ID NO: 1529645 - DNA, 18 bp, Homo sapiens
tatgacaagcctttgtgc

SEQ ID NO: 1529646 - DNA, 19 bp, Homo sapiens
tatgacaatttctggcaga

SEQ ID NO: 1529647 - DNA, 20 bp, Homo sapiens
tatgacacaaaggtggaata

SEQ ID NO: 1529648 - DNA, 16 bp, Homo sapiens
catttcacctgtgaca

SEQ ID NO: 1529649 - DNA, 21 bp, Homo sapiens
catttcagaagttagtttgta

SEQ ID NO: 1529650 - DNA, 23 bp, Homo sapiens
catttcagaagttagtttgtata

SEQ ID NO: 1529651 - DNA, 14 bp, Homo sapiens
catttcaggaattt

SEQ ID NO: 1529652 - DNA, 17 bp, Homo sapiens
catttcaggaatttaaa

SEQ ID NO: 1529653 - DNA, 16 bp, Homo sapiens
catttcatacaacaga

SEQ ID NO: 1529654 - DNA, 23 bp, Homo sapiens
catttcatacaacagaaaccaga

SEQ ID NO: 1529655 - DNA, 16 bp, Homo sapiens
catttcatcattgttt

SEQ ID NO: 1529656 - DNA, 18 bp, Homo sapiens
catttcatcattgtttct

SEQ ID NO: 1529657 - DNA, 20 bp, Homo sapiens
catttcatctatttctgaga

SEQ ID NO: 1529658 - DNA, 20 bp, Homo sapiens
catttcatgaaaaagctgct

SEQ ID NO: 1529659 - DNA, 11 bp, Homo sapiens
catttccaaac

SEQ ID NO: 1529660 - DNA, 18 bp, Homo sapiens
catttccaacaccacaga

SEQ ID NO: 1529661 - DNA, 13 bp, Homo sapiens
catttccaacagc

SEQ ID NO: 1529662 - DNA, 18 bp, Homo sapiens
catttccaactcaggtta

SEQ ID NO: 1529663 - DNA, 23 bp, Homo sapiens
catttccaccaagggtatctgct

SEQ ID NO: 1529664 - DNA, 14 bp, Homo sapiens
catttccagcattt

SEQ ID NO: 1529665 - DNA, 16 bp, Homo sapiens
catttccattgcttat

SEQ ID NO: 1529666 - DNA, 15 bp, Homo sapiens
catttccccctcctc

SEQ ID NO: 1529667 - DNA, 19 bp, Homo sapiens
catttcctatgtaactgca

SEQ ID NO: 1529668 - DNA, 11 bp, Homo sapiens
catttcctgcc

SEQ ID NO: 1529669 - DNA, 16 bp, Homo sapiens
catttccttggaggcc

SEQ ID NO: 1529670 - DNA, 11 bp, Homo sapiens
catttcctttt

SEQ ID NO: 1529671 - DNA, 20 bp, Homo sapiens
catttccttttcacattaga

SEQ ID NO: 1529672 - DNA, 22 bp, Homo sapiens
catttcgggaagggcatgcacg

SEQ ID NO: 1529673 - DNA, 23 bp, Homo sapiens
catttctaattaaccttactaat

SEQ ID NO: 1529674 - DNA, 14 bp, Homo sapiens
catttctataaata

SEQ ID NO: 1529675 - DNA, 14 bp, Homo sapiens
catttctatacttt

SEQ ID NO: 1529676 - DNA, 12 bp, Homo sapiens
catttctattaa

SEQ ID NO: 1529677 - DNA, 13 bp, Homo sapiens
catttctatttat

SEQ ID NO: 1529678 - DNA, 14 bp, Homo sapiens
catttctatttatt

SEQ ID NO: 1529679 - DNA, 22 bp, Homo sapiens
catttctcaatcagtgcagtga

SEQ ID NO: 1529680 - DNA, 13 bp, Homo sapiens
catttctctgagc

SEQ ID NO: 1529681 - DNA, 11 bp, Homo sapiens
catttctctgc

SEQ ID NO: 1529682 - DNA, 14 bp, Homo sapiens
catttctctttaaa

SEQ ID NO: 1529683 - DNA, 23 bp, Homo sapiens
catttctgcatcagctgctgaaa

SEQ ID NO: 1529684 - DNA, 23 bp, Homo sapiens
catttctggattgtggttccatg

SEQ ID NO: 1529685 - DNA, 10 bp, Homo sapiens
catttctgtc

SEQ ID NO: 1529686 - DNA, 12 bp, Homo sapiens
catttcttagac

SEQ ID NO: 1529687 - DNA, 18 bp, Homo sapiens
catttctttttaaaaaaa

SEQ ID NO: 1529688 - DNA, 17 bp, Homo sapiens
catttgaacctggatcc

SEQ ID NO: 1529689 - DNA, 21 bp, Homo sapiens
catttgacaaaactaaccttg

SEQ ID NO: 1529690 - DNA, 23 bp, Homo sapiens
catttgacacaaagcttctaaag

SEQ ID NO: 1529691 - DNA, 20 bp, Homo sapiens
catttgactgttcaatgatt

SEQ ID NO: 1529692 - DNA, 12 bp, Homo sapiens
catttgagaaat

SEQ ID NO: 1529693 - DNA, 14 bp, Homo sapiens
tatgattgaaaaga

SEQ ID NO: 1529694 - DNA, 15 bp, Homo sapiens
tatgattgaaaagaa

SEQ ID NO: 1529695 - DNA, 16 bp, Homo sapiens
tatgattgaaaagaag

SEQ ID NO: 1529696 - DNA, 17 bp, Homo sapiens
tatgatttaaaaacaac

SEQ ID NO: 1529697 - DNA, 17 bp, Homo sapiens
tatgatttataaacaga

SEQ ID NO: 1529698 - DNA, 22 bp, Homo sapiens
tatgatttgttttgaattttgt

SEQ ID NO: 1529699 - DNA, 17 bp, Homo sapiens
tatgatttttttttcat

SEQ ID NO: 1529700 - DNA, 14 bp, Homo sapiens
tatgcaaaagcagc

SEQ ID NO: 1529701 - DNA, 15 bp, Homo sapiens
tatgcaaaagcagct

SEQ ID NO: 1529702 - DNA, 16 bp, Homo sapiens
tatgcaaaagcagcta

SEQ ID NO: 1529703 - DNA, 12 bp, Homo sapiens
tatgcaaagcac

SEQ ID NO: 1529704 - DNA, 13 bp, Homo sapiens
tatgcaaatacaa

SEQ ID NO: 1529705 - DNA, 19 bp, Homo sapiens
tatgcaagatatttttgaa

SEQ ID NO: 1529706 - DNA, 20 bp, Homo sapiens
tatgcaaggaaggaaagaaa

SEQ ID NO: 1529707 - DNA, 21 bp, Homo sapiens
tatgcaaggtatttctccagt

SEQ ID NO: 1529708 - DNA, 20 bp, Homo sapiens
tatgcaccttgtgtctgtac

SEQ ID NO: 1529709 - DNA, 22 bp, Homo sapiens
tatgcaccttgtgtctgtacac

SEQ ID NO: 1529710 - DNA, 13 bp, Homo sapiens
tatgcacttttag

SEQ ID NO: 1529711 - DNA, 20 bp, Homo sapiens
tatgcacttttagaaatgca

SEQ ID NO: 1529712 - DNA, 22 bp, Homo sapiens
tatgcagaaatagacaaaaagt

SEQ ID NO: 1529713 - DNA, 23 bp, Homo sapiens
tatgcagacagtctgttatgcac

SEQ ID NO: 1529714 - DNA, 16 bp, Homo sapiens
tatgcagcaaatatat

SEQ ID NO: 1529715 - DNA, 19 bp, Homo sapiens
tatgcagccatatatggaa

SEQ ID NO: 1529716 - DNA, 13 bp, Homo sapiens
tatgcagggagca

SEQ ID NO: 1529717 - DNA, 16 bp, Homo sapiens
tatgcagggagcactg

SEQ ID NO: 1529718 - DNA, 17 bp, Homo sapiens
tatgcagggagcactgt

SEQ ID NO: 1529719 - DNA, 19 bp, Homo sapiens
tatgcatatatatatgtgt

SEQ ID NO: 1529720 - DNA, 14 bp, Homo sapiens
tatgcatatttgtt

SEQ ID NO: 1529721 - DNA, 23 bp, Homo sapiens
tatgcatggtgccccaggaccag

SEQ ID NO: 1529722 - DNA, 16 bp, Homo sapiens
tatgcattatatcaaa

SEQ ID NO: 1529723 - DNA, 19 bp, Homo sapiens
tatgcattcacatttagaa

SEQ ID NO: 1529724 - DNA, 22 bp, Homo sapiens
tatgcattcacatttagaaaag

SEQ ID NO: 1529725 - DNA, 14 bp, Homo sapiens
tatgcatttcattc

SEQ ID NO: 1529726 - DNA, 20 bp, Homo sapiens
tatgccacttccttttaact

SEQ ID NO: 1529727 - DNA, 14 bp, Homo sapiens
tatgccagctcagt

SEQ ID NO: 1529728 - DNA, 19 bp, Homo sapiens
tatgccattggggtagttg

SEQ ID NO: 1529729 - DNA, 16 bp, Homo sapiens
tatgccggatgtgctt

SEQ ID NO: 1529730 - DNA, 18 bp, Homo sapiens
tatgcctgattcatagta

SEQ ID NO: 1529731 - DNA, 13 bp, Homo sapiens
tatgcctgtattt

SEQ ID NO: 1529732 - DNA, 21 bp, Homo sapiens
tatgcctgtatttccaacaaa

SEQ ID NO: 1529733 - DNA, 17 bp, Homo sapiens
tatgccttaagcagaac

SEQ ID NO: 1529734 - DNA, 14 bp, Homo sapiens
tatgccttcttatt

SEQ ID NO: 1529735 - DNA, 20 bp, Homo sapiens
tatgcctttaaatctgtgat

SEQ ID NO: 1529736 - DNA, 21 bp, Homo sapiens
tatgcggttcttacagcacat

SEQ ID NO: 1529737 - DNA, 13 bp, Homo sapiens
tatgctaaactgt

SEQ ID NO: 1529738 - DNA, 17 bp, Homo sapiens
tatgctaaactgtgaaa

SEQ ID NO: 1529739 - DNA, 19 bp, Homo sapiens
tatgctaatttttggagaa

SEQ ID NO: 1529740 - DNA, 20 bp, Homo sapiens
tatgctagtttattggaagt

SEQ ID NO: 1529741 - DNA, 18 bp, Homo sapiens
tatgctctcactgtttgt

SEQ ID NO: 1529742 - DNA, 14 bp, Homo sapiens
tatgctctgcatgt

SEQ ID NO: 1529743 - DNA, 18 bp, Homo sapiens
tatgctctgcatgttaca

SEQ ID NO: 1529744 - DNA, 19 bp, Homo sapiens
tatgctctgcatgttacat

SEQ ID NO: 1529745 - DNA, 15 bp, Homo sapiens
tatgctgatcatcgc

SEQ ID NO: 1529746 - DNA, 22 bp, Homo sapiens
tatgctgatcatcgccagaggt

SEQ ID NO: 1529747 - DNA, 17 bp, Homo sapiens
tatgctgatcttttaaa

SEQ ID NO: 1529748 - DNA, 15 bp, Homo sapiens
tatgctggtggttaa

SEQ ID NO: 1529749 - DNA, 14 bp, Homo sapiens
tatgctgtatttta

SEQ ID NO: 1529750 - DNA, 18 bp, Homo sapiens
tatgctgttatgtccaga

SEQ ID NO: 1529751 - DNA, 13 bp, Homo sapiens
tatgcttaaaata

SEQ ID NO: 1529752 - DNA, 15 bp, Homo sapiens
tatgcttactgatat

SEQ ID NO: 1529753 - DNA, 21 bp, Homo sapiens
tatgcttactgatatatttta

SEQ ID NO: 1529754 - DNA, 17 bp, Homo sapiens
tatgcttgggccctgca

SEQ ID NO: 1529755 - DNA, 16 bp, Homo sapiens
tatgctttccctgagg

SEQ ID NO: 1529756 - DNA, 16 bp, Homo sapiens
tatgctttttctcaga

SEQ ID NO: 1529757 - DNA, 19 bp, Homo sapiens
tatgctttttctcagatct

SEQ ID NO: 1529758 - DNA, 20 bp, Homo sapiens
tatgctttttctcagatctg

SEQ ID NO: 1529759 - DNA, 22 bp, Homo sapiens
tatggaaaagggtcttcttggc

SEQ ID NO: 1529760 - DNA, 23 bp, Homo sapiens
tatggaaaagggtcttcttggca

SEQ ID NO: 1529761 - DNA, 17 bp, Homo sapiens
tatggaactctctccac

SEQ ID NO: 1529762 - DNA, 23 bp, Homo sapiens
tatggaatacagtgttattttct

SEQ ID NO: 1529763 - DNA, 15 bp, Homo sapiens
cattttcgtttttaa

SEQ ID NO: 1529764 - DNA, 15 bp, Homo sapiens
cattttctaaactgt

SEQ ID NO: 1529765 - DNA, 11 bp, Homo sapiens
cattttctata

SEQ ID NO: 1529766 - DNA, 14 bp, Homo sapiens
cattttctcttaga

SEQ ID NO: 1529767 - DNA, 22 bp, Homo sapiens
cattttctggccagtgtttaaa

SEQ ID NO: 1529768 - DNA, 23 bp, Homo sapiens
cattttcttattgcgctgctacc

SEQ ID NO: 1529769 - DNA, 21 bp, Homo sapiens
cattttctttttttaactggt

SEQ ID NO: 1529770 - DNA, 13 bp, Homo sapiens
cattttgaaacaa

SEQ ID NO: 1529771 - DNA, 19 bp, Homo sapiens
cattttgaggttttgtaaa

SEQ ID NO: 1529772 - DNA, 12 bp, Homo sapiens
cattttgcaaaa

SEQ ID NO: 1529773 - DNA, 15 bp, Homo sapiens
cattttgcaaaattt

SEQ ID NO: 1529774 - DNA, 13 bp, Homo sapiens
cattttgcactgt

SEQ ID NO: 1529775 - DNA, 14 bp, Homo sapiens
cattttgcactgta

SEQ ID NO: 1529776 - DNA, 17 bp, Homo sapiens
cattttgcactgtaaat

SEQ ID NO: 1529777 - DNA, 16 bp, Homo sapiens
cattttgcagcagtga

SEQ ID NO: 1529778 - DNA, 22 bp, Homo sapiens
cattttgcagcagtgagtctct

SEQ ID NO: 1529779 - DNA, 22 bp, Homo sapiens
cattttggaagttttcaggact

SEQ ID NO: 1529780 - DNA, 23 bp, Homo sapiens
cattttgggatccttcagcacag

SEQ ID NO: 1529781 - DNA, 20 bp, Homo sapiens
cattttggttttgtgttttg

SEQ ID NO: 1529782 - DNA, 18 bp, Homo sapiens
cattttgtaacaaatgaa

SEQ ID NO: 1529783 - DNA, 13 bp, Homo sapiens
cattttgtacatt

SEQ ID NO: 1529784 - DNA, 16 bp, Homo sapiens
cattttgtatattaac

SEQ ID NO: 1529785 - DNA, 22 bp, Homo sapiens
cattttgtatggagttaaataa

SEQ ID NO: 1529786 - DNA, 23 bp, Homo sapiens
cattttgtatggagttaaataaa

SEQ ID NO: 1529787 - DNA, 14 bp, Homo sapiens
cattttgttacata

SEQ ID NO: 1529788 - DNA, 15 bp, Homo sapiens
cattttgttatagaa

SEQ ID NO: 1529789 - DNA, 17 bp, Homo sapiens
cattttgttatagaata

SEQ ID NO: 1529790 - DNA, 12 bp, Homo sapiens
cattttgtttct

SEQ ID NO: 1529791 - DNA, 13 bp, Homo sapiens
catttttaaactt

SEQ ID NO: 1529792 - DNA, 15 bp, Homo sapiens
catttttaaattctt

SEQ ID NO: 1529793 - DNA, 23 bp, Homo sapiens
catttttaagatagaacacaaaa

SEQ ID NO: 1529794 - DNA, 21 bp, Homo sapiens
catttttaatattactgtctt

SEQ ID NO: 1529795 - DNA, 18 bp, Homo sapiens
catttttaatgtatctat

SEQ ID NO: 1529796 - DNA, 19 bp, Homo sapiens
catttttaatgtatctatt

SEQ ID NO: 1529797 - DNA, 22 bp, Homo sapiens
catttttataaactaccaaatt

SEQ ID NO: 1529798 - DNA, 14 bp, Homo sapiens
catttttatgcaga

SEQ ID NO: 1529799 - DNA, 20 bp, Homo sapiens
catttttattcatgccatct

SEQ ID NO: 1529800 - DNA, 15 bp, Homo sapiens
catttttcaatatat

SEQ ID NO: 1529801 - DNA, 21 bp, Homo sapiens
catttttcaatatattgaact

SEQ ID NO: 1529802 - DNA, 22 bp, Homo sapiens
catttttctcccaagaaacctg

SEQ ID NO: 1529803 - DNA, 13 bp, Homo sapiens
catttttgagcca

SEQ ID NO: 1529804 - DNA, 16 bp, Homo sapiens
cattttttaatttact

SEQ ID NO: 1529805 - DNA, 16 bp, Homo sapiens
cattttttaggtgctt

SEQ ID NO: 1529806 - DNA, 23 bp, Homo sapiens
cattttttagtctgtaatacact

SEQ ID NO: 1529807 - DNA, 16 bp, Homo sapiens
cattttttcctgtttg

SEQ ID NO: 1529808 - DNA, 12 bp, Homo sapiens
catttttttaga

SEQ ID NO: 1529809 - DNA, 15 bp, Homo sapiens
catttttttccaggc

SEQ ID NO: 1529810 - DNA, 19 bp, Homo sapiens
catttttttctctctggag

SEQ ID NO: 1529811 - DNA, 14 bp, Homo sapiens
tatgtaatataaat

SEQ ID NO: 1529812 - DNA, 24 bp, Homo sapiens
tatgtaatatattgtacaaatgta

SEQ ID NO: 1529813 - DNA, 17 bp, Homo sapiens
tatgtaattctttccat

SEQ ID NO: 1529814 - DNA, 14 bp, Homo sapiens
tatgtaatttatgc

SEQ ID NO: 1529815 - DNA, 15 bp, Homo sapiens
tatgtaatttcaaaa

SEQ ID NO: 1529816 - DNA, 17 bp, Homo sapiens
tatgtaatttcaaaata

SEQ ID NO: 1529817 - DNA, 11 bp, Homo sapiens
tatgtacaata

SEQ ID NO: 1529818 - DNA, 20 bp, Homo sapiens
tatgtacaatacaatgtaca

SEQ ID NO: 1529819 - DNA, 16 bp, Homo sapiens
tatgtaccatgaatat

SEQ ID NO: 1529820 - DNA, 21 bp, Homo sapiens
tatgtacgtttgtatgtgtgt

SEQ ID NO: 1529821 - DNA, 13 bp, Homo sapiens
tatgtacttgttt

SEQ ID NO: 1529822 - DNA, 20 bp, Homo sapiens
tatgtacttgtttgctatga

SEQ ID NO: 1529823 - DNA, 19 bp, Homo sapiens
tatgtacttttattttttg

SEQ ID NO: 1529824 - DNA, 23 bp, Homo sapiens
tatgtaggtaaaagtagaagcat

SEQ ID NO: 1529825 - DNA, 21 bp, Homo sapiens
tatgtagtgcatttttaaact

SEQ ID NO: 1529826 - DNA, 13 bp, Homo sapiens
tatgtatacatgt

SEQ ID NO: 1529827 - DNA, 22 bp, Homo sapiens
tatgtatatgacatttaaatgt

SEQ ID NO: 1529828 - DNA, 19 bp, Homo sapiens
tatgtatatttttttaatt

SEQ ID NO: 1529829 - DNA, 20 bp, Homo sapiens
tatgtatggaatacagtgtt

SEQ ID NO: 1529830 - DNA, 18 bp, Homo sapiens
tatgtatggatatatttg

SEQ ID NO: 1529831 - DNA, 19 bp, Homo sapiens
tatgtatggatatatttga

SEQ ID NO: 1529832 - DNA, 17 bp, Homo sapiens
tatgtatgtttacatat

SEQ ID NO: 1529833 - DNA, 14 bp, Homo sapiens
tatgtattaacact

SEQ ID NO: 1529834 - DNA, 22 bp, Homo sapiens
tatgtattaacactactcaaag

SEQ ID NO: 1529835 - DNA, 16 bp, Homo sapiens
tatgtattcccttgta

SEQ ID NO: 1529836 - DNA, 17 bp, Homo sapiens
tatgtattcccttgtat

SEQ ID NO: 1529837 - DNA, 14 bp, Homo sapiens
tatgtatttaaagt

SEQ ID NO: 1529838 - DNA, 21 bp, Homo sapiens
tatgtcaataaacaacagctg

SEQ ID NO: 1529839 - DNA, 19 bp, Homo sapiens
tatgtcaatatttagtaaa

SEQ ID NO: 1529840 - DNA, 16 bp, Homo sapiens
tatgtcaatttgtata

SEQ ID NO: 1529841 - DNA, 20 bp, Homo sapiens
tatgtcaatttgtatatcat

SEQ ID NO: 1529842 - DNA, 22 bp, Homo sapiens
tatgtcagcagctctgagacag

SEQ ID NO: 1529843 - DNA, 15 bp, Homo sapiens
tatgtcagtactatt

SEQ ID NO: 1529844 - DNA, 23 bp, Homo sapiens
tatgtcagtgctataaatgccag

SEQ ID NO: 1529845 - DNA, 13 bp, Homo sapiens
tatgtcatagaaa

SEQ ID NO: 1529846 - DNA, 16 bp, Homo sapiens
tatgtcatagaaatat

SEQ ID NO: 1529847 - DNA, 23 bp, Homo sapiens
tatgtcatttccttcaaggcatc

SEQ ID NO: 1529848 - DNA, 17 bp, Homo sapiens
tatgtccactgtgtata

SEQ ID NO: 1529849 - DNA, 14 bp, Homo sapiens
tatgtccagaaatt

SEQ ID NO: 1529850 - DNA, 13 bp, Homo sapiens
tatgtcctgtcat

SEQ ID NO: 1529851 - DNA, 18 bp, Homo sapiens
tatgtcgagagctggcca

SEQ ID NO: 1529852 - DNA, 12 bp, Homo sapiens
tatgtctcagga

SEQ ID NO: 1529853 - DNA, 13 bp, Homo sapiens
tatgtctctgcct

SEQ ID NO: 1529854 - DNA, 14 bp, Homo sapiens
tatgtctcttctga

SEQ ID NO: 1529855 - DNA, 13 bp, Homo sapiens
tatgtctcttgag

SEQ ID NO: 1529856 - DNA, 19 bp, Homo sapiens
tatgtctcttgagcatcaa

SEQ ID NO: 1529857 - DNA, 14 bp, Homo sapiens
tatgtctgaacata

SEQ ID NO: 1529858 - DNA, 21 bp, Homo sapiens
tatgtctgaacatagaaactc

SEQ ID NO: 1529859 - DNA, 14 bp, Homo sapiens
tatgtctgccatgt

SEQ ID NO: 1529860 - DNA, 11 bp, Homo sapiens
tatgtctgtgt

SEQ ID NO: 1529861 - DNA, 19 bp, Homo sapiens
tatgtctgtttttgtatct

SEQ ID NO: 1529862 - DNA, 21 bp, Homo sapiens
tatgtctgtttttgtatcttt

SEQ ID NO: 1529863 - DNA, 19 bp, Homo sapiens
tatgtgaaaggaacatttt

SEQ ID NO: 1529864 - DNA, 20 bp, Homo sapiens
tatgtgaaaggaacattttt

SEQ ID NO: 1529865 - DNA, 22 bp, Homo sapiens
tatgtgaatgatctctctgaat

SEQ ID NO: 1529866 - DNA, 12 bp, Homo sapiens
tatgtgaatttt

SEQ ID NO: 1529867 - DNA, 17 bp, Homo sapiens
tatgtgcactgcctgca

SEQ ID NO: 1529868 - DNA, 19 bp, Homo sapiens
tatgtgccaaagctttact

SEQ ID NO: 1529869 - DNA, 18 bp, Homo sapiens
tatgtgcgtctctctttc

SEQ ID NO: 1529870 - DNA, 15 bp, Homo sapiens
tatgtgctatgcaaa

SEQ ID NO: 1529871 - DNA, 15 bp, Homo sapiens
tatgtgctgtaattt

SEQ ID NO: 1529872 - DNA, 12 bp, Homo sapiens
tatgtggaagtg

SEQ ID NO: 1529873 - DNA, 16 bp, Homo sapiens
tatgtggaagtgtggg

SEQ ID NO: 1529874 - DNA, 21 bp, Homo sapiens
tatgtggctgaaaatgcaaag

SEQ ID NO: 1529875 - DNA, 23 bp, Homo sapiens
tatgtggctgaaaatgcaaagct

SEQ ID NO: 1529876 - DNA, 21 bp, Homo sapiens
tatgtgggatattgaatgtta

SEQ ID NO: 1529877 - DNA, 19 bp, Homo sapiens
tatgtggtttccacgatga

SEQ ID NO: 1529878 - DNA, 12 bp, Homo sapiens
tattatgtgttt

SEQ ID NO: 1529879 - DNA, 13 bp, Homo sapiens
tattatgtttatt

SEQ ID NO: 1529880 - DNA, 17 bp, Homo sapiens
tattattaatataataa

SEQ ID NO: 1529881 - DNA, 13 bp, Homo sapiens
tattattagaaat

SEQ ID NO: 1529882 - DNA, 16 bp, Homo sapiens
tattattatgttctta

SEQ ID NO: 1529883 - DNA, 16 bp, Homo sapiens
tattattcaagtgcct

SEQ ID NO: 1529884 - DNA, 13 bp, Homo sapiens
tattattctgcag

SEQ ID NO: 1529885 - DNA, 15 bp, Homo sapiens
tattattctgcagca

SEQ ID NO: 1529886 - DNA, 23 bp, Homo sapiens
tattattctgttttgcacagtta

SEQ ID NO: 1529887 - DNA, 15 bp, Homo sapiens
tattatttattgtat

SEQ ID NO: 1529888 - DNA, 16 bp, Homo sapiens
tattatttcaccagca

SEQ ID NO: 1529889 - DNA, 22 bp, Homo sapiens
tattatttctgttcttacaaat

SEQ ID NO: 1529890 - DNA, 13 bp, Homo sapiens
tattatttcttct

SEQ ID NO: 1529891 - DNA, 14 bp, Homo sapiens
tattatttcttctc

SEQ ID NO: 1529892 - DNA, 13 bp, Homo sapiens
tattattttactg

SEQ ID NO: 1529893 - DNA, 15 bp, Homo sapiens
tattattttcacctg

SEQ ID NO: 1529894 - DNA, 20 bp, Homo sapiens
tattatttttataattgtac

SEQ ID NO: 1529895 - DNA, 23 bp, Homo sapiens
tattcaaacagtctcaggaaatc

SEQ ID NO: 1529896 - DNA, 13 bp, Homo sapiens
tattcaaatttga

SEQ ID NO: 1529897 - DNA, 13 bp, Homo sapiens
tattcaaatttgt

SEQ ID NO: 1529898 - DNA, 20 bp, Homo sapiens
tattcaacacattggaattg

SEQ ID NO: 1529899 - DNA, 20 bp, Homo sapiens
tattcaataaaaaaaagaaa

SEQ ID NO: 1529900 - DNA, 21 bp, Homo sapiens
tattcaataccgctcagtatt

SEQ ID NO: 1529901 - DNA, 23 bp, Homo sapiens
tattcaatgaacttccatttgta

SEQ ID NO: 1529902 - DNA, 14 bp, Homo sapiens
tattcaatgtgaca

SEQ ID NO: 1529903 - DNA, 16 bp, Homo sapiens
tattcaattcttttaa

SEQ ID NO: 1529904 - DNA, 22 bp, Homo sapiens
tattcacatcgcttctgtgtat

SEQ ID NO: 1529905 - DNA, 14 bp, Homo sapiens
tattcacccctgcc

SEQ ID NO: 1529906 - DNA, 19 bp, Homo sapiens
tattcacctcagtagaaaa

SEQ ID NO: 1529907 - DNA, 10 bp, Homo sapiens
tattcactct

SEQ ID NO: 1529908 - DNA, 15 bp, Homo sapiens
tattcactgtaagtt

SEQ ID NO: 1529909 - DNA, 19 bp, Homo sapiens
tattcagccagcttaaacc

SEQ ID NO: 1529910 - DNA, 16 bp, Homo sapiens
tattcaggagagtaga

SEQ ID NO: 1529911 - DNA, 16 bp, Homo sapiens
tattcagggtaaatag

SEQ ID NO: 1529912 - DNA, 18 bp, Homo sapiens
tattcagtgctgtggcct

SEQ ID NO: 1529913 - DNA, 21 bp, Homo sapiens
tattcataatgaattataaca

SEQ ID NO: 1529914 - DNA, 19 bp, Homo sapiens
tattcatatacaaacatgt

SEQ ID NO: 1529915 - DNA, 13 bp, Homo sapiens
tattcatatttgt

SEQ ID NO: 1529916 - DNA, 17 bp, Homo sapiens
tattcatatttgtactt

SEQ ID NO: 1529917 - DNA, 22 bp, Homo sapiens
tattcatatttgtactttctgt

SEQ ID NO: 1529918 - DNA, 12 bp, Homo sapiens
tattcatttaaa

SEQ ID NO: 1529919 - DNA, 14 bp, Homo sapiens
tattcatttaaaat

SEQ ID NO: 1529920 - DNA, 19 bp, Homo sapiens
tattccaagacatgtctgt

SEQ ID NO: 1529921 - DNA, 16 bp, Homo sapiens
tattccaccattcaca

SEQ ID NO: 1529922 - DNA, 21 bp, Homo sapiens
tattccatgagctgctcatta

SEQ ID NO: 1529923 - DNA, 15 bp, Homo sapiens
tattcccaagtatgc

SEQ ID NO: 1529924 - DNA, 18 bp, Homo sapiens
tattcccaagtatgcctt

SEQ ID NO: 1529925 - DNA, 19 bp, Homo sapiens
tattcccaagtatgcctta

SEQ ID NO: 1529926 - DNA, 20 bp, Homo sapiens
tattcccaagtatgccttaa

SEQ ID NO: 1529927 - DNA, 15 bp, Homo sapiens
tattcccactcacca

SEQ ID NO: 1529928 - DNA, 16 bp, Homo sapiens
tattcccactcaccag

SEQ ID NO: 1529929 - DNA, 19 bp, Homo sapiens
tattcccactcaccagccc

SEQ ID NO: 1529930 - DNA, 22 bp, Homo sapiens
catttttttttcaatcaacttt

SEQ ID NO: 1529931 - DNA, 20 bp, Homo sapiens
cattttttttttctttttgg

SEQ ID NO: 1529932 - DNA, 22 bp, Homo sapiens
cattttttttttctttttgggg

SEQ ID NO: 1529933 - DNA, 12 bp, Homo sapiens
ccaaaaaactac

SEQ ID NO: 1529934 - DNA, 23 bp, Homo sapiens
ccaaaaaatatctagtaatatat

SEQ ID NO: 1529935 - DNA, 20 bp, Homo sapiens
ccaaaaaattctacaacaca

SEQ ID NO: 1529936 - DNA, 15 bp, Homo sapiens
ccaaaaatagaaatt

SEQ ID NO: 1529937 - DNA, 16 bp, Homo sapiens
ccaaaaattagccgag

SEQ ID NO: 1529938 - DNA, 18 bp, Homo sapiens
ccaaaacaagccaaagag

SEQ ID NO: 1529939 - DNA, 22 bp, Homo sapiens
ccaaaagaagcccccagctaag

SEQ ID NO: 1529940 - DNA, 16 bp, Homo sapiens
ccaaaagggaggctct

SEQ ID NO: 1529941 - DNA, 20 bp, Homo sapiens
ccaaaataccagagccttca

SEQ ID NO: 1529942 - DNA, 14 bp, Homo sapiens
ccaaaatgtgcctc

SEQ ID NO: 1529943 - DNA, 20 bp, Homo sapiens
ccaaaattgttttgagcttt

SEQ ID NO: 1529944 - DNA, 16 bp, Homo sapiens
ccaaaatttattttat

SEQ ID NO: 1529945 - DNA, 22 bp, Homo sapiens
ccaaaatttattttataagaaa

SEQ ID NO: 1529946 - DNA, 17 bp, Homo sapiens
ccaaacaccagtcacct

SEQ ID NO: 1529947 - DNA, 15 bp, Homo sapiens
ccaaacaccttccag

SEQ ID NO: 1529948 - DNA, 13 bp, Homo sapiens
ccaaacactcagt

SEQ ID NO: 1529949 - DNA, 16 bp, Homo sapiens
ccaaacacttctgctt

SEQ ID NO: 1529950 - DNA, 17 bp, Homo sapiens
ccaaacacttctgcttt

SEQ ID NO: 1529951 - DNA, 15 bp, Homo sapiens
ccaaaccatgagaat

SEQ ID NO: 1529952 - DNA, 17 bp, Homo sapiens
ccaaacccagtctcctc

SEQ ID NO: 1529953 - DNA, 21 bp, Homo sapiens
ccaaacccctagagacagtga

SEQ ID NO: 1529954 - DNA, 15 bp, Homo sapiens
ccaaaccctcctggg

SEQ ID NO: 1529955 - DNA, 17 bp, Homo sapiens
ccaaacccttgctttcc

SEQ ID NO: 1529956 - DNA, 23 bp, Homo sapiens
ccaaacccttgctttcctgggcc

SEQ ID NO: 1529957 - DNA, 19 bp, Homo sapiens
ccaaaccgcaaacgtgaaa

SEQ ID NO: 1529958 - DNA, 17 bp, Homo sapiens
ccaaaccgccagcgaac

SEQ ID NO: 1529959 - DNA, 16 bp, Homo sapiens
ccaaaccggcaggtgc

SEQ ID NO: 1529960 - DNA, 21 bp, Homo sapiens
ccaaacctccagcctccctgt

SEQ ID NO: 1529961 - DNA, 15 bp, Homo sapiens
ccaaacctgacagat

SEQ ID NO: 1529962 - DNA, 13 bp, Homo sapiens
ccaaacctggttc

SEQ ID NO: 1529963 - DNA, 22 bp, Homo sapiens
ccaaacgccctttcctcctcag

SEQ ID NO: 1529964 - DNA, 13 bp, Homo sapiens
ccaaacgcctccc

SEQ ID NO: 1529965 - DNA, 13 bp, Homo sapiens
ccaaactacagaa

SEQ ID NO: 1529966 - DNA, 15 bp, Homo sapiens
ccaaactcaggccca

SEQ ID NO: 1529967 - DNA, 20 bp, Homo sapiens
ccaaactcagttcgaccaaa

SEQ ID NO: 1529968 - DNA, 18 bp, Homo sapiens
ccaaactcttccctctct

SEQ ID NO: 1529969 - DNA, 19 bp, Homo sapiens
ccaaactgcacacacagct

SEQ ID NO: 1529970 - DNA, 17 bp, Homo sapiens
ccaaactgccaaaaaca

SEQ ID NO: 1529971 - DNA, 14 bp, Homo sapiens
ccaaactgcctaag

SEQ ID NO: 1529972 - DNA, 22 bp, Homo sapiens
ccaaagactctggaggtcatct

SEQ ID NO: 1529973 - DNA, 18 bp, Homo sapiens
ccaaagactgcagaaccc

SEQ ID NO: 1529974 - DNA, 21 bp, Homo sapiens
ccaaagagaatcccacattag

SEQ ID NO: 1529975 - DNA, 17 bp, Homo sapiens
ccaaagagcctttccaa

SEQ ID NO: 1529976 - DNA, 21 bp, Homo sapiens
ccaaagaggctgcccctctca

SEQ ID NO: 1529977 - DNA, 22 bp, Homo sapiens
ccaaagaggctgcccctctcac

SEQ ID NO: 1529978 - DNA, 23 bp, Homo sapiens
ccaaagaggctgcccctctcacc

SEQ ID NO: 1529979 - DNA, 15 bp, Homo sapiens
ccaaagagtgatagt

SEQ ID NO: 1529980 - DNA, 10 bp, Homo sapiens
ccaaagataa

SEQ ID NO: 1529981 - DNA, 20 bp, Homo sapiens
ccaaagcaatgtgagtccca

SEQ ID NO: 1529982 - DNA, 17 bp, Homo sapiens
ccaaagcacttttaaaa

SEQ ID NO: 1529983 - DNA, 14 bp, Homo sapiens
ccaaagcatggact

SEQ ID NO: 1529984 - DNA, 23 bp, Homo sapiens
ccaaagcctagacaacctttctg

SEQ ID NO: 1529985 - DNA, 16 bp, Homo sapiens
ccaaagcgctgaggct

SEQ ID NO: 1529986 - DNA, 18 bp, Homo sapiens
ccaaagctagggtggccc

SEQ ID NO: 1529987 - DNA, 19 bp, Homo sapiens
ccaaagctagggtggccct

SEQ ID NO: 1529988 - DNA, 14 bp, Homo sapiens
ccaaagctgagcct

SEQ ID NO: 1529989 - DNA, 21 bp, Homo sapiens
ccaaagctgagcctgcaggga

SEQ ID NO: 1529990 - DNA, 18 bp, Homo sapiens
ccaaagctgcccactgtt

SEQ ID NO: 1529991 - DNA, 20 bp, Homo sapiens
ccaaagctgcccactgtttc

SEQ ID NO: 1529992 - DNA, 21 bp, Homo sapiens
ccaaagctgcccactgtttct

SEQ ID NO: 1529993 - DNA, 23 bp, Homo sapiens
tattgactttatgttgtatgatt

SEQ ID NO: 1529994 - DNA, 18 bp, Homo sapiens
tattgagatttcttaaat

SEQ ID NO: 1529995 - DNA, 19 bp, Homo sapiens
tattgagttccagttgaag

SEQ ID NO: 1529996 - DNA, 16 bp, Homo sapiens
tattgataagttcata

SEQ ID NO: 1529997 - DNA, 21 bp, Homo sapiens
tattgatatgcttatacactt

SEQ ID NO: 1529998 - DNA, 23 bp, Homo sapiens
tattgatgcaatataagcataaa

SEQ ID NO: 1529999 - DNA, 18 bp, Homo sapiens
tattgattgggaaaacat

SEQ ID NO: 1530000 - DNA, 14 bp, Homo sapiens
tattgcaataaagt

SEQ ID NO: 1530001 - DNA, 16 bp, Homo sapiens
tattgcaataaagtat

SEQ ID NO: 1530002 - DNA, 14 bp, Homo sapiens
tattgcagaatgtg

SEQ ID NO: 1530003 - DNA, 20 bp, Homo sapiens
tattgcagacctgtcaccct

SEQ ID NO: 1530004 - DNA, 11 bp, Homo sapiens
tattgcataag

SEQ ID NO: 1530005 - DNA, 20 bp, Homo sapiens
tattgccatccactcctttt

SEQ ID NO: 1530006 - DNA, 13 bp, Homo sapiens
tattgccttattt

SEQ ID NO: 1530007 - DNA, 17 bp, Homo sapiens
tattgccttatttgtct

SEQ ID NO: 1530008 - DNA, 20 bp, Homo sapiens
tattgccttatttgtctgta

SEQ ID NO: 1530009 - DNA, 15 bp, Homo sapiens
tattgctaattgtgt

SEQ ID NO: 1530010 - DNA, 17 bp, Homo sapiens
tattgctatctaatggg

SEQ ID NO: 1530011 - DNA, 21 bp, Homo sapiens
tattgctgtgtcttcattttc

SEQ ID NO: 1530012 - DNA, 18 bp, Homo sapiens
tattgcttagtaagtatt

SEQ ID NO: 1530013 - DNA, 14 bp, Homo sapiens
tattgcttatttta

SEQ ID NO: 1530014 - DNA, 15 bp, Homo sapiens
tattgcttattttat

SEQ ID NO: 1530015 - DNA, 14 bp, Homo sapiens
tattggaaggtatt

SEQ ID NO: 1530016 - DNA, 19 bp, Homo sapiens
tattggaagtgttcaagaa

SEQ ID NO: 1530017 - DNA, 17 bp, Homo sapiens
tattggactccaggcct

SEQ ID NO: 1530018 - DNA, 14 bp, Homo sapiens
tattggccactggg

SEQ ID NO: 1530019 - DNA, 20 bp, Homo sapiens
tattgggagtcttaataaaa

SEQ ID NO: 1530020 - DNA, 22 bp, Homo sapiens
tattggtccagcttgctcttca

SEQ ID NO: 1530021 - DNA, 20 bp, Homo sapiens
tattggtttaaagaaagtgt

SEQ ID NO: 1530022 - DNA, 18 bp, Homo sapiens
tattgtaatcgtgtgcca

SEQ ID NO: 1530023 - DNA, 13 bp, Homo sapiens
tattgtaatgtaa

SEQ ID NO: 1530024 - DNA, 15 bp, Homo sapiens
tattgtacagactgt

SEQ ID NO: 1530025 - DNA, 17 bp, Homo sapiens
tattgtacagactgttt

SEQ ID NO: 1530026 - DNA, 14 bp, Homo sapiens
tattgtacataaaa

SEQ ID NO: 1530027 - DNA, 22 bp, Homo sapiens
tattgtacataaaagaattttt

SEQ ID NO: 1530028 - DNA, 11 bp, Homo sapiens
tattgtacctc

SEQ ID NO: 1530029 - DNA, 13 bp, Homo sapiens
tattgtatcattt

SEQ ID NO: 1530030 - DNA, 17 bp, Homo sapiens
tattgtattaggaaaat

SEQ ID NO: 1530031 - DNA, 15 bp, Homo sapiens
tattgtatttatgtg

SEQ ID NO: 1530032 - DNA, 19 bp, Homo sapiens
tattgtcagaaaagtgatt

SEQ ID NO: 1530033 - DNA, 21 bp, Homo sapiens
tattgtcatggggatcaattt

SEQ ID NO: 1530034 - DNA, 17 bp, Homo sapiens
tattgtccttcagagct

SEQ ID NO: 1530035 - DNA, 17 bp, Homo sapiens
tattgtgacttcactgt

SEQ ID NO: 1530036 - DNA, 18 bp, Homo sapiens
tattgtgacttcactgta

SEQ ID NO: 1530037 - DNA, 17 bp, Homo sapiens
tattgtgtgttatttaa

SEQ ID NO: 1530038 - DNA, 17 bp, Homo sapiens
tattgttaaacaaatga

SEQ ID NO: 1530039 - DNA, 16 bp, Homo sapiens
tattgttaatacaagg

SEQ ID NO: 1530040 - DNA, 22 bp, Homo sapiens
tattgttagaaaatgacttatt

SEQ ID NO: 1530041 - DNA, 20 bp, Homo sapiens
tattgttagggtcagccatt

SEQ ID NO: 1530042 - DNA, 15 bp, Homo sapiens
tattgttagtggact

SEQ ID NO: 1530043 - DNA, 14 bp, Homo sapiens
tattgttgaaaaag

SEQ ID NO: 1530044 - DNA, 17 bp, Homo sapiens
tattgttgaaaaagttt

SEQ ID NO: 1530045 - DNA, 15 bp, Homo sapiens
tattgtttaaaatca

SEQ ID NO: 1530046 - DNA, 14 bp, Homo sapiens
tattgtttatgtaa

SEQ ID NO: 1530047 - DNA, 22 bp, Homo sapiens
tattgtttattctttttaaagt

SEQ ID NO: 1530048 - DNA, 24 bp, Homo sapiens
tattgtttattctttttaaagtat

SEQ ID NO: 1530049 - DNA, 15 bp, Homo sapiens
ccaacaactctgcct

SEQ ID NO: 1530050 - DNA, 21 bp, Homo sapiens
ccaacaagaccgccccagggc

SEQ ID NO: 1530051 - DNA, 14 bp, Homo sapiens
ccaacaagcagctg

SEQ ID NO: 1530052 - DNA, 14 bp, Homo sapiens
ccaacaccacagac

SEQ ID NO: 1530053 - DNA, 15 bp, Homo sapiens
ccaacaccacagaca

SEQ ID NO: 1530054 - DNA, 20 bp, Homo sapiens
ccaacaccctgtctaaaaaa

SEQ ID NO: 1530055 - DNA, 14 bp, Homo sapiens
ccaacacgagcagg

SEQ ID NO: 1530056 - DNA, 21 bp, Homo sapiens
ccaacacgagcaggctactgt

SEQ ID NO: 1530057 - DNA, 18 bp, Homo sapiens
ccaacactgtgccctggt

SEQ ID NO: 1530058 - DNA, 18 bp, Homo sapiens
ccaacagaaggaaggagg

SEQ ID NO: 1530059 - DNA, 16 bp, Homo sapiens
ccaacagaggcctccc

SEQ ID NO: 1530060 - DNA, 16 bp, Homo sapiens
ccaacagcacctcccc

SEQ ID NO: 1530061 - DNA, 19 bp, Homo sapiens
ccaacagtcaaaacagaga

SEQ ID NO: 1530062 - DNA, 12 bp, Homo sapiens
ccaacagttgta

SEQ ID NO: 1530063 - DNA, 20 bp, Homo sapiens
ccaacagttgtatgtttgct

SEQ ID NO: 1530064 - DNA, 23 bp, Homo sapiens
ccaacataaaacaaaaccaagcc

SEQ ID NO: 1530065 - DNA, 17 bp, Homo sapiens
ccaacatatatttattg

SEQ ID NO: 1530066 - DNA, 13 bp, Homo sapiens
ccaacatcaacat

SEQ ID NO: 1530067 - DNA, 16 bp, Homo sapiens
ccaacatccagtcctg

SEQ ID NO: 1530068 - DNA, 17 bp, Homo sapiens
ccaacatcccattgccc

SEQ ID NO: 1530069 - DNA, 16 bp, Homo sapiens
ccaacatctccctccc

SEQ ID NO: 1530070 - DNA, 12 bp, Homo sapiens
ccaacatctttg

SEQ ID NO: 1530071 - DNA, 14 bp, Homo sapiens
ccaacatgaggaca

SEQ ID NO: 1530072 - DNA, 17 bp, Homo sapiens
ccaacatgaggacagaa

SEQ ID NO: 1530073 - DNA, 21 bp, Homo sapiens
ccaacatgaggacagaaggac

SEQ ID NO: 1530074 - DNA, 22 bp, Homo sapiens
ccaacatgaggacagaaggact

SEQ ID NO: 1530075 - DNA, 22 bp, Homo sapiens
ccaacatggagaaaccctgtct

SEQ ID NO: 1530076 - DNA, 15 bp, Homo sapiens
ccaacatttctcact

SEQ ID NO: 1530077 - DNA, 13 bp, Homo sapiens
ccaacatttcttg

SEQ ID NO: 1530078 - DNA, 19 bp, Homo sapiens
ccaaccacagcatcgggag

SEQ ID NO: 1530079 - DNA, 17 bp, Homo sapiens
ccaaccactgtgccact

SEQ ID NO: 1530080 - DNA, 17 bp, Homo sapiens
ccaaccagacctggaag

SEQ ID NO: 1530081 - DNA, 22 bp, Homo sapiens
ccaaccagcccgacagtgccat

SEQ ID NO: 1530082 - DNA, 20 bp, Homo sapiens
ccaaccaggccttcatcctc

SEQ ID NO: 1530083 - DNA, 13 bp, Homo sapiens
ccaacccagccac

SEQ ID NO: 1530084 - DNA, 12 bp, Homo sapiens
ccaacccatcag

SEQ ID NO: 1530085 - DNA, 23 bp, Homo sapiens
ccaaccccagcatcagcctgtag

SEQ ID NO: 1530086 - DNA, 13 bp, Homo sapiens
ccaacccccaccc

SEQ ID NO: 1530087 - DNA, 18 bp, Homo sapiens
ccaacccccaccccacac

SEQ ID NO: 1530088 - DNA, 16 bp, Homo sapiens
ccaacccccatctccc

SEQ ID NO: 1530089 - DNA, 14 bp, Homo sapiens
ccaaccccccagca

SEQ ID NO: 1530090 - DNA, 13 bp, Homo sapiens
ccaacccccctcc

SEQ ID NO: 1530091 - DNA, 16 bp, Homo sapiens
ccaacccccctcctgc

SEQ ID NO: 1530092 - DNA, 20 bp, Homo sapiens
ccaacccccctcctgctcct

SEQ ID NO: 1530093 - DNA, 22 bp, Homo sapiens
ccaacccccctcctgctcctcc

SEQ ID NO: 1530094 - DNA, 23 bp, Homo sapiens
ccaacccccctcctgctcctccc

SEQ ID NO: 1530095 - DNA, 22 bp, Homo sapiens
ccaaccccgcggtgctctggcg

SEQ ID NO: 1530096 - DNA, 17 bp, Homo sapiens
ccaaccctggcttgggg

SEQ ID NO: 1530097 - DNA, 16 bp, Homo sapiens
ccaaccctgtcctccc

SEQ ID NO: 1530098 - DNA, 16 bp, Homo sapiens
ccaaccctgtgggctt

SEQ ID NO: 1530099 - DNA, 16 bp, Homo sapiens
ccaaccgtgtctgtct

SEQ ID NO: 1530100 - DNA, 19 bp, Homo sapiens
ccaacctcaatgccctgcc

SEQ ID NO: 1530101 - DNA, 23 bp, Homo sapiens
ccaacctcaatgccctgccatta

SEQ ID NO: 1530102 - DNA, 13 bp, Homo sapiens
ccaacctcctgct

SEQ ID NO: 1530103 - DNA, 14 bp, Homo sapiens
ccaacctcctgctc

SEQ ID NO: 1530104 - DNA, 20 bp, Homo sapiens
ccaacctgaaggtcccctgg

SEQ ID NO: 1530105 - DNA, 22 bp, Homo sapiens
ccaacctgaaggtcccctggca

SEQ ID NO: 1530106 - DNA, 23 bp, Homo sapiens
ccaacctgaaggtcccctggcag

SEQ ID NO: 1530107 - DNA, 12 bp, Homo sapiens
ccaacctgacca

SEQ ID NO: 1530108 - DNA, 20 bp, Homo sapiens
tatttatacaagattgaaaa

SEQ ID NO: 1530109 - DNA, 19 bp, Homo sapiens
tatttatacccccaggaaa

SEQ ID NO: 1530110 - DNA, 11 bp, Homo sapiens
tatttatactc

SEQ ID NO: 1530111 - DNA, 15 bp, Homo sapiens
tatttatactctaga

SEQ ID NO: 1530112 - DNA, 18 bp, Homo sapiens
tatttatagaacagttga

SEQ ID NO: 1530113 - DNA, 18 bp, Homo sapiens
tatttatatatttataac

SEQ ID NO: 1530114 - DNA, 16 bp, Homo sapiens
tatttatatgtactgt

SEQ ID NO: 1530115 - DNA, 15 bp, Homo sapiens
tatttatcagtgaca

SEQ ID NO: 1530116 - DNA, 20 bp, Homo sapiens
tatttatctgtgcaaatcct

SEQ ID NO: 1530117 - DNA, 22 bp, Homo sapiens
tatttatgggcccctggcactc

SEQ ID NO: 1530118 - DNA, 15 bp, Homo sapiens
tatttattacctctg

SEQ ID NO: 1530119 - DNA, 18 bp, Homo sapiens
tatttattagccaactgt

SEQ ID NO: 1530120 - DNA, 19 bp, Homo sapiens
tatttattcactgtaagtt

SEQ ID NO: 1530121 - DNA, 12 bp, Homo sapiens
tatttattgact

SEQ ID NO: 1530122 - DNA, 13 bp, Homo sapiens
tatttattgcatt

SEQ ID NO: 1530123 - DNA, 14 bp, Homo sapiens
tatttattgtatta

SEQ ID NO: 1530124 - DNA, 11 bp, Homo sapiens
tatttattgtt

SEQ ID NO: 1530125 - DNA, 16 bp, Homo sapiens
tatttattgttagaaa

SEQ ID NO: 1530126 - DNA, 22 bp, Homo sapiens
tatttattgttcgatgcctgca

SEQ ID NO: 1530127 - DNA, 16 bp, Homo sapiens
tatttattgtttattt

SEQ ID NO: 1530128 - DNA, 17 bp, Homo sapiens
tatttatttactgagct

SEQ ID NO: 1530129 - DNA, 11 bp, Homo sapiens
tatttatttat

SEQ ID NO: 1530130 - DNA, 16 bp, Homo sapiens
tatttattttcctaaa

SEQ ID NO: 1530131 - DNA, 20 bp, Homo sapiens
tatttattttcctaaagaga

SEQ ID NO: 1530132 - DNA, 15 bp, Homo sapiens
tatttatttttcttg

SEQ ID NO: 1530133 - DNA, 20 bp, Homo sapiens
tatttattttttttaagtat

SEQ ID NO: 1530134 - DNA, 11 bp, Homo sapiens
tatttcaagtg

SEQ ID NO: 1530135 - DNA, 15 bp, Homo sapiens
tatttcaagtgccta

SEQ ID NO: 1530136 - DNA, 14 bp, Homo sapiens
tatttcaatctttt

SEQ ID NO: 1530137 - DNA, 15 bp, Homo sapiens
tatttcacagagcac

SEQ ID NO: 1530138 - DNA, 23 bp, Homo sapiens
tatttcacagagcacgcctgcca

SEQ ID NO: 1530139 - DNA, 14 bp, Homo sapiens
tatttcagaagttt

SEQ ID NO: 1530140 - DNA, 16 bp, Homo sapiens
tatttcagaagtttaa

SEQ ID NO: 1530141 - DNA, 15 bp, Homo sapiens
tatttcagacatttt

SEQ ID NO: 1530142 - DNA, 20 bp, Homo sapiens
tatttcagacattttcactg

SEQ ID NO: 1530143 - DNA, 18 bp, Homo sapiens
tatttcagatatcaaaat

SEQ ID NO: 1530144 - DNA, 19 bp, Homo sapiens
tatttcagatatcaaaatt

SEQ ID NO: 1530145 - DNA, 21 bp, Homo sapiens
tatttcagatatcaaaattct

SEQ ID NO: 1530146 - DNA, 19 bp, Homo sapiens
tatttcagtgttacctgtg

SEQ ID NO: 1530147 - DNA, 20 bp, Homo sapiens
tatttcagtgttacctgtgt

SEQ ID NO: 1530148 - DNA, 20 bp, Homo sapiens
tatttcagttttaaatgtac

SEQ ID NO: 1530149 - DNA, 18 bp, Homo sapiens
tatttccaaacctggttc

SEQ ID NO: 1530150 - DNA, 19 bp, Homo sapiens
tatttccaaacctggttca

SEQ ID NO: 1530151 - DNA, 13 bp, Homo sapiens
tatttccaacaaa

SEQ ID NO: 1530152 - DNA, 14 bp, Homo sapiens
tatttccaacaaac

SEQ ID NO: 1530153 - DNA, 20 bp, Homo sapiens
tatttccactattttcaaag

SEQ ID NO: 1530154 - DNA, 14 bp, Homo sapiens
tatttccactgaac

SEQ ID NO: 1530155 - DNA, 11 bp, Homo sapiens
tatttccagac

SEQ ID NO: 1530156 - DNA, 21 bp, Homo sapiens
tatttccccaggggaaaatga

SEQ ID NO: 1530157 - DNA, 22 bp, Homo sapiens
tatttccccaggggaaaatgaa

SEQ ID NO: 1530158 - DNA, 19 bp, Homo sapiens
tatttcccctcttctgcta

SEQ ID NO: 1530159 - DNA, 22 bp, Homo sapiens
tatttccctcacctttcccatc

SEQ ID NO: 1530160 - DNA, 15 bp, Homo sapiens
tatttcccttccaaa

SEQ ID NO: 1530161 - DNA, 17 bp, Homo sapiens
tatttcccttccaaaga

SEQ ID NO: 1530162 - DNA, 13 bp, Homo sapiens
tatttccctttag

SEQ ID NO: 1530163 - DNA, 22 bp, Homo sapiens
tatttcctgaacctggaaatga

SEQ ID NO: 1530164 - DNA, 21 bp, Homo sapiens
tatttcctgacttgagtgttc

SEQ ID NO: 1530165 - DNA, 14 bp, Homo sapiens
tatttcctttatgt

SEQ ID NO: 1530166 - DNA, 15 bp, Homo sapiens
tatttcgaaagctgc

SEQ ID NO: 1530167 - DNA, 19 bp, Homo sapiens
tatttcgagtgttgtgtta

SEQ ID NO: 1530168 - DNA, 14 bp, Homo sapiens
tataccaataaagt

SEQ ID NO: 1530169 - DNA, 15 bp, Homo sapiens
tataccaataaagtg

SEQ ID NO: 1530170 - DNA, 14 bp, Homo sapiens
tataccatttcctc

SEQ ID NO: 1530171 - DNA, 14 bp, Homo sapiens
tatacccacccaga

SEQ ID NO: 1530172 - DNA, 22 bp, Homo sapiens
tatacccacccagaatgagaca

SEQ ID NO: 1530173 - DNA, 16 bp, Homo sapiens
tatacccagaaagtta

SEQ ID NO: 1530174 - DNA, 20 bp, Homo sapiens
tatacctgattttttttcct

SEQ ID NO: 1530175 - DNA, 14 bp, Homo sapiens
tatacctggctttt

SEQ ID NO: 1530176 - DNA, 18 bp, Homo sapiens
tatacctgtttaaattgc

SEQ ID NO: 1530177 - DNA, 21 bp, Homo sapiens
tatacctgtttaaattgctca

SEQ ID NO: 1530178 - DNA, 21 bp, Homo sapiens
tataccttatttatttttgtg

SEQ ID NO: 1530179 - DNA, 21 bp, Homo sapiens
tatactctcaccatttggatc

SEQ ID NO: 1530180 - DNA, 11 bp, Homo sapiens
tatactgcata

SEQ ID NO: 1530181 - DNA, 16 bp, Homo sapiens
tatactgcatactttt

SEQ ID NO: 1530182 - DNA, 16 bp, Homo sapiens
tatactgctatttaca

SEQ ID NO: 1530183 - DNA, 18 bp, Homo sapiens
tatactgtatgtgccaaa

SEQ ID NO: 1530184 - DNA, 13 bp, Homo sapiens
tatactgtattaa

SEQ ID NO: 1530185 - DNA, 16 bp, Homo sapiens
tatactgtttgtaata

SEQ ID NO: 1530186 - DNA, 19 bp, Homo sapiens
tatactgtttgtaatatac

SEQ ID NO: 1530187 - DNA, 18 bp, Homo sapiens
tatacttaaaaattaata

SEQ ID NO: 1530188 - DNA, 17 bp, Homo sapiens
tatactttaatgtttta

SEQ ID NO: 1530189 - DNA, 12 bp, Homo sapiens
tatactttagta

SEQ ID NO: 1530190 - DNA, 15 bp, Homo sapiens
tatactttattgaaa

SEQ ID NO: 1530191 - DNA, 12 bp, Homo sapiens
tatactttgttc

SEQ ID NO: 1530192 - DNA, 15 bp, Homo sapiens
tatactttgttctgt

SEQ ID NO: 1530193 - DNA, 17 bp, Homo sapiens
tatagaaaacctgactt

SEQ ID NO: 1530194 - DNA, 14 bp, Homo sapiens
tatagaaacacgaa

SEQ ID NO: 1530195 - DNA, 23 bp, Homo sapiens
catgtgagccaccgctgccagca

SEQ ID NO: 1530196 - DNA, 19 bp, Homo sapiens
catgtgaggaggaaaagga

SEQ ID NO: 1530197 - DNA, 16 bp, Homo sapiens
catgtgagtccctgtg

SEQ ID NO: 1530198 - DNA, 17 bp, Homo sapiens
catgtgatctcattgtt

SEQ ID NO: 1530199 - DNA, 11 bp, Homo sapiens
catgtgccaag

SEQ ID NO: 1530200 - DNA, 15 bp, Homo sapiens
catgtgccacacagt

SEQ ID NO: 1530201 - DNA, 17 bp, Homo sapiens
catgtgccatctgtaca

SEQ ID NO: 1530202 - DNA, 19 bp, Homo sapiens
catgtgccatctgtacata

SEQ ID NO: 1530203 - DNA, 18 bp, Homo sapiens
catgtgcctgcaccagga

SEQ ID NO: 1530204 - DNA, 22 bp, Homo sapiens
catgtgcctgcaccaggagaca

SEQ ID NO: 1530205 - DNA, 20 bp, Homo sapiens
catgtgctagtcactggcag

SEQ ID NO: 1530206 - DNA, 19 bp, Homo sapiens
catgtgctgtgaccattta

SEQ ID NO: 1530207 - DNA, 20 bp, Homo sapiens
catgtggaaggcaagccagg

SEQ ID NO: 1530208 - DNA, 22 bp, Homo sapiens
catgtggaaggcaagccaggct

SEQ ID NO: 1530209 - DNA, 19 bp, Homo sapiens
catgtggccatggcctctg

SEQ ID NO: 1530210 - DNA, 20 bp, Homo sapiens
catgtggccatggcctctgc

SEQ ID NO: 1530211 - DNA, 21 bp, Homo sapiens
catgtggccatggcctctgca

SEQ ID NO: 1530212 - DNA, 14 bp, Homo sapiens
catgtggcctgtgg

SEQ ID NO: 1530213 - DNA, 17 bp, Homo sapiens
catgtggcctttatctc

SEQ ID NO: 1530214 - DNA, 13 bp, Homo sapiens
catgtggctggaa

SEQ ID NO: 1530215 - DNA, 15 bp, Homo sapiens
catgtggctggaaga

SEQ ID NO: 1530216 - DNA, 15 bp, Homo sapiens
catgtgggcacggag

SEQ ID NO: 1530217 - DNA, 21 bp, Homo sapiens
catgtgggcgcccaccctggg

SEQ ID NO: 1530218 - DNA, 22 bp, Homo sapiens
catgtgggcgcccaccctgggc

SEQ ID NO: 1530219 - DNA, 23 bp, Homo sapiens
catgtgggcgcccaccctgggct

SEQ ID NO: 1530220 - DNA, 18 bp, Homo sapiens
catgtggggccaggtcac

SEQ ID NO: 1530221 - DNA, 16 bp, Homo sapiens
catgtgggtgagccag

SEQ ID NO: 1530222 - DNA, 12 bp, Homo sapiens
catgtgtacata

SEQ ID NO: 1530223 - DNA, 15 bp, Homo sapiens
catgtgtacattctg

SEQ ID NO: 1530224 - DNA, 14 bp, Homo sapiens
catgtgtataaaaa

SEQ ID NO: 1530225 - DNA, 17 bp, Homo sapiens
catgtgtataaaaataa

SEQ ID NO: 1530226 - DNA, 18 bp, Homo sapiens
catgtgtcccaggagcag

SEQ ID NO: 1530227 - DNA, 15 bp, Homo sapiens
catgtgtgcatgtga

SEQ ID NO: 1530228 - DNA, 12 bp, Homo sapiens
catgtgtgcctg

SEQ ID NO: 1530229 - DNA, 13 bp, Homo sapiens
catgtgtgcctgt

SEQ ID NO: 1530230 - DNA, 13 bp, Homo sapiens
catgtgtgtgtct

SEQ ID NO: 1530231 - DNA, 18 bp, Homo sapiens
catgtgtgtgtctgtctt

SEQ ID NO: 1530232 - DNA, 24 bp, Homo sapiens
catgtgttgcaaattattctagtc

SEQ ID NO: 1530233 - DNA, 16 bp, Homo sapiens
catgttaaattagaat

SEQ ID NO: 1530234 - DNA, 13 bp, Homo sapiens
catgttaatttca

SEQ ID NO: 1530235 - DNA, 17 bp, Homo sapiens
catgttacataagataa

SEQ ID NO: 1530236 - DNA, 21 bp, Homo sapiens
catgttacataagataaatgt

SEQ ID NO: 1530237 - DNA, 18 bp, Homo sapiens
catgttagcaaacgcagc

SEQ ID NO: 1530238 - DNA, 21 bp, Homo sapiens
catgttagttaccttatagtt

SEQ ID NO: 1530239 - DNA, 12 bp, Homo sapiens
catgttatgctg

SEQ ID NO: 1530240 - DNA, 21 bp, Homo sapiens
catgttcattataatctcaaa

SEQ ID NO: 1530241 - DNA, 21 bp, Homo sapiens
catgttcctcaaaagcaccct

SEQ ID NO: 1530242 - DNA, 21 bp, Homo sapiens
catgttctgtgacatcctgct

SEQ ID NO: 1530243 - DNA, 13 bp, Homo sapiens
catgttgatttct

SEQ ID NO: 1530244 - DNA, 17 bp, Homo sapiens
catgttgcccctttctc

SEQ ID NO: 1530245 - DNA, 13 bp, Homo sapiens
catgttggccagg

SEQ ID NO: 1530246 - DNA, 16 bp, Homo sapiens
catgttggccaggctg

SEQ ID NO: 1530247 - DNA, 21 bp, Homo sapiens
catgttggccaggctggtcta

SEQ ID NO: 1530248 - DNA, 21 bp, Homo sapiens
catgttgggaaacttggctcg

SEQ ID NO: 1530249 - DNA, 16 bp, Homo sapiens
catgttgtaatgctgc

SEQ ID NO: 1530250 - DNA, 17 bp, Homo sapiens
catgttgtaatgctgca

SEQ ID NO: 1530251 - DNA, 22 bp, Homo sapiens
catgtttaaatagcctaaatga

SEQ ID NO: 1530252 - DNA, 12 bp, Homo sapiens
catgtttataaa

SEQ ID NO: 1530253 - DNA, 13 bp, Homo sapiens
catgtttataaat

SEQ ID NO: 1530254 - DNA, 14 bp, Homo sapiens
catgtttatgtaaa

SEQ ID NO: 1530255 - DNA, 21 bp, Homo sapiens
catgtttatttatttccagtg

SEQ ID NO: 1530256 - DNA, 21 bp, Homo sapiens
catgtttcctctagttctttg

SEQ ID NO: 1530257 - DNA, 21 bp, Homo sapiens
catgtttctcacattgctgta

SEQ ID NO: 1530258 - DNA, 11 bp, Homo sapiens
catgtttcttt

SEQ ID NO: 1530259 - DNA, 22 bp, Homo sapiens
catgtttctttgatcatgaata

SEQ ID NO: 1530260 - DNA, 16 bp, Homo sapiens
catgtttgagctcaga

SEQ ID NO: 1530261 - DNA, 19 bp, Homo sapiens
catgtttgagctcagaccc

SEQ ID NO: 1530262 - DNA, 18 bp, Homo sapiens
catgttttagcatttgta

SEQ ID NO: 1530263 - DNA, 10 bp, Homo sapiens
catgttttct

SEQ ID NO: 1530264 - DNA, 16 bp, Homo sapiens
catgttttgcatgtaa

SEQ ID NO: 1530265 - DNA, 20 bp, Homo sapiens
catgtttttctattaaaaat

SEQ ID NO: 1530266 - DNA, 12 bp, Homo sapiens
cattaaaacaat

SEQ ID NO: 1530267 - DNA, 14 bp, Homo sapiens
cattaaaactgctt

SEQ ID NO: 1530268 - DNA, 20 bp, Homo sapiens
cattaaaatatagagacagg

SEQ ID NO: 1530269 - DNA, 13 bp, Homo sapiens
cattaaagtcaga

SEQ ID NO: 1530270 - DNA, 17 bp, Homo sapiens
cattaaagtcagaagtt

SEQ ID NO: 1530271 - DNA, 13 bp, Homo sapiens
cattaacacaaag

SEQ ID NO: 1530272 - DNA, 13 bp, Homo sapiens
cattaacatgttt

SEQ ID NO: 1530273 - DNA, 19 bp, Homo sapiens
cattaactccctccaccag

SEQ ID NO: 1530274 - DNA, 22 bp, Homo sapiens
cattaactccctccaccagcct

SEQ ID NO: 1530275 - DNA, 18 bp, Homo sapiens
cattaaggggaagaatga

SEQ ID NO: 1530276 - DNA, 19 bp, Homo sapiens
cattaaggggaagaatgaa

SEQ ID NO: 1530277 - DNA, 23 bp, Homo sapiens
cattaaggggaagaatgaaagct

SEQ ID NO: 1530278 - DNA, 21 bp, Homo sapiens
cattaaggttatgcactgcct

SEQ ID NO: 1530279 - DNA, 16 bp, Homo sapiens
cattaataaagttgct

SEQ ID NO: 1530280 - DNA, 12 bp, Homo sapiens
cattaatattta

SEQ ID NO: 1530281 - DNA, 20 bp, Homo sapiens
cattaatcagttcattagaa

SEQ ID NO: 1530282 - DNA, 17 bp, Homo sapiens
cattaatctcaaagaga

SEQ ID NO: 1530283 - DNA, 14 bp, Homo sapiens
tatatatttataac

SEQ ID NO: 1530284 - DNA, 13 bp, Homo sapiens
tatatatttctaa

SEQ ID NO: 1530285 - DNA, 13 bp, Homo sapiens
tatatatttctat

SEQ ID NO: 1530286 - DNA, 17 bp, Homo sapiens
tatatatttctattatt

SEQ ID NO: 1530287 - DNA, 16 bp, Homo sapiens
tatatattttgtgtga

SEQ ID NO: 1530288 - DNA, 19 bp, Homo sapiens
tatatattttgttgttcct

SEQ ID NO: 1530289 - DNA, 22 bp, Homo sapiens
tatatatttttggttgtcaata

SEQ ID NO: 1530290 - DNA, 19 bp, Homo sapiens
tatatatttttttttggat

SEQ ID NO: 1530291 - DNA, 15 bp, Homo sapiens
tatatcaaacatgca

SEQ ID NO: 1530292 - DNA, 22 bp, Homo sapiens
tatatcaacagatagttgtgtt

SEQ ID NO: 1530293 - DNA, 17 bp, Homo sapiens
tatatcacacaatatag

SEQ ID NO: 1530294 - DNA, 11 bp, Homo sapiens
tatatcagcct

SEQ ID NO: 1530295 - DNA, 23 bp, Homo sapiens
tatatcagcctgagtctcctgtg

SEQ ID NO: 1530296 - DNA, 20 bp, Homo sapiens
tatatcagtcgttttagtgt

SEQ ID NO: 1530297 - DNA, 14 bp, Homo sapiens
tatatcatatgtat

SEQ ID NO: 1530298 - DNA, 16 bp, Homo sapiens
tatatcctttctaaca

SEQ ID NO: 1530299 - DNA, 14 bp, Homo sapiens
tatatctacaatat

SEQ ID NO: 1530300 - DNA, 16 bp, Homo sapiens
tatatctacaatatat

SEQ ID NO: 1530301 - DNA, 21 bp, Homo sapiens
tatatctaccccagactagat

SEQ ID NO: 1530302 - DNA, 14 bp, Homo sapiens
tatatctctatttg

SEQ ID NO: 1530303 - DNA, 12 bp, Homo sapiens
tatatctgtaaa

SEQ ID NO: 1530304 - DNA, 13 bp, Homo sapiens
tatatctgtaaat

SEQ ID NO: 1530305 - DNA, 22 bp, Homo sapiens
tatatgaatttaaatataattc

SEQ ID NO: 1530306 - DNA, 17 bp, Homo sapiens
tatatgattctctgtgg

SEQ ID NO: 1530307 - DNA, 21 bp, Homo sapiens
tatatgctctgcatgttacat

SEQ ID NO: 1530308 - DNA, 16 bp, Homo sapiens
tatatgcttactgata

SEQ ID NO: 1530309 - DNA, 17 bp, Homo sapiens
tatatgcttactgatat

SEQ ID NO: 1530310 - DNA, 15 bp, Homo sapiens
tatatggaagaaagt

SEQ ID NO: 1530311 - DNA, 16 bp, Homo sapiens
tatatggaagaaagta

SEQ ID NO: 1530312 - DNA, 23 bp, Homo sapiens
tatatggaggattctttccccag

SEQ ID NO: 1530313 - DNA, 15 bp, Homo sapiens
cattagtactttgtg

SEQ ID NO: 1530314 - DNA, 22 bp, Homo sapiens
cattagttactttattgaaggt

SEQ ID NO: 1530315 - DNA, 21 bp, Homo sapiens
cattagttgcactaactgctg

SEQ ID NO: 1530316 - DNA, 16 bp, Homo sapiens
cattagttttagaggc

SEQ ID NO: 1530317 - DNA, 13 bp, Homo sapiens
cattataaacgtg

SEQ ID NO: 1530318 - DNA, 20 bp, Homo sapiens
cattataacaactatttact

SEQ ID NO: 1530319 - DNA, 15 bp, Homo sapiens
cattataatctcaaa

SEQ ID NO: 1530320 - DNA, 22 bp, Homo sapiens
cattataatctcaaaggagaaa

SEQ ID NO: 1530321 - DNA, 13 bp, Homo sapiens
cattatcctaggg

SEQ ID NO: 1530322 - DNA, 16 bp, Homo sapiens
cattatcgggagcagt

SEQ ID NO: 1530323 - DNA, 17 bp, Homo sapiens
cattatcgggagcagtg

SEQ ID NO: 1530324 - DNA, 13 bp, Homo sapiens
cattatctcaaaa

SEQ ID NO: 1530325 - DNA, 16 bp, Homo sapiens
cattatctcacttagt

SEQ ID NO: 1530326 - DNA, 14 bp, Homo sapiens
cattatgatctaat

SEQ ID NO: 1530327 - DNA, 20 bp, Homo sapiens
cattatgatctaataaactt

SEQ ID NO: 1530328 - DNA, 22 bp, Homo sapiens
cattatgatctaataaacttta

SEQ ID NO: 1530329 - DNA, 14 bp, Homo sapiens
cattatgattcttt

SEQ ID NO: 1530330 - DNA, 22 bp, Homo sapiens
cattatgcacttttagaaatgc

SEQ ID NO: 1530331 - DNA, 14 bp, Homo sapiens
cattatgcctggct

SEQ ID NO: 1530332 - DNA, 22 bp, Homo sapiens
cattatggtagaatcattttta

SEQ ID NO: 1530333 - DNA, 20 bp, Homo sapiens
cattatgtaaaatgttttag

SEQ ID NO: 1530334 - DNA, 21 bp, Homo sapiens
cattatgtccactgtgtatag

SEQ ID NO: 1530335 - DNA, 22 bp, Homo sapiens
cattatgtccactgtgtataga

SEQ ID NO: 1530336 - DNA, 17 bp, Homo sapiens
cattattaaattgtaaa

SEQ ID NO: 1530337 - DNA, 16 bp, Homo sapiens
cattattatttctgtt

SEQ ID NO: 1530338 - DNA, 20 bp, Homo sapiens
cattattgacgaactggcta

SEQ ID NO: 1530339 - DNA, 16 bp, Homo sapiens
cattatttcttcccag

SEQ ID NO: 1530340 - DNA, 13 bp, Homo sapiens
cattatttgcatg

SEQ ID NO: 1530341 - DNA, 20 bp, Homo sapiens
cattatttttgttagcaaag

SEQ ID NO: 1530342 - DNA, 21 bp, Homo sapiens
cattatttttgttagcaaaga

SEQ ID NO: 1530343 - DNA, 19 bp, Homo sapiens
cattcaaaaaactctctcc

SEQ ID NO: 1530344 - DNA, 13 bp, Homo sapiens
cattcaaaatagt

SEQ ID NO: 1530345 - DNA, 18 bp, Homo sapiens
cattcaaaatagttctat

SEQ ID NO: 1530346 - DNA, 16 bp, Homo sapiens
cattcaaatcagtgat

SEQ ID NO: 1530347 - DNA, 19 bp, Homo sapiens
cattcaaatcagtgatcta

SEQ ID NO: 1530348 - DNA, 18 bp, Homo sapiens
cattcaagcctgtgaata

SEQ ID NO: 1530349 - DNA, 16 bp, Homo sapiens
cattcaatacaagtgt

SEQ ID NO: 1530350 - DNA, 21 bp, Homo sapiens
cattcaattagtggtcataaa

SEQ ID NO: 1530351 - DNA, 17 bp, Homo sapiens
cattcacacagggctct

SEQ ID NO: 1530352 - DNA, 15 bp, Homo sapiens
cattcacatttagaa

SEQ ID NO: 1530353 - DNA, 20 bp, Homo sapiens
cattcacatttgatgtacat

SEQ ID NO: 1530354 - DNA, 13 bp, Homo sapiens
cattcactcttcc

SEQ ID NO: 1530355 - DNA, 14 bp, Homo sapiens
cattcagaaatgtt

SEQ ID NO: 1530356 - DNA, 20 bp, Homo sapiens
cattcagaaatgttgagtct

SEQ ID NO: 1530357 - DNA, 23 bp, Homo sapiens
cattcagaaatgttgagtctgta

SEQ ID NO: 1530358 - DNA, 15 bp, Homo sapiens
cattcagacacttca

SEQ ID NO: 1530359 - DNA, 14 bp, Homo sapiens
cattcagactaaaa

SEQ ID NO: 1530360 - DNA, 21 bp, Homo sapiens
cattcagactaaaaatacacc

SEQ ID NO: 1530361 - DNA, 22 bp, Homo sapiens
cattcagagtcagccaggacca

SEQ ID NO: 1530362 - DNA, 23 bp, Homo sapiens
cattcagatcactgaatttataa

SEQ ID NO: 1530363 - DNA, 12 bp, Homo sapiens
cattcagcacac

SEQ ID NO: 1530364 - DNA, 13 bp, Homo sapiens
cattcagcacaca

SEQ ID NO: 1530365 - DNA, 20 bp, Homo sapiens
cattcagcagcaaattttca

SEQ ID NO: 1530366 - DNA, 19 bp, Homo sapiens
cattcagcatctactctaa

SEQ ID NO: 1530367 - DNA, 16 bp, Homo sapiens
cattcagctctggaga

SEQ ID NO: 1530368 - DNA, 20 bp, Homo sapiens
cattcagctctggagaacag

SEQ ID NO: 1530369 - DNA, 20 bp, Homo sapiens
cattcaggaaaactgacaga

SEQ ID NO: 1530370 - DNA, 14 bp, Homo sapiens
cattcatattaaga

SEQ ID NO: 1530371 - DNA, 21 bp, Homo sapiens
cattcatattaagacagtgta

SEQ ID NO: 1530372 - DNA, 23 bp, Homo sapiens
cattcatcaatatccctcttgta

SEQ ID NO: 1530373 - DNA, 14 bp, Homo sapiens
cattcatccttcca

SEQ ID NO: 1530374 - DNA, 13 bp, Homo sapiens
cattcatctcatt

SEQ ID NO: 1530375 - DNA, 15 bp, Homo sapiens
cattcattcttagct

SEQ ID NO: 1530376 - DNA, 20 bp, Homo sapiens
cattccaaaaagaacaataa

SEQ ID NO: 1530377 - DNA, 18 bp, Homo sapiens
cattccaacaatggggtg

SEQ ID NO: 1530378 - DNA, 23 bp, Homo sapiens
cattccaacagctcaagtcttcc

SEQ ID NO: 1530379 - DNA, 14 bp, Homo sapiens
cattccaagcctga

SEQ ID NO: 1530380 - DNA, 12 bp, Homo sapiens
cattccagagtt

SEQ ID NO: 1530381 - DNA, 12 bp, Homo sapiens
cattccagctct

SEQ ID NO: 1530382 - DNA, 17 bp, Homo sapiens
cattccagctctgcccc

SEQ ID NO: 1530383 - DNA, 19 bp, Homo sapiens
cattccagctctgcccccg

SEQ ID NO: 1530384 - DNA, 12 bp, Homo sapiens
cattccaggcag

SEQ ID NO: 1530385 - DNA, 16 bp, Homo sapiens
cattccagtaactttt

SEQ ID NO: 1530386 - DNA, 18 bp, Homo sapiens
cattccagtaactttttt

SEQ ID NO: 1530387 - DNA, 22 bp, Homo sapiens
cattccagtacagtattctttt

SEQ ID NO: 1530388 - DNA, 23 bp, Homo sapiens
cattccagtacagtattctttta

SEQ ID NO: 1530389 - DNA, 23 bp, Homo sapiens
cattccagtcaaatctgggctca

SEQ ID NO: 1530390 - DNA, 17 bp, Homo sapiens
cattcccagagtcagag

SEQ ID NO: 1530391 - DNA, 23 bp, Homo sapiens
cattcccagagtcagaggagaag

SEQ ID NO: 1530392 - DNA, 14 bp, Homo sapiens
cattcccagcccag

SEQ ID NO: 1530393 - DNA, 18 bp, Homo sapiens
cattcccccatgtggctg

SEQ ID NO: 1530394 - DNA, 19 bp, Homo sapiens
cattcccccatgtggctga

SEQ ID NO: 1530395 - DNA, 21 bp, Homo sapiens
cattccctctcatctcaggta

SEQ ID NO: 1530396 - DNA, 14 bp, Homo sapiens
cattccctgaatct

SEQ ID NO: 1530397 - DNA, 18 bp, Homo sapiens
cattccctgagtcaccag

SEQ ID NO: 1530398 - DNA, 16 bp, Homo sapiens
cattccggactggcag

SEQ ID NO: 1530399 - DNA, 19 bp, Homo sapiens
cattccggactggcagaag

SEQ ID NO: 1530400 - DNA, 13 bp, Homo sapiens
cattccgttagga

SEQ ID NO: 1530401 - DNA, 23 bp, Homo sapiens
cattccgttaggaataacactgc

SEQ ID NO: 1530402 - DNA, 18 bp, Homo sapiens
cattcctaactagaatta

SEQ ID NO: 1530403 - DNA, 19 bp, Homo sapiens
cattcctaagagtggagga

SEQ ID NO: 1530404 - DNA, 22 bp, Homo sapiens
cattcctaagagtggaggagga

SEQ ID NO: 1530405 - DNA, 15 bp, Homo sapiens
cattcctcagctgcc

SEQ ID NO: 1530406 - DNA, 17 bp, Homo sapiens
cattcctcagctgccaa

SEQ ID NO: 1530407 - DNA, 12 bp, Homo sapiens
cattcctccctc

SEQ ID NO: 1530408 - DNA, 19 bp, Homo sapiens
cattcctgaaagaaacagt

SEQ ID NO: 1530409 - DNA, 21 bp, Homo sapiens
cattcctgcctttaagccaaa

SEQ ID NO: 1530410 - DNA, 15 bp, Homo sapiens
cattcctggagcccg

SEQ ID NO: 1530411 - DNA, 13 bp, Homo sapiens
cattcctggcccc

SEQ ID NO: 1530412 - DNA, 19 bp, Homo sapiens
cattcctggtacccagcca

SEQ ID NO: 1530413 - DNA, 21 bp, Homo sapiens
cattccttctggcctctgctg

SEQ ID NO: 1530414 - DNA, 16 bp, Homo sapiens
cattcgcctttgtctt

SEQ ID NO: 1530415 - DNA, 23 bp, Homo sapiens
cattcggccttggtgaacacaca

SEQ ID NO: 1530416 - DNA, 16 bp, Homo sapiens
cattcgggaccaatat

SEQ ID NO: 1530417 - DNA, 21 bp, Homo sapiens
cattcggggaagctgcacatg

SEQ ID NO: 1530418 - DNA, 23 bp, Homo sapiens
cattcgtgaaaaccaaccctgtg

SEQ ID NO: 1530419 - DNA, 15 bp, Homo sapiens
cattcgtgagctggg

SEQ ID NO: 1530420 - DNA, 16 bp, Homo sapiens
cattctagatcctgca

SEQ ID NO: 1530421 - DNA, 23 bp, Homo sapiens
cattctagatcctgcaccccagc

SEQ ID NO: 1530422 - DNA, 17 bp, Homo sapiens
cattctcaagccctgca

SEQ ID NO: 1530423 - DNA, 11 bp, Homo sapiens
cattctcacat

SEQ ID NO: 1530424 - DNA, 19 bp, Homo sapiens
cattctcaccctgtgaaac

SEQ ID NO: 1530425 - DNA, 16 bp, Homo sapiens
cattctcactcctacc

SEQ ID NO: 1530426 - DNA, 23 bp, Homo sapiens
cattctcagaattcggtgtgctg

SEQ ID NO: 1530427 - DNA, 15 bp, Homo sapiens
cattctcccaggtac

SEQ ID NO: 1530428 - DNA, 21 bp, Homo sapiens
cattctcccaggtaccagctg

SEQ ID NO: 1530429 - DNA, 16 bp, Homo sapiens
tatatggatgattcag

SEQ ID NO: 1530430 - DNA, 18 bp, Homo sapiens
tatatggatgattcagaa

SEQ ID NO: 1530431 - DNA, 18 bp, Homo sapiens
tatatggtatatatacat

SEQ ID NO: 1530432 - DNA, 18 bp, Homo sapiens
tatatggttctccaagaa

SEQ ID NO: 1530433 - DNA, 22 bp, Homo sapiens
tatatggttctccaagaaactg

SEQ ID NO: 1530434 - DNA, 16 bp, Homo sapiens
tatatgtattatttat

SEQ ID NO: 1530435 - DNA, 19 bp, Homo sapiens
tatatgtattatttataat

SEQ ID NO: 1530436 - DNA, 20 bp, Homo sapiens
tatatgtatttaaaaaaatc

SEQ ID NO: 1530437 - DNA, 18 bp, Homo sapiens
tatatgtgaaacattttt

SEQ ID NO: 1530438 - DNA, 18 bp, Homo sapiens
tatatgtgaacatttatc

SEQ ID NO: 1530439 - DNA, 14 bp, Homo sapiens
tatatgtgcagtct

SEQ ID NO: 1530440 - DNA, 13 bp, Homo sapiens
tatatgtgtgtgt

SEQ ID NO: 1530441 - DNA, 17 bp, Homo sapiens
tatatgttggtttaatt

SEQ ID NO: 1530442 - DNA, 18 bp, Homo sapiens
tatatgttttgtctcgct

SEQ ID NO: 1530443 - DNA, 13 bp, Homo sapiens
tatattaaaacaa

SEQ ID NO: 1530444 - DNA, 20 bp, Homo sapiens
tatattaaaacaataatgca

SEQ ID NO: 1530445 - DNA, 22 bp, Homo sapiens
tatattaaaacaataatgcaat

SEQ ID NO: 1530446 - DNA, 13 bp, Homo sapiens
tatattaaaattc

SEQ ID NO: 1530447 - DNA, 12 bp, Homo sapiens
tatattaaacat

SEQ ID NO: 1530448 - DNA, 13 bp, Homo sapiens
tatattaaacata

SEQ ID NO: 1530449 - DNA, 18 bp, Homo sapiens
tatattaccagcaagaat

SEQ ID NO: 1530450 - DNA, 21 bp, Homo sapiens
tatattaccagcaagaataaa

SEQ ID NO: 1530451 - DNA, 23 bp, Homo sapiens
tatattactgacatttcttctag

SEQ ID NO: 1530452 - DNA, 17 bp, Homo sapiens
tatattagctaattaga

SEQ ID NO: 1530453 - DNA, 16 bp, Homo sapiens
tatattagctgaaaca

SEQ ID NO: 1530454 - DNA, 13 bp, Homo sapiens
tatattatatata

SEQ ID NO: 1530455 - DNA, 17 bp, Homo sapiens
tatattatatatatcta

SEQ ID NO: 1530456 - DNA, 20 bp, Homo sapiens
tatattatatatatctatat

SEQ ID NO: 1530457 - DNA, 20 bp, Homo sapiens
tatattatcatgcaaatgct

SEQ ID NO: 1530458 - DNA, 13 bp, Homo sapiens
tatattatgtctt

SEQ ID NO: 1530459 - DNA, 14 bp, Homo sapiens
tatattatttacat

SEQ ID NO: 1530460 - DNA, 22 bp, Homo sapiens
tatattcaggacttgaaagaaa

SEQ ID NO: 1530461 - DNA, 14 bp, Homo sapiens
tatattcatatatt

SEQ ID NO: 1530462 - DNA, 16 bp, Homo sapiens
tatattctttcaaagg

SEQ ID NO: 1530463 - DNA, 20 bp, Homo sapiens
tatattgaagacaatttgat

SEQ ID NO: 1530464 - DNA, 12 bp, Homo sapiens
tatattgtaatt

SEQ ID NO: 1530465 - DNA, 13 bp, Homo sapiens
tatattgtacaaa

SEQ ID NO: 1530466 - DNA, 15 bp, Homo sapiens
tatattgtacaaatg

SEQ ID NO: 1530467 - DNA, 18 bp, Homo sapiens
tatattgttagtggactt

SEQ ID NO: 1530468 - DNA, 14 bp, Homo sapiens
tatatttaaaaata

SEQ ID NO: 1530469 - DNA, 16 bp, Homo sapiens
tatatttaaaaattgt

SEQ ID NO: 1530470 - DNA, 16 bp, Homo sapiens
tatatttaacaatgac

SEQ ID NO: 1530471 - DNA, 12 bp, Homo sapiens
tatatttaggaa

SEQ ID NO: 1530472 - DNA, 22 bp, Homo sapiens
tatatttaggaaattcaaagca

SEQ ID NO: 1530473 - DNA, 21 bp, Homo sapiens
tatatttataactcatcataa

SEQ ID NO: 1530474 - DNA, 13 bp, Homo sapiens
tatatttatactc

SEQ ID NO: 1530475 - DNA, 12 bp, Homo sapiens
tatatttattca

SEQ ID NO: 1530476 - DNA, 16 bp, Homo sapiens
tatatttcactatttt

SEQ ID NO: 1530477 - DNA, 14 bp, Homo sapiens
tatatttcagacat

SEQ ID NO: 1530478 - DNA, 16 bp, Homo sapiens
tatatttcagacattt

SEQ ID NO: 1530479 - DNA, 15 bp, Homo sapiens
tatatttcatattga

SEQ ID NO: 1530480 - DNA, 13 bp, Homo sapiens
tatatttccttta

SEQ ID NO: 1530481 - DNA, 22 bp, Homo sapiens
tatatttcctttatgtgaattt

SEQ ID NO: 1530482 - DNA, 19 bp, Homo sapiens
tatatttcttcttctaaga

SEQ ID NO: 1530483 - DNA, 14 bp, Homo sapiens
tatatttctttgtt

SEQ ID NO: 1530484 - DNA, 11 bp, Homo sapiens
tatatttggaa

SEQ ID NO: 1530485 - DNA, 16 bp, Homo sapiens
tatatttggaaagaga

SEQ ID NO: 1530486 - DNA, 22 bp, Homo sapiens
tatatttgtaaactacaaagta

SEQ ID NO: 1530487 - DNA, 17 bp, Homo sapiens
tatatttgtaaagctat

SEQ ID NO: 1530488 - DNA, 17 bp, Homo sapiens
tatatttgtaggagaaa

SEQ ID NO: 1530489 - DNA, 13 bp, Homo sapiens
tatatttgtcttc

SEQ ID NO: 1530490 - DNA, 12 bp, Homo sapiens
tatattttaata

SEQ ID NO: 1530491 - DNA, 15 bp, Homo sapiens
tatattttagcattt

SEQ ID NO: 1530492 - DNA, 17 bp, Homo sapiens
tatattttagcatttta

SEQ ID NO: 1530493 - DNA, 23 bp, Homo sapiens
tatattttatgaacattgtactg

SEQ ID NO: 1530494 - DNA, 14 bp, Homo sapiens
tatattttcagagc

SEQ ID NO: 1530495 - DNA, 12 bp, Homo sapiens
tatattttggga

SEQ ID NO: 1530496 - DNA, 19 bp, Homo sapiens
tatattttgtgtgaaattg

SEQ ID NO: 1530497 - DNA, 22 bp, Homo sapiens
tatattttgtgtgaaattgcat

SEQ ID NO: 1530498 - DNA, 19 bp, Homo sapiens
tatatttttaagataataa

SEQ ID NO: 1530499 - DNA, 17 bp, Homo sapiens
tatatttttgtacatat

SEQ ID NO: 1530500 - DNA, 12 bp, Homo sapiens
tatatttttgtc

SEQ ID NO: 1530501 - DNA, 18 bp, Homo sapiens
tatatttttttaatttaa

SEQ ID NO: 1530502 - DNA, 15 bp, Homo sapiens
tatcaaaaaaccttt

SEQ ID NO: 1530503 - DNA, 22 bp, Homo sapiens
tatcaaaaagctaatgtgcagg

SEQ ID NO: 1530504 - DNA, 22 bp, Homo sapiens
tatcaaaagaaaattgatattt

SEQ ID NO: 1530505 - DNA, 23 bp, Homo sapiens
tatcaaaatcactatctttctga

SEQ ID NO: 1530506 - DNA, 13 bp, Homo sapiens
tatcaaacattaa

SEQ ID NO: 1530507 - DNA, 22 bp, Homo sapiens
tatcaaaccctagccttgcttg

SEQ ID NO: 1530508 - DNA, 16 bp, Homo sapiens
tatcaaactgaagcca

SEQ ID NO: 1530509 - DNA, 19 bp, Homo sapiens
tatcaaagggtgaaaatta

SEQ ID NO: 1530510 - DNA, 22 bp, Homo sapiens
tatcaaagggtgaaaattattt

SEQ ID NO: 1530511 - DNA, 17 bp, Homo sapiens
tatcaaataaaatatca

SEQ ID NO: 1530512 - DNA, 11 bp, Homo sapiens
cattgctctct

SEQ ID NO: 1530513 - DNA, 14 bp, Homo sapiens
cattgctctctggg

SEQ ID NO: 1530514 - DNA, 16 bp, Homo sapiens
cattgctctctgggct

SEQ ID NO: 1530515 - DNA, 15 bp, Homo sapiens
cattgctgagcctct

SEQ ID NO: 1530516 - DNA, 17 bp, Homo sapiens
cattgctgagcctctgc

SEQ ID NO: 1530517 - DNA, 18 bp, Homo sapiens
cattgctgagcctctgct

SEQ ID NO: 1530518 - DNA, 11 bp, Homo sapiens
cattgctgcca

SEQ ID NO: 1530519 - DNA, 15 bp, Homo sapiens
cattgctgctgctac

SEQ ID NO: 1530520 - DNA, 17 bp, Homo sapiens
cattgctgctgctacca

SEQ ID NO: 1530521 - DNA, 12 bp, Homo sapiens
cattgctggctg

SEQ ID NO: 1530522 - DNA, 13 bp, Homo sapiens
cattgctggctgc

SEQ ID NO: 1530523 - DNA, 17 bp, Homo sapiens
cattgctggtagagacc

SEQ ID NO: 1530524 - DNA, 20 bp, Homo sapiens
cattgctgtaccacatctgc

SEQ ID NO: 1530525 - DNA, 13 bp, Homo sapiens
cattgctgtgtga

SEQ ID NO: 1530526 - DNA, 18 bp, Homo sapiens
cattgctgttagagaaat

SEQ ID NO: 1530527 - DNA, 17 bp, Homo sapiens
cattgctgttctacttt

SEQ ID NO: 1530528 - DNA, 14 bp, Homo sapiens
cattgcttaccttg

SEQ ID NO: 1530529 - DNA, 12 bp, Homo sapiens
cattgctttctg

SEQ ID NO: 1530530 - DNA, 15 bp, Homo sapiens
cattgctttctgaaa

SEQ ID NO: 1530531 - DNA, 18 bp, Homo sapiens
cattgcttttgtttctta

SEQ ID NO: 1530532 - DNA, 18 bp, Homo sapiens
cattggaagaccccaccc

SEQ ID NO: 1530533 - DNA, 18 bp, Homo sapiens
cattggaatgttctcaga

SEQ ID NO: 1530534 - DNA, 19 bp, Homo sapiens
cattggaatgttctcagat

SEQ ID NO: 1530535 - DNA, 20 bp, Homo sapiens
cattggaattctactggaaa

SEQ ID NO: 1530536 - DNA, 14 bp, Homo sapiens
cattggagagctgt

SEQ ID NO: 1530537 - DNA, 15 bp, Homo sapiens
cattggagcattttc

SEQ ID NO: 1530538 - DNA, 19 bp, Homo sapiens
cattggagctgactgttct

SEQ ID NO: 1530539 - DNA, 16 bp, Homo sapiens
cattggagtcctggtt

SEQ ID NO: 1530540 - DNA, 20 bp, Homo sapiens
cattggcacctaatccaggc

SEQ ID NO: 1530541 - DNA, 15 bp, Homo sapiens
cattggcctctgtac

SEQ ID NO: 1530542 - DNA, 14 bp, Homo sapiens
cattggcctggcct

SEQ ID NO: 1530543 - DNA, 15 bp, Homo sapiens
cattggcctggcctc

SEQ ID NO: 1530544 - DNA, 17 bp, Homo sapiens
cattgggaccctccagt

SEQ ID NO: 1530545 - DNA, 22 bp, Homo sapiens
cattgggctgacacctaccatg

SEQ ID NO: 1530546 - DNA, 18 bp, Homo sapiens
cattgggtgggtaaattc

SEQ ID NO: 1530547 - DNA, 20 bp, Homo sapiens
cattggttcacctgtgactc

SEQ ID NO: 1530548 - DNA, 16 bp, Homo sapiens
cattgtaaaataaagt

SEQ ID NO: 1530549 - DNA, 16 bp, Homo sapiens
tatcagttactcagcc

SEQ ID NO: 1530550 - DNA, 17 bp, Homo sapiens
tatcagttactcagccc

SEQ ID NO: 1530551 - DNA, 14 bp, Homo sapiens
tatcagttgcaata

SEQ ID NO: 1530552 - DNA, 13 bp, Homo sapiens
tatcataaagcat

SEQ ID NO: 1530553 - DNA, 14 bp, Homo sapiens
tatcatagaaatgt

SEQ ID NO: 1530554 - DNA, 15 bp, Homo sapiens
tatcatagaaatgta

SEQ ID NO: 1530555 - DNA, 23 bp, Homo sapiens
tatcatagaaatgtaacttttgt

SEQ ID NO: 1530556 - DNA, 21 bp, Homo sapiens
tatcatatattaaaacaataa

SEQ ID NO: 1530557 - DNA, 15 bp, Homo sapiens
tatcatatttctgtg

SEQ ID NO: 1530558 - DNA, 22 bp, Homo sapiens
tatcatcaagcaggaattatgt

SEQ ID NO: 1530559 - DNA, 22 bp, Homo sapiens
tatcatccacattgttttaaaa

SEQ ID NO: 1530560 - DNA, 15 bp, Homo sapiens
tatcatcccaacagc

SEQ ID NO: 1530561 - DNA, 20 bp, Homo sapiens
tatcatgaaacacttctcat

SEQ ID NO: 1530562 - DNA, 23 bp, Homo sapiens
tatcatgaaacacttctcatcat

SEQ ID NO: 1530563 - DNA, 11 bp, Homo sapiens
tatcatgaatg

SEQ ID NO: 1530564 - DNA, 24 bp, Homo sapiens
tatcatgaattttaaagtatgcat

SEQ ID NO: 1530565 - DNA, 15 bp, Homo sapiens
tatcatgcaaatgct

SEQ ID NO: 1530566 - DNA, 16 bp, Homo sapiens
tatcatgcaaatgctg

SEQ ID NO: 1530567 - DNA, 17 bp, Homo sapiens
tatcatgcatgtcctgt

SEQ ID NO: 1530568 - DNA, 12 bp, Homo sapiens
tatcatgtatgg

SEQ ID NO: 1530569 - DNA, 16 bp, Homo sapiens
tatcattaaaaattac

SEQ ID NO: 1530570 - DNA, 19 bp, Homo sapiens
tatcattacaattttctgt

SEQ ID NO: 1530571 - DNA, 21 bp, Homo sapiens
tatcattacaattttctgtaa

SEQ ID NO: 1530572 - DNA, 13 bp, Homo sapiens
tatcatttactct

SEQ ID NO: 1530573 - DNA, 14 bp, Homo sapiens
tatcatttactctt

SEQ ID NO: 1530574 - DNA, 18 bp, Homo sapiens
tatcatttgagtgaatgt

SEQ ID NO: 1530575 - DNA, 19 bp, Homo sapiens
tatccaacatcaacatctt

SEQ ID NO: 1530576 - DNA, 15 bp, Homo sapiens
tatccaatgtctttt

SEQ ID NO: 1530577 - DNA, 12 bp, Homo sapiens
tatccacccagc

SEQ ID NO: 1530578 - DNA, 14 bp, Homo sapiens
tatccacccagccc

SEQ ID NO: 1530579 - DNA, 15 bp, Homo sapiens
tatccacccagccca

SEQ ID NO: 1530580 - DNA, 19 bp, Homo sapiens
tatccacccagcccattct

SEQ ID NO: 1530581 - DNA, 19 bp, Homo sapiens
tatccatagtgacttttca

SEQ ID NO: 1530582 - DNA, 22 bp, Homo sapiens
tatccatagtgacttttcaagt

SEQ ID NO: 1530583 - DNA, 16 bp, Homo sapiens
tatccatttatctttt

SEQ ID NO: 1530584 - DNA, 16 bp, Homo sapiens
tatcccaaacttcgga

SEQ ID NO: 1530585 - DNA, 19 bp, Homo sapiens
tatcccaaacttcggaaac

SEQ ID NO: 1530586 - DNA, 16 bp, Homo sapiens
tatcccaagaatgcaa

SEQ ID NO: 1530587 - DNA, 20 bp, Homo sapiens
tatcccaatcaaagaattac

SEQ ID NO: 1530588 - DNA, 22 bp, Homo sapiens
tatcccaatcaaagaattacag

SEQ ID NO: 1530589 - DNA, 16 bp, Homo sapiens
tatcccacatccaact

SEQ ID NO: 1530590 - DNA, 15 bp, Homo sapiens
tatccccaggccagg

SEQ ID NO: 1530591 - DNA, 17 bp, Homo sapiens
tatccccaggccaggtc

SEQ ID NO: 1530592 - DNA, 13 bp, Homo sapiens
tatccccatctcc

SEQ ID NO: 1530593 - DNA, 17 bp, Homo sapiens
tatccccccatcttgct

SEQ ID NO: 1530594 - DNA, 14 bp, Homo sapiens
tatcccctgcctcc

SEQ ID NO: 1530595 - DNA, 19 bp, Homo sapiens
tatcccctgcctcctgcca

SEQ ID NO: 1530596 - DNA, 23 bp, Homo sapiens
tatccctctcttccccttccctt

SEQ ID NO: 1530597 - DNA, 19 bp, Homo sapiens
tatccctcttgtaagtcat

SEQ ID NO: 1530598 - DNA, 13 bp, Homo sapiens
tatcctaaacttt

SEQ ID NO: 1530599 - DNA, 11 bp, Homo sapiens
tatcctcaggg

SEQ ID NO: 1530600 - DNA, 16 bp, Homo sapiens
tatcctcctgttctga

SEQ ID NO: 1530601 - DNA, 18 bp, Homo sapiens
tatcctctcttcctcttc

SEQ ID NO: 1530602 - DNA, 13 bp, Homo sapiens
tatcctgagccat

SEQ ID NO: 1530603 - DNA, 15 bp, Homo sapiens
tatcctgattccaaa

SEQ ID NO: 1530604 - DNA, 18 bp, Homo sapiens
tatcctgattccaaatat

SEQ ID NO: 1530605 - DNA, 11 bp, Homo sapiens
tatcctgcctc

SEQ ID NO: 1530606 - DNA, 12 bp, Homo sapiens
tatcctgcctca

SEQ ID NO: 1530607 - DNA, 16 bp, Homo sapiens
tatcctgcctcagccc

SEQ ID NO: 1530608 - DNA, 15 bp, Homo sapiens
tatcctggtgtctag

SEQ ID NO: 1530609 - DNA, 18 bp, Homo sapiens
tatcctggtgtctagttt

SEQ ID NO: 1530610 - DNA, 20 bp, Homo sapiens
tatcctggtgtctagtttgc

SEQ ID NO: 1530611 - DNA, 12 bp, Homo sapiens
tatcctgtattc

SEQ ID NO: 1530612 - DNA, 17 bp, Homo sapiens
tatcctgtattcttgtt

SEQ ID NO: 1530613 - DNA, 19 bp, Homo sapiens
tatcctgtgacatgtaaca

SEQ ID NO: 1530614 - DNA, 23 bp, Homo sapiens
tatcctgtgactgtctcacttaa

SEQ ID NO: 1530615 - DNA, 20 bp, Homo sapiens
tatccttataggcctgtccc

SEQ ID NO: 1530616 - DNA, 14 bp, Homo sapiens
tatccttctacttg

SEQ ID NO: 1530617 - DNA, 16 bp, Homo sapiens
tatccttctacttgtc

SEQ ID NO: 1530618 - DNA, 19 bp, Homo sapiens
tatccttgggggctcccag

SEQ ID NO: 1530619 - DNA, 17 bp, Homo sapiens
tatcctttctaacaaaa

SEQ ID NO: 1530620 - DNA, 14 bp, Homo sapiens
tatcgccctccttt

SEQ ID NO: 1530621 - DNA, 16 bp, Homo sapiens
tatcgccctcctttcc

SEQ ID NO: 1530622 - DNA, 14 bp, Homo sapiens
tatcgctgatgcag

SEQ ID NO: 1530623 - DNA, 15 bp, Homo sapiens
tatcggaagcagtgc

SEQ ID NO: 1530624 - DNA, 19 bp, Homo sapiens
tatcggctctattctctaa

SEQ ID NO: 1530625 - DNA, 17 bp, Homo sapiens
tatcgggaacagtgttt

SEQ ID NO: 1530626 - DNA, 14 bp, Homo sapiens
tatcgggagcagtg

SEQ ID NO: 1530627 - DNA, 18 bp, Homo sapiens
tatcgggagcagtgtctt

SEQ ID NO: 1530628 - DNA, 14 bp, Homo sapiens
tacagaatttgaat

SEQ ID NO: 1530629 - DNA, 16 bp, Homo sapiens
tacagaatttgaatta

SEQ ID NO: 1530630 - DNA, 11 bp, Homo sapiens
tacagacattc

SEQ ID NO: 1530631 - DNA, 14 bp, Homo sapiens
tacagactccatct

SEQ ID NO: 1530632 - DNA, 23 bp, Homo sapiens
tacagactccatctcttctgcaa

SEQ ID NO: 1530633 - DNA, 15 bp, Homo sapiens
tacagacttctccag

SEQ ID NO: 1530634 - DNA, 15 bp, Homo sapiens
tacagagcacatttg

SEQ ID NO: 1530635 - DNA, 22 bp, Homo sapiens
tacagaggatgccttttctgtg

SEQ ID NO: 1530636 - DNA, 11 bp, Homo sapiens
tacagaggtga

SEQ ID NO: 1530637 - DNA, 19 bp, Homo sapiens
tacagagtgtggactctgg

SEQ ID NO: 1530638 - DNA, 15 bp, Homo sapiens
tacagataaatgatt

SEQ ID NO: 1530639 - DNA, 16 bp, Homo sapiens
tacagataaatgattc

SEQ ID NO: 1530640 - DNA, 20 bp, Homo sapiens
tacagataaatgattcaaaa

SEQ ID NO: 1530641 - DNA, 22 bp, Homo sapiens
tacagataagtgttcttcagtg

SEQ ID NO: 1530642 - DNA, 14 bp, Homo sapiens
tacagataattcat

SEQ ID NO: 1530643 - DNA, 19 bp, Homo sapiens
tacagataattcatttgta

SEQ ID NO: 1530644 - DNA, 18 bp, Homo sapiens
tacagatactgtgagctt

SEQ ID NO: 1530645 - DNA, 16 bp, Homo sapiens
tacagatctcagggct

SEQ ID NO: 1530646 - DNA, 22 bp, Homo sapiens
tacagatgaatgtatttatttg

SEQ ID NO: 1530647 - DNA, 14 bp, Homo sapiens
tacagatgcctttt

SEQ ID NO: 1530648 - DNA, 16 bp, Homo sapiens
tacagatttagtttac

SEQ ID NO: 1530649 - DNA, 22 bp, Homo sapiens
tacagcaacaatttatgaattg

SEQ ID NO: 1530650 - DNA, 14 bp, Homo sapiens
tacagcactactct

SEQ ID NO: 1530651 - DNA, 10 bp, Homo sapiens
tacagcattg

SEQ ID NO: 1530652 - DNA, 20 bp, Homo sapiens
tacagcattgtctttgctgt

SEQ ID NO: 1530653 - DNA, 22 bp, Homo sapiens
tacagccaaaaaggaccaactg

SEQ ID NO: 1530654 - DNA, 20 bp, Homo sapiens
tacagccctaagtggctgcc

SEQ ID NO: 1530655 - DNA, 22 bp, Homo sapiens
tacagccctaagtggctgcctt

SEQ ID NO: 1530656 - DNA, 22 bp, Homo sapiens
tacagcctagggcagacaatag

SEQ ID NO: 1530657 - DNA, 13 bp, Homo sapiens
tacagcctgcaca

SEQ ID NO: 1530658 - DNA, 14 bp, Homo sapiens
tacagcctgcacac

SEQ ID NO: 1530659 - DNA, 16 bp, Homo sapiens
tacagcgcggaggagg

SEQ ID NO: 1530660 - DNA, 16 bp, Homo sapiens
tacagctcattaaact

SEQ ID NO: 1530661 - DNA, 12 bp, Homo sapiens
tacagctgtgtt

SEQ ID NO: 1530662 - DNA, 15 bp, Homo sapiens
tacaggaaggcttgc

SEQ ID NO: 1530663 - DNA, 13 bp, Homo sapiens
tacaggactgtaa

SEQ ID NO: 1530664 - DNA, 18 bp, Homo sapiens
tacaggactgtaaagatt

SEQ ID NO: 1530665 - DNA, 18 bp, Homo sapiens
tacaggagaggcagcatg

SEQ ID NO: 1530666 - DNA, 18 bp, Homo sapiens
tacaggaggttgtggatg

SEQ ID NO: 1530667 - DNA, 18 bp, Homo sapiens
tacaggatggtgggcagg

SEQ ID NO: 1530668 - DNA, 20 bp, Homo sapiens
tacaggcaaaacacgcaagg

SEQ ID NO: 1530669 - DNA, 22 bp, Homo sapiens
tacaggcaaaacacgcaagggc

SEQ ID NO: 1530670 - DNA, 21 bp, Homo sapiens
tacagggcatgcattttgcag

SEQ ID NO: 1530671 - DNA, 22 bp, Homo sapiens
tacagggtagcaggtaccactg

SEQ ID NO: 1530672 - DNA, 20 bp, Homo sapiens
tacaggtcacccatcaggac

SEQ ID NO: 1530673 - DNA, 18 bp, Homo sapiens
tacagtaactttatgtgt

SEQ ID NO: 1530674 - DNA, 19 bp, Homo sapiens
tacagtacacatccccaga

SEQ ID NO: 1530675 - DNA, 19 bp, Homo sapiens
tacagtaccttgttgcaga

SEQ ID NO: 1530676 - DNA, 20 bp, Homo sapiens
tacagtaccttgttgcagat

SEQ ID NO: 1530677 - DNA, 13 bp, Homo sapiens
tacagtagctgct

SEQ ID NO: 1530678 - DNA, 17 bp, Homo sapiens
tacagtatgatgaaaat

SEQ ID NO: 1530679 - DNA, 19 bp, Homo sapiens
tacagtattatagacaaaa

SEQ ID NO: 1530680 - DNA, 19 bp, Homo sapiens
tacagtgaaattttggtga

SEQ ID NO: 1530681 - DNA, 13 bp, Homo sapiens
tacagtgaggagg

SEQ ID NO: 1530682 - DNA, 14 bp, Homo sapiens
tacagtgcagacag

SEQ ID NO: 1530683 - DNA, 16 bp, Homo sapiens
tacagtgcagacaggc

SEQ ID NO: 1530684 - DNA, 21 bp, Homo sapiens
tacagtgcagagccttctcag

SEQ ID NO: 1530685 - DNA, 22 bp, Homo sapiens
tacagtgcagagccttctcaga

SEQ ID NO: 1530686 - DNA, 16 bp, Homo sapiens
tacagtgcctaaaata

SEQ ID NO: 1530687 - DNA, 15 bp, Homo sapiens
tacagtgtacatgta

SEQ ID NO: 1530688 - DNA, 19 bp, Homo sapiens
tacagttagggttttgcaa

SEQ ID NO: 1530689 - DNA, 13 bp, Homo sapiens
tacagttatttca

SEQ ID NO: 1530690 - DNA, 17 bp, Homo sapiens
tacagttctttcctctt

SEQ ID NO: 1530691 - DNA, 20 bp, Homo sapiens
tacagttctttcctctttct

SEQ ID NO: 1530692 - DNA, 18 bp, Homo sapiens
tacagttgttggcctccg

SEQ ID NO: 1530693 - DNA, 20 bp, Homo sapiens
tacagttttaactgtggata

SEQ ID NO: 1530694 - DNA, 21 bp, Homo sapiens
tacagttttaactgtggatat

SEQ ID NO: 1530695 - DNA, 20 bp, Homo sapiens
tacagtttttttctttgtgt

SEQ ID NO: 1530696 - DNA, 13 bp, Homo sapiens
tacataacattca

SEQ ID NO: 1530697 - DNA, 13 bp, Homo sapiens
tacataactcctg

SEQ ID NO: 1530698 - DNA, 15 bp, Homo sapiens
tacataactcctgtc

SEQ ID NO: 1530699 - DNA, 18 bp, Homo sapiens
tacataactcctgtccct

SEQ ID NO: 1530700 - DNA, 23 bp, Homo sapiens
tacataactcctgtcccttttcc

SEQ ID NO: 1530701 - DNA, 15 bp, Homo sapiens
tacataactgaaaat

SEQ ID NO: 1530702 - DNA, 22 bp, Homo sapiens
tacataacttgatatagaaagc

SEQ ID NO: 1530703 - DNA, 16 bp, Homo sapiens
tacataagataaatgt

SEQ ID NO: 1530704 - DNA, 17 bp, Homo sapiens
tacataagataaatgtg

SEQ ID NO: 1530705 - DNA, 22 bp, Homo sapiens
tacataagataaatgtgctgaa

SEQ ID NO: 1530706 - DNA, 15 bp, Homo sapiens
tacataagtaattca

SEQ ID NO: 1530707 - DNA, 17 bp, Homo sapiens
tacataagtaattcaag

SEQ ID NO: 1530708 - DNA, 19 bp, Homo sapiens
tacataagtaattcaagaa

SEQ ID NO: 1530709 - DNA, 14 bp, Homo sapiens
tacataattaaatt

SEQ ID NO: 1530710 - DNA, 16 bp, Homo sapiens
tacatacagattttac

SEQ ID NO: 1530711 - DNA, 14 bp, Homo sapiens
cagtttcacagaaa

SEQ ID NO: 1530712 - DNA, 15 bp, Homo sapiens
cagtttcacagaaaa

SEQ ID NO: 1530713 - DNA, 23 bp, Homo sapiens
cagtttcactttcacatagatgt

SEQ ID NO: 1530714 - DNA, 21 bp, Homo sapiens
cagtttcatcatttgcacaaa

SEQ ID NO: 1530715 - DNA, 12 bp, Homo sapiens
cagtttccaaat

SEQ ID NO: 1530716 - DNA, 21 bp, Homo sapiens
cagtttcttgcttggaagcca

SEQ ID NO: 1530717 - DNA, 22 bp, Homo sapiens
cagtttcttgcttggaagccag

SEQ ID NO: 1530718 - DNA, 23 bp, Homo sapiens
cagtttcttgcttggaagccagg

SEQ ID NO: 1530719 - DNA, 15 bp, Homo sapiens
cagtttgcaaaaaat

SEQ ID NO: 1530720 - DNA, 23 bp, Homo sapiens
cagtttgcagaaaagcacctgcc

SEQ ID NO: 1530721 - DNA, 14 bp, Homo sapiens
cagtttgctttgta

SEQ ID NO: 1530722 - DNA, 16 bp, Homo sapiens
cagtttggccctggag

SEQ ID NO: 1530723 - DNA, 18 bp, Homo sapiens
cagtttggccctggagcc

SEQ ID NO: 1530724 - DNA, 20 bp, Homo sapiens
cagtttggccctggagccag

SEQ ID NO: 1530725 - DNA, 22 bp, Homo sapiens
cagtttggccctggagccaggg

SEQ ID NO: 1530726 - DNA, 20 bp, Homo sapiens
cagtttgggtaaaatacttt

SEQ ID NO: 1530727 - DNA, 22 bp, Homo sapiens
cagtttgggtaaaatactttta

SEQ ID NO: 1530728 - DNA, 15 bp, Homo sapiens
cagtttgtgtgtctt

SEQ ID NO: 1530729 - DNA, 15 bp, Homo sapiens
cagtttgttggaaag

SEQ ID NO: 1530730 - DNA, 16 bp, Homo sapiens
cagttttaactagaat

SEQ ID NO: 1530731 - DNA, 13 bp, Homo sapiens
cagttttaactgt

SEQ ID NO: 1530732 - DNA, 23 bp, Homo sapiens
cagttttaactgtggatattgtt

SEQ ID NO: 1530733 - DNA, 11 bp, Homo sapiens
cagttttaata

SEQ ID NO: 1530734 - DNA, 21 bp, Homo sapiens
cagttttacgcaacactaaat

SEQ ID NO: 1530735 - DNA, 16 bp, Homo sapiens
cagttttcccctggcc

SEQ ID NO: 1530736 - DNA, 18 bp, Homo sapiens
cagttttcccctggcctc

SEQ ID NO: 1530737 - DNA, 13 bp, Homo sapiens
cagttttccttct

SEQ ID NO: 1530738 - DNA, 14 bp, Homo sapiens
cagttttccttctg

SEQ ID NO: 1530739 - DNA, 19 bp, Homo sapiens
cagttttctgagaaagact

SEQ ID NO: 1530740 - DNA, 20 bp, Homo sapiens
cagttttctgagaaagacta

SEQ ID NO: 1530741 - DNA, 12 bp, Homo sapiens
cagttttgtaaa

SEQ ID NO: 1530742 - DNA, 14 bp, Homo sapiens
cagttttgtaaatg

SEQ ID NO: 1530743 - DNA, 23 bp, Homo sapiens
cataccaggcaacctcccatccc

SEQ ID NO: 1530744 - DNA, 19 bp, Homo sapiens
cataccatctgctgccccg

SEQ ID NO: 1530745 - DNA, 15 bp, Homo sapiens
catacccatgcacag

SEQ ID NO: 1530746 - DNA, 22 bp, Homo sapiens
cataccgcctcgtgccagcagc

SEQ ID NO: 1530747 - DNA, 22 bp, Homo sapiens
catacctcagaatgtaaaagaa

SEQ ID NO: 1530748 - DNA, 19 bp, Homo sapiens
cataccttctggttgcttc

SEQ ID NO: 1530749 - DNA, 22 bp, Homo sapiens
cataccttctggttgcttcaga

SEQ ID NO: 1530750 - DNA, 14 bp, Homo sapiens
cataccttttctct

SEQ ID NO: 1530751 - DNA, 16 bp, Homo sapiens
catacgtgcacagggt

SEQ ID NO: 1530752 - DNA, 15 bp, Homo sapiens
catactacctagaag

SEQ ID NO: 1530753 - DNA, 18 bp, Homo sapiens
catactacctagaagtaa

SEQ ID NO: 1530754 - DNA, 20 bp, Homo sapiens
catactactgaaacagattt

SEQ ID NO: 1530755 - DNA, 17 bp, Homo sapiens
catactaggtgcctttt

SEQ ID NO: 1530756 - DNA, 19 bp, Homo sapiens
catactccgtgaggctgct

SEQ ID NO: 1530757 - DNA, 22 bp, Homo sapiens
catactccgtgaggctgctgcc

SEQ ID NO: 1530758 - DNA, 16 bp, Homo sapiens
catactccttgcttcc

SEQ ID NO: 1530759 - DNA, 14 bp, Homo sapiens
catactctgtgtaa

SEQ ID NO: 1530760 - DNA, 23 bp, Homo sapiens
catactctgtgtaatctctgatt

SEQ ID NO: 1530761 - DNA, 14 bp, Homo sapiens
catactcttctaaa

SEQ ID NO: 1530762 - DNA, 15 bp, Homo sapiens
catactcttctaaaa

SEQ ID NO: 1530763 - DNA, 15 bp, Homo sapiens
catactgattgggag

SEQ ID NO: 1530764 - DNA, 16 bp, Homo sapiens
catactgcatgtaagc

SEQ ID NO: 1530765 - DNA, 11 bp, Homo sapiens
catactgctgt

SEQ ID NO: 1530766 - DNA, 15 bp, Homo sapiens
catactggcctggac

SEQ ID NO: 1530767 - DNA, 22 bp, Homo sapiens
catactggcctggactgttttc

SEQ ID NO: 1530768 - DNA, 13 bp, Homo sapiens
catacttaaaata

SEQ ID NO: 1530769 - DNA, 20 bp, Homo sapiens
catacttcttacttgtctgt

SEQ ID NO: 1530770 - DNA, 17 bp, Homo sapiens
catacttgaagggccag

SEQ ID NO: 1530771 - DNA, 23 bp, Homo sapiens
catacttgaagggccagagccag

SEQ ID NO: 1530772 - DNA, 22 bp, Homo sapiens
catactttgacaaggaaaatct

SEQ ID NO: 1530773 - DNA, 16 bp, Homo sapiens
catactttgtattttg

SEQ ID NO: 1530774 - DNA, 18 bp, Homo sapiens
catactttgtattttgat

SEQ ID NO: 1530775 - DNA, 18 bp, Homo sapiens
catactttgtctgaaaaa

SEQ ID NO: 1530776 - DNA, 16 bp, Homo sapiens
catacttttggctcct

SEQ ID NO: 1530777 - DNA, 11 bp, Homo sapiens
catagaaaaat

SEQ ID NO: 1530778 - DNA, 23 bp, Homo sapiens
catagaaaaatgtataaaaatta

SEQ ID NO: 1530779 - DNA, 15 bp, Homo sapiens
catagaaacatgaca

SEQ ID NO: 1530780 - DNA, 19 bp, Homo sapiens
catagaaacatgacactga

SEQ ID NO: 1530781 - DNA, 23 bp, Homo sapiens
catagaaagtaaataaaaggact

SEQ ID NO: 1530782 - DNA, 23 bp, Homo sapiens
catagaaatggaaattttgctat

SEQ ID NO: 1530783 - DNA, 22 bp, Homo sapiens
catagaaatgtaggtcctcaga

SEQ ID NO: 1530784 - DNA, 13 bp, Homo sapiens
catagaattttga

SEQ ID NO: 1530785 - DNA, 13 bp, Homo sapiens
catagacatgaaa

SEQ ID NO: 1530786 - DNA, 18 bp, Homo sapiens
catagacctacagacctg

SEQ ID NO: 1530787 - DNA, 20 bp, Homo sapiens
catagacctacagacctggc

SEQ ID NO: 1530788 - DNA, 22 bp, Homo sapiens
catagacctacagacctggctc

SEQ ID NO: 1530789 - DNA, 22 bp, Homo sapiens
catagagctttttaatagcact

SEQ ID NO: 1530790 - DNA, 13 bp, Homo sapiens
catagaggcccag

SEQ ID NO: 1530791 - DNA, 18 bp, Homo sapiens
catagaggcccaggcacc

SEQ ID NO: 1530792 - DNA, 23 bp, Homo sapiens
catagaggcttctccgccagcct

SEQ ID NO: 1530793 - DNA, 14 bp, Homo sapiens
catagataaagctg

SEQ ID NO: 1530794 - DNA, 19 bp, Homo sapiens
catagataatattgtttgg

SEQ ID NO: 1530795 - DNA, 15 bp, Homo sapiens
catagatattttata

SEQ ID NO: 1530796 - DNA, 14 bp, Homo sapiens
catagatcttctga

SEQ ID NO: 1530797 - DNA, 18 bp, Homo sapiens
catagattaatggcactg

SEQ ID NO: 1530798 - DNA, 19 bp, Homo sapiens
catagattaatggcactga

SEQ ID NO: 1530799 - DNA, 17 bp, Homo sapiens
catagattattataaac

SEQ ID NO: 1530800 - DNA, 18 bp, Homo sapiens
catagattccctgagcag

SEQ ID NO: 1530801 - DNA, 15 bp, Homo sapiens
catagcaacaggaaa

SEQ ID NO: 1530802 - DNA, 23 bp, Homo sapiens
catagcaagattgcttaaaatag

SEQ ID NO: 1530803 - DNA, 19 bp, Homo sapiens
catagcaagcttttgctca

SEQ ID NO: 1530804 - DNA, 18 bp, Homo sapiens
catagcagctttgtctct

SEQ ID NO: 1530805 - DNA, 15 bp, Homo sapiens
catagcatcctgatt

SEQ ID NO: 1530806 - DNA, 15 bp, Homo sapiens
catagcatgacattt

SEQ ID NO: 1530807 - DNA, 17 bp, Homo sapiens
catagcatgcttccttt

SEQ ID NO: 1530808 - DNA, 20 bp, Homo sapiens
catagcatgcttcctttctc

SEQ ID NO: 1530809 - DNA, 21 bp, Homo sapiens
catagccaaagccaggcctga

SEQ ID NO: 1530810 - DNA, 18 bp, Homo sapiens
catagccaactctcccaa

SEQ ID NO: 1530811 - DNA, 19 bp, Homo sapiens
catagcctaatccctgggc

SEQ ID NO: 1530812 - DNA, 14 bp, Homo sapiens
catagcctcatgtt

SEQ ID NO: 1530813 - DNA, 17 bp, Homo sapiens
catagcctcatgttctg

SEQ ID NO: 1530814 - DNA, 16 bp, Homo sapiens
catagcctgcctgatc

SEQ ID NO: 1530815 - DNA, 15 bp, Homo sapiens
catagcgtcctgccc

SEQ ID NO: 1530816 - DNA, 19 bp, Homo sapiens
catagcgtcctgccctgcc

SEQ ID NO: 1530817 - DNA, 12 bp, Homo sapiens
catagctctggg

SEQ ID NO: 1530818 - DNA, 15 bp, Homo sapiens
catagctgtctagag

SEQ ID NO: 1530819 - DNA, 22 bp, Homo sapiens
cataggaaaagtacatttaata

SEQ ID NO: 1530820 - DNA, 23 bp, Homo sapiens
cataggaaaagtacatttaatac

SEQ ID NO: 1530821 - DNA, 14 bp, Homo sapiens
cataggaataaaat

SEQ ID NO: 1530822 - DNA, 23 bp, Homo sapiens
cataggactcaaagtttcagaga

SEQ ID NO: 1530823 - DNA, 17 bp, Homo sapiens
cataggcctgggtgctg

SEQ ID NO: 1530824 - DNA, 18 bp, Homo sapiens
cataggcggtcatgtgtg

SEQ ID NO: 1530825 - DNA, 19 bp, Homo sapiens
cataggctggtggccttgg

SEQ ID NO: 1530826 - DNA, 21 bp, Homo sapiens
catagggtcactttgccatta

SEQ ID NO: 1530827 - DNA, 17 bp, Homo sapiens
catagggtctcttcagg

SEQ ID NO: 1530828 - DNA, 21 bp, Homo sapiens
taattgcgtagaggctacagg

SEQ ID NO: 1530829 - DNA, 18 bp, Homo sapiens
taattgcttaaaagacat

SEQ ID NO: 1530830 - DNA, 15 bp, Homo sapiens
taattgcttacattt

SEQ ID NO: 1530831 - DNA, 14 bp, Homo sapiens
taattgctttaaat

SEQ ID NO: 1530832 - DNA, 15 bp, Homo sapiens
taattggacttttat

SEQ ID NO: 1530833 - DNA, 23 bp, Homo sapiens
taattggatttcctaatactgtc

SEQ ID NO: 1530834 - DNA, 22 bp, Homo sapiens
taattgtaaagtaaaagctata

SEQ ID NO: 1530835 - DNA, 11 bp, Homo sapiens
taattgtacaa

SEQ ID NO: 1530836 - DNA, 15 bp, Homo sapiens
taattgtacaaaatt

SEQ ID NO: 1530837 - DNA, 14 bp, Homo sapiens
taattgtacaataa

SEQ ID NO: 1530838 - DNA, 22 bp, Homo sapiens
taattgtagttctgtgtacttt

SEQ ID NO: 1530839 - DNA, 24 bp, Homo sapiens
taattgtataagtcaagcacatgt

SEQ ID NO: 1530840 - DNA, 21 bp, Homo sapiens
taattgtgaccaatacatttg

SEQ ID NO: 1530841 - DNA, 22 bp, Homo sapiens
taattgtgaccaatacatttgt

SEQ ID NO: 1530842 - DNA, 14 bp, Homo sapiens
taattgtggattaa

SEQ ID NO: 1530843 - DNA, 20 bp, Homo sapiens
taattgtgtggattctttaa

SEQ ID NO: 1530844 - DNA, 14 bp, Homo sapiens
taattgttgcatag

SEQ ID NO: 1530845 - DNA, 16 bp, Homo sapiens
taattgttgctaatct

SEQ ID NO: 1530846 - DNA, 15 bp, Homo sapiens
taattgtttccaact

SEQ ID NO: 1530847 - DNA, 14 bp, Homo sapiens
taattgttttttaa

SEQ ID NO: 1530848 - DNA, 17 bp, Homo sapiens
taattgttttttaaagc

SEQ ID NO: 1530849 - DNA, 21 bp, Homo sapiens
taattgttttttaaagcaagt

SEQ ID NO: 1530850 - DNA, 20 bp, Homo sapiens
taatttaaaaatctccatta

SEQ ID NO: 1530851 - DNA, 16 bp, Homo sapiens
taatttaaaattgtga

SEQ ID NO: 1530852 - DNA, 19 bp, Homo sapiens
taatttaaaattgtgatgt

SEQ ID NO: 1530853 - DNA, 11 bp, Homo sapiens
taatttaaaca

SEQ ID NO: 1530854 - DNA, 17 bp, Homo sapiens
taatttaaacacctcct

SEQ ID NO: 1530855 - DNA, 20 bp, Homo sapiens
taatttaaacaggcccagca

SEQ ID NO: 1530856 - DNA, 16 bp, Homo sapiens
taatttaaactgtgtt

SEQ ID NO: 1530857 - DNA, 13 bp, Homo sapiens
taatttaaagaga

SEQ ID NO: 1530858 - DNA, 14 bp, Homo sapiens
taatttaaagagac

SEQ ID NO: 1530859 - DNA, 13 bp, Homo sapiens
taatttaaatgaa

SEQ ID NO: 1530860 - DNA, 12 bp, Homo sapiens
taatttaacacc

SEQ ID NO: 1530861 - DNA, 16 bp, Homo sapiens
taatttaacccagctc

SEQ ID NO: 1530862 - DNA, 19 bp, Homo sapiens
taatttaactttctgggtt

SEQ ID NO: 1530863 - DNA, 21 bp, Homo sapiens
taatttaaggtctgtttgctg

SEQ ID NO: 1530864 - DNA, 13 bp, Homo sapiens
taatttaagtgac

SEQ ID NO: 1530865 - DNA, 16 bp, Homo sapiens
taatttaagtgacaca

SEQ ID NO: 1530866 - DNA, 21 bp, Homo sapiens
taatttaagtgacacagacat

SEQ ID NO: 1530867 - DNA, 22 bp, Homo sapiens
taatttacacacttgcatgaat

SEQ ID NO: 1530868 - DNA, 18 bp, Homo sapiens
tacaaggtaattgttttt

SEQ ID NO: 1530869 - DNA, 16 bp, Homo sapiens
tacaaggtataataaa

SEQ ID NO: 1530870 - DNA, 12 bp, Homo sapiens
tacaagtaatgt

SEQ ID NO: 1530871 - DNA, 12 bp, Homo sapiens
tacaagtaattt

SEQ ID NO: 1530872 - DNA, 17 bp, Homo sapiens
tacaagtgttcttaggt

SEQ ID NO: 1530873 - DNA, 21 bp, Homo sapiens
tacaagtgttcttaggtttac

SEQ ID NO: 1530874 - DNA, 16 bp, Homo sapiens
tacaagtttatatata

SEQ ID NO: 1530875 - DNA, 17 bp, Homo sapiens
tacaagtttcagacagg

SEQ ID NO: 1530876 - DNA, 18 bp, Homo sapiens
tacaagtttcagacaggg

SEQ ID NO: 1530877 - DNA, 13 bp, Homo sapiens
tacaagttttgta

SEQ ID NO: 1530878 - DNA, 13 bp, Homo sapiens
tacaataaactat

SEQ ID NO: 1530879 - DNA, 13 bp, Homo sapiens
tacaataaagttt

SEQ ID NO: 1530880 - DNA, 17 bp, Homo sapiens
tacaataaagtttacaa

SEQ ID NO: 1530881 - DNA, 23 bp, Homo sapiens
tacaataaagtttacaagcgaga

SEQ ID NO: 1530882 - DNA, 16 bp, Homo sapiens
tacaataaataatctg

SEQ ID NO: 1530883 - DNA, 13 bp, Homo sapiens
tacaataacataa

SEQ ID NO: 1530884 - DNA, 15 bp, Homo sapiens
tacaataatctctat

SEQ ID NO: 1530885 - DNA, 14 bp, Homo sapiens
tacaataatgtact

SEQ ID NO: 1530886 - DNA, 15 bp, Homo sapiens
tacaataatgtactc

SEQ ID NO: 1530887 - DNA, 16 bp, Homo sapiens
tacaataatgtactca

SEQ ID NO: 1530888 - DNA, 18 bp, Homo sapiens
tacaataatgtactcaca

SEQ ID NO: 1530889 - DNA, 14 bp, Homo sapiens
tacaatacaatgta

SEQ ID NO: 1530890 - DNA, 15 bp, Homo sapiens
tacaatatgtacatt

SEQ ID NO: 1530891 - DNA, 19 bp, Homo sapiens
tacaatattgattgggaaa

SEQ ID NO: 1530892 - DNA, 22 bp, Homo sapiens
tacaatcatggtcaagttccca

SEQ ID NO: 1530893 - DNA, 15 bp, Homo sapiens
tacaatgaactgctt

SEQ ID NO: 1530894 - DNA, 20 bp, Homo sapiens
tacaatgaactgcttttcct

SEQ ID NO: 1530895 - DNA, 14 bp, Homo sapiens
tacaatggtttatt

SEQ ID NO: 1530896 - DNA, 22 bp, Homo sapiens
tacaatggtttattcccaagta

SEQ ID NO: 1530897 - DNA, 15 bp, Homo sapiens
tacaatgtacaatta

SEQ ID NO: 1530898 - DNA, 18 bp, Homo sapiens
tacaatgtacaattatgt

SEQ ID NO: 1530899 - DNA, 19 bp, Homo sapiens
tacaatgtacaattatgtc

SEQ ID NO: 1530900 - DNA, 17 bp, Homo sapiens
tacaatgtatgtacaat

SEQ ID NO: 1530901 - DNA, 18 bp, Homo sapiens
tacaatgtatttatttaa

SEQ ID NO: 1530902 - DNA, 20 bp, Homo sapiens
tacaatgtatttatttaaaa

SEQ ID NO: 1530903 - DNA, 11 bp, Homo sapiens
tacaatgtgag

SEQ ID NO: 1530904 - DNA, 19 bp, Homo sapiens
tacaattatgtctcttgag

SEQ ID NO: 1530905 - DNA, 18 bp, Homo sapiens
tacaattatttttacagt

SEQ ID NO: 1530906 - DNA, 14 bp, Homo sapiens
tacaattcattgtt

SEQ ID NO: 1530907 - DNA, 16 bp, Homo sapiens
tacaattgaaatgact

SEQ ID NO: 1530908 - DNA, 16 bp, Homo sapiens
tacaattttaaagttc

SEQ ID NO: 1530909 - DNA, 17 bp, Homo sapiens
tacaattttaaagttct

SEQ ID NO: 1530910 - DNA, 22 bp, Homo sapiens
tacaattttaaagttcttattt

SEQ ID NO: 1530911 - DNA, 13 bp, Homo sapiens
tacaattttaaga

SEQ ID NO: 1530912 - DNA, 18 bp, Homo sapiens
tacaattttatctgtttc

SEQ ID NO: 1530913 - DNA, 14 bp, Homo sapiens
tacaattttctgta

SEQ ID NO: 1530914 - DNA, 18 bp, Homo sapiens
tacaatttttaataaatt

SEQ ID NO: 1530915 - DNA, 21 bp, Homo sapiens
tacaatttttaataaattgaa

SEQ ID NO: 1530916 - DNA, 20 bp, Homo sapiens
tacacaaaatcaaataatac

SEQ ID NO: 1530917 - DNA, 20 bp, Homo sapiens
tacacaaagaacttgctgct

SEQ ID NO: 1530918 - DNA, 15 bp, Homo sapiens
tacacaagtaaacat

SEQ ID NO: 1530919 - DNA, 17 bp, Homo sapiens
tacacaatacagtatta

SEQ ID NO: 1530920 - DNA, 22 bp, Homo sapiens
tacacacaaaaaccttggcata

SEQ ID NO: 1530921 - DNA, 21 bp, Homo sapiens
tacacacacacagacatatat

SEQ ID NO: 1530922 - DNA, 17 bp, Homo sapiens
tacacaccagaagatgt

SEQ ID NO: 1530923 - DNA, 13 bp, Homo sapiens
tacacagaaacac

SEQ ID NO: 1530924 - DNA, 21 bp, Homo sapiens
tacacagaaatgctgctggcc

SEQ ID NO: 1530925 - DNA, 22 bp, Homo sapiens
tacacagaaatgctgctggcca

SEQ ID NO: 1530926 - DNA, 17 bp, Homo sapiens
tacacagagaaggctat

SEQ ID NO: 1530927 - DNA, 13 bp, Homo sapiens
tacacagcctgga

SEQ ID NO: 1530928 - DNA, 15 bp, Homo sapiens
tacacagctctagac

SEQ ID NO: 1530929 - DNA, 15 bp, Homo sapiens
tacacagtactttat

SEQ ID NO: 1530930 - DNA, 21 bp, Homo sapiens
tacacagtactttattgtaca

SEQ ID NO: 1530931 - DNA, 23 bp, Homo sapiens
tacacagtgggaactctgacaag

SEQ ID NO: 1530932 - DNA, 23 bp, Homo sapiens
tacacatagcaggggcaccttcc

SEQ ID NO: 1530933 - DNA, 15 bp, Homo sapiens
tacacatgtaaaata

SEQ ID NO: 1530934 - DNA, 17 bp, Homo sapiens
tacacatgtaaaatatg

SEQ ID NO: 1530935 - DNA, 19 bp, Homo sapiens
tacacatgtaaaatatgta

SEQ ID NO: 1530936 - DNA, 16 bp, Homo sapiens
tacacattaaacagga

SEQ ID NO: 1530937 - DNA, 17 bp, Homo sapiens
tacacatttgctactgt

SEQ ID NO: 1530938 - DNA, 17 bp, Homo sapiens
tacaccaatgaaaacat

SEQ ID NO: 1530939 - DNA, 19 bp, Homo sapiens
tacaccacctcactcctgt

SEQ ID NO: 1530940 - DNA, 19 bp, Homo sapiens
tacaccagagataatatga

SEQ ID NO: 1530941 - DNA, 19 bp, Homo sapiens
tacaccattatcttggaaa

SEQ ID NO: 1530942 - DNA, 15 bp, Homo sapiens
tacacccctgtgctc

SEQ ID NO: 1530943 - DNA, 16 bp, Homo sapiens
tacaccgactagccag

SEQ ID NO: 1530944 - DNA, 15 bp, Homo sapiens
tacaccgggcctgga

SEQ ID NO: 1530945 - DNA, 14 bp, Homo sapiens
tacacctggctgag

SEQ ID NO: 1530946 - DNA, 22 bp, Homo sapiens
tacacctggctgaggttcctct

SEQ ID NO: 1530947 - DNA, 20 bp, Homo sapiens
tacaccttgccttgctgttt

SEQ ID NO: 1530948 - DNA, 19 bp, Homo sapiens
taatcctattaaaacacag

SEQ ID NO: 1530949 - DNA, 16 bp, Homo sapiens
taatcggcccacagct

SEQ ID NO: 1530950 - DNA, 22 bp, Homo sapiens
taatcgtgtgccatggatctga

SEQ ID NO: 1530951 - DNA, 13 bp, Homo sapiens
taatctaccagtg

SEQ ID NO: 1530952 - DNA, 22 bp, Homo sapiens
taatctactccttgtaaagact

SEQ ID NO: 1530953 - DNA, 17 bp, Homo sapiens
taatctcatacctctga

SEQ ID NO: 1530954 - DNA, 20 bp, Homo sapiens
taatctcatacctctgacca

SEQ ID NO: 1530955 - DNA, 16 bp, Homo sapiens
taatctccactttttt

SEQ ID NO: 1530956 - DNA, 18 bp, Homo sapiens
taatctctaaaattctag

SEQ ID NO: 1530957 - DNA, 19 bp, Homo sapiens
taatctctaaaattctagt

SEQ ID NO: 1530958 - DNA, 17 bp, Homo sapiens
taatctctctgcagctg

SEQ ID NO: 1530959 - DNA, 20 bp, Homo sapiens
taatctctctgcagctgccg

SEQ ID NO: 1530960 - DNA, 15 bp, Homo sapiens
taatctcttattcta

SEQ ID NO: 1530961 - DNA, 13 bp, Homo sapiens
taatctgaataaa

SEQ ID NO: 1530962 - DNA, 20 bp, Homo sapiens
taatctgaataaagtgtaac

SEQ ID NO: 1530963 - DNA, 21 bp, Homo sapiens
taatctgaataaagtgtaaca

SEQ ID NO: 1530964 - DNA, 22 bp, Homo sapiens
taatctgaataaagtgtaacaa

SEQ ID NO: 1530965 - DNA, 16 bp, Homo sapiens
taatctggtgacaaat

SEQ ID NO: 1530966 - DNA, 13 bp, Homo sapiens
taatctgttatgt

SEQ ID NO: 1530967 - DNA, 10 bp, Homo sapiens
taatcttaag

SEQ ID NO: 1530968 - DNA, 14 bp, Homo sapiens
taatcttagctttt

SEQ ID NO: 1530969 - DNA, 20 bp, Homo sapiens
taatcttaggggagagcttt

SEQ ID NO: 1530970 - DNA, 15 bp, Homo sapiens
taatcttcaatagtt

SEQ ID NO: 1530971 - DNA, 14 bp, Homo sapiens
taatcttctgcctt

SEQ ID NO: 1530972 - DNA, 15 bp, Homo sapiens
taatcttctgccttc

SEQ ID NO: 1530973 - DNA, 20 bp, Homo sapiens
taatcttgctctgcttgaca

SEQ ID NO: 1530974 - DNA, 22 bp, Homo sapiens
taatcttgctttctttagaatt

SEQ ID NO: 1530975 - DNA, 18 bp, Homo sapiens
taatctttctttacctga

SEQ ID NO: 1530976 - DNA, 21 bp, Homo sapiens
taatctttctttacctgagac

SEQ ID NO: 1530977 - DNA, 13 bp, Homo sapiens
taatctttctttt

SEQ ID NO: 1530978 - DNA, 12 bp, Homo sapiens
taatctttgggt

SEQ ID NO: 1530979 - DNA, 14 bp, Homo sapiens
taatcttttattta

SEQ ID NO: 1530980 - DNA, 16 bp, Homo sapiens
taatgaaaataaaaca

SEQ ID NO: 1530981 - DNA, 22 bp, Homo sapiens
taatgaaagactgtacaaagta

SEQ ID NO: 1530982 - DNA, 19 bp, Homo sapiens
taatgaaataatcagtgac

SEQ ID NO: 1530983 - DNA, 14 bp, Homo sapiens
taatgaaatatctg

SEQ ID NO: 1530984 - DNA, 19 bp, Homo sapiens
taatgaaatatctgtattt

SEQ ID NO: 1530985 - DNA, 16 bp, Homo sapiens
taatgaaatcaaatgt

SEQ ID NO: 1530986 - DNA, 18 bp, Homo sapiens
taatgaactaccatctga

SEQ ID NO: 1530987 - DNA, 14 bp, Homo sapiens
taatgaagagaaaa

SEQ ID NO: 1530988 - DNA, 22 bp, Homo sapiens
taatgaagggaaaggatatttt

SEQ ID NO: 1530989 - DNA, 15 bp, Homo sapiens
taatgaatggactca

SEQ ID NO: 1530990 - DNA, 19 bp, Homo sapiens
taatgaattataacagtta

SEQ ID NO: 1530991 - DNA, 22 bp, Homo sapiens
taatgaattataacagttatat

SEQ ID NO: 1530992 - DNA, 16 bp, Homo sapiens
taatgaatttttatga

SEQ ID NO: 1530993 - DNA, 21 bp, Homo sapiens
taatgaatttttatgatattc

SEQ ID NO: 1530994 - DNA, 20 bp, Homo sapiens
taatgaccacacctgcctct

SEQ ID NO: 1530995 - DNA, 16 bp, Homo sapiens
taatgacttagaaact

SEQ ID NO: 1530996 - DNA, 17 bp, Homo sapiens
taatgacttagaaactg

SEQ ID NO: 1530997 - DNA, 14 bp, Homo sapiens
taatgagaatagaa

SEQ ID NO: 1530998 - DNA, 22 bp, Homo sapiens
taatgagatgttattactgttt

SEQ ID NO: 1530999 - DNA, 12 bp, Homo sapiens
taatgagccatc

SEQ ID NO: 1531000 - DNA, 19 bp, Homo sapiens
taatgaggaaaaaatggta

SEQ ID NO: 1531001 - DNA, 15 bp, Homo sapiens
taatgaggaaatgtg

SEQ ID NO: 1531002 - DNA, 16 bp, Homo sapiens
taatgaggatgattat

SEQ ID NO: 1531003 - DNA, 17 bp, Homo sapiens
taatgagggaaatctgt

SEQ ID NO: 1531004 - DNA, 20 bp, Homo sapiens
taatgagggaaatctgtaaa

SEQ ID NO: 1531005 - DNA, 14 bp, Homo sapiens
taatgataaactca

SEQ ID NO: 1531006 - DNA, 18 bp, Homo sapiens
taatgataaactcagatc

SEQ ID NO: 1531007 - DNA, 16 bp, Homo sapiens
taatgatactgtgtgt

SEQ ID NO: 1531008 - DNA, 22 bp, Homo sapiens
taatgatgacaaaaaatgtttt

SEQ ID NO: 1531009 - DNA, 19 bp, Homo sapiens
taatgattatataaaatac

SEQ ID NO: 1531010 - DNA, 23 bp, Homo sapiens
taatgattatataaaatacataa

SEQ ID NO: 1531011 - DNA, 21 bp, Homo sapiens
taatgcaaaatttttttaatc

SEQ ID NO: 1531012 - DNA, 14 bp, Homo sapiens
taatgcattgcctg

SEQ ID NO: 1531013 - DNA, 16 bp, Homo sapiens
taatgcattgcctgta

SEQ ID NO: 1531014 - DNA, 17 bp, Homo sapiens
taatgcctctcccgcac

SEQ ID NO: 1531015 - DNA, 20 bp, Homo sapiens
taatgcctgctttttggaaa

SEQ ID NO: 1531016 - DNA, 21 bp, Homo sapiens
taatgccttactcttcttgaa

SEQ ID NO: 1531017 - DNA, 16 bp, Homo sapiens
taatgctgttgcctca

SEQ ID NO: 1531018 - DNA, 19 bp, Homo sapiens
cagtgcctaaaataagaat

SEQ ID NO: 1531019 - DNA, 14 bp, Homo sapiens
cagtgcctcgaggc

SEQ ID NO: 1531020 - DNA, 10 bp, Homo sapiens
cagtgcctgc

SEQ ID NO: 1531021 - DNA, 14 bp, Homo sapiens
cagtgcctgccact

SEQ ID NO: 1531022 - DNA, 15 bp, Homo sapiens
cagtgcctgccactc

SEQ ID NO: 1531023 - DNA, 18 bp, Homo sapiens
cagtgcctgccactctct

SEQ ID NO: 1531024 - DNA, 21 bp, Homo sapiens
cagtgcctgccactctctggg

SEQ ID NO: 1531025 - DNA, 24 bp, Homo sapiens
cagtgcctgccactctctgggact

SEQ ID NO: 1531026 - DNA, 13 bp, Homo sapiens
cagtgcctgctga

SEQ ID NO: 1531027 - DNA, 18 bp, Homo sapiens
cagtgcctgggaatgtat

SEQ ID NO: 1531028 - DNA, 22 bp, Homo sapiens
cagtgccttacctcctgcccag

SEQ ID NO: 1531029 - DNA, 23 bp, Homo sapiens
cagtgccttacctcctgcccagg

SEQ ID NO: 1531030 - DNA, 17 bp, Homo sapiens
cagtgccttccataatt

SEQ ID NO: 1531031 - DNA, 23 bp, Homo sapiens
cagtgccttccataattatgaca

SEQ ID NO: 1531032 - DNA, 13 bp, Homo sapiens
cagtgccttcctc

SEQ ID NO: 1531033 - DNA, 15 bp, Homo sapiens
cagtgccttctctca

SEQ ID NO: 1531034 - DNA, 18 bp, Homo sapiens
cagtgccttctctcagct

SEQ ID NO: 1531035 - DNA, 20 bp, Homo sapiens
cagtgccttctctcagctcc

SEQ ID NO: 1531036 - DNA, 15 bp, Homo sapiens
cagtgcggctgccag

SEQ ID NO: 1531037 - DNA, 15 bp, Homo sapiens
cagtgctacattttg

SEQ ID NO: 1531038 - DNA, 17 bp, Homo sapiens
cagtgctacattttgtg

SEQ ID NO: 1531039 - DNA, 22 bp, Homo sapiens
cagtgctataaatgccagagcc

SEQ ID NO: 1531040 - DNA, 13 bp, Homo sapiens
cagtgctcagctg

SEQ ID NO: 1531041 - DNA, 14 bp, Homo sapiens
cagtgctcagctgt

SEQ ID NO: 1531042 - DNA, 16 bp, Homo sapiens
cagtgctcagctgtgg

SEQ ID NO: 1531043 - DNA, 17 bp, Homo sapiens
cagtgctcagctgtggc

SEQ ID NO: 1531044 - DNA, 14 bp, Homo sapiens
cagtgctctcagct

SEQ ID NO: 1531045 - DNA, 15 bp, Homo sapiens
cagtgctgagggacc

SEQ ID NO: 1531046 - DNA, 13 bp, Homo sapiens
cagtgctgccatg

SEQ ID NO: 1531047 - DNA, 15 bp, Homo sapiens
cagtgctgcccatga

SEQ ID NO: 1531048 - DNA, 14 bp, Homo sapiens
cagtgctgcttctc

SEQ ID NO: 1531049 - DNA, 15 bp, Homo sapiens
cagtgctggaaggga

SEQ ID NO: 1531050 - DNA, 15 bp, Homo sapiens
cagtgctgggaccag

SEQ ID NO: 1531051 - DNA, 22 bp, Homo sapiens
cagtgctgggaccagagccaga

SEQ ID NO: 1531052 - DNA, 18 bp, Homo sapiens
cagtgctgtggcctgggc

SEQ ID NO: 1531053 - DNA, 14 bp, Homo sapiens
cagtgcttcagcct

SEQ ID NO: 1531054 - DNA, 19 bp, Homo sapiens
cagtgcttcagcctgaggc

SEQ ID NO: 1531055 - DNA, 20 bp, Homo sapiens
cagtgcttgagtttggggaa

SEQ ID NO: 1531056 - DNA, 19 bp, Homo sapiens
cagtgctttgcatgtatta

SEQ ID NO: 1531057 - DNA, 15 bp, Homo sapiens
cagtggaatagatgt

SEQ ID NO: 1531058 - DNA, 20 bp, Homo sapiens
cagtggacatcgtaggcagc

SEQ ID NO: 1531059 - DNA, 14 bp, Homo sapiens
cagtggactctgag

SEQ ID NO: 1531060 - DNA, 14 bp, Homo sapiens
cagtggagcctgcc

SEQ ID NO: 1531061 - DNA, 18 bp, Homo sapiens
cagtggagcctgccgccc

SEQ ID NO: 1531062 - DNA, 14 bp, Homo sapiens
cagtggagcctggg

SEQ ID NO: 1531063 - DNA, 14 bp, Homo sapiens
cagtggaggctgct

SEQ ID NO: 1531064 - DNA, 15 bp, Homo sapiens
cagtggaggctgctg

SEQ ID NO: 1531065 - DNA, 18 bp, Homo sapiens
cagtggaggctgctgtga

SEQ ID NO: 1531066 - DNA, 16 bp, Homo sapiens
cagtggatatgaccca

SEQ ID NO: 1531067 - DNA, 22 bp, Homo sapiens
cagtggatatgacccacactgc

SEQ ID NO: 1531068 - DNA, 12 bp, Homo sapiens
cagtggccaggc

SEQ ID NO: 1531069 - DNA, 22 bp, Homo sapiens
cagtggccggttgccactctcc

SEQ ID NO: 1531070 - DNA, 14 bp, Homo sapiens
cagtggcctggccg

SEQ ID NO: 1531071 - DNA, 22 bp, Homo sapiens
cagtggcctggccgttcagcct

SEQ ID NO: 1531072 - DNA, 21 bp, Homo sapiens
cagtggcgtgatctcagctca

SEQ ID NO: 1531073 - DNA, 14 bp, Homo sapiens
cagtggctcacgcc

SEQ ID NO: 1531074 - DNA, 20 bp, Homo sapiens
cagtggctcacgcctatgat

SEQ ID NO: 1531075 - DNA, 23 bp, Homo sapiens
cagtggctgagtagctctgcctt

SEQ ID NO: 1531076 - DNA, 20 bp, Homo sapiens
cagtggctggaagaaccact

SEQ ID NO: 1531077 - DNA, 20 bp, Homo sapiens
cagtggctggatctgtgagg

SEQ ID NO: 1531078 - DNA, 13 bp, Homo sapiens
cagtggctggtct

SEQ ID NO: 1531079 - DNA, 18 bp, Homo sapiens
cagtgggagccagggctg

SEQ ID NO: 1531080 - DNA, 17 bp, Homo sapiens
cagtgggagctgagctg

SEQ ID NO: 1531081 - DNA, 19 bp, Homo sapiens
cagtgggaggggcaggctg

SEQ ID NO: 1531082 - DNA, 20 bp, Homo sapiens
cagtgggcaggaggccccag

SEQ ID NO: 1531083 - DNA, 14 bp, Homo sapiens
cagtgggcaggtgg

SEQ ID NO: 1531084 - DNA, 15 bp, Homo sapiens
cagtgggcaggtggc

SEQ ID NO: 1531085 - DNA, 16 bp, Homo sapiens
cagtgggcaggtggcc

SEQ ID NO: 1531086 - DNA, 14 bp, Homo sapiens
cagtgggcccggag

SEQ ID NO: 1531087 - DNA, 23 bp, Homo sapiens
cagtgggcgttgggagcctagct

SEQ ID NO: 1531088 - DNA, 14 bp, Homo sapiens
cagtggggctggca

SEQ ID NO: 1531089 - DNA, 21 bp, Homo sapiens
cagtggggtcccccctgagtg

SEQ ID NO: 1531090 - DNA, 13 bp, Homo sapiens
cagtgggtggcac

SEQ ID NO: 1531091 - DNA, 19 bp, Homo sapiens
cagtgggtggcacctcctg

SEQ ID NO: 1531092 - DNA, 21 bp, Homo sapiens
cagtgggtggcacctcctgag

SEQ ID NO: 1531093 - DNA, 22 bp, Homo sapiens
cagtgggtggcacctcctgaga

SEQ ID NO: 1531094 - DNA, 23 bp, Homo sapiens
cagtgggtggcacctcctgagaa

SEQ ID NO: 1531095 - DNA, 18 bp, Homo sapiens
cagtggtcatgctcagcc

SEQ ID NO: 1531096 - DNA, 23 bp, Homo sapiens
cagtggtcccatttatatctgct

SEQ ID NO: 1531097 - DNA, 15 bp, Homo sapiens
cagtggtgggtaatt

SEQ ID NO: 1531098 - DNA, 17 bp, Homo sapiens
cagtggtgggtaattgt

SEQ ID NO: 1531099 - DNA, 18 bp, Homo sapiens
cagtggtgggtaattgta

SEQ ID NO: 1531100 - DNA, 20 bp, Homo sapiens
cagtggtgggtaattgtaca

SEQ ID NO: 1531101 - DNA, 21 bp, Homo sapiens
cagtggtgggtaattgtacaa

SEQ ID NO: 1531102 - DNA, 23 bp, Homo sapiens
cagtggtgggtaattgtacaata

SEQ ID NO: 1531103 - DNA, 14 bp, Homo sapiens
cagtggttgcctgg

SEQ ID NO: 1531104 - DNA, 15 bp, Homo sapiens
cagtggttgcctggg

SEQ ID NO: 1531105 - DNA, 16 bp, Homo sapiens
cagtggttgcctgggg

SEQ ID NO: 1531106 - DNA, 19 bp, Homo sapiens
cagtgtaatccaggggtgt

SEQ ID NO: 1531107 - DNA, 19 bp, Homo sapiens
cagtgtaatgtgacttcat

SEQ ID NO: 1531108 - DNA, 16 bp, Homo sapiens
cagtgtacacgtctgg

SEQ ID NO: 1531109 - DNA, 20 bp, Homo sapiens
cagtgtacaggtcacccatc

SEQ ID NO: 1531110 - DNA, 21 bp, Homo sapiens
cagtgtacaggtcacccatca

SEQ ID NO: 1531111 - DNA, 13 bp, Homo sapiens
cagtgtacatgta

SEQ ID NO: 1531112 - DNA, 15 bp, Homo sapiens
cagtgtacatgtaca

SEQ ID NO: 1531113 - DNA, 16 bp, Homo sapiens
cagtgtacatgtacat

SEQ ID NO: 1531114 - DNA, 21 bp, Homo sapiens
cagtgtacatgtacatagtaa

SEQ ID NO: 1531115 - DNA, 19 bp, Homo sapiens
cagtgtagccttgcccgga

SEQ ID NO: 1531116 - DNA, 17 bp, Homo sapiens
cagtgtatggaaataaa

SEQ ID NO: 1531117 - DNA, 18 bp, Homo sapiens
cagtgtcaagttgtgctt

SEQ ID NO: 1531118 - DNA, 19 bp, Homo sapiens
cagtgtcaagttgtgcttg

SEQ ID NO: 1531119 - DNA, 16 bp, Homo sapiens
cagtgtcagctgtggg

SEQ ID NO: 1531120 - DNA, 15 bp, Homo sapiens
cagtgtccagcttcc

SEQ ID NO: 1531121 - DNA, 12 bp, Homo sapiens
cagtgtcccctg

SEQ ID NO: 1531122 - DNA, 12 bp, Homo sapiens
cagtgtcctccc

SEQ ID NO: 1531123 - DNA, 14 bp, Homo sapiens
cagtgtctcggagg

SEQ ID NO: 1531124 - DNA, 24 bp, Homo sapiens
cagtgtctgtatcggagacagtga

SEQ ID NO: 1531125 - DNA, 13 bp, Homo sapiens
cagtgtctgtgtt

SEQ ID NO: 1531126 - DNA, 23 bp, Homo sapiens
cagtgtctgtgttttgaaagaat

SEQ ID NO: 1531127 - DNA, 16 bp, Homo sapiens
cagtgtcttccataat

SEQ ID NO: 1531128 - DNA, 18 bp, Homo sapiens
cagtgtcttccataatgt

SEQ ID NO: 1531129 - DNA, 20 bp, Homo sapiens
cagtgtcttccataatgtat

SEQ ID NO: 1531130 - DNA, 22 bp, Homo sapiens
cagtgtgaggacctccctgtct

SEQ ID NO: 1531131 - DNA, 19 bp, Homo sapiens
cagtgtgagggaaagagct

SEQ ID NO: 1531132 - DNA, 19 bp, Homo sapiens
cagtgtgatcccaagtgcc

SEQ ID NO: 1531133 - DNA, 22 bp, Homo sapiens
cagtgtgatcccaagtgccagt

SEQ ID NO: 1531134 - DNA, 14 bp, Homo sapiens
taatgctgtttcta

SEQ ID NO: 1531135 - DNA, 16 bp, Homo sapiens
taatgctgtttctaag

SEQ ID NO: 1531136 - DNA, 17 bp, Homo sapiens
taatgctgtttctaaga

SEQ ID NO: 1531137 - DNA, 16 bp, Homo sapiens
taatgcttggaatggc

SEQ ID NO: 1531138 - DNA, 16 bp, Homo sapiens
taatggaaaaatagta

SEQ ID NO: 1531139 - DNA, 21 bp, Homo sapiens
taatggaaaatgccatgaatt

SEQ ID NO: 1531140 - DNA, 17 bp, Homo sapiens
taatggaaaccaagcca

SEQ ID NO: 1531141 - DNA, 14 bp, Homo sapiens
taatgggcctgccc

SEQ ID NO: 1531142 - DNA, 16 bp, Homo sapiens
taatgggcctgcccaa

SEQ ID NO: 1531143 - DNA, 15 bp, Homo sapiens
taatggggcagacac

SEQ ID NO: 1531144 - DNA, 15 bp, Homo sapiens
taatgggggtagcag

SEQ ID NO: 1531145 - DNA, 17 bp, Homo sapiens
taatgggggtagcagct

SEQ ID NO: 1531146 - DNA, 18 bp, Homo sapiens
taatgggggtagcagctg

SEQ ID NO: 1531147 - DNA, 21 bp, Homo sapiens
taatgggggtagcagctggac

SEQ ID NO: 1531148 - DNA, 16 bp, Homo sapiens
taatggtaatagaata

SEQ ID NO: 1531149 - DNA, 23 bp, Homo sapiens
taatggtactgactttgcttgct

SEQ ID NO: 1531150 - DNA, 21 bp, Homo sapiens
taatggtcccatccaggcagt

SEQ ID NO: 1531151 - DNA, 20 bp, Homo sapiens
taatggtttttgttagttca

SEQ ID NO: 1531152 - DNA, 20 bp, Homo sapiens
taatgtaaataaactattta

SEQ ID NO: 1531153 - DNA, 17 bp, Homo sapiens
taatgtaataactgtga

SEQ ID NO: 1531154 - DNA, 18 bp, Homo sapiens
taatgtaataactgtgaa

SEQ ID NO: 1531155 - DNA, 23 bp, Homo sapiens
taatgtacgctgctgcaggacat

SEQ ID NO: 1531156 - DNA, 12 bp, Homo sapiens
taatgtactcac

SEQ ID NO: 1531157 - DNA, 13 bp, Homo sapiens
taatgtactcaca

SEQ ID NO: 1531158 - DNA, 15 bp, Homo sapiens
taatgtacttgaaaa

SEQ ID NO: 1531159 - DNA, 16 bp, Homo sapiens
taatgtatgttaccaa

SEQ ID NO: 1531160 - DNA, 14 bp, Homo sapiens
taatgtattcatat

SEQ ID NO: 1531161 - DNA, 15 bp, Homo sapiens
taatgtattttcttt

SEQ ID NO: 1531162 - DNA, 21 bp, Homo sapiens
taatgtcaatgttaatcagcc

SEQ ID NO: 1531163 - DNA, 21 bp, Homo sapiens
taatgtcaccaccttcccagc

SEQ ID NO: 1531164 - DNA, 13 bp, Homo sapiens
taatgtcattgct

SEQ ID NO: 1531165 - DNA, 17 bp, Homo sapiens
taatgtcattgctaaaa

SEQ ID NO: 1531166 - DNA, 19 bp, Homo sapiens
taatgtctctgtgagactc

SEQ ID NO: 1531167 - DNA, 17 bp, Homo sapiens
taatgtctgtttattaa

SEQ ID NO: 1531168 - DNA, 16 bp, Homo sapiens
taatgtgaagacattt

SEQ ID NO: 1531169 - DNA, 17 bp, Homo sapiens
taatgtggaataggata

SEQ ID NO: 1531170 - DNA, 13 bp, Homo sapiens
taatgttgataat

SEQ ID NO: 1531171 - DNA, 21 bp, Homo sapiens
taatgttgtgaataattacag

SEQ ID NO: 1531172 - DNA, 15 bp, Homo sapiens
taatgtttattaaat

SEQ ID NO: 1531173 - DNA, 22 bp, Homo sapiens
taatgtttattaaatgcttcat

SEQ ID NO: 1531174 - DNA, 18 bp, Homo sapiens
taatgtttccctcaagaa

SEQ ID NO: 1531175 - DNA, 19 bp, Homo sapiens
taatgtttcttaaatggaa

SEQ ID NO: 1531176 - DNA, 12 bp, Homo sapiens
taatgttttgta

SEQ ID NO: 1531177 - DNA, 19 bp, Homo sapiens
gtatatggtatatatacat

SEQ ID NO: 1531178 - DNA, 16 bp, Homo sapiens
gtatatggtatttatt

SEQ ID NO: 1531179 - DNA, 15 bp, Homo sapiens
gtatatggtggtaat

SEQ ID NO: 1531180 - DNA, 14 bp, Homo sapiens
gtatatgtatatat

SEQ ID NO: 1531181 - DNA, 12 bp, Homo sapiens
gtatatgtatta

SEQ ID NO: 1531182 - DNA, 12 bp, Homo sapiens
gtatatgtattc

SEQ ID NO: 1531183 - DNA, 15 bp, Homo sapiens
gtatatgtattccct

SEQ ID NO: 1531184 - DNA, 20 bp, Homo sapiens
gtatatgtattcccttgtat

SEQ ID NO: 1531185 - DNA, 13 bp, Homo sapiens
gtatatgtgcagt

SEQ ID NO: 1531186 - DNA, 13 bp, Homo sapiens
gtatatgttgtaa

SEQ ID NO: 1531187 - DNA, 13 bp, Homo sapiens
gtatattaacaaa

SEQ ID NO: 1531188 - DNA, 15 bp, Homo sapiens
gtatattcatatatt

SEQ ID NO: 1531189 - DNA, 22 bp, Homo sapiens
gtatattgtaggaatcctttga

SEQ ID NO: 1531190 - DNA, 20 bp, Homo sapiens
gtatattgtggatgtgttca

SEQ ID NO: 1531191 - DNA, 14 bp, Homo sapiens
gtatatttgtacaa

SEQ ID NO: 1531192 - DNA, 21 bp, Homo sapiens
gtatattttgggaatcttttc

SEQ ID NO: 1531193 - DNA, 19 bp, Homo sapiens
gtatcaataccaaatagct

SEQ ID NO: 1531194 - DNA, 13 bp, Homo sapiens
gtatcacagtgtt

SEQ ID NO: 1531195 - DNA, 18 bp, Homo sapiens
gtatcaccatacccagct

SEQ ID NO: 1531196 - DNA, 16 bp, Homo sapiens
gtatcacgatttgcag

SEQ ID NO: 1531197 - DNA, 21 bp, Homo sapiens
gtatcaggaaatatatatgtg

SEQ ID NO: 1531198 - DNA, 17 bp, Homo sapiens
gtatcaggacgagaatg

SEQ ID NO: 1531199 - DNA, 17 bp, Homo sapiens
gtatcagttgcaataat

SEQ ID NO: 1531200 - DNA, 19 bp, Homo sapiens
gtatcataaaaataaaatc

SEQ ID NO: 1531201 - DNA, 12 bp, Homo sapiens
gtatcatagaaa

SEQ ID NO: 1531202 - DNA, 20 bp, Homo sapiens
gtatcattacaattttctgt

SEQ ID NO: 1531203 - DNA, 21 bp, Homo sapiens
gtatcattacaattttctgta

SEQ ID NO: 1531204 - DNA, 16 bp, Homo sapiens
gtatcattcaactctc

SEQ ID NO: 1531205 - DNA, 14 bp, Homo sapiens
gtatccactttgca

SEQ ID NO: 1531206 - DNA, 20 bp, Homo sapiens
gtatcccaaatctgtcagca

SEQ ID NO: 1531207 - DNA, 17 bp, Homo sapiens
gtatccccccatcttgc

SEQ ID NO: 1531208 - DNA, 18 bp, Homo sapiens
gtatccccccatcttgct

SEQ ID NO: 1531209 - DNA, 14 bp, Homo sapiens
gtatcccctgcctc

SEQ ID NO: 1531210 - DNA, 16 bp, Homo sapiens
gtatcccctgcctcct

SEQ ID NO: 1531211 - DNA, 19 bp, Homo sapiens
gtatcccctgcctcctgcc

SEQ ID NO: 1531212 - DNA, 11 bp, Homo sapiens
gtatcctaaac

SEQ ID NO: 1531213 - DNA, 13 bp, Homo sapiens
gtatcctaaactt

SEQ ID NO: 1531214 - DNA, 22 bp, Homo sapiens
gtatcctaaactttagacttcc

SEQ ID NO: 1531215 - DNA, 17 bp, Homo sapiens
gtatcctccctggcaga

SEQ ID NO: 1531216 - DNA, 19 bp, Homo sapiens
gtatcctccctggcagaca

SEQ ID NO: 1531217 - DNA, 16 bp, Homo sapiens
gtatctaaaaaataac

SEQ ID NO: 1531218 - DNA, 17 bp, Homo sapiens
gtatctatttgtacaat

SEQ ID NO: 1531219 - DNA, 18 bp, Homo sapiens
gtatctatttgtacaatt

SEQ ID NO: 1531220 - DNA, 22 bp, Homo sapiens
gtatctcgtaatagcttctgtg

SEQ ID NO: 1531221 - DNA, 19 bp, Homo sapiens
gtatctgctgcctctgaaa

SEQ ID NO: 1531222 - DNA, 21 bp, Homo sapiens
gtatctgctgcctctgaaaat

SEQ ID NO: 1531223 - DNA, 18 bp, Homo sapiens
gtatctgggtaagaagaa

SEQ ID NO: 1531224 - DNA, 19 bp, Homo sapiens
gtatctgggtaagaagaaa

SEQ ID NO: 1531225 - DNA, 16 bp, Homo sapiens
gtatcttgaaatcctg

SEQ ID NO: 1531226 - DNA, 22 bp, Homo sapiens
gtatcttgggtgtattctctgt

SEQ ID NO: 1531227 - DNA, 23 bp, Homo sapiens
gtatcttgggtgtattctctgta

SEQ ID NO: 1531228 - DNA, 19 bp, Homo sapiens
gtatctttattaaaacaaa

SEQ ID NO: 1531229 - DNA, 16 bp, Homo sapiens
gtatcttttttcaaaa

SEQ ID NO: 1531230 - DNA, 13 bp, Homo sapiens
gtatgaaattata

SEQ ID NO: 1531231 - DNA, 23 bp, Homo sapiens
gtatgaaattatataagtattct

SEQ ID NO: 1531232 - DNA, 19 bp, Homo sapiens
gtatgaataatgaaaataa

SEQ ID NO: 1531233 - DNA, 16 bp, Homo sapiens
gtatgaatctatgcca

SEQ ID NO: 1531234 - DNA, 16 bp, Homo sapiens
taacttactgtatatg

SEQ ID NO: 1531235 - DNA, 15 bp, Homo sapiens
taacttagttttgca

SEQ ID NO: 1531236 - DNA, 16 bp, Homo sapiens
taacttagttttgcat

SEQ ID NO: 1531237 - DNA, 17 bp, Homo sapiens
taacttagttttgcata

SEQ ID NO: 1531238 - DNA, 14 bp, Homo sapiens
taacttatattgaa

SEQ ID NO: 1531239 - DNA, 12 bp, Homo sapiens
taacttattcca

SEQ ID NO: 1531240 - DNA, 16 bp, Homo sapiens
taacttatttagagat

SEQ ID NO: 1531241 - DNA, 14 bp, Homo sapiens
taacttcatagaaa

SEQ ID NO: 1531242 - DNA, 12 bp, Homo sapiens
taacttcctgct

SEQ ID NO: 1531243 - DNA, 18 bp, Homo sapiens
taacttcctgctgcaccc

SEQ ID NO: 1531244 - DNA, 18 bp, Homo sapiens
taacttctatattttaat

SEQ ID NO: 1531245 - DNA, 22 bp, Homo sapiens
taacttctatattttaatagaa

SEQ ID NO: 1531246 - DNA, 12 bp, Homo sapiens
taacttcttgct

SEQ ID NO: 1531247 - DNA, 19 bp, Homo sapiens
taacttcttgcttctttct

SEQ ID NO: 1531248 - DNA, 21 bp, Homo sapiens
taacttgatatagaaagctgt

SEQ ID NO: 1531249 - DNA, 20 bp, Homo sapiens
taacttgctgaatttcaggc

SEQ ID NO: 1531250 - DNA, 16 bp, Homo sapiens
taacttggagccccag

SEQ ID NO: 1531251 - DNA, 23 bp, Homo sapiens
taacttggatgagttttgggaag

SEQ ID NO: 1531252 - DNA, 12 bp, Homo sapiens
taacttgggagt

SEQ ID NO: 1531253 - DNA, 13 bp, Homo sapiens
taacttggggagg

SEQ ID NO: 1531254 - DNA, 15 bp, Homo sapiens
taacttgtatattcc

SEQ ID NO: 1531255 - DNA, 16 bp, Homo sapiens
taacttgtatattcca

SEQ ID NO: 1531256 - DNA, 19 bp, Homo sapiens
taacttgtcctatgtcaat

SEQ ID NO: 1531257 - DNA, 17 bp, Homo sapiens
taactttatcacattat

SEQ ID NO: 1531258 - DNA, 16 bp, Homo sapiens
taactttatgtgtaaa

SEQ ID NO: 1531259 - DNA, 15 bp, Homo sapiens
taactttcagaggca

SEQ ID NO: 1531260 - DNA, 19 bp, Homo sapiens
taactttcatgctacagaa

SEQ ID NO: 1531261 - DNA, 10 bp, Homo sapiens
taactttccc

SEQ ID NO: 1531262 - DNA, 14 bp, Homo sapiens
taacttttaaatgt

SEQ ID NO: 1531263 - DNA, 13 bp, Homo sapiens
taacttttgtaag

SEQ ID NO: 1531264 - DNA, 16 bp, Homo sapiens
taacttttgtgaatta

SEQ ID NO: 1531265 - DNA, 23 bp, Homo sapiens
taacttttttgtggcaattagtg

SEQ ID NO: 1531266 - DNA, 17 bp, Homo sapiens
taacttttttgtgtatg

SEQ ID NO: 1531267 - DNA, 23 bp, Homo sapiens
taactttttttaggggatttttt

SEQ ID NO: 1531268 - DNA, 17 bp, Homo sapiens
taagaaaaaaaatgtac

SEQ ID NO: 1531269 - DNA, 13 bp, Homo sapiens
taagaaaaacatg

SEQ ID NO: 1531270 - DNA, 18 bp, Homo sapiens
taagaaaaacatgtcatg

SEQ ID NO: 1531271 - DNA, 19 bp, Homo sapiens
taagaaaaacatgtcatgt

SEQ ID NO: 1531272 - DNA, 13 bp, Homo sapiens
taagaaaaacttt

SEQ ID NO: 1531273 - DNA, 16 bp, Homo sapiens
taagaaaaatcatgtt

SEQ ID NO: 1531274 - DNA, 20 bp, Homo sapiens
taagaaaacatttcttctcc

SEQ ID NO: 1531275 - DNA, 18 bp, Homo sapiens
taagaaaatacaataaac

SEQ ID NO: 1531276 - DNA, 14 bp, Homo sapiens
taagaaaatgttac

SEQ ID NO: 1531277 - DNA, 21 bp, Homo sapiens
taagaaacacagggttttgta

SEQ ID NO: 1531278 - DNA, 22 bp, Homo sapiens
taagaaacacagggttttgtat

SEQ ID NO: 1531279 - DNA, 23 bp, Homo sapiens
taagaaacacagggttttgtatt

SEQ ID NO: 1531280 - DNA, 19 bp, Homo sapiens
taagaaaccttgctctcct

SEQ ID NO: 1531281 - DNA, 15 bp, Homo sapiens
taagaaaggaagcat

SEQ ID NO: 1531282 - DNA, 22 bp, Homo sapiens
taagaaagtgaagcaaatcaga

SEQ ID NO: 1531283 - DNA, 16 bp, Homo sapiens
taagaaatactcatgt

SEQ ID NO: 1531284 - DNA, 19 bp, Homo sapiens
taagaaatcaaagagagaa

SEQ ID NO: 1531285 - DNA, 15 bp, Homo sapiens
taagaaatctggccc

SEQ ID NO: 1531286 - DNA, 21 bp, Homo sapiens
taagaaatctggcccagggtg

SEQ ID NO: 1531287 - DNA, 16 bp, Homo sapiens
taagaacaactacctg

SEQ ID NO: 1531288 - DNA, 12 bp, Homo sapiens
taagaacagatc

SEQ ID NO: 1531289 - DNA, 14 bp, Homo sapiens
taagaacctggaac

SEQ ID NO: 1531290 - DNA, 15 bp, Homo sapiens
taagaacgaggattt

SEQ ID NO: 1531291 - DNA, 13 bp, Homo sapiens
taagaactgtaca

SEQ ID NO: 1531292 - DNA, 21 bp, Homo sapiens
taagaagaaaattgctgtgcc

SEQ ID NO: 1531293 - DNA, 14 bp, Homo sapiens
taagaagaaagcaa

SEQ ID NO: 1531294 - DNA, 17 bp, Homo sapiens
taagaagaagttcatgt

SEQ ID NO: 1531295 - DNA, 22 bp, Homo sapiens
taagaagaagttcatgtccaaa

SEQ ID NO: 1531296 - DNA, 12 bp, Homo sapiens
taagaagacatt

SEQ ID NO: 1531297 - DNA, 19 bp, Homo sapiens
gggcctggcctgagctggg

SEQ ID NO: 1531298 - DNA, 17 bp, Homo sapiens
gggcctggcttgctcca

SEQ ID NO: 1531299 - DNA, 19 bp, Homo sapiens
gggcctggcttgctccagg

SEQ ID NO: 1531300 - DNA, 21 bp, Homo sapiens
gggcctgggacttccatgcct

SEQ ID NO: 1531301 - DNA, 22 bp, Homo sapiens
gggcctgggagggttcccctgg

SEQ ID NO: 1531302 - DNA, 14 bp, Homo sapiens
gggcctgggcctca

SEQ ID NO: 1531303 - DNA, 13 bp, Homo sapiens
gggcctggggctc

SEQ ID NO: 1531304 - DNA, 16 bp, Homo sapiens
gggcctgtcccccaag

SEQ ID NO: 1531305 - DNA, 13 bp, Homo sapiens
gggcgacaaaaac

SEQ ID NO: 1531306 - DNA, 20 bp, Homo sapiens
gggcgactggggagtcctca

SEQ ID NO: 1531307 - DNA, 14 bp, Homo sapiens
gggcgagcccctcc

SEQ ID NO: 1531308 - DNA, 15 bp, Homo sapiens
gggcgagcccctcct

SEQ ID NO: 1531309 - DNA, 18 bp, Homo sapiens
gggcgagtcactgcctct

SEQ ID NO: 1531310 - DNA, 16 bp, Homo sapiens
gggcgcaaaggtgcct

SEQ ID NO: 1531311 - DNA, 12 bp, Homo sapiens
gggcgccctctc

SEQ ID NO: 1531312 - DNA, 13 bp, Homo sapiens
gggcgctcagacg

SEQ ID NO: 1531313 - DNA, 20 bp, Homo sapiens
gggcgctcaggacccaggcc

SEQ ID NO: 1531314 - DNA, 22 bp, Homo sapiens
gggcgctctccctaccttgcct

SEQ ID NO: 1531315 - DNA, 21 bp, Homo sapiens
gggcgctgcagcctcccttcc

SEQ ID NO: 1531316 - DNA, 12 bp, Homo sapiens
gggcgctggccc

SEQ ID NO: 1531317 - DNA, 16 bp, Homo sapiens
gggcgctggcccagcc

SEQ ID NO: 1531318 - DNA, 18 bp, Homo sapiens
gggcggaagagttacaat

SEQ ID NO: 1531319 - DNA, 13 bp, Homo sapiens
gggcggccaggca

SEQ ID NO: 1531320 - DNA, 14 bp, Homo sapiens
gggcggccaggcaa

SEQ ID NO: 1531321 - DNA, 15 bp, Homo sapiens
gggcggccaggcaac

SEQ ID NO: 1531322 - DNA, 16 bp, Homo sapiens
gggcggggcaggaatg

SEQ ID NO: 1531323 - DNA, 22 bp, Homo sapiens
gggcgggtacagcgcggaggag

SEQ ID NO: 1531324 - DNA, 16 bp, Homo sapiens
gggcgtgactcaccca

SEQ ID NO: 1531325 - DNA, 18 bp, Homo sapiens
gggcgttgggagcctagc

SEQ ID NO: 1531326 - DNA, 20 bp, Homo sapiens
gggctaagagctagcgctgc

SEQ ID NO: 1531327 - DNA, 23 bp, Homo sapiens
gggctaccctaaagggagaagga

SEQ ID NO: 1531328 - DNA, 15 bp, Homo sapiens
gggctactggcagct

SEQ ID NO: 1531329 - DNA, 16 bp, Homo sapiens
gggctactggcagctc

SEQ ID NO: 1531330 - DNA, 17 bp, Homo sapiens
gggctagtgtgagtggc

SEQ ID NO: 1531331 - DNA, 15 bp, Homo sapiens
gggctatggcaaggg

SEQ ID NO: 1531332 - DNA, 16 bp, Homo sapiens
gggctatggcaagggg

SEQ ID NO: 1531333 - DNA, 12 bp, Homo sapiens
gggctatttgtg

SEQ ID NO: 1531334 - DNA, 13 bp, Homo sapiens
gggctcaaagccc

SEQ ID NO: 1531335 - DNA, 21 bp, Homo sapiens
gggctcaaatgatcctcccac

SEQ ID NO: 1531336 - DNA, 19 bp, Homo sapiens
gggctcagccacagcctga

SEQ ID NO: 1531337 - DNA, 16 bp, Homo sapiens
gggctcagcctggtgg

SEQ ID NO: 1531338 - DNA, 19 bp, Homo sapiens
gggctcagggttggccatt

SEQ ID NO: 1531339 - DNA, 19 bp, Homo sapiens
gggctccacacagcagtgt

SEQ ID NO: 1531340 - DNA, 21 bp, Homo sapiens
gggctccagcatccagcctgt

SEQ ID NO: 1531341 - DNA, 23 bp, Homo sapiens
gggctccagcatccagcctgtgt

SEQ ID NO: 1531342 - DNA, 13 bp, Homo sapiens
gggctccagccat

SEQ ID NO: 1531343 - DNA, 22 bp, Homo sapiens
gggctcccaggggtctccctgg

SEQ ID NO: 1531344 - DNA, 15 bp, Homo sapiens
gggctcctggctgcc

SEQ ID NO: 1531345 - DNA, 16 bp, Homo sapiens
gggctcctggctgcca

SEQ ID NO: 1531346 - DNA, 17 bp, Homo sapiens
gggctcctggctgccag

SEQ ID NO: 1531347 - DNA, 14 bp, Homo sapiens
gggctccttcccct

SEQ ID NO: 1531348 - DNA, 21 bp, Homo sapiens
gggctcctttctccagccagc

SEQ ID NO: 1531349 - DNA, 20 bp, Homo sapiens
gggctcgccatgccgggggt

SEQ ID NO: 1531350 - DNA, 16 bp, Homo sapiens
gggctctccaaagggg

SEQ ID NO: 1531351 - DNA, 16 bp, Homo sapiens
gggctctgcaggccac

SEQ ID NO: 1531352 - DNA, 15 bp, Homo sapiens
gggctctgccaccct

SEQ ID NO: 1531353 - DNA, 20 bp, Homo sapiens
gggctctgccccagctctgg

SEQ ID NO: 1531354 - DNA, 20 bp, Homo sapiens
gggctctgccccaggcccta

SEQ ID NO: 1531355 - DNA, 12 bp, Homo sapiens
gggctctgcctt

SEQ ID NO: 1531356 - DNA, 23 bp, Homo sapiens
gggctctgccttctcaggccccg

SEQ ID NO: 1531357 - DNA, 19 bp, Homo sapiens
gggctctgcttcctcagcc

SEQ ID NO: 1531358 - DNA, 17 bp, Homo sapiens
gggctctggccaccctg

SEQ ID NO: 1531359 - DNA, 19 bp, Homo sapiens
gggctctggccaccctggc

SEQ ID NO: 1531360 - DNA, 16 bp, Homo sapiens
gggctctgtgcagtca

SEQ ID NO: 1531361 - DNA, 16 bp, Homo sapiens
gggctctgttacacta

SEQ ID NO: 1531362 - DNA, 22 bp, Homo sapiens
gggctcttctcaggggctctag

SEQ ID NO: 1531363 - DNA, 18 bp, Homo sapiens
gggctgaacggggagaaa

SEQ ID NO: 1531364 - DNA, 17 bp, Homo sapiens
gggctgaatcttctgga

SEQ ID NO: 1531365 - DNA, 23 bp, Homo sapiens
gggctgaatgtatgtcagtgcta

SEQ ID NO: 1531366 - DNA, 15 bp, Homo sapiens
gggctgacacctacc

SEQ ID NO: 1531367 - DNA, 21 bp, Homo sapiens
gggctgacacctaccatgctg

SEQ ID NO: 1531368 - DNA, 15 bp, Homo sapiens
gggctgagcccctac

SEQ ID NO: 1531369 - DNA, 13 bp, Homo sapiens
gggctgagccctg

SEQ ID NO: 1531370 - DNA, 18 bp, Homo sapiens
gggctgaggacgagaccc

SEQ ID NO: 1531371 - DNA, 16 bp, Homo sapiens
gggctgagggcctgct

SEQ ID NO: 1531372 - DNA, 19 bp, Homo sapiens
gggctgagtggggagcagt

SEQ ID NO: 1531373 - DNA, 14 bp, Homo sapiens
gggctgatctcagg

SEQ ID NO: 1531374 - DNA, 16 bp, Homo sapiens
gggctgatctcaggga

SEQ ID NO: 1531375 - DNA, 20 bp, Homo sapiens
gggctgatgaagaagggggt

SEQ ID NO: 1531376 - DNA, 22 bp, Homo sapiens
gggctgcagcatgttgctgagg

SEQ ID NO: 1531377 - DNA, 11 bp, Homo sapiens
gggctgcatga

SEQ ID NO: 1531378 - DNA, 20 bp, Homo sapiens
gggctgcccctaatctctgt

SEQ ID NO: 1531379 - DNA, 13 bp, Homo sapiens
gggctgccctgcc

SEQ ID NO: 1531380 - DNA, 15 bp, Homo sapiens
gggctgccctggtgc

SEQ ID NO: 1531381 - DNA, 20 bp, Homo sapiens
gggctgcccttgttgcctgc

SEQ ID NO: 1531382 - DNA, 20 bp, Homo sapiens
gggctgccggatctgggctg

SEQ ID NO: 1531383 - DNA, 15 bp, Homo sapiens
gggctgcctgggctg

SEQ ID NO: 1531384 - DNA, 15 bp, Homo sapiens
gggctgctcccctaa

SEQ ID NO: 1531385 - DNA, 11 bp, Homo sapiens
gggctgctcct

SEQ ID NO: 1531386 - DNA, 16 bp, Homo sapiens
gggctgctggggcatg

SEQ ID NO: 1531387 - DNA, 18 bp, Homo sapiens
gggctgcttcctcctgga

SEQ ID NO: 1531388 - DNA, 15 bp, Homo sapiens
gggctggactgaggc

SEQ ID NO: 1531389 - DNA, 22 bp, Homo sapiens
gggctggagaaagagctgcctg

SEQ ID NO: 1531390 - DNA, 15 bp, Homo sapiens
gggctggaggcccag

SEQ ID NO: 1531391 - DNA, 16 bp, Homo sapiens
gggctggaggcccagg

SEQ ID NO: 1531392 - DNA, 15 bp, Homo sapiens
gggctggagggaagg

SEQ ID NO: 1531393 - DNA, 17 bp, Homo sapiens
gggctggagtgcgctct

SEQ ID NO: 1531394 - DNA, 23 bp, Homo sapiens
gggctggagtgcgctcttggtcc

SEQ ID NO: 1531395 - DNA, 16 bp, Homo sapiens
gggctggctcctctgc

SEQ ID NO: 1531396 - DNA, 11 bp, Homo sapiens
gggctggctgg

SEQ ID NO: 1531397 - DNA, 12 bp, Homo sapiens
gggctgggccag

SEQ ID NO: 1531398 - DNA, 16 bp, Homo sapiens
gggctgggccaggtct

SEQ ID NO: 1531399 - DNA, 18 bp, Homo sapiens
gggctgggccctctgtcc

SEQ ID NO: 1531400 - DNA, 12 bp, Homo sapiens
gggctggggagg

SEQ ID NO: 1531401 - DNA, 15 bp, Homo sapiens
gggctggggaggagg

SEQ ID NO: 1531402 - DNA, 15 bp, Homo sapiens
gggctggtgccagcc

SEQ ID NO: 1531403 - DNA, 21 bp, Homo sapiens
gggctgtatttatctctgagg

SEQ ID NO: 1531404 - DNA, 15 bp, Homo sapiens
gggctgtcctgctgc

SEQ ID NO: 1531405 - DNA, 12 bp, Homo sapiens
gggctgtgccaa

SEQ ID NO: 1531406 - DNA, 19 bp, Homo sapiens
gggtccaggaaggcagctg

SEQ ID NO: 1531407 - DNA, 12 bp, Homo sapiens
gggtccagggcc

SEQ ID NO: 1531408 - DNA, 14 bp, Homo sapiens
gggtcccagtggga

SEQ ID NO: 1531409 - DNA, 17 bp, Homo sapiens
gggtcccagtgggaggg

SEQ ID NO: 1531410 - DNA, 18 bp, Homo sapiens
gggtccccagctccccag

SEQ ID NO: 1531411 - DNA, 13 bp, Homo sapiens
gggtcccctctgt

SEQ ID NO: 1531412 - DNA, 16 bp, Homo sapiens
gggtcccggccgcgcc

SEQ ID NO: 1531413 - DNA, 18 bp, Homo sapiens
gggtccctaattctcttc

SEQ ID NO: 1531414 - DNA, 17 bp, Homo sapiens
gggtccctagcagccca

SEQ ID NO: 1531415 - DNA, 12 bp, Homo sapiens
gggtccctcctc

SEQ ID NO: 1531416 - DNA, 20 bp, Homo sapiens
gggtcccttgaaggaagagg

SEQ ID NO: 1531417 - DNA, 16 bp, Homo sapiens
gggtccgcaccagctg

SEQ ID NO: 1531418 - DNA, 17 bp, Homo sapiens
gggtccgcaccagctgc

SEQ ID NO: 1531419 - DNA, 18 bp, Homo sapiens
gggtccgcaccagctgct

SEQ ID NO: 1531420 - DNA, 22 bp, Homo sapiens
gggtccgcaccagctgctctgc

SEQ ID NO: 1531421 - DNA, 13 bp, Homo sapiens
gggcagcaaggct

SEQ ID NO: 1531422 - DNA, 17 bp, Homo sapiens
cactgtcccttgcctca

SEQ ID NO: 1531423 - DNA, 12 bp, Homo sapiens
cactgtcctggg

SEQ ID NO: 1531424 - DNA, 13 bp, Homo sapiens
cactgtgaaggac

SEQ ID NO: 1531425 - DNA, 15 bp, Homo sapiens
gggcccagaccctgg

SEQ ID NO: 1531426 - DNA, 19 bp, Homo sapiens
gggcccagaccctgggcaa

SEQ ID NO: 1531427 - DNA, 12 bp, Homo sapiens
gggcccagagcc

SEQ ID NO: 1531428 - DNA, 15 bp, Homo sapiens
gggcccagagcccag

SEQ ID NO: 1531429 - DNA, 20 bp, Homo sapiens
gggcccagagcccagctcca

SEQ ID NO: 1531430 - DNA, 12 bp, Homo sapiens
gggcccagagga

SEQ ID NO: 1531431 - DNA, 14 bp, Homo sapiens
gggcccagaggagc

SEQ ID NO: 1531432 - DNA, 13 bp, Homo sapiens
gggcccagatctg

SEQ ID NO: 1531433 - DNA, 21 bp, Homo sapiens
gggcccagcacatggccatag

SEQ ID NO: 1531434 - DNA, 16 bp, Homo sapiens
gggcccagcccagagc

SEQ ID NO: 1531435 - DNA, 17 bp, Homo sapiens
gggcccagcccagagcc

SEQ ID NO: 1531436 - DNA, 19 bp, Homo sapiens
gggcccagcgctctcctgg

SEQ ID NO: 1531437 - DNA, 20 bp, Homo sapiens
gggcccagcgctctcctgga

SEQ ID NO: 1531438 - DNA, 13 bp, Homo sapiens
gggcccagctgag

SEQ ID NO: 1531439 - DNA, 21 bp, Homo sapiens
gggcccagctgggctctgcca

SEQ ID NO: 1531440 - DNA, 16 bp, Homo sapiens
gggcccagctgtagcc

SEQ ID NO: 1531441 - DNA, 22 bp, Homo sapiens
gggcccagctgtagccatggct

SEQ ID NO: 1531442 - DNA, 17 bp, Homo sapiens
gggcccaggaccagctg

SEQ ID NO: 1531443 - DNA, 14 bp, Homo sapiens
gggcccaggcaggt

SEQ ID NO: 1531444 - DNA, 13 bp, Homo sapiens
gggcccagtgcat

SEQ ID NO: 1531445 - DNA, 13 bp, Homo sapiens
gggcccatcaggc

SEQ ID NO: 1531446 - DNA, 15 bp, Homo sapiens
gggccccaccaccta

SEQ ID NO: 1531447 - DNA, 13 bp, Homo sapiens
gggccccacctac

SEQ ID NO: 1531448 - DNA, 18 bp, Homo sapiens
gggccccagatctgcctg

SEQ ID NO: 1531449 - DNA, 20 bp, Homo sapiens
gggccccagatctgcctggg

SEQ ID NO: 1531450 - DNA, 12 bp, Homo sapiens
gggccccatgct

SEQ ID NO: 1531451 - DNA, 12 bp, Homo sapiens
gggcccccacag

SEQ ID NO: 1531452 - DNA, 14 bp, Homo sapiens
gggccccccaactg

SEQ ID NO: 1531453 - DNA, 21 bp, Homo sapiens
gggcccccggccacgctccct

SEQ ID NO: 1531454 - DNA, 17 bp, Homo sapiens
gggccccgccagggctg

SEQ ID NO: 1531455 - DNA, 18 bp, Homo sapiens
gggccccgccagggctgg

SEQ ID NO: 1531456 - DNA, 20 bp, Homo sapiens
gggccccgccagggctgggg

SEQ ID NO: 1531457 - DNA, 17 bp, Homo sapiens
gggccccgggctggaga

SEQ ID NO: 1531458 - DNA, 18 bp, Homo sapiens
gggccccgggctggagaa

SEQ ID NO: 1531459 - DNA, 14 bp, Homo sapiens
gggccccggggctg

SEQ ID NO: 1531460 - DNA, 17 bp, Homo sapiens
gggccccggggctggca

SEQ ID NO: 1531461 - DNA, 19 bp, Homo sapiens
gggccccggggctggcaag

SEQ ID NO: 1531462 - DNA, 17 bp, Homo sapiens
gggcccctcaccctgcc

SEQ ID NO: 1531463 - DNA, 19 bp, Homo sapiens
gggcccctcaccctgcctt

SEQ ID NO: 1531464 - DNA, 17 bp, Homo sapiens
gggcccctccctctgcc

SEQ ID NO: 1531465 - DNA, 17 bp, Homo sapiens
gggcccctctgcccagc

SEQ ID NO: 1531466 - DNA, 23 bp, Homo sapiens
gggcccctctgcccagcttgggc

SEQ ID NO: 1531467 - DNA, 15 bp, Homo sapiens
gggcccctggcactc

SEQ ID NO: 1531468 - DNA, 18 bp, Homo sapiens
gggcccctggcccagagt

SEQ ID NO: 1531469 - DNA, 14 bp, Homo sapiens
gggcccctgggctt

SEQ ID NO: 1531470 - DNA, 18 bp, Homo sapiens
gggcccgaacagggactt

SEQ ID NO: 1531471 - DNA, 21 bp, Homo sapiens
gggcccgcagtgctgggacca

SEQ ID NO: 1531472 - DNA, 22 bp, Homo sapiens
gggcccgcagtgctgggaccag

SEQ ID NO: 1531473 - DNA, 16 bp, Homo sapiens
gggcccggccacaccc

SEQ ID NO: 1531474 - DNA, 16 bp, Homo sapiens
gggccctctctctgcg

SEQ ID NO: 1531475 - DNA, 17 bp, Homo sapiens
gggccctctctctgggc

SEQ ID NO: 1531476 - DNA, 21 bp, Homo sapiens
gggccctctctctgggcccag

SEQ ID NO: 1531477 - DNA, 12 bp, Homo sapiens
gggccctgagct

SEQ ID NO: 1531478 - DNA, 13 bp, Homo sapiens
gggccctgagctc

SEQ ID NO: 1531479 - DNA, 12 bp, Homo sapiens
gggccctgcaca

SEQ ID NO: 1531480 - DNA, 19 bp, Homo sapiens
gggccctgcattggcctgg

SEQ ID NO: 1531481 - DNA, 13 bp, Homo sapiens
gggccctgcccca

SEQ ID NO: 1531482 - DNA, 19 bp, Homo sapiens
gggccctgccccaccccat

SEQ ID NO: 1531483 - DNA, 19 bp, Homo sapiens
gggccctgccctggcaggg

SEQ ID NO: 1531484 - DNA, 11 bp, Homo sapiens
gggccctgcta

SEQ ID NO: 1531485 - DNA, 14 bp, Homo sapiens
gggccctggccagg

SEQ ID NO: 1531486 - DNA, 20 bp, Homo sapiens
gggccctgtggagtccagct

SEQ ID NO: 1531487 - DNA, 13 bp, Homo sapiens
gggccgaaagaga

SEQ ID NO: 1531488 - DNA, 14 bp, Homo sapiens
gggccgactaagag

SEQ ID NO: 1531489 - DNA, 13 bp, Homo sapiens
gggccgaggccca

SEQ ID NO: 1531490 - DNA, 14 bp, Homo sapiens
gggccgaggcccag

SEQ ID NO: 1531491 - DNA, 20 bp, Homo sapiens
gggccgaggcccagcgggca

SEQ ID NO: 1531492 - DNA, 17 bp, Homo sapiens
gggccgccacggcctgg

SEQ ID NO: 1531493 - DNA, 16 bp, Homo sapiens
gggccgcccgctccct

SEQ ID NO: 1531494 - DNA, 14 bp, Homo sapiens
gggccgcggccgcc

SEQ ID NO: 1531495 - DNA, 16 bp, Homo sapiens
gggccgcggccgcccg

SEQ ID NO: 1531496 - DNA, 20 bp, Homo sapiens
gggccgcgtggtgccatccc

SEQ ID NO: 1531497 - DNA, 19 bp, Homo sapiens
gggccggccctgtgtgcag

SEQ ID NO: 1531498 - DNA, 14 bp, Homo sapiens
gggccgggcctggg

SEQ ID NO: 1531499 - DNA, 14 bp, Homo sapiens
gggccggggatgga

SEQ ID NO: 1531500 - DNA, 16 bp, Homo sapiens
gggccggggatggatc

SEQ ID NO: 1531501 - DNA, 15 bp, Homo sapiens
gggccgtaccccacc

SEQ ID NO: 1531502 - DNA, 12 bp, Homo sapiens
gggccgtgtccc

SEQ ID NO: 1531503 - DNA, 22 bp, Homo sapiens
gggcctagatccacacacagag

SEQ ID NO: 1531504 - DNA, 19 bp, Homo sapiens
gggcctcaaaggcccgctc

SEQ ID NO: 1531505 - DNA, 20 bp, Homo sapiens
gggcctcaaaggcccgctct

SEQ ID NO: 1531506 - DNA, 14 bp, Homo sapiens
gggcctcaggctct

SEQ ID NO: 1531507 - DNA, 15 bp, Homo sapiens
gggcctcaggctctg

SEQ ID NO: 1531508 - DNA, 18 bp, Homo sapiens
gggcctcaggctctgcac

SEQ ID NO: 1531509 - DNA, 21 bp, Homo sapiens
gggcctcagtgtgcccatctg

SEQ ID NO: 1531510 - DNA, 11 bp, Homo sapiens
gggcctccagg

SEQ ID NO: 1531511 - DNA, 23 bp, Homo sapiens
gggcctccatgccccagctctgg

SEQ ID NO: 1531512 - DNA, 23 bp, Homo sapiens
gggcctcccataattgctttgcc

SEQ ID NO: 1531513 - DNA, 13 bp, Homo sapiens
gggcctcccctgg

SEQ ID NO: 1531514 - DNA, 16 bp, Homo sapiens
gggcctcccctgggca

SEQ ID NO: 1531515 - DNA, 21 bp, Homo sapiens
gggcctcctctgtccagggcc

SEQ ID NO: 1531516 - DNA, 16 bp, Homo sapiens
gggcctccttgtccag

SEQ ID NO: 1531517 - DNA, 16 bp, Homo sapiens
gggcctcgggacctca

SEQ ID NO: 1531518 - DNA, 18 bp, Homo sapiens
gggcctctcctgccctct

SEQ ID NO: 1531519 - DNA, 16 bp, Homo sapiens
gggcctctgcctggga

SEQ ID NO: 1531520 - DNA, 21 bp, Homo sapiens
gggcctctgttcctttctctg

SEQ ID NO: 1531521 - DNA, 23 bp, Homo sapiens
gggcctctgttcctttctctggg

SEQ ID NO: 1531522 - DNA, 18 bp, Homo sapiens
gggcctgacaccccctcc

SEQ ID NO: 1531523 - DNA, 19 bp, Homo sapiens
gggcctgagggtccacctg

SEQ ID NO: 1531524 - DNA, 12 bp, Homo sapiens
gggcctgcaggt

SEQ ID NO: 1531525 - DNA, 23 bp, Homo sapiens
gggcctgcagtgattcagcaggc

SEQ ID NO: 1531526 - DNA, 18 bp, Homo sapiens
gggcctgcatggagaagg

SEQ ID NO: 1531527 - DNA, 15 bp, Homo sapiens
gggcctgcccaatgc

SEQ ID NO: 1531528 - DNA, 11 bp, Homo sapiens
gggcctgcccc

SEQ ID NO: 1531529 - DNA, 23 bp, Homo sapiens
gggcctgccctctgccccatcat

SEQ ID NO: 1531530 - DNA, 14 bp, Homo sapiens
gggcctgccgggct

SEQ ID NO: 1531531 - DNA, 18 bp, Homo sapiens
gggcctgctccagacctg

SEQ ID NO: 1531532 - DNA, 15 bp, Homo sapiens
gggcctgctggaggc

SEQ ID NO: 1531533 - DNA, 16 bp, Homo sapiens
gggcctggacaaggtc

SEQ ID NO: 1531534 - DNA, 14 bp, Homo sapiens
gggcctggacctgc

SEQ ID NO: 1531535 - DNA, 15 bp, Homo sapiens
gggcctggagcccca

SEQ ID NO: 1531536 - DNA, 10 bp, Homo sapiens
gggcctggca

SEQ ID NO: 1531537 - DNA, 21 bp, Homo sapiens
gggcctggccagtcctggtcc

SEQ ID NO: 1531538 - DNA, 18 bp, Homo sapiens
cacctggccgcctccagg

SEQ ID NO: 1531539 - DNA, 22 bp, Homo sapiens
cacctggccgcctccaggagcc

SEQ ID NO: 1531540 - DNA, 16 bp, Homo sapiens
cacctggcctgctggg

SEQ ID NO: 1531541 - DNA, 14 bp, Homo sapiens
cacctggcctgggc

SEQ ID NO: 1531542 - DNA, 19 bp, Homo sapiens
cacctggctgagcctggct

SEQ ID NO: 1531543 - DNA, 23 bp, Homo sapiens
cacctggctgaggttcctctgcc

SEQ ID NO: 1531544 - DNA, 20 bp, Homo sapiens
cacctgggattacaagcatg

SEQ ID NO: 1531545 - DNA, 16 bp, Homo sapiens
cacctgggcttaagaa

SEQ ID NO: 1531546 - DNA, 15 bp, Homo sapiens
cacctggtacctgga

SEQ ID NO: 1531547 - DNA, 16 bp, Homo sapiens
cacctggtacctggac

SEQ ID NO: 1531548 - DNA, 22 bp, Homo sapiens
cacctggtacctggacggtgcg

SEQ ID NO: 1531549 - DNA, 13 bp, Homo sapiens
cacctggtactga

SEQ ID NO: 1531550 - DNA, 20 bp, Homo sapiens
cacctggtgcgggcctggcc

SEQ ID NO: 1531551 - DNA, 21 bp, Homo sapiens
cacctggtgcgggcctggccc

SEQ ID NO: 1531552 - DNA, 22 bp, Homo sapiens
cacctggtgcgggcctggccct

SEQ ID NO: 1531553 - DNA, 23 bp, Homo sapiens
cacctggtggatacctggttgag

SEQ ID NO: 1531554 - DNA, 12 bp, Homo sapiens
cacctgtacatt

SEQ ID NO: 1531555 - DNA, 14 bp, Homo sapiens
cacctgtacattct

SEQ ID NO: 1531556 - DNA, 18 bp, Homo sapiens
cacctgtagcacttactg

SEQ ID NO: 1531557 - DNA, 20 bp, Homo sapiens
cacctgtagtcccagctact

SEQ ID NO: 1531558 - DNA, 22 bp, Homo sapiens
cacctgtccccaccctccactc

SEQ ID NO: 1531559 - DNA, 18 bp, Homo sapiens
cacctgtctcagcctccc

SEQ ID NO: 1531560 - DNA, 18 bp, Homo sapiens
cacctgtcttggcctccc

SEQ ID NO: 1531561 - DNA, 12 bp, Homo sapiens
cacctgtgacaa

SEQ ID NO: 1531562 - DNA, 12 bp, Homo sapiens
cacctgtgtcca

SEQ ID NO: 1531563 - DNA, 14 bp, Homo sapiens
cacctgtgtccaag

SEQ ID NO: 1531564 - DNA, 22 bp, Homo sapiens
cacctgttaaaatgtacactgg

SEQ ID NO: 1531565 - DNA, 19 bp, Homo sapiens
cacctgttcacagaaaaag

SEQ ID NO: 1531566 - DNA, 23 bp, Homo sapiens
cacctgttcacagaaaaagcatg

SEQ ID NO: 1531567 - DNA, 20 bp, Homo sapiens
cacctgtttttaagctgttt

SEQ ID NO: 1531568 - DNA, 13 bp, Homo sapiens
caccttagctggc

SEQ ID NO: 1531569 - DNA, 23 bp, Homo sapiens
caccttagggtggctttaattgt

SEQ ID NO: 1531570 - DNA, 22 bp, Homo sapiens
caccttatctatgatgtttctt

SEQ ID NO: 1531571 - DNA, 15 bp, Homo sapiens
caccttcaaaatgtt

SEQ ID NO: 1531572 - DNA, 19 bp, Homo sapiens
caccttcaattcctgggcc

SEQ ID NO: 1531573 - DNA, 16 bp, Homo sapiens
caccttcacctcggag

SEQ ID NO: 1531574 - DNA, 16 bp, Homo sapiens
caccttcatgattata

SEQ ID NO: 1531575 - DNA, 16 bp, Homo sapiens
caccttccagggccct

SEQ ID NO: 1531576 - DNA, 18 bp, Homo sapiens
caccttcccactttccca

SEQ ID NO: 1531577 - DNA, 15 bp, Homo sapiens
caccttcccagctct

SEQ ID NO: 1531578 - DNA, 17 bp, Homo sapiens
caccttctgagtattct

SEQ ID NO: 1531579 - DNA, 13 bp, Homo sapiens
caccttgccttgc

SEQ ID NO: 1531580 - DNA, 12 bp, Homo sapiens
caccttggaagg

SEQ ID NO: 1531581 - DNA, 13 bp, Homo sapiens
caccttggaaggg

SEQ ID NO: 1531582 - DNA, 17 bp, Homo sapiens
caccttggcaccagaca

SEQ ID NO: 1531583 - DNA, 13 bp, Homo sapiens
caccttggcccag

SEQ ID NO: 1531584 - DNA, 15 bp, Homo sapiens
caccttggcccagga

SEQ ID NO: 1531585 - DNA, 20 bp, Homo sapiens
caccttgggatgatgcctca

SEQ ID NO: 1531586 - DNA, 13 bp, Homo sapiens
caccttgtcatgt

SEQ ID NO: 1531587 - DNA, 13 bp, Homo sapiens
caccttgtctgct

SEQ ID NO: 1531588 - DNA, 22 bp, Homo sapiens
caccttgtctgctaaataaaca

SEQ ID NO: 1531589 - DNA, 13 bp, Homo sapiens
caccttgtgcctg

SEQ ID NO: 1531590 - DNA, 16 bp, Homo sapiens
caccttgtgcctgggg

SEQ ID NO: 1531591 - DNA, 21 bp, Homo sapiens
caccttgtgtctgtacacgtg

SEQ ID NO: 1531592 - DNA, 22 bp, Homo sapiens
cacctttactgtgcttattttt

SEQ ID NO: 1531593 - DNA, 19 bp, Homo sapiens
cacctttggaaagctctga

SEQ ID NO: 1531594 - DNA, 23 bp, Homo sapiens
cacctttggctggtagcagcagg

SEQ ID NO: 1531595 - DNA, 19 bp, Homo sapiens
cacctttgtaagacatttg

SEQ ID NO: 1531596 - DNA, 20 bp, Homo sapiens
cacctttgtaagacatttgt

SEQ ID NO: 1531597 - DNA, 20 bp, Homo sapiens
cacctttgttttttgttgga

SEQ ID NO: 1531598 - DNA, 15 bp, Homo sapiens
caccttttccccagg

SEQ ID NO: 1531599 - DNA, 20 bp, Homo sapiens
cacctttttaataaaaatac

SEQ ID NO: 1531600 - DNA, 17 bp, Homo sapiens
cacgaaatgttattttt

SEQ ID NO: 1531601 - DNA, 21 bp, Homo sapiens
cacgaaggtaaaaagtatttt

SEQ ID NO: 1531602 - DNA, 14 bp, Homo sapiens
cacgagcaaaccca

SEQ ID NO: 1531603 - DNA, 21 bp, Homo sapiens
cacgagcaaacccagaggtgg

SEQ ID NO: 1531604 - DNA, 22 bp, Homo sapiens
cacgagcaaacccagaggtgga

SEQ ID NO: 1531605 - DNA, 13 bp, Homo sapiens
cacgagcacaatg

SEQ ID NO: 1531606 - DNA, 17 bp, Homo sapiens
cacgagcaggctactgt

SEQ ID NO: 1531607 - DNA, 16 bp, Homo sapiens
cacgagccacaagctg

SEQ ID NO: 1531608 - DNA, 17 bp, Homo sapiens
cacgagccacaagctgc

SEQ ID NO: 1531609 - DNA, 21 bp, Homo sapiens
cacgagccacaagctgcactg

SEQ ID NO: 1531610 - DNA, 23 bp, Homo sapiens
cacgaggaatctgtgggtctggg

SEQ ID NO: 1531611 - DNA, 16 bp, Homo sapiens
cacgaggatggcctgg

SEQ ID NO: 1531612 - DNA, 18 bp, Homo sapiens
cacgagtcacctgcaagc

SEQ ID NO: 1531613 - DNA, 20 bp, Homo sapiens
cacgataaataatcggccca

SEQ ID NO: 1531614 - DNA, 15 bp, Homo sapiens
cacgatgcatttaat

SEQ ID NO: 1531615 - DNA, 17 bp, Homo sapiens
cacgatgcatttaataa

SEQ ID NO: 1531616 - DNA, 19 bp, Homo sapiens
cacgatgcatttaataaag

SEQ ID NO: 1531617 - DNA, 21 bp, Homo sapiens
cacgatgcatttaataaagat

SEQ ID NO: 1531618 - DNA, 22 bp, Homo sapiens
cacgatgcatttaataaagatg

SEQ ID NO: 1531619 - DNA, 18 bp, Homo sapiens
cacgatgtggccctggcc

SEQ ID NO: 1531620 - DNA, 21 bp, Homo sapiens
cacgatttgcaggattccctt

SEQ ID NO: 1531621 - DNA, 17 bp, Homo sapiens
cacgcaagggcatcagg

SEQ ID NO: 1531622 - DNA, 14 bp, Homo sapiens
cacgcaccactgct

SEQ ID NO: 1531623 - DNA, 18 bp, Homo sapiens
cacgcaccactgcttccc

SEQ ID NO: 1531624 - DNA, 22 bp, Homo sapiens
cacgcacgacgtcagcctctta

SEQ ID NO: 1531625 - DNA, 13 bp, Homo sapiens
cacgcactgggcc

SEQ ID NO: 1531626 - DNA, 15 bp, Homo sapiens
cacgcactgggccac

SEQ ID NO: 1531627 - DNA, 21 bp, Homo sapiens
cacgcactgggccacggagga

SEQ ID NO: 1531628 - DNA, 23 bp, Homo sapiens
cacgcactgggccacggaggagg

SEQ ID NO: 1531629 - DNA, 17 bp, Homo sapiens
cacgcacttgcctgttg

SEQ ID NO: 1531630 - DNA, 19 bp, Homo sapiens
cacgcacttgcctgttggc

SEQ ID NO: 1531631 - DNA, 13 bp, Homo sapiens
cacgcagccagga

SEQ ID NO: 1531632 - DNA, 18 bp, Homo sapiens
ggctcctggctgccaggc

SEQ ID NO: 1531633 - DNA, 20 bp, Homo sapiens
ggctcctggctgtgcccagc

SEQ ID NO: 1531634 - DNA, 15 bp, Homo sapiens
ggctcctgtggcagc

SEQ ID NO: 1531635 - DNA, 14 bp, Homo sapiens
ggctcctgttttgc

SEQ ID NO: 1531636 - DNA, 19 bp, Homo sapiens
ggctccttcccctgcacct

SEQ ID NO: 1531637 - DNA, 12 bp, Homo sapiens
ggctcctttctc

SEQ ID NO: 1531638 - DNA, 20 bp, Homo sapiens
ggctcgaatctctgtgcctt

SEQ ID NO: 1531639 - DNA, 19 bp, Homo sapiens
ggctcgcagggtgcaggag

SEQ ID NO: 1531640 - DNA, 16 bp, Homo sapiens
ggctcgccatgccggg

SEQ ID NO: 1531641 - DNA, 17 bp, Homo sapiens
ggctcgccgtgtctcag

SEQ ID NO: 1531642 - DNA, 22 bp, Homo sapiens
ggctcgccgtgtctcagcctct

SEQ ID NO: 1531643 - DNA, 15 bp, Homo sapiens
ggctcggacccaccc

SEQ ID NO: 1531644 - DNA, 19 bp, Homo sapiens
ggctcggacccaccccaac

SEQ ID NO: 1531645 - DNA, 23 bp, Homo sapiens
ggctcgtggactgagtgggaagc

SEQ ID NO: 1531646 - DNA, 17 bp, Homo sapiens
ggctctaccctgtctgt

SEQ ID NO: 1531647 - DNA, 11 bp, Homo sapiens
ggctctagatc

SEQ ID NO: 1531648 - DNA, 23 bp, Homo sapiens
ggctctattccaataaactatga

SEQ ID NO: 1531649 - DNA, 21 bp, Homo sapiens
ggctctattctctaaactggc

SEQ ID NO: 1531650 - DNA, 15 bp, Homo sapiens
ggctctcagaggaaa

SEQ ID NO: 1531651 - DNA, 22 bp, Homo sapiens
ggctctccaaaggggctgctgg

SEQ ID NO: 1531652 - DNA, 12 bp, Homo sapiens
tccatgaatgta

SEQ ID NO: 1531653 - DNA, 13 bp, Homo sapiens
tccatgaatgtat

SEQ ID NO: 1531654 - DNA, 15 bp, Homo sapiens
tccatgaatgtatca

SEQ ID NO: 1531655 - DNA, 15 bp, Homo sapiens
tccatgaatgttcct

SEQ ID NO: 1531656 - DNA, 20 bp, Homo sapiens
tccatgacctagttttccat

SEQ ID NO: 1531657 - DNA, 14 bp, Homo sapiens
tccatgactggctg

SEQ ID NO: 1531658 - DNA, 16 bp, Homo sapiens
tccatgagctgctcat

SEQ ID NO: 1531659 - DNA, 14 bp, Homo sapiens
tccatgcaactgga

SEQ ID NO: 1531660 - DNA, 16 bp, Homo sapiens
tccatgccatgaatga

SEQ ID NO: 1531661 - DNA, 17 bp, Homo sapiens
tccatgccccagctctg

SEQ ID NO: 1531662 - DNA, 18 bp, Homo sapiens
tccatgccccagctctgg

SEQ ID NO: 1531663 - DNA, 21 bp, Homo sapiens
tccatgcctgtagctttcctg

SEQ ID NO: 1531664 - DNA, 21 bp, Homo sapiens
tccatgcgtgtttctgactct

SEQ ID NO: 1531665 - DNA, 14 bp, Homo sapiens
tccatgctccaggg

SEQ ID NO: 1531666 - DNA, 17 bp, Homo sapiens
tccatgctccttgagag

SEQ ID NO: 1531667 - DNA, 16 bp, Homo sapiens
tccatggcaccagccc

SEQ ID NO: 1531668 - DNA, 14 bp, Homo sapiens
tccatggcagcagc

SEQ ID NO: 1531669 - DNA, 15 bp, Homo sapiens
tccatggcagcagcc

SEQ ID NO: 1531670 - DNA, 16 bp, Homo sapiens
tccatggcagcagcca

SEQ ID NO: 1531671 - DNA, 18 bp, Homo sapiens
tccatggcagcagccagg

SEQ ID NO: 1531672 - DNA, 21 bp, Homo sapiens
tccatggccaccccgtgccac

SEQ ID NO: 1531673 - DNA, 21 bp, Homo sapiens
tccatggctaagaccacagac

SEQ ID NO: 1531674 - DNA, 14 bp, Homo sapiens
tccatgggagccag

SEQ ID NO: 1531675 - DNA, 15 bp, Homo sapiens
tccatgggagccagc

SEQ ID NO: 1531676 - DNA, 23 bp, Homo sapiens
tccatgggagccagctgcttttt

SEQ ID NO: 1531677 - DNA, 15 bp, Homo sapiens
tccatgggcagtatg

SEQ ID NO: 1531678 - DNA, 18 bp, Homo sapiens
tccatgtacttgtttgca

SEQ ID NO: 1531679 - DNA, 21 bp, Homo sapiens
tccatgtattcacacacccct

SEQ ID NO: 1531680 - DNA, 22 bp, Homo sapiens
tccatgtattcacacacccctc

SEQ ID NO: 1531681 - DNA, 18 bp, Homo sapiens
tccatgtgatctcattgt

SEQ ID NO: 1531682 - DNA, 13 bp, Homo sapiens
tccatgtgccttt

SEQ ID NO: 1531683 - DNA, 20 bp, Homo sapiens
tccatgtgcctttctttgcc

SEQ ID NO: 1531684 - DNA, 16 bp, Homo sapiens
tccatgtggacttagg

SEQ ID NO: 1531685 - DNA, 14 bp, Homo sapiens
tccatgtgtatcca

SEQ ID NO: 1531686 - DNA, 15 bp, Homo sapiens
tccatgttgctgcca

SEQ ID NO: 1531687 - DNA, 22 bp, Homo sapiens
tccatgttttttcttcaaatgt

SEQ ID NO: 1531688 - DNA, 20 bp, Homo sapiens
tccattaacttagcatgtgt

SEQ ID NO: 1531689 - DNA, 19 bp, Homo sapiens
tccattactgtgatttctg

SEQ ID NO: 1531690 - DNA, 23 bp, Homo sapiens
tccattagaaaattttgtaaaac

SEQ ID NO: 1531691 - DNA, 20 bp, Homo sapiens
tccattaggccagcaacgct

SEQ ID NO: 1531692 - DNA, 17 bp, Homo sapiens
ccagggcctccagggcc

SEQ ID NO: 1531693 - DNA, 12 bp, Homo sapiens
ccagggcctgac

SEQ ID NO: 1531694 - DNA, 15 bp, Homo sapiens
ccagggcctgacacc

SEQ ID NO: 1531695 - DNA, 21 bp, Homo sapiens
ccagggccttttctggcaccg

SEQ ID NO: 1531696 - DNA, 11 bp, Homo sapiens
ccagggctcag

SEQ ID NO: 1531697 - DNA, 15 bp, Homo sapiens
ccagggctcagcctg

SEQ ID NO: 1531698 - DNA, 12 bp, Homo sapiens
ccagggctcctg

SEQ ID NO: 1531699 - DNA, 20 bp, Homo sapiens
ccagggctcctgcacttact

SEQ ID NO: 1531700 - DNA, 12 bp, Homo sapiens
ccagggctctgc

SEQ ID NO: 1531701 - DNA, 14 bp, Homo sapiens
ccagggctgcaggg

SEQ ID NO: 1531702 - DNA, 17 bp, Homo sapiens
ccagggctggactgagg

SEQ ID NO: 1531703 - DNA, 19 bp, Homo sapiens
ccagggctggactgaggcc

SEQ ID NO: 1531704 - DNA, 19 bp, Homo sapiens
ccagggctgggaggaagga

SEQ ID NO: 1531705 - DNA, 12 bp, Homo sapiens
ccagggctgggg

SEQ ID NO: 1531706 - DNA, 19 bp, Homo sapiens
ccagggctggggacagagg

SEQ ID NO: 1531707 - DNA, 20 bp, Homo sapiens
ccagggcttacctgtacact

SEQ ID NO: 1531708 - DNA, 21 bp, Homo sapiens
ccagggcttacctgtacactg

SEQ ID NO: 1531709 - DNA, 18 bp, Homo sapiens
ccagggcttttcccagga

SEQ ID NO: 1531710 - DNA, 16 bp, Homo sapiens
ccaggggaaggaagga

SEQ ID NO: 1531711 - DNA, 18 bp, Homo sapiens
ccaggggaccacacctcc

SEQ ID NO: 1531712 - DNA, 15 bp, Homo sapiens
ccaggggacccctgc

SEQ ID NO: 1531713 - DNA, 21 bp, Homo sapiens
ccaggggagagggtctggaga

SEQ ID NO: 1531714 - DNA, 12 bp, Homo sapiens
ccaggggagcca

SEQ ID NO: 1531715 - DNA, 13 bp, Homo sapiens
ccaggggagccag

SEQ ID NO: 1531716 - DNA, 17 bp, Homo sapiens
ccaggggagccagctgc

SEQ ID NO: 1531717 - DNA, 21 bp, Homo sapiens
ccaggggagccagctgcttga

SEQ ID NO: 1531718 - DNA, 16 bp, Homo sapiens
ccaggggaggagcctg

SEQ ID NO: 1531719 - DNA, 21 bp, Homo sapiens
ccaggggaggcctgaggcttc

SEQ ID NO: 1531720 - DNA, 16 bp, Homo sapiens
ccaggggagttgtgtc

SEQ ID NO: 1531721 - DNA, 12 bp, Homo sapiens
ccaggggcagca

SEQ ID NO: 1531722 - DNA, 18 bp, Homo sapiens
ccaggggcagcaaggcct

SEQ ID NO: 1531723 - DNA, 12 bp, Homo sapiens
ccaggggcagga

SEQ ID NO: 1531724 - DNA, 16 bp, Homo sapiens
ccaggggcaggactga

SEQ ID NO: 1531725 - DNA, 14 bp, Homo sapiens
ccaggggcctgcag

SEQ ID NO: 1531726 - DNA, 18 bp, Homo sapiens
ccagggggatgccactcc

SEQ ID NO: 1531727 - DNA, 23 bp, Homo sapiens
ccagggggcccgaacagggactt

SEQ ID NO: 1531728 - DNA, 15 bp, Homo sapiens
ccagggggcctggag

SEQ ID NO: 1531729 - DNA, 13 bp, Homo sapiens
ccaggggtgcccc

SEQ ID NO: 1531730 - DNA, 15 bp, Homo sapiens
ccaggggtgccccct

SEQ ID NO: 1531731 - DNA, 13 bp, Homo sapiens
ccaggggtttctc

SEQ ID NO: 1531732 - DNA, 20 bp, Homo sapiens
ccagggtagacttggagctg

SEQ ID NO: 1531733 - DNA, 24 bp, Homo sapiens
ccagggtagacttggagctgtcct

SEQ ID NO: 1531734 - DNA, 14 bp, Homo sapiens
ccagggtccgcacc

SEQ ID NO: 1531735 - DNA, 22 bp, Homo sapiens
ccagggtccgcaccagctgctc

SEQ ID NO: 1531736 - DNA, 23 bp, Homo sapiens
ccagggtccgcaccagctgctct

SEQ ID NO: 1531737 - DNA, 24 bp, Homo sapiens
ccagggtccgcaccagctgctctg

SEQ ID NO: 1531738 - DNA, 17 bp, Homo sapiens
ccagggtcttgggctac

SEQ ID NO: 1531739 - DNA, 19 bp, Homo sapiens
ccagggtcttgggctactg

SEQ ID NO: 1531740 - DNA, 23 bp, Homo sapiens
ccagggtcttgggctactggcag

SEQ ID NO: 1531741 - DNA, 21 bp, Homo sapiens
ccagggtgtggccctgccatc

SEQ ID NO: 1531742 - DNA, 18 bp, Homo sapiens
ccagggttgtgctttcta

SEQ ID NO: 1531743 - DNA, 18 bp, Homo sapiens
ccaggtaatatgtcttgg

SEQ ID NO: 1531744 - DNA, 23 bp, Homo sapiens
ccaggtaccagctgcgcttgctt

SEQ ID NO: 1531745 - DNA, 13 bp, Homo sapiens
ccaggtagaaact

SEQ ID NO: 1531746 - DNA, 16 bp, Homo sapiens
ccaggtatcaaatcaa

SEQ ID NO: 1531747 - DNA, 19 bp, Homo sapiens
ccaggtatccaaaaatgtg

SEQ ID NO: 1531748 - DNA, 14 bp, Homo sapiens
ccaggtccagctct

SEQ ID NO: 1531749 - DNA, 18 bp, Homo sapiens
ccaggtccagctctggag

SEQ ID NO: 1531750 - DNA, 17 bp, Homo sapiens
ccaggtccctggaccag

SEQ ID NO: 1531751 - DNA, 22 bp, Homo sapiens
ccaggtccctttcatttgctat

SEQ ID NO: 1531752 - DNA, 13 bp, Homo sapiens
ccaggtcctgctc

SEQ ID NO: 1531753 - DNA, 15 bp, Homo sapiens
ccaggtcctgctccg

SEQ ID NO: 1531754 - DNA, 22 bp, Homo sapiens
ccaggtcctgctccgctgcctg

SEQ ID NO: 1531755 - DNA, 17 bp, Homo sapiens
ccaggtcggagtgcctg

SEQ ID NO: 1531756 - DNA, 19 bp, Homo sapiens
ccaggtcggagtgcctgga

SEQ ID NO: 1531757 - DNA, 21 bp, Homo sapiens
ccaggtcggagtgcctggagt

SEQ ID NO: 1531758 - DNA, 23 bp, Homo sapiens
ccaggtcggagtgcctggagtca

SEQ ID NO: 1531759 - DNA, 18 bp, Homo sapiens
ccaggtcgggcagtggag

SEQ ID NO: 1531760 - DNA, 17 bp, Homo sapiens
ccaggtctcactgcttt

SEQ ID NO: 1531761 - DNA, 18 bp, Homo sapiens
ccaggtctcactgctttg

SEQ ID NO: 1531762 - DNA, 16 bp, Homo sapiens
ccaggtctctccactg

SEQ ID NO: 1531763 - DNA, 20 bp, Homo sapiens
ccaggtgaggcccaagagcc

SEQ ID NO: 1531764 - DNA, 18 bp, Homo sapiens
ccaggtgcagaccttggg

SEQ ID NO: 1531765 - DNA, 13 bp, Homo sapiens
ccaggtgcagagg

SEQ ID NO: 1531766 - DNA, 20 bp, Homo sapiens
ccaggtgcagaggtaccctg

SEQ ID NO: 1531767 - DNA, 22 bp, Homo sapiens
ccaggtgcagaggtaccctggg

SEQ ID NO: 1531768 - DNA, 23 bp, Homo sapiens
ccaggtgcagaggtaccctgggt

SEQ ID NO: 1531769 - DNA, 14 bp, Homo sapiens
ccaggtgcagtggc

SEQ ID NO: 1531770 - DNA, 17 bp, Homo sapiens
ccaggtgccagttatgg

SEQ ID NO: 1531771 - DNA, 16 bp, Homo sapiens
ccaggtggagggcaca

SEQ ID NO: 1531772 - DNA, 18 bp, Homo sapiens
ccaggtggagggcacagc

SEQ ID NO: 1531773 - DNA, 16 bp, Homo sapiens
ccaggtggcctgcgtc

SEQ ID NO: 1531774 - DNA, 20 bp, Homo sapiens
ccaggtggctgacccagtcc

SEQ ID NO: 1531775 - DNA, 18 bp, Homo sapiens
ccaggtgggaacggctga

SEQ ID NO: 1531776 - DNA, 16 bp, Homo sapiens
ccaggtgtgcacgtgg

SEQ ID NO: 1531777 - DNA, 24 bp, Homo sapiens
ccaggtgtgcctgtgctcctgccc

SEQ ID NO: 1531778 - DNA, 23 bp, Homo sapiens
ccaggtgttaacattccaagact

SEQ ID NO: 1531779 - DNA, 18 bp, Homo sapiens
ccaggtgttgccatttct

SEQ ID NO: 1531780 - DNA, 21 bp, Homo sapiens
ccaggttagcctttgccctgt

SEQ ID NO: 1531781 - DNA, 18 bp, Homo sapiens
ccaggttccatccaccac

SEQ ID NO: 1531782 - DNA, 23 bp, Homo sapiens
ccaggttccatccaccaccttgc

SEQ ID NO: 1531783 - DNA, 15 bp, Homo sapiens
ccaggttcccccagc

SEQ ID NO: 1531784 - DNA, 16 bp, Homo sapiens
ccaggttcccccagca

SEQ ID NO: 1531785 - DNA, 14 bp, Homo sapiens
ccaggttcgagacc

SEQ ID NO: 1531786 - DNA, 23 bp, Homo sapiens
ccaggttctccgttagctcctgt

SEQ ID NO: 1531787 - DNA, 20 bp, Homo sapiens
ccaggttgacaccattctcc

SEQ ID NO: 1531788 - DNA, 15 bp, Homo sapiens
ccaggttgcagctgc

SEQ ID NO: 1531789 - DNA, 17 bp, Homo sapiens
ccaggttgcagctgctc

SEQ ID NO: 1531790 - DNA, 22 bp, Homo sapiens
ccaggttgggctataaaatatt

SEQ ID NO: 1531791 - DNA, 15 bp, Homo sapiens
ccaggtttcattttg

SEQ ID NO: 1531792 - DNA, 20 bp, Homo sapiens
ccagtaaaaaaaaaaaatgg

SEQ ID NO: 1531793 - DNA, 22 bp, Homo sapiens
ccagtaaaatactattgcctca

SEQ ID NO: 1531794 - DNA, 20 bp, Homo sapiens
ccagtaacgcgtcttcctga

SEQ ID NO: 1531795 - DNA, 19 bp, Homo sapiens
ccagtaacttttttgtgta

SEQ ID NO: 1531796 - DNA, 20 bp, Homo sapiens
ccagtaacttttttgtgtat

SEQ ID NO: 1531797 - DNA, 18 bp, Homo sapiens
ccagtacctagctggctc

SEQ ID NO: 1531798 - DNA, 18 bp, Homo sapiens
ccagtacctccaagcaag

SEQ ID NO: 1531799 - DNA, 14 bp, Homo sapiens
ccagtaccttgctt

SEQ ID NO: 1531800 - DNA, 12 bp, Homo sapiens
ccagtaggagac

SEQ ID NO: 1531801 - DNA, 20 bp, Homo sapiens
ccagtatctcttcagtctct

SEQ ID NO: 1531802 - DNA, 18 bp, Homo sapiens
ccagtatttagaagccaa

SEQ ID NO: 1531803 - DNA, 22 bp, Homo sapiens
ccagtcaaatctgggctcactc

SEQ ID NO: 1531804 - DNA, 16 bp, Homo sapiens
ccagtcaacagattca

SEQ ID NO: 1531805 - DNA, 20 bp, Homo sapiens
ccagtcacctcgtctccctg

SEQ ID NO: 1531806 - DNA, 13 bp, Homo sapiens
ccagtcactgctg

SEQ ID NO: 1531807 - DNA, 17 bp, Homo sapiens
ccagtcactgctgcaag

SEQ ID NO: 1531808 - DNA, 22 bp, Homo sapiens
tccattcacagttctttgggcc

SEQ ID NO: 1531809 - DNA, 18 bp, Homo sapiens
tccattcctggagcccga

SEQ ID NO: 1531810 - DNA, 16 bp, Homo sapiens
tccattctttcagctg

SEQ ID NO: 1531811 - DNA, 20 bp, Homo sapiens
tccattgattttttttttct

SEQ ID NO: 1531812 - DNA, 16 bp, Homo sapiens
tccattggatctgcaa

SEQ ID NO: 1531813 - DNA, 22 bp, Homo sapiens
tccattggtttacctgtgaaat

SEQ ID NO: 1531814 - DNA, 16 bp, Homo sapiens
tccatttatttatgaa

SEQ ID NO: 1531815 - DNA, 15 bp, Homo sapiens
tccatttccagttca

SEQ ID NO: 1531816 - DNA, 15 bp, Homo sapiens
tccatttccattgct

SEQ ID NO: 1531817 - DNA, 22 bp, Homo sapiens
tccatttcccaaagtcctctgc

SEQ ID NO: 1531818 - DNA, 18 bp, Homo sapiens
tccatttcccacatcttt

SEQ ID NO: 1531819 - DNA, 14 bp, Homo sapiens
tccatttcccctct

SEQ ID NO: 1531820 - DNA, 21 bp, Homo sapiens
tccatttctcaatcagtgcag

SEQ ID NO: 1531821 - DNA, 24 bp, Homo sapiens
tccatttctcaatcagtgcagtga

SEQ ID NO: 1531822 - DNA, 16 bp, Homo sapiens
tccatttcttcctcac

SEQ ID NO: 1531823 - DNA, 15 bp, Homo sapiens
tccatttgctcttca

SEQ ID NO: 1531824 - DNA, 17 bp, Homo sapiens
tccattttaattttaaa

SEQ ID NO: 1531825 - DNA, 16 bp, Homo sapiens
tccattttacacagca

SEQ ID NO: 1531826 - DNA, 12 bp, Homo sapiens
tccattttctaa

SEQ ID NO: 1531827 - DNA, 16 bp, Homo sapiens
tccattttctaaactg

SEQ ID NO: 1531828 - DNA, 17 bp, Homo sapiens
tccattttctaaactgt

SEQ ID NO: 1531829 - DNA, 21 bp, Homo sapiens
tccatttttctcccaagaaac

SEQ ID NO: 1531830 - DNA, 19 bp, Homo sapiens
tccattttttcttcccttt

SEQ ID NO: 1531831 - DNA, 20 bp, Homo sapiens
tccatttttttctttactta

SEQ ID NO: 1531832 - DNA, 23 bp, Homo sapiens
tccatttttttctttacttatct

SEQ ID NO: 1531833 - DNA, 14 bp, Homo sapiens
tcccaaaattgttt

SEQ ID NO: 1531834 - DNA, 24 bp, Homo sapiens
tcccaaacgccctttcctcctcag

SEQ ID NO: 1531835 - DNA, 15 bp, Homo sapiens
tcccaaagtcctctg

SEQ ID NO: 1531836 - DNA, 20 bp, Homo sapiens
tcccaaagtgctgagattac

SEQ ID NO: 1531837 - DNA, 23 bp, Homo sapiens
tcccaaagtgctgagattacagg

SEQ ID NO: 1531838 - DNA, 20 bp, Homo sapiens
tcccaaagtgctgggattac

SEQ ID NO: 1531839 - DNA, 21 bp, Homo sapiens
tcccaaagtgctgggattaca

SEQ ID NO: 1531840 - DNA, 15 bp, Homo sapiens
tcccaacaagcagct

SEQ ID NO: 1531841 - DNA, 15 bp, Homo sapiens
tcccaacagccatgc

SEQ ID NO: 1531842 - DNA, 16 bp, Homo sapiens
tcccaacagccatgcc

SEQ ID NO: 1531843 - DNA, 17 bp, Homo sapiens
tcccaacagccatgccc

SEQ ID NO: 1531844 - DNA, 11 bp, Homo sapiens
tcccaacatcg

SEQ ID NO: 1531845 - DNA, 22 bp, Homo sapiens
tcccaaccccagggcccccaca

SEQ ID NO: 1531846 - DNA, 23 bp, Homo sapiens
tcccaaccccagggcccccacag

SEQ ID NO: 1531847 - DNA, 14 bp, Homo sapiens
tcccaacccccctc

SEQ ID NO: 1531848 - DNA, 18 bp, Homo sapiens
tcccaacccccctcctgc

SEQ ID NO: 1531849 - DNA, 19 bp, Homo sapiens
tcccaacccccctcctgct

SEQ ID NO: 1531850 - DNA, 23 bp, Homo sapiens
tcccaacccccctcctgctcctc

SEQ ID NO: 1531851 - DNA, 16 bp, Homo sapiens
tcccaacctcaatgcc

SEQ ID NO: 1531852 - DNA, 22 bp, Homo sapiens
tcccaacctcaatgccctgcca

SEQ ID NO: 1531853 - DNA, 19 bp, Homo sapiens
tcccaacgtgcaaagccaa

SEQ ID NO: 1531854 - DNA, 15 bp, Homo sapiens
tcccaacttcttcct

SEQ ID NO: 1531855 - DNA, 13 bp, Homo sapiens
tcccaagaatgca

SEQ ID NO: 1531856 - DNA, 18 bp, Homo sapiens
tcccaagcgttcctggcc

SEQ ID NO: 1531857 - DNA, 21 bp, Homo sapiens
tcccaagcgttcctggccttc

SEQ ID NO: 1531858 - DNA, 14 bp, Homo sapiens
tcccaaggagccat

SEQ ID NO: 1531859 - DNA, 22 bp, Homo sapiens
tcccaaggagctgatttccagg

SEQ ID NO: 1531860 - DNA, 13 bp, Homo sapiens
tcccaagggacag

SEQ ID NO: 1531861 - DNA, 21 bp, Homo sapiens
tcccaagggacagcaagtgag

SEQ ID NO: 1531862 - DNA, 20 bp, Homo sapiens
tcccaagtagctgagactac

SEQ ID NO: 1531863 - DNA, 20 bp, Homo sapiens
tcccaagtagctgggactac

SEQ ID NO: 1531864 - DNA, 23 bp, Homo sapiens
tcccaagtagctgggattacagg

SEQ ID NO: 1531865 - DNA, 21 bp, Homo sapiens
tcccaagtatgccttaagcag

SEQ ID NO: 1531866 - DNA, 16 bp, Homo sapiens
tcccaagtcccaccct

SEQ ID NO: 1531867 - DNA, 14 bp, Homo sapiens
tcccaataaaagtg

SEQ ID NO: 1531868 - DNA, 20 bp, Homo sapiens
tcccaatcaaagaattacag

SEQ ID NO: 1531869 - DNA, 13 bp, Homo sapiens
tcccaatcagcac

SEQ ID NO: 1531870 - DNA, 18 bp, Homo sapiens
tcccaatcagcactgaaa

SEQ ID NO: 1531871 - DNA, 13 bp, Homo sapiens
tcccaatcagctt

SEQ ID NO: 1531872 - DNA, 20 bp, Homo sapiens
tcccaattagcttggcctac

SEQ ID NO: 1531873 - DNA, 14 bp, Homo sapiens
tcccaattaggaag

SEQ ID NO: 1531874 - DNA, 15 bp, Homo sapiens
tcccaattaggaagt

SEQ ID NO: 1531875 - DNA, 17 bp, Homo sapiens
tcccaatttcagactcc

SEQ ID NO: 1531876 - DNA, 23 bp, Homo sapiens
tcccaatttcagactcccattcc

SEQ ID NO: 1531877 - DNA, 11 bp, Homo sapiens
tcccacacagg

SEQ ID NO: 1531878 - DNA, 13 bp, Homo sapiens
tcccacaccgctg

SEQ ID NO: 1531879 - DNA, 13 bp, Homo sapiens
tcccacacctgcc

SEQ ID NO: 1531880 - DNA, 13 bp, Homo sapiens
tcccacagcctcc

SEQ ID NO: 1531881 - DNA, 16 bp, Homo sapiens
tcccagcttcaaatgc

SEQ ID NO: 1531882 - DNA, 11 bp, Homo sapiens
tcccaggaccc

SEQ ID NO: 1531883 - DNA, 12 bp, Homo sapiens
tcccaggaccct

SEQ ID NO: 1531884 - DNA, 14 bp, Homo sapiens
tcccaggaccctga

SEQ ID NO: 1531885 - DNA, 21 bp, Homo sapiens
tcccaggacctcggatgacca

SEQ ID NO: 1531886 - DNA, 14 bp, Homo sapiens
tcccaggagaaaga

SEQ ID NO: 1531887 - DNA, 16 bp, Homo sapiens
tcccaggagacagttc

SEQ ID NO: 1531888 - DNA, 17 bp, Homo sapiens
tcccaggagctgcccag

SEQ ID NO: 1531889 - DNA, 18 bp, Homo sapiens
tcccaggatctgctccaa

SEQ ID NO: 1531890 - DNA, 14 bp, Homo sapiens
tcccaggcaagcag

SEQ ID NO: 1531891 - DNA, 12 bp, Homo sapiens
tcccaggcccac

SEQ ID NO: 1531892 - DNA, 19 bp, Homo sapiens
tcccaggcccactgtgcct

SEQ ID NO: 1531893 - DNA, 20 bp, Homo sapiens
tcccaggcccactgtgcctc

SEQ ID NO: 1531894 - DNA, 15 bp, Homo sapiens
tcccaggcccgagat

SEQ ID NO: 1531895 - DNA, 13 bp, Homo sapiens
tcccaggcccttt

SEQ ID NO: 1531896 - DNA, 16 bp, Homo sapiens
tcccaggccctttggc

SEQ ID NO: 1531897 - DNA, 17 bp, Homo sapiens
tcccaggccctttggct

SEQ ID NO: 1531898 - DNA, 17 bp, Homo sapiens
tcccaggcctgcctgca

SEQ ID NO: 1531899 - DNA, 16 bp, Homo sapiens
tcccaggcgccccttc

SEQ ID NO: 1531900 - DNA, 18 bp, Homo sapiens
tcccaggcgccccttccc

SEQ ID NO: 1531901 - DNA, 20 bp, Homo sapiens
tcccaggcgccccttccccc

SEQ ID NO: 1531902 - DNA, 21 bp, Homo sapiens
tcccaggcgccccttccccct

SEQ ID NO: 1531903 - DNA, 20 bp, Homo sapiens
tcccaggctgggctctgcct

SEQ ID NO: 1531904 - DNA, 21 bp, Homo sapiens
tcccaggctgggctctgcctg

SEQ ID NO: 1531905 - DNA, 20 bp, Homo sapiens
tcccagggctctgcaggcca

SEQ ID NO: 1531906 - DNA, 17 bp, Homo sapiens
tcccaggggaccacacc

SEQ ID NO: 1531907 - DNA, 16 bp, Homo sapiens
tcccaggggcagccac

SEQ ID NO: 1531908 - DNA, 22 bp, Homo sapiens
tcccaggggcagccacaccact

SEQ ID NO: 1531909 - DNA, 17 bp, Homo sapiens
tcccaggggtctccctg

SEQ ID NO: 1531910 - DNA, 16 bp, Homo sapiens
tcccaggtaccagctg

SEQ ID NO: 1531911 - DNA, 19 bp, Homo sapiens
tcccaggtaccagctgcgc

SEQ ID NO: 1531912 - DNA, 17 bp, Homo sapiens
tcccaggtcgggcagtg

SEQ ID NO: 1531913 - DNA, 12 bp, Homo sapiens
tcccagtatttt

SEQ ID NO: 1531914 - DNA, 15 bp, Homo sapiens
tcccagtatttttat

SEQ ID NO: 1531915 - DNA, 19 bp, Homo sapiens
tcccagtcactcctctcta

SEQ ID NO: 1531916 - DNA, 13 bp, Homo sapiens
tcccagtcagaaa

SEQ ID NO: 1531917 - DNA, 19 bp, Homo sapiens
tcccagtccctcgccgtcc

SEQ ID NO: 1531918 - DNA, 20 bp, Homo sapiens
tcccagtgaatccctgggag

SEQ ID NO: 1531919 - DNA, 14 bp, Homo sapiens
tcccagtgacaaca

SEQ ID NO: 1531920 - DNA, 14 bp, Homo sapiens
tcccagtgccttct

SEQ ID NO: 1531921 - DNA, 18 bp, Homo sapiens
tcccagtgggagcttccc

SEQ ID NO: 1531922 - DNA, 14 bp, Homo sapiens
tcccagtgggaggg

SEQ ID NO: 1531923 - DNA, 21 bp, Homo sapiens
tcccagtgggaggggcaggct

SEQ ID NO: 1531924 - DNA, 22 bp, Homo sapiens
tcccagtgggaggggcaggctg

SEQ ID NO: 1531925 - DNA, 23 bp, Homo sapiens
tcccagtgggaggggcaggctga

SEQ ID NO: 1531926 - DNA, 15 bp, Homo sapiens
tcccagttcaggagt

SEQ ID NO: 1531927 - DNA, 22 bp, Homo sapiens
tcccataattgctttgccaaaa

SEQ ID NO: 1531928 - DNA, 22 bp, Homo sapiens
tcccataattttcttcatgcaa

SEQ ID NO: 1531929 - DNA, 21 bp, Homo sapiens
tcccatagtggggcctgggag

SEQ ID NO: 1531930 - DNA, 18 bp, Homo sapiens
ccagtcactgctgcaagg

SEQ ID NO: 1531931 - DNA, 17 bp, Homo sapiens
ccagtcaggctgcagag

SEQ ID NO: 1531932 - DNA, 21 bp, Homo sapiens
ccagtcaggctgcagaggcac

SEQ ID NO: 1531933 - DNA, 19 bp, Homo sapiens
ccagtcagggacagcagcc

SEQ ID NO: 1531934 - DNA, 20 bp, Homo sapiens
ccagtcagggacagcagcct

SEQ ID NO: 1531935 - DNA, 22 bp, Homo sapiens
ccagtcagggacagcagcctcc

SEQ ID NO: 1531936 - DNA, 16 bp, Homo sapiens
ccagtcatctgtaaga

SEQ ID NO: 1531937 - DNA, 21 bp, Homo sapiens
ccagtcatctgtaagagcttg

SEQ ID NO: 1531938 - DNA, 22 bp, Homo sapiens
ccagtcccacaccgctggtccc

SEQ ID NO: 1531939 - DNA, 23 bp, Homo sapiens
ccagtcccagggaaggtggggcc

SEQ ID NO: 1531940 - DNA, 14 bp, Homo sapiens
ccagtcccaggggc

SEQ ID NO: 1531941 - DNA, 14 bp, Homo sapiens
ccagtcccattcct

SEQ ID NO: 1531942 - DNA, 15 bp, Homo sapiens
ccagtccccacccct

SEQ ID NO: 1531943 - DNA, 21 bp, Homo sapiens
ccagtccccacccgcctgcag

SEQ ID NO: 1531944 - DNA, 14 bp, Homo sapiens
ccagtccctggagc

SEQ ID NO: 1531945 - DNA, 19 bp, Homo sapiens
ccagtccctgggggaagcc

SEQ ID NO: 1531946 - DNA, 13 bp, Homo sapiens
ccagtcctccact

SEQ ID NO: 1531947 - DNA, 22 bp, Homo sapiens
ccagtcctctcccaagtccaca

SEQ ID NO: 1531948 - DNA, 19 bp, Homo sapiens
ccagtcctgcctggccagg

SEQ ID NO: 1531949 - DNA, 21 bp, Homo sapiens
ccagtcctgcctggccaggca

SEQ ID NO: 1531950 - DNA, 14 bp, Homo sapiens
ccagtcctggtcct

SEQ ID NO: 1531951 - DNA, 20 bp, Homo sapiens
ccagtcctggtcctggctgc

SEQ ID NO: 1531952 - DNA, 21 bp, Homo sapiens
ccagtccttagcaaggggctc

SEQ ID NO: 1531953 - DNA, 13 bp, Homo sapiens
ccagtcgacccca

SEQ ID NO: 1531954 - DNA, 18 bp, Homo sapiens
ccagtcggccccatctct

SEQ ID NO: 1531955 - DNA, 20 bp, Homo sapiens
ccagtcgtcatcagatgctt

SEQ ID NO: 1531956 - DNA, 21 bp, Homo sapiens
ccagtctatttccactgaaca

SEQ ID NO: 1531957 - DNA, 15 bp, Homo sapiens
ccagtctcagagacc

SEQ ID NO: 1531958 - DNA, 19 bp, Homo sapiens
ccagtctcagagaccagca

SEQ ID NO: 1531959 - DNA, 20 bp, Homo sapiens
ccagtctcagagaccagcac

SEQ ID NO: 1531960 - DNA, 12 bp, Homo sapiens
ccagtctcccag

SEQ ID NO: 1531961 - DNA, 14 bp, Homo sapiens
ccagtctcccaggc

SEQ ID NO: 1531962 - DNA, 19 bp, Homo sapiens
ccagtctcccaggccccct

SEQ ID NO: 1531963 - DNA, 21 bp, Homo sapiens
ccagtctcccaggccccctgc

SEQ ID NO: 1531964 - DNA, 15 bp, Homo sapiens
ccagtctcctctcca

SEQ ID NO: 1531965 - DNA, 18 bp, Homo sapiens
ccagtctgtctactgtgg

SEQ ID NO: 1531966 - DNA, 20 bp, Homo sapiens
ccagtctgtgatccttggtg

SEQ ID NO: 1531967 - DNA, 21 bp, Homo sapiens
ccagtctgtggatcagagatg

SEQ ID NO: 1531968 - DNA, 15 bp, Homo sapiens
ccagtcttcctctta

SEQ ID NO: 1531969 - DNA, 18 bp, Homo sapiens
ccagtgaacattcccagc

SEQ ID NO: 1531970 - DNA, 21 bp, Homo sapiens
ccagtgaacattcccagccca

SEQ ID NO: 1531971 - DNA, 22 bp, Homo sapiens
ccagtgaacttacacttggagc

SEQ ID NO: 1531972 - DNA, 12 bp, Homo sapiens
ccagtgaagact

SEQ ID NO: 1531973 - DNA, 16 bp, Homo sapiens
ccagtgaattcttgaa

SEQ ID NO: 1531974 - DNA, 17 bp, Homo sapiens
ccagtgacagacaggct

SEQ ID NO: 1531975 - DNA, 13 bp, Homo sapiens
ccagtgacctctc

SEQ ID NO: 1531976 - DNA, 19 bp, Homo sapiens
ccagtgacctctctctctg

SEQ ID NO: 1531977 - DNA, 17 bp, Homo sapiens
ccagtgagtacctgcaa

SEQ ID NO: 1531978 - DNA, 14 bp, Homo sapiens
ccagtgcaaatgca

SEQ ID NO: 1531979 - DNA, 17 bp, Homo sapiens
ccagtgcaaatgcatgc

SEQ ID NO: 1531980 - DNA, 16 bp, Homo sapiens
ccagtgcagccactgg

SEQ ID NO: 1531981 - DNA, 19 bp, Homo sapiens
ccagtgcagttgtgatttc

SEQ ID NO: 1531982 - DNA, 18 bp, Homo sapiens
ccagtgcatggggaggca

SEQ ID NO: 1531983 - DNA, 15 bp, Homo sapiens
ccagtgccctggggc

SEQ ID NO: 1531984 - DNA, 20 bp, Homo sapiens
ccagtgccgaggacatgcat

SEQ ID NO: 1531985 - DNA, 16 bp, Homo sapiens
ccagtgcctgccactc

SEQ ID NO: 1531986 - DNA, 17 bp, Homo sapiens
ccagtgcctgccactct

SEQ ID NO: 1531987 - DNA, 18 bp, Homo sapiens
ccagtgcctgccactctc

SEQ ID NO: 1531988 - DNA, 18 bp, Homo sapiens
ccagtgccttacctcctg

SEQ ID NO: 1531989 - DNA, 19 bp, Homo sapiens
ccagtgccttacctcctgc

SEQ ID NO: 1531990 - DNA, 20 bp, Homo sapiens
ccagtgcggctgccaggttc

SEQ ID NO: 1531991 - DNA, 14 bp, Homo sapiens
ccagtgctcagctg

SEQ ID NO: 1531992 - DNA, 15 bp, Homo sapiens
ccagtgctcagctgt

SEQ ID NO: 1531993 - DNA, 19 bp, Homo sapiens
ccagtgctcagctgtggct

SEQ ID NO: 1531994 - DNA, 20 bp, Homo sapiens
ccagtgctccaggcacccag

SEQ ID NO: 1531995 - DNA, 22 bp, Homo sapiens
ccatcattttccatatcctggt

SEQ ID NO: 1531996 - DNA, 19 bp, Homo sapiens
ccatccactctaccctccc

SEQ ID NO: 1531997 - DNA, 13 bp, Homo sapiens
ccatccagccaga

SEQ ID NO: 1531998 - DNA, 14 bp, Homo sapiens
ccatccagccagac

SEQ ID NO: 1531999 - DNA, 12 bp, Homo sapiens
ccatccagcctc

SEQ ID NO: 1532000 - DNA, 15 bp, Homo sapiens
ccatccagcctccag

SEQ ID NO: 1532001 - DNA, 13 bp, Homo sapiens
ccatccaggtctt

SEQ ID NO: 1532002 - DNA, 20 bp, Homo sapiens
ccatccaggtcttgactcat

SEQ ID NO: 1532003 - DNA, 18 bp, Homo sapiens
ccatccagtgacaaacca

SEQ ID NO: 1532004 - DNA, 14 bp, Homo sapiens
ccatccatctccag

SEQ ID NO: 1532005 - DNA, 16 bp, Homo sapiens
ccatccatctccaggg

SEQ ID NO: 1532006 - DNA, 12 bp, Homo sapiens
ccatcccagtcc

SEQ ID NO: 1532007 - DNA, 16 bp, Homo sapiens
ccatcccagtccctcg

SEQ ID NO: 1532008 - DNA, 16 bp, Homo sapiens
ccatccccaactccat

SEQ ID NO: 1532009 - DNA, 13 bp, Homo sapiens
ccatccccctgcc

SEQ ID NO: 1532010 - DNA, 19 bp, Homo sapiens
ccatccccgtccatgctca

SEQ ID NO: 1532011 - DNA, 19 bp, Homo sapiens
ccatcccgaaaatctctcg

SEQ ID NO: 1532012 - DNA, 14 bp, Homo sapiens
ccatccctgggggc

SEQ ID NO: 1532013 - DNA, 16 bp, Homo sapiens
ccatcccttcggagcc

SEQ ID NO: 1532014 - DNA, 23 bp, Homo sapiens
ccatccggtggcctattccagga

SEQ ID NO: 1532015 - DNA, 23 bp, Homo sapiens
ccatcctaccctcgggcccacct

SEQ ID NO: 1532016 - DNA, 17 bp, Homo sapiens
ccatcctcatccctgac

SEQ ID NO: 1532017 - DNA, 15 bp, Homo sapiens
ccatcctgcagcctc

SEQ ID NO: 1532018 - DNA, 21 bp, Homo sapiens
ccatcctgcagcctcctcctg

SEQ ID NO: 1532019 - DNA, 14 bp, Homo sapiens
ccatcctggcccct

SEQ ID NO: 1532020 - DNA, 12 bp, Homo sapiens
ccatcctggcta

SEQ ID NO: 1532021 - DNA, 13 bp, Homo sapiens
ccatcctggctaa

SEQ ID NO: 1532022 - DNA, 12 bp, Homo sapiens
ccatcctggggc

SEQ ID NO: 1532023 - DNA, 16 bp, Homo sapiens
ccatcctggggcagca

SEQ ID NO: 1532024 - DNA, 18 bp, Homo sapiens
ccatccttcaccagagcc

SEQ ID NO: 1532025 - DNA, 20 bp, Homo sapiens
ccatccttcaccagagccca

SEQ ID NO: 1532026 - DNA, 13 bp, Homo sapiens
ccatccttgctgc

SEQ ID NO: 1532027 - DNA, 20 bp, Homo sapiens
ccatcgctgtgtgttagttc

SEQ ID NO: 1532028 - DNA, 23 bp, Homo sapiens
ccatcgctgtgtgttagttccca

SEQ ID NO: 1532029 - DNA, 17 bp, Homo sapiens
ccatcgtgaagaagcct

SEQ ID NO: 1532030 - DNA, 20 bp, Homo sapiens
ccatcgtgaagaagcctgta

SEQ ID NO: 1532031 - DNA, 14 bp, Homo sapiens
ccatctaaaatact

SEQ ID NO: 1532032 - DNA, 22 bp, Homo sapiens
ccatctaaactggagtgatgtt

SEQ ID NO: 1532033 - DNA, 21 bp, Homo sapiens
ccatctagactagcaatctct

SEQ ID NO: 1532034 - DNA, 14 bp, Homo sapiens
ccatctagccagcc

SEQ ID NO: 1532035 - DNA, 21 bp, Homo sapiens
ccatctcaaaaaaaaaaaaga

SEQ ID NO: 1532036 - DNA, 15 bp, Homo sapiens
ccatctcaaaacaaa

SEQ ID NO: 1532037 - DNA, 18 bp, Homo sapiens
ccatctcaaaacaaaaca

SEQ ID NO: 1532038 - DNA, 13 bp, Homo sapiens
ccatctcaggtgc

SEQ ID NO: 1532039 - DNA, 23 bp, Homo sapiens
ccatctcaggtgccactccctga

SEQ ID NO: 1532040 - DNA, 14 bp, Homo sapiens
ccatctcatcctgg

SEQ ID NO: 1532041 - DNA, 17 bp, Homo sapiens
ccatctcatcctggcac

SEQ ID NO: 1532042 - DNA, 14 bp, Homo sapiens
ccatctccagggag

SEQ ID NO: 1532043 - DNA, 12 bp, Homo sapiens
ccatctccccag

SEQ ID NO: 1532044 - DNA, 18 bp, Homo sapiens
ccatctccccaggcctcc

SEQ ID NO: 1532045 - DNA, 13 bp, Homo sapiens
ccatctccctgcc

SEQ ID NO: 1532046 - DNA, 17 bp, Homo sapiens
ccatctccctgcctggc

SEQ ID NO: 1532047 - DNA, 16 bp, Homo sapiens
ccatctccttccccca

SEQ ID NO: 1532048 - DNA, 19 bp, Homo sapiens
ccatctccttcccccagcc

SEQ ID NO: 1532049 - DNA, 23 bp, Homo sapiens
ccatctccttcccccagcccaat

SEQ ID NO: 1532050 - DNA, 16 bp, Homo sapiens
ccatctcctttcaggg

SEQ ID NO: 1532051 - DNA, 20 bp, Homo sapiens
ccatctcgccacccctcctt

SEQ ID NO: 1532052 - DNA, 20 bp, Homo sapiens
ccatctcgggcacaggccca

SEQ ID NO: 1532053 - DNA, 16 bp, Homo sapiens
ccatctctatcagaaa

SEQ ID NO: 1532054 - DNA, 23 bp, Homo sapiens
ccatctctgattttcaaagcttt

SEQ ID NO: 1532055 - DNA, 13 bp, Homo sapiens
ccatctctgcctg

SEQ ID NO: 1532056 - DNA, 13 bp, Homo sapiens
ccatctcttccta

SEQ ID NO: 1532057 - DNA, 14 bp, Homo sapiens
ccatctcttctgca

SEQ ID NO: 1532058 - DNA, 21 bp, Homo sapiens
ccatctgactgccaagccaga

SEQ ID NO: 1532059 - DNA, 19 bp, Homo sapiens
ccatctgatgtttcatatt

SEQ ID NO: 1532060 - DNA, 14 bp, Homo sapiens
ccatctgcacccct

SEQ ID NO: 1532061 - DNA, 23 bp, Homo sapiens
ccatctgcaccccttctctcctc

SEQ ID NO: 1532062 - DNA, 21 bp, Homo sapiens
ccatctgcccaggggtgcccc

SEQ ID NO: 1532063 - DNA, 19 bp, Homo sapiens
ccatctggatgtaaatcct

SEQ ID NO: 1532064 - DNA, 14 bp, Homo sapiens
ccatctggcagggt

SEQ ID NO: 1532065 - DNA, 16 bp, Homo sapiens
ccatctggcagggtgg

SEQ ID NO: 1532066 - DNA, 15 bp, Homo sapiens
ccatctggctttttc

SEQ ID NO: 1532067 - DNA, 21 bp, Homo sapiens
ccatctggctttttctgccac

SEQ ID NO: 1532068 - DNA, 22 bp, Homo sapiens
ccatctgggagtccccttttct

SEQ ID NO: 1532069 - DNA, 19 bp, Homo sapiens
ccatctgtaaaggggcagc

SEQ ID NO: 1532070 - DNA, 14 bp, Homo sapiens
ccatctgtacatat

SEQ ID NO: 1532071 - DNA, 13 bp, Homo sapiens
ccatctgtccaca

SEQ ID NO: 1532072 - DNA, 23 bp, Homo sapiens
ccatctgtccacatccccagagc

SEQ ID NO: 1532073 - DNA, 15 bp, Homo sapiens
ccatctgtctgccaa

SEQ ID NO: 1532074 - DNA, 22 bp, Homo sapiens
ccatctgtcttgccagccagaa

SEQ ID NO: 1532075 - DNA, 16 bp, Homo sapiens
ccatctgtttgttttt

SEQ ID NO: 1532076 - DNA, 14 bp, Homo sapiens
ccatcttccagcca

SEQ ID NO: 1532077 - DNA, 16 bp, Homo sapiens
ccatcttgagccacag

SEQ ID NO: 1532078 - DNA, 21 bp, Homo sapiens
ccatcttgcttccctaatcta

SEQ ID NO: 1532079 - DNA, 16 bp, Homo sapiens
ccatcttgtggggcca

SEQ ID NO: 1532080 - DNA, 18 bp, Homo sapiens
ccatcttgtggggccagg

SEQ ID NO: 1532081 - DNA, 14 bp, Homo sapiens
ccatctttgaactt

SEQ ID NO: 1532082 - DNA, 23 bp, Homo sapiens
ccatctttgatccttctgagctc

SEQ ID NO: 1532083 - DNA, 13 bp, Homo sapiens
ccatgaaacaaag

SEQ ID NO: 1532084 - DNA, 12 bp, Homo sapiens
ccatgaacaaat

SEQ ID NO: 1532085 - DNA, 14 bp, Homo sapiens
ccatgaacttgata

SEQ ID NO: 1532086 - DNA, 16 bp, Homo sapiens
ccatgaagacaggaca

SEQ ID NO: 1532087 - DNA, 18 bp, Homo sapiens
ccatgaatgtatcaggaa

SEQ ID NO: 1532088 - DNA, 12 bp, Homo sapiens
ccatgacccacc

SEQ ID NO: 1532089 - DNA, 16 bp, Homo sapiens
ccatgactggctgtct

SEQ ID NO: 1532090 - DNA, 12 bp, Homo sapiens
ccatgagcaagc

SEQ ID NO: 1532091 - DNA, 14 bp, Homo sapiens
ccatgagctgctca

SEQ ID NO: 1532092 - DNA, 17 bp, Homo sapiens
ccatgaggaaggaacag

SEQ ID NO: 1532093 - DNA, 18 bp, Homo sapiens
ccatgaggagttgctgtt

SEQ ID NO: 1532094 - DNA, 14 bp, Homo sapiens
ccatgaggtactgg

SEQ ID NO: 1532095 - DNA, 17 bp, Homo sapiens
ccatgaggtactggtcc

SEQ ID NO: 1532096 - DNA, 19 bp, Homo sapiens
ccatgagttccagaaagta

SEQ ID NO: 1532097 - DNA, 22 bp, Homo sapiens
ccatgatccctgtgttgtctct

SEQ ID NO: 1532098 - DNA, 18 bp, Homo sapiens
ccatgatttcccactgca

SEQ ID NO: 1532099 - DNA, 15 bp, Homo sapiens
ccatgatttgtccca

SEQ ID NO: 1532100 - DNA, 16 bp, Homo sapiens
ccatgatttgtcccag

SEQ ID NO: 1532101 - DNA, 19 bp, Homo sapiens
ccatgatttgtcccagcct

SEQ ID NO: 1532102 - DNA, 20 bp, Homo sapiens
ccatgatttgtcccagcctg

SEQ ID NO: 1532103 - DNA, 21 bp, Homo sapiens
ccatgatttgtcccagcctgg

SEQ ID NO: 1532104 - DNA, 12 bp, Homo sapiens
ccatgcaactgg

SEQ ID NO: 1532105 - DNA, 23 bp, Homo sapiens
ccatgcacactcatgcacacaga

SEQ ID NO: 1532106 - DNA, 14 bp, Homo sapiens
ccatgcacagtaca

SEQ ID NO: 1532107 - DNA, 13 bp, Homo sapiens
ccatgcacctccc

SEQ ID NO: 1532108 - DNA, 15 bp, Homo sapiens
ccatgcacctccctt

SEQ ID NO: 1532109 - DNA, 17 bp, Homo sapiens
ccatgcactgtgaagga

SEQ ID NO: 1532110 - DNA, 20 bp, Homo sapiens
tccacccccgccacggccac

SEQ ID NO: 1532111 - DNA, 23 bp, Homo sapiens
tccacccccgccacggccaccct

SEQ ID NO: 1532112 - DNA, 21 bp, Homo sapiens
tccaccctcatttctgccagc

SEQ ID NO: 1532113 - DNA, 15 bp, Homo sapiens
tccaccctccacctt

SEQ ID NO: 1532114 - DNA, 13 bp, Homo sapiens
tccaccctgccaa

SEQ ID NO: 1532115 - DNA, 14 bp, Homo sapiens
tccaccctgccaag

SEQ ID NO: 1532116 - DNA, 12 bp, Homo sapiens
tccaccctggaa

SEQ ID NO: 1532117 - DNA, 14 bp, Homo sapiens
tccaccctgtcccc

SEQ ID NO: 1532118 - DNA, 17 bp, Homo sapiens
tccaccctgtcccccag

SEQ ID NO: 1532119 - DNA, 16 bp, Homo sapiens
tccacccttccatcag

SEQ ID NO: 1532120 - DNA, 17 bp, Homo sapiens
tccacccttccatcagc

SEQ ID NO: 1532121 - DNA, 13 bp, Homo sapiens
tccacccttggcc

SEQ ID NO: 1532122 - DNA, 16 bp, Homo sapiens
tccacccttggcctgt

SEQ ID NO: 1532123 - DNA, 20 bp, Homo sapiens
tccacccttggcctgtctca

SEQ ID NO: 1532124 - DNA, 14 bp, Homo sapiens
tccaccgctgccta

SEQ ID NO: 1532125 - DNA, 19 bp, Homo sapiens
tccaccgctgcctaagtgg

SEQ ID NO: 1532126 - DNA, 22 bp, Homo sapiens
tccaccggcctcggcctcccaa

SEQ ID NO: 1532127 - DNA, 21 bp, Homo sapiens
tccacctacacccctgtgctc

SEQ ID NO: 1532128 - DNA, 19 bp, Homo sapiens
tccacctcatcactggact

SEQ ID NO: 1532129 - DNA, 20 bp, Homo sapiens
tccacctcctagaggtgggc

SEQ ID NO: 1532130 - DNA, 16 bp, Homo sapiens
ccaggaatttcccagg

SEQ ID NO: 1532131 - DNA, 20 bp, Homo sapiens
ccaggaatttcccaggaccc

SEQ ID NO: 1532132 - DNA, 21 bp, Homo sapiens
ccaggaatttcccaggaccct

SEQ ID NO: 1532133 - DNA, 22 bp, Homo sapiens
ccaggaatttcccaggaccctg

SEQ ID NO: 1532134 - DNA, 22 bp, Homo sapiens
ccaggaattttgtgtgattggc

SEQ ID NO: 1532135 - DNA, 14 bp, Homo sapiens
ccaggacaggcccg

SEQ ID NO: 1532136 - DNA, 15 bp, Homo sapiens
ccaggacaggcccgg

SEQ ID NO: 1532137 - DNA, 13 bp, Homo sapiens
ccaggaccagcct

SEQ ID NO: 1532138 - DNA, 14 bp, Homo sapiens
ccaggaccagctca

SEQ ID NO: 1532139 - DNA, 15 bp, Homo sapiens
ccaggaccagctggg

SEQ ID NO: 1532140 - DNA, 21 bp, Homo sapiens
ccaggaccatcctggagggct

SEQ ID NO: 1532141 - DNA, 21 bp, Homo sapiens
ccaggaccctgacctccgccc

SEQ ID NO: 1532142 - DNA, 14 bp, Homo sapiens
ccaggacgggccac

SEQ ID NO: 1532143 - DNA, 22 bp, Homo sapiens
ccaggacgggccacacgtggct

SEQ ID NO: 1532144 - DNA, 15 bp, Homo sapiens
ccaggactcaccctc

SEQ ID NO: 1532145 - DNA, 16 bp, Homo sapiens
ccaggactccctcctc

SEQ ID NO: 1532146 - DNA, 22 bp, Homo sapiens
ccaggactccctcctcacctct

SEQ ID NO: 1532147 - DNA, 14 bp, Homo sapiens
ccaggactgaaaga

SEQ ID NO: 1532148 - DNA, 14 bp, Homo sapiens
ccaggactggctgt

SEQ ID NO: 1532149 - DNA, 21 bp, Homo sapiens
ccaggactgggtctgacctgg

SEQ ID NO: 1532150 - DNA, 22 bp, Homo sapiens
ccaggagaaagatgaaactgaa

SEQ ID NO: 1532151 - DNA, 21 bp, Homo sapiens
ccaggagaaccactacatgca

SEQ ID NO: 1532152 - DNA, 21 bp, Homo sapiens
ccaggagaagctcagctgcat

SEQ ID NO: 1532153 - DNA, 22 bp, Homo sapiens
ccaggagaagctcagctgcatt

SEQ ID NO: 1532154 - DNA, 20 bp, Homo sapiens
ccaggagaataaaagaaatt

SEQ ID NO: 1532155 - DNA, 16 bp, Homo sapiens
ccaggagacagacaga

SEQ ID NO: 1532156 - DNA, 15 bp, Homo sapiens
ccaggagacagacca

SEQ ID NO: 1532157 - DNA, 22 bp, Homo sapiens
ccaggagacagaccacttgcca

SEQ ID NO: 1532158 - DNA, 12 bp, Homo sapiens
ccaggagacctg

SEQ ID NO: 1532159 - DNA, 13 bp, Homo sapiens
ccaggagacctgc

SEQ ID NO: 1532160 - DNA, 17 bp, Homo sapiens
ccaggagacctgctctc

SEQ ID NO: 1532161 - DNA, 15 bp, Homo sapiens
ccaggagagagccag

SEQ ID NO: 1532162 - DNA, 23 bp, Homo sapiens
ccaggagagagccaggatgccca

SEQ ID NO: 1532163 - DNA, 18 bp, Homo sapiens
ccaggagagccagccctc

SEQ ID NO: 1532164 - DNA, 19 bp, Homo sapiens
ccaggagagccagccctcc

SEQ ID NO: 1532165 - DNA, 23 bp, Homo sapiens
ccaggagagccagccctccctgt

SEQ ID NO: 1532166 - DNA, 14 bp, Homo sapiens
ccaggagcagcagc

SEQ ID NO: 1532167 - DNA, 16 bp, Homo sapiens
ccaggagcagcagcca

SEQ ID NO: 1532168 - DNA, 20 bp, Homo sapiens
ccaggagcagcagccagcac

SEQ ID NO: 1532169 - DNA, 23 bp, Homo sapiens
ccaggagcagcagccagcaccac

SEQ ID NO: 1532170 - DNA, 22 bp, Homo sapiens
ccaggagcagcttttggtctcc

SEQ ID NO: 1532171 - DNA, 16 bp, Homo sapiens
ccaggagcaggcacgg

SEQ ID NO: 1532172 - DNA, 19 bp, Homo sapiens
ccaggagccgggcctccca

SEQ ID NO: 1532173 - DNA, 18 bp, Homo sapiens
ccaggagcctaccccctg

SEQ ID NO: 1532174 - DNA, 17 bp, Homo sapiens
ccaggagcctgtgcctc

SEQ ID NO: 1532175 - DNA, 13 bp, Homo sapiens
ccaggagctaatc

SEQ ID NO: 1532176 - DNA, 16 bp, Homo sapiens
ccaggagctagcccag

SEQ ID NO: 1532177 - DNA, 21 bp, Homo sapiens
ccaggagctagcccagtccct

SEQ ID NO: 1532178 - DNA, 20 bp, Homo sapiens
ccaggagctctgcgccaggc

SEQ ID NO: 1532179 - DNA, 19 bp, Homo sapiens
ccaggagctgatggcagct

SEQ ID NO: 1532180 - DNA, 21 bp, Homo sapiens
ccaggaggccgagtggctgcc

SEQ ID NO: 1532181 - DNA, 18 bp, Homo sapiens
ccaggaggtgcttgaggc

SEQ ID NO: 1532182 - DNA, 21 bp, Homo sapiens
ccaggaggtgcttgaggcccc

SEQ ID NO: 1532183 - DNA, 19 bp, Homo sapiens
ccaggaggttggtgactga

SEQ ID NO: 1532184 - DNA, 16 bp, Homo sapiens
ccaggagtaagacaag

SEQ ID NO: 1532185 - DNA, 13 bp, Homo sapiens
ccaggagtctgtg

SEQ ID NO: 1532186 - DNA, 15 bp, Homo sapiens
ccaggagtctgtgct

SEQ ID NO: 1532187 - DNA, 18 bp, Homo sapiens
ccaggagtctgtgctctt

SEQ ID NO: 1532188 - DNA, 20 bp, Homo sapiens
ccaggagttcgaggctgcag

SEQ ID NO: 1532189 - DNA, 17 bp, Homo sapiens
ccaggagtttgagacaa

SEQ ID NO: 1532190 - DNA, 17 bp, Homo sapiens
ccaggagtttgaggctg

SEQ ID NO: 1532191 - DNA, 15 bp, Homo sapiens
ccaggatactggcac

SEQ ID NO: 1532192 - DNA, 21 bp, Homo sapiens
ccaggatactggcacagaggt

SEQ ID NO: 1532193 - DNA, 18 bp, Homo sapiens
ccaggatcactctctgct

SEQ ID NO: 1532194 - DNA, 19 bp, Homo sapiens
ccaggatcactctctgctg

SEQ ID NO: 1532195 - DNA, 21 bp, Homo sapiens
ccaggatcactctctgctggc

SEQ ID NO: 1532196 - DNA, 18 bp, Homo sapiens
ccaggatcccaagcctcc

SEQ ID NO: 1532197 - DNA, 22 bp, Homo sapiens
ccaggatcccaagcctcctgct

SEQ ID NO: 1532198 - DNA, 15 bp, Homo sapiens
ccaggatcctgcagg

SEQ ID NO: 1532199 - DNA, 16 bp, Homo sapiens
ccaggatctttgactg

SEQ ID NO: 1532200 - DNA, 20 bp, Homo sapiens
ccaggatctttgactgaaaa

SEQ ID NO: 1532201 - DNA, 17 bp, Homo sapiens
ccaggatgacacctcca

SEQ ID NO: 1532202 - DNA, 14 bp, Homo sapiens
ccaggatgcccacc

SEQ ID NO: 1532203 - DNA, 17 bp, Homo sapiens
ccaggattcccccagcc

SEQ ID NO: 1532204 - DNA, 16 bp, Homo sapiens
ccaggatttattttga

SEQ ID NO: 1532205 - DNA, 23 bp, Homo sapiens
ccaggattttaacaaaagcaaga

SEQ ID NO: 1532206 - DNA, 15 bp, Homo sapiens
ccaggcaacctccca

SEQ ID NO: 1532207 - DNA, 16 bp, Homo sapiens
ccaggcaacctcccat

SEQ ID NO: 1532208 - DNA, 19 bp, Homo sapiens
ccaggcaacctcccatccc

SEQ ID NO: 1532209 - DNA, 16 bp, Homo sapiens
ccaggcacagctgagt

SEQ ID NO: 1532210 - DNA, 12 bp, Homo sapiens
ccaggcacaggg

SEQ ID NO: 1532211 - DNA, 14 bp, Homo sapiens
ccaggcacagggcc

SEQ ID NO: 1532212 - DNA, 15 bp, Homo sapiens
ccaggcaccaccagg

SEQ ID NO: 1532213 - DNA, 18 bp, Homo sapiens
ccaggcaccaccaggagc

SEQ ID NO: 1532214 - DNA, 21 bp, Homo sapiens
ccaggcaccaccaggagcagc

SEQ ID NO: 1532215 - DNA, 19 bp, Homo sapiens
ccaggcacccagctttgtc

SEQ ID NO: 1532216 - DNA, 14 bp, Homo sapiens
ccaggcacccatgt

SEQ ID NO: 1532217 - DNA, 20 bp, Homo sapiens
ccaggcacccatgtgggcgc

SEQ ID NO: 1532218 - DNA, 16 bp, Homo sapiens
ccaggcacctcttcct

SEQ ID NO: 1532219 - DNA, 18 bp, Homo sapiens
ccaggcacctggcctgct

SEQ ID NO: 1532220 - DNA, 21 bp, Homo sapiens
ccaggcacctggcctgctggg

SEQ ID NO: 1532221 - DNA, 19 bp, Homo sapiens
ccaggcacgaacccacctg

SEQ ID NO: 1532222 - DNA, 22 bp, Homo sapiens
ccaggcacgaacccacctgctg

SEQ ID NO: 1532223 - DNA, 23 bp, Homo sapiens
ccaggcacgaacccacctgctga

SEQ ID NO: 1532224 - DNA, 16 bp, Homo sapiens
tccagataactctctt

SEQ ID NO: 1532225 - DNA, 21 bp, Homo sapiens
tccagataactctctttcctt

SEQ ID NO: 1532226 - DNA, 15 bp, Homo sapiens
tccagatagtgtagc

SEQ ID NO: 1532227 - DNA, 17 bp, Homo sapiens
tccagatcactgccaca

SEQ ID NO: 1532228 - DNA, 17 bp, Homo sapiens
tccagatctttcagaaa

SEQ ID NO: 1532229 - DNA, 19 bp, Homo sapiens
tccagatgtttccagactt

SEQ ID NO: 1532230 - DNA, 14 bp, Homo sapiens
tccagattctgatg

SEQ ID NO: 1532231 - DNA, 16 bp, Homo sapiens
tccagattctgatgca

SEQ ID NO: 1532232 - DNA, 15 bp, Homo sapiens
tccagcaactgccct

SEQ ID NO: 1532233 - DNA, 17 bp, Homo sapiens
tccagcaactgcccttc

SEQ ID NO: 1532234 - DNA, 19 bp, Homo sapiens
tccagcaactgcccttcca

SEQ ID NO: 1532235 - DNA, 18 bp, Homo sapiens
tccagcaacttcttctcc

SEQ ID NO: 1532236 - DNA, 20 bp, Homo sapiens
tccagcaacttcttctccat

SEQ ID NO: 1532237 - DNA, 15 bp, Homo sapiens
tccagcaccttgtgc

SEQ ID NO: 1532238 - DNA, 21 bp, Homo sapiens
tccagcaccttgtgcctgggg

SEQ ID NO: 1532239 - DNA, 23 bp, Homo sapiens
tccagcagaagacaaaaagacaa

SEQ ID NO: 1532240 - DNA, 22 bp, Homo sapiens
tccagcagcacacctcagcccc

SEQ ID NO: 1532241 - DNA, 12 bp, Homo sapiens
tccagcagctgc

SEQ ID NO: 1532242 - DNA, 15 bp, Homo sapiens
tccagcagctgcggg

SEQ ID NO: 1532243 - DNA, 18 bp, Homo sapiens
tccagcaggtcacactgg

SEQ ID NO: 1532244 - DNA, 13 bp, Homo sapiens
tccagcagtcagt

SEQ ID NO: 1532245 - DNA, 20 bp, Homo sapiens
tccagcagtctgataaactg

SEQ ID NO: 1532246 - DNA, 23 bp, Homo sapiens
tccagccagcaatgatgtccaga

SEQ ID NO: 1532247 - DNA, 14 bp, Homo sapiens
tccagccagctcct

SEQ ID NO: 1532248 - DNA, 18 bp, Homo sapiens
tccagcccctctggtcgc

SEQ ID NO: 1532249 - DNA, 15 bp, Homo sapiens
tccagcccctgtccc

SEQ ID NO: 1532250 - DNA, 21 bp, Homo sapiens
tccagccgccattgccaccag

SEQ ID NO: 1532251 - DNA, 12 bp, Homo sapiens
tccagcctccag

SEQ ID NO: 1532252 - DNA, 14 bp, Homo sapiens
tccagcctccaggg

SEQ ID NO: 1532253 - DNA, 21 bp, Homo sapiens
tccagcctccctgtctccagc

SEQ ID NO: 1532254 - DNA, 20 bp, Homo sapiens
tccagcctgagtgacagagc

SEQ ID NO: 1532255 - DNA, 23 bp, Homo sapiens
tccagcctgggcagccaggctgc

SEQ ID NO: 1532256 - DNA, 22 bp, Homo sapiens
tccagcctggggaccccacttc

SEQ ID NO: 1532257 - DNA, 22 bp, Homo sapiens
tccagcctgggtcacagagtga

SEQ ID NO: 1532258 - DNA, 23 bp, Homo sapiens
tccagcctgggtcacagagtgag

SEQ ID NO: 1532259 - DNA, 13 bp, Homo sapiens
tccagcctgtgtg

SEQ ID NO: 1532260 - DNA, 14 bp, Homo sapiens
tccagccttccagg

SEQ ID NO: 1532261 - DNA, 24 bp, Homo sapiens
tccagcctttccaagtcactagaa

SEQ ID NO: 1532262 - DNA, 21 bp, Homo sapiens
tccagcgatggtgctgcccag

SEQ ID NO: 1532263 - DNA, 16 bp, Homo sapiens
tccagcgtcactccag

SEQ ID NO: 1532264 - DNA, 20 bp, Homo sapiens
tccagcgtcactccagtgct

SEQ ID NO: 1532265 - DNA, 20 bp, Homo sapiens
tccagctcccactccctttc

SEQ ID NO: 1532266 - DNA, 13 bp, Homo sapiens
tccagctcctgta

SEQ ID NO: 1532267 - DNA, 11 bp, Homo sapiens
tccagctcttg

SEQ ID NO: 1532268 - DNA, 16 bp, Homo sapiens
tccagctctttagaat

SEQ ID NO: 1532269 - DNA, 12 bp, Homo sapiens
tccagctgacat

SEQ ID NO: 1532270 - DNA, 14 bp, Homo sapiens
tccagctgactaaa

SEQ ID NO: 1532271 - DNA, 12 bp, Homo sapiens
tccagctgcccc

SEQ ID NO: 1532272 - DNA, 11 bp, Homo sapiens
tccagctgcct

SEQ ID NO: 1532273 - DNA, 12 bp, Homo sapiens
tccagctgctgt

SEQ ID NO: 1532274 - DNA, 13 bp, Homo sapiens
tccagctggcctg

SEQ ID NO: 1532275 - DNA, 17 bp, Homo sapiens
tccagctgggcctcctg

SEQ ID NO: 1532276 - DNA, 21 bp, Homo sapiens
tccagctgggcctcctgcctc

SEQ ID NO: 1532277 - DNA, 16 bp, Homo sapiens
tccagcttcagctcaa

SEQ ID NO: 1532278 - DNA, 17 bp, Homo sapiens
tccagcttcagctcaac

SEQ ID NO: 1532279 - DNA, 19 bp, Homo sapiens
tccaggaaaaaataaaaag

SEQ ID NO: 1532280 - DNA, 20 bp, Homo sapiens
tccaggaaaaaataaaaaga

SEQ ID NO: 1532281 - DNA, 23 bp, Homo sapiens
tccaggaaggcagctgctcttag

SEQ ID NO: 1532282 - DNA, 20 bp, Homo sapiens
tccaggactatatttgggcc

SEQ ID NO: 1532283 - DNA, 23 bp, Homo sapiens
tccaggagaagggggctctgccc

SEQ ID NO: 1532284 - DNA, 19 bp, Homo sapiens
tccaggagaagtgctccct

SEQ ID NO: 1532285 - DNA, 21 bp, Homo sapiens
tccaggagaagtgctccctgg

SEQ ID NO: 1532286 - DNA, 23 bp, Homo sapiens
tccaggagaagtgctccctggag

SEQ ID NO: 1532287 - DNA, 16 bp, Homo sapiens
tccaggagagagccag

SEQ ID NO: 1532288 - DNA, 14 bp, Homo sapiens
tccaggagcctggc

SEQ ID NO: 1532289 - DNA, 15 bp, Homo sapiens
tccaggagcctgtgc

SEQ ID NO: 1532290 - DNA, 23 bp, Homo sapiens
tccaggagcttcttgtttccttg

SEQ ID NO: 1532291 - DNA, 17 bp, Homo sapiens
tccaggaggcagtggac

SEQ ID NO: 1532292 - DNA, 14 bp, Homo sapiens
tccaggatcctgca

SEQ ID NO: 1532293 - DNA, 16 bp, Homo sapiens
tccaggatcctgcagg

SEQ ID NO: 1532294 - DNA, 19 bp, Homo sapiens
tccaggattttaatttcag

SEQ ID NO: 1532295 - DNA, 15 bp, Homo sapiens
tccaggcaaaaggag

SEQ ID NO: 1532296 - DNA, 16 bp, Homo sapiens
tccaggcacagctgag

SEQ ID NO: 1532297 - DNA, 12 bp, Homo sapiens
tccaggcagaag

SEQ ID NO: 1532298 - DNA, 15 bp, Homo sapiens
tccaggcagatccag

SEQ ID NO: 1532299 - DNA, 20 bp, Homo sapiens
tccaggcagatccaggacta

SEQ ID NO: 1532300 - DNA, 21 bp, Homo sapiens
tccaggcagatccaggactat

SEQ ID NO: 1532301 - DNA, 15 bp, Homo sapiens
tccaggcagcctctg

SEQ ID NO: 1532302 - DNA, 18 bp, Homo sapiens
tccaggcagctccctcct

SEQ ID NO: 1532303 - DNA, 19 bp, Homo sapiens
tccaggcagctccctcctg

SEQ ID NO: 1532304 - DNA, 14 bp, Homo sapiens
tccaggcaggccag

SEQ ID NO: 1532305 - DNA, 15 bp, Homo sapiens
tccaggcaggccagg

SEQ ID NO: 1532306 - DNA, 23 bp, Homo sapiens
tccaggcagtcgggggctggcct

SEQ ID NO: 1532307 - DNA, 14 bp, Homo sapiens
tccaggccactgtg

SEQ ID NO: 1532308 - DNA, 21 bp, Homo sapiens
tccaggccactgtggccagag

SEQ ID NO: 1532309 - DNA, 23 bp, Homo sapiens
tccaggccactgtggccagagct

SEQ ID NO: 1532310 - DNA, 22 bp, Homo sapiens
tccaggccagggctcctgtggc

SEQ ID NO: 1532311 - DNA, 15 bp, Homo sapiens
tccaggcccaaggct

SEQ ID NO: 1532312 - DNA, 17 bp, Homo sapiens
tccaggcccaaggctcc

SEQ ID NO: 1532313 - DNA, 19 bp, Homo sapiens
tccaggcccaaggctcccg

SEQ ID NO: 1532314 - DNA, 16 bp, Homo sapiens
tccaggcccctgagga

SEQ ID NO: 1532315 - DNA, 20 bp, Homo sapiens
tccaggccgcgccctttccc

SEQ ID NO: 1532316 - DNA, 14 bp, Homo sapiens
tccaggcctgacca

SEQ ID NO: 1532317 - DNA, 16 bp, Homo sapiens
tccaggcctgatcttg

SEQ ID NO: 1532318 - DNA, 14 bp, Homo sapiens
tccaggcctgcagg

SEQ ID NO: 1532319 - DNA, 13 bp, Homo sapiens
tccaggcctgcct

SEQ ID NO: 1532320 - DNA, 17 bp, Homo sapiens
tccaggcctgcctccca

SEQ ID NO: 1532321 - DNA, 19 bp, Homo sapiens
tccaggcctgcctcccact

SEQ ID NO: 1532322 - DNA, 23 bp, Homo sapiens
tccaggcgtgggacgtggtcagg

SEQ ID NO: 1532323 - DNA, 19 bp, Homo sapiens
tccaggctatgtataaaat

SEQ ID NO: 1532324 - DNA, 14 bp, Homo sapiens
tccaggctcttcct

SEQ ID NO: 1532325 - DNA, 20 bp, Homo sapiens
tccaggctttgtacagagtg

SEQ ID NO: 1532326 - DNA, 18 bp, Homo sapiens
tccagggaagctggccga

SEQ ID NO: 1532327 - DNA, 14 bp, Homo sapiens
tccagggaatccaa

SEQ ID NO: 1532328 - DNA, 18 bp, Homo sapiens
tccagggaatccaagcct

SEQ ID NO: 1532329 - DNA, 19 bp, Homo sapiens
tccagggaatccaagcctc

SEQ ID NO: 1532330 - DNA, 22 bp, Homo sapiens
tccagggaccactgggtgagag

SEQ ID NO: 1532331 - DNA, 18 bp, Homo sapiens
tccagggaggcgatgcca

SEQ ID NO: 1532332 - DNA, 23 bp, Homo sapiens
tccagggaggcgatgccagcctt

SEQ ID NO: 1532333 - DNA, 11 bp, Homo sapiens
tccagggaggg

SEQ ID NO: 1532334 - DNA, 18 bp, Homo sapiens
tccagggagtcccctccc

SEQ ID NO: 1532335 - DNA, 17 bp, Homo sapiens
tccagggatggagatgg

SEQ ID NO: 1532336 - DNA, 14 bp, Homo sapiens
tccagggcagcagc

SEQ ID NO: 1532337 - DNA, 15 bp, Homo sapiens
tccagggcagcagcc

SEQ ID NO: 1532338 - DNA, 19 bp, Homo sapiens
tccagggcattgctcagcc

SEQ ID NO: 1532339 - DNA, 15 bp, Homo sapiens
ccagggacccccaga

SEQ ID NO: 1532340 - DNA, 22 bp, Homo sapiens
ccagggagcctttggttctggc

SEQ ID NO: 1532341 - DNA, 17 bp, Homo sapiens
ccagggagctctgggga

SEQ ID NO: 1532342 - DNA, 23 bp, Homo sapiens
ccagggagctctggggacagctt

SEQ ID NO: 1532343 - DNA, 13 bp, Homo sapiens
ccagggaggagag

SEQ ID NO: 1532344 - DNA, 14 bp, Homo sapiens
ccagggaggagagg

SEQ ID NO: 1532345 - DNA, 13 bp, Homo sapiens
ccagggagtcccc

SEQ ID NO: 1532346 - DNA, 20 bp, Homo sapiens
ccagggatgctgggctgggc

SEQ ID NO: 1532347 - DNA, 21 bp, Homo sapiens
ccagggatgctgggctgggcc

SEQ ID NO: 1532348 - DNA, 23 bp, Homo sapiens
ccagggatgctgggctgggccct

SEQ ID NO: 1532349 - DNA, 22 bp, Homo sapiens
ccagggcaagggttaaggcctg

SEQ ID NO: 1532350 - DNA, 14 bp, Homo sapiens
ccagggcagcaagg

SEQ ID NO: 1532351 - DNA, 13 bp, Homo sapiens
ccagggcagcagc

SEQ ID NO: 1532352 - DNA, 15 bp, Homo sapiens
ccagggcattgctca

SEQ ID NO: 1532353 - DNA, 17 bp, Homo sapiens
ccagggcattgctcagc

SEQ ID NO: 1532354 - DNA, 18 bp, Homo sapiens
ccagggcattgctcagcc

SEQ ID NO: 1532355 - DNA, 20 bp, Homo sapiens
ccagggcattgctcagcccg

SEQ ID NO: 1532356 - DNA, 14 bp, Homo sapiens
ccagggccacgctc

SEQ ID NO: 1532357 - DNA, 19 bp, Homo sapiens
ccagggccacgtgccaggc

SEQ ID NO: 1532358 - DNA, 19 bp, Homo sapiens
ccagggccactctgcctct

SEQ ID NO: 1532359 - DNA, 14 bp, Homo sapiens
ccagggccagggcc

SEQ ID NO: 1532360 - DNA, 17 bp, Homo sapiens
ccagggcccaggcaaat

SEQ ID NO: 1532361 - DNA, 16 bp, Homo sapiens
ccagggcccccacagg

SEQ ID NO: 1532362 - DNA, 17 bp, Homo sapiens
ccagggcccccacaggc

SEQ ID NO: 1532363 - DNA, 12 bp, Homo sapiens
ccagggcccctc

SEQ ID NO: 1532364 - DNA, 22 bp, Homo sapiens
ccagggcccctcaccctgcctt

SEQ ID NO: 1532365 - DNA, 18 bp, Homo sapiens
ccagggccctaggcccct

SEQ ID NO: 1532366 - DNA, 13 bp, Homo sapiens
ccagggccctccc

SEQ ID NO: 1532367 - DNA, 16 bp, Homo sapiens
ccagggccctcccagc

SEQ ID NO: 1532368 - DNA, 18 bp, Homo sapiens
ccagggccctcccagccc

SEQ ID NO: 1532369 - DNA, 15 bp, Homo sapiens
ccagggccctgcaga

SEQ ID NO: 1532370 - DNA, 20 bp, Homo sapiens
ccagggccgcggccgcccgc

SEQ ID NO: 1532371 - DNA, 12 bp, Homo sapiens
ccagggcctcca

SEQ ID NO: 1532372 - DNA, 16 bp, Homo sapiens
ccagggcctccagggc

SEQ ID NO: 1532373 - DNA, 16 bp, Homo sapiens
tcacacccatttaaaa

SEQ ID NO: 1532374 - DNA, 23 bp, Homo sapiens
tcacaccgttcgtacgcccagga

SEQ ID NO: 1532375 - DNA, 17 bp, Homo sapiens
tcacacctcagtgggaa

SEQ ID NO: 1532376 - DNA, 18 bp, Homo sapiens
tcacacctcagtgggaag

SEQ ID NO: 1532377 - DNA, 20 bp, Homo sapiens
tcacacctgaactgaacacc

SEQ ID NO: 1532378 - DNA, 17 bp, Homo sapiens
tcacacctgactctgaa

SEQ ID NO: 1532379 - DNA, 19 bp, Homo sapiens
tcacacctgactctgaaat

SEQ ID NO: 1532380 - DNA, 20 bp, Homo sapiens
tcacacgtttaatcccagca

SEQ ID NO: 1532381 - DNA, 21 bp, Homo sapiens
tcacactgagaatgtaagaac

SEQ ID NO: 1532382 - DNA, 18 bp, Homo sapiens
tcacactgcgcaggtctc

SEQ ID NO: 1532383 - DNA, 23 bp, Homo sapiens
tcacactgcgcaggtctcttctg

SEQ ID NO: 1532384 - DNA, 19 bp, Homo sapiens
tcacactggccacaaggac

SEQ ID NO: 1532385 - DNA, 16 bp, Homo sapiens
tcacactgggtggtgg

SEQ ID NO: 1532386 - DNA, 15 bp, Homo sapiens
tcacactgtcttccc

SEQ ID NO: 1532387 - DNA, 17 bp, Homo sapiens
tcacactgtcttcccga

SEQ ID NO: 1532388 - DNA, 20 bp, Homo sapiens
tcacacttccaccagcctgc

SEQ ID NO: 1532389 - DNA, 14 bp, Homo sapiens
tcacagaaaaagca

SEQ ID NO: 1532390 - DNA, 16 bp, Homo sapiens
tcacagaaaaagcatg

SEQ ID NO: 1532391 - DNA, 14 bp, Homo sapiens
tcacagaaatcaga

SEQ ID NO: 1532392 - DNA, 15 bp, Homo sapiens
tcacagacctggagc

SEQ ID NO: 1532393 - DNA, 20 bp, Homo sapiens
tcacagacctggagcccctg

SEQ ID NO: 1532394 - DNA, 11 bp, Homo sapiens
tcacagagaag

SEQ ID NO: 1532395 - DNA, 17 bp, Homo sapiens
tcacagagcacgcctgc

SEQ ID NO: 1532396 - DNA, 18 bp, Homo sapiens
tcacagagcacgcctgcc

SEQ ID NO: 1532397 - DNA, 19 bp, Homo sapiens
tcacagagcacgcctgcca

SEQ ID NO: 1532398 - DNA, 21 bp, Homo sapiens
tcacagagcacgcctgccatc

SEQ ID NO: 1532399 - DNA, 15 bp, Homo sapiens
tcacagagctttccg

SEQ ID NO: 1532400 - DNA, 12 bp, Homo sapiens
tcacagaggctt

SEQ ID NO: 1532401 - DNA, 17 bp, Homo sapiens
ccaatgcattggcctct

SEQ ID NO: 1532402 - DNA, 18 bp, Homo sapiens
ccaatgccccactggcag

SEQ ID NO: 1532403 - DNA, 22 bp, Homo sapiens
ccaatgcctgtgaagcagtcag

SEQ ID NO: 1532404 - DNA, 15 bp, Homo sapiens
ccaatgcctttttag

SEQ ID NO: 1532405 - DNA, 23 bp, Homo sapiens
ccaatgcggcccactttcctgag

SEQ ID NO: 1532406 - DNA, 24 bp, Homo sapiens
ccaatgctttgggaggccaaggca

SEQ ID NO: 1532407 - DNA, 18 bp, Homo sapiens
ccaatggggccagcactg

SEQ ID NO: 1532408 - DNA, 20 bp, Homo sapiens
ccaatgggtttttccctgta

SEQ ID NO: 1532409 - DNA, 17 bp, Homo sapiens
ccaatgtatgtgtggct

SEQ ID NO: 1532410 - DNA, 16 bp, Homo sapiens
ccaattagtttccttt

SEQ ID NO: 1532411 - DNA, 20 bp, Homo sapiens
ccaattagtttcctttttaa

SEQ ID NO: 1532412 - DNA, 22 bp, Homo sapiens
ccaattatatgagacgtttttg

SEQ ID NO: 1532413 - DNA, 16 bp, Homo sapiens
ccaattatcatctttt

SEQ ID NO: 1532414 - DNA, 21 bp, Homo sapiens
ccaattcaaccctttgcccca

SEQ ID NO: 1532415 - DNA, 12 bp, Homo sapiens
ccaattctaaat

SEQ ID NO: 1532416 - DNA, 17 bp, Homo sapiens
ccaattctggacagaca

SEQ ID NO: 1532417 - DNA, 16 bp, Homo sapiens
ccaattgaaaagtgtt

SEQ ID NO: 1532418 - DNA, 15 bp, Homo sapiens
ccaattgtcaaatta

SEQ ID NO: 1532419 - DNA, 13 bp, Homo sapiens
ccaattgtgctgc

SEQ ID NO: 1532420 - DNA, 15 bp, Homo sapiens
ccaattgtgctgcca

SEQ ID NO: 1532421 - DNA, 16 bp, Homo sapiens
ccaattgtgctgccat

SEQ ID NO: 1532422 - DNA, 19 bp, Homo sapiens
ccaatttcaagttccaagt

SEQ ID NO: 1532423 - DNA, 16 bp, Homo sapiens
ccaatttcagactccc

SEQ ID NO: 1532424 - DNA, 11 bp, Homo sapiens
ccaatttcccc

SEQ ID NO: 1532425 - DNA, 11 bp, Homo sapiens
ccaatttcctc

SEQ ID NO: 1532426 - DNA, 21 bp, Homo sapiens
ccaatttcctctccactgctg

SEQ ID NO: 1532427 - DNA, 23 bp, Homo sapiens
ccaatttcctctccactgctgga

SEQ ID NO: 1532428 - DNA, 14 bp, Homo sapiens
ccaatttgtaagta

SEQ ID NO: 1532429 - DNA, 20 bp, Homo sapiens
ccaattttaaaaaataacat

SEQ ID NO: 1532430 - DNA, 22 bp, Homo sapiens
ccacaaaaacaggtatatactt

SEQ ID NO: 1532431 - DNA, 16 bp, Homo sapiens
ccacaaaccctgctga

SEQ ID NO: 1532432 - DNA, 17 bp, Homo sapiens
ccacaaacggagcccct

SEQ ID NO: 1532433 - DNA, 18 bp, Homo sapiens
ccacaaacggagcccctg

SEQ ID NO: 1532434 - DNA, 20 bp, Homo sapiens
ccacaaacggagcccctgaa

SEQ ID NO: 1532435 - DNA, 19 bp, Homo sapiens
ccacaaagcattttcattt

SEQ ID NO: 1532436 - DNA, 21 bp, Homo sapiens
ccacaaatcaaagcaagggct

SEQ ID NO: 1532437 - DNA, 23 bp, Homo sapiens
ccacaaatcaaagcaagggctcc

SEQ ID NO: 1532438 - DNA, 12 bp, Homo sapiens
ccacaactgaca

SEQ ID NO: 1532439 - DNA, 17 bp, Homo sapiens
ccacaactgacacagga

SEQ ID NO: 1532440 - DNA, 18 bp, Homo sapiens
ccacaagattcccagaga

SEQ ID NO: 1532441 - DNA, 21 bp, Homo sapiens
ccacaagattcccagagacag

SEQ ID NO: 1532442 - DNA, 15 bp, Homo sapiens
ccacaagctgtccct

SEQ ID NO: 1532443 - DNA, 18 bp, Homo sapiens
ccacaagctgtccctgca

SEQ ID NO: 1532444 - DNA, 19 bp, Homo sapiens
ccacaagctgtccctgcag

SEQ ID NO: 1532445 - DNA, 15 bp, Homo sapiens
ccacaaggaaaagga

SEQ ID NO: 1532446 - DNA, 17 bp, Homo sapiens
ccacaaggaaaaggagg

SEQ ID NO: 1532447 - DNA, 24 bp, Homo sapiens
ccacaaggaataaatgagagggaa

SEQ ID NO: 1532448 - DNA, 21 bp, Homo sapiens
ccacaaggacttcctgtccag

SEQ ID NO: 1532449 - DNA, 15 bp, Homo sapiens
ccacaagttaaataa

SEQ ID NO: 1532450 - DNA, 13 bp, Homo sapiens
ccacaatctggct

SEQ ID NO: 1532451 - DNA, 20 bp, Homo sapiens
ccacacaacaccaggactta

SEQ ID NO: 1532452 - DNA, 23 bp, Homo sapiens
ccacacacacccacacactcgcc

SEQ ID NO: 1532453 - DNA, 18 bp, Homo sapiens
ccacacacagaggaagag

SEQ ID NO: 1532454 - DNA, 22 bp, Homo sapiens
ccacacacagaggaagagcagg

SEQ ID NO: 1532455 - DNA, 15 bp, Homo sapiens
ccacacactcgcccg

SEQ ID NO: 1532456 - DNA, 15 bp, Homo sapiens
ccacacactttccat

SEQ ID NO: 1532457 - DNA, 18 bp, Homo sapiens
ccacacactttccatctc

SEQ ID NO: 1532458 - DNA, 21 bp, Homo sapiens
ccacacactttccatctctgc

SEQ ID NO: 1532459 - DNA, 15 bp, Homo sapiens
ccacacagaatgcaa

SEQ ID NO: 1532460 - DNA, 19 bp, Homo sapiens
ccacacagcagtgtcccct

SEQ ID NO: 1532461 - DNA, 14 bp, Homo sapiens
ccacacagctgccc

SEQ ID NO: 1532462 - DNA, 13 bp, Homo sapiens
ccacacagggcac

SEQ ID NO: 1532463 - DNA, 15 bp, Homo sapiens
ccacacagggcactg

SEQ ID NO: 1532464 - DNA, 14 bp, Homo sapiens
ccacaccaacactg

SEQ ID NO: 1532465 - DNA, 14 bp, Homo sapiens
ccacaccaaccagg

SEQ ID NO: 1532466 - DNA, 16 bp, Homo sapiens
ccacaccagcctcctg

SEQ ID NO: 1532467 - DNA, 15 bp, Homo sapiens
ccacaccctctccca

SEQ ID NO: 1532468 - DNA, 14 bp, Homo sapiens
ccacaccgcagaag

SEQ ID NO: 1532469 - DNA, 18 bp, Homo sapiens
ccacaccgctggtccctg

SEQ ID NO: 1532470 - DNA, 23 bp, Homo sapiens
ccacaccgctggtccctgccctc

SEQ ID NO: 1532471 - DNA, 18 bp, Homo sapiens
ccacacctcagttccctt

SEQ ID NO: 1532472 - DNA, 19 bp, Homo sapiens
ccacacctcagttcccttg

SEQ ID NO: 1532473 - DNA, 14 bp, Homo sapiens
ccacacctccctga

SEQ ID NO: 1532474 - DNA, 12 bp, Homo sapiens
ccacacctgagc

SEQ ID NO: 1532475 - DNA, 19 bp, Homo sapiens
ccacacctgagcgctgtgg

SEQ ID NO: 1532476 - DNA, 13 bp, Homo sapiens
ccacacctgcagt

SEQ ID NO: 1532477 - DNA, 17 bp, Homo sapiens
ccacacctgcagtgcca

SEQ ID NO: 1532478 - DNA, 12 bp, Homo sapiens
ccacacctgcct

SEQ ID NO: 1532479 - DNA, 14 bp, Homo sapiens
ccacacctggcctt

SEQ ID NO: 1532480 - DNA, 16 bp, Homo sapiens
ccacacctggccttaa

SEQ ID NO: 1532481 - DNA, 22 bp, Homo sapiens
ccacacctggccttaaagaggg

SEQ ID NO: 1532482 - DNA, 15 bp, Homo sapiens
ccacaccttccaggg

SEQ ID NO: 1532483 - DNA, 18 bp, Homo sapiens
ccacaccttccagggccc

SEQ ID NO: 1532484 - DNA, 22 bp, Homo sapiens
ccacaccttccagggccctagg

SEQ ID NO: 1532485 - DNA, 15 bp, Homo sapiens
ccacacgtggctggc

SEQ ID NO: 1532486 - DNA, 16 bp, Homo sapiens
ccacactaacctgggt

SEQ ID NO: 1532487 - DNA, 14 bp, Homo sapiens
ccacactacacagc

SEQ ID NO: 1532488 - DNA, 16 bp, Homo sapiens
ccacactacacagcac

SEQ ID NO: 1532489 - DNA, 11 bp, Homo sapiens
ccacactccac

SEQ ID NO: 1532490 - DNA, 13 bp, Homo sapiens
ccacactccactc

SEQ ID NO: 1532491 - DNA, 14 bp, Homo sapiens
ccacactccactct

SEQ ID NO: 1532492 - DNA, 12 bp, Homo sapiens
tcaccaccccct

SEQ ID NO: 1532493 - DNA, 17 bp, Homo sapiens
tcaccaccccctgtccc

SEQ ID NO: 1532494 - DNA, 14 bp, Homo sapiens
tcaccacccttcca

SEQ ID NO: 1532495 - DNA, 13 bp, Homo sapiens
tcaccaccgcctc

SEQ ID NO: 1532496 - DNA, 15 bp, Homo sapiens
tcaccaccgcctctg

SEQ ID NO: 1532497 - DNA, 20 bp, Homo sapiens
tcaccaccgcctctggccgc

SEQ ID NO: 1532498 - DNA, 15 bp, Homo sapiens
tcaccaccttcccag

SEQ ID NO: 1532499 - DNA, 18 bp, Homo sapiens
tcaccaccttcccagctc

SEQ ID NO: 1532500 - DNA, 18 bp, Homo sapiens
tcaccacgactggccagg

SEQ ID NO: 1532501 - DNA, 21 bp, Homo sapiens
tcaccagagcccatgctcaac

SEQ ID NO: 1532502 - DNA, 20 bp, Homo sapiens
tcaccagagcttctctgggc

SEQ ID NO: 1532503 - DNA, 22 bp, Homo sapiens
tcaccagagcttctctgggctg

SEQ ID NO: 1532504 - DNA, 15 bp, Homo sapiens
tcaccagatttgcta

SEQ ID NO: 1532505 - DNA, 13 bp, Homo sapiens
tcaccagcaacat

SEQ ID NO: 1532506 - DNA, 21 bp, Homo sapiens
tcaccagcaacatctcgagcc

SEQ ID NO: 1532507 - DNA, 13 bp, Homo sapiens
tcaccagcagcat

SEQ ID NO: 1532508 - DNA, 22 bp, Homo sapiens
tcaccagccccactgccagcag

SEQ ID NO: 1532509 - DNA, 23 bp, Homo sapiens
tcaccagccccactgccagcagc

SEQ ID NO: 1532510 - DNA, 12 bp, Homo sapiens
tcaccaggcctg

SEQ ID NO: 1532511 - DNA, 14 bp, Homo sapiens
tcaccaggcctggc

SEQ ID NO: 1532512 - DNA, 17 bp, Homo sapiens
tcaccaggcctggcctc

SEQ ID NO: 1532513 - DNA, 19 bp, Homo sapiens
tcaccaggcctggcctctg

SEQ ID NO: 1532514 - DNA, 22 bp, Homo sapiens
tcaccaggcctggcctctgggc

SEQ ID NO: 1532515 - DNA, 14 bp, Homo sapiens
tcaccatacccagc

SEQ ID NO: 1532516 - DNA, 15 bp, Homo sapiens
ccaagctctctgcat

SEQ ID NO: 1532517 - DNA, 15 bp, Homo sapiens
ccaagctgagtttcc

SEQ ID NO: 1532518 - DNA, 14 bp, Homo sapiens
ccaagctgttttct

SEQ ID NO: 1532519 - DNA, 12 bp, Homo sapiens
ccaagcttcaga

SEQ ID NO: 1532520 - DNA, 16 bp, Homo sapiens
ccaagcttcagagcct

SEQ ID NO: 1532521 - DNA, 17 bp, Homo sapiens
ccaagcttcagagccta

SEQ ID NO: 1532522 - DNA, 20 bp, Homo sapiens
ccaagcttcagagcctagcc

SEQ ID NO: 1532523 - DNA, 12 bp, Homo sapiens
ccaagcttccct

SEQ ID NO: 1532524 - DNA, 16 bp, Homo sapiens
ccaagcttggcagccg

SEQ ID NO: 1532525 - DNA, 17 bp, Homo sapiens
ccaagcttggcagccga

SEQ ID NO: 1532526 - DNA, 23 bp, Homo sapiens
ccaagcttgtccaacccgaggcc

SEQ ID NO: 1532527 - DNA, 15 bp, Homo sapiens
ccaaggactgagggc

SEQ ID NO: 1532528 - DNA, 13 bp, Homo sapiens
ccaaggagaccaa

SEQ ID NO: 1532529 - DNA, 21 bp, Homo sapiens
ccaaggaggaaaaacagacaa

SEQ ID NO: 1532530 - DNA, 15 bp, Homo sapiens
ccaaggcaaggcagg

SEQ ID NO: 1532531 - DNA, 15 bp, Homo sapiens
ccaaggcagaggcct

SEQ ID NO: 1532532 - DNA, 21 bp, Homo sapiens
ccaaggcagaggcctgggctg

SEQ ID NO: 1532533 - DNA, 22 bp, Homo sapiens
ccaaggcagaggcctgggctgg

SEQ ID NO: 1532534 - DNA, 13 bp, Homo sapiens
ccaaggcagcctc

SEQ ID NO: 1532535 - DNA, 19 bp, Homo sapiens
ccaaggcagcctccagagc

SEQ ID NO: 1532536 - DNA, 22 bp, Homo sapiens
ccaaggcagcctccagagccag

SEQ ID NO: 1532537 - DNA, 23 bp, Homo sapiens
ccaaggcagcctccagagccagc

SEQ ID NO: 1532538 - DNA, 15 bp, Homo sapiens
ccaaggcagcgaccc

SEQ ID NO: 1532539 - DNA, 17 bp, Homo sapiens
ccaaggcagcgacccca

SEQ ID NO: 1532540 - DNA, 19 bp, Homo sapiens
ccaaggccagagtggcctg

SEQ ID NO: 1532541 - DNA, 11 bp, Homo sapiens
ccaaggccagt

SEQ ID NO: 1532542 - DNA, 18 bp, Homo sapiens
ccaaggccgaagctctgg

SEQ ID NO: 1532543 - DNA, 22 bp, Homo sapiens
ccaaggccgccagcgtgtggag

SEQ ID NO: 1532544 - DNA, 23 bp, Homo sapiens
ccaaggccgccagcgtgtggagc

SEQ ID NO: 1532545 - DNA, 12 bp, Homo sapiens
ccaaggcctctc

SEQ ID NO: 1532546 - DNA, 19 bp, Homo sapiens
ccaaggcctctctctgcct

SEQ ID NO: 1532547 - DNA, 22 bp, Homo sapiens
ccaagggacagcaagtgagcag

SEQ ID NO: 1532548 - DNA, 20 bp, Homo sapiens
ccaagggacaggagaagaga

SEQ ID NO: 1532549 - DNA, 18 bp, Homo sapiens
ccaagggcccagaccctg

SEQ ID NO: 1532550 - DNA, 11 bp, Homo sapiens
ccaagggcccc

SEQ ID NO: 1532551 - DNA, 12 bp, Homo sapiens
ccaagggccgtg

SEQ ID NO: 1532552 - DNA, 20 bp, Homo sapiens
ccaagggcttctgcaccctc

SEQ ID NO: 1532553 - DNA, 21 bp, Homo sapiens
ccaagggcttctgcaccctcc

SEQ ID NO: 1532554 - DNA, 18 bp, Homo sapiens
ccaaggggtgggccacag

SEQ ID NO: 1532555 - DNA, 21 bp, Homo sapiens
ccaagggtttcgactggtcca

SEQ ID NO: 1532556 - DNA, 14 bp, Homo sapiens
ccaaggtcctctca

SEQ ID NO: 1532557 - DNA, 16 bp, Homo sapiens
ccaaggtcctctcagt

SEQ ID NO: 1532558 - DNA, 15 bp, Homo sapiens
ccaaggtgccaccac

SEQ ID NO: 1532559 - DNA, 12 bp, Homo sapiens
ccaaggtgctgg

SEQ ID NO: 1532560 - DNA, 16 bp, Homo sapiens
ccaaggtggagggaag

SEQ ID NO: 1532561 - DNA, 19 bp, Homo sapiens
ccaaggtggagggaaggat

SEQ ID NO: 1532562 - DNA, 17 bp, Homo sapiens
ccaaggtgggctgagcc

SEQ ID NO: 1532563 - DNA, 20 bp, Homo sapiens
ccaaggtttaaagagtctag

SEQ ID NO: 1532564 - DNA, 21 bp, Homo sapiens
ccaaggttttataaggctgat

SEQ ID NO: 1532565 - DNA, 18 bp, Homo sapiens
ccaagtaaacagggtacc

SEQ ID NO: 1532566 - DNA, 20 bp, Homo sapiens
ccaagtagctgggattacag

SEQ ID NO: 1532567 - DNA, 13 bp, Homo sapiens
ccaagtatgcctt

SEQ ID NO: 1532568 - DNA, 20 bp, Homo sapiens
ccaagtatgccttaagcaga

SEQ ID NO: 1532569 - DNA, 13 bp, Homo sapiens
ccaagtattttgc

SEQ ID NO: 1532570 - DNA, 20 bp, Homo sapiens
ccaagtcacacgcttttgaa

SEQ ID NO: 1532571 - DNA, 13 bp, Homo sapiens
ccaagtcccaccc

SEQ ID NO: 1532572 - DNA, 13 bp, Homo sapiens
ccaagtccctgtt

SEQ ID NO: 1532573 - DNA, 15 bp, Homo sapiens
ccaagtcctgaagag

SEQ ID NO: 1532574 - DNA, 20 bp, Homo sapiens
ccaagtcctgaagaggcggg

SEQ ID NO: 1532575 - DNA, 14 bp, Homo sapiens
ccaagtctaatgaa

SEQ ID NO: 1532576 - DNA, 17 bp, Homo sapiens
ccaagtctaatgaagag

SEQ ID NO: 1532577 - DNA, 13 bp, Homo sapiens
ccaagtcttctcc

SEQ ID NO: 1532578 - DNA, 19 bp, Homo sapiens
ccaagtctttcttcttttt

SEQ ID NO: 1532579 - DNA, 18 bp, Homo sapiens
ccaagtgaacactagcca

SEQ ID NO: 1532580 - DNA, 23 bp, Homo sapiens
ccaagtgatccttccacctcagt

SEQ ID NO: 1532581 - DNA, 16 bp, Homo sapiens
ccaagtgcactttcta

SEQ ID NO: 1532582 - DNA, 21 bp, Homo sapiens
ccaagtgccagaggtgggcag

SEQ ID NO: 1532583 - DNA, 23 bp, Homo sapiens
ccaagtgccagaggtgggcaggt

SEQ ID NO: 1532584 - DNA, 16 bp, Homo sapiens
ccaagtgccagtcttg

SEQ ID NO: 1532585 - DNA, 23 bp, Homo sapiens
ccaagtgctggcccacccagtcc

SEQ ID NO: 1532586 - DNA, 16 bp, Homo sapiens
ccaagtggtccagcgt

SEQ ID NO: 1532587 - DNA, 20 bp, Homo sapiens
ccaagtggtccagcgtcact

SEQ ID NO: 1532588 - DNA, 22 bp, Homo sapiens
ccaagttataaatcaatgtcac

SEQ ID NO: 1532589 - DNA, 16 bp, Homo sapiens
ccaagttgctgtcact

SEQ ID NO: 1532590 - DNA, 17 bp, Homo sapiens
ccaagttgctgtcactg

SEQ ID NO: 1532591 - DNA, 17 bp, Homo sapiens
ccaagttgtgcttgagc

SEQ ID NO: 1532592 - DNA, 17 bp, Homo sapiens
ccaagtttccatagcaa

SEQ ID NO: 1532593 - DNA, 22 bp, Homo sapiens
ccaataaaagctcttctttttt

SEQ ID NO: 1532594 - DNA, 14 bp, Homo sapiens
ccaataaaagtgac

SEQ ID NO: 1532595 - DNA, 21 bp, Homo sapiens
ccaataaaagtgactctcagc

SEQ ID NO: 1532596 - DNA, 16 bp, Homo sapiens
ccaataaacagctccc

SEQ ID NO: 1532597 - DNA, 17 bp, Homo sapiens
tcaagttgtgcttgttt

SEQ ID NO: 1532598 - DNA, 22 bp, Homo sapiens
tcaagttgtgcttgtttacagc

SEQ ID NO: 1532599 - DNA, 19 bp, Homo sapiens
tcaagttgttgactgtgat

SEQ ID NO: 1532600 - DNA, 20 bp, Homo sapiens
tcaagttgttgactgtgatt

SEQ ID NO: 1532601 - DNA, 19 bp, Homo sapiens
tcaataaaaaaaagaaatg

SEQ ID NO: 1532602 - DNA, 16 bp, Homo sapiens
tcaataaaatgtgatt

SEQ ID NO: 1532603 - DNA, 19 bp, Homo sapiens
tcaataaaatgtgattttt

SEQ ID NO: 1532604 - DNA, 17 bp, Homo sapiens
tcaataaacaacagctg

SEQ ID NO: 1532605 - DNA, 18 bp, Homo sapiens
tcaataaacaacagctga

SEQ ID NO: 1532606 - DNA, 21 bp, Homo sapiens
tcaataaacagcttcatgcct

SEQ ID NO: 1532607 - DNA, 15 bp, Homo sapiens
tcaataaagtaccct

SEQ ID NO: 1532608 - DNA, 15 bp, Homo sapiens
tcaataccgctcagt

SEQ ID NO: 1532609 - DNA, 18 bp, Homo sapiens
tcaataccgctcagtatt

SEQ ID NO: 1532610 - DNA, 17 bp, Homo sapiens
tcaatagctttgtagtt

SEQ ID NO: 1532611 - DNA, 19 bp, Homo sapiens
tcaatagtaaaagataaca

SEQ ID NO: 1532612 - DNA, 14 bp, Homo sapiens
tcaatagtaatata

SEQ ID NO: 1532613 - DNA, 20 bp, Homo sapiens
tcaatatattgaacttttgt

SEQ ID NO: 1532614 - DNA, 22 bp, Homo sapiens
tcaatatattgaacttttgtac

SEQ ID NO: 1532615 - DNA, 15 bp, Homo sapiens
tcaatatcagctttg

SEQ ID NO: 1532616 - DNA, 15 bp, Homo sapiens
tcaatatgaatctat

SEQ ID NO: 1532617 - DNA, 21 bp, Homo sapiens
tcaatattaaatacagacact

SEQ ID NO: 1532618 - DNA, 19 bp, Homo sapiens
tcaatattgacatttgtag

SEQ ID NO: 1532619 - DNA, 12 bp, Homo sapiens
tcaatatttatt

SEQ ID NO: 1532620 - DNA, 21 bp, Homo sapiens
tcaatcaaataagtatttata

SEQ ID NO: 1532621 - DNA, 17 bp, Homo sapiens
tcaatcaactttactgt

SEQ ID NO: 1532622 - DNA, 11 bp, Homo sapiens
tcaatcactgt

SEQ ID NO: 1532623 - DNA, 14 bp, Homo sapiens
tcaatcagtataat

SEQ ID NO: 1532624 - DNA, 16 bp, Homo sapiens
tcaatcagtgcagtga

SEQ ID NO: 1532625 - DNA, 13 bp, Homo sapiens
tcaatcatttcta

SEQ ID NO: 1532626 - DNA, 16 bp, Homo sapiens
tcaatcatttctatta

SEQ ID NO: 1532627 - DNA, 17 bp, Homo sapiens
tcaatcccctcattcag

SEQ ID NO: 1532628 - DNA, 22 bp, Homo sapiens
tcaatcctgggcaatcagacac

SEQ ID NO: 1532629 - DNA, 19 bp, Homo sapiens
tcaatctctgttctgctcc

SEQ ID NO: 1532630 - DNA, 16 bp, Homo sapiens
tcaatctgtttttcat

SEQ ID NO: 1532631 - DNA, 14 bp, Homo sapiens
tcaggaacagaagg

SEQ ID NO: 1532632 - DNA, 16 bp, Homo sapiens
tcaggaacagaaggat

SEQ ID NO: 1532633 - DNA, 15 bp, Homo sapiens
tcaggaagaaatcac

SEQ ID NO: 1532634 - DNA, 13 bp, Homo sapiens
tcaggaagaacac

SEQ ID NO: 1532635 - DNA, 19 bp, Homo sapiens
ccactgtggcgttctgctg

SEQ ID NO: 1532636 - DNA, 13 bp, Homo sapiens
ccactgtggtggc

SEQ ID NO: 1532637 - DNA, 12 bp, Homo sapiens
ccactgtgtata

SEQ ID NO: 1532638 - DNA, 21 bp, Homo sapiens
ccactgttctgaaaggagaca

SEQ ID NO: 1532639 - DNA, 17 bp, Homo sapiens
ccactgtttctcttgag

SEQ ID NO: 1532640 - DNA, 19 bp, Homo sapiens
ccactgtttctcttgagct

SEQ ID NO: 1532641 - DNA, 21 bp, Homo sapiens
ccactgtttctcttgagctgg

SEQ ID NO: 1532642 - DNA, 16 bp, Homo sapiens
ccacttaaaaaatgtc

SEQ ID NO: 1532643 - DNA, 17 bp, Homo sapiens
ccacttaaaaaatgtcc

SEQ ID NO: 1532644 - DNA, 22 bp, Homo sapiens
ccacttattccccattcttcct

SEQ ID NO: 1532645 - DNA, 15 bp, Homo sapiens
ccacttcaaccccca

SEQ ID NO: 1532646 - DNA, 19 bp, Homo sapiens
ccacttcacccccaacttc

SEQ ID NO: 1532647 - DNA, 24 bp, Homo sapiens
ccacttcacccccaacttcaccac

SEQ ID NO: 1532648 - DNA, 12 bp, Homo sapiens
ccacttcactgt

SEQ ID NO: 1532649 - DNA, 14 bp, Homo sapiens
ccacttcactgtga

SEQ ID NO: 1532650 - DNA, 23 bp, Homo sapiens
ccacttcattcttgaaagctgtg

SEQ ID NO: 1532651 - DNA, 19 bp, Homo sapiens
ccacttccaggggaacctg

SEQ ID NO: 1532652 - DNA, 14 bp, Homo sapiens
ccacttctgtgcca

SEQ ID NO: 1532653 - DNA, 15 bp, Homo sapiens
ccacttgacattcct

SEQ ID NO: 1532654 - DNA, 21 bp, Homo sapiens
ccacttgacattccttgtcac

SEQ ID NO: 1532655 - DNA, 14 bp, Homo sapiens
ccacttgaggcctg

SEQ ID NO: 1532656 - DNA, 19 bp, Homo sapiens
ccacttgaggcctgatctg

SEQ ID NO: 1532657 - DNA, 22 bp, Homo sapiens
ccacttgaggcctgatctgccc

SEQ ID NO: 1532658 - DNA, 16 bp, Homo sapiens
ccacttgattgagaaa

SEQ ID NO: 1532659 - DNA, 16 bp, Homo sapiens
ccacttgcctcttcct

SEQ ID NO: 1532660 - DNA, 22 bp, Homo sapiens
ccacttgcctcttccttgaaga

SEQ ID NO: 1532661 - DNA, 19 bp, Homo sapiens
ccacttgtcaaagaaggtg

SEQ ID NO: 1532662 - DNA, 14 bp, Homo sapiens
ccacttgtttgcac

SEQ ID NO: 1532663 - DNA, 15 bp, Homo sapiens
ccacttgtttgcact

SEQ ID NO: 1532664 - DNA, 19 bp, Homo sapiens
ccactttacccacctagaa

SEQ ID NO: 1532665 - DNA, 19 bp, Homo sapiens
ccactttcaagctgcactg

SEQ ID NO: 1532666 - DNA, 19 bp, Homo sapiens
ccactttgaagggcaagaa

SEQ ID NO: 1532667 - DNA, 17 bp, Homo sapiens
ccactttggctgaacta

SEQ ID NO: 1532668 - DNA, 22 bp, Homo sapiens
ccactttggcttctcctgtgac

SEQ ID NO: 1532669 - DNA, 13 bp, Homo sapiens
ccactttgtccat

SEQ ID NO: 1532670 - DNA, 22 bp, Homo sapiens
ccactttgtttcgtggggaggt

SEQ ID NO: 1532671 - DNA, 12 bp, Homo sapiens
ccactttttaac

SEQ ID NO: 1532672 - DNA, 20 bp, Homo sapiens
ccactttttttttttctgcc

SEQ ID NO: 1532673 - DNA, 16 bp, Homo sapiens
ccagaaaacctccagt

SEQ ID NO: 1532674 - DNA, 18 bp, Homo sapiens
ccagaaaatgtaaggcaa

SEQ ID NO: 1532675 - DNA, 18 bp, Homo sapiens
ccagaaacacccctctgt

SEQ ID NO: 1532676 - DNA, 22 bp, Homo sapiens
ccagaaacatctctggcccaga

SEQ ID NO: 1532677 - DNA, 15 bp, Homo sapiens
ccagaaagcctctct

SEQ ID NO: 1532678 - DNA, 23 bp, Homo sapiens
ccagaaagcctctctctccctcc

SEQ ID NO: 1532679 - DNA, 23 bp, Homo sapiens
ccagaaaggatatttaagaaaat

SEQ ID NO: 1532680 - DNA, 21 bp, Homo sapiens
ccagaaataaagttggtgaca

SEQ ID NO: 1532681 - DNA, 18 bp, Homo sapiens
ccagaaattctggcccag

SEQ ID NO: 1532682 - DNA, 19 bp, Homo sapiens
ccagaaccaccccggcccc

SEQ ID NO: 1532683 - DNA, 14 bp, Homo sapiens
ccagaacctgtcct

SEQ ID NO: 1532684 - DNA, 21 bp, Homo sapiens
ccagaacgtggtttgcctgag

SEQ ID NO: 1532685 - DNA, 22 bp, Homo sapiens
ccagaagaagagaagctgctga

SEQ ID NO: 1532686 - DNA, 16 bp, Homo sapiens
ccagaagaatattcag

SEQ ID NO: 1532687 - DNA, 17 bp, Homo sapiens
ccagaagatgccagctt

SEQ ID NO: 1532688 - DNA, 19 bp, Homo sapiens
ccagaagatgccagcttct

SEQ ID NO: 1532689 - DNA, 12 bp, Homo sapiens
ccagaagcctct

SEQ ID NO: 1532690 - DNA, 13 bp, Homo sapiens
ccagaagctgctc

SEQ ID NO: 1532691 - DNA, 23 bp, Homo sapiens
ccagaagctgttgggagaaagca

SEQ ID NO: 1532692 - DNA, 16 bp, Homo sapiens
ccagaagcttccatag

SEQ ID NO: 1532693 - DNA, 16 bp, Homo sapiens
ccagaagtaccagact

SEQ ID NO: 1532694 - DNA, 21 bp, Homo sapiens
ccagaagtcctccctcctgca

SEQ ID NO: 1532695 - DNA, 18 bp, Homo sapiens
ccagaatccataaatgtg

SEQ ID NO: 1532696 - DNA, 16 bp, Homo sapiens
ccagaatgagacatcc

SEQ ID NO: 1532697 - DNA, 14 bp, Homo sapiens
ccagaatgctgggt

SEQ ID NO: 1532698 - DNA, 17 bp, Homo sapiens
ccagaatggagtctttt

SEQ ID NO: 1532699 - DNA, 12 bp, Homo sapiens
ccagaattccct

SEQ ID NO: 1532700 - DNA, 17 bp, Homo sapiens
ccagaattgcagttcag

SEQ ID NO: 1532701 - DNA, 19 bp, Homo sapiens
ccagaatttaccatcatct

SEQ ID NO: 1532702 - DNA, 21 bp, Homo sapiens
ccagaatttaccatcatctct

SEQ ID NO: 1532703 - DNA, 21 bp, Homo sapiens
ccagaatttattagtttaaaa

SEQ ID NO: 1532704 - DNA, 15 bp, Homo sapiens
ccagacacaggccct

SEQ ID NO: 1532705 - DNA, 19 bp, Homo sapiens
ccagacacaggccctccct

SEQ ID NO: 1532706 - DNA, 12 bp, Homo sapiens
ccagacacatgg

SEQ ID NO: 1532707 - DNA, 17 bp, Homo sapiens
ccagacaccatgtgcaa

SEQ ID NO: 1532708 - DNA, 23 bp, Homo sapiens
ccagacactgaccatccactcta

SEQ ID NO: 1532709 - DNA, 20 bp, Homo sapiens
ccagacagctccctctgcct

SEQ ID NO: 1532710 - DNA, 22 bp, Homo sapiens
ccagacagtggatatgacccac

SEQ ID NO: 1532711 - DNA, 22 bp, Homo sapiens
ccagacatacgaaacacaaacc

SEQ ID NO: 1532712 - DNA, 20 bp, Homo sapiens
ccagacatgccacaaggact

SEQ ID NO: 1532713 - DNA, 14 bp, Homo sapiens
ccagacatggtgtc

SEQ ID NO: 1532714 - DNA, 15 bp, Homo sapiens
ccagaccccacgctg

SEQ ID NO: 1532715 - DNA, 19 bp, Homo sapiens
ccagacccctctggccagg

SEQ ID NO: 1532716 - DNA, 22 bp, Homo sapiens
ccagacccctctggccaggatg

SEQ ID NO: 1532717 - DNA, 24 bp, Homo sapiens
ccagacccctctggccaggatgga

SEQ ID NO: 1532718 - DNA, 15 bp, Homo sapiens
ccagacccctggctt

SEQ ID NO: 1532719 - DNA, 24 bp, Homo sapiens
ccagacccctggcttttcactgct

SEQ ID NO: 1532720 - DNA, 21 bp, Homo sapiens
ccagaccctgaagatttcaga

SEQ ID NO: 1532721 - DNA, 12 bp, Homo sapiens
ccagaccctgcc

SEQ ID NO: 1532722 - DNA, 13 bp, Homo sapiens
ccagaccctgcct

SEQ ID NO: 1532723 - DNA, 16 bp, Homo sapiens
ccagaccctgcctgag

SEQ ID NO: 1532724 - DNA, 18 bp, Homo sapiens
ccagaccctgcctgagcc

SEQ ID NO: 1532725 - DNA, 12 bp, Homo sapiens
ccagaccctggg

SEQ ID NO: 1532726 - DNA, 22 bp, Homo sapiens
ccagacctggaagaacaggcct

SEQ ID NO: 1532727 - DNA, 20 bp, Homo sapiens
ccagacctggctccactctt

SEQ ID NO: 1532728 - DNA, 21 bp, Homo sapiens
ccagacgcatagactgaggta

SEQ ID NO: 1532729 - DNA, 19 bp, Homo sapiens
ccagacggttcaccagcct

SEQ ID NO: 1532730 - DNA, 22 bp, Homo sapiens
ccagactagatggacctgcctg

SEQ ID NO: 1532731 - DNA, 22 bp, Homo sapiens
ccagactcaaacggaggaagcc

SEQ ID NO: 1532732 - DNA, 15 bp, Homo sapiens
ccagactcagagacc

SEQ ID NO: 1532733 - DNA, 22 bp, Homo sapiens
ccagactcagagctctctctac

SEQ ID NO: 1532734 - DNA, 23 bp, Homo sapiens
ccagactcagagctctctctaca

SEQ ID NO: 1532735 - DNA, 17 bp, Homo sapiens
ccagactcaggttccag

SEQ ID NO: 1532736 - DNA, 19 bp, Homo sapiens
ccagactcaggttccagaa

SEQ ID NO: 1532737 - DNA, 13 bp, Homo sapiens
ccagactcttgcc

SEQ ID NO: 1532738 - DNA, 15 bp, Homo sapiens
ccagactcttgcctg

SEQ ID NO: 1532739 - DNA, 17 bp, Homo sapiens
ccagactctttttttga

SEQ ID NO: 1532740 - DNA, 19 bp, Homo sapiens
ccagactgagctctccagg

SEQ ID NO: 1532741 - DNA, 22 bp, Homo sapiens
ccagactgagctctccaggcca

SEQ ID NO: 1532742 - DNA, 22 bp, Homo sapiens
ccagactgcttccaattttctg

SEQ ID NO: 1532743 - DNA, 18 bp, Homo sapiens
ccagactgggcccaggca

SEQ ID NO: 1532744 - DNA, 18 bp, Homo sapiens
ccagactgtctccacggc

SEQ ID NO: 1532745 - DNA, 13 bp, Homo sapiens
ccagacttccttg

SEQ ID NO: 1532746 - DNA, 15 bp, Homo sapiens
ccagacttccttgag

SEQ ID NO: 1532747 - DNA, 16 bp, Homo sapiens
ccagagaaaggggagc

SEQ ID NO: 1532748 - DNA, 22 bp, Homo sapiens
tcagtaacccccttaaatttaa

SEQ ID NO: 1532749 - DNA, 13 bp, Homo sapiens
tcagtaataactc

SEQ ID NO: 1532750 - DNA, 22 bp, Homo sapiens
tcagtaatgcagtttttaaaaa

SEQ ID NO: 1532751 - DNA, 18 bp, Homo sapiens
tcagtaatttgaggacaa

SEQ ID NO: 1532752 - DNA, 17 bp, Homo sapiens
tcagtaccctctcagct

SEQ ID NO: 1532753 - DNA, 16 bp, Homo sapiens
tcagtacgatcaagtt

SEQ ID NO: 1532754 - DNA, 20 bp, Homo sapiens
tcagtacttgtgaaacacag

SEQ ID NO: 1532755 - DNA, 22 bp, Homo sapiens
tcagtacttgtgaaacacagct

SEQ ID NO: 1532756 - DNA, 24 bp, Homo sapiens
tcagtacttgtgaaacacagctgt

SEQ ID NO: 1532757 - DNA, 15 bp, Homo sapiens
tcagtagaattacca

SEQ ID NO: 1532758 - DNA, 19 bp, Homo sapiens
tcagtagctgaacctgtct

SEQ ID NO: 1532759 - DNA, 15 bp, Homo sapiens
tcagtagtttcatgt

SEQ ID NO: 1532760 - DNA, 14 bp, Homo sapiens
tcagtagtttgcat

SEQ ID NO: 1532761 - DNA, 22 bp, Homo sapiens
tcagtatgctttccctgaggaa

SEQ ID NO: 1532762 - DNA, 23 bp, Homo sapiens
tcagtatgtccccataagacaaa

SEQ ID NO: 1532763 - DNA, 12 bp, Homo sapiens
tcagtatgtgga

SEQ ID NO: 1532764 - DNA, 21 bp, Homo sapiens
tcagtattaaaggggggaggg

SEQ ID NO: 1532765 - DNA, 22 bp, Homo sapiens
tcagtattaaaggggggagggg

SEQ ID NO: 1532766 - DNA, 17 bp, Homo sapiens
tcagtattctgacatgt

SEQ ID NO: 1532767 - DNA, 19 bp, Homo sapiens
tcagtcagtgcaaatgtca

SEQ ID NO: 1532768 - DNA, 13 bp, Homo sapiens
tcagtcagttccc

SEQ ID NO: 1532769 - DNA, 15 bp, Homo sapiens
tcagtcagttcccgg

SEQ ID NO: 1532770 - DNA, 23 bp, Homo sapiens
tcagtcagttcccggagcacagc

SEQ ID NO: 1532771 - DNA, 18 bp, Homo sapiens
tcagtcatcaaagcagaa

SEQ ID NO: 1532772 - DNA, 21 bp, Homo sapiens
tcagtcatcaaagcagaagtc

SEQ ID NO: 1532773 - DNA, 12 bp, Homo sapiens
tcagtccactgt

SEQ ID NO: 1532774 - DNA, 17 bp, Homo sapiens
tcagtcccatcagagag

SEQ ID NO: 1532775 - DNA, 21 bp, Homo sapiens
tcagtcccccaccacactgaa

SEQ ID NO: 1532776 - DNA, 14 bp, Homo sapiens
tcagtcccctccca

SEQ ID NO: 1532777 - DNA, 18 bp, Homo sapiens
tcagtcccctcccatctg

SEQ ID NO: 1532778 - DNA, 16 bp, Homo sapiens
tcagtccctatgtatt

SEQ ID NO: 1532779 - DNA, 17 bp, Homo sapiens
tcagtccctatgtattt

SEQ ID NO: 1532780 - DNA, 18 bp, Homo sapiens
tcagtccctatgtatttg

SEQ ID NO: 1532781 - DNA, 16 bp, Homo sapiens
tcagtccgcctggccg

SEQ ID NO: 1532782 - DNA, 19 bp, Homo sapiens
tcagtcgttgtgctttttt

SEQ ID NO: 1532783 - DNA, 14 bp, Homo sapiens
tcagtcgttttagt

SEQ ID NO: 1532784 - DNA, 17 bp, Homo sapiens
tcagtctaaggtctcat

SEQ ID NO: 1532785 - DNA, 17 bp, Homo sapiens
tcagtctcacagagaag

SEQ ID NO: 1532786 - DNA, 14 bp, Homo sapiens
tcagtctcagctgc

SEQ ID NO: 1532787 - DNA, 22 bp, Homo sapiens
tcagtctcccagctaattgaga

SEQ ID NO: 1532788 - DNA, 18 bp, Homo sapiens
tcagtctctataccaata

SEQ ID NO: 1532789 - DNA, 20 bp, Homo sapiens
tcagtctctataccaataaa

SEQ ID NO: 1532790 - DNA, 23 bp, Homo sapiens
tcagtctctataccaataaagtg

SEQ ID NO: 1532791 - DNA, 13 bp, Homo sapiens
tcagtctgctcca

SEQ ID NO: 1532792 - DNA, 16 bp, Homo sapiens
tcagtctgctccacca

SEQ ID NO: 1532793 - DNA, 20 bp, Homo sapiens
tcagtcttctctcactttga

SEQ ID NO: 1532794 - DNA, 13 bp, Homo sapiens
tcagtcttctgga

SEQ ID NO: 1532795 - DNA, 12 bp, Homo sapiens
tcagtcttgtag

SEQ ID NO: 1532796 - DNA, 12 bp, Homo sapiens
tcagtctttgct

SEQ ID NO: 1532797 - DNA, 24 bp, Homo sapiens
tcagtctttgctcagtgtccagct

SEQ ID NO: 1532798 - DNA, 21 bp, Homo sapiens
tcagtgaagaaccctatttaa

SEQ ID NO: 1532799 - DNA, 19 bp, Homo sapiens
tcagtgaagatgctgtaaa

SEQ ID NO: 1532800 - DNA, 19 bp, Homo sapiens
tcagtgaatatttttgtat

SEQ ID NO: 1532801 - DNA, 21 bp, Homo sapiens
tcagtgaatatttttgtattt

SEQ ID NO: 1532802 - DNA, 23 bp, Homo sapiens
tcagtgacatcaaagcctggcct

SEQ ID NO: 1532803 - DNA, 14 bp, Homo sapiens
tcagtgactcctgc

SEQ ID NO: 1532804 - DNA, 16 bp, Homo sapiens
tcagtgactcctgctg

SEQ ID NO: 1532805 - DNA, 16 bp, Homo sapiens
tcagtgagctggggcc

SEQ ID NO: 1532806 - DNA, 22 bp, Homo sapiens
tcagtgaggagggatgtgggta

SEQ ID NO: 1532807 - DNA, 17 bp, Homo sapiens
tcagtgattttcaaacc

SEQ ID NO: 1532808 - DNA, 21 bp, Homo sapiens
tcagtgcagtgatacatgtac

SEQ ID NO: 1532809 - DNA, 13 bp, Homo sapiens
tcagtgcagtttc

SEQ ID NO: 1532810 - DNA, 14 bp, Homo sapiens
tcagtgccacttga

SEQ ID NO: 1532811 - DNA, 17 bp, Homo sapiens
tcagtgccacttgacat

SEQ ID NO: 1532812 - DNA, 14 bp, Homo sapiens
tcagtgccttcctc

SEQ ID NO: 1532813 - DNA, 19 bp, Homo sapiens
tcagtgccttctctcagct

SEQ ID NO: 1532814 - DNA, 22 bp, Homo sapiens
tcagtgccttctctcagctccc

SEQ ID NO: 1532815 - DNA, 15 bp, Homo sapiens
tcagtgctacatttt

SEQ ID NO: 1532816 - DNA, 19 bp, Homo sapiens
tcagtgctataaatgccag

SEQ ID NO: 1532817 - DNA, 18 bp, Homo sapiens
tcagtgctcgagacacag

SEQ ID NO: 1532818 - DNA, 13 bp, Homo sapiens
tcagtgctctcag

SEQ ID NO: 1532819 - DNA, 16 bp, Homo sapiens
tcagtgctctcagctg

SEQ ID NO: 1532820 - DNA, 19 bp, Homo sapiens
tcagtgctgtggcctgggc

SEQ ID NO: 1532821 - DNA, 12 bp, Homo sapiens
tcagtggagcct

SEQ ID NO: 1532822 - DNA, 11 bp, Homo sapiens
tcagtggatca

SEQ ID NO: 1532823 - DNA, 12 bp, Homo sapiens
tcagtggcttcc

SEQ ID NO: 1532824 - DNA, 15 bp, Homo sapiens
tcagtgggaacgtga

SEQ ID NO: 1532825 - DNA, 23 bp, Homo sapiens
tcagtgggaacgtgactgcccca

SEQ ID NO: 1532826 - DNA, 15 bp, Homo sapiens
tcagtggggcagcct

SEQ ID NO: 1532827 - DNA, 14 bp, Homo sapiens
tcagtggtgggaga

SEQ ID NO: 1532828 - DNA, 14 bp, Homo sapiens
tcagtgtaaagtgt

SEQ ID NO: 1532829 - DNA, 16 bp, Homo sapiens
tcagtgtaagccctgc

SEQ ID NO: 1532830 - DNA, 17 bp, Homo sapiens
tcagtgtaatgtgactt

SEQ ID NO: 1532831 - DNA, 18 bp, Homo sapiens
tcagtgtacacgtctgga

SEQ ID NO: 1532832 - DNA, 21 bp, Homo sapiens
tcagtgtccagcttccaaagc

SEQ ID NO: 1532833 - DNA, 13 bp, Homo sapiens
tcagtgttaaaaa

SEQ ID NO: 1532834 - DNA, 23 bp, Homo sapiens
tcagtgttaaaaaatttttgaaa

SEQ ID NO: 1532835 - DNA, 16 bp, Homo sapiens
tcagtgttagagaaat

SEQ ID NO: 1532836 - DNA, 20 bp, Homo sapiens
tcagtgttccctttcctact

SEQ ID NO: 1532837 - DNA, 18 bp, Homo sapiens
tcagtgttgttgctctag

SEQ ID NO: 1532838 - DNA, 12 bp, Homo sapiens
tcagtgtttcat

SEQ ID NO: 1532839 - DNA, 15 bp, Homo sapiens
tcagtgttttggact

SEQ ID NO: 1532840 - DNA, 18 bp, Homo sapiens
tcagttaaggaagatcct

SEQ ID NO: 1532841 - DNA, 18 bp, Homo sapiens
tcagttaattcttagata

SEQ ID NO: 1532842 - DNA, 14 bp, Homo sapiens
tcagttactcagcc

SEQ ID NO: 1532843 - DNA, 19 bp, Homo sapiens
tcagttcattgtggtcctt

SEQ ID NO: 1532844 - DNA, 17 bp, Homo sapiens
tcagttcccaccatctg

SEQ ID NO: 1532845 - DNA, 18 bp, Homo sapiens
tcagttcgaccaaactca

SEQ ID NO: 1532846 - DNA, 14 bp, Homo sapiens
tcagttgtgttttt

SEQ ID NO: 1532847 - DNA, 15 bp, Homo sapiens
tcagtttaatccttc

SEQ ID NO: 1532848 - DNA, 16 bp, Homo sapiens
tcagtttaatccttct

SEQ ID NO: 1532849 - DNA, 19 bp, Homo sapiens
tcagtttcacagaaaataa

SEQ ID NO: 1532850 - DNA, 21 bp, Homo sapiens
tcagtttccgaatctctttcc

SEQ ID NO: 1532851 - DNA, 16 bp, Homo sapiens
tcagtttgttggaaag

SEQ ID NO: 1532852 - DNA, 17 bp, Homo sapiens
tcagttttatcattttc

SEQ ID NO: 1532853 - DNA, 19 bp, Homo sapiens
tcagttttatcattttcaa

SEQ ID NO: 1532854 - DNA, 14 bp, Homo sapiens
tcagttttatcttt

SEQ ID NO: 1532855 - DNA, 15 bp, Homo sapiens
tcagtttttcatttg

SEQ ID NO: 1532856 - DNA, 18 bp, Homo sapiens
tcagttttttgttttaca

SEQ ID NO: 1532857 - DNA, 17 bp, Homo sapiens
tcataaaaataaccaaa

SEQ ID NO: 1532858 - DNA, 21 bp, Homo sapiens
tcataaaataaagtatatata

SEQ ID NO: 1532859 - DNA, 17 bp, Homo sapiens
tcataaaatgaaacttt

SEQ ID NO: 1532860 - DNA, 21 bp, Homo sapiens
tcataaataaaggtgtagaaa

SEQ ID NO: 1532861 - DNA, 22 bp, Homo sapiens
tcataaatactgtcaaacaata

SEQ ID NO: 1532862 - DNA, 12 bp, Homo sapiens
tcataaatgaag

SEQ ID NO: 1532863 - DNA, 15 bp, Homo sapiens
tcataacttgctgaa

SEQ ID NO: 1532864 - DNA, 15 bp, Homo sapiens
tcataaggcttcaaa

SEQ ID NO: 1532865 - DNA, 22 bp, Homo sapiens
ccagagaaggacggtgccaagg

SEQ ID NO: 1532866 - DNA, 13 bp, Homo sapiens
ccagagacaggga

SEQ ID NO: 1532867 - DNA, 20 bp, Homo sapiens
ccagagacatacttgaaggg

SEQ ID NO: 1532868 - DNA, 17 bp, Homo sapiens
ccagagacatgggcctc

SEQ ID NO: 1532869 - DNA, 16 bp, Homo sapiens
ccagagaggaatcaga

SEQ ID NO: 1532870 - DNA, 16 bp, Homo sapiens
ccagagaggagcacct

SEQ ID NO: 1532871 - DNA, 20 bp, Homo sapiens
ccagagagggcccagctgta

SEQ ID NO: 1532872 - DNA, 17 bp, Homo sapiens
ccagagatgcctccacc

SEQ ID NO: 1532873 - DNA, 20 bp, Homo sapiens
ccagagatgcctccaccgct

SEQ ID NO: 1532874 - DNA, 19 bp, Homo sapiens
ccagagcaaccagaaggag

SEQ ID NO: 1532875 - DNA, 23 bp, Homo sapiens
ccagagcaccccctgctccacca

SEQ ID NO: 1532876 - DNA, 14 bp, Homo sapiens
ccagagcaggagcc

SEQ ID NO: 1532877 - DNA, 14 bp, Homo sapiens
ccagagcaggaggc

SEQ ID NO: 1532878 - DNA, 23 bp, Homo sapiens
ccagagcaggaggcccctggccc

SEQ ID NO: 1532879 - DNA, 20 bp, Homo sapiens
ccagagcatttccaacacca

SEQ ID NO: 1532880 - DNA, 22 bp, Homo sapiens
ccagagcatttccaacaccaca

SEQ ID NO: 1532881 - DNA, 23 bp, Homo sapiens
ccagagcatttccaacaccacag

SEQ ID NO: 1532882 - DNA, 14 bp, Homo sapiens
ccagagccaacctg

SEQ ID NO: 1532883 - DNA, 12 bp, Homo sapiens
ccagagccagat

SEQ ID NO: 1532884 - DNA, 16 bp, Homo sapiens
ccagagccagatgcag

SEQ ID NO: 1532885 - DNA, 22 bp, Homo sapiens
ccagagccagatgcaggacagg

SEQ ID NO: 1532886 - DNA, 17 bp, Homo sapiens
ccagagccagcctggga

SEQ ID NO: 1532887 - DNA, 19 bp, Homo sapiens
ccagagccagcctgggact

SEQ ID NO: 1532888 - DNA, 11 bp, Homo sapiens
ccagagccagg

SEQ ID NO: 1532889 - DNA, 23 bp, Homo sapiens
ccagagccaggggggtgaggagc

SEQ ID NO: 1532890 - DNA, 11 bp, Homo sapiens
ccagagcccag

SEQ ID NO: 1532891 - DNA, 12 bp, Homo sapiens
ccagagcccagc

SEQ ID NO: 1532892 - DNA, 13 bp, Homo sapiens
ccagagcccagct

SEQ ID NO: 1532893 - DNA, 15 bp, Homo sapiens
ccagagcccagctcc

SEQ ID NO: 1532894 - DNA, 16 bp, Homo sapiens
ccagagcccagctcca

SEQ ID NO: 1532895 - DNA, 18 bp, Homo sapiens
ccagagcccagctccaag

SEQ ID NO: 1532896 - DNA, 22 bp, Homo sapiens
ccagagcccagctcttgctctc

SEQ ID NO: 1532897 - DNA, 18 bp, Homo sapiens
ccagagccccacacggag

SEQ ID NO: 1532898 - DNA, 19 bp, Homo sapiens
ccagagccccacacggagg

SEQ ID NO: 1532899 - DNA, 21 bp, Homo sapiens
ccagagcccctcctccagccc

SEQ ID NO: 1532900 - DNA, 18 bp, Homo sapiens
ccagagcccttcactgcc

SEQ ID NO: 1532901 - DNA, 21 bp, Homo sapiens
ccagagcccttcactgccatg

SEQ ID NO: 1532902 - DNA, 22 bp, Homo sapiens
ccagagcccttcactgccatga

SEQ ID NO: 1532903 - DNA, 19 bp, Homo sapiens
ccagagcctctgctggaag

SEQ ID NO: 1532904 - DNA, 19 bp, Homo sapiens
ccagagcctggctgcccat

SEQ ID NO: 1532905 - DNA, 19 bp, Homo sapiens
ccagagcctgtctttcagc

SEQ ID NO: 1532906 - DNA, 12 bp, Homo sapiens
ccagagccttca

SEQ ID NO: 1532907 - DNA, 23 bp, Homo sapiens
ccagagcgaggaaaggattttac

SEQ ID NO: 1532908 - DNA, 14 bp, Homo sapiens
ccagagctcatccc

SEQ ID NO: 1532909 - DNA, 22 bp, Homo sapiens
ccagagctcatcccccctgctg

SEQ ID NO: 1532910 - DNA, 15 bp, Homo sapiens
ccagagctgccgact

SEQ ID NO: 1532911 - DNA, 20 bp, Homo sapiens
ccagagctggaaggcagggc

SEQ ID NO: 1532912 - DNA, 23 bp, Homo sapiens
ccagagctggaaggcagggcaga

SEQ ID NO: 1532913 - DNA, 23 bp, Homo sapiens
ccagagctgtctgaactcacgtg

SEQ ID NO: 1532914 - DNA, 18 bp, Homo sapiens
ccagagctgtgccagcag

SEQ ID NO: 1532915 - DNA, 17 bp, Homo sapiens
ccagagctgtgcctgct

SEQ ID NO: 1532916 - DNA, 19 bp, Homo sapiens
ccagagctgtgcctgctca

SEQ ID NO: 1532917 - DNA, 20 bp, Homo sapiens
ccagagctgtgcctgctcag

SEQ ID NO: 1532918 - DNA, 22 bp, Homo sapiens
ccagagctgtttatggcctcag

SEQ ID NO: 1532919 - DNA, 19 bp, Homo sapiens
ccagagcttattggccact

SEQ ID NO: 1532920 - DNA, 17 bp, Homo sapiens
ccagagcttctctgggc

SEQ ID NO: 1532921 - DNA, 18 bp, Homo sapiens
ccagagcttctctgggct

SEQ ID NO: 1532922 - DNA, 20 bp, Homo sapiens
ccagagcttctctgggctga

SEQ ID NO: 1532923 - DNA, 15 bp, Homo sapiens
ccagaggaagcccct

SEQ ID NO: 1532924 - DNA, 18 bp, Homo sapiens
ccagaggaaggaaaagga

SEQ ID NO: 1532925 - DNA, 17 bp, Homo sapiens
ccagaggaatcctggca

SEQ ID NO: 1532926 - DNA, 15 bp, Homo sapiens
ccagaggactcccaa

SEQ ID NO: 1532927 - DNA, 20 bp, Homo sapiens
ccagaggactcccaaccctg

SEQ ID NO: 1532928 - DNA, 16 bp, Homo sapiens
ccagaggagccaccag

SEQ ID NO: 1532929 - DNA, 16 bp, Homo sapiens
ccagaggagccttttt

SEQ ID NO: 1532930 - DNA, 22 bp, Homo sapiens
ccagaggagctgggagccgggc

SEQ ID NO: 1532931 - DNA, 18 bp, Homo sapiens
ccagaggatgctctttcc

SEQ ID NO: 1532932 - DNA, 11 bp, Homo sapiens
ccagaggcaga

SEQ ID NO: 1532933 - DNA, 18 bp, Homo sapiens
ccagaggcagaggttgca

SEQ ID NO: 1532934 - DNA, 18 bp, Homo sapiens
ccagaggcccccagccca

SEQ ID NO: 1532935 - DNA, 21 bp, Homo sapiens
ccagaggcccccagcccaggg

SEQ ID NO: 1532936 - DNA, 15 bp, Homo sapiens
ccagaggccctggag

SEQ ID NO: 1532937 - DNA, 16 bp, Homo sapiens
ccagaggccctggagg

SEQ ID NO: 1532938 - DNA, 16 bp, Homo sapiens
ccagaggctcccaatc

SEQ ID NO: 1532939 - DNA, 16 bp, Homo sapiens
ccagaggctgggttca

SEQ ID NO: 1532940 - DNA, 13 bp, Homo sapiens
ccagagggcagtg

SEQ ID NO: 1532941 - DNA, 13 bp, Homo sapiens
ccagagggcatgc

SEQ ID NO: 1532942 - DNA, 16 bp, Homo sapiens
ccagagggccagcagg

SEQ ID NO: 1532943 - DNA, 22 bp, Homo sapiens
ccagagggccagcaggctcctg

SEQ ID NO: 1532944 - DNA, 15 bp, Homo sapiens
ccagagggcccaggc

SEQ ID NO: 1532945 - DNA, 21 bp, Homo sapiens
ccagaggtattcctctcttaa

SEQ ID NO: 1532946 - DNA, 23 bp, Homo sapiens
ccagaggtcctccgtagggtctt

SEQ ID NO: 1532947 - DNA, 17 bp, Homo sapiens
ccagaggtcgcagctac

SEQ ID NO: 1532948 - DNA, 20 bp, Homo sapiens
ccagaggtgggatcctccct

SEQ ID NO: 1532949 - DNA, 18 bp, Homo sapiens
ccagaggtgggcaggtgg

SEQ ID NO: 1532950 - DNA, 22 bp, Homo sapiens
ccagaggtgggcaggtggtggc

SEQ ID NO: 1532951 - DNA, 19 bp, Homo sapiens
ccagaggttatctgcctgg

SEQ ID NO: 1532952 - DNA, 21 bp, Homo sapiens
ccagaggttatctgcctggcc

SEQ ID NO: 1532953 - DNA, 14 bp, Homo sapiens
ccagagtctgagcc

SEQ ID NO: 1532954 - DNA, 19 bp, Homo sapiens
ccagagtgaaagggctatg

SEQ ID NO: 1532955 - DNA, 21 bp, Homo sapiens
ccagagtgaaagggctatggc

SEQ ID NO: 1532956 - DNA, 22 bp, Homo sapiens
ccagagtgaaagggctatggca

SEQ ID NO: 1532957 - DNA, 19 bp, Homo sapiens
ccagagtgctgaggccagg

SEQ ID NO: 1532958 - DNA, 15 bp, Homo sapiens
ccagagtggagtctg

SEQ ID NO: 1532959 - DNA, 19 bp, Homo sapiens
ccagagtggagtctgagtc

SEQ ID NO: 1532960 - DNA, 13 bp, Homo sapiens
ccagagtggcctg

SEQ ID NO: 1532961 - DNA, 17 bp, Homo sapiens
ccagagtggcctggcca

SEQ ID NO: 1532962 - DNA, 12 bp, Homo sapiens
ccagagtggctg

SEQ ID NO: 1532963 - DNA, 21 bp, Homo sapiens
ccagagtgtgggaagggagag

SEQ ID NO: 1532964 - DNA, 16 bp, Homo sapiens
ccagagttaaaatgtt

SEQ ID NO: 1532965 - DNA, 20 bp, Homo sapiens
ccagagttaaaatgtttact

SEQ ID NO: 1532966 - DNA, 21 bp, Homo sapiens
ccagagttaaaatgtttactg

SEQ ID NO: 1532967 - DNA, 22 bp, Homo sapiens
ccagagttaaaatgtttactgt

SEQ ID NO: 1532968 - DNA, 17 bp, Homo sapiens
ccagagttcctgcggag

SEQ ID NO: 1532969 - DNA, 18 bp, Homo sapiens
ccagagtttttaaagcct

SEQ ID NO: 1532970 - DNA, 19 bp, Homo sapiens
ccagagtttttaaagcctt

SEQ ID NO: 1532971 - DNA, 21 bp, Homo sapiens
ccagagtttttaaagccttct

SEQ ID NO: 1532972 - DNA, 22 bp, Homo sapiens
ccagagtttttaaagccttctg

SEQ ID NO: 1532973 - DNA, 19 bp, Homo sapiens
ccagataactctctttcct

SEQ ID NO: 1532974 - DNA, 21 bp, Homo sapiens
ccagatacgggggctgtgact

SEQ ID NO: 1532975 - DNA, 14 bp, Homo sapiens
ccagatagagaaat

SEQ ID NO: 1532976 - DNA, 15 bp, Homo sapiens
ccagatataactgtc

SEQ ID NO: 1532977 - DNA, 21 bp, Homo sapiens
ccagatcaccagcccggcctg

SEQ ID NO: 1532978 - DNA, 18 bp, Homo sapiens
ccagatcactgccacact

SEQ ID NO: 1532979 - DNA, 20 bp, Homo sapiens
ccagatcactgccacactct

SEQ ID NO: 1532980 - DNA, 23 bp, Homo sapiens
tcataagttggaccagaggaagc

SEQ ID NO: 1532981 - DNA, 22 bp, Homo sapiens
tcataagtttgtttaaacactt

SEQ ID NO: 1532982 - DNA, 18 bp, Homo sapiens
tcataataaaagtgaagt

SEQ ID NO: 1532983 - DNA, 19 bp, Homo sapiens
tcataataaatatctgtac

SEQ ID NO: 1532984 - DNA, 16 bp, Homo sapiens
tcataatcagtaaata

SEQ ID NO: 1532985 - DNA, 18 bp, Homo sapiens
tcataatcagtaaatagt

SEQ ID NO: 1532986 - DNA, 21 bp, Homo sapiens
tcataatgaattataacagtt

SEQ ID NO: 1532987 - DNA, 17 bp, Homo sapiens
tcataatgcagaagtat

SEQ ID NO: 1532988 - DNA, 16 bp, Homo sapiens
tcataatgctttgtta

SEQ ID NO: 1532989 - DNA, 13 bp, Homo sapiens
tcataatgtatta

SEQ ID NO: 1532990 - DNA, 14 bp, Homo sapiens
tcataattacattc

SEQ ID NO: 1532991 - DNA, 15 bp, Homo sapiens
tcataattacattcc

SEQ ID NO: 1532992 - DNA, 13 bp, Homo sapiens
tcataattggaat

SEQ ID NO: 1532993 - DNA, 23 bp, Homo sapiens
tcataatttaaaaatctccatta

SEQ ID NO: 1532994 - DNA, 16 bp, Homo sapiens
tcatacaaactctcac

SEQ ID NO: 1532995 - DNA, 14 bp, Homo sapiens
tcataccatctgct

SEQ ID NO: 1532996 - DNA, 15 bp, Homo sapiens
tcataccatctgctg

SEQ ID NO: 1532997 - DNA, 18 bp, Homo sapiens
tcataccgcctcgtgcca

SEQ ID NO: 1532998 - DNA, 14 bp, Homo sapiens
tcatacctcagaat

SEQ ID NO: 1532999 - DNA, 13 bp, Homo sapiens
tcatagaaatatt

SEQ ID NO: 1533000 - DNA, 13 bp, Homo sapiens
tcatagaaatgta

SEQ ID NO: 1533001 - DNA, 20 bp, Homo sapiens
tcatagagatttgtctaatt

SEQ ID NO: 1533002 - DNA, 18 bp, Homo sapiens
tcatagaggtgagaaaac

SEQ ID NO: 1533003 - DNA, 23 bp, Homo sapiens
tcatagagttgattgtctagtga

SEQ ID NO: 1533004 - DNA, 18 bp, Homo sapiens
tcatagcatcctgattat

SEQ ID NO: 1533005 - DNA, 20 bp, Homo sapiens
tcataggaagggaccaaggc

SEQ ID NO: 1533006 - DNA, 15 bp, Homo sapiens
tcataggagactgcg

SEQ ID NO: 1533007 - DNA, 19 bp, Homo sapiens
tcataggcggtcatgtgtg

SEQ ID NO: 1533008 - DNA, 17 bp, Homo sapiens
tcatagggtctcttcag

SEQ ID NO: 1533009 - DNA, 20 bp, Homo sapiens
tcatagggtctcttcaggtt

SEQ ID NO: 1533010 - DNA, 22 bp, Homo sapiens
tcatagtactctttgtagcaaa

SEQ ID NO: 1533011 - DNA, 18 bp, Homo sapiens
tcatagtagtttttacag

SEQ ID NO: 1533012 - DNA, 21 bp, Homo sapiens
tcatagtataactttaaatct

SEQ ID NO: 1533013 - DNA, 22 bp, Homo sapiens
tcatagtatcttcactgtgtta

SEQ ID NO: 1533014 - DNA, 22 bp, Homo sapiens
tcatagtcttgaaatgaaaggg

SEQ ID NO: 1533015 - DNA, 16 bp, Homo sapiens
tcatataaactcattt

SEQ ID NO: 1533016 - DNA, 17 bp, Homo sapiens
tcatataaactcattta

SEQ ID NO: 1533017 - DNA, 15 bp, Homo sapiens
tcatataataaatgt

SEQ ID NO: 1533018 - DNA, 23 bp, Homo sapiens
tcatataattaaagactcaagag

SEQ ID NO: 1533019 - DNA, 15 bp, Homo sapiens
tcatatactgccatg

SEQ ID NO: 1533020 - DNA, 17 bp, Homo sapiens
tcatatattaaaacaat

SEQ ID NO: 1533021 - DNA, 13 bp, Homo sapiens
tcatatatttaag

SEQ ID NO: 1533022 - DNA, 23 bp, Homo sapiens
tcatatatttaagccttttgtgt

SEQ ID NO: 1533023 - DNA, 14 bp, Homo sapiens
tcatatctggagcc

SEQ ID NO: 1533024 - DNA, 21 bp, Homo sapiens
tcatatgaaaaaaatgcattt

SEQ ID NO: 1533025 - DNA, 15 bp, Homo sapiens
tcatatgattctgct

SEQ ID NO: 1533026 - DNA, 19 bp, Homo sapiens
tcatatgattctgctttta

SEQ ID NO: 1533027 - DNA, 20 bp, Homo sapiens
tcatatgtacttgtttgcta

SEQ ID NO: 1533028 - DNA, 13 bp, Homo sapiens
tcatattaagaca

SEQ ID NO: 1533029 - DNA, 20 bp, Homo sapiens
tcatattaagacagtgtaca

SEQ ID NO: 1533030 - DNA, 15 bp, Homo sapiens
tcatattcagcttgc

SEQ ID NO: 1533031 - DNA, 16 bp, Homo sapiens
tcatattctgtctgga

SEQ ID NO: 1533032 - DNA, 23 bp, Homo sapiens
tcatattgagatcagcattcaaa

SEQ ID NO: 1533033 - DNA, 18 bp, Homo sapiens
tcatattgtatgtaagta

SEQ ID NO: 1533034 - DNA, 14 bp, Homo sapiens
tcatatttcccctt

SEQ ID NO: 1533035 - DNA, 22 bp, Homo sapiens
tcatatttcttatcaccacagt

SEQ ID NO: 1533036 - DNA, 19 bp, Homo sapiens
tcatatttgggggctaagg

SEQ ID NO: 1533037 - DNA, 16 bp, Homo sapiens
tcatattttaaatctg

SEQ ID NO: 1533038 - DNA, 16 bp, Homo sapiens
tcatcaaatcatcatt

SEQ ID NO: 1533039 - DNA, 22 bp, Homo sapiens
tcatcaactgaatgaggtcagc

SEQ ID NO: 1533040 - DNA, 13 bp, Homo sapiens
tcatcaagaaggg

SEQ ID NO: 1533041 - DNA, 18 bp, Homo sapiens
tcatcaagaagggctgca

SEQ ID NO: 1533042 - DNA, 21 bp, Homo sapiens
tcatcaatatccctcttgtaa

SEQ ID NO: 1533043 - DNA, 22 bp, Homo sapiens
tcatcaatatccctcttgtaag

SEQ ID NO: 1533044 - DNA, 13 bp, Homo sapiens
tcatcaatcaaat

SEQ ID NO: 1533045 - DNA, 23 bp, Homo sapiens
tcatcaatcaaataagtatttat

SEQ ID NO: 1533046 - DNA, 23 bp, Homo sapiens
tcatcacatttctatgccaaaca

SEQ ID NO: 1533047 - DNA, 13 bp, Homo sapiens
tcatcaccaccct

SEQ ID NO: 1533048 - DNA, 14 bp, Homo sapiens
tcatcaccaccctt

SEQ ID NO: 1533049 - DNA, 16 bp, Homo sapiens
tcatcacctgctagaa

SEQ ID NO: 1533050 - DNA, 13 bp, Homo sapiens
tcatcactggact

SEQ ID NO: 1533051 - DNA, 16 bp, Homo sapiens
tcatcactggactgca

SEQ ID NO: 1533052 - DNA, 17 bp, Homo sapiens
tcatcactggactgcat

SEQ ID NO: 1533053 - DNA, 21 bp, Homo sapiens
tcatcactttgacctaaatta

SEQ ID NO: 1533054 - DNA, 16 bp, Homo sapiens
tcatcagatgcctgct

SEQ ID NO: 1533055 - DNA, 12 bp, Homo sapiens
tcatcagcattt

SEQ ID NO: 1533056 - DNA, 18 bp, Homo sapiens
tcatcagccaccatccta

SEQ ID NO: 1533057 - DNA, 14 bp, Homo sapiens
tcatcatattgtat

SEQ ID NO: 1533058 - DNA, 16 bp, Homo sapiens
tcatcatgaactggct

SEQ ID NO: 1533059 - DNA, 20 bp, Homo sapiens
tcatcatggaggtcatacat

SEQ ID NO: 1533060 - DNA, 16 bp, Homo sapiens
tcatcattaatgactt

SEQ ID NO: 1533061 - DNA, 15 bp, Homo sapiens
tcatcattccctctc

SEQ ID NO: 1533062 - DNA, 15 bp, Homo sapiens
tcatcattcttgtgg

SEQ ID NO: 1533063 - DNA, 17 bp, Homo sapiens
tcatcattcttgtggga

SEQ ID NO: 1533064 - DNA, 19 bp, Homo sapiens
tcatcattcttgtgggaga

SEQ ID NO: 1533065 - DNA, 22 bp, Homo sapiens
tcatcattgggctcacttctaa

SEQ ID NO: 1533066 - DNA, 22 bp, Homo sapiens
tcatcattgtttctgcatgaat

SEQ ID NO: 1533067 - DNA, 15 bp, Homo sapiens
tcatccaatcctcac

SEQ ID NO: 1533068 - DNA, 18 bp, Homo sapiens
tcatccaatcctcactgg

SEQ ID NO: 1533069 - DNA, 19 bp, Homo sapiens
tcatccaatcctcactggg

SEQ ID NO: 1533070 - DNA, 13 bp, Homo sapiens
tcatccaatgtga

SEQ ID NO: 1533071 - DNA, 14 bp, Homo sapiens
tcatccaatgtgaa

SEQ ID NO: 1533072 - DNA, 15 bp, Homo sapiens
tcatccacattgttt

SEQ ID NO: 1533073 - DNA, 20 bp, Homo sapiens
tcatccagactcagagctct

SEQ ID NO: 1533074 - DNA, 20 bp, Homo sapiens
tcatccaggcccaactgtga

SEQ ID NO: 1533075 - DNA, 18 bp, Homo sapiens
tcatccagtgttgtcatg

SEQ ID NO: 1533076 - DNA, 21 bp, Homo sapiens
tcatccccacaatctggctta

SEQ ID NO: 1533077 - DNA, 14 bp, Homo sapiens
tcatcccccctgct

SEQ ID NO: 1533078 - DNA, 16 bp, Homo sapiens
tcatcccccctgctgc

SEQ ID NO: 1533079 - DNA, 17 bp, Homo sapiens
tcatcccccctgctgcc

SEQ ID NO: 1533080 - DNA, 14 bp, Homo sapiens
tcatcccctcagaa

SEQ ID NO: 1533081 - DNA, 20 bp, Homo sapiens
tcatcccctcagaaggtctg

SEQ ID NO: 1533082 - DNA, 20 bp, Homo sapiens
tcatcccctcgtcctgtccc

SEQ ID NO: 1533083 - DNA, 14 bp, Homo sapiens
tcatcccgtatcac

SEQ ID NO: 1533084 - DNA, 21 bp, Homo sapiens
tcatccctatgggattcagtg

SEQ ID NO: 1533085 - DNA, 13 bp, Homo sapiens
tcatccctcaact

SEQ ID NO: 1533086 - DNA, 17 bp, Homo sapiens
tcatccctcaactgagg

SEQ ID NO: 1533087 - DNA, 14 bp, Homo sapiens
tcatccctttccag

SEQ ID NO: 1533088 - DNA, 14 bp, Homo sapiens
tcatccgaggcagg

SEQ ID NO: 1533089 - DNA, 15 bp, Homo sapiens
tcatccgaggcaggg

SEQ ID NO: 1533090 - DNA, 15 bp, Homo sapiens
tcatccggcagcctg

SEQ ID NO: 1533091 - DNA, 17 bp, Homo sapiens
tcatccggcagcctgga

SEQ ID NO: 1533092 - DNA, 18 bp, Homo sapiens
tcatcctcaaagaaagtg

SEQ ID NO: 1533093 - DNA, 13 bp, Homo sapiens
tcatcctcctccc

SEQ ID NO: 1533094 - DNA, 23 bp, Homo sapiens
tcatcctcctccccagctcttct

SEQ ID NO: 1533095 - DNA, 17 bp, Homo sapiens
tcatcctcttttaatgg

SEQ ID NO: 1533096 - DNA, 13 bp, Homo sapiens
ccagatccagcct

SEQ ID NO: 1533097 - DNA, 14 bp, Homo sapiens
ccagatccagcctg

SEQ ID NO: 1533098 - DNA, 15 bp, Homo sapiens
ccagatccagcctgg

SEQ ID NO: 1533099 - DNA, 12 bp, Homo sapiens
ccagatcctggg

SEQ ID NO: 1533100 - DNA, 14 bp, Homo sapiens
ccagatctcatgga

SEQ ID NO: 1533101 - DNA, 19 bp, Homo sapiens
ccagatctgcctgggcctg

SEQ ID NO: 1533102 - DNA, 22 bp, Homo sapiens
ccagatctgcctgggcctgtgc

SEQ ID NO: 1533103 - DNA, 19 bp, Homo sapiens
ccagatctggtcccttgca

SEQ ID NO: 1533104 - DNA, 16 bp, Homo sapiens
ccagatctttctcttc

SEQ ID NO: 1533105 - DNA, 16 bp, Homo sapiens
ccagatgaactgactg

SEQ ID NO: 1533106 - DNA, 21 bp, Homo sapiens
ccagatgagcagaagctctcg

SEQ ID NO: 1533107 - DNA, 22 bp, Homo sapiens
ccagatgatcccagtcactcct

SEQ ID NO: 1533108 - DNA, 14 bp, Homo sapiens
ccagatgcaggaca

SEQ ID NO: 1533109 - DNA, 18 bp, Homo sapiens
ccagatgcaggacaggag

SEQ ID NO: 1533110 - DNA, 22 bp, Homo sapiens
ccagatgcaggacaggaggcgg

SEQ ID NO: 1533111 - DNA, 20 bp, Homo sapiens
ccagatgcctccccaagact

SEQ ID NO: 1533112 - DNA, 23 bp, Homo sapiens
ccagatgccttctagattcactg

SEQ ID NO: 1533113 - DNA, 17 bp, Homo sapiens
ccagatgcgtcccaaga

SEQ ID NO: 1533114 - DNA, 21 bp, Homo sapiens
ccagatgtccgtctctcttgc

SEQ ID NO: 1533115 - DNA, 21 bp, Homo sapiens
ccagatgttgcttttgaaaag

SEQ ID NO: 1533116 - DNA, 22 bp, Homo sapiens
ccagatgttgcttttgaaaagt

SEQ ID NO: 1533117 - DNA, 15 bp, Homo sapiens
ccagattcccctgtg

SEQ ID NO: 1533118 - DNA, 16 bp, Homo sapiens
ccagattcccctgtgt

SEQ ID NO: 1533119 - DNA, 15 bp, Homo sapiens
ccagattctcttgaa

SEQ ID NO: 1533120 - DNA, 14 bp, Homo sapiens
ccagattctgatgc

SEQ ID NO: 1533121 - DNA, 13 bp, Homo sapiens
ccagattgacgac

SEQ ID NO: 1533122 - DNA, 18 bp, Homo sapiens
ccagattgacgacaagtg

SEQ ID NO: 1533123 - DNA, 17 bp, Homo sapiens
ccagattgtggtgggcc

SEQ ID NO: 1533124 - DNA, 16 bp, Homo sapiens
ccagattgtgtacata

SEQ ID NO: 1533125 - DNA, 21 bp, Homo sapiens
ccagatttgctaatttatcct

SEQ ID NO: 1533126 - DNA, 23 bp, Homo sapiens
ccagatttggggtataggtctca

SEQ ID NO: 1533127 - DNA, 12 bp, Homo sapiens
ccagatttgtct

SEQ ID NO: 1533128 - DNA, 22 bp, Homo sapiens
ccagcaacacagcctgggcccc

SEQ ID NO: 1533129 - DNA, 15 bp, Homo sapiens
ccagcaacgcccctc

SEQ ID NO: 1533130 - DNA, 14 bp, Homo sapiens
ccagcaactgccct

SEQ ID NO: 1533131 - DNA, 14 bp, Homo sapiens
ccagcaacttcttc

SEQ ID NO: 1533132 - DNA, 13 bp, Homo sapiens
ccagcaagacctc

SEQ ID NO: 1533133 - DNA, 14 bp, Homo sapiens
ccagcaagacctca

SEQ ID NO: 1533134 - DNA, 23 bp, Homo sapiens
ccagcacacacacataagcactg

SEQ ID NO: 1533135 - DNA, 14 bp, Homo sapiens
ccagcacaccaagt

SEQ ID NO: 1533136 - DNA, 17 bp, Homo sapiens
ccagcacaccgggccaa

SEQ ID NO: 1533137 - DNA, 18 bp, Homo sapiens
ccagcacagagcgtcctt

SEQ ID NO: 1533138 - DNA, 21 bp, Homo sapiens
ccagcacagagcgtccttccc

SEQ ID NO: 1533139 - DNA, 13 bp, Homo sapiens
ccagcacagcttg

SEQ ID NO: 1533140 - DNA, 17 bp, Homo sapiens
ccagcacagcttgacct

SEQ ID NO: 1533141 - DNA, 13 bp, Homo sapiens
ccagcacatgaaa

SEQ ID NO: 1533142 - DNA, 13 bp, Homo sapiens
ccagcacctgctc

SEQ ID NO: 1533143 - DNA, 14 bp, Homo sapiens
ccagcacctgctcc

SEQ ID NO: 1533144 - DNA, 18 bp, Homo sapiens
ccagcacctgctcccagt

SEQ ID NO: 1533145 - DNA, 15 bp, Homo sapiens
ccagcacctggcatc

SEQ ID NO: 1533146 - DNA, 18 bp, Homo sapiens
ccagcaccttgtgcctgg

SEQ ID NO: 1533147 - DNA, 19 bp, Homo sapiens
ccagcaccttgtgcctggg

SEQ ID NO: 1533148 - DNA, 20 bp, Homo sapiens
ccagcaccttgtgcctgggg

SEQ ID NO: 1533149 - DNA, 19 bp, Homo sapiens
ccagcactagtaaaggagg

SEQ ID NO: 1533150 - DNA, 13 bp, Homo sapiens
ccagcactgagga

SEQ ID NO: 1533151 - DNA, 14 bp, Homo sapiens
ccagcactgtgaag

SEQ ID NO: 1533152 - DNA, 15 bp, Homo sapiens
ccagcacttgtatat

SEQ ID NO: 1533153 - DNA, 14 bp, Homo sapiens
ccagcactttggga

SEQ ID NO: 1533154 - DNA, 16 bp, Homo sapiens
ccagcactttgggagg

SEQ ID NO: 1533155 - DNA, 20 bp, Homo sapiens
ccagcagaatggaggcaggg

SEQ ID NO: 1533156 - DNA, 21 bp, Homo sapiens
ccagcagacagagccaggaga

SEQ ID NO: 1533157 - DNA, 22 bp, Homo sapiens
ccagcagacagagccaggagaa

SEQ ID NO: 1533158 - DNA, 18 bp, Homo sapiens
ccagcagatcccagctca

SEQ ID NO: 1533159 - DNA, 18 bp, Homo sapiens
ccagcagcagcaggtgat

SEQ ID NO: 1533160 - DNA, 14 bp, Homo sapiens
ccagcagcctcgca

SEQ ID NO: 1533161 - DNA, 21 bp, Homo sapiens
ccagcagcctcgcacaggccc

SEQ ID NO: 1533162 - DNA, 20 bp, Homo sapiens
ccagcagcgcgcaggcctgc

SEQ ID NO: 1533163 - DNA, 23 bp, Homo sapiens
ccagcagcgcgcaggcctgcgtg

SEQ ID NO: 1533164 - DNA, 18 bp, Homo sapiens
ccagcagctgcgggtctg

SEQ ID NO: 1533165 - DNA, 14 bp, Homo sapiens
ccagcagctgtcag

SEQ ID NO: 1533166 - DNA, 14 bp, Homo sapiens
ccagcaggaagcca

SEQ ID NO: 1533167 - DNA, 20 bp, Homo sapiens
ccagcaggaagccaggctga

SEQ ID NO: 1533168 - DNA, 21 bp, Homo sapiens
ccagcaggagagactgagcag

SEQ ID NO: 1533169 - DNA, 21 bp, Homo sapiens
ccagcaggaggttctgggcct

SEQ ID NO: 1533170 - DNA, 23 bp, Homo sapiens
ccagcaggaggttctgggcctct

SEQ ID NO: 1533171 - DNA, 15 bp, Homo sapiens
ccagcaggcaggtgg

SEQ ID NO: 1533172 - DNA, 20 bp, Homo sapiens
ccagcaggccagggactcag

SEQ ID NO: 1533173 - DNA, 16 bp, Homo sapiens
ccagcaggcccagcat

SEQ ID NO: 1533174 - DNA, 23 bp, Homo sapiens
ccagcaggccggatcggtactgt

SEQ ID NO: 1533175 - DNA, 12 bp, Homo sapiens
ccagcaggctcc

SEQ ID NO: 1533176 - DNA, 15 bp, Homo sapiens
ccagcaggctcctgg

SEQ ID NO: 1533177 - DNA, 19 bp, Homo sapiens
ccagcaggctcctggctgt

SEQ ID NO: 1533178 - DNA, 22 bp, Homo sapiens
ccagcaggctcctggctgtgcc

SEQ ID NO: 1533179 - DNA, 18 bp, Homo sapiens
ccagcaggggccctcact

SEQ ID NO: 1533180 - DNA, 17 bp, Homo sapiens
ccagcaggtgtggtggc

SEQ ID NO: 1533181 - DNA, 23 bp, Homo sapiens
ccagcaggtgtggtggctcatgg

SEQ ID NO: 1533182 - DNA, 18 bp, Homo sapiens
ccagcagtgggggtcaga

SEQ ID NO: 1533183 - DNA, 14 bp, Homo sapiens
ccagcatcacctgc

SEQ ID NO: 1533184 - DNA, 15 bp, Homo sapiens
ccagcatcacctgcc

SEQ ID NO: 1533185 - DNA, 12 bp, Homo sapiens
ccagcatccctg

SEQ ID NO: 1533186 - DNA, 13 bp, Homo sapiens
ccagcatccctgg

SEQ ID NO: 1533187 - DNA, 16 bp, Homo sapiens
ccagcatccctggagc

SEQ ID NO: 1533188 - DNA, 17 bp, Homo sapiens
ccagcatccctggagca

SEQ ID NO: 1533189 - DNA, 17 bp, Homo sapiens
ccagcatcccttctgcc

SEQ ID NO: 1533190 - DNA, 19 bp, Homo sapiens
ccagcatccttttctgcag

SEQ ID NO: 1533191 - DNA, 16 bp, Homo sapiens
ccagcatggttgcaga

SEQ ID NO: 1533192 - DNA, 17 bp, Homo sapiens
ccagcattcagcacaca

SEQ ID NO: 1533193 - DNA, 18 bp, Homo sapiens
ccagcattccagcccctc

SEQ ID NO: 1533194 - DNA, 14 bp, Homo sapiens
ccagcattccagct

SEQ ID NO: 1533195 - DNA, 18 bp, Homo sapiens
ccagcattccagctctgc

SEQ ID NO: 1533196 - DNA, 18 bp, Homo sapiens
ccagcatttaagtgacct

SEQ ID NO: 1533197 - DNA, 22 bp, Homo sapiens
ccagcatttaagtgaccttctg

SEQ ID NO: 1533198 - DNA, 18 bp, Homo sapiens
ccagcatttagctggcca

SEQ ID NO: 1533199 - DNA, 24 bp, Homo sapiens
ccagcatttggttttacacaggaa

SEQ ID NO: 1533200 - DNA, 17 bp, Homo sapiens
ccagccaaaccctgtct

SEQ ID NO: 1533201 - DNA, 22 bp, Homo sapiens
ccagccaagggtcctcacccct

SEQ ID NO: 1533202 - DNA, 24 bp, Homo sapiens
ccagccaatctagaggcaagcctg

SEQ ID NO: 1533203 - DNA, 12 bp, Homo sapiens
ccagccacctag

SEQ ID NO: 1533204 - DNA, 16 bp, Homo sapiens
ccagccacgactgcca

SEQ ID NO: 1533205 - DNA, 15 bp, Homo sapiens
ccagccacgcagggc

SEQ ID NO: 1533206 - DNA, 21 bp, Homo sapiens
ccagccacggacgctggctcc

SEQ ID NO: 1533207 - DNA, 15 bp, Homo sapiens
ccagccagaagcctc

SEQ ID NO: 1533208 - DNA, 19 bp, Homo sapiens
ccagccagcagcagcccaa

SEQ ID NO: 1533209 - DNA, 23 bp, Homo sapiens
ccagccagcagccagctctcagc

SEQ ID NO: 1533210 - DNA, 19 bp, Homo sapiens
ccagccagcctcagaaggc

SEQ ID NO: 1533211 - DNA, 14 bp, Homo sapiens
ccagccagctcctg

SEQ ID NO: 1533212 - DNA, 20 bp, Homo sapiens
tcatcctggcacgccctact

SEQ ID NO: 1533213 - DNA, 19 bp, Homo sapiens
tcatcctgggatgtaaacc

SEQ ID NO: 1533214 - DNA, 15 bp, Homo sapiens
tcatccttccatcca

SEQ ID NO: 1533215 - DNA, 13 bp, Homo sapiens
tcatccttcccca

SEQ ID NO: 1533216 - DNA, 16 bp, Homo sapiens
tcatcctttgttctga

SEQ ID NO: 1533217 - DNA, 23 bp, Homo sapiens
tcatcgattcaaactgctccaag

SEQ ID NO: 1533218 - DNA, 15 bp, Homo sapiens
tcatcgccagaggtg

SEQ ID NO: 1533219 - DNA, 18 bp, Homo sapiens
tcatcgctcccaaaggaa

SEQ ID NO: 1533220 - DNA, 16 bp, Homo sapiens
tcatctaccttttctg

SEQ ID NO: 1533221 - DNA, 15 bp, Homo sapiens
tcatctatttctgag

SEQ ID NO: 1533222 - DNA, 16 bp, Homo sapiens
tcatctatttggaacc

SEQ ID NO: 1533223 - DNA, 17 bp, Homo sapiens
tcatctcagcttttctg

SEQ ID NO: 1533224 - DNA, 13 bp, Homo sapiens
tcatctcatttgt

SEQ ID NO: 1533225 - DNA, 14 bp, Homo sapiens
tcatctcatttgta

SEQ ID NO: 1533226 - DNA, 23 bp, Homo sapiens
tcatctccagggagtcccctccc

SEQ ID NO: 1533227 - DNA, 17 bp, Homo sapiens
tcatctcccctcctggc

SEQ ID NO: 1533228 - DNA, 20 bp, Homo sapiens
tcatctccctcctccaggtc

SEQ ID NO: 1533229 - DNA, 21 bp, Homo sapiens
tcatctccctcctccaggtcg

SEQ ID NO: 1533230 - DNA, 14 bp, Homo sapiens
tcatctctctgccc

SEQ ID NO: 1533231 - DNA, 19 bp, Homo sapiens
tcatctcttagctcccctc

SEQ ID NO: 1533232 - DNA, 17 bp, Homo sapiens
tcatctgactatgacat

SEQ ID NO: 1533233 - DNA, 18 bp, Homo sapiens
tcatctgactatgacata

SEQ ID NO: 1533234 - DNA, 16 bp, Homo sapiens
tcatctgagaggctct

SEQ ID NO: 1533235 - DNA, 12 bp, Homo sapiens
tcatctgaggag

SEQ ID NO: 1533236 - DNA, 13 bp, Homo sapiens
tcatctgcaaagg

SEQ ID NO: 1533237 - DNA, 14 bp, Homo sapiens
tcatctgcaaaggg

SEQ ID NO: 1533238 - DNA, 16 bp, Homo sapiens
tcatctgctctccttc

SEQ ID NO: 1533239 - DNA, 17 bp, Homo sapiens
tcatctgctctccttcc

SEQ ID NO: 1533240 - DNA, 18 bp, Homo sapiens
tcatctgctctccttcct

SEQ ID NO: 1533241 - DNA, 14 bp, Homo sapiens
tcatctgctggtcc

SEQ ID NO: 1533242 - DNA, 19 bp, Homo sapiens
tcatctgctggtccgtggg

SEQ ID NO: 1533243 - DNA, 18 bp, Homo sapiens
tcatctggattctacaaa

SEQ ID NO: 1533244 - DNA, 22 bp, Homo sapiens
tcatctgtaagagcttgctcca

SEQ ID NO: 1533245 - DNA, 13 bp, Homo sapiens
tcatctgtacata

SEQ ID NO: 1533246 - DNA, 16 bp, Homo sapiens
tcatctgtggagctgc

SEQ ID NO: 1533247 - DNA, 22 bp, Homo sapiens
tcatctgtggagctgccacaga

SEQ ID NO: 1533248 - DNA, 15 bp, Homo sapiens
tcatcttcctgtgtc

SEQ ID NO: 1533249 - DNA, 19 bp, Homo sapiens
tcatcttcctgtgtcctga

SEQ ID NO: 1533250 - DNA, 17 bp, Homo sapiens
tcatcttgcagcattta

SEQ ID NO: 1533251 - DNA, 11 bp, Homo sapiens
tcatcttgcta

SEQ ID NO: 1533252 - DNA, 18 bp, Homo sapiens
tcatcttgctaccagtat

SEQ ID NO: 1533253 - DNA, 22 bp, Homo sapiens
tcatcttgctaccagtatttag

SEQ ID NO: 1533254 - DNA, 14 bp, Homo sapiens
tcatgaaaagagga

SEQ ID NO: 1533255 - DNA, 23 bp, Homo sapiens
tcatgaaaagaggaacaggtgga

SEQ ID NO: 1533256 - DNA, 12 bp, Homo sapiens
tcatgaaaatac

SEQ ID NO: 1533257 - DNA, 16 bp, Homo sapiens
tcatgaaaataccatt

SEQ ID NO: 1533258 - DNA, 15 bp, Homo sapiens
tcatgaaatatgcat

SEQ ID NO: 1533259 - DNA, 17 bp, Homo sapiens
tcatgaactggcttgta

SEQ ID NO: 1533260 - DNA, 18 bp, Homo sapiens
tcatgaactggcttgtac

SEQ ID NO: 1533261 - DNA, 18 bp, Homo sapiens
tcatgaacttggctgtaa

SEQ ID NO: 1533262 - DNA, 11 bp, Homo sapiens
tcatgaatgtg

SEQ ID NO: 1533263 - DNA, 19 bp, Homo sapiens
tcatgaattatataatttt

SEQ ID NO: 1533264 - DNA, 19 bp, Homo sapiens
tcatgaattcccttttaat

SEQ ID NO: 1533265 - DNA, 18 bp, Homo sapiens
tcatgaattttaaagtat

SEQ ID NO: 1533266 - DNA, 19 bp, Homo sapiens
tcatgacaagatgggacag

SEQ ID NO: 1533267 - DNA, 16 bp, Homo sapiens
tcatgacaagcatttt

SEQ ID NO: 1533268 - DNA, 13 bp, Homo sapiens
tcatgacagccag

SEQ ID NO: 1533269 - DNA, 16 bp, Homo sapiens
tcatgaccagcaaata

SEQ ID NO: 1533270 - DNA, 14 bp, Homo sapiens
tcatgaccagtaaa

SEQ ID NO: 1533271 - DNA, 15 bp, Homo sapiens
tcatgagaagccaag

SEQ ID NO: 1533272 - DNA, 14 bp, Homo sapiens
tcatgagcccacca

SEQ ID NO: 1533273 - DNA, 13 bp, Homo sapiens
tcatgagcctgct

SEQ ID NO: 1533274 - DNA, 14 bp, Homo sapiens
tcatgagctgggta

SEQ ID NO: 1533275 - DNA, 14 bp, Homo sapiens
tcatgaggggagag

SEQ ID NO: 1533276 - DNA, 22 bp, Homo sapiens
tcatgatagaaggctatgggga

SEQ ID NO: 1533277 - DNA, 13 bp, Homo sapiens
tcatgatctccct

SEQ ID NO: 1533278 - DNA, 15 bp, Homo sapiens
tcatgatctccctgc

SEQ ID NO: 1533279 - DNA, 23 bp, Homo sapiens
tcatgattagaaattacctgtgg

SEQ ID NO: 1533280 - DNA, 22 bp, Homo sapiens
tcatgattatagcaactaatgt

SEQ ID NO: 1533281 - DNA, 13 bp, Homo sapiens
tcatgattcatga

SEQ ID NO: 1533282 - DNA, 20 bp, Homo sapiens
tcatgattcatgagctgggt

SEQ ID NO: 1533283 - DNA, 17 bp, Homo sapiens
tcatgatttcatttcaa

SEQ ID NO: 1533284 - DNA, 22 bp, Homo sapiens
tcatgattttaagtttctctgc

SEQ ID NO: 1533285 - DNA, 13 bp, Homo sapiens
tcatgcaatgaca

SEQ ID NO: 1533286 - DNA, 16 bp, Homo sapiens
tcatgcaatgacatct

SEQ ID NO: 1533287 - DNA, 13 bp, Homo sapiens
tcatgcagccgtg

SEQ ID NO: 1533288 - DNA, 12 bp, Homo sapiens
tcatgcagctgt

SEQ ID NO: 1533289 - DNA, 15 bp, Homo sapiens
tcatgcagttcctgg

SEQ ID NO: 1533290 - DNA, 17 bp, Homo sapiens
tcatgcatagtcccagc

SEQ ID NO: 1533291 - DNA, 15 bp, Homo sapiens
tcatgccatctgttt

SEQ ID NO: 1533292 - DNA, 18 bp, Homo sapiens
tcatgccatctgttttca

SEQ ID NO: 1533293 - DNA, 14 bp, Homo sapiens
tcatgccattctgc

SEQ ID NO: 1533294 - DNA, 17 bp, Homo sapiens
tcatgcccaagccctga

SEQ ID NO: 1533295 - DNA, 15 bp, Homo sapiens
tcatgcccaccccct

SEQ ID NO: 1533296 - DNA, 18 bp, Homo sapiens
tcatgcccaccccctgcc

SEQ ID NO: 1533297 - DNA, 16 bp, Homo sapiens
tcatgcccagctctct

SEQ ID NO: 1533298 - DNA, 20 bp, Homo sapiens
tcatgcccagctctctgacg

SEQ ID NO: 1533299 - DNA, 15 bp, Homo sapiens
tcatgccccctttca

SEQ ID NO: 1533300 - DNA, 18 bp, Homo sapiens
tcatgccccctttcagat

SEQ ID NO: 1533301 - DNA, 16 bp, Homo sapiens
tcatgcctttgtaagt

SEQ ID NO: 1533302 - DNA, 12 bp, Homo sapiens
tcatgctcagcc

SEQ ID NO: 1533303 - DNA, 13 bp, Homo sapiens
tcatgctcagcct

SEQ ID NO: 1533304 - DNA, 21 bp, Homo sapiens
tcatgctcagccttgctgctc

SEQ ID NO: 1533305 - DNA, 22 bp, Homo sapiens
tcatgctcagccttgctgctct

SEQ ID NO: 1533306 - DNA, 23 bp, Homo sapiens
tcatgctcagccttgctgctctg

SEQ ID NO: 1533307 - DNA, 20 bp, Homo sapiens
tcatgctggagggaggctgg

SEQ ID NO: 1533308 - DNA, 19 bp, Homo sapiens
tcatgctgttgctgctact

SEQ ID NO: 1533309 - DNA, 14 bp, Homo sapiens
tcatgcttgacata

SEQ ID NO: 1533310 - DNA, 20 bp, Homo sapiens
tcatggaagtggcagtgaaa

SEQ ID NO: 1533311 - DNA, 21 bp, Homo sapiens
tcatggaccaagaatgagctg

SEQ ID NO: 1533312 - DNA, 18 bp, Homo sapiens
tcatggaccagtggctgg

SEQ ID NO: 1533313 - DNA, 23 bp, Homo sapiens
tcatggaccagtggctggtctca

SEQ ID NO: 1533314 - DNA, 17 bp, Homo sapiens
tcatggcccccaggggc

SEQ ID NO: 1533315 - DNA, 16 bp, Homo sapiens
tcatggctgctgttgc

SEQ ID NO: 1533316 - DNA, 20 bp, Homo sapiens
tcatggctgcttgattttgt

SEQ ID NO: 1533317 - DNA, 15 bp, Homo sapiens
tcatggcttaatgtt

SEQ ID NO: 1533318 - DNA, 18 bp, Homo sapiens
tcatggcttaatgtttat

SEQ ID NO: 1533319 - DNA, 21 bp, Homo sapiens
tcatgggaaaagaccagggct

SEQ ID NO: 1533320 - DNA, 19 bp, Homo sapiens
tcatgggccactgcttttc

SEQ ID NO: 1533321 - DNA, 19 bp, Homo sapiens
tcatggggatcaattttca

SEQ ID NO: 1533322 - DNA, 17 bp, Homo sapiens
tcatggggtccctgctg

SEQ ID NO: 1533323 - DNA, 18 bp, Homo sapiens
tcatggggtccctgctgc

SEQ ID NO: 1533324 - DNA, 20 bp, Homo sapiens
tcatgggtcccttgaaggaa

SEQ ID NO: 1533325 - DNA, 23 bp, Homo sapiens
tcatggtgggttcaggggactca

SEQ ID NO: 1533326 - DNA, 13 bp, Homo sapiens
tcatgtaacattg

SEQ ID NO: 1533327 - DNA, 18 bp, Homo sapiens
tcatgtaccatcaataaa

SEQ ID NO: 1533328 - DNA, 16 bp, Homo sapiens
tcatgtacttcctgtg

SEQ ID NO: 1533329 - DNA, 14 bp, Homo sapiens
tcaaatatgcaaag

SEQ ID NO: 1533330 - DNA, 18 bp, Homo sapiens
tcaaatatgcaaagcact

SEQ ID NO: 1533331 - DNA, 13 bp, Homo sapiens
tcaaatcaacttt

SEQ ID NO: 1533332 - DNA, 22 bp, Homo sapiens
tcaaatcacaaggatttctcta

SEQ ID NO: 1533333 - DNA, 17 bp, Homo sapiens
tcaaatcagtgataatt

SEQ ID NO: 1533334 - DNA, 13 bp, Homo sapiens
tcaaatcatcatt

SEQ ID NO: 1533335 - DNA, 13 bp, Homo sapiens
tcaaatccagtgg

SEQ ID NO: 1533336 - DNA, 15 bp, Homo sapiens
tcaaatccagtggtg

SEQ ID NO: 1533337 - DNA, 17 bp, Homo sapiens
tcaaatccagtggtggg

SEQ ID NO: 1533338 - DNA, 18 bp, Homo sapiens
tcaaatccagtggtgggt

SEQ ID NO: 1533339 - DNA, 21 bp, Homo sapiens
tcaaatccagtggtgggtaat

SEQ ID NO: 1533340 - DNA, 17 bp, Homo sapiens
tcaaatcctcaccatcc

SEQ ID NO: 1533341 - DNA, 15 bp, Homo sapiens
tcaaatcgatttagt

SEQ ID NO: 1533342 - DNA, 15 bp, Homo sapiens
tcaaatctaccactg

SEQ ID NO: 1533343 - DNA, 15 bp, Homo sapiens
tcaaatctattcaga

SEQ ID NO: 1533344 - DNA, 13 bp, Homo sapiens
tcaaatgaaatgt

SEQ ID NO: 1533345 - DNA, 14 bp, Homo sapiens
tcaaatgaaatgta

SEQ ID NO: 1533346 - DNA, 20 bp, Homo sapiens
tcaaatgaaatgtatgcatt

SEQ ID NO: 1533347 - DNA, 22 bp, Homo sapiens
tcaaatgagtaacatttgctgt

SEQ ID NO: 1533348 - DNA, 16 bp, Homo sapiens
tcaaatgatcctccca

SEQ ID NO: 1533349 - DNA, 13 bp, Homo sapiens
tcaaatgttctaa

SEQ ID NO: 1533350 - DNA, 19 bp, Homo sapiens
tcaaatgttctaagtttct

SEQ ID NO: 1533351 - DNA, 23 bp, Homo sapiens
tcaaatgttctaagtttctaaga

SEQ ID NO: 1533352 - DNA, 19 bp, Homo sapiens
tcaaatgtttaaaccacta

SEQ ID NO: 1533353 - DNA, 17 bp, Homo sapiens
tcaaatgtttccttaaa

SEQ ID NO: 1533354 - DNA, 15 bp, Homo sapiens
tcaaattagaagaca

SEQ ID NO: 1533355 - DNA, 22 bp, Homo sapiens
tcaaattagaagacatttatac

SEQ ID NO: 1533356 - DNA, 12 bp, Homo sapiens
tcaaattgctgc

SEQ ID NO: 1533357 - DNA, 14 bp, Homo sapiens
tcaaattgctgctt

SEQ ID NO: 1533358 - DNA, 17 bp, Homo sapiens
tcaaattgctgcttgga

SEQ ID NO: 1533359 - DNA, 14 bp, Homo sapiens
tcaaattttttgac

SEQ ID NO: 1533360 - DNA, 21 bp, Homo sapiens
tcaacaaagaaacaaagatgt

SEQ ID NO: 1533361 - DNA, 22 bp, Homo sapiens
tcaacaaatattcactggcccc

SEQ ID NO: 1533362 - DNA, 19 bp, Homo sapiens
tcaacacttattttctgaa

SEQ ID NO: 1533363 - DNA, 20 bp, Homo sapiens
tcaacacttattttctgaat

SEQ ID NO: 1533364 - DNA, 14 bp, Homo sapiens
tcaacagaacatat

SEQ ID NO: 1533365 - DNA, 19 bp, Homo sapiens
tcaacagagaaggcaggaa

SEQ ID NO: 1533366 - DNA, 17 bp, Homo sapiens
tcaacagagggagttta

SEQ ID NO: 1533367 - DNA, 12 bp, Homo sapiens
tcaacagattca

SEQ ID NO: 1533368 - DNA, 21 bp, Homo sapiens
tcaacagattcagaatgagaa

SEQ ID NO: 1533369 - DNA, 17 bp, Homo sapiens
tcaacagcatgtctact

SEQ ID NO: 1533370 - DNA, 20 bp, Homo sapiens
tcaacagtaaaccactgaaa

SEQ ID NO: 1533371 - DNA, 17 bp, Homo sapiens
tcaacataccttggcca

SEQ ID NO: 1533372 - DNA, 12 bp, Homo sapiens
tcaacatctttt

SEQ ID NO: 1533373 - DNA, 19 bp, Homo sapiens
tcaacatgttactgaccag

SEQ ID NO: 1533374 - DNA, 21 bp, Homo sapiens
tcaacatgttactgaccagca

SEQ ID NO: 1533375 - DNA, 22 bp, Homo sapiens
tcaacatgttactgaccagcaa

SEQ ID NO: 1533376 - DNA, 14 bp, Homo sapiens
tcaacatttccaaa

SEQ ID NO: 1533377 - DNA, 15 bp, Homo sapiens
tcaacatttccaaaa

SEQ ID NO: 1533378 - DNA, 18 bp, Homo sapiens
tcaacatttttttttctc

SEQ ID NO: 1533379 - DNA, 14 bp, Homo sapiens
tcaaccactgtggc

SEQ ID NO: 1533380 - DNA, 13 bp, Homo sapiens
tcaaccaggaaga

SEQ ID NO: 1533381 - DNA, 16 bp, Homo sapiens
tcaaccatcgctttat

SEQ ID NO: 1533382 - DNA, 15 bp, Homo sapiens
tcaaccattccccat

SEQ ID NO: 1533383 - DNA, 18 bp, Homo sapiens
tcaaccattccccatggg

SEQ ID NO: 1533384 - DNA, 17 bp, Homo sapiens
tcaaccggaaggaggcc

SEQ ID NO: 1533385 - DNA, 15 bp, Homo sapiens
tcaaccgtacaatgg

SEQ ID NO: 1533386 - DNA, 15 bp, Homo sapiens
tcaaccttaagacct

SEQ ID NO: 1533387 - DNA, 23 bp, Homo sapiens
tcaaccttaagacctactgttct

SEQ ID NO: 1533388 - DNA, 22 bp, Homo sapiens
tcaacggaagccccctcttcct

SEQ ID NO: 1533389 - DNA, 18 bp, Homo sapiens
tcaactaaagttgtactt

SEQ ID NO: 1533390 - DNA, 14 bp, Homo sapiens
tcaactcacagctt

SEQ ID NO: 1533391 - DNA, 17 bp, Homo sapiens
tcaactcacagcttctc

SEQ ID NO: 1533392 - DNA, 19 bp, Homo sapiens
tcaactcacagcttctcca

SEQ ID NO: 1533393 - DNA, 19 bp, Homo sapiens
tcaactcacctaatgttta

SEQ ID NO: 1533394 - DNA, 20 bp, Homo sapiens
tcaactctccaatgttctat

SEQ ID NO: 1533395 - DNA, 20 bp, Homo sapiens
tcaactctgaagctaattgt

SEQ ID NO: 1533396 - DNA, 23 bp, Homo sapiens
tcaactgaaaagactcagtgttc

SEQ ID NO: 1533397 - DNA, 14 bp, Homo sapiens
tcaactgagggcca

SEQ ID NO: 1533398 - DNA, 19 bp, Homo sapiens
tcaactgaggttcttggga

SEQ ID NO: 1533399 - DNA, 14 bp, Homo sapiens
tcaactgcctactc

SEQ ID NO: 1533400 - DNA, 17 bp, Homo sapiens
tcaactgctgttttatg

SEQ ID NO: 1533401 - DNA, 16 bp, Homo sapiens
tcaactgggtccagaa

SEQ ID NO: 1533402 - DNA, 16 bp, Homo sapiens
tataaatggacctttt

SEQ ID NO: 1533403 - DNA, 19 bp, Homo sapiens
tataaatggaccttttata

SEQ ID NO: 1533404 - DNA, 16 bp, Homo sapiens
tataaatggtgttttt

SEQ ID NO: 1533405 - DNA, 14 bp, Homo sapiens
tataaatgtataaa

SEQ ID NO: 1533406 - DNA, 15 bp, Homo sapiens
tataaattactatct

SEQ ID NO: 1533407 - DNA, 22 bp, Homo sapiens
tataaattactatctgttgaaa

SEQ ID NO: 1533408 - DNA, 15 bp, Homo sapiens
tataaatttttacct

SEQ ID NO: 1533409 - DNA, 23 bp, Homo sapiens
tataacacatttttttgcatgca

SEQ ID NO: 1533410 - DNA, 22 bp, Homo sapiens
tataacacttaggactagaaga

SEQ ID NO: 1533411 - DNA, 16 bp, Homo sapiens
tataacagttatattt

SEQ ID NO: 1533412 - DNA, 15 bp, Homo sapiens
tataacatgcaaaca

SEQ ID NO: 1533413 - DNA, 14 bp, Homo sapiens
tataacatgtaaaa

SEQ ID NO: 1533414 - DNA, 20 bp, Homo sapiens
tataaccacaaagcacagtt

SEQ ID NO: 1533415 - DNA, 15 bp, Homo sapiens
tataaccatatgata

SEQ ID NO: 1533416 - DNA, 15 bp, Homo sapiens
tataaccccagctcc

SEQ ID NO: 1533417 - DNA, 20 bp, Homo sapiens
tataacctagttaaagaaag

SEQ ID NO: 1533418 - DNA, 14 bp, Homo sapiens
tataacgtgttcaa

SEQ ID NO: 1533419 - DNA, 17 bp, Homo sapiens
tataactcatcataaaa

SEQ ID NO: 1533420 - DNA, 21 bp, Homo sapiens
tataactcatcataaaataaa

SEQ ID NO: 1533421 - DNA, 23 bp, Homo sapiens
tataactctgcactactcctctg

SEQ ID NO: 1533422 - DNA, 19 bp, Homo sapiens
tagccgcccatgcactggg

SEQ ID NO: 1533423 - DNA, 13 bp, Homo sapiens
tagccgccctgag

SEQ ID NO: 1533424 - DNA, 15 bp, Homo sapiens
tagccgccctgagag

SEQ ID NO: 1533425 - DNA, 16 bp, Homo sapiens
tagccggccactttgg

SEQ ID NO: 1533426 - DNA, 21 bp, Homo sapiens
tagcctaaaacgaatggtctt

SEQ ID NO: 1533427 - DNA, 24 bp, Homo sapiens
tagcctaaagtatacaactgcctg

SEQ ID NO: 1533428 - DNA, 23 bp, Homo sapiens
tagcctcacggggttggctgttc

SEQ ID NO: 1533429 - DNA, 13 bp, Homo sapiens
tagcctccctgaa

SEQ ID NO: 1533430 - DNA, 19 bp, Homo sapiens
tagcctccttcgcaggcat

SEQ ID NO: 1533431 - DNA, 15 bp, Homo sapiens
tagcctctggatcta

SEQ ID NO: 1533432 - DNA, 15 bp, Homo sapiens
tagcctcttgtgtaa

SEQ ID NO: 1533433 - DNA, 21 bp, Homo sapiens
tagccttattcacctttttaa

SEQ ID NO: 1533434 - DNA, 16 bp, Homo sapiens
tagccttccaacattt

SEQ ID NO: 1533435 - DNA, 18 bp, Homo sapiens
tagccttcctccacatcc

SEQ ID NO: 1533436 - DNA, 22 bp, Homo sapiens
tagccttgcccggattctggga

SEQ ID NO: 1533437 - DNA, 13 bp, Homo sapiens
tagccttgcttgt

SEQ ID NO: 1533438 - DNA, 14 bp, Homo sapiens
tagccttgtgccct

SEQ ID NO: 1533439 - DNA, 17 bp, Homo sapiens
tagccttgtgccctgcc

SEQ ID NO: 1533440 - DNA, 22 bp, Homo sapiens
tagccttgtgccctgcccccat

SEQ ID NO: 1533441 - DNA, 13 bp, Homo sapiens
tagcctttcttgt

SEQ ID NO: 1533442 - DNA, 14 bp, Homo sapiens
tagcctttgccctg

SEQ ID NO: 1533443 - DNA, 14 bp, Homo sapiens
tagcgacagcattt

SEQ ID NO: 1533444 - DNA, 19 bp, Homo sapiens
tagcgatctctcctggcct

SEQ ID NO: 1533445 - DNA, 21 bp, Homo sapiens
tagcgctgccgcaccccagag

SEQ ID NO: 1533446 - DNA, 18 bp, Homo sapiens
tagcggagcccagcctgg

SEQ ID NO: 1533447 - DNA, 14 bp, Homo sapiens
tagcgggactcagt

SEQ ID NO: 1533448 - DNA, 14 bp, Homo sapiens
tagcgtcaagacat

SEQ ID NO: 1533449 - DNA, 17 bp, Homo sapiens
tagcgtcctgccctgcc

SEQ ID NO: 1533450 - DNA, 15 bp, Homo sapiens
tagctacaggaagca

SEQ ID NO: 1533451 - DNA, 15 bp, Homo sapiens
tagctacagtgcata

SEQ ID NO: 1533452 - DNA, 15 bp, Homo sapiens
tagctacatgttctt

SEQ ID NO: 1533453 - DNA, 20 bp, Homo sapiens
tagctacatgttctttgtac

SEQ ID NO: 1533454 - DNA, 16 bp, Homo sapiens
tagctagtagcaatgt

SEQ ID NO: 1533455 - DNA, 17 bp, Homo sapiens
tagctagtttgcttttt

SEQ ID NO: 1533456 - DNA, 19 bp, Homo sapiens
tagctagtttgctttttgc

SEQ ID NO: 1533457 - DNA, 23 bp, Homo sapiens
tagctatatatttaggaaattca

SEQ ID NO: 1533458 - DNA, 17 bp, Homo sapiens
tagctcaagaattgtta

SEQ ID NO: 1533459 - DNA, 15 bp, Homo sapiens
tagctcaccaggcct

SEQ ID NO: 1533460 - DNA, 23 bp, Homo sapiens
tagctcaccaggcctggcctctg

SEQ ID NO: 1533461 - DNA, 17 bp, Homo sapiens
tagctcactgaatcttc

SEQ ID NO: 1533462 - DNA, 16 bp, Homo sapiens
tagctcaggtgcctta

SEQ ID NO: 1533463 - DNA, 12 bp, Homo sapiens
tagctcagttta

SEQ ID NO: 1533464 - DNA, 21 bp, Homo sapiens
tagctccataaagtacaaatg

SEQ ID NO: 1533465 - DNA, 19 bp, Homo sapiens
tagctcccctgctgaggca

SEQ ID NO: 1533466 - DNA, 15 bp, Homo sapiens
tagctccctcctccc

SEQ ID NO: 1533467 - DNA, 16 bp, Homo sapiens
tagctccctcctccca

SEQ ID NO: 1533468 - DNA, 19 bp, Homo sapiens
tagctccctcctcccatct

SEQ ID NO: 1533469 - DNA, 19 bp, Homo sapiens
tagctcctccccttcctct

SEQ ID NO: 1533470 - DNA, 16 bp, Homo sapiens
tagctcctcctcctgg

SEQ ID NO: 1533471 - DNA, 18 bp, Homo sapiens
tagctctactgccctccc

SEQ ID NO: 1533472 - DNA, 15 bp, Homo sapiens
tagctctctaggcct

SEQ ID NO: 1533473 - DNA, 17 bp, Homo sapiens
tagctctctaggcctct

SEQ ID NO: 1533474 - DNA, 12 bp, Homo sapiens
tagctctgcctc

SEQ ID NO: 1533475 - DNA, 21 bp, Homo sapiens
tagctctggacgtgaaatact

SEQ ID NO: 1533476 - DNA, 11 bp, Homo sapiens
tagctctgggg

SEQ ID NO: 1533477 - DNA, 22 bp, Homo sapiens
tagctctggggtgggcagtttt

SEQ ID NO: 1533478 - DNA, 13 bp, Homo sapiens
tagctcttacaca

SEQ ID NO: 1533479 - DNA, 17 bp, Homo sapiens
tagctcttagtctcttt

SEQ ID NO: 1533480 - DNA, 21 bp, Homo sapiens
tagctctttgggcctctcctg

SEQ ID NO: 1533481 - DNA, 17 bp, Homo sapiens
tagctgaaaagggcact

SEQ ID NO: 1533482 - DNA, 21 bp, Homo sapiens
tagctgacccagccccttgag

SEQ ID NO: 1533483 - DNA, 11 bp, Homo sapiens
tagctgcagaa

SEQ ID NO: 1533484 - DNA, 23 bp, Homo sapiens
tagctgcatcctccaagaatcta

SEQ ID NO: 1533485 - DNA, 12 bp, Homo sapiens
tagctgccactt

SEQ ID NO: 1533486 - DNA, 17 bp, Homo sapiens
tagctgccactttcacg

SEQ ID NO: 1533487 - DNA, 22 bp, Homo sapiens
tagctggctctgtgagggtgct

SEQ ID NO: 1533488 - DNA, 21 bp, Homo sapiens
tagctgggactacagatgtgg

SEQ ID NO: 1533489 - DNA, 12 bp, Homo sapiens
tagctggggctt

SEQ ID NO: 1533490 - DNA, 14 bp, Homo sapiens
tagctggggcttca

SEQ ID NO: 1533491 - DNA, 17 bp, Homo sapiens
tagctgtaagggcagtg

SEQ ID NO: 1533492 - DNA, 16 bp, Homo sapiens
tagctgtactataagt

SEQ ID NO: 1533493 - DNA, 23 bp, Homo sapiens
tagctgtactataagtagttggt

SEQ ID NO: 1533494 - DNA, 17 bp, Homo sapiens
tagctgtacttcttgaa

SEQ ID NO: 1533495 - DNA, 21 bp, Homo sapiens
tagctgtatgatttgttttga

SEQ ID NO: 1533496 - DNA, 22 bp, Homo sapiens
tagctgtcctctcagaactcct

SEQ ID NO: 1533497 - DNA, 14 bp, Homo sapiens
tagctgtggtgagg

SEQ ID NO: 1533498 - DNA, 18 bp, Homo sapiens
tagctgtggtgaggtggg

SEQ ID NO: 1533499 - DNA, 22 bp, Homo sapiens
tagctgtgtgaatacctgctca

SEQ ID NO: 1533500 - DNA, 19 bp, Homo sapiens
tagcttaactaatttgaat

SEQ ID NO: 1533501 - DNA, 21 bp, Homo sapiens
tagcttacaagccagctggag

SEQ ID NO: 1533502 - DNA, 16 bp, Homo sapiens
tagcttaccagaagct

SEQ ID NO: 1533503 - DNA, 15 bp, Homo sapiens
tagcttacctgaaca

SEQ ID NO: 1533504 - DNA, 19 bp, Homo sapiens
tagcttacctgacacaaga

SEQ ID NO: 1533505 - DNA, 21 bp, Homo sapiens
tagcttactgataaacctaat

SEQ ID NO: 1533506 - DNA, 13 bp, Homo sapiens
tagcttctgcttt

SEQ ID NO: 1533507 - DNA, 15 bp, Homo sapiens
tagcttctgcttttc

SEQ ID NO: 1533508 - DNA, 22 bp, Homo sapiens
tagcttctgcttttctgccctg

SEQ ID NO: 1533509 - DNA, 21 bp, Homo sapiens
tagctttaatcaatcatgccc

SEQ ID NO: 1533510 - DNA, 14 bp, Homo sapiens
tagctttaccctca

SEQ ID NO: 1533511 - DNA, 18 bp, Homo sapiens
tagctttattttttaagt

SEQ ID NO: 1533512 - DNA, 19 bp, Homo sapiens
tagctttattttttaagta

SEQ ID NO: 1533513 - DNA, 20 bp, Homo sapiens
tagctttattttttaagtat

SEQ ID NO: 1533514 - DNA, 13 bp, Homo sapiens
tagctttctcagg

SEQ ID NO: 1533515 - DNA, 13 bp, Homo sapiens
tagctttgaaact

SEQ ID NO: 1533516 - DNA, 11 bp, Homo sapiens
tagctttgctc

SEQ ID NO: 1533517 - DNA, 15 bp, Homo sapiens
tagctttgctctttg

SEQ ID NO: 1533518 - DNA, 12 bp, Homo sapiens
tagcttttcctt

SEQ ID NO: 1533519 - DNA, 20 bp, Homo sapiens
tagcttttgccagtattatg

SEQ ID NO: 1533520 - DNA, 17 bp, Homo sapiens
taggaaaagtacattta

SEQ ID NO: 1533521 - DNA, 16 bp, Homo sapiens
taggaacatatgaaaa

SEQ ID NO: 1533522 - DNA, 15 bp, Homo sapiens
taggaactgctgggc

SEQ ID NO: 1533523 - DNA, 14 bp, Homo sapiens
taggaagagaaacc

SEQ ID NO: 1533524 - DNA, 18 bp, Homo sapiens
taggaagagcaggactcc

SEQ ID NO: 1533525 - DNA, 17 bp, Homo sapiens
taggaagggatctgaga

SEQ ID NO: 1533526 - DNA, 20 bp, Homo sapiens
taggaagggatctgagaaca

SEQ ID NO: 1533527 - DNA, 17 bp, Homo sapiens
taggaagtacgagcccc

SEQ ID NO: 1533528 - DNA, 12 bp, Homo sapiens
taggaataaata

SEQ ID NO: 1533529 - DNA, 14 bp, Homo sapiens
taggaatcccagag

SEQ ID NO: 1533530 - DNA, 22 bp, Homo sapiens
taggaatcctttgagaatgtga

SEQ ID NO: 1533531 - DNA, 17 bp, Homo sapiens
taggttctaaagttcta

SEQ ID NO: 1533532 - DNA, 20 bp, Homo sapiens
taggttctaaagttctaaga

SEQ ID NO: 1533533 - DNA, 22 bp, Homo sapiens
taggttctaaagttctaagatt

SEQ ID NO: 1533534 - DNA, 16 bp, Homo sapiens
taggttggacagcccc

SEQ ID NO: 1533535 - DNA, 12 bp, Homo sapiens
taggtttactgt

SEQ ID NO: 1533536 - DNA, 16 bp, Homo sapiens
taggtttactgtgaag

SEQ ID NO: 1533537 - DNA, 20 bp, Homo sapiens
taggtttactgtgaagagaa

SEQ ID NO: 1533538 - DNA, 19 bp, Homo sapiens
taggtttttttgtatagta

SEQ ID NO: 1533539 - DNA, 19 bp, Homo sapiens
tagtaaaagtggtctctgc

SEQ ID NO: 1533540 - DNA, 23 bp, Homo sapiens
tagtaaaagtggtctctgctggg

SEQ ID NO: 1533541 - DNA, 11 bp, Homo sapiens
tagagagaata

SEQ ID NO: 1533542 - DNA, 20 bp, Homo sapiens
tagagagcctgtcaccagag

SEQ ID NO: 1533543 - DNA, 20 bp, Homo sapiens
taaggtccggtgttctaaga

SEQ ID NO: 1533544 - DNA, 13 bp, Homo sapiens
taaggtcctaagg

SEQ ID NO: 1533545 - DNA, 21 bp, Homo sapiens
taaggtctttcagtacttttt

SEQ ID NO: 1533546 - DNA, 23 bp, Homo sapiens
taaggtgcctcagttttccttct

SEQ ID NO: 1533547 - DNA, 16 bp, Homo sapiens
taaggtgtgcaaagat

SEQ ID NO: 1533548 - DNA, 18 bp, Homo sapiens
taaggttacctttgttcc

SEQ ID NO: 1533549 - DNA, 16 bp, Homo sapiens
taaggttctcatagga

SEQ ID NO: 1533550 - DNA, 15 bp, Homo sapiens
taaggttgcacacag

SEQ ID NO: 1533551 - DNA, 16 bp, Homo sapiens
taaggttgcacacagt

SEQ ID NO: 1533552 - DNA, 21 bp, Homo sapiens
taaggttgcacacagtacaca

SEQ ID NO: 1533553 - DNA, 21 bp, Homo sapiens
taaggtttccagtcagatgag

SEQ ID NO: 1533554 - DNA, 13 bp, Homo sapiens
taaggtttgcaaa

SEQ ID NO: 1533555 - DNA, 19 bp, Homo sapiens
taaggttttaagctaaaat

SEQ ID NO: 1533556 - DNA, 17 bp, Homo sapiens
taagtaaaaccacagca

SEQ ID NO: 1533557 - DNA, 13 bp, Homo sapiens
taagtaaatgcta

SEQ ID NO: 1533558 - DNA, 19 bp, Homo sapiens
taagtaagacttttattaa

SEQ ID NO: 1533559 - DNA, 15 bp, Homo sapiens
taagtaatcatctaa

SEQ ID NO: 1533560 - DNA, 21 bp, Homo sapiens
taagtaattatcgggaacagt

SEQ ID NO: 1533561 - DNA, 21 bp, Homo sapiens
taagtaattgcatttctgctc

SEQ ID NO: 1533562 - DNA, 16 bp, Homo sapiens
taagtaattgcctaca

SEQ ID NO: 1533563 - DNA, 16 bp, Homo sapiens
taagtactatgtatca

SEQ ID NO: 1533564 - DNA, 22 bp, Homo sapiens
taagtacttccacttgtgtata

SEQ ID NO: 1533565 - DNA, 19 bp, Homo sapiens
taagtaggaaagtcaccca

SEQ ID NO: 1533566 - DNA, 15 bp, Homo sapiens
taagtagtaaatcag

SEQ ID NO: 1533567 - DNA, 12 bp, Homo sapiens
taagtatatagt

SEQ ID NO: 1533568 - DNA, 14 bp, Homo sapiens
taagtatatagtat

SEQ ID NO: 1533569 - DNA, 16 bp, Homo sapiens
taagtatcttgtgctt

SEQ ID NO: 1533570 - DNA, 14 bp, Homo sapiens
taagtatgttattt

SEQ ID NO: 1533571 - DNA, 20 bp, Homo sapiens
taagtatttaggtttttgtt

SEQ ID NO: 1533572 - DNA, 15 bp, Homo sapiens
taagtatttatatat

SEQ ID NO: 1533573 - DNA, 19 bp, Homo sapiens
taagtatttatatatttat

SEQ ID NO: 1533574 - DNA, 14 bp, Homo sapiens
taagtatttctgat

SEQ ID NO: 1533575 - DNA, 14 bp, Homo sapiens
taagtcaacagtaa

SEQ ID NO: 1533576 - DNA, 17 bp, Homo sapiens
taagtcaacagtaaacc

SEQ ID NO: 1533577 - DNA, 22 bp, Homo sapiens
taagtcaagcacatgtaataaa

SEQ ID NO: 1533578 - DNA, 18 bp, Homo sapiens
taagtcaggtaatatacc

SEQ ID NO: 1533579 - DNA, 21 bp, Homo sapiens
taagtcagtttcacatatttg

SEQ ID NO: 1533580 - DNA, 19 bp, Homo sapiens
taagtcatctacttaataa

SEQ ID NO: 1533581 - DNA, 16 bp, Homo sapiens
taagtctcgaatgtaa

SEQ ID NO: 1533582 - DNA, 19 bp, Homo sapiens
taagtctcttacaaaagct

SEQ ID NO: 1533583 - DNA, 14 bp, Homo sapiens
taagtcttccttaa

SEQ ID NO: 1533584 - DNA, 20 bp, Homo sapiens
taagtcttccttaaatgact

SEQ ID NO: 1533585 - DNA, 16 bp, Homo sapiens
taagtgaaaaggtcat

SEQ ID NO: 1533586 - DNA, 19 bp, Homo sapiens
taagtgaagaatacatcag

SEQ ID NO: 1533587 - DNA, 12 bp, Homo sapiens
taagtgacacag

SEQ ID NO: 1533588 - DNA, 21 bp, Homo sapiens
taagtgacaccaataaatgtt

SEQ ID NO: 1533589 - DNA, 15 bp, Homo sapiens
taagtgaccttctga

SEQ ID NO: 1533590 - DNA, 21 bp, Homo sapiens
taagtgaccttctgatcttgg

SEQ ID NO: 1533591 - DNA, 15 bp, Homo sapiens
taagtgactttaaac

SEQ ID NO: 1533592 - DNA, 19 bp, Homo sapiens
taagtgatgtgctgaattt

SEQ ID NO: 1533593 - DNA, 17 bp, Homo sapiens
taagtgcacttttttat

SEQ ID NO: 1533594 - DNA, 22 bp, Homo sapiens
taagtgccaggatggaatgatg

SEQ ID NO: 1533595 - DNA, 14 bp, Homo sapiens
taagtgcccaaagt

SEQ ID NO: 1533596 - DNA, 13 bp, Homo sapiens
taagtgctttgta

SEQ ID NO: 1533597 - DNA, 17 bp, Homo sapiens
taagtggcgtgtgcata

SEQ ID NO: 1533598 - DNA, 16 bp, Homo sapiens
taagtgtaaaaaatgt

SEQ ID NO: 1533599 - DNA, 18 bp, Homo sapiens
taagtgtaaaaaatgtct

SEQ ID NO: 1533600 - DNA, 18 bp, Homo sapiens
taagtgtgcttagtttta

SEQ ID NO: 1533601 - DNA, 17 bp, Homo sapiens
taagtgtggttttgtaa

SEQ ID NO: 1533602 - DNA, 22 bp, Homo sapiens
taagtgtgtcttcctagaattc

SEQ ID NO: 1533603 - DNA, 20 bp, Homo sapiens
taagtgttctcatgaagcag

SEQ ID NO: 1533604 - DNA, 14 bp, Homo sapiens
taagtgttgtaaat

SEQ ID NO: 1533605 - DNA, 12 bp, Homo sapiens
taagtgtttctc

SEQ ID NO: 1533606 - DNA, 18 bp, Homo sapiens
taagttatttttgtacat

SEQ ID NO: 1533607 - DNA, 17 bp, Homo sapiens
taagttcatgtttgtaa

SEQ ID NO: 1533608 - DNA, 18 bp, Homo sapiens
taagttcatgtttgtaaa

SEQ ID NO: 1533609 - DNA, 14 bp, Homo sapiens
ccccgcagcccgtg

SEQ ID NO: 1533610 - DNA, 22 bp, Homo sapiens
ccccgcaggatccctcctgagc

SEQ ID NO: 1533611 - DNA, 12 bp, Homo sapiens
ccccgcagtccc

SEQ ID NO: 1533612 - DNA, 18 bp, Homo sapiens
ccccgcagtccccagccc

SEQ ID NO: 1533613 - DNA, 15 bp, Homo sapiens
ccccgcccacccacg

SEQ ID NO: 1533614 - DNA, 17 bp, Homo sapiens
ccccgcccagctgcacc

SEQ ID NO: 1533615 - DNA, 12 bp, Homo sapiens
ccccgcccccac

SEQ ID NO: 1533616 - DNA, 16 bp, Homo sapiens
ccccgcccccacccct

SEQ ID NO: 1533617 - DNA, 15 bp, Homo sapiens
ccccgcctccactct

SEQ ID NO: 1533618 - DNA, 12 bp, Homo sapiens
ccccgcctgagt

SEQ ID NO: 1533619 - DNA, 13 bp, Homo sapiens
ccccgcctgccac

SEQ ID NO: 1533620 - DNA, 12 bp, Homo sapiens
ccccgcctgcct

SEQ ID NO: 1533621 - DNA, 13 bp, Homo sapiens
ccccgcctgcctc

SEQ ID NO: 1533622 - DNA, 13 bp, Homo sapiens
ccccgcctgggca

SEQ ID NO: 1533623 - DNA, 17 bp, Homo sapiens
ccccgcgggttctagac

SEQ ID NO: 1533624 - DNA, 12 bp, Homo sapiens
ccccgctcccac

SEQ ID NO: 1533625 - DNA, 16 bp, Homo sapiens
ccccgctccgtctctg

SEQ ID NO: 1533626 - DNA, 21 bp, Homo sapiens
ccccgctccgtctctgtcctc

SEQ ID NO: 1533627 - DNA, 16 bp, Homo sapiens
ccccgctctccctgtc

SEQ ID NO: 1533628 - DNA, 16 bp, Homo sapiens
ccccgcttccccacag

SEQ ID NO: 1533629 - DNA, 21 bp, Homo sapiens
ccccgcttccccacagaactg

SEQ ID NO: 1533630 - DNA, 17 bp, Homo sapiens
ccccgcttgtccagcgc

SEQ ID NO: 1533631 - DNA, 19 bp, Homo sapiens
ccccgcttgtccagcgcct

SEQ ID NO: 1533632 - DNA, 13 bp, Homo sapiens
ccccggcaggcct

SEQ ID NO: 1533633 - DNA, 19 bp, Homo sapiens
ccccggccccagccagagt

SEQ ID NO: 1533634 - DNA, 13 bp, Homo sapiens
ccccggccctacc

SEQ ID NO: 1533635 - DNA, 13 bp, Homo sapiens
ccccggcctcagg

SEQ ID NO: 1533636 - DNA, 14 bp, Homo sapiens
ccccggcctcaggg

SEQ ID NO: 1533637 - DNA, 21 bp, Homo sapiens
ccccggcctcagggcgctcag

SEQ ID NO: 1533638 - DNA, 16 bp, Homo sapiens
ccccggcctctctctt

SEQ ID NO: 1533639 - DNA, 17 bp, Homo sapiens
ccccggcttcctttccc

SEQ ID NO: 1533640 - DNA, 15 bp, Homo sapiens
ccccgggatattata

SEQ ID NO: 1533641 - DNA, 12 bp, Homo sapiens
ccccggggctgg

SEQ ID NO: 1533642 - DNA, 14 bp, Homo sapiens
ccccggggctggca

SEQ ID NO: 1533643 - DNA, 16 bp, Homo sapiens
ccccggggctggcaag

SEQ ID NO: 1533644 - DNA, 17 bp, Homo sapiens
ccccgggggaggaaggg

SEQ ID NO: 1533645 - DNA, 20 bp, Homo sapiens
ccccggtggcggccccagca

SEQ ID NO: 1533646 - DNA, 18 bp, Homo sapiens
ccccggtgtgcggtgcat

SEQ ID NO: 1533647 - DNA, 16 bp, Homo sapiens
ccccgtcagggagagg

SEQ ID NO: 1533648 - DNA, 15 bp, Homo sapiens
ccccgtgtaaaaagc

SEQ ID NO: 1533649 - DNA, 19 bp, Homo sapiens
ccccgtgtaaaaagcctcc

SEQ ID NO: 1533650 - DNA, 22 bp, Homo sapiens
ccccgtgtcctctccctgccaa

SEQ ID NO: 1533651 - DNA, 15 bp, Homo sapiens
ccccgtgttcaggac

SEQ ID NO: 1533652 - DNA, 21 bp, Homo sapiens
ccccgttccctgtcagaggct

SEQ ID NO: 1533653 - DNA, 19 bp, Homo sapiens
ccccgttgcttcccgctgc

SEQ ID NO: 1533654 - DNA, 14 bp, Homo sapiens
ccccgtttctggtg

SEQ ID NO: 1533655 - DNA, 13 bp, Homo sapiens
cccctaagtgccc

SEQ ID NO: 1533656 - DNA, 14 bp, Homo sapiens
cccctaatgtcagc

SEQ ID NO: 1533657 - DNA, 17 bp, Homo sapiens
cccctacagcctgcaca

SEQ ID NO: 1533658 - DNA, 13 bp, Homo sapiens
cccctaccccaca

SEQ ID NO: 1533659 - DNA, 14 bp, Homo sapiens
cccctagccctggt

SEQ ID NO: 1533660 - DNA, 15 bp, Homo sapiens
cccctagcctgcctc

SEQ ID NO: 1533661 - DNA, 19 bp, Homo sapiens
cccctaggatgctgcagca

SEQ ID NO: 1533662 - DNA, 20 bp, Homo sapiens
cccctagtgctattctgtgt

SEQ ID NO: 1533663 - DNA, 20 bp, Homo sapiens
cccctcaaagggagagaaaa

SEQ ID NO: 1533664 - DNA, 20 bp, Homo sapiens
cccctcaccatccagtgggc

SEQ ID NO: 1533665 - DNA, 12 bp, Homo sapiens
cccctcacctcc

SEQ ID NO: 1533666 - DNA, 14 bp, Homo sapiens
cccctcacctcctc

SEQ ID NO: 1533667 - DNA, 12 bp, Homo sapiens
cccctcacctgg

SEQ ID NO: 1533668 - DNA, 16 bp, Homo sapiens
cccctcactccccagg

SEQ ID NO: 1533669 - DNA, 21 bp, Homo sapiens
cccctcagcgggggccttgaa

SEQ ID NO: 1533670 - DNA, 13 bp, Homo sapiens
cccctccaaacct

SEQ ID NO: 1533671 - DNA, 17 bp, Homo sapiens
cccctccaaacctccag

SEQ ID NO: 1533672 - DNA, 20 bp, Homo sapiens
cccctccacagctgcagctg

SEQ ID NO: 1533673 - DNA, 13 bp, Homo sapiens
cccctccagaccc

SEQ ID NO: 1533674 - DNA, 17 bp, Homo sapiens
cccctccagaccctgcc

SEQ ID NO: 1533675 - DNA, 19 bp, Homo sapiens
cccctccagaccctgcctg

SEQ ID NO: 1533676 - DNA, 22 bp, Homo sapiens
cccctccagctcatgacactgt

SEQ ID NO: 1533677 - DNA, 11 bp, Homo sapiens
cccctccagga

SEQ ID NO: 1533678 - DNA, 13 bp, Homo sapiens
cccctccaggaag

SEQ ID NO: 1533679 - DNA, 15 bp, Homo sapiens
cccctccatccaccc

SEQ ID NO: 1533680 - DNA, 21 bp, Homo sapiens
cccctcccacacccaaagctg

SEQ ID NO: 1533681 - DNA, 18 bp, Homo sapiens
cccctcccacccacagcc

SEQ ID NO: 1533682 - DNA, 20 bp, Homo sapiens
cccctcccacgcctcaccag

SEQ ID NO: 1533683 - DNA, 16 bp, Homo sapiens
cccctcccccaacccc

SEQ ID NO: 1533684 - DNA, 21 bp, Homo sapiens
cccctcccccaacccccaccc

SEQ ID NO: 1533685 - DNA, 14 bp, Homo sapiens
cccctccctctgcc

SEQ ID NO: 1533686 - DNA, 13 bp, Homo sapiens
cccctccctgtcc

SEQ ID NO: 1533687 - DNA, 15 bp, Homo sapiens
cccctcccttctggg

SEQ ID NO: 1533688 - DNA, 12 bp, Homo sapiens
cccctccctttc

SEQ ID NO: 1533689 - DNA, 20 bp, Homo sapiens
cccctccgatgctgaggcca

SEQ ID NO: 1533690 - DNA, 13 bp, Homo sapiens
cccctccgcagca

SEQ ID NO: 1533691 - DNA, 18 bp, Homo sapiens
cccctccggactggtgcc

SEQ ID NO: 1533692 - DNA, 12 bp, Homo sapiens
cccctcctccac

SEQ ID NO: 1533693 - DNA, 15 bp, Homo sapiens
cccctcctccactct

SEQ ID NO: 1533694 - DNA, 14 bp, Homo sapiens
cccctcctccagta

SEQ ID NO: 1533695 - DNA, 17 bp, Homo sapiens
cccctcctctagctgtg

SEQ ID NO: 1533696 - DNA, 20 bp, Homo sapiens
tcttgaaatattcagaaatt

SEQ ID NO: 1533697 - DNA, 16 bp, Homo sapiens
tcttgaaatgaaaggg

SEQ ID NO: 1533698 - DNA, 20 bp, Homo sapiens
tcttgaacgagcagcccagg

SEQ ID NO: 1533699 - DNA, 22 bp, Homo sapiens
tcttgaacgagcagcccagggc

SEQ ID NO: 1533700 - DNA, 19 bp, Homo sapiens
tcttgaagcccccagccct

SEQ ID NO: 1533701 - DNA, 16 bp, Homo sapiens
tcttgaaggaaaaatt

SEQ ID NO: 1533702 - DNA, 18 bp, Homo sapiens
tcttgaaggaaaaattca

SEQ ID NO: 1533703 - DNA, 20 bp, Homo sapiens
tcttgaagtcagccacactg

SEQ ID NO: 1533704 - DNA, 16 bp, Homo sapiens
tcttgaagtccaggac

SEQ ID NO: 1533705 - DNA, 21 bp, Homo sapiens
tcttgaataaagtattctagt

SEQ ID NO: 1533706 - DNA, 14 bp, Homo sapiens
tcttgaatataaaa

SEQ ID NO: 1533707 - DNA, 22 bp, Homo sapiens
tcttgaatctagggagggggaa

SEQ ID NO: 1533708 - DNA, 16 bp, Homo sapiens
tcttgaatgtcttttg

SEQ ID NO: 1533709 - DNA, 21 bp, Homo sapiens
tcttgaatttttgatgtagat

SEQ ID NO: 1533710 - DNA, 13 bp, Homo sapiens
tcttgacaaaacc

SEQ ID NO: 1533711 - DNA, 21 bp, Homo sapiens
tcttgacaagctgacttggca

SEQ ID NO: 1533712 - DNA, 22 bp, Homo sapiens
tcttgacaagctgacttggcac

SEQ ID NO: 1533713 - DNA, 23 bp, Homo sapiens
tcttgacaagctgacttggcact

SEQ ID NO: 1533714 - DNA, 19 bp, Homo sapiens
tcttgacattcaaggcatt

SEQ ID NO: 1533715 - DNA, 13 bp, Homo sapiens
tcttgaccaacag

SEQ ID NO: 1533716 - DNA, 17 bp, Homo sapiens
tcttgactctaaatgca

SEQ ID NO: 1533717 - DNA, 17 bp, Homo sapiens
tcttgagagctcaggca

SEQ ID NO: 1533718 - DNA, 19 bp, Homo sapiens
tcttgagagctcaggcagc

SEQ ID NO: 1533719 - DNA, 14 bp, Homo sapiens
tcttgagagctgct

SEQ ID NO: 1533720 - DNA, 22 bp, Homo sapiens
tcttgagcagtggctggtccag

SEQ ID NO: 1533721 - DNA, 17 bp, Homo sapiens
tcttgagcatcaatctt

SEQ ID NO: 1533722 - DNA, 12 bp, Homo sapiens
tcttgagccaca

SEQ ID NO: 1533723 - DNA, 16 bp, Homo sapiens
tcttgagccagccagg

SEQ ID NO: 1533724 - DNA, 13 bp, Homo sapiens
tcttgagctggcc

SEQ ID NO: 1533725 - DNA, 12 bp, Homo sapiens
cccctctggtcg

SEQ ID NO: 1533726 - DNA, 22 bp, Homo sapiens
cccctctgtgcttcgactactg

SEQ ID NO: 1533727 - DNA, 22 bp, Homo sapiens
cccctcttagcttacaggaagc

SEQ ID NO: 1533728 - DNA, 16 bp, Homo sapiens
cccctcttcctccctg

SEQ ID NO: 1533729 - DNA, 22 bp, Homo sapiens
cccctcttggagaagtctcagc

SEQ ID NO: 1533730 - DNA, 19 bp, Homo sapiens
cccctctttcgtctactgc

SEQ ID NO: 1533731 - DNA, 20 bp, Homo sapiens
cccctgaaagtgacagagac

SEQ ID NO: 1533732 - DNA, 20 bp, Homo sapiens
cccctgacctaccccagcca

SEQ ID NO: 1533733 - DNA, 19 bp, Homo sapiens
cccctgagcaatgtctgtg

SEQ ID NO: 1533734 - DNA, 21 bp, Homo sapiens
cccctgagcaatgtctgtgct

SEQ ID NO: 1533735 - DNA, 15 bp, Homo sapiens
cccctgagcccagag

SEQ ID NO: 1533736 - DNA, 13 bp, Homo sapiens
cccctgaggactg

SEQ ID NO: 1533737 - DNA, 16 bp, Homo sapiens
cccctgaggactggag

SEQ ID NO: 1533738 - DNA, 11 bp, Homo sapiens
cccctgaggca

SEQ ID NO: 1533739 - DNA, 14 bp, Homo sapiens
cccctgaggcagcc

SEQ ID NO: 1533740 - DNA, 23 bp, Homo sapiens
cccctgatacatgagccagtgat

SEQ ID NO: 1533741 - DNA, 20 bp, Homo sapiens
cccctgatgcagcctgtggc

SEQ ID NO: 1533742 - DNA, 16 bp, Homo sapiens
cccctgcacccacccc

SEQ ID NO: 1533743 - DNA, 14 bp, Homo sapiens
cccctgcactgtaa

SEQ ID NO: 1533744 - DNA, 18 bp, Homo sapiens
cccctgcactgtaaaatg

SEQ ID NO: 1533745 - DNA, 24 bp, Homo sapiens
cccctgcatctatcgagtttgcaa

SEQ ID NO: 1533746 - DNA, 12 bp, Homo sapiens
cccctgccccca

SEQ ID NO: 1533747 - DNA, 16 bp, Homo sapiens
cccctgcccccaggac

SEQ ID NO: 1533748 - DNA, 19 bp, Homo sapiens
cccctgcccccaggactgg

SEQ ID NO: 1533749 - DNA, 17 bp, Homo sapiens
cccctgccccccagcct

SEQ ID NO: 1533750 - DNA, 13 bp, Homo sapiens
cccctgcccctac

SEQ ID NO: 1533751 - DNA, 23 bp, Homo sapiens
cccctgcccgagagagctctggc

SEQ ID NO: 1533752 - DNA, 19 bp, Homo sapiens
cccctgccctcgtggccag

SEQ ID NO: 1533753 - DNA, 17 bp, Homo sapiens
cccctgccctggtccag

SEQ ID NO: 1533754 - DNA, 19 bp, Homo sapiens
cccctgccggtgcacaggc

SEQ ID NO: 1533755 - DNA, 20 bp, Homo sapiens
cccctgccggtgcacaggcc

SEQ ID NO: 1533756 - DNA, 12 bp, Homo sapiens
cccctgcctcct

SEQ ID NO: 1533757 - DNA, 15 bp, Homo sapiens
cccctgcctcctgcc

SEQ ID NO: 1533758 - DNA, 18 bp, Homo sapiens
cccctgcctcctgccacc

SEQ ID NO: 1533759 - DNA, 22 bp, Homo sapiens
cccctgcctgttggcaggccca

SEQ ID NO: 1533760 - DNA, 18 bp, Homo sapiens
cccctgctactcctgtgc

SEQ ID NO: 1533761 - DNA, 12 bp, Homo sapiens
cccctgctccca

SEQ ID NO: 1533762 - DNA, 13 bp, Homo sapiens
cccctgctgccca

SEQ ID NO: 1533763 - DNA, 16 bp, Homo sapiens
cccctgctgcccagtg

SEQ ID NO: 1533764 - DNA, 14 bp, Homo sapiens
cccctgctgtctct

SEQ ID NO: 1533765 - DNA, 17 bp, Homo sapiens
cccctggaaacccacct

SEQ ID NO: 1533766 - DNA, 20 bp, Homo sapiens
cccctggaagagcccagtct

SEQ ID NO: 1533767 - DNA, 22 bp, Homo sapiens
cccctggatgggcattgggctg

SEQ ID NO: 1533768 - DNA, 19 bp, Homo sapiens
cccctggccagctctgagg

SEQ ID NO: 1533769 - DNA, 13 bp, Homo sapiens
cccctggcccagc

SEQ ID NO: 1533770 - DNA, 15 bp, Homo sapiens
cccctggcccagcgg

SEQ ID NO: 1533771 - DNA, 16 bp, Homo sapiens
cccctggcccagcggc

SEQ ID NO: 1533772 - DNA, 16 bp, Homo sapiens
cccctggccccgcctg

SEQ ID NO: 1533773 - DNA, 19 bp, Homo sapiens
cccctggccccgcctgcct

SEQ ID NO: 1533774 - DNA, 12 bp, Homo sapiens
cccctggcctct

SEQ ID NO: 1533775 - DNA, 14 bp, Homo sapiens
cccctggcctctgt

SEQ ID NO: 1533776 - DNA, 15 bp, Homo sapiens
cccctggctctgggc

SEQ ID NO: 1533777 - DNA, 20 bp, Homo sapiens
cccctggctttgcctcttct

SEQ ID NO: 1533778 - DNA, 18 bp, Homo sapiens
cccctggcttttcactgc

SEQ ID NO: 1533779 - DNA, 20 bp, Homo sapiens
cccctggcttttcactgctg

SEQ ID NO: 1533780 - DNA, 23 bp, Homo sapiens
cccctggcttttcactgctggct

SEQ ID NO: 1533781 - DNA, 15 bp, Homo sapiens
cccctgggcagggtt

SEQ ID NO: 1533782 - DNA, 10 bp, Homo sapiens
cccctgggct

SEQ ID NO: 1533783 - DNA, 14 bp, Homo sapiens
cccctgggctctca

SEQ ID NO: 1533784 - DNA, 15 bp, Homo sapiens
cccctgggctctcac

SEQ ID NO: 1533785 - DNA, 18 bp, Homo sapiens
cccctgggctctcaccca

SEQ ID NO: 1533786 - DNA, 13 bp, Homo sapiens
cccctgggctctg

SEQ ID NO: 1533787 - DNA, 20 bp, Homo sapiens
cccctgggcttggcctgctg

SEQ ID NO: 1533788 - DNA, 21 bp, Homo sapiens
cccctgggcttggcctgctgt

SEQ ID NO: 1533789 - DNA, 22 bp, Homo sapiens
cccctgggcttggcctgctgtg

SEQ ID NO: 1533790 - DNA, 19 bp, Homo sapiens
cccctggggtggccaccag

SEQ ID NO: 1533791 - DNA, 20 bp, Homo sapiens
cccctggggtggccaccagt

SEQ ID NO: 1533792 - DNA, 21 bp, Homo sapiens
cccctggggtgggatctgagc

SEQ ID NO: 1533793 - DNA, 19 bp, Homo sapiens
cccctgggttaacaaatga

SEQ ID NO: 1533794 - DNA, 15 bp, Homo sapiens
cccctggtggacagt

SEQ ID NO: 1533795 - DNA, 19 bp, Homo sapiens
cccctggtggacagtcctg

SEQ ID NO: 1533796 - DNA, 21 bp, Homo sapiens
cccctggtggacagtcctggg

SEQ ID NO: 1533797 - DNA, 23 bp, Homo sapiens
cccctggtggacagtcctgggag

SEQ ID NO: 1533798 - DNA, 18 bp, Homo sapiens
cccctgtacatttgtgct

SEQ ID NO: 1533799 - DNA, 20 bp, Homo sapiens
cccctgtagactagtgccgt

SEQ ID NO: 1533800 - DNA, 22 bp, Homo sapiens
cccctgtagggaaaccttggag

SEQ ID NO: 1533801 - DNA, 23 bp, Homo sapiens
cccctgtagggaaaccttggaga

SEQ ID NO: 1533802 - DNA, 11 bp, Homo sapiens
cccctgtccca

SEQ ID NO: 1533803 - DNA, 21 bp, Homo sapiens
cccctgtcccaccaactctgc

SEQ ID NO: 1533804 - DNA, 18 bp, Homo sapiens
cccctgtcccattctaga

SEQ ID NO: 1533805 - DNA, 19 bp, Homo sapiens
cccctgtggataccaaggt

SEQ ID NO: 1533806 - DNA, 14 bp, Homo sapiens
cccctgtggccaac

SEQ ID NO: 1533807 - DNA, 19 bp, Homo sapiens
cccctgtggccaactgcaa

SEQ ID NO: 1533808 - DNA, 18 bp, Homo sapiens
cccctgtggccctggcca

SEQ ID NO: 1533809 - DNA, 12 bp, Homo sapiens
cccctgtgggga

SEQ ID NO: 1533810 - DNA, 24 bp, Homo sapiens
cccctgtggggatctcaggggctg

SEQ ID NO: 1533811 - DNA, 14 bp, Homo sapiens
ccccttcagtgccc

SEQ ID NO: 1533812 - DNA, 23 bp, Homo sapiens
ccccttccatggtactgtagcag

SEQ ID NO: 1533813 - DNA, 22 bp, Homo sapiens
tcttgtacttctgtgttcattt

SEQ ID NO: 1533814 - DNA, 18 bp, Homo sapiens
tcttgtagctttatcaaa

SEQ ID NO: 1533815 - DNA, 21 bp, Homo sapiens
tcttgtataagatcctagatc

SEQ ID NO: 1533816 - DNA, 20 bp, Homo sapiens
tcttgtcctcattcttgcct

SEQ ID NO: 1533817 - DNA, 12 bp, Homo sapiens
tcttgtctctgg

SEQ ID NO: 1533818 - DNA, 15 bp, Homo sapiens
tcttgtctctgggct

SEQ ID NO: 1533819 - DNA, 19 bp, Homo sapiens
tcttgtcttcctatttcag

SEQ ID NO: 1533820 - DNA, 20 bp, Homo sapiens
tcttgtcttcctatttcaga

SEQ ID NO: 1533821 - DNA, 22 bp, Homo sapiens
tcttgtgagtggataatcagga

SEQ ID NO: 1533822 - DNA, 17 bp, Homo sapiens
tcttgtgctagaatact

SEQ ID NO: 1533823 - DNA, 19 bp, Homo sapiens
tcttgtgctagaatacttt

SEQ ID NO: 1533824 - DNA, 18 bp, Homo sapiens
tcttgtgcttttcctgat

SEQ ID NO: 1533825 - DNA, 15 bp, Homo sapiens
tcttgtgggagacag

SEQ ID NO: 1533826 - DNA, 20 bp, Homo sapiens
tcttgtgggagacagcagcc

SEQ ID NO: 1533827 - DNA, 13 bp, Homo sapiens
tcttgtggtgagg

SEQ ID NO: 1533828 - DNA, 18 bp, Homo sapiens
tcttgtgtgattaactta

SEQ ID NO: 1533829 - DNA, 19 bp, Homo sapiens
tcttgtgtgattaacttat

SEQ ID NO: 1533830 - DNA, 20 bp, Homo sapiens
tcttgttactgctgattctt

SEQ ID NO: 1533831 - DNA, 15 bp, Homo sapiens
tcttgttactgtgat

SEQ ID NO: 1533832 - DNA, 15 bp, Homo sapiens
tcttgttagaaaaca

SEQ ID NO: 1533833 - DNA, 22 bp, Homo sapiens
tcttgttcattttgagtatttt

SEQ ID NO: 1533834 - DNA, 20 bp, Homo sapiens
tcttgtttctgaagtactta

SEQ ID NO: 1533835 - DNA, 22 bp, Homo sapiens
tcttgtttcttttcacatagct

SEQ ID NO: 1533836 - DNA, 13 bp, Homo sapiens
tcttgtttgtcag

SEQ ID NO: 1533837 - DNA, 14 bp, Homo sapiens
tcttgtttgtcagc

SEQ ID NO: 1533838 - DNA, 16 bp, Homo sapiens
tcttgtttgtcagcat

SEQ ID NO: 1533839 - DNA, 18 bp, Homo sapiens
cccgacagcctggcacag

SEQ ID NO: 1533840 - DNA, 23 bp, Homo sapiens
cccgacagtgccatccccacctt

SEQ ID NO: 1533841 - DNA, 18 bp, Homo sapiens
cccgacgccacagcccag

SEQ ID NO: 1533842 - DNA, 14 bp, Homo sapiens
cccgacggctgtga

SEQ ID NO: 1533843 - DNA, 15 bp, Homo sapiens
cccgacggctgtgac

SEQ ID NO: 1533844 - DNA, 12 bp, Homo sapiens
cccgactgcctg

SEQ ID NO: 1533845 - DNA, 13 bp, Homo sapiens
cccgactgcctgt

SEQ ID NO: 1533846 - DNA, 18 bp, Homo sapiens
cccgagaaccctgagcag

SEQ ID NO: 1533847 - DNA, 19 bp, Homo sapiens
cccgagaagtgctcttggc

SEQ ID NO: 1533848 - DNA, 17 bp, Homo sapiens
cccgagacaccatcctg

SEQ ID NO: 1533849 - DNA, 21 bp, Homo sapiens
cccgagacaccatcctgagcc

SEQ ID NO: 1533850 - DNA, 22 bp, Homo sapiens
cccgagacaccatcctgagcca

SEQ ID NO: 1533851 - DNA, 17 bp, Homo sapiens
cccgagagagctctggc

SEQ ID NO: 1533852 - DNA, 20 bp, Homo sapiens
cccgagagagctctggcccc

SEQ ID NO: 1533853 - DNA, 12 bp, Homo sapiens
cccgagcacata

SEQ ID NO: 1533854 - DNA, 12 bp, Homo sapiens
cccgaggcccgc

SEQ ID NO: 1533855 - DNA, 14 bp, Homo sapiens
cccgaggctgcccc

SEQ ID NO: 1533856 - DNA, 15 bp, Homo sapiens
cccgaggctgcccca

SEQ ID NO: 1533857 - DNA, 16 bp, Homo sapiens
cccgaggctgccccag

SEQ ID NO: 1533858 - DNA, 20 bp, Homo sapiens
cccgaggctgccccaggccg

SEQ ID NO: 1533859 - DNA, 15 bp, Homo sapiens
cccgagtctccggga

SEQ ID NO: 1533860 - DNA, 19 bp, Homo sapiens
cccgagtggtggcagccag

SEQ ID NO: 1533861 - DNA, 15 bp, Homo sapiens
cccgatacctcagcc

SEQ ID NO: 1533862 - DNA, 16 bp, Homo sapiens
cccgatattctccctg

SEQ ID NO: 1533863 - DNA, 19 bp, Homo sapiens
cccgatattctccctgacc

SEQ ID NO: 1533864 - DNA, 15 bp, Homo sapiens
cccgatgctgctttc

SEQ ID NO: 1533865 - DNA, 16 bp, Homo sapiens
cccgatgctgctttcc

SEQ ID NO: 1533866 - DNA, 13 bp, Homo sapiens
cccgatggggcat

SEQ ID NO: 1533867 - DNA, 19 bp, Homo sapiens
cccgcaacccacagctcag

SEQ ID NO: 1533868 - DNA, 16 bp, Homo sapiens
cccgcacagccacccg

SEQ ID NO: 1533869 - DNA, 19 bp, Homo sapiens
cccgcaccccccaagctgt

SEQ ID NO: 1533870 - DNA, 19 bp, Homo sapiens
cccgcaccccggcctcagg

SEQ ID NO: 1533871 - DNA, 21 bp, Homo sapiens
cccgcagcccgcctgccgtgc

SEQ ID NO: 1533872 - DNA, 22 bp, Homo sapiens
cccgcaggaactgggctgggcc

SEQ ID NO: 1533873 - DNA, 22 bp, Homo sapiens
cccgcaggatccctcctgagct

SEQ ID NO: 1533874 - DNA, 15 bp, Homo sapiens
cccgcagtgctggga

SEQ ID NO: 1533875 - DNA, 20 bp, Homo sapiens
cccgcagtgctgggaccaga

SEQ ID NO: 1533876 - DNA, 22 bp, Homo sapiens
cccgcagtgctgggaccagagc

SEQ ID NO: 1533877 - DNA, 18 bp, Homo sapiens
cccgccacggccaccctc

SEQ ID NO: 1533878 - DNA, 12 bp, Homo sapiens
cccgccagcccc

SEQ ID NO: 1533879 - DNA, 15 bp, Homo sapiens
cccgccagcctcagt

SEQ ID NO: 1533880 - DNA, 15 bp, Homo sapiens
cccgcccacccacgc

SEQ ID NO: 1533881 - DNA, 16 bp, Homo sapiens
cccgcccactgtcctg

SEQ ID NO: 1533882 - DNA, 18 bp, Homo sapiens
cccgcccactgtcctggg

SEQ ID NO: 1533883 - DNA, 13 bp, Homo sapiens
cccgccccacagg

SEQ ID NO: 1533884 - DNA, 15 bp, Homo sapiens
cccgcccccacccct

SEQ ID NO: 1533885 - DNA, 21 bp, Homo sapiens
cccgccccgttgtgagctgga

SEQ ID NO: 1533886 - DNA, 14 bp, Homo sapiens
cccgcccctgggga

SEQ ID NO: 1533887 - DNA, 14 bp, Homo sapiens
cccgcccctgtggc

SEQ ID NO: 1533888 - DNA, 15 bp, Homo sapiens
cccgcccctgtggcc

SEQ ID NO: 1533889 - DNA, 22 bp, Homo sapiens
cccgccgcgccagtccccgcta

SEQ ID NO: 1533890 - DNA, 19 bp, Homo sapiens
cccgcctccactctagttc

SEQ ID NO: 1533891 - DNA, 22 bp, Homo sapiens
cccgcctccactctagttctag

SEQ ID NO: 1533892 - DNA, 15 bp, Homo sapiens
cccgcctccctctca

SEQ ID NO: 1533893 - DNA, 24 bp, Homo sapiens
cccgcctccctctcagaggcctgc

SEQ ID NO: 1533894 - DNA, 23 bp, Homo sapiens
cccgcctgagtcagtgctctcag

SEQ ID NO: 1533895 - DNA, 12 bp, Homo sapiens
cccgcctgccac

SEQ ID NO: 1533896 - DNA, 14 bp, Homo sapiens
cccgcctgccctca

SEQ ID NO: 1533897 - DNA, 16 bp, Homo sapiens
cccgcctgccgtgcat

SEQ ID NO: 1533898 - DNA, 12 bp, Homo sapiens
cccgcctgcctc

SEQ ID NO: 1533899 - DNA, 17 bp, Homo sapiens
cccgcctgcctcctggc

SEQ ID NO: 1533900 - DNA, 21 bp, Homo sapiens
cccgcctggccaggagcaggc

SEQ ID NO: 1533901 - DNA, 22 bp, Homo sapiens
cccgccttccaaaacctgcttc

SEQ ID NO: 1533902 - DNA, 15 bp, Homo sapiens
cccgcgcctccttcc

SEQ ID NO: 1533903 - DNA, 14 bp, Homo sapiens
cccgcgggttctag

SEQ ID NO: 1533904 - DNA, 20 bp, Homo sapiens
cccgcggtgctctggcggct

SEQ ID NO: 1533905 - DNA, 20 bp, Homo sapiens
cccgctagcggggccaggag

SEQ ID NO: 1533906 - DNA, 21 bp, Homo sapiens
cccgctcacaacttgggttct

SEQ ID NO: 1533907 - DNA, 23 bp, Homo sapiens
cccgctcagccctccctgcccct

SEQ ID NO: 1533908 - DNA, 21 bp, Homo sapiens
cccgctcaggggcctggaggt

SEQ ID NO: 1533909 - DNA, 20 bp, Homo sapiens
cccgctccgtctctgtcctc

SEQ ID NO: 1533910 - DNA, 21 bp, Homo sapiens
cccgctccgtctctgtcctcg

SEQ ID NO: 1533911 - DNA, 23 bp, Homo sapiens
cccgctcctgccgcagacgggca

SEQ ID NO: 1533912 - DNA, 15 bp, Homo sapiens
cccgctctccctgtc

SEQ ID NO: 1533913 - DNA, 16 bp, Homo sapiens
cccgctctctggctgt

SEQ ID NO: 1533914 - DNA, 16 bp, Homo sapiens
cccgctgatggagccc

SEQ ID NO: 1533915 - DNA, 12 bp, Homo sapiens
cccgctgctgct

SEQ ID NO: 1533916 - DNA, 15 bp, Homo sapiens
cccgctgctgctgct

SEQ ID NO: 1533917 - DNA, 15 bp, Homo sapiens
cccgctgctgtgctc

SEQ ID NO: 1533918 - DNA, 19 bp, Homo sapiens
cccgctgctgtgctctggg

SEQ ID NO: 1533919 - DNA, 23 bp, Homo sapiens
cccgctgctgtgctctggggatt

SEQ ID NO: 1533920 - DNA, 21 bp, Homo sapiens
cccgctgggatttcttcgctg

SEQ ID NO: 1533921 - DNA, 15 bp, Homo sapiens
cccgctgggctgagc

SEQ ID NO: 1533922 - DNA, 15 bp, Homo sapiens
cccgctgtggccgca

SEQ ID NO: 1533923 - DNA, 16 bp, Homo sapiens
cccgcttcctggcctc

SEQ ID NO: 1533924 - DNA, 17 bp, Homo sapiens
cccgcttcctggcctcc

SEQ ID NO: 1533925 - DNA, 14 bp, Homo sapiens
cccgcttggccacc

SEQ ID NO: 1533926 - DNA, 19 bp, Homo sapiens
cccggaagggctttggttc

SEQ ID NO: 1533927 - DNA, 19 bp, Homo sapiens
cccggagaaggccgctgcc

SEQ ID NO: 1533928 - DNA, 20 bp, Homo sapiens
cccggagcacagccctggga

SEQ ID NO: 1533929 - DNA, 17 bp, Homo sapiens
cccggaggggcctggca

SEQ ID NO: 1533930 - DNA, 14 bp, Homo sapiens
cccggattctggga

SEQ ID NO: 1533931 - DNA, 19 bp, Homo sapiens
cccggcaagcgcttctgct

SEQ ID NO: 1533932 - DNA, 13 bp, Homo sapiens
tctttgataacaa

SEQ ID NO: 1533933 - DNA, 18 bp, Homo sapiens
tctttgataacaaaaaat

SEQ ID NO: 1533934 - DNA, 21 bp, Homo sapiens
tctttgataacaaaaaataaa

SEQ ID NO: 1533935 - DNA, 14 bp, Homo sapiens
tctttgatcatgaa

SEQ ID NO: 1533936 - DNA, 20 bp, Homo sapiens
tctttgatcatgaataactg

SEQ ID NO: 1533937 - DNA, 15 bp, Homo sapiens
tctttgatccttctg

SEQ ID NO: 1533938 - DNA, 16 bp, Homo sapiens
tctttgattctccttc

SEQ ID NO: 1533939 - DNA, 20 bp, Homo sapiens
tctttgattctccttcagcc

SEQ ID NO: 1533940 - DNA, 16 bp, Homo sapiens
tctttgcaacttccca

SEQ ID NO: 1533941 - DNA, 18 bp, Homo sapiens
tctttgcaccaaagacat

SEQ ID NO: 1533942 - DNA, 19 bp, Homo sapiens
tctttgcaccaaagacatc

SEQ ID NO: 1533943 - DNA, 16 bp, Homo sapiens
tctttgcacttaaaaa

SEQ ID NO: 1533944 - DNA, 18 bp, Homo sapiens
tctttgcactttttctta

SEQ ID NO: 1533945 - DNA, 21 bp, Homo sapiens
tctttgctactgaatgtgttt

SEQ ID NO: 1533946 - DNA, 16 bp, Homo sapiens
tctttgctcagtggat

SEQ ID NO: 1533947 - DNA, 18 bp, Homo sapiens
tctttgctgcagtcttct

SEQ ID NO: 1533948 - DNA, 15 bp, Homo sapiens
tctttgctgtactct

SEQ ID NO: 1533949 - DNA, 23 bp, Homo sapiens
tctttgctgtactcttgctgatg

SEQ ID NO: 1533950 - DNA, 16 bp, Homo sapiens
tctttggaaatagcat

SEQ ID NO: 1533951 - DNA, 14 bp, Homo sapiens
tctttggctgcagg

SEQ ID NO: 1533952 - DNA, 18 bp, Homo sapiens
tctttggtaggtaaatct

SEQ ID NO: 1533953 - DNA, 12 bp, Homo sapiens
tctttggttcta

SEQ ID NO: 1533954 - DNA, 22 bp, Homo sapiens
cccggcgcggtggctcacgcct

SEQ ID NO: 1533955 - DNA, 22 bp, Homo sapiens
cccggctgagggtgggaggcaa

SEQ ID NO: 1533956 - DNA, 14 bp, Homo sapiens
cccggctggccggg

SEQ ID NO: 1533957 - DNA, 20 bp, Homo sapiens
cccggctgtgattgctgcca

SEQ ID NO: 1533958 - DNA, 12 bp, Homo sapiens
cccgggaaggaa

SEQ ID NO: 1533959 - DNA, 16 bp, Homo sapiens
cccgggaaggaaggct

SEQ ID NO: 1533960 - DNA, 18 bp, Homo sapiens
cccgggaccacagctgct

SEQ ID NO: 1533961 - DNA, 23 bp, Homo sapiens
cccgggaggcggaggttccagtg

SEQ ID NO: 1533962 - DNA, 18 bp, Homo sapiens
cccgggatattatagaaa

SEQ ID NO: 1533963 - DNA, 13 bp, Homo sapiens
cccgggatgcacc

SEQ ID NO: 1533964 - DNA, 13 bp, Homo sapiens
cccgggcagggct

SEQ ID NO: 1533965 - DNA, 22 bp, Homo sapiens
cccgggcagggctcccacagag

SEQ ID NO: 1533966 - DNA, 14 bp, Homo sapiens
cccgggccagggct

SEQ ID NO: 1533967 - DNA, 13 bp, Homo sapiens
cccgggcccagag

SEQ ID NO: 1533968 - DNA, 22 bp, Homo sapiens
cccgggcccgttgaggatgagg

SEQ ID NO: 1533969 - DNA, 16 bp, Homo sapiens
cccgggctctctgctg

SEQ ID NO: 1533970 - DNA, 16 bp, Homo sapiens
cccgggctctggccac

SEQ ID NO: 1533971 - DNA, 17 bp, Homo sapiens
cccgggctctggccacc

SEQ ID NO: 1533972 - DNA, 21 bp, Homo sapiens
cccgggctggagaaagagctg

SEQ ID NO: 1533973 - DNA, 11 bp, Homo sapiens
cccggggagga

SEQ ID NO: 1533974 - DNA, 22 bp, Homo sapiens
cccggggctggcaagcagggaa

SEQ ID NO: 1533975 - DNA, 18 bp, Homo sapiens
cccgggggcagggtgggg

SEQ ID NO: 1533976 - DNA, 16 bp, Homo sapiens
cccgggtccaggagaa

SEQ ID NO: 1533977 - DNA, 14 bp, Homo sapiens
cccgggtccccagc

SEQ ID NO: 1533978 - DNA, 18 bp, Homo sapiens
cccgggtccccagctccc

SEQ ID NO: 1533979 - DNA, 21 bp, Homo sapiens
cccgggtccccagctccccag

SEQ ID NO: 1533980 - DNA, 22 bp, Homo sapiens
cccgggtctccttggctgtctg

SEQ ID NO: 1533981 - DNA, 22 bp, Homo sapiens
cccggtctatgtcgagagctgg

SEQ ID NO: 1533982 - DNA, 13 bp, Homo sapiens
cccggtgctccct

SEQ ID NO: 1533983 - DNA, 14 bp, Homo sapiens
cccggtgctccctc

SEQ ID NO: 1533984 - DNA, 16 bp, Homo sapiens
cccggtgctccctctg

SEQ ID NO: 1533985 - DNA, 18 bp, Homo sapiens
cccggtggtttgccatgt

SEQ ID NO: 1533986 - DNA, 16 bp, Homo sapiens
cccgtaggcagcctct

SEQ ID NO: 1533987 - DNA, 19 bp, Homo sapiens
cccgtcaggacgttgagga

SEQ ID NO: 1533988 - DNA, 17 bp, Homo sapiens
cccgtcagggcccaagt

SEQ ID NO: 1533989 - DNA, 18 bp, Homo sapiens
cccgtcatgttcctcaaa

SEQ ID NO: 1533990 - DNA, 14 bp, Homo sapiens
cccgtcctgcctgt

SEQ ID NO: 1533991 - DNA, 16 bp, Homo sapiens
cccgtcctgcctgtgg

SEQ ID NO: 1533992 - DNA, 17 bp, Homo sapiens
cccgtcggagctgcctg

SEQ ID NO: 1533993 - DNA, 20 bp, Homo sapiens
cccgtcggagctgcctgcag

SEQ ID NO: 1533994 - DNA, 21 bp, Homo sapiens
cccgtcggagctgcctgcagc

SEQ ID NO: 1533995 - DNA, 22 bp, Homo sapiens
cccgtcggagctgcctgcagca

SEQ ID NO: 1533996 - DNA, 12 bp, Homo sapiens
cccgtctcagtg

SEQ ID NO: 1533997 - DNA, 14 bp, Homo sapiens
cccgtctctactaa

SEQ ID NO: 1533998 - DNA, 12 bp, Homo sapiens
cccgtcttcagc

SEQ ID NO: 1533999 - DNA, 15 bp, Homo sapiens
cccgtcttcagccta

SEQ ID NO: 1534000 - DNA, 20 bp, Homo sapiens
cccgtgaaagaattattttt

SEQ ID NO: 1534001 - DNA, 18 bp, Homo sapiens
cccgtgaagcagtgcctc

SEQ ID NO: 1534002 - DNA, 17 bp, Homo sapiens
cccgtgacgaggctcaa

SEQ ID NO: 1534003 - DNA, 12 bp, Homo sapiens
cccgtgccaccc

SEQ ID NO: 1534004 - DNA, 22 bp, Homo sapiens
cccgtgcccccgcctgccaccg

SEQ ID NO: 1534005 - DNA, 23 bp, Homo sapiens
cccgtgggcgcaaaggtgcctca

SEQ ID NO: 1534006 - DNA, 14 bp, Homo sapiens
cccgtggggcaggg

SEQ ID NO: 1534007 - DNA, 18 bp, Homo sapiens
cccgtggtctccttgcac

SEQ ID NO: 1534008 - DNA, 17 bp, Homo sapiens
cccgtgtaaaaagcctc

SEQ ID NO: 1534009 - DNA, 23 bp, Homo sapiens
cccgtgtcggttcttcctggaag

SEQ ID NO: 1534010 - DNA, 21 bp, Homo sapiens
cccgtgtgtgtgtatgtgtgt

SEQ ID NO: 1534011 - DNA, 15 bp, Homo sapiens
cccgtgttcaggaca

SEQ ID NO: 1534012 - DNA, 14 bp, Homo sapiens
cccgttccagctga

SEQ ID NO: 1534013 - DNA, 20 bp, Homo sapiens
cccgttccctgtcagaggct

SEQ ID NO: 1534014 - DNA, 14 bp, Homo sapiens
cccgtttcagaagg

SEQ ID NO: 1534015 - DNA, 23 bp, Homo sapiens
cccgtttcagaaggaccaattga

SEQ ID NO: 1534016 - DNA, 19 bp, Homo sapiens
cccgtttctccttttccta

SEQ ID NO: 1534017 - DNA, 20 bp, Homo sapiens
ccctaaaagaaaccctgcac

SEQ ID NO: 1534018 - DNA, 23 bp, Homo sapiens
ccctaaacaaaagcaaagatgca

SEQ ID NO: 1534019 - DNA, 23 bp, Homo sapiens
ccctaaatatacatctgtgtatt

SEQ ID NO: 1534020 - DNA, 14 bp, Homo sapiens
ccctaactgcagac

SEQ ID NO: 1534021 - DNA, 12 bp, Homo sapiens
ccctaagagact

SEQ ID NO: 1534022 - DNA, 23 bp, Homo sapiens
ccctaagcccccagggcctccag

SEQ ID NO: 1534023 - DNA, 13 bp, Homo sapiens
ccctaaggtccta

SEQ ID NO: 1534024 - DNA, 12 bp, Homo sapiens
ccctaagtgccc

SEQ ID NO: 1534025 - DNA, 16 bp, Homo sapiens
ccctaagtgcccaaag

SEQ ID NO: 1534026 - DNA, 17 bp, Homo sapiens
ccctaagtgcccaaagt

SEQ ID NO: 1534027 - DNA, 17 bp, Homo sapiens
ccctaattctcttcgct

SEQ ID NO: 1534028 - DNA, 18 bp, Homo sapiens
ccctacacccctcccctg

SEQ ID NO: 1534029 - DNA, 17 bp, Homo sapiens
ccctacagcctagggca

SEQ ID NO: 1534030 - DNA, 23 bp, Homo sapiens
ccctacagcctgcacacacctgc

SEQ ID NO: 1534031 - DNA, 23 bp, Homo sapiens
ccctaccagcgcccgctgggctg

SEQ ID NO: 1534032 - DNA, 21 bp, Homo sapiens
ccctaccccacaccaggccgt

SEQ ID NO: 1534033 - DNA, 15 bp, Homo sapiens
ccctaccctggcagg

SEQ ID NO: 1534034 - DNA, 16 bp, Homo sapiens
ccctactcccctgggc

SEQ ID NO: 1534035 - DNA, 22 bp, Homo sapiens
ccctacttgataatattagtga

SEQ ID NO: 1534036 - DNA, 13 bp, Homo sapiens
ccctagagagaat

SEQ ID NO: 1534037 - DNA, 14 bp, Homo sapiens
ccctagagagaata

SEQ ID NO: 1534038 - DNA, 19 bp, Homo sapiens
ccctagaggcgagccaggc

SEQ ID NO: 1534039 - DNA, 14 bp, Homo sapiens
ccctagcaaaactc

SEQ ID NO: 1534040 - DNA, 20 bp, Homo sapiens
ccctagcagcccaccctgct

SEQ ID NO: 1534041 - DNA, 13 bp, Homo sapiens
ccctagcagtgaa

SEQ ID NO: 1534042 - DNA, 12 bp, Homo sapiens
ccctagccctgg

SEQ ID NO: 1534043 - DNA, 23 bp, Homo sapiens
ccctagcctgacccggaggaaag

SEQ ID NO: 1534044 - DNA, 11 bp, Homo sapiens
ccctagccttg

SEQ ID NO: 1534045 - DNA, 15 bp, Homo sapiens
ccctagctcaccagg

SEQ ID NO: 1534046 - DNA, 17 bp, Homo sapiens
ccctagctcaccaggcc

SEQ ID NO: 1534047 - DNA, 13 bp, Homo sapiens
ccctagctgaccc

SEQ ID NO: 1534048 - DNA, 19 bp, Homo sapiens
ccctagctgtcccatgggg

SEQ ID NO: 1534049 - DNA, 17 bp, Homo sapiens
ccctagctttagaccct

SEQ ID NO: 1534050 - DNA, 21 bp, Homo sapiens
ccctagctttagaccctgggt

SEQ ID NO: 1534051 - DNA, 19 bp, Homo sapiens
tgaaaaatctcaattgaaa

SEQ ID NO: 1534052 - DNA, 23 bp, Homo sapiens
tgaaaaatctgttgataaatcca

SEQ ID NO: 1534053 - DNA, 14 bp, Homo sapiens
tgaaaaattaactt

SEQ ID NO: 1534054 - DNA, 19 bp, Homo sapiens
tgaaaaattcctttgtgtt

SEQ ID NO: 1534055 - DNA, 12 bp, Homo sapiens
tgaaaacaaaaa

SEQ ID NO: 1534056 - DNA, 17 bp, Homo sapiens
tgaaaacaagaaagaaa

SEQ ID NO: 1534057 - DNA, 23 bp, Homo sapiens
tgaaaacatggtagaattggaga

SEQ ID NO: 1534058 - DNA, 20 bp, Homo sapiens
tgaaaaccaaccctgtgggc

SEQ ID NO: 1534059 - DNA, 15 bp, Homo sapiens
tgaaaacccagagag

SEQ ID NO: 1534060 - DNA, 17 bp, Homo sapiens
tgaaaagaaatgctaat

SEQ ID NO: 1534061 - DNA, 19 bp, Homo sapiens
tgaaaagactccaaagaaa

SEQ ID NO: 1534062 - DNA, 18 bp, Homo sapiens
tgaaaagcaattgccctg

SEQ ID NO: 1534063 - DNA, 13 bp, Homo sapiens
tgaaaagcacaca

SEQ ID NO: 1534064 - DNA, 17 bp, Homo sapiens
tgaaaagctttgtttgt

SEQ ID NO: 1534065 - DNA, 16 bp, Homo sapiens
tgaaaaggcaaaaagc

SEQ ID NO: 1534066 - DNA, 21 bp, Homo sapiens
tgaaaagggcggaagagttac

SEQ ID NO: 1534067 - DNA, 21 bp, Homo sapiens
tgaaaagtatattgataacct

SEQ ID NO: 1534068 - DNA, 12 bp, Homo sapiens
tgaaaagttgaa

SEQ ID NO: 1534069 - DNA, 17 bp, Homo sapiens
ccctcaaaaaaagcctt

SEQ ID NO: 1534070 - DNA, 19 bp, Homo sapiens
ccctcaaaaaaagccttta

SEQ ID NO: 1534071 - DNA, 24 bp, Homo sapiens
ccctcaaacctcctcttctgacgt

SEQ ID NO: 1534072 - DNA, 17 bp, Homo sapiens
ccctcaccatccagtgg

SEQ ID NO: 1534073 - DNA, 13 bp, Homo sapiens
ccctcacccctgc

SEQ ID NO: 1534074 - DNA, 12 bp, Homo sapiens
ccctcacctggt

SEQ ID NO: 1534075 - DNA, 23 bp, Homo sapiens
ccctcaccttggcaccagacacc

SEQ ID NO: 1534076 - DNA, 15 bp, Homo sapiens
ccctcactccccagg

SEQ ID NO: 1534077 - DNA, 15 bp, Homo sapiens
ccctcactccctctg

SEQ ID NO: 1534078 - DNA, 17 bp, Homo sapiens
ccctcactgctggggag

SEQ ID NO: 1534079 - DNA, 21 bp, Homo sapiens
ccctcagaaggtctgttttga

SEQ ID NO: 1534080 - DNA, 21 bp, Homo sapiens
ccctcagcaccccttccatgt

SEQ ID NO: 1534081 - DNA, 12 bp, Homo sapiens
ccctcagccctt

SEQ ID NO: 1534082 - DNA, 14 bp, Homo sapiens
ccctcagcccttgc

SEQ ID NO: 1534083 - DNA, 19 bp, Homo sapiens
ccctcagcccttgccccca

SEQ ID NO: 1534084 - DNA, 13 bp, Homo sapiens
ccctcagcctcca

SEQ ID NO: 1534085 - DNA, 17 bp, Homo sapiens
ccctcagcctccaatgc

SEQ ID NO: 1534086 - DNA, 18 bp, Homo sapiens
ccctcaggcataggcctg

SEQ ID NO: 1534087 - DNA, 20 bp, Homo sapiens
ccctcaggcataggcctggg

SEQ ID NO: 1534088 - DNA, 23 bp, Homo sapiens
ccctcaggcataggcctgggtgc

SEQ ID NO: 1534089 - DNA, 16 bp, Homo sapiens
ccctcaggttcctttt

SEQ ID NO: 1534090 - DNA, 19 bp, Homo sapiens
ccctcagtagtccctgcac

SEQ ID NO: 1534091 - DNA, 18 bp, Homo sapiens
ccctcagtcagttcccgg

SEQ ID NO: 1534092 - DNA, 22 bp, Homo sapiens
ccctcagtcagttcccggagca

SEQ ID NO: 1534093 - DNA, 23 bp, Homo sapiens
ccctcataagtttgtttaaacac

SEQ ID NO: 1534094 - DNA, 17 bp, Homo sapiens
ccctcataccatctgct

SEQ ID NO: 1534095 - DNA, 19 bp, Homo sapiens
ccctcataccatctgctgc

SEQ ID NO: 1534096 - DNA, 14 bp, Homo sapiens
ccctcatgccaacc

SEQ ID NO: 1534097 - DNA, 19 bp, Homo sapiens
ccctcatggcccccagggg

SEQ ID NO: 1534098 - DNA, 20 bp, Homo sapiens
ccctcatggcccccaggggc

SEQ ID NO: 1534099 - DNA, 17 bp, Homo sapiens
ccctcatggcccctctg

SEQ ID NO: 1534100 - DNA, 15 bp, Homo sapiens
ccctcatggctctgg

SEQ ID NO: 1534101 - DNA, 15 bp, Homo sapiens
ccctcattcaggaaa

SEQ ID NO: 1534102 - DNA, 17 bp, Homo sapiens
ccctcattcaggaaaac

SEQ ID NO: 1534103 - DNA, 18 bp, Homo sapiens
ccctccaaacctccagcc

SEQ ID NO: 1534104 - DNA, 11 bp, Homo sapiens
ccctccaaaga

SEQ ID NO: 1534105 - DNA, 14 bp, Homo sapiens
ccctccacagctgc

SEQ ID NO: 1534106 - DNA, 18 bp, Homo sapiens
ccctccaccagcctgctg

SEQ ID NO: 1534107 - DNA, 20 bp, Homo sapiens
ccctccaccagcctgctgac

SEQ ID NO: 1534108 - DNA, 17 bp, Homo sapiens
ccctccactcagctgtc

SEQ ID NO: 1534109 - DNA, 14 bp, Homo sapiens
ccctccactccact

SEQ ID NO: 1534110 - DNA, 16 bp, Homo sapiens
ccctccactccactgc

SEQ ID NO: 1534111 - DNA, 14 bp, Homo sapiens
ccctccagcaccac

SEQ ID NO: 1534112 - DNA, 23 bp, Homo sapiens
ccctccagcgggacaccctggtt

SEQ ID NO: 1534113 - DNA, 13 bp, Homo sapiens
ccctccaggcctg

SEQ ID NO: 1534114 - DNA, 15 bp, Homo sapiens
ccctccaggcctgca

SEQ ID NO: 1534115 - DNA, 18 bp, Homo sapiens
ccctccaggcctgcaggg

SEQ ID NO: 1534116 - DNA, 19 bp, Homo sapiens
ccctccaggcctgcagggg

SEQ ID NO: 1534117 - DNA, 12 bp, Homo sapiens
ccctcccaacct

SEQ ID NO: 1534118 - DNA, 14 bp, Homo sapiens
ccctcccaacctca

SEQ ID NO: 1534119 - DNA, 23 bp, Homo sapiens
ccctcccaacctcaatgccctgc

SEQ ID NO: 1534120 - DNA, 15 bp, Homo sapiens
ccctcccaaggagcc

SEQ ID NO: 1534121 - DNA, 18 bp, Homo sapiens
ccctcccaagtagctggg

SEQ ID NO: 1534122 - DNA, 16 bp, Homo sapiens
ccctcccaatcctctc

SEQ ID NO: 1534123 - DNA, 19 bp, Homo sapiens
ccctcccacacccaaagct

SEQ ID NO: 1534124 - DNA, 10 bp, Homo sapiens
ccctcccaga

SEQ ID NO: 1534125 - DNA, 14 bp, Homo sapiens
ccctcccagcccat

SEQ ID NO: 1534126 - DNA, 22 bp, Homo sapiens
ccctcccagggccagggccctg

SEQ ID NO: 1534127 - DNA, 14 bp, Homo sapiens
ccctcccaggggag

SEQ ID NO: 1534128 - DNA, 22 bp, Homo sapiens
ccctcccaggggagccagctgc

SEQ ID NO: 1534129 - DNA, 15 bp, Homo sapiens
ccctcccaggtcggg

SEQ ID NO: 1534130 - DNA, 21 bp, Homo sapiens
ccctcccaggtcgggcagtgg

SEQ ID NO: 1534131 - DNA, 14 bp, Homo sapiens
ccctcccagttttc

SEQ ID NO: 1534132 - DNA, 13 bp, Homo sapiens
ccctcccatctgg

SEQ ID NO: 1534133 - DNA, 19 bp, Homo sapiens
ccctccccacagtgccacc

SEQ ID NO: 1534134 - DNA, 23 bp, Homo sapiens
ccctccccacagtgccacccatg

SEQ ID NO: 1534135 - DNA, 14 bp, Homo sapiens
ccctccccagggga

SEQ ID NO: 1534136 - DNA, 17 bp, Homo sapiens
ccctccccattcacaga

SEQ ID NO: 1534137 - DNA, 21 bp, Homo sapiens
ccctccccattcacagagcct

SEQ ID NO: 1534138 - DNA, 13 bp, Homo sapiens
ccctcccccagca

SEQ ID NO: 1534139 - DNA, 15 bp, Homo sapiens
ccctccccccagact

SEQ ID NO: 1534140 - DNA, 16 bp, Homo sapiens
ccctccccccagactc

SEQ ID NO: 1534141 - DNA, 20 bp, Homo sapiens
ccctcccccccatgcactgt

SEQ ID NO: 1534142 - DNA, 15 bp, Homo sapiens
ccctccccctcctgc

SEQ ID NO: 1534143 - DNA, 13 bp, Homo sapiens
ccctccccctgag

SEQ ID NO: 1534144 - DNA, 14 bp, Homo sapiens
ccctccccctgcca

SEQ ID NO: 1534145 - DNA, 16 bp, Homo sapiens
ccctccccgcaccccc

SEQ ID NO: 1534146 - DNA, 21 bp, Homo sapiens
ccctccccgcccctgtggccc

SEQ ID NO: 1534147 - DNA, 18 bp, Homo sapiens
ccctccccggccacatgc

SEQ ID NO: 1534148 - DNA, 15 bp, Homo sapiens
ccctcccctgctccc

SEQ ID NO: 1534149 - DNA, 16 bp, Homo sapiens
ccctcccctgctccca

SEQ ID NO: 1534150 - DNA, 16 bp, Homo sapiens
ccctccccttcccctt

SEQ ID NO: 1534151 - DNA, 14 bp, Homo sapiens
ccctccccttctct

SEQ ID NO: 1534152 - DNA, 13 bp, Homo sapiens
ccctcccgcacct

SEQ ID NO: 1534153 - DNA, 18 bp, Homo sapiens
ccctcccgcaccttcctc

SEQ ID NO: 1534154 - DNA, 21 bp, Homo sapiens
ccctcccgcaccttcctcctc

SEQ ID NO: 1534155 - DNA, 14 bp, Homo sapiens
ccctccctctccca

SEQ ID NO: 1534156 - DNA, 13 bp, Homo sapiens
ccctccctgggtt

SEQ ID NO: 1534157 - DNA, 16 bp, Homo sapiens
ccctccctgggttcag

SEQ ID NO: 1534158 - DNA, 12 bp, Homo sapiens
ccctcccttgga

SEQ ID NO: 1534159 - DNA, 19 bp, Homo sapiens
ccctcccttggaaacctgc

SEQ ID NO: 1534160 - DNA, 18 bp, Homo sapiens
ccctccgatgctgaggcc

SEQ ID NO: 1534161 - DNA, 13 bp, Homo sapiens
ccctccgccctgc

SEQ ID NO: 1534162 - DNA, 16 bp, Homo sapiens
ccctccgccgtgccgg

SEQ ID NO: 1534163 - DNA, 15 bp, Homo sapiens
ccctccgcctgggat

SEQ ID NO: 1534164 - DNA, 21 bp, Homo sapiens
ccctccgccttcactccggtg

SEQ ID NO: 1534165 - DNA, 18 bp, Homo sapiens
ccctccggcgggtgacag

SEQ ID NO: 1534166 - DNA, 23 bp, Homo sapiens
ccctccggcgggtgacagctccg

SEQ ID NO: 1534167 - DNA, 23 bp, Homo sapiens
ccctcctcacctctggactggct

SEQ ID NO: 1534168 - DNA, 22 bp, Homo sapiens
ccctcctcagcgagaggcagca

SEQ ID NO: 1534169 - DNA, 23 bp, Homo sapiens
ccctcctccaggcctgcctccca

SEQ ID NO: 1534170 - DNA, 22 bp, Homo sapiens
tgaaataaaaaaaaaaggatga

SEQ ID NO: 1534171 - DNA, 17 bp, Homo sapiens
tgaaataaaatgccata

SEQ ID NO: 1534172 - DNA, 13 bp, Homo sapiens
tgaaataaatgtt

SEQ ID NO: 1534173 - DNA, 23 bp, Homo sapiens
tgaaataaattctgacttatgaa

SEQ ID NO: 1534174 - DNA, 14 bp, Homo sapiens
tgaaataatatatt

SEQ ID NO: 1534175 - DNA, 18 bp, Homo sapiens
tgaaataatatatttctt

SEQ ID NO: 1534176 - DNA, 15 bp, Homo sapiens
tgaaataatcagtga

SEQ ID NO: 1534177 - DNA, 18 bp, Homo sapiens
tgaaataattacagaata

SEQ ID NO: 1534178 - DNA, 19 bp, Homo sapiens
tgaaatacacaagtaaaca

SEQ ID NO: 1534179 - DNA, 13 bp, Homo sapiens
tgaaatacatcct

SEQ ID NO: 1534180 - DNA, 17 bp, Homo sapiens
tgaaataccttttctca

SEQ ID NO: 1534181 - DNA, 19 bp, Homo sapiens
tgaaatacttcgatgatga

SEQ ID NO: 1534182 - DNA, 21 bp, Homo sapiens
tgaaatagtatacattgtctt

SEQ ID NO: 1534183 - DNA, 13 bp, Homo sapiens
tgaaatagtctgt

SEQ ID NO: 1534184 - DNA, 16 bp, Homo sapiens
ccctcgaaccaaggca

SEQ ID NO: 1534185 - DNA, 17 bp, Homo sapiens
ccctcgaaccaaggcag

SEQ ID NO: 1534186 - DNA, 18 bp, Homo sapiens
ccctcgaaccaaggcagc

SEQ ID NO: 1534187 - DNA, 21 bp, Homo sapiens
ccctcgaaccaaggcagcctc

SEQ ID NO: 1534188 - DNA, 17 bp, Homo sapiens
ccctcgaccctgtgcag

SEQ ID NO: 1534189 - DNA, 15 bp, Homo sapiens
ccctcgccctgtgag

SEQ ID NO: 1534190 - DNA, 19 bp, Homo sapiens
ccctcgccgtccctcccag

SEQ ID NO: 1534191 - DNA, 16 bp, Homo sapiens
ccctcgcgcccaaaag

SEQ ID NO: 1534192 - DNA, 21 bp, Homo sapiens
ccctcgctgctgctactaccc

SEQ ID NO: 1534193 - DNA, 14 bp, Homo sapiens
ccctcgctgcttct

SEQ ID NO: 1534194 - DNA, 17 bp, Homo sapiens
ccctcgctgcttctgtg

SEQ ID NO: 1534195 - DNA, 21 bp, Homo sapiens
ccctcggaagccgtctgactc

SEQ ID NO: 1534196 - DNA, 19 bp, Homo sapiens
ccctcggaggtccagctgg

SEQ ID NO: 1534197 - DNA, 18 bp, Homo sapiens
ccctcgggcccacctggc

SEQ ID NO: 1534198 - DNA, 20 bp, Homo sapiens
ccctcgggcccacctggcca

SEQ ID NO: 1534199 - DNA, 21 bp, Homo sapiens
ccctcgggcccacctggccac

SEQ ID NO: 1534200 - DNA, 19 bp, Homo sapiens
ccctcgggccccatcctca

SEQ ID NO: 1534201 - DNA, 17 bp, Homo sapiens
ccctcgggcgagtcact

SEQ ID NO: 1534202 - DNA, 17 bp, Homo sapiens
ccctcgtcctgtcccag

SEQ ID NO: 1534203 - DNA, 13 bp, Homo sapiens
ccctcgtggccag

SEQ ID NO: 1534204 - DNA, 15 bp, Homo sapiens
ccctcgtggccagcc

SEQ ID NO: 1534205 - DNA, 19 bp, Homo sapiens
ccctcgtggccagcccggc

SEQ ID NO: 1534206 - DNA, 20 bp, Homo sapiens
ccctcgtggccagcccggct

SEQ ID NO: 1534207 - DNA, 15 bp, Homo sapiens
ccctcgtggccttcc

SEQ ID NO: 1534208 - DNA, 13 bp, Homo sapiens
ccctctaacccag

SEQ ID NO: 1534209 - DNA, 16 bp, Homo sapiens
ccctctcacccgggac

SEQ ID NO: 1534210 - DNA, 23 bp, Homo sapiens
ccctctcagaggcctgctgccag

SEQ ID NO: 1534211 - DNA, 14 bp, Homo sapiens
ccctctcagctcca

SEQ ID NO: 1534212 - DNA, 10 bp, Homo sapiens
ccctctcagg

SEQ ID NO: 1534213 - DNA, 20 bp, Homo sapiens
ccctctcccaaaaaactact

SEQ ID NO: 1534214 - DNA, 15 bp, Homo sapiens
ccctctccctctctc

SEQ ID NO: 1534215 - DNA, 11 bp, Homo sapiens
ccctctccctg

SEQ ID NO: 1534216 - DNA, 13 bp, Homo sapiens
ccctctcctgcct

SEQ ID NO: 1534217 - DNA, 11 bp, Homo sapiens
ccctctcctgt

SEQ ID NO: 1534218 - DNA, 18 bp, Homo sapiens
ccctctcctgtctgccct

SEQ ID NO: 1534219 - DNA, 17 bp, Homo sapiens
ccctctccttcctgtgt

SEQ ID NO: 1534220 - DNA, 19 bp, Homo sapiens
ccctctcgctcccctctgc

SEQ ID NO: 1534221 - DNA, 16 bp, Homo sapiens
ccctctcggccaggca

SEQ ID NO: 1534222 - DNA, 22 bp, Homo sapiens
ccctctctcataccctccctcc

SEQ ID NO: 1534223 - DNA, 19 bp, Homo sapiens
ccctctctcccatttcagg

SEQ ID NO: 1534224 - DNA, 14 bp, Homo sapiens
ccctctctctgggc

SEQ ID NO: 1534225 - DNA, 15 bp, Homo sapiens
ccctctctcttctgc

SEQ ID NO: 1534226 - DNA, 17 bp, Homo sapiens
ccctctctcttctgctc

SEQ ID NO: 1534227 - DNA, 18 bp, Homo sapiens
ccctctctcttctgctcc

SEQ ID NO: 1534228 - DNA, 22 bp, Homo sapiens
ccctctctcttctgctccaccc

SEQ ID NO: 1534229 - DNA, 13 bp, Homo sapiens
ccctctctgctcc

SEQ ID NO: 1534230 - DNA, 14 bp, Homo sapiens
ccctctctgctcct

SEQ ID NO: 1534231 - DNA, 15 bp, Homo sapiens
ccctctctggtttcc

SEQ ID NO: 1534232 - DNA, 13 bp, Homo sapiens
ccctctctgtgca

SEQ ID NO: 1534233 - DNA, 12 bp, Homo sapiens
ccctctcttggc

SEQ ID NO: 1534234 - DNA, 12 bp, Homo sapiens
ccctctctttct

SEQ ID NO: 1534235 - DNA, 14 bp, Homo sapiens
ccctctgcccagct

SEQ ID NO: 1534236 - DNA, 15 bp, Homo sapiens
ccctctgcccagctt

SEQ ID NO: 1534237 - DNA, 16 bp, Homo sapiens
ccctctgcccagcttg

SEQ ID NO: 1534238 - DNA, 18 bp, Homo sapiens
ccctctgcccagcttggg

SEQ ID NO: 1534239 - DNA, 19 bp, Homo sapiens
ccctctgcccagcttgggc

SEQ ID NO: 1534240 - DNA, 12 bp, Homo sapiens
ccctctgcccca

SEQ ID NO: 1534241 - DNA, 22 bp, Homo sapiens
ccctctgccccaagcagccagc

SEQ ID NO: 1534242 - DNA, 23 bp, Homo sapiens
ccctctgccccaagcagccagcc

SEQ ID NO: 1534243 - DNA, 14 bp, Homo sapiens
ccctctgcctgcac

SEQ ID NO: 1534244 - DNA, 16 bp, Homo sapiens
ccctctgcctgcactc

SEQ ID NO: 1534245 - DNA, 18 bp, Homo sapiens
ccctctgcctgcactccc

SEQ ID NO: 1534246 - DNA, 21 bp, Homo sapiens
ccctctgcctgcactccctgg

SEQ ID NO: 1534247 - DNA, 13 bp, Homo sapiens
ccctctgccttca

SEQ ID NO: 1534248 - DNA, 12 bp, Homo sapiens
ccctctgcggct

SEQ ID NO: 1534249 - DNA, 21 bp, Homo sapiens
ccctctgctctgcctggagtg

SEQ ID NO: 1534250 - DNA, 11 bp, Homo sapiens
ccctctgctgc

SEQ ID NO: 1534251 - DNA, 15 bp, Homo sapiens
ccctctgctgtcctg

SEQ ID NO: 1534252 - DNA, 17 bp, Homo sapiens
ccctctgctgtcctgca

SEQ ID NO: 1534253 - DNA, 21 bp, Homo sapiens
ccctctgctgtcctgcagtag

SEQ ID NO: 1534254 - DNA, 12 bp, Homo sapiens
ccctctggcttc

SEQ ID NO: 1534255 - DNA, 13 bp, Homo sapiens
ccctctggcttcc

SEQ ID NO: 1534256 - DNA, 15 bp, Homo sapiens
ccctctgggcctgtt

SEQ ID NO: 1534257 - DNA, 20 bp, Homo sapiens
ccctctgggcctgttctctt

SEQ ID NO: 1534258 - DNA, 19 bp, Homo sapiens
ccctctgggggtcctctct

SEQ ID NO: 1534259 - DNA, 22 bp, Homo sapiens
ccctctggtcgctcctgcccac

SEQ ID NO: 1534260 - DNA, 21 bp, Homo sapiens
ccctctgtagctccctcctcc

SEQ ID NO: 1534261 - DNA, 15 bp, Homo sapiens
ccctctgtcatcctc

SEQ ID NO: 1534262 - DNA, 22 bp, Homo sapiens
ccctctgtctaggactgcagtg

SEQ ID NO: 1534263 - DNA, 18 bp, Homo sapiens
ccctctgtgtatttgctt

SEQ ID NO: 1534264 - DNA, 20 bp, Homo sapiens
ccctctgtttctctttcctt

SEQ ID NO: 1534265 - DNA, 22 bp, Homo sapiens
ccctcttcactgtggccacagc

SEQ ID NO: 1534266 - DNA, 12 bp, Homo sapiens
ccctcttcctcc

SEQ ID NO: 1534267 - DNA, 15 bp, Homo sapiens
ccctcttgcccatcc

SEQ ID NO: 1534268 - DNA, 16 bp, Homo sapiens
ccctcttgcccatcct

SEQ ID NO: 1534269 - DNA, 21 bp, Homo sapiens
ccctcttgcccgcacccctcc

SEQ ID NO: 1534270 - DNA, 23 bp, Homo sapiens
ccctcttggagaagtctcagcta

SEQ ID NO: 1534271 - DNA, 20 bp, Homo sapiens
ccctctttcttgtttgtcag

SEQ ID NO: 1534272 - DNA, 14 bp, Homo sapiens
ccctctttgctgca

SEQ ID NO: 1534273 - DNA, 15 bp, Homo sapiens
ccctgaaaaactgat

SEQ ID NO: 1534274 - DNA, 19 bp, Homo sapiens
ccctgaaaacgaaggggcc

SEQ ID NO: 1534275 - DNA, 24 bp, Homo sapiens
ccctgaaaatgtttttctgccagg

SEQ ID NO: 1534276 - DNA, 19 bp, Homo sapiens
ccctgaaaggaacactggc

SEQ ID NO: 1534277 - DNA, 14 bp, Homo sapiens
ccctgaacccctgg

SEQ ID NO: 1534278 - DNA, 20 bp, Homo sapiens
ccctgaacccctggccagct

SEQ ID NO: 1534279 - DNA, 15 bp, Homo sapiens
ccctgaacgttttct

SEQ ID NO: 1534280 - DNA, 18 bp, Homo sapiens
ccctgaacgttttcttct

SEQ ID NO: 1534281 - DNA, 20 bp, Homo sapiens
ccctgaacgttttcttcttt

SEQ ID NO: 1534282 - DNA, 17 bp, Homo sapiens
ccctgaagatttcagag

SEQ ID NO: 1534283 - DNA, 15 bp, Homo sapiens
ccctgacctcactgt

SEQ ID NO: 1534284 - DNA, 19 bp, Homo sapiens
ccctgacctccgcccctgc

SEQ ID NO: 1534285 - DNA, 18 bp, Homo sapiens
ccctgactctctgtgacc

SEQ ID NO: 1534286 - DNA, 16 bp, Homo sapiens
ccctgacttctggaga

SEQ ID NO: 1534287 - DNA, 20 bp, Homo sapiens
ccctgagaaacccaccagcc

SEQ ID NO: 1534288 - DNA, 20 bp, Homo sapiens
ccctgagacaaatggaggcc

SEQ ID NO: 1534289 - DNA, 20 bp, Homo sapiens
tgaactattttaaataaaat

SEQ ID NO: 1534290 - DNA, 14 bp, Homo sapiens
tgaactcaaacgat

SEQ ID NO: 1534291 - DNA, 13 bp, Homo sapiens
tgaactcaagctg

SEQ ID NO: 1534292 - DNA, 14 bp, Homo sapiens
tgaactcaagctgc

SEQ ID NO: 1534293 - DNA, 18 bp, Homo sapiens
tgaactcaagctgcgttt

SEQ ID NO: 1534294 - DNA, 15 bp, Homo sapiens
tgaactcaccctggg

SEQ ID NO: 1534295 - DNA, 20 bp, Homo sapiens
tgaactcagcacattcggga

SEQ ID NO: 1534296 - DNA, 18 bp, Homo sapiens
tgaactccttccccactt

SEQ ID NO: 1534297 - DNA, 22 bp, Homo sapiens
tgaactcttcagaacacacaga

SEQ ID NO: 1534298 - DNA, 22 bp, Homo sapiens
tgaactctttctggcctgcctt

SEQ ID NO: 1534299 - DNA, 13 bp, Homo sapiens
tgaagggaagtgg

SEQ ID NO: 1534300 - DNA, 14 bp, Homo sapiens
tgaagggagagcca

SEQ ID NO: 1534301 - DNA, 19 bp, Homo sapiens
tgaagggagagccagctcc

SEQ ID NO: 1534302 - DNA, 15 bp, Homo sapiens
tgaagggccagagcc

SEQ ID NO: 1534303 - DNA, 17 bp, Homo sapiens
tgaagggccagagccag

SEQ ID NO: 1534304 - DNA, 22 bp, Homo sapiens
tgaaggtcccctggcagtgctg

SEQ ID NO: 1534305 - DNA, 19 bp, Homo sapiens
tgaaggtgataagggaaaa

SEQ ID NO: 1534306 - DNA, 20 bp, Homo sapiens
tgaaggtgctgacggccagg

SEQ ID NO: 1534307 - DNA, 18 bp, Homo sapiens
tgaaggtttttgtaaaga

SEQ ID NO: 1534308 - DNA, 14 bp, Homo sapiens
tgaagtaaactttt

SEQ ID NO: 1534309 - DNA, 16 bp, Homo sapiens
tgaagtaaactttttg

SEQ ID NO: 1534310 - DNA, 17 bp, Homo sapiens
tgaagtaacttatttga

SEQ ID NO: 1534311 - DNA, 13 bp, Homo sapiens
tgaagtacatatt

SEQ ID NO: 1534312 - DNA, 20 bp, Homo sapiens
tgaagtacatattaggaaaa

SEQ ID NO: 1534313 - DNA, 13 bp, Homo sapiens
tgaagtagatggt

SEQ ID NO: 1534314 - DNA, 14 bp, Homo sapiens
tgaagtaggtggct

SEQ ID NO: 1534315 - DNA, 15 bp, Homo sapiens
tgaagtatactgtat

SEQ ID NO: 1534316 - DNA, 16 bp, Homo sapiens
tgaagtcactgcacag

SEQ ID NO: 1534317 - DNA, 12 bp, Homo sapiens
tgaagtcagcca

SEQ ID NO: 1534318 - DNA, 22 bp, Homo sapiens
tgaagtcagccacactgggcct

SEQ ID NO: 1534319 - DNA, 20 bp, Homo sapiens
tgaagtccctgtttgggaat

SEQ ID NO: 1534320 - DNA, 13 bp, Homo sapiens
tgaagtgaatctg

SEQ ID NO: 1534321 - DNA, 17 bp, Homo sapiens
tgaagtgcacaggagcc

SEQ ID NO: 1534322 - DNA, 13 bp, Homo sapiens
tgaagtggctggt

SEQ ID NO: 1534323 - DNA, 19 bp, Homo sapiens
tgaagtggctggtagaaaa

SEQ ID NO: 1534324 - DNA, 15 bp, Homo sapiens
tgaagttagtggaaa

SEQ ID NO: 1534325 - DNA, 16 bp, Homo sapiens
tgaagttcatcttgca

SEQ ID NO: 1534326 - DNA, 16 bp, Homo sapiens
tgaagttcatggtgat

SEQ ID NO: 1534327 - DNA, 13 bp, Homo sapiens
tgaagttctgagc

SEQ ID NO: 1534328 - DNA, 14 bp, Homo sapiens
tgaagttgctgttt

SEQ ID NO: 1534329 - DNA, 18 bp, Homo sapiens
tgaagttgggtgtttcca

SEQ ID NO: 1534330 - DNA, 13 bp, Homo sapiens
tgaagttggttta

SEQ ID NO: 1534331 - DNA, 21 bp, Homo sapiens
tgaagttggtttagctttgga

SEQ ID NO: 1534332 - DNA, 12 bp, Homo sapiens
tgaagttgtgca

SEQ ID NO: 1534333 - DNA, 22 bp, Homo sapiens
tgaagttgtgcaacggccaggg

SEQ ID NO: 1534334 - DNA, 20 bp, Homo sapiens
tgaagttgtttatcaacttc

SEQ ID NO: 1534335 - DNA, 18 bp, Homo sapiens
tgaagtttaattgtctca

SEQ ID NO: 1534336 - DNA, 20 bp, Homo sapiens
tgaagtttacattgtaaata

SEQ ID NO: 1534337 - DNA, 13 bp, Homo sapiens
tgaagtttcaagt

SEQ ID NO: 1534338 - DNA, 15 bp, Homo sapiens
tgaataaaagtgcac

SEQ ID NO: 1534339 - DNA, 16 bp, Homo sapiens
tgaataaaagtgcaca

SEQ ID NO: 1534340 - DNA, 15 bp, Homo sapiens
tgaataaagacacct

SEQ ID NO: 1534341 - DNA, 20 bp, Homo sapiens
tgaataaagcctttgtatct

SEQ ID NO: 1534342 - DNA, 12 bp, Homo sapiens
tgaataaagtgt

SEQ ID NO: 1534343 - DNA, 14 bp, Homo sapiens
tgaataatgaaaat

SEQ ID NO: 1534344 - DNA, 15 bp, Homo sapiens
tgaataatttcccaa

SEQ ID NO: 1534345 - DNA, 22 bp, Homo sapiens
tgaataatttcccaattaggaa

SEQ ID NO: 1534346 - DNA, 17 bp, Homo sapiens
tgaatacaaacaatgga

SEQ ID NO: 1534347 - DNA, 23 bp, Homo sapiens
tgaatacaaacaatggaaactga

SEQ ID NO: 1534348 - DNA, 13 bp, Homo sapiens
tgaatacaagcct

SEQ ID NO: 1534349 - DNA, 19 bp, Homo sapiens
tgaatacagggcatgcatt

SEQ ID NO: 1534350 - DNA, 13 bp, Homo sapiens
tgaatacattaac

SEQ ID NO: 1534351 - DNA, 16 bp, Homo sapiens
tgaatacattctttgc

SEQ ID NO: 1534352 - DNA, 17 bp, Homo sapiens
tgaatacattctttgct

SEQ ID NO: 1534353 - DNA, 17 bp, Homo sapiens
tgaataccattaaaact

SEQ ID NO: 1534354 - DNA, 12 bp, Homo sapiens
tgaatacctaag

SEQ ID NO: 1534355 - DNA, 15 bp, Homo sapiens
tgaatactcttgaaa

SEQ ID NO: 1534356 - DNA, 21 bp, Homo sapiens
tgaatactcttgaaaggccaa

SEQ ID NO: 1534357 - DNA, 14 bp, Homo sapiens
tgaatactgctaca

SEQ ID NO: 1534358 - DNA, 13 bp, Homo sapiens
tgaatactgtgaa

SEQ ID NO: 1534359 - DNA, 13 bp, Homo sapiens
tgaatagatgtga

SEQ ID NO: 1534360 - DNA, 16 bp, Homo sapiens
tgaatagatgtgatca

SEQ ID NO: 1534361 - DNA, 23 bp, Homo sapiens
tgaatatccattctcgttttagg

SEQ ID NO: 1534362 - DNA, 14 bp, Homo sapiens
tgaatatctattaa

SEQ ID NO: 1534363 - DNA, 16 bp, Homo sapiens
tgaatatctattaata

SEQ ID NO: 1534364 - DNA, 12 bp, Homo sapiens
tgaatattttca

SEQ ID NO: 1534365 - DNA, 15 bp, Homo sapiens
tgaatcactgtgctc

SEQ ID NO: 1534366 - DNA, 17 bp, Homo sapiens
tgaatcactgtgctcag

SEQ ID NO: 1534367 - DNA, 13 bp, Homo sapiens
tgaatcatgagcc

SEQ ID NO: 1534368 - DNA, 18 bp, Homo sapiens
tgaatcatgagcctgctg

SEQ ID NO: 1534369 - DNA, 18 bp, Homo sapiens
tgaatccaaatctgtcct

SEQ ID NO: 1534370 - DNA, 17 bp, Homo sapiens
tgaatccattgaaagtg

SEQ ID NO: 1534371 - DNA, 15 bp, Homo sapiens
tgaatctacatttgt

SEQ ID NO: 1534372 - DNA, 20 bp, Homo sapiens
tgaatctacatttgtttgta

SEQ ID NO: 1534373 - DNA, 14 bp, Homo sapiens
tgaatctatgccaa

SEQ ID NO: 1534374 - DNA, 21 bp, Homo sapiens
tgaatctattatactgtatta

SEQ ID NO: 1534375 - DNA, 15 bp, Homo sapiens
tgaatctcagaaaat

SEQ ID NO: 1534376 - DNA, 19 bp, Homo sapiens
tgaatctcataattggaat

SEQ ID NO: 1534377 - DNA, 19 bp, Homo sapiens
tgaatctcccctcctcaca

SEQ ID NO: 1534378 - DNA, 20 bp, Homo sapiens
tgaatctgcgagtagatgaa

SEQ ID NO: 1534379 - DNA, 12 bp, Homo sapiens
tgaatcttctgg

SEQ ID NO: 1534380 - DNA, 14 bp, Homo sapiens
tgaatgaaatatca

SEQ ID NO: 1534381 - DNA, 15 bp, Homo sapiens
tgaatgaacaaacct

SEQ ID NO: 1534382 - DNA, 22 bp, Homo sapiens
tgaatgacttccccaatatctt

SEQ ID NO: 1534383 - DNA, 19 bp, Homo sapiens
tgaatgaggtcccaggcag

SEQ ID NO: 1534384 - DNA, 22 bp, Homo sapiens
tgaatgaggtcccaggcagaga

SEQ ID NO: 1534385 - DNA, 19 bp, Homo sapiens
tgaatgatttccaaagaga

SEQ ID NO: 1534386 - DNA, 20 bp, Homo sapiens
tgaatgcaaaattgttttca

SEQ ID NO: 1534387 - DNA, 18 bp, Homo sapiens
tgaatgcaccatggtcaa

SEQ ID NO: 1534388 - DNA, 13 bp, Homo sapiens
tgaatgcagaaaa

SEQ ID NO: 1534389 - DNA, 19 bp, Homo sapiens
tgaatgcctatggtggatc

SEQ ID NO: 1534390 - DNA, 18 bp, Homo sapiens
tgaatgcctcgctccctt

SEQ ID NO: 1534391 - DNA, 16 bp, Homo sapiens
tgaatgctagacagaa

SEQ ID NO: 1534392 - DNA, 18 bp, Homo sapiens
tgaatgctgccagtgtgg

SEQ ID NO: 1534393 - DNA, 22 bp, Homo sapiens
tgaatgctgccagtgtggagtg

SEQ ID NO: 1534394 - DNA, 14 bp, Homo sapiens
tgaatgggttgtta

SEQ ID NO: 1534395 - DNA, 15 bp, Homo sapiens
tgaatggtgttgtat

SEQ ID NO: 1534396 - DNA, 18 bp, Homo sapiens
tgaatggtgttgtatgcc

SEQ ID NO: 1534397 - DNA, 20 bp, Homo sapiens
tgaatggtgttgtatgcctt

SEQ ID NO: 1534398 - DNA, 21 bp, Homo sapiens
tgaatggttccatgcctgagg

SEQ ID NO: 1534399 - DNA, 23 bp, Homo sapiens
tgaatggttccatgcctgagggt

SEQ ID NO: 1534400 - DNA, 24 bp, Homo sapiens
tgaatggttgtacgttttgcacat

SEQ ID NO: 1534401 - DNA, 20 bp, Homo sapiens
tgaatggttttcaaaataaa

SEQ ID NO: 1534402 - DNA, 19 bp, Homo sapiens
tgaatgtaaatttgtacta

SEQ ID NO: 1534403 - DNA, 21 bp, Homo sapiens
tgaatgtaaatttgtactatt

SEQ ID NO: 1534404 - DNA, 11 bp, Homo sapiens
tgaatgtcaca

SEQ ID NO: 1534405 - DNA, 14 bp, Homo sapiens
tgaatgtcacaaat

SEQ ID NO: 1534406 - DNA, 17 bp, Homo sapiens
tgaatgtccccattcta

SEQ ID NO: 1534407 - DNA, 18 bp, Homo sapiens
tgaatgtccccattctat

SEQ ID NO: 1534408 - DNA, 19 bp, Homo sapiens
tgaatgtccccattctata

SEQ ID NO: 1534409 - DNA, 17 bp, Homo sapiens
tcttaggggagagcttt

SEQ ID NO: 1534410 - DNA, 14 bp, Homo sapiens
tcttaggtttactg

SEQ ID NO: 1534411 - DNA, 15 bp, Homo sapiens
tcttagtgcccgcct

SEQ ID NO: 1534412 - DNA, 20 bp, Homo sapiens
tcttagtgcttcagagtttg

SEQ ID NO: 1534413 - DNA, 20 bp, Homo sapiens
tcttagttgacaacctagaa

SEQ ID NO: 1534414 - DNA, 21 bp, Homo sapiens
tcttagttgacaacctagaat

SEQ ID NO: 1534415 - DNA, 23 bp, Homo sapiens
tcttagttgacaacctagaatgt

SEQ ID NO: 1534416 - DNA, 21 bp, Homo sapiens
tcttagtttggattcttatgt

SEQ ID NO: 1534417 - DNA, 22 bp, Homo sapiens
tcttatccaacatcaacatctt

SEQ ID NO: 1534418 - DNA, 19 bp, Homo sapiens
tcttatcctctctctcttc

SEQ ID NO: 1534419 - DNA, 18 bp, Homo sapiens
tcttatctagcaagaaga

SEQ ID NO: 1534420 - DNA, 16 bp, Homo sapiens
tcttatgaggagggga

SEQ ID NO: 1534421 - DNA, 14 bp, Homo sapiens
tcttatgccttttc

SEQ ID NO: 1534422 - DNA, 14 bp, Homo sapiens
tcttatggcacaaa

SEQ ID NO: 1534423 - DNA, 16 bp, Homo sapiens
tcttatggtccagaaa

SEQ ID NO: 1534424 - DNA, 19 bp, Homo sapiens
tcttatgtgacattaacaa

SEQ ID NO: 1534425 - DNA, 19 bp, Homo sapiens
tcttattactattattgtt

SEQ ID NO: 1534426 - DNA, 17 bp, Homo sapiens
tcttattccaggagaag

SEQ ID NO: 1534427 - DNA, 24 bp, Homo sapiens
tcttattcccaaactacagaataa

SEQ ID NO: 1534428 - DNA, 12 bp, Homo sapiens
tcttattccgag

SEQ ID NO: 1534429 - DNA, 21 bp, Homo sapiens
tcttattccgagcattccagt

SEQ ID NO: 1534430 - DNA, 15 bp, Homo sapiens
tcttattctcactcc

SEQ ID NO: 1534431 - DNA, 13 bp, Homo sapiens
tcttattctgtat

SEQ ID NO: 1534432 - DNA, 19 bp, Homo sapiens
tcttattgtttaatctttt

SEQ ID NO: 1534433 - DNA, 16 bp, Homo sapiens
tcttatttcatttctt

SEQ ID NO: 1534434 - DNA, 13 bp, Homo sapiens
tcttattttagta

SEQ ID NO: 1534435 - DNA, 23 bp, Homo sapiens
tcttcaaacagtatataactttt

SEQ ID NO: 1534436 - DNA, 14 bp, Homo sapiens
tcttcaaactgtga

SEQ ID NO: 1534437 - DNA, 17 bp, Homo sapiens
tcttcaaactttcactt

SEQ ID NO: 1534438 - DNA, 22 bp, Homo sapiens
tcttcaaatgtttaaaccacta

SEQ ID NO: 1534439 - DNA, 19 bp, Homo sapiens
tcttcaaattagaagacat

SEQ ID NO: 1534440 - DNA, 15 bp, Homo sapiens
tcttcaagctgtccc

SEQ ID NO: 1534441 - DNA, 22 bp, Homo sapiens
tcttcaagctgtcccctctgtc

SEQ ID NO: 1534442 - DNA, 14 bp, Homo sapiens
tcttcaatctctgg

SEQ ID NO: 1534443 - DNA, 18 bp, Homo sapiens
tcttcaatttattactga

SEQ ID NO: 1534444 - DNA, 19 bp, Homo sapiens
tcttcaccaagtgcaatag

SEQ ID NO: 1534445 - DNA, 19 bp, Homo sapiens
tcttcacccagctaatctg

SEQ ID NO: 1534446 - DNA, 18 bp, Homo sapiens
tcttcacccctacactgt

SEQ ID NO: 1534447 - DNA, 16 bp, Homo sapiens
tcttcaccctcccctt

SEQ ID NO: 1534448 - DNA, 19 bp, Homo sapiens
tcttcacctaagtctctgt

SEQ ID NO: 1534449 - DNA, 13 bp, Homo sapiens
tcttcacctcaga

SEQ ID NO: 1534450 - DNA, 16 bp, Homo sapiens
tcttcactcaaatttt

SEQ ID NO: 1534451 - DNA, 20 bp, Homo sapiens
tcttcactcaggtctcagct

SEQ ID NO: 1534452 - DNA, 17 bp, Homo sapiens
tcttcagaacacacaga

SEQ ID NO: 1534453 - DNA, 20 bp, Homo sapiens
tcttcagaacacacagactt

SEQ ID NO: 1534454 - DNA, 21 bp, Homo sapiens
tcttcagaacacacagacttt

SEQ ID NO: 1534455 - DNA, 22 bp, Homo sapiens
tcttcagaacacacagactttc

SEQ ID NO: 1534456 - DNA, 23 bp, Homo sapiens
tcttcagaacacacagactttct

SEQ ID NO: 1534457 - DNA, 18 bp, Homo sapiens
tcttcagaagacactgca

SEQ ID NO: 1534458 - DNA, 19 bp, Homo sapiens
tcttcagatacaaactgca

SEQ ID NO: 1534459 - DNA, 13 bp, Homo sapiens
tcttcagatgcca

SEQ ID NO: 1534460 - DNA, 14 bp, Homo sapiens
tcttcagatgccac

SEQ ID NO: 1534461 - DNA, 21 bp, Homo sapiens
tcttcaggaggccctggtgtc

SEQ ID NO: 1534462 - DNA, 14 bp, Homo sapiens
tcttcagggtctaa

SEQ ID NO: 1534463 - DNA, 18 bp, Homo sapiens
tcttcagtctcacagaga

SEQ ID NO: 1534464 - DNA, 19 bp, Homo sapiens
tcttcagtctcacagagaa

SEQ ID NO: 1534465 - DNA, 19 bp, Homo sapiens
tcttcagttaattcttaga

SEQ ID NO: 1534466 - DNA, 12 bp, Homo sapiens
tcttcagtttta

SEQ ID NO: 1534467 - DNA, 16 bp, Homo sapiens
tcttcatcccattcca

SEQ ID NO: 1534468 - DNA, 19 bp, Homo sapiens
tcttcatccggcagcctgg

SEQ ID NO: 1534469 - DNA, 19 bp, Homo sapiens
tcttcatctgactatgaca

SEQ ID NO: 1534470 - DNA, 20 bp, Homo sapiens
tcttcatgagtagtgggcta

SEQ ID NO: 1534471 - DNA, 21 bp, Homo sapiens
tcttcatggcatcttcaatat

SEQ ID NO: 1534472 - DNA, 19 bp, Homo sapiens
tcttcattttcattaccag

SEQ ID NO: 1534473 - DNA, 17 bp, Homo sapiens
tcttccaaccatttatc

SEQ ID NO: 1534474 - DNA, 19 bp, Homo sapiens
tcttccaaccatttatctt

SEQ ID NO: 1534475 - DNA, 24 bp, Homo sapiens
tcttccaagcaaaggtgaagagac

SEQ ID NO: 1534476 - DNA, 20 bp, Homo sapiens
tcttccacaaaaaatacttt

SEQ ID NO: 1534477 - DNA, 19 bp, Homo sapiens
tcttccacctgtgccctca

SEQ ID NO: 1534478 - DNA, 13 bp, Homo sapiens
tcttccagaatcc

SEQ ID NO: 1534479 - DNA, 13 bp, Homo sapiens
tcttccagaatgc

SEQ ID NO: 1534480 - DNA, 17 bp, Homo sapiens
tcttccagaatgctgaa

SEQ ID NO: 1534481 - DNA, 21 bp, Homo sapiens
tcttccagtgaacattcccag

SEQ ID NO: 1534482 - DNA, 16 bp, Homo sapiens
tcttccataatgtata

SEQ ID NO: 1534483 - DNA, 18 bp, Homo sapiens
tcttccatcatcactgta

SEQ ID NO: 1534484 - DNA, 16 bp, Homo sapiens
tcttccatgtatcttt

SEQ ID NO: 1534485 - DNA, 21 bp, Homo sapiens
tcttcccaacttgcctttgaa

SEQ ID NO: 1534486 - DNA, 15 bp, Homo sapiens
tctggtactttctgt

SEQ ID NO: 1534487 - DNA, 13 bp, Homo sapiens
tctggtataattg

SEQ ID NO: 1534488 - DNA, 17 bp, Homo sapiens
tctggtgaagctcactt

SEQ ID NO: 1534489 - DNA, 18 bp, Homo sapiens
tctggtgcagaatatgac

SEQ ID NO: 1534490 - DNA, 17 bp, Homo sapiens
tctggtgccatttctga

SEQ ID NO: 1534491 - DNA, 16 bp, Homo sapiens
tctggtgctactccat

SEQ ID NO: 1534492 - DNA, 19 bp, Homo sapiens
tctggtgctactccatgca

SEQ ID NO: 1534493 - DNA, 12 bp, Homo sapiens
tctggtgcttta

SEQ ID NO: 1534494 - DNA, 12 bp, Homo sapiens
tctggtggctta

SEQ ID NO: 1534495 - DNA, 18 bp, Homo sapiens
tctggtggggctgtcctg

SEQ ID NO: 1534496 - DNA, 14 bp, Homo sapiens
tctggttaatttat

SEQ ID NO: 1534497 - DNA, 20 bp, Homo sapiens
tctggttatttttctcttgt

SEQ ID NO: 1534498 - DNA, 13 bp, Homo sapiens
tctggttctaaca

SEQ ID NO: 1534499 - DNA, 16 bp, Homo sapiens
tctggttgatttgtaa

SEQ ID NO: 1534500 - DNA, 22 bp, Homo sapiens
tctggttgatttgtaacacagt

SEQ ID NO: 1534501 - DNA, 13 bp, Homo sapiens
tctggttgcttca

SEQ ID NO: 1534502 - DNA, 16 bp, Homo sapiens
tctggttgtatttcta

SEQ ID NO: 1534503 - DNA, 21 bp, Homo sapiens
tctggttgttgcaccatctgc

SEQ ID NO: 1534504 - DNA, 21 bp, Homo sapiens
tctggttttctggtggggctg

SEQ ID NO: 1534505 - DNA, 14 bp, Homo sapiens
tctgtaaaaaatgg

SEQ ID NO: 1534506 - DNA, 20 bp, Homo sapiens
tctgtaaaaaatggagctca

SEQ ID NO: 1534507 - DNA, 12 bp, Homo sapiens
tctgtaaactgt

SEQ ID NO: 1534508 - DNA, 12 bp, Homo sapiens
tctgtaaagcca

SEQ ID NO: 1534509 - DNA, 13 bp, Homo sapiens
tctgtaaagccag

SEQ ID NO: 1534510 - DNA, 14 bp, Homo sapiens
tctgtaaataacct

SEQ ID NO: 1534511 - DNA, 11 bp, Homo sapiens
tctgtaaattt

SEQ ID NO: 1534512 - DNA, 16 bp, Homo sapiens
tctgtaaatttaactg

SEQ ID NO: 1534513 - DNA, 22 bp, Homo sapiens
tctgtaaatttaactgcatata

SEQ ID NO: 1534514 - DNA, 17 bp, Homo sapiens
tctgtaactattgggtg

SEQ ID NO: 1534515 - DNA, 13 bp, Homo sapiens
tctgtaagagctt

SEQ ID NO: 1534516 - DNA, 20 bp, Homo sapiens
tctgtaagagcttgctccag

SEQ ID NO: 1534517 - DNA, 20 bp, Homo sapiens
tctgtaagcggtggtttgta

SEQ ID NO: 1534518 - DNA, 16 bp, Homo sapiens
tctgtaatagttcagt

SEQ ID NO: 1534519 - DNA, 20 bp, Homo sapiens
tctgtaatggaactgacccc

SEQ ID NO: 1534520 - DNA, 14 bp, Homo sapiens
tctgtaatgtaaat

SEQ ID NO: 1534521 - DNA, 16 bp, Homo sapiens
tctgtaatgtaaataa

SEQ ID NO: 1534522 - DNA, 17 bp, Homo sapiens
tctgtaattgataatag

SEQ ID NO: 1534523 - DNA, 18 bp, Homo sapiens
tctgtacagattcagcct

SEQ ID NO: 1534524 - DNA, 14 bp, Homo sapiens
tctgtacctcgggt

SEQ ID NO: 1534525 - DNA, 20 bp, Homo sapiens
tctgtacttttcattctctt

SEQ ID NO: 1534526 - DNA, 22 bp, Homo sapiens
tctgtagacttctggttgtatt

SEQ ID NO: 1534527 - DNA, 16 bp, Homo sapiens
tctgtagattctgtgg

SEQ ID NO: 1534528 - DNA, 23 bp, Homo sapiens
tctgtagattctgtggaacaagc

SEQ ID NO: 1534529 - DNA, 17 bp, Homo sapiens
tctgtagctccctcctc

SEQ ID NO: 1534530 - DNA, 22 bp, Homo sapiens
tctgtagcttaaaccaacaata

SEQ ID NO: 1534531 - DNA, 19 bp, Homo sapiens
tctgtaggcacagagctgc

SEQ ID NO: 1534532 - DNA, 22 bp, Homo sapiens
tctgtagggatttttggctaca

SEQ ID NO: 1534533 - DNA, 14 bp, Homo sapiens
tctgttattgtatt

SEQ ID NO: 1534534 - DNA, 22 bp, Homo sapiens
tctgttcacttttcctccctca

SEQ ID NO: 1534535 - DNA, 15 bp, Homo sapiens
tctgttcagcaaact

SEQ ID NO: 1534536 - DNA, 18 bp, Homo sapiens
tctgttccaacctcctgc

SEQ ID NO: 1534537 - DNA, 22 bp, Homo sapiens
tctgttccaacctcctgctctg

SEQ ID NO: 1534538 - DNA, 19 bp, Homo sapiens
tctgttccatgcaactgga

SEQ ID NO: 1534539 - DNA, 14 bp, Homo sapiens
tctgttccctgggc

SEQ ID NO: 1534540 - DNA, 13 bp, Homo sapiens
tctgttccttcac

SEQ ID NO: 1534541 - DNA, 15 bp, Homo sapiens
tctgttccttcacat

SEQ ID NO: 1534542 - DNA, 12 bp, Homo sapiens
tctgttctgctc

SEQ ID NO: 1534543 - DNA, 15 bp, Homo sapiens
tctgttctgctccca

SEQ ID NO: 1534544 - DNA, 18 bp, Homo sapiens
tctgttctgctcccagat

SEQ ID NO: 1534545 - DNA, 16 bp, Homo sapiens
tctgttgaaaagcaca

SEQ ID NO: 1534546 - DNA, 22 bp, Homo sapiens
tctgttgaaaaggtgtcctttt

SEQ ID NO: 1534547 - DNA, 17 bp, Homo sapiens
tctgttgagtaaaacac

SEQ ID NO: 1534548 - DNA, 23 bp, Homo sapiens
tctgttgatcccacttcactgtg

SEQ ID NO: 1534549 - DNA, 15 bp, Homo sapiens
tctgttggcaggctg

SEQ ID NO: 1534550 - DNA, 15 bp, Homo sapiens
tctgttgtaagaata

SEQ ID NO: 1534551 - DNA, 14 bp, Homo sapiens
tctgttgtcaaact

SEQ ID NO: 1534552 - DNA, 23 bp, Homo sapiens
tctgttgtggaaagtagctgcta

SEQ ID NO: 1534553 - DNA, 14 bp, Homo sapiens
tctgttgtgtgtca

SEQ ID NO: 1534554 - DNA, 18 bp, Homo sapiens
tctgttgtgtgtcatgcc

SEQ ID NO: 1534555 - DNA, 15 bp, Homo sapiens
tctgttgttccattt

SEQ ID NO: 1534556 - DNA, 17 bp, Homo sapiens
tctgttgttccatttta

SEQ ID NO: 1534557 - DNA, 20 bp, Homo sapiens
tctgtttatggccacattta

SEQ ID NO: 1534558 - DNA, 20 bp, Homo sapiens
tctgtttattaactactgaa

SEQ ID NO: 1534559 - DNA, 18 bp, Homo sapiens
tctgtttattcttccaga

SEQ ID NO: 1534560 - DNA, 20 bp, Homo sapiens
tctgtttattcttccagaat

SEQ ID NO: 1534561 - DNA, 22 bp, Homo sapiens
tctgtttattcttccagaatgc

SEQ ID NO: 1534562 - DNA, 23 bp, Homo sapiens
tctgtttattcttccagaatgct

SEQ ID NO: 1534563 - DNA, 19 bp, Homo sapiens
tctgtttcaaactgaattt

SEQ ID NO: 1534564 - DNA, 23 bp, Homo sapiens
tctgtttcaaggcactctagatt

SEQ ID NO: 1534565 - DNA, 18 bp, Homo sapiens
tctgtttcctatttaata

SEQ ID NO: 1534566 - DNA, 18 bp, Homo sapiens
tctgtttctctttccttg

SEQ ID NO: 1534567 - DNA, 13 bp, Homo sapiens
tctgtttgaaact

SEQ ID NO: 1534568 - DNA, 16 bp, Homo sapiens
tctgtttgcgtacttg

SEQ ID NO: 1534569 - DNA, 14 bp, Homo sapiens
tctgtttgctgttg

SEQ ID NO: 1534570 - DNA, 18 bp, Homo sapiens
tctgtttggacccatggt

SEQ ID NO: 1534571 - DNA, 16 bp, Homo sapiens
tctgtttggcacttgt

SEQ ID NO: 1534572 - DNA, 17 bp, Homo sapiens
tctgtttggcacttgta

SEQ ID NO: 1534573 - DNA, 20 bp, Homo sapiens
tctgtttggcacttgtattt

SEQ ID NO: 1534574 - DNA, 18 bp, Homo sapiens
tctgtttgtctgaacaaa

SEQ ID NO: 1534575 - DNA, 12 bp, Homo sapiens
tctgtttgttaa

SEQ ID NO: 1534576 - DNA, 21 bp, Homo sapiens
tctgtttgtttcaagaacctg

SEQ ID NO: 1534577 - DNA, 18 bp, Homo sapiens
tctgttttagtatgtaaa

SEQ ID NO: 1534578 - DNA, 14 bp, Homo sapiens
tctgttttctggaa

SEQ ID NO: 1534579 - DNA, 18 bp, Homo sapiens
tctgttttcttctcagtc

SEQ ID NO: 1534580 - DNA, 19 bp, Homo sapiens
tctgttttgtggtttggaa

SEQ ID NO: 1534581 - DNA, 19 bp, Homo sapiens
tctgtttttaatgctattt

SEQ ID NO: 1534582 - DNA, 14 bp, Homo sapiens
tcttaaaaaaataa

SEQ ID NO: 1534583 - DNA, 20 bp, Homo sapiens
tcttaaaattcaagaaaata

SEQ ID NO: 1534584 - DNA, 13 bp, Homo sapiens
tcttaaacaatgt

SEQ ID NO: 1534585 - DNA, 15 bp, Homo sapiens
tcttaaacaatgtat

SEQ ID NO: 1534586 - DNA, 16 bp, Homo sapiens
tcttaaacaatgtata

SEQ ID NO: 1534587 - DNA, 19 bp, Homo sapiens
tcttaaacaatgtataaag

SEQ ID NO: 1534588 - DNA, 16 bp, Homo sapiens
tcttaaagaaacagct

SEQ ID NO: 1534589 - DNA, 14 bp, Homo sapiens
tcttaaaggcctgg

SEQ ID NO: 1534590 - DNA, 17 bp, Homo sapiens
tcttaaaggcctggaac

SEQ ID NO: 1534591 - DNA, 17 bp, Homo sapiens
tcttaaatctaaacaaa

SEQ ID NO: 1534592 - DNA, 15 bp, Homo sapiens
tcttaaattttcttc

SEQ ID NO: 1534593 - DNA, 16 bp, Homo sapiens
tcttaacctttgctat

SEQ ID NO: 1534594 - DNA, 16 bp, Homo sapiens
tcttaacgaataaagg

SEQ ID NO: 1534595 - DNA, 16 bp, Homo sapiens
tcttaacttcttgctt

SEQ ID NO: 1534596 - DNA, 13 bp, Homo sapiens
tcttaagaaataa

SEQ ID NO: 1534597 - DNA, 18 bp, Homo sapiens
tcttaagattctttgtga

SEQ ID NO: 1534598 - DNA, 23 bp, Homo sapiens
tcttaaggattgtgatattttta

SEQ ID NO: 1534599 - DNA, 13 bp, Homo sapiens
tcttaagtgtttc

SEQ ID NO: 1534600 - DNA, 18 bp, Homo sapiens
tcttaagtgtttctcaaa

SEQ ID NO: 1534601 - DNA, 14 bp, Homo sapiens
tcttaatactgtta

SEQ ID NO: 1534602 - DNA, 14 bp, Homo sapiens
tcttaatccagtct

SEQ ID NO: 1534603 - DNA, 22 bp, Homo sapiens
tcttaatccattaaaaagttgt

SEQ ID NO: 1534604 - DNA, 18 bp, Homo sapiens
tcttaatgtaacatgttt

SEQ ID NO: 1534605 - DNA, 24 bp, Homo sapiens
tctggagatggaagcttgttgaaa

SEQ ID NO: 1534606 - DNA, 18 bp, Homo sapiens
tctggagcccctcctccc

SEQ ID NO: 1534607 - DNA, 20 bp, Homo sapiens
tctggagctgggagacaaag

SEQ ID NO: 1534608 - DNA, 13 bp, Homo sapiens
tctggaggaagtt

SEQ ID NO: 1534609 - DNA, 16 bp, Homo sapiens
tctggaggaagttctc

SEQ ID NO: 1534610 - DNA, 22 bp, Homo sapiens
tctggaggaagttctccagctt

SEQ ID NO: 1534611 - DNA, 19 bp, Homo sapiens
tctggaggccttccagctg

SEQ ID NO: 1534612 - DNA, 21 bp, Homo sapiens
tctggaggccttccagctgct

SEQ ID NO: 1534613 - DNA, 16 bp, Homo sapiens
tctggagggaaacacc

SEQ ID NO: 1534614 - DNA, 15 bp, Homo sapiens
tctggagtcacatca

SEQ ID NO: 1534615 - DNA, 14 bp, Homo sapiens
tctggagtgattct

SEQ ID NO: 1534616 - DNA, 17 bp, Homo sapiens
tctggagttgatctgga

SEQ ID NO: 1534617 - DNA, 15 bp, Homo sapiens
tctggatccatgggg

SEQ ID NO: 1534618 - DNA, 24 bp, Homo sapiens
tctggatcccgaggtatggcagag

SEQ ID NO: 1534619 - DNA, 14 bp, Homo sapiens
tctggatctcctgc

SEQ ID NO: 1534620 - DNA, 15 bp, Homo sapiens
tctggatctcctgct

SEQ ID NO: 1534621 - DNA, 19 bp, Homo sapiens
tctggatgcacagatgcca

SEQ ID NO: 1534622 - DNA, 13 bp, Homo sapiens
tctggatggccgg

SEQ ID NO: 1534623 - DNA, 20 bp, Homo sapiens
tctggatggccgggctgctg

SEQ ID NO: 1534624 - DNA, 15 bp, Homo sapiens
tctggatgtaaatcc

SEQ ID NO: 1534625 - DNA, 15 bp, Homo sapiens
tctggattctgggag

SEQ ID NO: 1534626 - DNA, 22 bp, Homo sapiens
tctggattctgggaggcaagaa

SEQ ID NO: 1534627 - DNA, 23 bp, Homo sapiens
tctggattgtggttccatgcagc

SEQ ID NO: 1534628 - DNA, 23 bp, Homo sapiens
tctggcaaggactttgtacattt

SEQ ID NO: 1534629 - DNA, 22 bp, Homo sapiens
tctggcaatggatgaactgaaa

SEQ ID NO: 1534630 - DNA, 20 bp, Homo sapiens
tctggcagggtgggatggag

SEQ ID NO: 1534631 - DNA, 18 bp, Homo sapiens
tctggcattagaattatt

SEQ ID NO: 1534632 - DNA, 10 bp, Homo sapiens
tctggccacc

SEQ ID NO: 1534633 - DNA, 11 bp, Homo sapiens
tctggccaccc

SEQ ID NO: 1534634 - DNA, 12 bp, Homo sapiens
tctggccaccct

SEQ ID NO: 1534635 - DNA, 13 bp, Homo sapiens
tctggccaccctg

SEQ ID NO: 1534636 - DNA, 15 bp, Homo sapiens
tctggccaccctggc

SEQ ID NO: 1534637 - DNA, 19 bp, Homo sapiens
tctggccaggatggagggg

SEQ ID NO: 1534638 - DNA, 14 bp, Homo sapiens
tctggcccaccagg

SEQ ID NO: 1534639 - DNA, 21 bp, Homo sapiens
tctggcccagaaagcctctct

SEQ ID NO: 1534640 - DNA, 11 bp, Homo sapiens
tctggccctat

SEQ ID NO: 1534641 - DNA, 19 bp, Homo sapiens
tctggccctcacccctgcc

SEQ ID NO: 1534642 - DNA, 11 bp, Homo sapiens
tctggccctga

SEQ ID NO: 1534643 - DNA, 18 bp, Homo sapiens
tctggccctgacttctgg

SEQ ID NO: 1534644 - DNA, 13 bp, Homo sapiens
tctggccctgcct

SEQ ID NO: 1534645 - DNA, 16 bp, Homo sapiens
tctggccctgccttct

SEQ ID NO: 1534646 - DNA, 21 bp, Homo sapiens
tctggccctggggatcttccc

SEQ ID NO: 1534647 - DNA, 23 bp, Homo sapiens
tctggcccttgcttacctctcag

SEQ ID NO: 1534648 - DNA, 14 bp, Homo sapiens
tctggccggtgctg

SEQ ID NO: 1534649 - DNA, 16 bp, Homo sapiens
tctggccggtgctggg

SEQ ID NO: 1534650 - DNA, 22 bp, Homo sapiens
tctggcgacagttttccttctc

SEQ ID NO: 1534651 - DNA, 18 bp, Homo sapiens
tctggcgttctcaagaat

SEQ ID NO: 1534652 - DNA, 23 bp, Homo sapiens
tctggctcggacccaccccaact

SEQ ID NO: 1534653 - DNA, 15 bp, Homo sapiens
tctggctctaattca

SEQ ID NO: 1534654 - DNA, 20 bp, Homo sapiens
tctggctctaattcacagtg

SEQ ID NO: 1534655 - DNA, 18 bp, Homo sapiens
tctggctgaacactggca

SEQ ID NO: 1534656 - DNA, 13 bp, Homo sapiens
tctggctgaaccc

SEQ ID NO: 1534657 - DNA, 20 bp, Homo sapiens
tctggctgaaccctgtgctg

SEQ ID NO: 1534658 - DNA, 23 bp, Homo sapiens
tctgcccaggggtgccccctcct

SEQ ID NO: 1534659 - DNA, 17 bp, Homo sapiens
tctgccccaagcagcca

SEQ ID NO: 1534660 - DNA, 19 bp, Homo sapiens
tctgccccaagcagccagc

SEQ ID NO: 1534661 - DNA, 20 bp, Homo sapiens
tctgccccaagcagccagcc

SEQ ID NO: 1534662 - DNA, 22 bp, Homo sapiens
tctgccccaagcagccagccag

SEQ ID NO: 1534663 - DNA, 22 bp, Homo sapiens
tctgccccaagcccccaacccc

SEQ ID NO: 1534664 - DNA, 15 bp, Homo sapiens
tctgccccagagtgg

SEQ ID NO: 1534665 - DNA, 13 bp, Homo sapiens
tctgccccagcct

SEQ ID NO: 1534666 - DNA, 16 bp, Homo sapiens
tctgccccagctctgg

SEQ ID NO: 1534667 - DNA, 17 bp, Homo sapiens
tctgccccagctctggc

SEQ ID NO: 1534668 - DNA, 18 bp, Homo sapiens
tctgccccaggccctact

SEQ ID NO: 1534669 - DNA, 16 bp, Homo sapiens
tctgccccagtagtca

SEQ ID NO: 1534670 - DNA, 23 bp, Homo sapiens
tctgccccatcattgcacctgca

SEQ ID NO: 1534671 - DNA, 22 bp, Homo sapiens
tctgcccccgcgggttctagac

SEQ ID NO: 1534672 - DNA, 15 bp, Homo sapiens
tctgccccctccccc

SEQ ID NO: 1534673 - DNA, 14 bp, Homo sapiens
tctgcccctccccc

SEQ ID NO: 1534674 - DNA, 15 bp, Homo sapiens
tctgcccctccccca

SEQ ID NO: 1534675 - DNA, 16 bp, Homo sapiens
tctgcccctcccccaa

SEQ ID NO: 1534676 - DNA, 15 bp, Homo sapiens
tctgccccttgggca

SEQ ID NO: 1534677 - DNA, 19 bp, Homo sapiens
tctgccccttgggcatcca

SEQ ID NO: 1534678 - DNA, 22 bp, Homo sapiens
tctgccccttgggcatccaccc

SEQ ID NO: 1534679 - DNA, 16 bp, Homo sapiens
tctgccctctgctgct

SEQ ID NO: 1534680 - DNA, 13 bp, Homo sapiens
tctgccctctggg

SEQ ID NO: 1534681 - DNA, 15 bp, Homo sapiens
tctgccctctgggtc

SEQ ID NO: 1534682 - DNA, 15 bp, Homo sapiens
tctgccctgcctgag

SEQ ID NO: 1534683 - DNA, 12 bp, Homo sapiens
tctgccctggat

SEQ ID NO: 1534684 - DNA, 23 bp, Homo sapiens
tctgccctggattggttggcaaa

SEQ ID NO: 1534685 - DNA, 13 bp, Homo sapiens
tctgccctggctg

SEQ ID NO: 1534686 - DNA, 16 bp, Homo sapiens
tctgccctggctgctg

SEQ ID NO: 1534687 - DNA, 17 bp, Homo sapiens
tctgccctggctgctgc

SEQ ID NO: 1534688 - DNA, 14 bp, Homo sapiens
tctgccctgggttc

SEQ ID NO: 1534689 - DNA, 14 bp, Homo sapiens
tctgccgcctgcgt

SEQ ID NO: 1534690 - DNA, 18 bp, Homo sapiens
tctgccgctacctccctc

SEQ ID NO: 1534691 - DNA, 19 bp, Homo sapiens
tctgccggtcgggcagcca

SEQ ID NO: 1534692 - DNA, 20 bp, Homo sapiens
tctgccggtcgggcagccag

SEQ ID NO: 1534693 - DNA, 19 bp, Homo sapiens
tctgcctagagtgtagcct

SEQ ID NO: 1534694 - DNA, 16 bp, Homo sapiens
tctgcctaggagctgg

SEQ ID NO: 1534695 - DNA, 20 bp, Homo sapiens
tctgcctaggagctggctgg

SEQ ID NO: 1534696 - DNA, 21 bp, Homo sapiens
tctgcctcaatgtgaatcaga

SEQ ID NO: 1534697 - DNA, 13 bp, Homo sapiens
tctgcctctcctc

SEQ ID NO: 1534698 - DNA, 16 bp, Homo sapiens
tctgcctctgcctgca

SEQ ID NO: 1534699 - DNA, 16 bp, Homo sapiens
tctgcctgaacctggg

SEQ ID NO: 1534700 - DNA, 16 bp, Homo sapiens
tctgcctgagattctt

SEQ ID NO: 1534701 - DNA, 17 bp, Homo sapiens
tctgcctgagattcttt

SEQ ID NO: 1534702 - DNA, 13 bp, Homo sapiens
tctgcctgcactc

SEQ ID NO: 1534703 - DNA, 18 bp, Homo sapiens
tctgcctgcactccctgg

SEQ ID NO: 1534704 - DNA, 22 bp, Homo sapiens
tctgcctgcactccctggcctt

SEQ ID NO: 1534705 - DNA, 16 bp, Homo sapiens
tctgcctgccagctgc

SEQ ID NO: 1534706 - DNA, 21 bp, Homo sapiens
tctgcctgccagctgcactga

SEQ ID NO: 1534707 - DNA, 10 bp, Homo sapiens
tctgcctgga

SEQ ID NO: 1534708 - DNA, 13 bp, Homo sapiens
tctgcctggagtg

SEQ ID NO: 1534709 - DNA, 14 bp, Homo sapiens
ccccatccctcggg

SEQ ID NO: 1534710 - DNA, 16 bp, Homo sapiens
ccccatcctcatccct

SEQ ID NO: 1534711 - DNA, 18 bp, Homo sapiens
ccccatcctcatccctga

SEQ ID NO: 1534712 - DNA, 15 bp, Homo sapiens
ccccatcggccaaga

SEQ ID NO: 1534713 - DNA, 15 bp, Homo sapiens
ccccatctcatcctg

SEQ ID NO: 1534714 - DNA, 17 bp, Homo sapiens
ccccatctcatcctggc

SEQ ID NO: 1534715 - DNA, 17 bp, Homo sapiens
ccccatctccccaggcc

SEQ ID NO: 1534716 - DNA, 18 bp, Homo sapiens
ccccatctccccaggcct

SEQ ID NO: 1534717 - DNA, 20 bp, Homo sapiens
ccccatctccccaggcctcc

SEQ ID NO: 1534718 - DNA, 18 bp, Homo sapiens
ccccatctccctgcctgg

SEQ ID NO: 1534719 - DNA, 14 bp, Homo sapiens
ccccatctggatgt

SEQ ID NO: 1534720 - DNA, 21 bp, Homo sapiens
ccccatcttccacctgtgccc

SEQ ID NO: 1534721 - DNA, 15 bp, Homo sapiens
ccccatgaggaagga

SEQ ID NO: 1534722 - DNA, 13 bp, Homo sapiens
ccccatgcagtct

SEQ ID NO: 1534723 - DNA, 14 bp, Homo sapiens
ccccatgccaccac

SEQ ID NO: 1534724 - DNA, 15 bp, Homo sapiens
ccccatgcccctccc

SEQ ID NO: 1534725 - DNA, 12 bp, Homo sapiens
ccccatgcctgt

SEQ ID NO: 1534726 - DNA, 15 bp, Homo sapiens
ccccatgcctgtcca

SEQ ID NO: 1534727 - DNA, 17 bp, Homo sapiens
ccccatgcctgtccagc

SEQ ID NO: 1534728 - DNA, 20 bp, Homo sapiens
ccccatgcctgtccagcctg

SEQ ID NO: 1534729 - DNA, 18 bp, Homo sapiens
ccccatggccccaggccc

SEQ ID NO: 1534730 - DNA, 12 bp, Homo sapiens
ccccatgggctg

SEQ ID NO: 1534731 - DNA, 17 bp, Homo sapiens
ccccatgggctgtgtcc

SEQ ID NO: 1534732 - DNA, 23 bp, Homo sapiens
ccccatggggctgcgggacagag

SEQ ID NO: 1534733 - DNA, 15 bp, Homo sapiens
ccccatggggtcctt

SEQ ID NO: 1534734 - DNA, 20 bp, Homo sapiens
ccccatggtgctaggaagag

SEQ ID NO: 1534735 - DNA, 23 bp, Homo sapiens
ccccatgtgcctgcaccaggaga

SEQ ID NO: 1534736 - DNA, 22 bp, Homo sapiens
ccccatgtgggtgaccaggtcc

SEQ ID NO: 1534737 - DNA, 16 bp, Homo sapiens
ccccatgtgtcctggt

SEQ ID NO: 1534738 - DNA, 23 bp, Homo sapiens
ccccatgtgtcctggttcccgtt

SEQ ID NO: 1534739 - DNA, 19 bp, Homo sapiens
ccccatgttgtaatgctgc

SEQ ID NO: 1534740 - DNA, 21 bp, Homo sapiens
ccccatgttgtaatgctgcac

SEQ ID NO: 1534741 - DNA, 15 bp, Homo sapiens
ccccattcacagagc

SEQ ID NO: 1534742 - DNA, 12 bp, Homo sapiens
ccccattccctc

SEQ ID NO: 1534743 - DNA, 16 bp, Homo sapiens
ccccattcttcctagt

SEQ ID NO: 1534744 - DNA, 19 bp, Homo sapiens
ccccatttcccatctgcac

SEQ ID NO: 1534745 - DNA, 13 bp, Homo sapiens
ccccatttctatt

SEQ ID NO: 1534746 - DNA, 17 bp, Homo sapiens
ccccatttctatttatt

SEQ ID NO: 1534747 - DNA, 15 bp, Homo sapiens
cccccaaagacctgc

SEQ ID NO: 1534748 - DNA, 22 bp, Homo sapiens
cccccaaagcaatgtgagtccc

SEQ ID NO: 1534749 - DNA, 19 bp, Homo sapiens
cccccaacaccccgcctgc

SEQ ID NO: 1534750 - DNA, 22 bp, Homo sapiens
cccccaacaccccgcctgcctc

SEQ ID NO: 1534751 - DNA, 16 bp, Homo sapiens
cccccaacactgtgcc

SEQ ID NO: 1534752 - DNA, 20 bp, Homo sapiens
cccccaacactgtgccctgg

SEQ ID NO: 1534753 - DNA, 21 bp, Homo sapiens
cccccaacttcaccaccccct

SEQ ID NO: 1534754 - DNA, 18 bp, Homo sapiens
cccccaaggttctccaac

SEQ ID NO: 1534755 - DNA, 21 bp, Homo sapiens
cccccacaagctgtccctgca

SEQ ID NO: 1534756 - DNA, 14 bp, Homo sapiens
cccccacccccagc

SEQ ID NO: 1534757 - DNA, 15 bp, Homo sapiens
cccccacccccagct

SEQ ID NO: 1534758 - DNA, 13 bp, Homo sapiens
cccccacccctac

SEQ ID NO: 1534759 - DNA, 21 bp, Homo sapiens
cccccactctcattccccagg

SEQ ID NO: 1534760 - DNA, 14 bp, Homo sapiens
cccccactgccaca

SEQ ID NO: 1534761 - DNA, 22 bp, Homo sapiens
cccccagaacctgtccttgcac

SEQ ID NO: 1534762 - DNA, 17 bp, Homo sapiens
cccccagcactgaggaa

SEQ ID NO: 1534763 - DNA, 12 bp, Homo sapiens
cccccagcactt

SEQ ID NO: 1534764 - DNA, 13 bp, Homo sapiens
cccccagcccagg

SEQ ID NO: 1534765 - DNA, 21 bp, Homo sapiens
cccccagcccagggctcctgc

SEQ ID NO: 1534766 - DNA, 18 bp, Homo sapiens
cccccagctaagaacctg

SEQ ID NO: 1534767 - DNA, 14 bp, Homo sapiens
cccccagctctggt

SEQ ID NO: 1534768 - DNA, 12 bp, Homo sapiens
cccccagctggt

SEQ ID NO: 1534769 - DNA, 16 bp, Homo sapiens
cccccaggattccccc

SEQ ID NO: 1534770 - DNA, 18 bp, Homo sapiens
cccccagggcctccaggg

SEQ ID NO: 1534771 - DNA, 20 bp, Homo sapiens
cccccagggcctccagggcc

SEQ ID NO: 1534772 - DNA, 19 bp, Homo sapiens
cccccaggtggcctgcgtc

SEQ ID NO: 1534773 - DNA, 20 bp, Homo sapiens
cccccaggttccgaagaaga

SEQ ID NO: 1534774 - DNA, 11 bp, Homo sapiens
cccccatctcc

SEQ ID NO: 1534775 - DNA, 18 bp, Homo sapiens
cccccatctccccaggcc

SEQ ID NO: 1534776 - DNA, 20 bp, Homo sapiens
cccccatgccaccacccacc

SEQ ID NO: 1534777 - DNA, 13 bp, Homo sapiens
cccccatgtggct

SEQ ID NO: 1534778 - DNA, 22 bp, Homo sapiens
cccccatgttgtaatgctgcac

SEQ ID NO: 1534779 - DNA, 18 bp, Homo sapiens
ccccccagaacctgtcct

SEQ ID NO: 1534780 - DNA, 13 bp, Homo sapiens
ccccccagcactg

SEQ ID NO: 1534781 - DNA, 12 bp, Homo sapiens
ccccccagcctc

SEQ ID NO: 1534782 - DNA, 14 bp, Homo sapiens
ccccccatgcactg

SEQ ID NO: 1534783 - DNA, 13 bp, Homo sapiens
cccccccatgcag

SEQ ID NO: 1534784 - DNA, 12 bp, Homo sapiens
cccccctcctcc

SEQ ID NO: 1534785 - DNA, 14 bp, Homo sapiens
cccccgaccctgcc

SEQ ID NO: 1534786 - DNA, 14 bp, Homo sapiens
cccccgactgcctg

SEQ ID NO: 1534787 - DNA, 14 bp, Homo sapiens
cccccgcacagcca

SEQ ID NO: 1534788 - DNA, 21 bp, Homo sapiens
cccccgcacagccacccgtgg

SEQ ID NO: 1534789 - DNA, 20 bp, Homo sapiens
cccccgcagcaccctgcaga

SEQ ID NO: 1534790 - DNA, 17 bp, Homo sapiens
cccccgccacggccacc

SEQ ID NO: 1534791 - DNA, 19 bp, Homo sapiens
cccccgccacggccaccct

SEQ ID NO: 1534792 - DNA, 12 bp, Homo sapiens
cccccgccatgc

SEQ ID NO: 1534793 - DNA, 13 bp, Homo sapiens
cccccgccgcgcc

SEQ ID NO: 1534794 - DNA, 14 bp, Homo sapiens
cccccgcctgccac

SEQ ID NO: 1534795 - DNA, 15 bp, Homo sapiens
cccccgcctgccacc

SEQ ID NO: 1534796 - DNA, 15 bp, Homo sapiens
cccccgcctgggcac

SEQ ID NO: 1534797 - DNA, 21 bp, Homo sapiens
cccccgcgctcgcccagcagg

SEQ ID NO: 1534798 - DNA, 18 bp, Homo sapiens
cccccgcgggttctagac

SEQ ID NO: 1534799 - DNA, 17 bp, Homo sapiens
cccccgtggggcaggga

SEQ ID NO: 1534800 - DNA, 16 bp, Homo sapiens
ccccctcaaacctcct

SEQ ID NO: 1534801 - DNA, 19 bp, Homo sapiens
ccccctcaaacctcctctt

SEQ ID NO: 1534802 - DNA, 15 bp, Homo sapiens
ccccctcaccatcca

SEQ ID NO: 1534803 - DNA, 22 bp, Homo sapiens
ccccctccaggagagagccagg

SEQ ID NO: 1534804 - DNA, 13 bp, Homo sapiens
ccccctcccaggg

SEQ ID NO: 1534805 - DNA, 20 bp, Homo sapiens
ccccctccctgtcccagggc

SEQ ID NO: 1534806 - DNA, 19 bp, Homo sapiens
ccccctccgccctgccact

SEQ ID NO: 1534807 - DNA, 10 bp, Homo sapiens
ccccctcctc

SEQ ID NO: 1534808 - DNA, 22 bp, Homo sapiens
ccccctcctctcccatccccct

SEQ ID NO: 1534809 - DNA, 15 bp, Homo sapiens
ccccctcctgctcct

SEQ ID NO: 1534810 - DNA, 17 bp, Homo sapiens
ccccctcctgctcctcc

SEQ ID NO: 1534811 - DNA, 18 bp, Homo sapiens
ccccctcctgctcctccc

SEQ ID NO: 1534812 - DNA, 23 bp, Homo sapiens
ccccctcctgctcctccctgccc

SEQ ID NO: 1534813 - DNA, 23 bp, Homo sapiens
ccccctctgccggtcgggcagcc

SEQ ID NO: 1534814 - DNA, 11 bp, Homo sapiens
ccccctctgct

SEQ ID NO: 1534815 - DNA, 13 bp, Homo sapiens
ccccctctgcttc

SEQ ID NO: 1534816 - DNA, 16 bp, Homo sapiens
ccccctctgtcttgtg

SEQ ID NO: 1534817 - DNA, 19 bp, Homo sapiens
ccccctcttcctccctggg

SEQ ID NO: 1534818 - DNA, 19 bp, Homo sapiens
ccccctcttcttctgaaga

SEQ ID NO: 1534819 - DNA, 23 bp, Homo sapiens
ccccctgagtcaactggagcaag

SEQ ID NO: 1534820 - DNA, 12 bp, Homo sapiens
ccccctgcaccc

SEQ ID NO: 1534821 - DNA, 12 bp, Homo sapiens
ccccctgcatct

SEQ ID NO: 1534822 - DNA, 21 bp, Homo sapiens
ccccctgccccccagcctctg

SEQ ID NO: 1534823 - DNA, 14 bp, Homo sapiens
ccccctgccctgca

SEQ ID NO: 1534824 - DNA, 12 bp, Homo sapiens
ccccctgcctgc

SEQ ID NO: 1534825 - DNA, 18 bp, Homo sapiens
ccccctgctccaccagca

SEQ ID NO: 1534826 - DNA, 20 bp, Homo sapiens
ccccctgctccaccagcagc

SEQ ID NO: 1534827 - DNA, 12 bp, Homo sapiens
tctgcctggcct

SEQ ID NO: 1534828 - DNA, 13 bp, Homo sapiens
tctgcctggcctg

SEQ ID NO: 1534829 - DNA, 16 bp, Homo sapiens
tctgcctggcctggct

SEQ ID NO: 1534830 - DNA, 14 bp, Homo sapiens
tctgcctgggcctg

SEQ ID NO: 1534831 - DNA, 15 bp, Homo sapiens
tctgcctgggcctgt

SEQ ID NO: 1534832 - DNA, 18 bp, Homo sapiens
tctgcctgtctggtgcct

SEQ ID NO: 1534833 - DNA, 11 bp, Homo sapiens
tctgcctgtga

SEQ ID NO: 1534834 - DNA, 14 bp, Homo sapiens
tctgcctgtgagcc

SEQ ID NO: 1534835 - DNA, 18 bp, Homo sapiens
tctgcctgtggccttgcc

SEQ ID NO: 1534836 - DNA, 17 bp, Homo sapiens
tctgccttaaaaccaaa

SEQ ID NO: 1534837 - DNA, 20 bp, Homo sapiens
tctgccttaaaaccaaagag

SEQ ID NO: 1534838 - DNA, 20 bp, Homo sapiens
tctgccttcacaaatgtcat

SEQ ID NO: 1534839 - DNA, 15 bp, Homo sapiens
tctgccttctcaggc

SEQ ID NO: 1534840 - DNA, 17 bp, Homo sapiens
tctgccttctcaggccc

SEQ ID NO: 1534841 - DNA, 20 bp, Homo sapiens
tctgccttctcatgatccaa

SEQ ID NO: 1534842 - DNA, 15 bp, Homo sapiens
tctgccttggcatcc

SEQ ID NO: 1534843 - DNA, 13 bp, Homo sapiens
tctgcgccaggca

SEQ ID NO: 1534844 - DNA, 21 bp, Homo sapiens
tctgcgccaggcagagctgag

SEQ ID NO: 1534845 - DNA, 18 bp, Homo sapiens
tctgcgcccttgtgccct

SEQ ID NO: 1534846 - DNA, 19 bp, Homo sapiens
tctgcgcccttgtgccctg

SEQ ID NO: 1534847 - DNA, 15 bp, Homo sapiens
tctgcgcctgaaaag

SEQ ID NO: 1534848 - DNA, 15 bp, Homo sapiens
tctgcgtctgtgttg

SEQ ID NO: 1534849 - DNA, 19 bp, Homo sapiens
tctgcgtggcgcaggtgcc

SEQ ID NO: 1534850 - DNA, 14 bp, Homo sapiens
tctgcgtgtgtata

SEQ ID NO: 1534851 - DNA, 20 bp, Homo sapiens
tctgctaaccatttatataa

SEQ ID NO: 1534852 - DNA, 21 bp, Homo sapiens
tctgctaacttggagccccag

SEQ ID NO: 1534853 - DNA, 20 bp, Homo sapiens
tctgctaagttctcccaaca

SEQ ID NO: 1534854 - DNA, 18 bp, Homo sapiens
tctgctagactcctcagg

SEQ ID NO: 1534855 - DNA, 23 bp, Homo sapiens
tctgctagactcctcaggagaga

SEQ ID NO: 1534856 - DNA, 14 bp, Homo sapiens
tctgctaggcgctg

SEQ ID NO: 1534857 - DNA, 21 bp, Homo sapiens
tctgctaggcgctggggagac

SEQ ID NO: 1534858 - DNA, 20 bp, Homo sapiens
tctgctcaccgcccatcagg

SEQ ID NO: 1534859 - DNA, 21 bp, Homo sapiens
tctgctcaccgcccatcaggg

SEQ ID NO: 1534860 - DNA, 22 bp, Homo sapiens
tctgctcagtaatttgaggaca

SEQ ID NO: 1534861 - DNA, 22 bp, Homo sapiens
tctgctcattttgacaaagtgc

SEQ ID NO: 1534862 - DNA, 20 bp, Homo sapiens
tctgctccaccacatcctcc

SEQ ID NO: 1534863 - DNA, 14 bp, Homo sapiens
tctgctccaccctt

SEQ ID NO: 1534864 - DNA, 17 bp, Homo sapiens
tctgctccacccttggc

SEQ ID NO: 1534865 - DNA, 18 bp, Homo sapiens
tctgctccacccttggcc

SEQ ID NO: 1534866 - DNA, 20 bp, Homo sapiens
tctgctccacccttggcctg

SEQ ID NO: 1534867 - DNA, 20 bp, Homo sapiens
tctgctccagcaactgccct

SEQ ID NO: 1534868 - DNA, 22 bp, Homo sapiens
tctgctccagcaactgcccttc

SEQ ID NO: 1534869 - DNA, 14 bp, Homo sapiens
tctgctccccagga

SEQ ID NO: 1534870 - DNA, 11 bp, Homo sapiens
tctgctcctgc

SEQ ID NO: 1534871 - DNA, 12 bp, Homo sapiens
tctgctcctgct

SEQ ID NO: 1534872 - DNA, 19 bp, Homo sapiens
tctgctccttcactgttcc

SEQ ID NO: 1534873 - DNA, 22 bp, Homo sapiens
tctgctcggcttcttggacctt

SEQ ID NO: 1534874 - DNA, 14 bp, Homo sapiens
tctgctctagccag

SEQ ID NO: 1534875 - DNA, 15 bp, Homo sapiens
tctgctctagggaat

SEQ ID NO: 1534876 - DNA, 15 bp, Homo sapiens
tctgctctccttcct

SEQ ID NO: 1534877 - DNA, 19 bp, Homo sapiens
tctgctctccttcctggag

SEQ ID NO: 1534878 - DNA, 20 bp, Homo sapiens
tctgctctccttcctggagc

SEQ ID NO: 1534879 - DNA, 12 bp, Homo sapiens
tctgctctgccc

SEQ ID NO: 1534880 - DNA, 13 bp, Homo sapiens
tctgctctgccct

SEQ ID NO: 1534881 - DNA, 13 bp, Homo sapiens
tctgctctgcctg

SEQ ID NO: 1534882 - DNA, 13 bp, Homo sapiens
tctgctctggtgg

SEQ ID NO: 1534883 - DNA, 18 bp, Homo sapiens
tctgctctttctctgcca

SEQ ID NO: 1534884 - DNA, 20 bp, Homo sapiens
tctgctctttctctgccagt

SEQ ID NO: 1534885 - DNA, 12 bp, Homo sapiens
tctgctgaggcc

SEQ ID NO: 1534886 - DNA, 19 bp, Homo sapiens
tctgctgaggcccagtgca

SEQ ID NO: 1534887 - DNA, 14 bp, Homo sapiens
tctgctgcccctgc

SEQ ID NO: 1534888 - DNA, 15 bp, Homo sapiens
tctgctgcccctgca

SEQ ID NO: 1534889 - DNA, 18 bp, Homo sapiens
tctgctgcccctgcagtt

SEQ ID NO: 1534890 - DNA, 13 bp, Homo sapiens
tctgctgccctct

SEQ ID NO: 1534891 - DNA, 14 bp, Homo sapiens
tctgctgccggctc

SEQ ID NO: 1534892 - DNA, 23 bp, Homo sapiens
tctgctggaaggggcagcaggag

SEQ ID NO: 1534893 - DNA, 18 bp, Homo sapiens
tctgctggataaaatgag

SEQ ID NO: 1534894 - DNA, 23 bp, Homo sapiens
tctgctggcatcaagaggtggga

SEQ ID NO: 1534895 - DNA, 18 bp, Homo sapiens
tctgctggcctggatctc

SEQ ID NO: 1534896 - DNA, 17 bp, Homo sapiens
tctgctgggctctgcct

SEQ ID NO: 1534897 - DNA, 18 bp, Homo sapiens
tctgctggtatttctaat

SEQ ID NO: 1534898 - DNA, 16 bp, Homo sapiens
tctgctggttttaaca

SEQ ID NO: 1534899 - DNA, 17 bp, Homo sapiens
tctgctggttttaacaa

SEQ ID NO: 1534900 - DNA, 15 bp, Homo sapiens
tctgctgtcctgcag

SEQ ID NO: 1534901 - DNA, 15 bp, Homo sapiens
tctgcttcctcagcc

SEQ ID NO: 1534902 - DNA, 19 bp, Homo sapiens
tctgcttcctcagccctag

SEQ ID NO: 1534903 - DNA, 19 bp, Homo sapiens
tctgcttctctgacttctg

SEQ ID NO: 1534904 - DNA, 18 bp, Homo sapiens
tctgcttgacaacatctg

SEQ ID NO: 1534905 - DNA, 13 bp, Homo sapiens
tctgcttgacaga

SEQ ID NO: 1534906 - DNA, 20 bp, Homo sapiens
tctgcttgccgactggctgt

SEQ ID NO: 1534907 - DNA, 17 bp, Homo sapiens
tctgctttcacttaagt

SEQ ID NO: 1534908 - DNA, 15 bp, Homo sapiens
tctgctttctgcctc

SEQ ID NO: 1534909 - DNA, 13 bp, Homo sapiens
tctgcttttacca

SEQ ID NO: 1534910 - DNA, 15 bp, Homo sapiens
tctgcttttctgccc

SEQ ID NO: 1534911 - DNA, 16 bp, Homo sapiens
tctgcttttctgccct

SEQ ID NO: 1534912 - DNA, 18 bp, Homo sapiens
tctgcttttctgccctgg

SEQ ID NO: 1534913 - DNA, 17 bp, Homo sapiens
tctggaaatccagataa

SEQ ID NO: 1534914 - DNA, 22 bp, Homo sapiens
tctggaacaacttgtagcagct

SEQ ID NO: 1534915 - DNA, 18 bp, Homo sapiens
tctggaacccagactcag

SEQ ID NO: 1534916 - DNA, 20 bp, Homo sapiens
tctggaagagaggaatgcct

SEQ ID NO: 1534917 - DNA, 15 bp, Homo sapiens
tctggaagattctta

SEQ ID NO: 1534918 - DNA, 16 bp, Homo sapiens
tctggaagtttctggt

SEQ ID NO: 1534919 - DNA, 18 bp, Homo sapiens
tctggaataaagttgcag

SEQ ID NO: 1534920 - DNA, 19 bp, Homo sapiens
tctggaataaagttgcaga

SEQ ID NO: 1534921 - DNA, 14 bp, Homo sapiens
tctggaatacatga

SEQ ID NO: 1534922 - DNA, 22 bp, Homo sapiens
tctggaatacatgaaatataga

SEQ ID NO: 1534923 - DNA, 19 bp, Homo sapiens
tctggaatattgtgattct

SEQ ID NO: 1534924 - DNA, 19 bp, Homo sapiens
tctggaatctggagaccag

SEQ ID NO: 1534925 - DNA, 23 bp, Homo sapiens
tctggaatggtacatgtcttcca

SEQ ID NO: 1534926 - DNA, 19 bp, Homo sapiens
tctggacagccccaccctg

SEQ ID NO: 1534927 - DNA, 23 bp, Homo sapiens
tctggacagtacctgattgtatt

SEQ ID NO: 1534928 - DNA, 18 bp, Homo sapiens
tctggacattctctttga

SEQ ID NO: 1534929 - DNA, 24 bp, Homo sapiens
tctggacattctctttgataacaa

SEQ ID NO: 1534930 - DNA, 16 bp, Homo sapiens
tctggacccttggcct

SEQ ID NO: 1534931 - DNA, 15 bp, Homo sapiens
tctggacggcaggct

SEQ ID NO: 1534932 - DNA, 20 bp, Homo sapiens
tctggactacacccaagcct

SEQ ID NO: 1534933 - DNA, 14 bp, Homo sapiens
tctggactctgccc

SEQ ID NO: 1534934 - DNA, 20 bp, Homo sapiens
tctggactctgccccaatcg

SEQ ID NO: 1534935 - DNA, 19 bp, Homo sapiens
tctggactgaagcctgcag

SEQ ID NO: 1534936 - DNA, 21 bp, Homo sapiens
tctggactgaagcctgcagga

SEQ ID NO: 1534937 - DNA, 19 bp, Homo sapiens
tctggactgccccagaaaa

SEQ ID NO: 1534938 - DNA, 19 bp, Homo sapiens
tctggacttggcaacagaa

SEQ ID NO: 1534939 - DNA, 18 bp, Homo sapiens
tctggacttggtcttgaa

SEQ ID NO: 1534940 - DNA, 22 bp, Homo sapiens
tctggagaagcagtgagccgca

SEQ ID NO: 1534941 - DNA, 15 bp, Homo sapiens
tctggagaccaggga

SEQ ID NO: 1534942 - DNA, 16 bp, Homo sapiens
tctggagatggaagct

SEQ ID NO: 1534943 - DNA, 17 bp, Homo sapiens
tctgagtcaaatccagt

SEQ ID NO: 1534944 - DNA, 18 bp, Homo sapiens
tctgagtcaaatccagtg

SEQ ID NO: 1534945 - DNA, 14 bp, Homo sapiens
tctgagtcccagga

SEQ ID NO: 1534946 - DNA, 15 bp, Homo sapiens
tctgagttcttgtgt

SEQ ID NO: 1534947 - DNA, 20 bp, Homo sapiens
tctgagttcttgtgtcctgg

SEQ ID NO: 1534948 - DNA, 20 bp, Homo sapiens
tctgagtttaccatttgtaa

SEQ ID NO: 1534949 - DNA, 14 bp, Homo sapiens
tctgagttttgtgt

SEQ ID NO: 1534950 - DNA, 18 bp, Homo sapiens
tctgataaagttccttaa

SEQ ID NO: 1534951 - DNA, 13 bp, Homo sapiens
tctgatatgggac

SEQ ID NO: 1534952 - DNA, 21 bp, Homo sapiens
tctgatatgggactgagcctg

SEQ ID NO: 1534953 - DNA, 15 bp, Homo sapiens
tctgatattaatcaa

SEQ ID NO: 1534954 - DNA, 19 bp, Homo sapiens
tctgatattccatgaatgt

SEQ ID NO: 1534955 - DNA, 20 bp, Homo sapiens
tctgatattccatgaatgta

SEQ ID NO: 1534956 - DNA, 22 bp, Homo sapiens
tctgatattccatgaatgtatc

SEQ ID NO: 1534957 - DNA, 14 bp, Homo sapiens
tctgatctaacaaa

SEQ ID NO: 1534958 - DNA, 12 bp, Homo sapiens
tctgatctctgt

SEQ ID NO: 1534959 - DNA, 23 bp, Homo sapiens
tctgatggccttaatttcctttt

SEQ ID NO: 1534960 - DNA, 16 bp, Homo sapiens
tctgattaaaacaact

SEQ ID NO: 1534961 - DNA, 21 bp, Homo sapiens
tctgattaaatttaatatact

SEQ ID NO: 1534962 - DNA, 14 bp, Homo sapiens
tctgattactgtcc

SEQ ID NO: 1534963 - DNA, 11 bp, Homo sapiens
tctgattccac

SEQ ID NO: 1534964 - DNA, 15 bp, Homo sapiens
tctgattctggcttt

SEQ ID NO: 1534965 - DNA, 19 bp, Homo sapiens
tctgattctggctttaagc

SEQ ID NO: 1534966 - DNA, 22 bp, Homo sapiens
tctgattgatttgattgggatg

SEQ ID NO: 1534967 - DNA, 11 bp, Homo sapiens
tctgattggct

SEQ ID NO: 1534968 - DNA, 13 bp, Homo sapiens
tctgattggctgc

SEQ ID NO: 1534969 - DNA, 16 bp, Homo sapiens
tctgattggctgctta

SEQ ID NO: 1534970 - DNA, 12 bp, Homo sapiens
tctgatttcagt

SEQ ID NO: 1534971 - DNA, 14 bp, Homo sapiens
tctgatttcagttt

SEQ ID NO: 1534972 - DNA, 18 bp, Homo sapiens
tctgatttcagtttttca

SEQ ID NO: 1534973 - DNA, 13 bp, Homo sapiens
tctgattttaatg

SEQ ID NO: 1534974 - DNA, 18 bp, Homo sapiens
tctgattttaatgaaatc

SEQ ID NO: 1534975 - DNA, 21 bp, Homo sapiens
tctgattttaatgaaatcaaa

SEQ ID NO: 1534976 - DNA, 23 bp, Homo sapiens
tctgattttaatgaaatcaaatg

SEQ ID NO: 1534977 - DNA, 13 bp, Homo sapiens
tctgattttagga

SEQ ID NO: 1534978 - DNA, 21 bp, Homo sapiens
tctgattttgtgcaaaagctt

SEQ ID NO: 1534979 - DNA, 16 bp, Homo sapiens
tctgatttttctcttt

SEQ ID NO: 1534980 - DNA, 17 bp, Homo sapiens
tctgatttttctctttt

SEQ ID NO: 1534981 - DNA, 18 bp, Homo sapiens
tctgatttttctcttttt

SEQ ID NO: 1534982 - DNA, 18 bp, Homo sapiens
tctgcaacatttgacaaa

SEQ ID NO: 1534983 - DNA, 16 bp, Homo sapiens
tctgcaactagccaag

SEQ ID NO: 1534984 - DNA, 19 bp, Homo sapiens
tctgcaactagccaaggct

SEQ ID NO: 1534985 - DNA, 14 bp, Homo sapiens
tctgcaactgctca

SEQ ID NO: 1534986 - DNA, 20 bp, Homo sapiens
tctgcaagcacatctgcatt

SEQ ID NO: 1534987 - DNA, 14 bp, Homo sapiens
tctgcaagggccca

SEQ ID NO: 1534988 - DNA, 17 bp, Homo sapiens
tctgcaaggtctttggt

SEQ ID NO: 1534989 - DNA, 16 bp, Homo sapiens
tcccctgcctcctgcc

SEQ ID NO: 1534990 - DNA, 17 bp, Homo sapiens
tcccctgcctcctgcca

SEQ ID NO: 1534991 - DNA, 18 bp, Homo sapiens
tcccctgcctcctgccac

SEQ ID NO: 1534992 - DNA, 15 bp, Homo sapiens
tcccctggaaaccca

SEQ ID NO: 1534993 - DNA, 16 bp, Homo sapiens
tcccctggagccagca

SEQ ID NO: 1534994 - DNA, 15 bp, Homo sapiens
tcccctggcagtgct

SEQ ID NO: 1534995 - DNA, 13 bp, Homo sapiens
tcccctggcctca

SEQ ID NO: 1534996 - DNA, 21 bp, Homo sapiens
tcccctggcctcagttcccag

SEQ ID NO: 1534997 - DNA, 21 bp, Homo sapiens
tcccctgggcatcttctggct

SEQ ID NO: 1534998 - DNA, 16 bp, Homo sapiens
tcccctgggtcctcca

SEQ ID NO: 1534999 - DNA, 20 bp, Homo sapiens
tcccctgggtcctccaaaga

SEQ ID NO: 1535000 - DNA, 19 bp, Homo sapiens
tcccctgggttaacaaatg

SEQ ID NO: 1535001 - DNA, 19 bp, Homo sapiens
tcccctgtcccaccaactc

SEQ ID NO: 1535002 - DNA, 20 bp, Homo sapiens
tcccctgtcccaccaactct

SEQ ID NO: 1535003 - DNA, 12 bp, Homo sapiens
tcccctgtgtca

SEQ ID NO: 1535004 - DNA, 15 bp, Homo sapiens
tcccctgttcactct

SEQ ID NO: 1535005 - DNA, 22 bp, Homo sapiens
tcccctgttgattatcttcagc

SEQ ID NO: 1535006 - DNA, 12 bp, Homo sapiens
tccccttcctgt

SEQ ID NO: 1535007 - DNA, 13 bp, Homo sapiens
tccccttctctca

SEQ ID NO: 1535008 - DNA, 15 bp, Homo sapiens
tccccttctctcatc

SEQ ID NO: 1535009 - DNA, 13 bp, Homo sapiens
tccccttgcccag

SEQ ID NO: 1535010 - DNA, 24 bp, Homo sapiens
tccccttgcccagggctcagcctg

SEQ ID NO: 1535011 - DNA, 12 bp, Homo sapiens
tcccctttcctg

SEQ ID NO: 1535012 - DNA, 14 bp, Homo sapiens
tcccctttcctgtc

SEQ ID NO: 1535013 - DNA, 15 bp, Homo sapiens
tcccctttgcactgt

SEQ ID NO: 1535014 - DNA, 15 bp, Homo sapiens
tccccttttgcctgg

SEQ ID NO: 1535015 - DNA, 18 bp, Homo sapiens
tccccttttgcctggctg

SEQ ID NO: 1535016 - DNA, 22 bp, Homo sapiens
tcccgaggaactcgcctcagcc

SEQ ID NO: 1535017 - DNA, 20 bp, Homo sapiens
tcccgatgagggaaggagcc

SEQ ID NO: 1535018 - DNA, 17 bp, Homo sapiens
tcccgcactctgccccc

SEQ ID NO: 1535019 - DNA, 23 bp, Homo sapiens
tcccgcatcaaggtcagcatgag

SEQ ID NO: 1535020 - DNA, 14 bp, Homo sapiens
tcccgccccgcccc

SEQ ID NO: 1535021 - DNA, 16 bp, Homo sapiens
tcccgccccgcccctc

SEQ ID NO: 1535022 - DNA, 17 bp, Homo sapiens
tcccgccccgcccctcc

SEQ ID NO: 1535023 - DNA, 15 bp, Homo sapiens
tcccgcctcagcctc

SEQ ID NO: 1535024 - DNA, 18 bp, Homo sapiens
tcccgcctcagcctcctg

SEQ ID NO: 1535025 - DNA, 17 bp, Homo sapiens
tcccgcctccctctcag

SEQ ID NO: 1535026 - DNA, 13 bp, Homo sapiens
tcccgccttccaa

SEQ ID NO: 1535027 - DNA, 20 bp, Homo sapiens
tcccgcggtgctgactgagg

SEQ ID NO: 1535028 - DNA, 20 bp, Homo sapiens
tcccgctgcacatggacaga

SEQ ID NO: 1535029 - DNA, 22 bp, Homo sapiens
tcccgctgcacatggacagact

SEQ ID NO: 1535030 - DNA, 15 bp, Homo sapiens
tcccgctgctgctgc

SEQ ID NO: 1535031 - DNA, 22 bp, Homo sapiens
tcccgctgctgtgctctgggga

SEQ ID NO: 1535032 - DNA, 14 bp, Homo sapiens
tcccgcttcctggc

SEQ ID NO: 1535033 - DNA, 17 bp, Homo sapiens
tcccgcttcctggcctc

SEQ ID NO: 1535034 - DNA, 22 bp, Homo sapiens
tcccggagcacagccctgggag

SEQ ID NO: 1535035 - DNA, 20 bp, Homo sapiens
tcccggcaagcgcttctgct

SEQ ID NO: 1535036 - DNA, 23 bp, Homo sapiens
tcccggcaagcgcttctgctgaa

SEQ ID NO: 1535037 - DNA, 18 bp, Homo sapiens
tcccggccagctctggag

SEQ ID NO: 1535038 - DNA, 15 bp, Homo sapiens
tcccggccgcgccgc

SEQ ID NO: 1535039 - DNA, 18 bp, Homo sapiens
tcccggccgcgccgccgc

SEQ ID NO: 1535040 - DNA, 16 bp, Homo sapiens
tcccggccggccctgg

SEQ ID NO: 1535041 - DNA, 15 bp, Homo sapiens
tcgggagcagtgtct

SEQ ID NO: 1535042 - DNA, 23 bp, Homo sapiens
tcgggagcagtgtcttccataat

SEQ ID NO: 1535043 - DNA, 13 bp, Homo sapiens
tcgggaggagcag

SEQ ID NO: 1535044 - DNA, 22 bp, Homo sapiens
tcgggaggagcagcccggggag

SEQ ID NO: 1535045 - DNA, 13 bp, Homo sapiens
tcgggaggctgag

SEQ ID NO: 1535046 - DNA, 14 bp, Homo sapiens
tcgggaggctgagg

SEQ ID NO: 1535047 - DNA, 21 bp, Homo sapiens
tcgggagtcctctagcaggcc

SEQ ID NO: 1535048 - DNA, 21 bp, Homo sapiens
tcgggatgccgttctgttcca

SEQ ID NO: 1535049 - DNA, 12 bp, Homo sapiens
tcgggattcttt

SEQ ID NO: 1535050 - DNA, 15 bp, Homo sapiens
tcgggcaccagccag

SEQ ID NO: 1535051 - DNA, 16 bp, Homo sapiens
tcgggcaccagccagc

SEQ ID NO: 1535052 - DNA, 21 bp, Homo sapiens
tcgggcagtggaggctgctgt

SEQ ID NO: 1535053 - DNA, 23 bp, Homo sapiens
tcgggcagtggaggctgctgtga

SEQ ID NO: 1535054 - DNA, 14 bp, Homo sapiens
tcgggcccacctgg

SEQ ID NO: 1535055 - DNA, 17 bp, Homo sapiens
tcgggcccacctggcca

SEQ ID NO: 1535056 - DNA, 23 bp, Homo sapiens
tcgggccccatcctcatccctga

SEQ ID NO: 1535057 - DNA, 21 bp, Homo sapiens
tcgggccgtaggggctcctga

SEQ ID NO: 1535058 - DNA, 16 bp, Homo sapiens
tcggggcatgctgggg

SEQ ID NO: 1535059 - DNA, 12 bp, Homo sapiens
tcggggccctgt

SEQ ID NO: 1535060 - DNA, 15 bp, Homo sapiens
tcggggccctgtgta

SEQ ID NO: 1535061 - DNA, 13 bp, Homo sapiens
tcgggggctggcc

SEQ ID NO: 1535062 - DNA, 15 bp, Homo sapiens
tcgggggctgtggat

SEQ ID NO: 1535063 - DNA, 16 bp, Homo sapiens
tcggggggctctgcct

SEQ ID NO: 1535064 - DNA, 19 bp, Homo sapiens
tcggggtaaaaagtggctg

SEQ ID NO: 1535065 - DNA, 12 bp, Homo sapiens
tcggggtggggg

SEQ ID NO: 1535066 - DNA, 13 bp, Homo sapiens
tcgggtccagaga

SEQ ID NO: 1535067 - DNA, 18 bp, Homo sapiens
tcggtgctccatctccgc

SEQ ID NO: 1535068 - DNA, 16 bp, Homo sapiens
tcggtgggccagagct

SEQ ID NO: 1535069 - DNA, 21 bp, Homo sapiens
tcggttcaagttgatgtgaca

SEQ ID NO: 1535070 - DNA, 23 bp, Homo sapiens
tcggttccacgtccccctggggc

SEQ ID NO: 1535071 - DNA, 16 bp, Homo sapiens
tcgtaacctggtgcct

SEQ ID NO: 1535072 - DNA, 17 bp, Homo sapiens
tcgtaatagcttctgtg

SEQ ID NO: 1535073 - DNA, 20 bp, Homo sapiens
tcgtaatagcttctgtgtgt

SEQ ID NO: 1535074 - DNA, 16 bp, Homo sapiens
tcgtacagaaagctgc

SEQ ID NO: 1535075 - DNA, 21 bp, Homo sapiens
tcgtacctgtccctccaggcc

SEQ ID NO: 1535076 - DNA, 14 bp, Homo sapiens
tcgtaggcagccac

SEQ ID NO: 1535077 - DNA, 18 bp, Homo sapiens
tcgtagtccatcaccatt

SEQ ID NO: 1535078 - DNA, 17 bp, Homo sapiens
tcgtatgatcagtactg

SEQ ID NO: 1535079 - DNA, 24 bp, Homo sapiens
tcgtcactcaaatgaatttgctaa

SEQ ID NO: 1535080 - DNA, 18 bp, Homo sapiens
tcgtccaagggacagccc

SEQ ID NO: 1535081 - DNA, 20 bp, Homo sapiens
tcgtccaagggacagcccac

SEQ ID NO: 1535082 - DNA, 18 bp, Homo sapiens
tcgtccatgtttctcaca

SEQ ID NO: 1535083 - DNA, 14 bp, Homo sapiens
tcgtcctccccctg

SEQ ID NO: 1535084 - DNA, 16 bp, Homo sapiens
tcgtcctccccctgcc

SEQ ID NO: 1535085 - DNA, 14 bp, Homo sapiens
tcgtcctgtcccag

SEQ ID NO: 1535086 - DNA, 16 bp, Homo sapiens
tcgtcctgtcccagag

SEQ ID NO: 1535087 - DNA, 21 bp, Homo sapiens
tcgtctccctggtgcctctgt

SEQ ID NO: 1535088 - DNA, 13 bp, Homo sapiens
tcgtctttacttc

SEQ ID NO: 1535089 - DNA, 17 bp, Homo sapiens
tcgtgaacatagagttt

SEQ ID NO: 1535090 - DNA, 15 bp, Homo sapiens
tcgtgaagaagcctg

SEQ ID NO: 1535091 - DNA, 17 bp, Homo sapiens
tcgtgaagtatactgta

SEQ ID NO: 1535092 - DNA, 19 bp, Homo sapiens
tcgtgaagtatactgtatt

SEQ ID NO: 1535093 - DNA, 20 bp, Homo sapiens
tcgtgacccttcagggccag

SEQ ID NO: 1535094 - DNA, 20 bp, Homo sapiens
tcgtgattttcaagcagcat

SEQ ID NO: 1535095 - DNA, 15 bp, Homo sapiens
tcgtgcactctgcta

SEQ ID NO: 1535096 - DNA, 20 bp, Homo sapiens
tcgtgcactctgctaatcat

SEQ ID NO: 1535097 - DNA, 11 bp, Homo sapiens
tcgtgccagca

SEQ ID NO: 1535098 - DNA, 14 bp, Homo sapiens
tcgtgccagcagcc

SEQ ID NO: 1535099 - DNA, 20 bp, Homo sapiens
tcgtgcccccccttccccct

SEQ ID NO: 1535100 - DNA, 20 bp, Homo sapiens
tcgtgccgttactctccaac

SEQ ID NO: 1535101 - DNA, 16 bp, Homo sapiens
tcgtgctactgcactc

SEQ ID NO: 1535102 - DNA, 22 bp, Homo sapiens
tcgtgctactgcactccagcct

SEQ ID NO: 1535103 - DNA, 13 bp, Homo sapiens
tcgtgctgtgctc

SEQ ID NO: 1535104 - DNA, 17 bp, Homo sapiens
tcgtggacacacacaga

SEQ ID NO: 1535105 - DNA, 18 bp, Homo sapiens
tcgtggacacacacagac

SEQ ID NO: 1535106 - DNA, 17 bp, Homo sapiens
tcgtggactgtgctggt

SEQ ID NO: 1535107 - DNA, 14 bp, Homo sapiens
tcgtggccagcccg

SEQ ID NO: 1535108 - DNA, 15 bp, Homo sapiens
tcgtggggtgtgctg

SEQ ID NO: 1535109 - DNA, 22 bp, Homo sapiens
tcgtggtgatcaattaaatgta

SEQ ID NO: 1535110 - DNA, 20 bp, Homo sapiens
tcgtgtagtggaagagcagc

SEQ ID NO: 1535111 - DNA, 14 bp, Homo sapiens
tcgtgtatttatta

SEQ ID NO: 1535112 - DNA, 21 bp, Homo sapiens
tcgtgtgatttcctacagaaa

SEQ ID NO: 1535113 - DNA, 17 bp, Homo sapiens
tcgtgtgcaacagacaa

SEQ ID NO: 1535114 - DNA, 22 bp, Homo sapiens
tcgttaactgtgtatgtacata

SEQ ID NO: 1535115 - DNA, 14 bp, Homo sapiens
tcgttgttattatt

SEQ ID NO: 1535116 - DNA, 15 bp, Homo sapiens
tcgtttccatcatgt

SEQ ID NO: 1535117 - DNA, 12 bp, Homo sapiens
tcgttttagtgt

SEQ ID NO: 1535118 - DNA, 15 bp, Homo sapiens
tcgttttagtgtctg

SEQ ID NO: 1535119 - DNA, 23 bp, Homo sapiens
tcgttttgaagacgtggactcct

SEQ ID NO: 1535120 - DNA, 20 bp, Homo sapiens
tcgtttttgtattttcatga

SEQ ID NO: 1535121 - DNA, 18 bp, Homo sapiens
tctaaaaaacagaggcca

SEQ ID NO: 1535122 - DNA, 17 bp, Homo sapiens
tctaaaaaataactgtg

SEQ ID NO: 1535123 - DNA, 13 bp, Homo sapiens
tctaaaactatgg

SEQ ID NO: 1535124 - DNA, 23 bp, Homo sapiens
tctaaaactatggttcccaataa

SEQ ID NO: 1535125 - DNA, 14 bp, Homo sapiens
tctaaaagctctgt

SEQ ID NO: 1535126 - DNA, 18 bp, Homo sapiens
tctaaaaggtaatgtgtg

SEQ ID NO: 1535127 - DNA, 22 bp, Homo sapiens
tctaaaatcttatagttctagg

SEQ ID NO: 1535128 - DNA, 21 bp, Homo sapiens
tctaaaatgtgatgttctaag

SEQ ID NO: 1535129 - DNA, 22 bp, Homo sapiens
tctaaaatgtgatgttctaagg

SEQ ID NO: 1535130 - DNA, 16 bp, Homo sapiens
tctaaaattattatat

SEQ ID NO: 1535131 - DNA, 12 bp, Homo sapiens
tctaaaattcta

SEQ ID NO: 1535132 - DNA, 14 bp, Homo sapiens
tctaaacagttatt

SEQ ID NO: 1535133 - DNA, 18 bp, Homo sapiens
tctaaaccccagattctt

SEQ ID NO: 1535134 - DNA, 24 bp, Homo sapiens
tctaaaccccagattcttcagctt

SEQ ID NO: 1535135 - DNA, 20 bp, Homo sapiens
tctaaacgtggtcaccttcg

SEQ ID NO: 1535136 - DNA, 18 bp, Homo sapiens
tctaaactgttttcatgt

SEQ ID NO: 1535137 - DNA, 20 bp, Homo sapiens
tctaaacttttgagaatgtt

SEQ ID NO: 1535138 - DNA, 13 bp, Homo sapiens
tctaaagaaaaat

SEQ ID NO: 1535139 - DNA, 22 bp, Homo sapiens
tctaaagatcaagtgggccttg

SEQ ID NO: 1535140 - DNA, 22 bp, Homo sapiens
tctaaagatggagtttctaagg

SEQ ID NO: 1535141 - DNA, 16 bp, Homo sapiens
tctaaagattctatag

SEQ ID NO: 1535142 - DNA, 14 bp, Homo sapiens
tctaaagctctgac

SEQ ID NO: 1535143 - DNA, 17 bp, Homo sapiens
tctaaaggtccacaggt

SEQ ID NO: 1535144 - DNA, 18 bp, Homo sapiens
tctaaaggtggtgaggca

SEQ ID NO: 1535145 - DNA, 19 bp, Homo sapiens
tctaaagtagcaactgctg

SEQ ID NO: 1535146 - DNA, 23 bp, Homo sapiens
tctaaagtagcaactgctggtga

SEQ ID NO: 1535147 - DNA, 11 bp, Homo sapiens
tctaaagttct

SEQ ID NO: 1535148 - DNA, 12 bp, Homo sapiens
tctaaagttcta

SEQ ID NO: 1535149 - DNA, 20 bp, Homo sapiens
tctaaagttctaagattctg

SEQ ID NO: 1535150 - DNA, 14 bp, Homo sapiens
tctaaataaaaata

SEQ ID NO: 1535151 - DNA, 21 bp, Homo sapiens
tctaaatccgacttgaatatt

SEQ ID NO: 1535152 - DNA, 14 bp, Homo sapiens
tctaaatctattta

SEQ ID NO: 1535153 - DNA, 16 bp, Homo sapiens
tctaaatctatttatt

SEQ ID NO: 1535154 - DNA, 20 bp, Homo sapiens
tctaaatctatttattaata

SEQ ID NO: 1535155 - DNA, 13 bp, Homo sapiens
tctaaatgcagtt

SEQ ID NO: 1535156 - DNA, 15 bp, Homo sapiens
tctacctcttggctg

SEQ ID NO: 1535157 - DNA, 16 bp, Homo sapiens
tctacctgaggccagg

SEQ ID NO: 1535158 - DNA, 13 bp, Homo sapiens
tctacctggcaga

SEQ ID NO: 1535159 - DNA, 13 bp, Homo sapiens
tctaccttttctg

SEQ ID NO: 1535160 - DNA, 15 bp, Homo sapiens
tctacgcaattgaca

SEQ ID NO: 1535161 - DNA, 19 bp, Homo sapiens
tctactaatgcctcttcat

SEQ ID NO: 1535162 - DNA, 14 bp, Homo sapiens
tctactcagaaatt

SEQ ID NO: 1535163 - DNA, 21 bp, Homo sapiens
tctactcagaaatttttattt

SEQ ID NO: 1535164 - DNA, 16 bp, Homo sapiens
tctatatatgtgtatg

SEQ ID NO: 1535165 - DNA, 18 bp, Homo sapiens
tctatatcatatttctgt

SEQ ID NO: 1535166 - DNA, 16 bp, Homo sapiens
tctatatttattttca

SEQ ID NO: 1535167 - DNA, 14 bp, Homo sapiens
tctatatttgtctt

SEQ ID NO: 1535168 - DNA, 16 bp, Homo sapiens
tctatatttgtcttcc

SEQ ID NO: 1535169 - DNA, 17 bp, Homo sapiens
tctatattttaatagaa

SEQ ID NO: 1535170 - DNA, 11 bp, Homo sapiens
tctatcacctg

SEQ ID NO: 1535171 - DNA, 16 bp, Homo sapiens
tctatcacctgtcatc

SEQ ID NO: 1535172 - DNA, 17 bp, Homo sapiens
tctatccatctcctggt

SEQ ID NO: 1535173 - DNA, 21 bp, Homo sapiens
tctatcctagtcttcacaact

SEQ ID NO: 1535174 - DNA, 17 bp, Homo sapiens
tctatcttccaaatgca

SEQ ID NO: 1535175 - DNA, 18 bp, Homo sapiens
tctatgaagcccacccag

SEQ ID NO: 1535176 - DNA, 17 bp, Homo sapiens
tctatgaagtatataat

SEQ ID NO: 1535177 - DNA, 17 bp, Homo sapiens
tctatgacatgaaatga

SEQ ID NO: 1535178 - DNA, 20 bp, Homo sapiens
cccagagcccctcctccagc

SEQ ID NO: 1535179 - DNA, 20 bp, Homo sapiens
cccagagcgaggaaaggatt

SEQ ID NO: 1535180 - DNA, 19 bp, Homo sapiens
cccagagctcatcccccct

SEQ ID NO: 1535181 - DNA, 23 bp, Homo sapiens
cccagagctcatcccccctgctg

SEQ ID NO: 1535182 - DNA, 11 bp, Homo sapiens
cccagagctgt

SEQ ID NO: 1535183 - DNA, 13 bp, Homo sapiens
cccagagctgttt

SEQ ID NO: 1535184 - DNA, 22 bp, Homo sapiens
cccagagcttattggccactgg

SEQ ID NO: 1535185 - DNA, 15 bp, Homo sapiens
cccagaggagggcag

SEQ ID NO: 1535186 - DNA, 13 bp, Homo sapiens
cccagaggccctg

SEQ ID NO: 1535187 - DNA, 14 bp, Homo sapiens
cccagaggccctgg

SEQ ID NO: 1535188 - DNA, 16 bp, Homo sapiens
cccagaggccctggag

SEQ ID NO: 1535189 - DNA, 16 bp, Homo sapiens
cccagaggctcccaat

SEQ ID NO: 1535190 - DNA, 15 bp, Homo sapiens
cccagagggcccagg

SEQ ID NO: 1535191 - DNA, 16 bp, Homo sapiens
cccagagggcccaggc

SEQ ID NO: 1535192 - DNA, 23 bp, Homo sapiens
cccagagggcccaggcaggccac

SEQ ID NO: 1535193 - DNA, 17 bp, Homo sapiens
cccagaggtcgcagcta

SEQ ID NO: 1535194 - DNA, 18 bp, Homo sapiens
cccagaggtcgcagctac

SEQ ID NO: 1535195 - DNA, 22 bp, Homo sapiens
cccagaggtcgcagctaccctc

SEQ ID NO: 1535196 - DNA, 20 bp, Homo sapiens
cccagaggtgggatcctccc

SEQ ID NO: 1535197 - DNA, 18 bp, Homo sapiens
cccagaggttatctgcct

SEQ ID NO: 1535198 - DNA, 22 bp, Homo sapiens
cccagaggttatctgcctggcc

SEQ ID NO: 1535199 - DNA, 23 bp, Homo sapiens
cccagaggttatctgcctggcct

SEQ ID NO: 1535200 - DNA, 23 bp, Homo sapiens
cccagagttgctgggagctgaaa

SEQ ID NO: 1535201 - DNA, 19 bp, Homo sapiens
cccagatacgggggctgtg

SEQ ID NO: 1535202 - DNA, 16 bp, Homo sapiens
cccagatctgcctggg

SEQ ID NO: 1535203 - DNA, 23 bp, Homo sapiens
cccagatctgcctgggcctgtgc

SEQ ID NO: 1535204 - DNA, 20 bp, Homo sapiens
cccagatgttgcttttgaaa

SEQ ID NO: 1535205 - DNA, 16 bp, Homo sapiens
cccagattcccctgtg

SEQ ID NO: 1535206 - DNA, 16 bp, Homo sapiens
cccagattgtgtacat

SEQ ID NO: 1535207 - DNA, 23 bp, Homo sapiens
cccagcaacgcccctccaaacct

SEQ ID NO: 1535208 - DNA, 17 bp, Homo sapiens
cccagcaagcgggagcc

SEQ ID NO: 1535209 - DNA, 22 bp, Homo sapiens
cccagcaagcgggagcccgtgg

SEQ ID NO: 1535210 - DNA, 18 bp, Homo sapiens
cccagcacagcttgacct

SEQ ID NO: 1535211 - DNA, 19 bp, Homo sapiens
cccagcacatggccataga

SEQ ID NO: 1535212 - DNA, 13 bp, Homo sapiens
cccagcacctgct

SEQ ID NO: 1535213 - DNA, 17 bp, Homo sapiens
cccagcactttgagagg

SEQ ID NO: 1535214 - DNA, 15 bp, Homo sapiens
cccagcactttggga

SEQ ID NO: 1535215 - DNA, 23 bp, Homo sapiens
cccagcactttgggaggccgagg

SEQ ID NO: 1535216 - DNA, 21 bp, Homo sapiens
cccagcagaatggaggcaggg

SEQ ID NO: 1535217 - DNA, 13 bp, Homo sapiens
cccagcagcagag

SEQ ID NO: 1535218 - DNA, 16 bp, Homo sapiens
cccagcaggaagccag

SEQ ID NO: 1535219 - DNA, 21 bp, Homo sapiens
cccagcaggagagactgagca

SEQ ID NO: 1535220 - DNA, 12 bp, Homo sapiens
cccagcaggccc

SEQ ID NO: 1535221 - DNA, 21 bp, Homo sapiens
cccagcaggcccagcatgcag

SEQ ID NO: 1535222 - DNA, 18 bp, Homo sapiens
cccagcatcagcctgtag

SEQ ID NO: 1535223 - DNA, 14 bp, Homo sapiens
cccagcatccctgg

SEQ ID NO: 1535224 - DNA, 18 bp, Homo sapiens
cccagcatccctggagca

SEQ ID NO: 1535225 - DNA, 13 bp, Homo sapiens
cccagcatctccc

SEQ ID NO: 1535226 - DNA, 20 bp, Homo sapiens
cccagcattccagcccctct

SEQ ID NO: 1535227 - DNA, 22 bp, Homo sapiens
cccagcattccagcccctctgg

SEQ ID NO: 1535228 - DNA, 23 bp, Homo sapiens
cccagcatttggttttacacagg

SEQ ID NO: 1535229 - DNA, 10 bp, Homo sapiens
cccagccaca

SEQ ID NO: 1535230 - DNA, 14 bp, Homo sapiens
cccagccaccccgg

SEQ ID NO: 1535231 - DNA, 19 bp, Homo sapiens
cccagccacgactgccatg

SEQ ID NO: 1535232 - DNA, 18 bp, Homo sapiens
cccagccagagttcctgc

SEQ ID NO: 1535233 - DNA, 12 bp, Homo sapiens
cccagccaggcc

SEQ ID NO: 1535234 - DNA, 18 bp, Homo sapiens
cccagccaggccaacagc

SEQ ID NO: 1535235 - DNA, 22 bp, Homo sapiens
cccagccaggccaacagcacct

SEQ ID NO: 1535236 - DNA, 15 bp, Homo sapiens
cccagccatctgccc

SEQ ID NO: 1535237 - DNA, 22 bp, Homo sapiens
cccagccatctgcccaggggtg

SEQ ID NO: 1535238 - DNA, 10 bp, Homo sapiens
cccagccatt

SEQ ID NO: 1535239 - DNA, 9 bp, Homo sapiens
cccagccca

SEQ ID NO: 1535240 - DNA, 16 bp, Homo sapiens
cccagcccaaagctgt

SEQ ID NO: 1535241 - DNA, 10 bp, Homo sapiens
cccagcccag

SEQ ID NO: 1535242 - DNA, 11 bp, Homo sapiens
cccagcccaga

SEQ ID NO: 1535243 - DNA, 13 bp, Homo sapiens
cccagcccagaga

SEQ ID NO: 1535244 - DNA, 14 bp, Homo sapiens
cccagcccagagcc

SEQ ID NO: 1535245 - DNA, 19 bp, Homo sapiens
cccagcccagagccacctg

SEQ ID NO: 1535246 - DNA, 12 bp, Homo sapiens
cccagcccagat

SEQ ID NO: 1535247 - DNA, 18 bp, Homo sapiens
cccagcccagctggtggg

SEQ ID NO: 1535248 - DNA, 15 bp, Homo sapiens
cccagccccggggtg

SEQ ID NO: 1535249 - DNA, 22 bp, Homo sapiens
cccagccccggtggctgggcag

SEQ ID NO: 1535250 - DNA, 18 bp, Homo sapiens
cccagcccctactgctgt

SEQ ID NO: 1535251 - DNA, 19 bp, Homo sapiens
cccagcccctactgctgtg

SEQ ID NO: 1535252 - DNA, 20 bp, Homo sapiens
cccagcccctgcccctcatg

SEQ ID NO: 1535253 - DNA, 23 bp, Homo sapiens
cccagcccctgcccctcatgcca

SEQ ID NO: 1535254 - DNA, 13 bp, Homo sapiens
cccagccctcaga

SEQ ID NO: 1535255 - DNA, 12 bp, Homo sapiens
cccagccctgct

SEQ ID NO: 1535256 - DNA, 14 bp, Homo sapiens
cccagccctgctgg

SEQ ID NO: 1535257 - DNA, 11 bp, Homo sapiens
cccagccctgg

SEQ ID NO: 1535258 - DNA, 14 bp, Homo sapiens
cccagccctgggaa

SEQ ID NO: 1535259 - DNA, 15 bp, Homo sapiens
cccagcccttctgcc

SEQ ID NO: 1535260 - DNA, 21 bp, Homo sapiens
cccagccctttgggaggctga

SEQ ID NO: 1535261 - DNA, 18 bp, Homo sapiens
cccagccggcctctctgg

SEQ ID NO: 1535262 - DNA, 14 bp, Homo sapiens
cccagccgggcaca

SEQ ID NO: 1535263 - DNA, 18 bp, Homo sapiens
cccagcctccctgaagcc

SEQ ID NO: 1535264 - DNA, 21 bp, Homo sapiens
cccagcctcttctagagccgt

SEQ ID NO: 1535265 - DNA, 21 bp, Homo sapiens
cccagcctcttgctcagagct

SEQ ID NO: 1535266 - DNA, 18 bp, Homo sapiens
cccagcctgaaagataca

SEQ ID NO: 1535267 - DNA, 19 bp, Homo sapiens
cccagcctgaaagatacag

SEQ ID NO: 1535268 - DNA, 20 bp, Homo sapiens
cccagcctggccacgcagcc

SEQ ID NO: 1535269 - DNA, 22 bp, Homo sapiens
cccagcctggccacgcagccag

SEQ ID NO: 1535270 - DNA, 23 bp, Homo sapiens
cccagcctggccacgcagccagg

SEQ ID NO: 1535271 - DNA, 18 bp, Homo sapiens
cccagcctgggagcccag

SEQ ID NO: 1535272 - DNA, 14 bp, Homo sapiens
cccagcctggggct

SEQ ID NO: 1535273 - DNA, 17 bp, Homo sapiens
cccagcctggggctccc

SEQ ID NO: 1535274 - DNA, 19 bp, Homo sapiens
cccagcctggggctccctc

SEQ ID NO: 1535275 - DNA, 23 bp, Homo sapiens
cccagcctggggctccctctctg

SEQ ID NO: 1535276 - DNA, 12 bp, Homo sapiens
cccagcctgtcc

SEQ ID NO: 1535277 - DNA, 19 bp, Homo sapiens
cccagcctgtggttacagt

SEQ ID NO: 1535278 - DNA, 23 bp, Homo sapiens
cccagcgcggccagcgtcccagg

SEQ ID NO: 1535279 - DNA, 16 bp, Homo sapiens
tctccaatatcagtgc

SEQ ID NO: 1535280 - DNA, 12 bp, Homo sapiens
tctccacagtgt

SEQ ID NO: 1535281 - DNA, 14 bp, Homo sapiens
tctccacagtgttg

SEQ ID NO: 1535282 - DNA, 23 bp, Homo sapiens
tctccaccacccaacccaaacca

SEQ ID NO: 1535283 - DNA, 14 bp, Homo sapiens
tctccacccacctt

SEQ ID NO: 1535284 - DNA, 14 bp, Homo sapiens
tctccacctcagcc

SEQ ID NO: 1535285 - DNA, 19 bp, Homo sapiens
tctccacctcagccttgga

SEQ ID NO: 1535286 - DNA, 12 bp, Homo sapiens
tctccacctccc

SEQ ID NO: 1535287 - DNA, 23 bp, Homo sapiens
tctccacctcccccaaaccctgc

SEQ ID NO: 1535288 - DNA, 20 bp, Homo sapiens
tctccactaaatgagctcct

SEQ ID NO: 1535289 - DNA, 16 bp, Homo sapiens
tctccactgctctcag

SEQ ID NO: 1535290 - DNA, 14 bp, Homo sapiens
tctccactgctgga

SEQ ID NO: 1535291 - DNA, 17 bp, Homo sapiens
tctccactgctggacat

SEQ ID NO: 1535292 - DNA, 18 bp, Homo sapiens
tctccagatgtttccaga

SEQ ID NO: 1535293 - DNA, 12 bp, Homo sapiens
tctccagccagc

SEQ ID NO: 1535294 - DNA, 15 bp, Homo sapiens
tctccagccagcaat

SEQ ID NO: 1535295 - DNA, 16 bp, Homo sapiens
tctccagccagcaatg

SEQ ID NO: 1535296 - DNA, 18 bp, Homo sapiens
tctccagcggccctgtca

SEQ ID NO: 1535297 - DNA, 17 bp, Homo sapiens
tctccagctgcctgggc

SEQ ID NO: 1535298 - DNA, 19 bp, Homo sapiens
tctccagctgcctgggccc

SEQ ID NO: 1535299 - DNA, 11 bp, Homo sapiens
tctccagctgg

SEQ ID NO: 1535300 - DNA, 19 bp, Homo sapiens
tctccagctgggctctgca

SEQ ID NO: 1535301 - DNA, 16 bp, Homo sapiens
cccagggctcagcctg

SEQ ID NO: 1535302 - DNA, 14 bp, Homo sapiens
cccagggctgggag

SEQ ID NO: 1535303 - DNA, 16 bp, Homo sapiens
cccaggggacaaggga

SEQ ID NO: 1535304 - DNA, 18 bp, Homo sapiens
cccaggggacaagggatt

SEQ ID NO: 1535305 - DNA, 23 bp, Homo sapiens
cccaggggcagcaaggccttggt

SEQ ID NO: 1535306 - DNA, 12 bp, Homo sapiens
cccagggggcct

SEQ ID NO: 1535307 - DNA, 15 bp, Homo sapiens
cccagggggcctgga

SEQ ID NO: 1535308 - DNA, 16 bp, Homo sapiens
cccagggggcctggag

SEQ ID NO: 1535309 - DNA, 22 bp, Homo sapiens
cccagggggtctcacccatgca

SEQ ID NO: 1535310 - DNA, 15 bp, Homo sapiens
cccaggggtcccagc

SEQ ID NO: 1535311 - DNA, 18 bp, Homo sapiens
cccaggggtcccagccac

SEQ ID NO: 1535312 - DNA, 14 bp, Homo sapiens
cccaggggtctccc

SEQ ID NO: 1535313 - DNA, 22 bp, Homo sapiens
cccaggggtgccccctcctctc

SEQ ID NO: 1535314 - DNA, 20 bp, Homo sapiens
cccagggtacccgcctgagc

SEQ ID NO: 1535315 - DNA, 17 bp, Homo sapiens
cccagggtcctgtgcct

SEQ ID NO: 1535316 - DNA, 16 bp, Homo sapiens
cccagggtcttcccta

SEQ ID NO: 1535317 - DNA, 17 bp, Homo sapiens
cccaggtccagctctgg

SEQ ID NO: 1535318 - DNA, 17 bp, Homo sapiens
cccaggtcgggcagtgg

SEQ ID NO: 1535319 - DNA, 18 bp, Homo sapiens
cccaggtcgggcagtgga

SEQ ID NO: 1535320 - DNA, 14 bp, Homo sapiens
cccaggtctctcca

SEQ ID NO: 1535321 - DNA, 19 bp, Homo sapiens
cccaggtctctccactgct

SEQ ID NO: 1535322 - DNA, 16 bp, Homo sapiens
cccaggtggagggcac

SEQ ID NO: 1535323 - DNA, 15 bp, Homo sapiens
cccaggtgtgcctgt

SEQ ID NO: 1535324 - DNA, 19 bp, Homo sapiens
cccaggtgttaacattcca

SEQ ID NO: 1535325 - DNA, 19 bp, Homo sapiens
cccaggttcccccagcaag

SEQ ID NO: 1535326 - DNA, 20 bp, Homo sapiens
cccaggttcccccagcaagc

SEQ ID NO: 1535327 - DNA, 19 bp, Homo sapiens
cccaggttgacaccattct

SEQ ID NO: 1535328 - DNA, 21 bp, Homo sapiens
cccagtacctagctggctctg

SEQ ID NO: 1535329 - DNA, 18 bp, Homo sapiens
cccagtacctccaagcaa

SEQ ID NO: 1535330 - DNA, 13 bp, Homo sapiens
cccagtcactcct

SEQ ID NO: 1535331 - DNA, 19 bp, Homo sapiens
cccagtcactcctctctag

SEQ ID NO: 1535332 - DNA, 13 bp, Homo sapiens
cccagtcagaaat

SEQ ID NO: 1535333 - DNA, 22 bp, Homo sapiens
cccagtccatgctccagggtca

SEQ ID NO: 1535334 - DNA, 14 bp, Homo sapiens
cccagtcccaggga

SEQ ID NO: 1535335 - DNA, 15 bp, Homo sapiens
cccagtcccagggaa

SEQ ID NO: 1535336 - DNA, 15 bp, Homo sapiens
cccagtccccacccg

SEQ ID NO: 1535337 - DNA, 19 bp, Homo sapiens
cccagtccccacccgcctg

SEQ ID NO: 1535338 - DNA, 14 bp, Homo sapiens
cccagtccctggag

SEQ ID NO: 1535339 - DNA, 13 bp, Homo sapiens
cccagtccctggg

SEQ ID NO: 1535340 - DNA, 14 bp, Homo sapiens
cccagtccctgggg

SEQ ID NO: 1535341 - DNA, 23 bp, Homo sapiens
cccagtccctgggggaagccctg

SEQ ID NO: 1535342 - DNA, 15 bp, Homo sapiens
cccagtcgaccccaa

SEQ ID NO: 1535343 - DNA, 18 bp, Homo sapiens
cccagtgaatccctggga

SEQ ID NO: 1535344 - DNA, 19 bp, Homo sapiens
cccagtgaatccctgggag

SEQ ID NO: 1535345 - DNA, 21 bp, Homo sapiens
cccagtgcaaaccacttctcc

SEQ ID NO: 1535346 - DNA, 12 bp, Homo sapiens
cccagtgcagaa

SEQ ID NO: 1535347 - DNA, 15 bp, Homo sapiens
cccagtgcagaatgt

SEQ ID NO: 1535348 - DNA, 17 bp, Homo sapiens
cccagtgcagaatgtaa

SEQ ID NO: 1535349 - DNA, 19 bp, Homo sapiens
cccagtgcatggtggccag

SEQ ID NO: 1535350 - DNA, 20 bp, Homo sapiens
cccagtgcatggtggccaga

SEQ ID NO: 1535351 - DNA, 12 bp, Homo sapiens
cccagtgccact

SEQ ID NO: 1535352 - DNA, 14 bp, Homo sapiens
cccagtgccactgc

SEQ ID NO: 1535353 - DNA, 17 bp, Homo sapiens
cccagtgccactgcccc

SEQ ID NO: 1535354 - DNA, 19 bp, Homo sapiens
cccagtgcccccactgacc

SEQ ID NO: 1535355 - DNA, 16 bp, Homo sapiens
cccagtgccctggggc

SEQ ID NO: 1535356 - DNA, 23 bp, Homo sapiens
cccagtgccctggggctgatctc

SEQ ID NO: 1535357 - DNA, 15 bp, Homo sapiens
cccagtgcctgccac

SEQ ID NO: 1535358 - DNA, 13 bp, Homo sapiens
cccagtgctgcca

SEQ ID NO: 1535359 - DNA, 19 bp, Homo sapiens
cccagtgctgccatgccac

SEQ ID NO: 1535360 - DNA, 21 bp, Homo sapiens
cccagtgctgccatgccactg

SEQ ID NO: 1535361 - DNA, 16 bp, Homo sapiens
cccagtggagcctgcc

SEQ ID NO: 1535362 - DNA, 19 bp, Homo sapiens
cccagtggagcctgccgcc

SEQ ID NO: 1535363 - DNA, 17 bp, Homo sapiens
cccagtgggagcttccc

SEQ ID NO: 1535364 - DNA, 14 bp, Homo sapiens
cccagtgggagggg

SEQ ID NO: 1535365 - DNA, 19 bp, Homo sapiens
cccagtgggaggggcaggc

SEQ ID NO: 1535366 - DNA, 19 bp, Homo sapiens
cccagtgggcatagtcagt

SEQ ID NO: 1535367 - DNA, 17 bp, Homo sapiens
cccagtgtcagctgtgg

SEQ ID NO: 1535368 - DNA, 14 bp, Homo sapiens
cccagtgtccttcc

SEQ ID NO: 1535369 - DNA, 14 bp, Homo sapiens
cccagtgtgcacgc

SEQ ID NO: 1535370 - DNA, 14 bp, Homo sapiens
cccagttaaagatt

SEQ ID NO: 1535371 - DNA, 22 bp, Homo sapiens
cccagttaatactccagagaca

SEQ ID NO: 1535372 - DNA, 21 bp, Homo sapiens
cccagttcctgtggctccctc

SEQ ID NO: 1535373 - DNA, 21 bp, Homo sapiens
cccataaacagcacacctgtg

SEQ ID NO: 1535374 - DNA, 23 bp, Homo sapiens
cccataatagttagccctcagtc

SEQ ID NO: 1535375 - DNA, 21 bp, Homo sapiens
cccatacaatgtatgtacaat

SEQ ID NO: 1535376 - DNA, 23 bp, Homo sapiens
cccatacaatgtatgtacaatac

SEQ ID NO: 1535377 - DNA, 22 bp, Homo sapiens
cccatagatcttctgaaatgaa

SEQ ID NO: 1535378 - DNA, 16 bp, Homo sapiens
cccatagcttccatga

SEQ ID NO: 1535379 - DNA, 15 bp, Homo sapiens
cccatagtggggcct

SEQ ID NO: 1535380 - DNA, 19 bp, Homo sapiens
cccatagtggggcctggga

SEQ ID NO: 1535381 - DNA, 16 bp, Homo sapiens
cccatattttccccct

SEQ ID NO: 1535382 - DNA, 22 bp, Homo sapiens
cccatcacagggttgggcccag

SEQ ID NO: 1535383 - DNA, 15 bp, Homo sapiens
cccatcacccaagcc

SEQ ID NO: 1535384 - DNA, 18 bp, Homo sapiens
cccatcagctccagctgc

SEQ ID NO: 1535385 - DNA, 11 bp, Homo sapiens
cccatcaggac

SEQ ID NO: 1535386 - DNA, 18 bp, Homo sapiens
cccatccagacctggctc

SEQ ID NO: 1535387 - DNA, 14 bp, Homo sapiens
cccatccagccaga

SEQ ID NO: 1535388 - DNA, 12 bp, Homo sapiens
cccatccagcct

SEQ ID NO: 1535389 - DNA, 13 bp, Homo sapiens
cccatccagcctc

SEQ ID NO: 1535390 - DNA, 16 bp, Homo sapiens
cccatccagcctccag

SEQ ID NO: 1535391 - DNA, 18 bp, Homo sapiens
cccatccagcctccaggg

SEQ ID NO: 1535392 - DNA, 13 bp, Homo sapiens
cccatccaggcag

SEQ ID NO: 1535393 - DNA, 14 bp, Homo sapiens
cccatccattaggc

SEQ ID NO: 1535394 - DNA, 14 bp, Homo sapiens
tctcctactgagga

SEQ ID NO: 1535395 - DNA, 19 bp, Homo sapiens
tctcctatatatttctatt

SEQ ID NO: 1535396 - DNA, 23 bp, Homo sapiens
tctcctatatatttctattatta

SEQ ID NO: 1535397 - DNA, 23 bp, Homo sapiens
tctcctatcctggtttttgtagc

SEQ ID NO: 1535398 - DNA, 19 bp, Homo sapiens
tctcctatgtggcagctgg

SEQ ID NO: 1535399 - DNA, 20 bp, Homo sapiens
tctcctcaagtccccaagat

SEQ ID NO: 1535400 - DNA, 13 bp, Homo sapiens
tctcctcatctcc

SEQ ID NO: 1535401 - DNA, 14 bp, Homo sapiens
tctcctcatctcca

SEQ ID NO: 1535402 - DNA, 18 bp, Homo sapiens
tctcctcccgccccgccc

SEQ ID NO: 1535403 - DNA, 14 bp, Homo sapiens
tctcctccctcagc

SEQ ID NO: 1535404 - DNA, 22 bp, Homo sapiens
tctcctccctcctggggaaggt

SEQ ID NO: 1535405 - DNA, 13 bp, Homo sapiens
tctcctcccttcc

SEQ ID NO: 1535406 - DNA, 12 bp, Homo sapiens
tctcctctccat

SEQ ID NO: 1535407 - DNA, 13 bp, Homo sapiens
tctcctctctgag

SEQ ID NO: 1535408 - DNA, 14 bp, Homo sapiens
tctcctctctgaga

SEQ ID NO: 1535409 - DNA, 16 bp, Homo sapiens
tctcctctcttggcat

SEQ ID NO: 1535410 - DNA, 14 bp, Homo sapiens
tctcctcttaaaaa

SEQ ID NO: 1535411 - DNA, 16 bp, Homo sapiens
tctcctcttttatctt

SEQ ID NO: 1535412 - DNA, 14 bp, Homo sapiens
tctcctgaatattt

SEQ ID NO: 1535413 - DNA, 15 bp, Homo sapiens
tctcctgacagaagg

SEQ ID NO: 1535414 - DNA, 16 bp, Homo sapiens
tctcctgacccagtcc

SEQ ID NO: 1535415 - DNA, 12 bp, Homo sapiens
tctcctgacctc

SEQ ID NO: 1535416 - DNA, 18 bp, Homo sapiens
tctcctgatagtcacctg

SEQ ID NO: 1535417 - DNA, 13 bp, Homo sapiens
tctcctgccccaa

SEQ ID NO: 1535418 - DNA, 13 bp, Homo sapiens
tctcctgccctct

SEQ ID NO: 1535419 - DNA, 19 bp, Homo sapiens
tctcctgccctctgctctg

SEQ ID NO: 1535420 - DNA, 15 bp, Homo sapiens
cccatgcacagtaca

SEQ ID NO: 1535421 - DNA, 18 bp, Homo sapiens
cccatgcactgtgaagga

SEQ ID NO: 1535422 - DNA, 22 bp, Homo sapiens
cccatgcactgtgaaggaccct

SEQ ID NO: 1535423 - DNA, 15 bp, Homo sapiens
cccatgcagctgctc

SEQ ID NO: 1535424 - DNA, 19 bp, Homo sapiens
cccatgcagctgctcccca

SEQ ID NO: 1535425 - DNA, 18 bp, Homo sapiens
cccatgccaccacccacc

SEQ ID NO: 1535426 - DNA, 13 bp, Homo sapiens
cccatgcccctcc

SEQ ID NO: 1535427 - DNA, 20 bp, Homo sapiens
cccatgcgtgccgcctgctc

SEQ ID NO: 1535428 - DNA, 13 bp, Homo sapiens
cccatgctctgcc

SEQ ID NO: 1535429 - DNA, 17 bp, Homo sapiens
cccatgctctgccccaa

SEQ ID NO: 1535430 - DNA, 16 bp, Homo sapiens
cccatggcccccaata

SEQ ID NO: 1535431 - DNA, 22 bp, Homo sapiens
cccatggcccccaataaaggca

SEQ ID NO: 1535432 - DNA, 15 bp, Homo sapiens
cccatggctgaagct

SEQ ID NO: 1535433 - DNA, 22 bp, Homo sapiens
cccatggctgaagctggagcag

SEQ ID NO: 1535434 - DNA, 23 bp, Homo sapiens
cccatgggctgtgtcctaaggcc

SEQ ID NO: 1535435 - DNA, 19 bp, Homo sapiens
cccatgggggtgagaccct

SEQ ID NO: 1535436 - DNA, 15 bp, Homo sapiens
cccatgtagccccct

SEQ ID NO: 1535437 - DNA, 12 bp, Homo sapiens
cccatgtcacct

SEQ ID NO: 1535438 - DNA, 16 bp, Homo sapiens
cccatgtctctcagaa

SEQ ID NO: 1535439 - DNA, 20 bp, Homo sapiens
cccatgtgagtccctgtgat

SEQ ID NO: 1535440 - DNA, 19 bp, Homo sapiens
cccatgtgcctgcaccagg

SEQ ID NO: 1535441 - DNA, 13 bp, Homo sapiens
cccatgtgcctgt

SEQ ID NO: 1535442 - DNA, 16 bp, Homo sapiens
cccatgtgcctgtcac

SEQ ID NO: 1535443 - DNA, 13 bp, Homo sapiens
cccatgtggctga

SEQ ID NO: 1535444 - DNA, 17 bp, Homo sapiens
cccatgtggctgaagac

SEQ ID NO: 1535445 - DNA, 21 bp, Homo sapiens
cccatgtgggcgcccaccctg

SEQ ID NO: 1535446 - DNA, 19 bp, Homo sapiens
cccatgttgtaatgctgca

SEQ ID NO: 1535447 - DNA, 20 bp, Homo sapiens
cccatgttgtaatgctgcac

SEQ ID NO: 1535448 - DNA, 18 bp, Homo sapiens
cccattagaccaagcttg

SEQ ID NO: 1535449 - DNA, 16 bp, Homo sapiens
cccattaggacaatca

SEQ ID NO: 1535450 - DNA, 18 bp, Homo sapiens
cccattcacagagccttt

SEQ ID NO: 1535451 - DNA, 18 bp, Homo sapiens
cccattcagagactgtcc

SEQ ID NO: 1535452 - DNA, 20 bp, Homo sapiens
cccattccaggcagcctctg

SEQ ID NO: 1535453 - DNA, 13 bp, Homo sapiens
cccattcctccct

SEQ ID NO: 1535454 - DNA, 14 bp, Homo sapiens
cccattcctccctc

SEQ ID NO: 1535455 - DNA, 12 bp, Homo sapiens
cccattcctgaa

SEQ ID NO: 1535456 - DNA, 18 bp, Homo sapiens
cccattcctgaagaacca

SEQ ID NO: 1535457 - DNA, 17 bp, Homo sapiens
cccattcgtctgtccca

SEQ ID NO: 1535458 - DNA, 12 bp, Homo sapiens
cccattctagat

SEQ ID NO: 1535459 - DNA, 19 bp, Homo sapiens
cccattctagatcctgcac

SEQ ID NO: 1535460 - DNA, 19 bp, Homo sapiens
cccattctataaattcaac

SEQ ID NO: 1535461 - DNA, 18 bp, Homo sapiens
cccattctctctcctgtc

SEQ ID NO: 1535462 - DNA, 21 bp, Homo sapiens
cccattctgcctccattctga

SEQ ID NO: 1535463 - DNA, 23 bp, Homo sapiens
cccattgctgccaaggtggaggg

SEQ ID NO: 1535464 - DNA, 19 bp, Homo sapiens
cccattgtggctcctatct

SEQ ID NO: 1535465 - DNA, 19 bp, Homo sapiens
cccattgttgtcaaggaag

SEQ ID NO: 1535466 - DNA, 21 bp, Homo sapiens
cccattgttgtcaaggaagaa

SEQ ID NO: 1535467 - DNA, 19 bp, Homo sapiens
cccatttcccatctgcacc

SEQ ID NO: 1535468 - DNA, 19 bp, Homo sapiens
cccatttccttggaggcca

SEQ ID NO: 1535469 - DNA, 17 bp, Homo sapiens
cccatttctatttattt

SEQ ID NO: 1535470 - DNA, 20 bp, Homo sapiens
cccatttctatttatttact

SEQ ID NO: 1535471 - DNA, 16 bp, Homo sapiens
cccatttgtgccagag

SEQ ID NO: 1535472 - DNA, 18 bp, Homo sapiens
cccatttgtgccagagga

SEQ ID NO: 1535473 - DNA, 12 bp, Homo sapiens
cccattttgcaa

SEQ ID NO: 1535474 - DNA, 17 bp, Homo sapiens
cccatttttgagccaag

SEQ ID NO: 1535475 - DNA, 13 bp, Homo sapiens
ccccaaaatccaa

SEQ ID NO: 1535476 - DNA, 16 bp, Homo sapiens
ccccaaaatccaaaac

SEQ ID NO: 1535477 - DNA, 14 bp, Homo sapiens
ccccaaaccctgct

SEQ ID NO: 1535478 - DNA, 19 bp, Homo sapiens
ccccaaagctttcctgccc

SEQ ID NO: 1535479 - DNA, 18 bp, Homo sapiens
ccccaaattgccttcagc

SEQ ID NO: 1535480 - DNA, 13 bp, Homo sapiens
ccccaacactgtc

SEQ ID NO: 1535481 - DNA, 19 bp, Homo sapiens
ccccaacactgtccttccc

SEQ ID NO: 1535482 - DNA, 17 bp, Homo sapiens
ccccaacactgtgccct

SEQ ID NO: 1535483 - DNA, 21 bp, Homo sapiens
ccccaaccccgcggtgctctg

SEQ ID NO: 1535484 - DNA, 13 bp, Homo sapiens
ccccaacctcagg

SEQ ID NO: 1535485 - DNA, 17 bp, Homo sapiens
ccccaacgtcccctccg

SEQ ID NO: 1535486 - DNA, 14 bp, Homo sapiens
ccccaactctcccc

SEQ ID NO: 1535487 - DNA, 17 bp, Homo sapiens
ccccaactctccccagt

SEQ ID NO: 1535488 - DNA, 20 bp, Homo sapiens
ccccaacttcaccaccccct

SEQ ID NO: 1535489 - DNA, 22 bp, Homo sapiens
ccccaagattgagctctctgcc

SEQ ID NO: 1535490 - DNA, 16 bp, Homo sapiens
ccccaagcagccagcc

SEQ ID NO: 1535491 - DNA, 13 bp, Homo sapiens
ccccaagctgggc

SEQ ID NO: 1535492 - DNA, 14 bp, Homo sapiens
ccccaagctgtttt

SEQ ID NO: 1535493 - DNA, 11 bp, Homo sapiens
ccccaaggcct

SEQ ID NO: 1535494 - DNA, 19 bp, Homo sapiens
ccccaaggcctctctctgc

SEQ ID NO: 1535495 - DNA, 23 bp, Homo sapiens
ccccaaggcctctctctgcctga

SEQ ID NO: 1535496 - DNA, 21 bp, Homo sapiens
ccccaagggcccagaccctgg

SEQ ID NO: 1535497 - DNA, 13 bp, Homo sapiens
ccccaaggttctc

SEQ ID NO: 1535498 - DNA, 18 bp, Homo sapiens
ccccaaggttctggttcc

SEQ ID NO: 1535499 - DNA, 20 bp, Homo sapiens
ccccaataaaggcagctgcc

SEQ ID NO: 1535500 - DNA, 18 bp, Homo sapiens
ccccaatcggactgccaa

SEQ ID NO: 1535501 - DNA, 20 bp, Homo sapiens
ccccaatcggactgccaaat

SEQ ID NO: 1535502 - DNA, 20 bp, Homo sapiens
ccccaatcgggtccagagac

SEQ ID NO: 1535503 - DNA, 23 bp, Homo sapiens
ccccaatgacacccatgccagag

SEQ ID NO: 1535504 - DNA, 13 bp, Homo sapiens
ccccaattctccc

SEQ ID NO: 1535505 - DNA, 22 bp, Homo sapiens
ccccacaagctgtccctgcagg

SEQ ID NO: 1535506 - DNA, 14 bp, Homo sapiens
ccccacaccaggcc

SEQ ID NO: 1535507 - DNA, 16 bp, Homo sapiens
ccccacacctcagttc

SEQ ID NO: 1535508 - DNA, 12 bp, Homo sapiens
ccccacacctgc

SEQ ID NO: 1535509 - DNA, 18 bp, Homo sapiens
ccccaggccggagcccag

SEQ ID NO: 1535510 - DNA, 15 bp, Homo sapiens
ccccaggcctccagc

SEQ ID NO: 1535511 - DNA, 18 bp, Homo sapiens
ccccaggcctccagcctc

SEQ ID NO: 1535512 - DNA, 18 bp, Homo sapiens
ccccaggctcgtggactg

SEQ ID NO: 1535513 - DNA, 22 bp, Homo sapiens
ccccagggacaaaacactgtgt

SEQ ID NO: 1535514 - DNA, 23 bp, Homo sapiens
ccccagggacaaaacactgtgtc

SEQ ID NO: 1535515 - DNA, 14 bp, Homo sapiens
ccccagggagctct

SEQ ID NO: 1535516 - DNA, 18 bp, Homo sapiens
ccccagggagctctgggg

SEQ ID NO: 1535517 - DNA, 21 bp, Homo sapiens
ccccagggcccctccctctgc

SEQ ID NO: 1535518 - DNA, 22 bp, Homo sapiens
ccccagggcccctccctctgcc

SEQ ID NO: 1535519 - DNA, 14 bp, Homo sapiens
ccccagggcctcca

SEQ ID NO: 1535520 - DNA, 16 bp, Homo sapiens
ccccaggggaaaatga

SEQ ID NO: 1535521 - DNA, 14 bp, Homo sapiens
ccccaggggcagca

SEQ ID NO: 1535522 - DNA, 19 bp, Homo sapiens
ccccaggggcagcaaggcc

SEQ ID NO: 1535523 - DNA, 20 bp, Homo sapiens
ccccaggggcagcaaggcct

SEQ ID NO: 1535524 - DNA, 14 bp, Homo sapiens
ccccaggggcagga

SEQ ID NO: 1535525 - DNA, 17 bp, Homo sapiens
ccccaggggtcccagcc

SEQ ID NO: 1535526 - DNA, 21 bp, Homo sapiens
ccccaggtggcctgcgtcttt

SEQ ID NO: 1535527 - DNA, 14 bp, Homo sapiens
ccccagtacctcca

SEQ ID NO: 1535528 - DNA, 18 bp, Homo sapiens
ccccagtatctcttcagt

SEQ ID NO: 1535529 - DNA, 13 bp, Homo sapiens
ccccagtgcctgc

SEQ ID NO: 1535530 - DNA, 14 bp, Homo sapiens
ccccagtgcctgcc

SEQ ID NO: 1535531 - DNA, 15 bp, Homo sapiens
ccccagtgcctgcca

SEQ ID NO: 1535532 - DNA, 16 bp, Homo sapiens
ccccagtgcctgccac

SEQ ID NO: 1535533 - DNA, 15 bp, Homo sapiens
ccccagttcctatga

SEQ ID NO: 1535534 - DNA, 21 bp, Homo sapiens
ccccagttcctgtggctccct

SEQ ID NO: 1535535 - DNA, 18 bp, Homo sapiens
ccccatcagttcccccag

SEQ ID NO: 1535536 - DNA, 12 bp, Homo sapiens
ccccatccagcc

SEQ ID NO: 1535537 - DNA, 13 bp, Homo sapiens
ccccatccagcca

SEQ ID NO: 1535538 - DNA, 13 bp, Homo sapiens
ccccatccagcct

SEQ ID NO: 1535539 - DNA, 14 bp, Homo sapiens
ccccatccagcctc

SEQ ID NO: 1535540 - DNA, 13 bp, Homo sapiens
ccccatcccccac

SEQ ID NO: 1535541 - DNA, 21 bp, Homo sapiens
tctctccctcccctgccattt

SEQ ID NO: 1535542 - DNA, 15 bp, Homo sapiens
tctctccctccctct

SEQ ID NO: 1535543 - DNA, 20 bp, Homo sapiens
tctctcccttcctctctcct

SEQ ID NO: 1535544 - DNA, 15 bp, Homo sapiens
tctctcctccctcct

SEQ ID NO: 1535545 - DNA, 13 bp, Homo sapiens
tctctcctggctc

SEQ ID NO: 1535546 - DNA, 13 bp, Homo sapiens
tctctcctgtcca

SEQ ID NO: 1535547 - DNA, 13 bp, Homo sapiens
tctctccttcctc

SEQ ID NO: 1535548 - DNA, 18 bp, Homo sapiens
tctctccttcctcttggc

SEQ ID NO: 1535549 - DNA, 13 bp, Homo sapiens
tctctccttggcc

SEQ ID NO: 1535550 - DNA, 17 bp, Homo sapiens
tctctccttggccacag

SEQ ID NO: 1535551 - DNA, 14 bp, Homo sapiens
tctctcctttgctg

SEQ ID NO: 1535552 - DNA, 15 bp, Homo sapiens
tctctcggctcccca

SEQ ID NO: 1535553 - DNA, 23 bp, Homo sapiens
tctctcggctccccatgtgtcct

SEQ ID NO: 1535554 - DNA, 15 bp, Homo sapiens
tctctcggttccacg

SEQ ID NO: 1535555 - DNA, 19 bp, Homo sapiens
tctctctactcctacctca

SEQ ID NO: 1535556 - DNA, 22 bp, Homo sapiens
tctctctactcctacctcagcc

SEQ ID NO: 1535557 - DNA, 23 bp, Homo sapiens
tctctctccaccccccacgtctg

SEQ ID NO: 1535558 - DNA, 15 bp, Homo sapiens
tctctctccagggtg

SEQ ID NO: 1535559 - DNA, 13 bp, Homo sapiens
tctctctctacaa

SEQ ID NO: 1535560 - DNA, 12 bp, Homo sapiens
tctctctctcct

SEQ ID NO: 1535561 - DNA, 15 bp, Homo sapiens
tctctctctctcaca

SEQ ID NO: 1535562 - DNA, 13 bp, Homo sapiens
tctctctctctcg

SEQ ID NO: 1535563 - DNA, 15 bp, Homo sapiens
tctctctctctcgct

SEQ ID NO: 1535564 - DNA, 12 bp, Homo sapiens
tctctctgcagc

SEQ ID NO: 1535565 - DNA, 14 bp, Homo sapiens
tctctctgcagctg

SEQ ID NO: 1535566 - DNA, 16 bp, Homo sapiens
tctctctgcagctgcc

SEQ ID NO: 1535567 - DNA, 12 bp, Homo sapiens
tctctctgccaa

SEQ ID NO: 1535568 - DNA, 12 bp, Homo sapiens
tctctctgcctg

SEQ ID NO: 1535569 - DNA, 15 bp, Homo sapiens
tctctctgcctgtga

SEQ ID NO: 1535570 - DNA, 11 bp, Homo sapiens
tctctctggag

SEQ ID NO: 1535571 - DNA, 14 bp, Homo sapiens
tctctctggcttct

SEQ ID NO: 1535572 - DNA, 15 bp, Homo sapiens
tctctctggcttctc

SEQ ID NO: 1535573 - DNA, 17 bp, Homo sapiens
tctctctggcttctctc

SEQ ID NO: 1535574 - DNA, 22 bp, Homo sapiens
tctctctggcttctctcttttc

SEQ ID NO: 1535575 - DNA, 14 bp, Homo sapiens
tctctctgggtcag

SEQ ID NO: 1535576 - DNA, 11 bp, Homo sapiens
tctctcttctg

SEQ ID NO: 1535577 - DNA, 14 bp, Homo sapiens
tctctcttctgcct

SEQ ID NO: 1535578 - DNA, 14 bp, Homo sapiens
tctctcttctgctc

SEQ ID NO: 1535579 - DNA, 12 bp, Homo sapiens
tctctcttgctt

SEQ ID NO: 1535580 - DNA, 21 bp, Homo sapiens
tctctcttgtcctcttctgct

SEQ ID NO: 1535581 - DNA, 18 bp, Homo sapiens
tctctctttaaccctccc

SEQ ID NO: 1535582 - DNA, 17 bp, Homo sapiens
tctctctttatacagct

SEQ ID NO: 1535583 - DNA, 13 bp, Homo sapiens
tctctcttttcct

SEQ ID NO: 1535584 - DNA, 14 bp, Homo sapiens
tctctgaacagaaa

SEQ ID NO: 1535585 - DNA, 23 bp, Homo sapiens
tctctgaagatctaaacttttga

SEQ ID NO: 1535586 - DNA, 11 bp, Homo sapiens
tctctgaaggg

SEQ ID NO: 1535587 - DNA, 12 bp, Homo sapiens
tctctgaggcta

SEQ ID NO: 1535588 - DNA, 18 bp, Homo sapiens
tctctgagtcaaatccag

SEQ ID NO: 1535589 - DNA, 20 bp, Homo sapiens
tctctgagtcaaatccagtg

SEQ ID NO: 1535590 - DNA, 23 bp, Homo sapiens
tctctgagtcaaatccagtggtg

SEQ ID NO: 1535591 - DNA, 14 bp, Homo sapiens
tctctgatttgcaa

SEQ ID NO: 1535592 - DNA, 20 bp, Homo sapiens
tctctgattttcaaagcttt

SEQ ID NO: 1535593 - DNA, 13 bp, Homo sapiens
tctctgcaacact

SEQ ID NO: 1535594 - DNA, 14 bp, Homo sapiens
tctctgcaatttgt

SEQ ID NO: 1535595 - DNA, 15 bp, Homo sapiens
tctctgcagacttcc

SEQ ID NO: 1535596 - DNA, 16 bp, Homo sapiens
tctctgcagccagccc

SEQ ID NO: 1535597 - DNA, 13 bp, Homo sapiens
tctctgcagctgc

SEQ ID NO: 1535598 - DNA, 14 bp, Homo sapiens
tctctgcagctgcc

SEQ ID NO: 1535599 - DNA, 19 bp, Homo sapiens
tctctgcatctactcccaa

SEQ ID NO: 1535600 - DNA, 22 bp, Homo sapiens
tctctgccaacatgaggacaga

SEQ ID NO: 1535601 - DNA, 23 bp, Homo sapiens
tctctgccaacatgaggacagaa

SEQ ID NO: 1535602 - DNA, 14 bp, Homo sapiens
tctctgccagtgac

SEQ ID NO: 1535603 - DNA, 15 bp, Homo sapiens
tctctgccagtgaca

SEQ ID NO: 1535604 - DNA, 16 bp, Homo sapiens
tctctgccatgtggca

SEQ ID NO: 1535605 - DNA, 21 bp, Homo sapiens
tctctgccatgtggcagaagt

SEQ ID NO: 1535606 - DNA, 14 bp, Homo sapiens
tctctgccgcctgc

SEQ ID NO: 1535607 - DNA, 17 bp, Homo sapiens
tctctgccgcctgcgtt

SEQ ID NO: 1535608 - DNA, 13 bp, Homo sapiens
tctctgcctgtca

SEQ ID NO: 1535609 - DNA, 15 bp, Homo sapiens
tctctgctccaccac

SEQ ID NO: 1535610 - DNA, 17 bp, Homo sapiens
tctctgctccaccacat

SEQ ID NO: 1535611 - DNA, 15 bp, Homo sapiens
tctctgctctagcca

SEQ ID NO: 1535612 - DNA, 16 bp, Homo sapiens
tctctgctctagccag

SEQ ID NO: 1535613 - DNA, 18 bp, Homo sapiens
tctctgctctagccagga

SEQ ID NO: 1535614 - DNA, 13 bp, Homo sapiens
tctctgctgaagg

SEQ ID NO: 1535615 - DNA, 10 bp, Homo sapiens
tctctgctgg

SEQ ID NO: 1535616 - DNA, 16 bp, Homo sapiens
tctctgctggcccagc

SEQ ID NO: 1535617 - DNA, 11 bp, Homo sapiens
tctctgctggg

SEQ ID NO: 1535618 - DNA, 17 bp, Homo sapiens
tctctggaaaagctggg

SEQ ID NO: 1535619 - DNA, 16 bp, Homo sapiens
tctctggaaggcccct

SEQ ID NO: 1535620 - DNA, 11 bp, Homo sapiens
tctctggagcc

SEQ ID NO: 1535621 - DNA, 14 bp, Homo sapiens
tctctggagcccct

SEQ ID NO: 1535622 - DNA, 20 bp, Homo sapiens
tctctggagcccctcctccc

SEQ ID NO: 1535623 - DNA, 22 bp, Homo sapiens
tctctggagtgagctctgtttc

SEQ ID NO: 1535624 - DNA, 15 bp, Homo sapiens
tctctggcccagaaa

SEQ ID NO: 1535625 - DNA, 17 bp, Homo sapiens
tctctggcctcccaccc

SEQ ID NO: 1535626 - DNA, 16 bp, Homo sapiens
tctgaaataaatgttc

SEQ ID NO: 1535627 - DNA, 23 bp, Homo sapiens
tctgaaatccataaactaagaga

SEQ ID NO: 1535628 - DNA, 18 bp, Homo sapiens
tctgaaatcgccgtgtta

SEQ ID NO: 1535629 - DNA, 14 bp, Homo sapiens
tctgaaatctcctt

SEQ ID NO: 1535630 - DNA, 16 bp, Homo sapiens
tctgaaatctgaagac

SEQ ID NO: 1535631 - DNA, 14 bp, Homo sapiens
tctgaaatgtgata

SEQ ID NO: 1535632 - DNA, 21 bp, Homo sapiens
tctgaaatgtgataagttctt

SEQ ID NO: 1535633 - DNA, 21 bp, Homo sapiens
tctgaactcaaactgaggaat

SEQ ID NO: 1535634 - DNA, 15 bp, Homo sapiens
tctgaactcaagctg

SEQ ID NO: 1535635 - DNA, 21 bp, Homo sapiens
tctgaactccatacagcctct

SEQ ID NO: 1535636 - DNA, 15 bp, Homo sapiens
tctgaactgttacaa

SEQ ID NO: 1535637 - DNA, 12 bp, Homo sapiens
tctgaacttgcc

SEQ ID NO: 1535638 - DNA, 17 bp, Homo sapiens
tctgaagagtatccttc

SEQ ID NO: 1535639 - DNA, 23 bp, Homo sapiens
tctgaagatcagaacattcagct

SEQ ID NO: 1535640 - DNA, 17 bp, Homo sapiens
tctgaagccctcccagg

SEQ ID NO: 1535641 - DNA, 22 bp, Homo sapiens
tctgaagcttgactcccaagtt

SEQ ID NO: 1535642 - DNA, 21 bp, Homo sapiens
tctgaagctttaccagctgaa

SEQ ID NO: 1535643 - DNA, 13 bp, Homo sapiens
tctgaaggactgg

SEQ ID NO: 1535644 - DNA, 20 bp, Homo sapiens
tctgaagtcacatcacagga

SEQ ID NO: 1535645 - DNA, 22 bp, Homo sapiens
tctgaagtcacatcacaggaca

SEQ ID NO: 1535646 - DNA, 15 bp, Homo sapiens
tctgaagtcactgca

SEQ ID NO: 1535647 - DNA, 15 bp, Homo sapiens
tctgaataatttctt

SEQ ID NO: 1535648 - DNA, 16 bp, Homo sapiens
tctgaataatttctta

SEQ ID NO: 1535649 - DNA, 17 bp, Homo sapiens
tctgaatattctagaac

SEQ ID NO: 1535650 - DNA, 14 bp, Homo sapiens
tctgaatattttgt

SEQ ID NO: 1535651 - DNA, 16 bp, Homo sapiens
tctgaatgggagccag

SEQ ID NO: 1535652 - DNA, 21 bp, Homo sapiens
tctgaattaattaatttggag

SEQ ID NO: 1535653 - DNA, 18 bp, Homo sapiens
tctgaattcataaaaata

SEQ ID NO: 1535654 - DNA, 19 bp, Homo sapiens
tctgaattcataaaaataa

SEQ ID NO: 1535655 - DNA, 17 bp, Homo sapiens
tctgaatttatctttga

SEQ ID NO: 1535656 - DNA, 15 bp, Homo sapiens
tctgaattttgcaat

SEQ ID NO: 1535657 - DNA, 13 bp, Homo sapiens
tctgacaagggct

SEQ ID NO: 1535658 - DNA, 16 bp, Homo sapiens
tctgacaagggctgac

SEQ ID NO: 1535659 - DNA, 20 bp, Homo sapiens
tctgacaagggctgacctgc

SEQ ID NO: 1535660 - DNA, 13 bp, Homo sapiens
tctgacacaaaaa

SEQ ID NO: 1535661 - DNA, 18 bp, Homo sapiens
tctgacagtccacagggg

SEQ ID NO: 1535662 - DNA, 20 bp, Homo sapiens
tctgacagtttttctgtttt

SEQ ID NO: 1535663 - DNA, 12 bp, Homo sapiens
tctgacatccct

SEQ ID NO: 1535664 - DNA, 13 bp, Homo sapiens
tctgacatccctt

SEQ ID NO: 1535665 - DNA, 20 bp, Homo sapiens
tctgacatcccttcctggaa

SEQ ID NO: 1535666 - DNA, 20 bp, Homo sapiens
tctgacatgtaagaaaatgt

SEQ ID NO: 1535667 - DNA, 14 bp, Homo sapiens
cctcctgcccagga

SEQ ID NO: 1535668 - DNA, 21 bp, Homo sapiens
cctcctgcccaggagagccag

SEQ ID NO: 1535669 - DNA, 11 bp, Homo sapiens
cctcctgctcc

SEQ ID NO: 1535670 - DNA, 14 bp, Homo sapiens
cctcctgctcctca

SEQ ID NO: 1535671 - DNA, 17 bp, Homo sapiens
cctcctgctcctcaccc

SEQ ID NO: 1535672 - DNA, 14 bp, Homo sapiens
cctcctgctcctcc

SEQ ID NO: 1535673 - DNA, 12 bp, Homo sapiens
cctcctgctctg

SEQ ID NO: 1535674 - DNA, 11 bp, Homo sapiens
cctcctgctgt

SEQ ID NO: 1535675 - DNA, 14 bp, Homo sapiens
cctcctgctgtgct

SEQ ID NO: 1535676 - DNA, 23 bp, Homo sapiens
cctcctggagctctgtgggtctc

SEQ ID NO: 1535677 - DNA, 18 bp, Homo sapiens
cctcctggctcaggccca

SEQ ID NO: 1535678 - DNA, 21 bp, Homo sapiens
cctcctggctgtgacacctgg

SEQ ID NO: 1535679 - DNA, 20 bp, Homo sapiens
tgctagcaaatggcagaacc

SEQ ID NO: 1535680 - DNA, 15 bp, Homo sapiens
tgctagctgtagaaa

SEQ ID NO: 1535681 - DNA, 16 bp, Homo sapiens
tgctagctgtagaaat

SEQ ID NO: 1535682 - DNA, 17 bp, Homo sapiens
tgctaggagccccagct

SEQ ID NO: 1535683 - DNA, 21 bp, Homo sapiens
tgctaggagccccagcttcct

SEQ ID NO: 1535684 - DNA, 19 bp, Homo sapiens
tgctaggcgctggggagac

SEQ ID NO: 1535685 - DNA, 15 bp, Homo sapiens
tgctaggggatgagg

SEQ ID NO: 1535686 - DNA, 19 bp, Homo sapiens
tgctaggggatgaggggct

SEQ ID NO: 1535687 - DNA, 21 bp, Homo sapiens
tgctagggttaggaggtcctt

SEQ ID NO: 1535688 - DNA, 19 bp, Homo sapiens
tgctagtagtgttctagat

SEQ ID NO: 1535689 - DNA, 17 bp, Homo sapiens
tgctagtcactggcagc

SEQ ID NO: 1535690 - DNA, 21 bp, Homo sapiens
tgctagtcactggcagcctgc

SEQ ID NO: 1535691 - DNA, 22 bp, Homo sapiens
tgctagtctcagataggtgctt

SEQ ID NO: 1535692 - DNA, 18 bp, Homo sapiens
tgctagtgaaatggctgg

SEQ ID NO: 1535693 - DNA, 22 bp, Homo sapiens
tgctagtgaaatggctggggcc

SEQ ID NO: 1535694 - DNA, 18 bp, Homo sapiens
tgctagttctgctgccct

SEQ ID NO: 1535695 - DNA, 18 bp, Homo sapiens
tgctagtttattggaagt

SEQ ID NO: 1535696 - DNA, 17 bp, Homo sapiens
tgctataaatgccagag

SEQ ID NO: 1535697 - DNA, 23 bp, Homo sapiens
tgctataaatgccagagccaacc

SEQ ID NO: 1535698 - DNA, 22 bp, Homo sapiens
tgctataatcattagttttaga

SEQ ID NO: 1535699 - DNA, 18 bp, Homo sapiens
tgctataatctgttttta

SEQ ID NO: 1535700 - DNA, 15 bp, Homo sapiens
tgctatacacacaca

SEQ ID NO: 1535701 - DNA, 16 bp, Homo sapiens
tgctatacttatcaca

SEQ ID NO: 1535702 - DNA, 22 bp, Homo sapiens
tgctatcgcaccactgtgtatt

SEQ ID NO: 1535703 - DNA, 19 bp, Homo sapiens
tgctatcgccctcctttcc

SEQ ID NO: 1535704 - DNA, 20 bp, Homo sapiens
tgctatctggaggccttcca

SEQ ID NO: 1535705 - DNA, 12 bp, Homo sapiens
tgctatgaaaat

SEQ ID NO: 1535706 - DNA, 17 bp, Homo sapiens
tgctatgaaaatgagca

SEQ ID NO: 1535707 - DNA, 20 bp, Homo sapiens
tgctatgaaaatgagcatca

SEQ ID NO: 1535708 - DNA, 22 bp, Homo sapiens
tgctatgaaaatgagcatcaga

SEQ ID NO: 1535709 - DNA, 19 bp, Homo sapiens
tgctatgagctggggatgt

SEQ ID NO: 1535710 - DNA, 20 bp, Homo sapiens
tgctatgagctggggatgtc

SEQ ID NO: 1535711 - DNA, 16 bp, Homo sapiens
tgctatggatggcttc

SEQ ID NO: 1535712 - DNA, 18 bp, Homo sapiens
tgctatgttactattttc

SEQ ID NO: 1535713 - DNA, 14 bp, Homo sapiens
tgctattctgtgtt

SEQ ID NO: 1535714 - DNA, 18 bp, Homo sapiens
tgctattgttgtgggctt

SEQ ID NO: 1535715 - DNA, 24 bp, Homo sapiens
tgctatttgagcatgcacagctgc

SEQ ID NO: 1535716 - DNA, 15 bp, Homo sapiens
tgctatttgtacaaa

SEQ ID NO: 1535717 - DNA, 18 bp, Homo sapiens
tgctatttgtacaaataa

SEQ ID NO: 1535718 - DNA, 20 bp, Homo sapiens
tgctatttgtacaaataaac

SEQ ID NO: 1535719 - DNA, 19 bp, Homo sapiens
tgctattttatttgtattc

SEQ ID NO: 1535720 - DNA, 19 bp, Homo sapiens
tgctcaacagacaattaga

SEQ ID NO: 1535721 - DNA, 23 bp, Homo sapiens
tgctcaacagcatatgggtggga

SEQ ID NO: 1535722 - DNA, 14 bp, Homo sapiens
tgctcaaccactgt

SEQ ID NO: 1535723 - DNA, 22 bp, Homo sapiens
tgctcaagaagacatggagact

SEQ ID NO: 1535724 - DNA, 19 bp, Homo sapiens
tgctcaagccgcaagctct

SEQ ID NO: 1535725 - DNA, 22 bp, Homo sapiens
tgctcaagccgcaagctctcag

SEQ ID NO: 1535726 - DNA, 15 bp, Homo sapiens
tgctcaatagcttga

SEQ ID NO: 1535727 - DNA, 15 bp, Homo sapiens
tgctcacagttatta

SEQ ID NO: 1535728 - DNA, 14 bp, Homo sapiens
tgctcacatgtctt

SEQ ID NO: 1535729 - DNA, 15 bp, Homo sapiens
tgctcacatgtcttt

SEQ ID NO: 1535730 - DNA, 19 bp, Homo sapiens
tgctcaccgcccatcaggg

SEQ ID NO: 1535731 - DNA, 21 bp, Homo sapiens
tgctcacgtctctgccgcctg

SEQ ID NO: 1535732 - DNA, 17 bp, Homo sapiens
tgctcagaacttgctgc

SEQ ID NO: 1535733 - DNA, 20 bp, Homo sapiens
tgctcagaacttgctgctgt

SEQ ID NO: 1535734 - DNA, 21 bp, Homo sapiens
tgctcagaacttgctgctgtc

SEQ ID NO: 1535735 - DNA, 14 bp, Homo sapiens
tgctcagaagggct

SEQ ID NO: 1535736 - DNA, 20 bp, Homo sapiens
tgctcagcaaggggctctgc

SEQ ID NO: 1535737 - DNA, 20 bp, Homo sapiens
tgctcagcagccagtctcag

SEQ ID NO: 1535738 - DNA, 17 bp, Homo sapiens
tgctcagccaaatttcc

SEQ ID NO: 1535739 - DNA, 13 bp, Homo sapiens
tgctcagcccgct

SEQ ID NO: 1535740 - DNA, 21 bp, Homo sapiens
tgctcagcccgcttggccacc

SEQ ID NO: 1535741 - DNA, 13 bp, Homo sapiens
tgctcagccctgc

SEQ ID NO: 1535742 - DNA, 18 bp, Homo sapiens
tgctcagcctcatcctga

SEQ ID NO: 1535743 - DNA, 22 bp, Homo sapiens
tgctcagcgcttaaaaaaacaa

SEQ ID NO: 1535744 - DNA, 21 bp, Homo sapiens
tgctcagctctggtccaggcc

SEQ ID NO: 1535745 - DNA, 19 bp, Homo sapiens
tgctcaggcttgaaatgca

SEQ ID NO: 1535746 - DNA, 16 bp, Homo sapiens
tgctcagggtcaattt

SEQ ID NO: 1535747 - DNA, 17 bp, Homo sapiens
tgctcagggtcactgaa

SEQ ID NO: 1535748 - DNA, 13 bp, Homo sapiens
tgctcagtggatc

SEQ ID NO: 1535749 - DNA, 17 bp, Homo sapiens
tgctcagtgtccagctt

SEQ ID NO: 1535750 - DNA, 18 bp, Homo sapiens
tgctcagtgtccagcttc

SEQ ID NO: 1535751 - DNA, 19 bp, Homo sapiens
tgctcagtgtccagcttcc

SEQ ID NO: 1535752 - DNA, 23 bp, Homo sapiens
tgctcagtgtccagcttccaaag

SEQ ID NO: 1535753 - DNA, 15 bp, Homo sapiens
tgctcagtgtttcat

SEQ ID NO: 1535754 - DNA, 13 bp, Homo sapiens
tgctcataaattg

SEQ ID NO: 1535755 - DNA, 13 bp, Homo sapiens
tgctcataggacc

SEQ ID NO: 1535756 - DNA, 15 bp, Homo sapiens
tgctcataggacctg

SEQ ID NO: 1535757 - DNA, 16 bp, Homo sapiens
tgctcataggacctgc

SEQ ID NO: 1535758 - DNA, 21 bp, Homo sapiens
tgctcatattgtgattctgcc

SEQ ID NO: 1535759 - DNA, 17 bp, Homo sapiens
tgctcatccactctact

SEQ ID NO: 1535760 - DNA, 18 bp, Homo sapiens
tgctcatcggagactgcc

SEQ ID NO: 1535761 - DNA, 14 bp, Homo sapiens
tgctcatctgctgg

SEQ ID NO: 1535762 - DNA, 17 bp, Homo sapiens
tgctcatctgtacatac

SEQ ID NO: 1535763 - DNA, 22 bp, Homo sapiens
tgctcattacagttctttcctc

SEQ ID NO: 1535764 - DNA, 15 bp, Homo sapiens
tgctcattttctggt

SEQ ID NO: 1535765 - DNA, 15 bp, Homo sapiens
tgctccaagattcta

SEQ ID NO: 1535766 - DNA, 16 bp, Homo sapiens
tgctccaccagcagca

SEQ ID NO: 1535767 - DNA, 22 bp, Homo sapiens
tgctccagaagatgccagcttc

SEQ ID NO: 1535768 - DNA, 12 bp, Homo sapiens
tgctccagacct

SEQ ID NO: 1535769 - DNA, 22 bp, Homo sapiens
tgctccagataactctctttcc

SEQ ID NO: 1535770 - DNA, 23 bp, Homo sapiens
tgctccagataactctctttcct

SEQ ID NO: 1535771 - DNA, 23 bp, Homo sapiens
tgctccagcaactgcccttccag

SEQ ID NO: 1535772 - DNA, 19 bp, Homo sapiens
tgctccagcagcacacctc

SEQ ID NO: 1535773 - DNA, 12 bp, Homo sapiens
tgctccagggtc

SEQ ID NO: 1535774 - DNA, 17 bp, Homo sapiens
tgctccagggtcaggcg

SEQ ID NO: 1535775 - DNA, 20 bp, Homo sapiens
tgctccatgactggctgtct

SEQ ID NO: 1535776 - DNA, 19 bp, Homo sapiens
tgctccatggatgcatgcc

SEQ ID NO: 1535777 - DNA, 19 bp, Homo sapiens
tgctccattttttcttccc

SEQ ID NO: 1535778 - DNA, 18 bp, Homo sapiens
tgctcccaccaccagtga

SEQ ID NO: 1535779 - DNA, 17 bp, Homo sapiens
tgctcccagatgccttc

SEQ ID NO: 1535780 - DNA, 21 bp, Homo sapiens
tgctcccagatgccttctaga

SEQ ID NO: 1535781 - DNA, 23 bp, Homo sapiens
cctctcatcagtgtcctcttgct

SEQ ID NO: 1535782 - DNA, 17 bp, Homo sapiens
cctctccaaccactgtg

SEQ ID NO: 1535783 - DNA, 21 bp, Homo sapiens
cctctccaaccactgtgccac

SEQ ID NO: 1535784 - DNA, 22 bp, Homo sapiens
cctctccaaccactgtgccact

SEQ ID NO: 1535785 - DNA, 21 bp, Homo sapiens
cctctccaagggcttctgcac

SEQ ID NO: 1535786 - DNA, 12 bp, Homo sapiens
cctctccactgc

SEQ ID NO: 1535787 - DNA, 16 bp, Homo sapiens
cctctccactgctgga

SEQ ID NO: 1535788 - DNA, 14 bp, Homo sapiens
cctctccaggccag

SEQ ID NO: 1535789 - DNA, 19 bp, Homo sapiens
cctctccagtttgcacctg

SEQ ID NO: 1535790 - DNA, 20 bp, Homo sapiens
cctctccagtttgcacctgt

SEQ ID NO: 1535791 - DNA, 13 bp, Homo sapiens
cctctccatttgc

SEQ ID NO: 1535792 - DNA, 22 bp, Homo sapiens
cctctccattttagcccagtgt

SEQ ID NO: 1535793 - DNA, 21 bp, Homo sapiens
cctctcccacccggccacagc

SEQ ID NO: 1535794 - DNA, 22 bp, Homo sapiens
cctctcccacccggccacagct

SEQ ID NO: 1535795 - DNA, 18 bp, Homo sapiens
tgctccctcccctgccct

SEQ ID NO: 1535796 - DNA, 19 bp, Homo sapiens
tgctccctcccctgccctg

SEQ ID NO: 1535797 - DNA, 20 bp, Homo sapiens
tgctccctcccctgccctgg

SEQ ID NO: 1535798 - DNA, 22 bp, Homo sapiens
tgctccctgtagggtccaacca

SEQ ID NO: 1535799 - DNA, 12 bp, Homo sapiens
tgctccctgtct

SEQ ID NO: 1535800 - DNA, 17 bp, Homo sapiens
tgctccctgtctgtgtc

SEQ ID NO: 1535801 - DNA, 21 bp, Homo sapiens
tgctccctgtctgtgtcccag

SEQ ID NO: 1535802 - DNA, 20 bp, Homo sapiens
tgctccgaggacccaggaaa

SEQ ID NO: 1535803 - DNA, 14 bp, Homo sapiens
tgctccgctcccac

SEQ ID NO: 1535804 - DNA, 23 bp, Homo sapiens
tgctccgctcccaccgcccccac

SEQ ID NO: 1535805 - DNA, 13 bp, Homo sapiens
tgctccgctgcct

SEQ ID NO: 1535806 - DNA, 14 bp, Homo sapiens
tgctccgctgcctg

SEQ ID NO: 1535807 - DNA, 15 bp, Homo sapiens
tgctccgctgcctgg

SEQ ID NO: 1535808 - DNA, 23 bp, Homo sapiens
tgctccggagatgaatatgagct

SEQ ID NO: 1535809 - DNA, 19 bp, Homo sapiens
tgctccgtgcctccaccac

SEQ ID NO: 1535810 - DNA, 22 bp, Homo sapiens
tgctcctcactggaggagcagc

SEQ ID NO: 1535811 - DNA, 23 bp, Homo sapiens
tgctcctcactggaggagcagct

SEQ ID NO: 1535812 - DNA, 11 bp, Homo sapiens
tgctcctccag

SEQ ID NO: 1535813 - DNA, 12 bp, Homo sapiens
tgctcctccagg

SEQ ID NO: 1535814 - DNA, 11 bp, Homo sapiens
tgctcctccct

SEQ ID NO: 1535815 - DNA, 13 bp, Homo sapiens
tgctcctccctgc

SEQ ID NO: 1535816 - DNA, 14 bp, Homo sapiens
tgctcctccctgcc

SEQ ID NO: 1535817 - DNA, 19 bp, Homo sapiens
tgctcctccctgcccccca

SEQ ID NO: 1535818 - DNA, 21 bp, Homo sapiens
tgctcctccctgccccccaag

SEQ ID NO: 1535819 - DNA, 19 bp, Homo sapiens
tgctcctccctggctgccc

SEQ ID NO: 1535820 - DNA, 13 bp, Homo sapiens
tgctcctctcttt

SEQ ID NO: 1535821 - DNA, 13 bp, Homo sapiens
tgctcctgcccag

SEQ ID NO: 1535822 - DNA, 11 bp, Homo sapiens
tgctcctgctt

SEQ ID NO: 1535823 - DNA, 16 bp, Homo sapiens
tgctcctgcttttctg

SEQ ID NO: 1535824 - DNA, 20 bp, Homo sapiens
tgctcctgcttttctgtcct

SEQ ID NO: 1535825 - DNA, 21 bp, Homo sapiens
tgctcctgcttttctgtcctg

SEQ ID NO: 1535826 - DNA, 17 bp, Homo sapiens
tgctccttcactgttcc

SEQ ID NO: 1535827 - DNA, 23 bp, Homo sapiens
tgctccttgagaggagaaatgca

SEQ ID NO: 1535828 - DNA, 14 bp, Homo sapiens
tgctccttttctct

SEQ ID NO: 1535829 - DNA, 19 bp, Homo sapiens
tgctcgcccagacaccatg

SEQ ID NO: 1535830 - DNA, 20 bp, Homo sapiens
tgctctaaaatatttatgaa

SEQ ID NO: 1535831 - DNA, 23 bp, Homo sapiens
tgctctaaaatatttatgaagaa

SEQ ID NO: 1535832 - DNA, 11 bp, Homo sapiens
tgctctaacac

SEQ ID NO: 1535833 - DNA, 16 bp, Homo sapiens
tgctctaacagccctc

SEQ ID NO: 1535834 - DNA, 16 bp, Homo sapiens
tgctctaactggacat

SEQ ID NO: 1535835 - DNA, 18 bp, Homo sapiens
tgctctagattcataaat

SEQ ID NO: 1535836 - DNA, 15 bp, Homo sapiens
tgctctagccaggag

SEQ ID NO: 1535837 - DNA, 16 bp, Homo sapiens
tgctctagccaggagt

SEQ ID NO: 1535838 - DNA, 23 bp, Homo sapiens
tgctctagccaggagtctgtgct

SEQ ID NO: 1535839 - DNA, 14 bp, Homo sapiens
tgctctagggaatc

SEQ ID NO: 1535840 - DNA, 19 bp, Homo sapiens
tgctctagggaatctggat

SEQ ID NO: 1535841 - DNA, 14 bp, Homo sapiens
tgctctagtgggac

SEQ ID NO: 1535842 - DNA, 16 bp, Homo sapiens
tgctctagtgggacag

SEQ ID NO: 1535843 - DNA, 17 bp, Homo sapiens
tgctctatgtctgcctt

SEQ ID NO: 1535844 - DNA, 14 bp, Homo sapiens
tgctctattaagat

SEQ ID NO: 1535845 - DNA, 20 bp, Homo sapiens
tgctctattaagattggaaa

SEQ ID NO: 1535846 - DNA, 14 bp, Homo sapiens
tgctctcactgttt

SEQ ID NO: 1535847 - DNA, 22 bp, Homo sapiens
tgctctcactgtttgtttttat

SEQ ID NO: 1535848 - DNA, 13 bp, Homo sapiens
tgctctcagcctc

SEQ ID NO: 1535849 - DNA, 14 bp, Homo sapiens
tgctctcagcctcc

SEQ ID NO: 1535850 - DNA, 18 bp, Homo sapiens
tgctctcagcctcccaca

SEQ ID NO: 1535851 - DNA, 11 bp, Homo sapiens
tgctctcctca

SEQ ID NO: 1535852 - DNA, 16 bp, Homo sapiens
tgctctcctcatctcc

SEQ ID NO: 1535853 - DNA, 13 bp, Homo sapiens
tgctctcctccac

SEQ ID NO: 1535854 - DNA, 17 bp, Homo sapiens
tgctctccttcctggag

SEQ ID NO: 1535855 - DNA, 13 bp, Homo sapiens
tgctctctgcagc

SEQ ID NO: 1535856 - DNA, 15 bp, Homo sapiens
tgctctctgcagcca

SEQ ID NO: 1535857 - DNA, 21 bp, Homo sapiens
tgctctctgcagccagcccag

SEQ ID NO: 1535858 - DNA, 12 bp, Homo sapiens
tgctctctgcca

SEQ ID NO: 1535859 - DNA, 14 bp, Homo sapiens
tgctctctgtgacc

SEQ ID NO: 1535860 - DNA, 15 bp, Homo sapiens
tgctctcttcaggag

SEQ ID NO: 1535861 - DNA, 17 bp, Homo sapiens
tgctctgaaatctcctt

SEQ ID NO: 1535862 - DNA, 20 bp, Homo sapiens
tgctctgaatattttgtaat

SEQ ID NO: 1535863 - DNA, 18 bp, Homo sapiens
tgctctgcatgttacata

SEQ ID NO: 1535864 - DNA, 15 bp, Homo sapiens
tgctctgcctggagt

SEQ ID NO: 1535865 - DNA, 17 bp, Homo sapiens
tgctctgcctggagtgt

SEQ ID NO: 1535866 - DNA, 16 bp, Homo sapiens
tgctctgcgtggcgca

SEQ ID NO: 1535867 - DNA, 21 bp, Homo sapiens
tgctctgcttgacaacatctg

SEQ ID NO: 1535868 - DNA, 22 bp, Homo sapiens
tgctctggaataaagttgcaga

SEQ ID NO: 1535869 - DNA, 13 bp, Homo sapiens
tgctctggagcag

SEQ ID NO: 1535870 - DNA, 16 bp, Homo sapiens
tgctctggagcagcca

SEQ ID NO: 1535871 - DNA, 18 bp, Homo sapiens
tgctctggagcagccaag

SEQ ID NO: 1535872 - DNA, 21 bp, Homo sapiens
tgctctggagcagccaaggcc

SEQ ID NO: 1535873 - DNA, 18 bp, Homo sapiens
tgctctggaggaagttct

SEQ ID NO: 1535874 - DNA, 15 bp, Homo sapiens
tgctctggcaccatc

SEQ ID NO: 1535875 - DNA, 21 bp, Homo sapiens
tgctctggcaccatcagcctg

SEQ ID NO: 1535876 - DNA, 12 bp, Homo sapiens
tgctctgtactg

SEQ ID NO: 1535877 - DNA, 11 bp, Homo sapiens
tgctctgtgtc

SEQ ID NO: 1535878 - DNA, 17 bp, Homo sapiens
tgctcttcatcccattc

SEQ ID NO: 1535879 - DNA, 15 bp, Homo sapiens
tgctcttccaaagct

SEQ ID NO: 1535880 - DNA, 13 bp, Homo sapiens
tgctcttcccagc

SEQ ID NO: 1535881 - DNA, 23 bp, Homo sapiens
tgctcttctgtggaccactgcat

SEQ ID NO: 1535882 - DNA, 17 bp, Homo sapiens
tgctcttggctgacccc

SEQ ID NO: 1535883 - DNA, 21 bp, Homo sapiens
tgctcttggctgacccctctg

SEQ ID NO: 1535884 - DNA, 12 bp, Homo sapiens
tgctctttccca

SEQ ID NO: 1535885 - DNA, 13 bp, Homo sapiens
tgctctttcccag

SEQ ID NO: 1535886 - DNA, 15 bp, Homo sapiens
tgctctttcccagga

SEQ ID NO: 1535887 - DNA, 14 bp, Homo sapiens
tgctctttctctgc

SEQ ID NO: 1535888 - DNA, 19 bp, Homo sapiens
tgctctttgtggcagtggc

SEQ ID NO: 1535889 - DNA, 20 bp, Homo sapiens
tgctcttttcctggtgctct

SEQ ID NO: 1535890 - DNA, 23 bp, Homo sapiens
tgctcttttctcctcactgtatc

SEQ ID NO: 1535891 - DNA, 12 bp, Homo sapiens
tgctcttttgtg

SEQ ID NO: 1535892 - DNA, 19 bp, Homo sapiens
tgctgaaaactagctcgtg

SEQ ID NO: 1535893 - DNA, 22 bp, Homo sapiens
tgctgaaaattgcctttctgtg

SEQ ID NO: 1535894 - DNA, 15 bp, Homo sapiens
tgctgaacacagtgt

SEQ ID NO: 1535895 - DNA, 22 bp, Homo sapiens
tgctgaacacagtgtctgttca

SEQ ID NO: 1535896 - DNA, 23 bp, Homo sapiens
cctctttcaagcagtcgtgcctg

SEQ ID NO: 1535897 - DNA, 15 bp, Homo sapiens
cctctttccctagga

SEQ ID NO: 1535898 - DNA, 14 bp, Homo sapiens
cctctttccctgcg

SEQ ID NO: 1535899 - DNA, 15 bp, Homo sapiens
cctctttccctgcga

SEQ ID NO: 1535900 - DNA, 14 bp, Homo sapiens
cctctttctcagtt

SEQ ID NO: 1535901 - DNA, 11 bp, Homo sapiens
cctctttctgc

SEQ ID NO: 1535902 - DNA, 12 bp, Homo sapiens
cctctttctgct

SEQ ID NO: 1535903 - DNA, 23 bp, Homo sapiens
cctctttcttgtttgtcagcatc

SEQ ID NO: 1535904 - DNA, 18 bp, Homo sapiens
cctctttggctcccctgt

SEQ ID NO: 1535905 - DNA, 20 bp, Homo sapiens
cctctttggctcccctgtac

SEQ ID NO: 1535906 - DNA, 13 bp, Homo sapiens
cctctttgggcag

SEQ ID NO: 1535907 - DNA, 23 bp, Homo sapiens
cctgaaaaactgatcaaaaataa

SEQ ID NO: 1535908 - DNA, 13 bp, Homo sapiens
cctgaaaacccag

SEQ ID NO: 1535909 - DNA, 22 bp, Homo sapiens
cctgaaaagtaacttggctttc

SEQ ID NO: 1535910 - DNA, 23 bp, Homo sapiens
cctgaaaatgtttttctgccagg

SEQ ID NO: 1535911 - DNA, 13 bp, Homo sapiens
cctgaaaattgta

SEQ ID NO: 1535912 - DNA, 20 bp, Homo sapiens
cctgaaacctagtactgccc

SEQ ID NO: 1535913 - DNA, 19 bp, Homo sapiens
cctgaaaggaacactggct

SEQ ID NO: 1535914 - DNA, 15 bp, Homo sapiens
cctgaaataatatat

SEQ ID NO: 1535915 - DNA, 13 bp, Homo sapiens
cctgaaattccaa

SEQ ID NO: 1535916 - DNA, 20 bp, Homo sapiens
tgctgactatttgaccccca

SEQ ID NO: 1535917 - DNA, 13 bp, Homo sapiens
tgctgactgaggc

SEQ ID NO: 1535918 - DNA, 14 bp, Homo sapiens
tgctgactgaggcc

SEQ ID NO: 1535919 - DNA, 17 bp, Homo sapiens
tgctgactgaggcctgc

SEQ ID NO: 1535920 - DNA, 19 bp, Homo sapiens
tgctgactgtactcctccc

SEQ ID NO: 1535921 - DNA, 21 bp, Homo sapiens
tgctgactgtactcctcccag

SEQ ID NO: 1535922 - DNA, 21 bp, Homo sapiens
tgctgagagacccaaggagga

SEQ ID NO: 1535923 - DNA, 22 bp, Homo sapiens
tgctgagagggctcgaggggtg

SEQ ID NO: 1535924 - DNA, 19 bp, Homo sapiens
tgctgaggatacagctctt

SEQ ID NO: 1535925 - DNA, 12 bp, Homo sapiens
tgctgaggcacc

SEQ ID NO: 1535926 - DNA, 15 bp, Homo sapiens
tgctgaggccaccca

SEQ ID NO: 1535927 - DNA, 17 bp, Homo sapiens
tgctgagggaccagcca

SEQ ID NO: 1535928 - DNA, 21 bp, Homo sapiens
tgctgagggaccgagcccagc

SEQ ID NO: 1535929 - DNA, 23 bp, Homo sapiens
tgctgagggaccgagcccagcag

SEQ ID NO: 1535930 - DNA, 16 bp, Homo sapiens
tgctgagtaaacataa

SEQ ID NO: 1535931 - DNA, 17 bp, Homo sapiens
tgctgagtcatctgtta

SEQ ID NO: 1535932 - DNA, 19 bp, Homo sapiens
tgctgagtcatctgttagg

SEQ ID NO: 1535933 - DNA, 17 bp, Homo sapiens
tgctgagttgttctaac

SEQ ID NO: 1535934 - DNA, 17 bp, Homo sapiens
tgctgatatcaacagct

SEQ ID NO: 1535935 - DNA, 22 bp, Homo sapiens
tgctgatatcaacagcttccct

SEQ ID NO: 1535936 - DNA, 21 bp, Homo sapiens
tgctgatcatcgccagaggtg

SEQ ID NO: 1535937 - DNA, 18 bp, Homo sapiens
tgctgatcccggccggcc

SEQ ID NO: 1535938 - DNA, 22 bp, Homo sapiens
tgctgatccctgctctctgagt

SEQ ID NO: 1535939 - DNA, 16 bp, Homo sapiens
tgctgatcctaagaat

SEQ ID NO: 1535940 - DNA, 18 bp, Homo sapiens
tgctgatcctgctgacct

SEQ ID NO: 1535941 - DNA, 20 bp, Homo sapiens
tgctgatcctgctgacctca

SEQ ID NO: 1535942 - DNA, 15 bp, Homo sapiens
tgctgatggagcctt

SEQ ID NO: 1535943 - DNA, 17 bp, Homo sapiens
tgctgatggcccctcca

SEQ ID NO: 1535944 - DNA, 20 bp, Homo sapiens
tgctgatggcccctccagca

SEQ ID NO: 1535945 - DNA, 21 bp, Homo sapiens
tgctgatggcccctccagcac

SEQ ID NO: 1535946 - DNA, 17 bp, Homo sapiens
tgctgatgtaggagctg

SEQ ID NO: 1535947 - DNA, 22 bp, Homo sapiens
tgctgatgtcaaagtgtaacag

SEQ ID NO: 1535948 - DNA, 16 bp, Homo sapiens
tgctgattatttatga

SEQ ID NO: 1535949 - DNA, 17 bp, Homo sapiens
tgctgattatttatgac

SEQ ID NO: 1535950 - DNA, 16 bp, Homo sapiens
tgctgattcttgtaaa

SEQ ID NO: 1535951 - DNA, 17 bp, Homo sapiens
tgctgattcttgtaaat

SEQ ID NO: 1535952 - DNA, 16 bp, Homo sapiens
tgctgatttcccctct

SEQ ID NO: 1535953 - DNA, 18 bp, Homo sapiens
tgctgatttggtgaccaa

SEQ ID NO: 1535954 - DNA, 17 bp, Homo sapiens
tgctgattttattcttg

SEQ ID NO: 1535955 - DNA, 13 bp, Homo sapiens
tgctgcaaacctg

SEQ ID NO: 1535956 - DNA, 14 bp, Homo sapiens
tgctgcaaacctga

SEQ ID NO: 1535957 - DNA, 22 bp, Homo sapiens
tgctgcaaaggagaagcacagc

SEQ ID NO: 1535958 - DNA, 15 bp, Homo sapiens
tgctgcaccagagtg

SEQ ID NO: 1535959 - DNA, 16 bp, Homo sapiens
tgctgcaccctgcgcc

SEQ ID NO: 1535960 - DNA, 20 bp, Homo sapiens
tgctgcaccctgcgcctcca

SEQ ID NO: 1535961 - DNA, 23 bp, Homo sapiens
tgctgcaccctgcgcctccagag

SEQ ID NO: 1535962 - DNA, 13 bp, Homo sapiens
tgctgcaccttgt

SEQ ID NO: 1535963 - DNA, 22 bp, Homo sapiens
tgctgcaccttgtaaatgctct

SEQ ID NO: 1535964 - DNA, 15 bp, Homo sapiens
tgctgcacttcctgt

SEQ ID NO: 1535965 - DNA, 12 bp, Homo sapiens
tgctgcagcaga

SEQ ID NO: 1535966 - DNA, 15 bp, Homo sapiens
tgctgcagccctgcc

SEQ ID NO: 1535967 - DNA, 21 bp, Homo sapiens
tgctgcagggctttaaaattc

SEQ ID NO: 1535968 - DNA, 17 bp, Homo sapiens
tgctgccaaccatacct

SEQ ID NO: 1535969 - DNA, 19 bp, Homo sapiens
tgctgccacacttcaggct

SEQ ID NO: 1535970 - DNA, 22 bp, Homo sapiens
tgctgccacacttcaggctctt

SEQ ID NO: 1535971 - DNA, 19 bp, Homo sapiens
tgctgccaggcactgttca

SEQ ID NO: 1535972 - DNA, 17 bp, Homo sapiens
tgctgccagtgcagcca

SEQ ID NO: 1535973 - DNA, 12 bp, Homo sapiens
tgctgccatgcc

SEQ ID NO: 1535974 - DNA, 20 bp, Homo sapiens
tgctgccatgccactgccag

SEQ ID NO: 1535975 - DNA, 19 bp, Homo sapiens
tgctgccattacagaggta

SEQ ID NO: 1535976 - DNA, 20 bp, Homo sapiens
tgctgccatttgatttttct

SEQ ID NO: 1535977 - DNA, 15 bp, Homo sapiens
tgctgcccagccact

SEQ ID NO: 1535978 - DNA, 13 bp, Homo sapiens
tgctgccccagct

SEQ ID NO: 1535979 - DNA, 15 bp, Homo sapiens
tgctgccccagctga

SEQ ID NO: 1535980 - DNA, 22 bp, Homo sapiens
tgctgcccccaccccggggacc

SEQ ID NO: 1535981 - DNA, 15 bp, Homo sapiens
tgctgcccctgcagt

SEQ ID NO: 1535982 - DNA, 21 bp, Homo sapiens
tgctgcccctgcagttggcag

SEQ ID NO: 1535983 - DNA, 21 bp, Homo sapiens
tgctgcccgtcttcagcctag

SEQ ID NO: 1535984 - DNA, 22 bp, Homo sapiens
tgctgcccgtcttcagcctagc

SEQ ID NO: 1535985 - DNA, 21 bp, Homo sapiens
tgctgccctcccacagcctcc

SEQ ID NO: 1535986 - DNA, 14 bp, Homo sapiens
tgctgcctctgaaa

SEQ ID NO: 1535987 - DNA, 15 bp, Homo sapiens
tgctgcctctgaaaa

SEQ ID NO: 1535988 - DNA, 21 bp, Homo sapiens
tgctgcctctgaaacagaaag

SEQ ID NO: 1535989 - DNA, 14 bp, Homo sapiens
tgctgcctgagtca

SEQ ID NO: 1535990 - DNA, 15 bp, Homo sapiens
tgctgcctgcctgtc

SEQ ID NO: 1535991 - DNA, 21 bp, Homo sapiens
tgctgcctgtatttgagagac

SEQ ID NO: 1535992 - DNA, 15 bp, Homo sapiens
tgctgccttgcttct

SEQ ID NO: 1535993 - DNA, 15 bp, Homo sapiens
tgctgccttttctgg

SEQ ID NO: 1535994 - DNA, 17 bp, Homo sapiens
tgctgccttttctggag

SEQ ID NO: 1535995 - DNA, 21 bp, Homo sapiens
tgctgccttttctttaacttt

SEQ ID NO: 1535996 - DNA, 16 bp, Homo sapiens
tgctgcgcccttacct

SEQ ID NO: 1535997 - DNA, 20 bp, Homo sapiens
tgctgcgcccttaccttccc

SEQ ID NO: 1535998 - DNA, 18 bp, Homo sapiens
tgctgcggaggagctgcc

SEQ ID NO: 1535999 - DNA, 18 bp, Homo sapiens
tgctgcgtccccactccc

SEQ ID NO: 1536000 - DNA, 22 bp, Homo sapiens
tgctgcgtccccactcccttgg

SEQ ID NO: 1536001 - DNA, 21 bp, Homo sapiens
tgctgctaattctttgcaaaa

SEQ ID NO: 1536002 - DNA, 15 bp, Homo sapiens
tgctgctaccagcgc

SEQ ID NO: 1536003 - DNA, 15 bp, Homo sapiens
tgctgctatgaaaat

SEQ ID NO: 1536004 - DNA, 18 bp, Homo sapiens
tgctgctcaggcccatgc

SEQ ID NO: 1536005 - DNA, 19 bp, Homo sapiens
tgctgctccatggatgcat

SEQ ID NO: 1536006 - DNA, 16 bp, Homo sapiens
tgctgctccgcccgct

SEQ ID NO: 1536007 - DNA, 20 bp, Homo sapiens
tgctgctccggtttgggctg

SEQ ID NO: 1536008 - DNA, 14 bp, Homo sapiens
tgctgctgcccctt

SEQ ID NO: 1536009 - DNA, 13 bp, Homo sapiens
tgctgctgcctct

SEQ ID NO: 1536010 - DNA, 22 bp, Homo sapiens
cctgagctcggtggacccaggg

SEQ ID NO: 1536011 - DNA, 12 bp, Homo sapiens
cctgagctgggg

SEQ ID NO: 1536012 - DNA, 13 bp, Homo sapiens
cctgagctgggga

SEQ ID NO: 1536013 - DNA, 15 bp, Homo sapiens
cctgagctgtcgctg

SEQ ID NO: 1536014 - DNA, 19 bp, Homo sapiens
cctgagctgtcgctgcctc

SEQ ID NO: 1536015 - DNA, 13 bp, Homo sapiens
cctgaggaactgt

SEQ ID NO: 1536016 - DNA, 19 bp, Homo sapiens
cctgaggactgatttcaga

SEQ ID NO: 1536017 - DNA, 23 bp, Homo sapiens
cctgaggactgatttcagagtga

SEQ ID NO: 1536018 - DNA, 16 bp, Homo sapiens
cctgaggactggagac

SEQ ID NO: 1536019 - DNA, 13 bp, Homo sapiens
cctgaggagagga

SEQ ID NO: 1536020 - DNA, 17 bp, Homo sapiens
cctgaggagccctgagg

SEQ ID NO: 1536021 - DNA, 22 bp, Homo sapiens
cctgaggaggaggacacagcac

SEQ ID NO: 1536022 - DNA, 16 bp, Homo sapiens
cctgaggatgagctgg

SEQ ID NO: 1536023 - DNA, 12 bp, Homo sapiens
cctgaggcagcc

SEQ ID NO: 1536024 - DNA, 18 bp, Homo sapiens
cctgaggcagcccagctc

SEQ ID NO: 1536025 - DNA, 21 bp, Homo sapiens
cctgaggctgagactgcggga

SEQ ID NO: 1536026 - DNA, 13 bp, Homo sapiens
cctgaggcttcac

SEQ ID NO: 1536027 - DNA, 13 bp, Homo sapiens
cctgagggcccct

SEQ ID NO: 1536028 - DNA, 20 bp, Homo sapiens
cctgagggcccctctgccca

SEQ ID NO: 1536029 - DNA, 21 bp, Homo sapiens
cctgagggcccctctgcccag

SEQ ID NO: 1536030 - DNA, 22 bp, Homo sapiens
cctgagggcccctctgcccagc

SEQ ID NO: 1536031 - DNA, 23 bp, Homo sapiens
cctgagggcccctctgcccagct

SEQ ID NO: 1536032 - DNA, 20 bp, Homo sapiens
cctgaggggcatctgcccct

SEQ ID NO: 1536033 - DNA, 23 bp, Homo sapiens
cctgaggggcatctgcccctccc

SEQ ID NO: 1536034 - DNA, 17 bp, Homo sapiens
tgctggagaattgactg

SEQ ID NO: 1536035 - DNA, 20 bp, Homo sapiens
tgctggaggcctcaggtgct

SEQ ID NO: 1536036 - DNA, 21 bp, Homo sapiens
tgctggaggcctcaggtgctg

SEQ ID NO: 1536037 - DNA, 15 bp, Homo sapiens
tgctggataaaatga

SEQ ID NO: 1536038 - DNA, 18 bp, Homo sapiens
tgctggatgtctgccaat

SEQ ID NO: 1536039 - DNA, 18 bp, Homo sapiens
tgctggcaggattcttcc

SEQ ID NO: 1536040 - DNA, 18 bp, Homo sapiens
tgctggccaaatagcaaa

SEQ ID NO: 1536041 - DNA, 20 bp, Homo sapiens
tgctggccaaatagcaaaga

SEQ ID NO: 1536042 - DNA, 12 bp, Homo sapiens
tgctggcccagg

SEQ ID NO: 1536043 - DNA, 17 bp, Homo sapiens
tgctggcccagggccca

SEQ ID NO: 1536044 - DNA, 22 bp, Homo sapiens
tgctggccccagccctgctggg

SEQ ID NO: 1536045 - DNA, 15 bp, Homo sapiens
tgctggcctggatct

SEQ ID NO: 1536046 - DNA, 14 bp, Homo sapiens
tgctggctctgaga

SEQ ID NO: 1536047 - DNA, 17 bp, Homo sapiens
tgctggctctgagaatc

SEQ ID NO: 1536048 - DNA, 18 bp, Homo sapiens
tgctggctctgagaatca

SEQ ID NO: 1536049 - DNA, 13 bp, Homo sapiens
tgctggctgccca

SEQ ID NO: 1536050 - DNA, 14 bp, Homo sapiens
tgctggctgcccag

SEQ ID NO: 1536051 - DNA, 14 bp, Homo sapiens
tgctggctgcctta

SEQ ID NO: 1536052 - DNA, 15 bp, Homo sapiens
tgctggctgccttag

SEQ ID NO: 1536053 - DNA, 14 bp, Homo sapiens
tgctggctgcggcc

SEQ ID NO: 1536054 - DNA, 19 bp, Homo sapiens
tgctgggaaccccgcagcc

SEQ ID NO: 1536055 - DNA, 15 bp, Homo sapiens
tgctgggaccagagc

SEQ ID NO: 1536056 - DNA, 16 bp, Homo sapiens
tgctgggaccagagcc

SEQ ID NO: 1536057 - DNA, 19 bp, Homo sapiens
tgctgggaccagagccaga

SEQ ID NO: 1536058 - DNA, 16 bp, Homo sapiens
tgctgggacccacctc

SEQ ID NO: 1536059 - DNA, 16 bp, Homo sapiens
tgctgggactcagcct

SEQ ID NO: 1536060 - DNA, 15 bp, Homo sapiens
tgctgggactggcca

SEQ ID NO: 1536061 - DNA, 15 bp, Homo sapiens
tgctgggagctccac

SEQ ID NO: 1536062 - DNA, 18 bp, Homo sapiens
tgctgggagctccactct

SEQ ID NO: 1536063 - DNA, 20 bp, Homo sapiens
tgctgggagctccactctgc

SEQ ID NO: 1536064 - DNA, 21 bp, Homo sapiens
tgctgggagctccactctgct

SEQ ID NO: 1536065 - DNA, 18 bp, Homo sapiens
tgctgggagctgaaaaat

SEQ ID NO: 1536066 - DNA, 19 bp, Homo sapiens
tgctgggcattttcccaga

SEQ ID NO: 1536067 - DNA, 16 bp, Homo sapiens
tgctgggccagggaaa

SEQ ID NO: 1536068 - DNA, 18 bp, Homo sapiens
tgctgggccagggaaaca

SEQ ID NO: 1536069 - DNA, 16 bp, Homo sapiens
tgctgggctctccacc

SEQ ID NO: 1536070 - DNA, 12 bp, Homo sapiens
tgctgggctggg

SEQ ID NO: 1536071 - DNA, 16 bp, Homo sapiens
tgctggggaagacagt

SEQ ID NO: 1536072 - DNA, 21 bp, Homo sapiens
tgctggggcatgtgtgcctgt

SEQ ID NO: 1536073 - DNA, 22 bp, Homo sapiens
tgctggggcatgtgtgcctgtg

SEQ ID NO: 1536074 - DNA, 22 bp, Homo sapiens
tgctggggccgccacggcctgg

SEQ ID NO: 1536075 - DNA, 19 bp, Homo sapiens
tgctggggtcaaggcagta

SEQ ID NO: 1536076 - DNA, 20 bp, Homo sapiens
tgctgggttcccactcccgg

SEQ ID NO: 1536077 - DNA, 14 bp, Homo sapiens
tgctgggttggtgc

SEQ ID NO: 1536078 - DNA, 18 bp, Homo sapiens
tgctggtagagaccccca

SEQ ID NO: 1536079 - DNA, 18 bp, Homo sapiens
tgctggtagatgctgagg

SEQ ID NO: 1536080 - DNA, 20 bp, Homo sapiens
tgctggtcagagagacctca

SEQ ID NO: 1536081 - DNA, 21 bp, Homo sapiens
tgctggtcagagagacctcat

SEQ ID NO: 1536082 - DNA, 18 bp, Homo sapiens
tgctggtcccctcctcag

SEQ ID NO: 1536083 - DNA, 13 bp, Homo sapiens
tgctggtgaacac

SEQ ID NO: 1536084 - DNA, 18 bp, Homo sapiens
tgctggtgaacactgtga

SEQ ID NO: 1536085 - DNA, 18 bp, Homo sapiens
tgctggtgtagtcttttt

SEQ ID NO: 1536086 - DNA, 14 bp, Homo sapiens
tgctggtgtcctga

SEQ ID NO: 1536087 - DNA, 17 bp, Homo sapiens
tgctggtgtcctgacca

SEQ ID NO: 1536088 - DNA, 22 bp, Homo sapiens
tgctggtgtcctgaccaccctc

SEQ ID NO: 1536089 - DNA, 23 bp, Homo sapiens
tgctggttgtcatttttgcagta

SEQ ID NO: 1536090 - DNA, 17 bp, Homo sapiens
tgctggttgttgccagg

SEQ ID NO: 1536091 - DNA, 17 bp, Homo sapiens
tgctggtttgaaagatt

SEQ ID NO: 1536092 - DNA, 15 bp, Homo sapiens
tgctggttttaacaa

SEQ ID NO: 1536093 - DNA, 22 bp, Homo sapiens
tgctggttttcctaaatgcagt

SEQ ID NO: 1536094 - DNA, 13 bp, Homo sapiens
tgctggttttcta

SEQ ID NO: 1536095 - DNA, 19 bp, Homo sapiens
tgctgtaactgctgagcca

SEQ ID NO: 1536096 - DNA, 14 bp, Homo sapiens
tgctgtaatattgt

SEQ ID NO: 1536097 - DNA, 20 bp, Homo sapiens
tgctgtacacatatttgaag

SEQ ID NO: 1536098 - DNA, 22 bp, Homo sapiens
tgctgtaccacatctgctctag

SEQ ID NO: 1536099 - DNA, 21 bp, Homo sapiens
tgctgtacccttccacctcct

SEQ ID NO: 1536100 - DNA, 23 bp, Homo sapiens
tgctgtactcttgctgatggctg

SEQ ID NO: 1536101 - DNA, 22 bp, Homo sapiens
tgctgtcaacttcccatctggc

SEQ ID NO: 1536102 - DNA, 13 bp, Homo sapiens
tgctgtcactgtt

SEQ ID NO: 1536103 - DNA, 13 bp, Homo sapiens
tgctgtccaggca

SEQ ID NO: 1536104 - DNA, 23 bp, Homo sapiens
tgctgtccaggcagctccctcct

SEQ ID NO: 1536105 - DNA, 16 bp, Homo sapiens
tgctgtccctccccct

SEQ ID NO: 1536106 - DNA, 16 bp, Homo sapiens
tgctgtcctaggccac

SEQ ID NO: 1536107 - DNA, 23 bp, Homo sapiens
tgctgtcctaggccacaccatct

SEQ ID NO: 1536108 - DNA, 16 bp, Homo sapiens
tgctgtctctctgggc

SEQ ID NO: 1536109 - DNA, 18 bp, Homo sapiens
tgctgtcttttgttctct

SEQ ID NO: 1536110 - DNA, 20 bp, Homo sapiens
tgctgtcttttgttctctga

SEQ ID NO: 1536111 - DNA, 19 bp, Homo sapiens
tgctgtgaccatttataat

SEQ ID NO: 1536112 - DNA, 23 bp, Homo sapiens
tgctgtgagtctttggttctaag

SEQ ID NO: 1536113 - DNA, 20 bp, Homo sapiens
tgctgtgatacgatgcttca

SEQ ID NO: 1536114 - DNA, 14 bp, Homo sapiens
tgctgtgcagctct

SEQ ID NO: 1536115 - DNA, 14 bp, Homo sapiens
tgctgtgccccacc

SEQ ID NO: 1536116 - DNA, 15 bp, Homo sapiens
tgctgtgcctcccaa

SEQ ID NO: 1536117 - DNA, 12 bp, Homo sapiens
tgctgtgcctgc

SEQ ID NO: 1536118 - DNA, 13 bp, Homo sapiens
tgctgtgcctgct

SEQ ID NO: 1536119 - DNA, 16 bp, Homo sapiens
tgctgtgcgcccaggg

SEQ ID NO: 1536120 - DNA, 17 bp, Homo sapiens
tgctgtgcgcccagggc

SEQ ID NO: 1536121 - DNA, 13 bp, Homo sapiens
tgctgtgctctgg

SEQ ID NO: 1536122 - DNA, 12 bp, Homo sapiens
tgctgtggcctg

SEQ ID NO: 1536123 - DNA, 14 bp, Homo sapiens
tgctgtggcctggg

SEQ ID NO: 1536124 - DNA, 16 bp, Homo sapiens
tgctgtggtggggaga

SEQ ID NO: 1536125 - DNA, 12 bp, Homo sapiens
tgcttgggctga

SEQ ID NO: 1536126 - DNA, 21 bp, Homo sapiens
tgcttgggctgacccagcatc

SEQ ID NO: 1536127 - DNA, 15 bp, Homo sapiens
tgcttggtctgtttg

SEQ ID NO: 1536128 - DNA, 19 bp, Homo sapiens
tgcttggtggggctcgtgg

SEQ ID NO: 1536129 - DNA, 20 bp, Homo sapiens
tgcttggtggggctcgtggc

SEQ ID NO: 1536130 - DNA, 20 bp, Homo sapiens
tgcttgtaacaagaaaacat

SEQ ID NO: 1536131 - DNA, 21 bp, Homo sapiens
tgcttgtaacaagaaaacata

SEQ ID NO: 1536132 - DNA, 18 bp, Homo sapiens
tgcttgtaatcaagcctt

SEQ ID NO: 1536133 - DNA, 21 bp, Homo sapiens
tgcttgtaatcaagcctttat

SEQ ID NO: 1536134 - DNA, 13 bp, Homo sapiens
tgcttgtcatctg

SEQ ID NO: 1536135 - DNA, 21 bp, Homo sapiens
tgcttgtcatctgcatgtcta

SEQ ID NO: 1536136 - DNA, 20 bp, Homo sapiens
tgcttgtcttctggtacttt

SEQ ID NO: 1536137 - DNA, 20 bp, Homo sapiens
tgcttgttaatgctttctga

SEQ ID NO: 1536138 - DNA, 16 bp, Homo sapiens
tgcttgttccctctcc

SEQ ID NO: 1536139 - DNA, 23 bp, Homo sapiens
tgcttgttgggattcctgaccca

SEQ ID NO: 1536140 - DNA, 14 bp, Homo sapiens
tgcttgtttatgat

SEQ ID NO: 1536141 - DNA, 17 bp, Homo sapiens
tgctttaattttagcaa

SEQ ID NO: 1536142 - DNA, 20 bp, Homo sapiens
tgctttacatgctgtgctct

SEQ ID NO: 1536143 - DNA, 18 bp, Homo sapiens
tgctttagagaatgccac

SEQ ID NO: 1536144 - DNA, 21 bp, Homo sapiens
tgctttattaatgttttcaaa

SEQ ID NO: 1536145 - DNA, 19 bp, Homo sapiens
tgctttcacaaatatagtt

SEQ ID NO: 1536146 - DNA, 14 bp, Homo sapiens
tgctttcccctgtg

SEQ ID NO: 1536147 - DNA, 16 bp, Homo sapiens
tgctttccctgaggaa

SEQ ID NO: 1536148 - DNA, 18 bp, Homo sapiens
tgctttcctctgagattc

SEQ ID NO: 1536149 - DNA, 15 bp, Homo sapiens
tgctttcctgggcct

SEQ ID NO: 1536150 - DNA, 16 bp, Homo sapiens
tgctttcctgggcctt

SEQ ID NO: 1536151 - DNA, 19 bp, Homo sapiens
tgctttcgtgtaaattatg

SEQ ID NO: 1536152 - DNA, 22 bp, Homo sapiens
tgctttctagcaaatatgctgt

SEQ ID NO: 1536153 - DNA, 20 bp, Homo sapiens
tgctttgaagtagctctttt

SEQ ID NO: 1536154 - DNA, 14 bp, Homo sapiens
tgctttgcaaagac

SEQ ID NO: 1536155 - DNA, 16 bp, Homo sapiens
tgctttgcatctttgt

SEQ ID NO: 1536156 - DNA, 20 bp, Homo sapiens
tgctttgccaaaataccaga

SEQ ID NO: 1536157 - DNA, 24 bp, Homo sapiens
tgctttgccaagttgctgtcactg

SEQ ID NO: 1536158 - DNA, 22 bp, Homo sapiens
tgctttgccataaccacattta

SEQ ID NO: 1536159 - DNA, 15 bp, Homo sapiens
tgctttgcccctgag

SEQ ID NO: 1536160 - DNA, 12 bp, Homo sapiens
tgctttgctaga

SEQ ID NO: 1536161 - DNA, 16 bp, Homo sapiens
tgctttgctgcacaaa

SEQ ID NO: 1536162 - DNA, 13 bp, Homo sapiens
tgctttgctgcta

SEQ ID NO: 1536163 - DNA, 15 bp, Homo sapiens
tgctttgctgctatg

SEQ ID NO: 1536164 - DNA, 16 bp, Homo sapiens
tgctttgctgctatga

SEQ ID NO: 1536165 - DNA, 21 bp, Homo sapiens
tgctttgctgctatgaaaatg

SEQ ID NO: 1536166 - DNA, 24 bp, Homo sapiens
tgctttggatgattttttaagcag

SEQ ID NO: 1536167 - DNA, 17 bp, Homo sapiens
tgctttgggctgccctg

SEQ ID NO: 1536168 - DNA, 19 bp, Homo sapiens
tgctttgggctgccctggt

SEQ ID NO: 1536169 - DNA, 21 bp, Homo sapiens
tgctttgggctgccctggtgc

SEQ ID NO: 1536170 - DNA, 19 bp, Homo sapiens
tgctttggggggtgtgctg

SEQ ID NO: 1536171 - DNA, 17 bp, Homo sapiens
tgctttgtgtgattgaa

SEQ ID NO: 1536172 - DNA, 17 bp, Homo sapiens
tgcttttaaaaaaaaat

SEQ ID NO: 1536173 - DNA, 17 bp, Homo sapiens
tgcttttaccatgcccc

SEQ ID NO: 1536174 - DNA, 12 bp, Homo sapiens
tgcttttagaat

SEQ ID NO: 1536175 - DNA, 23 bp, Homo sapiens
tgcttttcaaatgtttgaaaaca

SEQ ID NO: 1536176 - DNA, 19 bp, Homo sapiens
tgcttttcatgtagaactc

SEQ ID NO: 1536177 - DNA, 23 bp, Homo sapiens
tgcttttcatgtagaactcagca

SEQ ID NO: 1536178 - DNA, 13 bp, Homo sapiens
tgcttttccagga

SEQ ID NO: 1536179 - DNA, 21 bp, Homo sapiens
tgcttttccaggatcctgcag

SEQ ID NO: 1536180 - DNA, 17 bp, Homo sapiens
tgcttttccctttgtga

SEQ ID NO: 1536181 - DNA, 16 bp, Homo sapiens
tgcttttctgtcctgg

SEQ ID NO: 1536182 - DNA, 14 bp, Homo sapiens
tgcttttgatgtga

SEQ ID NO: 1536183 - DNA, 22 bp, Homo sapiens
tgcttttgcacaccttttcccc

SEQ ID NO: 1536184 - DNA, 21 bp, Homo sapiens
tgcttttgcatttctcttcct

SEQ ID NO: 1536185 - DNA, 21 bp, Homo sapiens
tgcttttgccactttggcttc

SEQ ID NO: 1536186 - DNA, 21 bp, Homo sapiens
tgcttttggcaaaactctact

SEQ ID NO: 1536187 - DNA, 16 bp, Homo sapiens
tgcttttgttgtgact

SEQ ID NO: 1536188 - DNA, 19 bp, Homo sapiens
tgcttttgttgtgactttt

SEQ ID NO: 1536189 - DNA, 17 bp, Homo sapiens
tgcttttgtttcttaag

SEQ ID NO: 1536190 - DNA, 14 bp, Homo sapiens
tgctttttccaact

SEQ ID NO: 1536191 - DNA, 21 bp, Homo sapiens
tgctttttccaactcagaaat

SEQ ID NO: 1536192 - DNA, 14 bp, Homo sapiens
tgctttttggaaag

SEQ ID NO: 1536193 - DNA, 20 bp, Homo sapiens
tgcttttttccaaaacaaaa

SEQ ID NO: 1536194 - DNA, 21 bp, Homo sapiens
tgcttttttgttttgtgctaa

SEQ ID NO: 1536195 - DNA, 15 bp, Homo sapiens
tgctttttttgaaac

SEQ ID NO: 1536196 - DNA, 12 bp, Homo sapiens
tggaaaaaaaca

SEQ ID NO: 1536197 - DNA, 21 bp, Homo sapiens
tggaaaaaaacataaaaagca

SEQ ID NO: 1536198 - DNA, 19 bp, Homo sapiens
tggaaaaaaatacaaaaag

SEQ ID NO: 1536199 - DNA, 13 bp, Homo sapiens
tggaaaaaactct

SEQ ID NO: 1536200 - DNA, 15 bp, Homo sapiens
tggaaaaaactctga

SEQ ID NO: 1536201 - DNA, 22 bp, Homo sapiens
tggaaaaaatgatgttcattta

SEQ ID NO: 1536202 - DNA, 13 bp, Homo sapiens
tggaaaaatccag

SEQ ID NO: 1536203 - DNA, 11 bp, Homo sapiens
tggaaaaatgg

SEQ ID NO: 1536204 - DNA, 19 bp, Homo sapiens
tggaaaaatggttgatgga

SEQ ID NO: 1536205 - DNA, 22 bp, Homo sapiens
tggaaaaatggttgatggaaaa

SEQ ID NO: 1536206 - DNA, 22 bp, Homo sapiens
tggaaaacaaaccatctctagt

SEQ ID NO: 1536207 - DNA, 14 bp, Homo sapiens
tggaaaacagaaac

SEQ ID NO: 1536208 - DNA, 18 bp, Homo sapiens
tggaaaacagaacactta

SEQ ID NO: 1536209 - DNA, 19 bp, Homo sapiens
tggaaaacagaacacttat

SEQ ID NO: 1536210 - DNA, 15 bp, Homo sapiens
tggaaaacagggtgc

SEQ ID NO: 1536211 - DNA, 14 bp, Homo sapiens
tggaaaacctcctt

SEQ ID NO: 1536212 - DNA, 15 bp, Homo sapiens
tggaaaaggaagact

SEQ ID NO: 1536213 - DNA, 16 bp, Homo sapiens
tggaaaagtgtccttc

SEQ ID NO: 1536214 - DNA, 22 bp, Homo sapiens
tggaaaagttagtattaaaatc

SEQ ID NO: 1536215 - DNA, 15 bp, Homo sapiens
tggaaaataaattat

SEQ ID NO: 1536216 - DNA, 16 bp, Homo sapiens
tggaaaataaattatt

SEQ ID NO: 1536217 - DNA, 21 bp, Homo sapiens
tggaaaatacctaattgtgga

SEQ ID NO: 1536218 - DNA, 22 bp, Homo sapiens
tggaaaatacctaattgtggat

SEQ ID NO: 1536219 - DNA, 24 bp, Homo sapiens
tggaaaatacctaattgtggatga

SEQ ID NO: 1536220 - DNA, 20 bp, Homo sapiens
tggaaaattttctccttggt

SEQ ID NO: 1536221 - DNA, 17 bp, Homo sapiens
tggaaacaatcctgtta

SEQ ID NO: 1536222 - DNA, 18 bp, Homo sapiens
tggaaacagcatgaataa

SEQ ID NO: 1536223 - DNA, 19 bp, Homo sapiens
tggaaacagcatgaataaa

SEQ ID NO: 1536224 - DNA, 15 bp, Homo sapiens
tggaaaccacagtca

SEQ ID NO: 1536225 - DNA, 17 bp, Homo sapiens
tggaaacctgccctgcc

SEQ ID NO: 1536226 - DNA, 24 bp, Homo sapiens
tggaaacctgccctgcctgagggc

SEQ ID NO: 1536227 - DNA, 19 bp, Homo sapiens
tggaaaccttccacccagt

SEQ ID NO: 1536228 - DNA, 13 bp, Homo sapiens
tggaaactcagcc

SEQ ID NO: 1536229 - DNA, 13 bp, Homo sapiens
tggaaactggcca

SEQ ID NO: 1536230 - DNA, 18 bp, Homo sapiens
tggaaagataactaggaa

SEQ ID NO: 1536231 - DNA, 15 bp, Homo sapiens
tggaaagcaaagggc

SEQ ID NO: 1536232 - DNA, 20 bp, Homo sapiens
tggaaagcatcacctcaggc

SEQ ID NO: 1536233 - DNA, 21 bp, Homo sapiens
tggaaagcatcacctcaggcc

SEQ ID NO: 1536234 - DNA, 14 bp, Homo sapiens
tggaaagcctctgc

SEQ ID NO: 1536235 - DNA, 16 bp, Homo sapiens
tggaaagcctctgctg

SEQ ID NO: 1536236 - DNA, 22 bp, Homo sapiens
tggaaaggatctgtgattggct

SEQ ID NO: 1536237 - DNA, 13 bp, Homo sapiens
tggaaaggctcag

SEQ ID NO: 1536238 - DNA, 21 bp, Homo sapiens
tggaaaggctcagtctcagga

SEQ ID NO: 1536239 - DNA, 18 bp, Homo sapiens
tgccccagctctggcttc

SEQ ID NO: 1536240 - DNA, 18 bp, Homo sapiens
tgccccagctgactgtgg

SEQ ID NO: 1536241 - DNA, 14 bp, Homo sapiens
tgccccaggaccag

SEQ ID NO: 1536242 - DNA, 20 bp, Homo sapiens
tgccccaggaccagctcagg

SEQ ID NO: 1536243 - DNA, 21 bp, Homo sapiens
tgccccaggatcactctctgc

SEQ ID NO: 1536244 - DNA, 12 bp, Homo sapiens
tgccccaggccc

SEQ ID NO: 1536245 - DNA, 14 bp, Homo sapiens
tgccccaggcctga

SEQ ID NO: 1536246 - DNA, 12 bp, Homo sapiens
tgccccaggctc

SEQ ID NO: 1536247 - DNA, 24 bp, Homo sapiens
tgccccagtcggccccatctctca

SEQ ID NO: 1536248 - DNA, 12 bp, Homo sapiens
tgccccatgcct

SEQ ID NO: 1536249 - DNA, 22 bp, Homo sapiens
tgcccccaccccggggaccctg

SEQ ID NO: 1536250 - DNA, 23 bp, Homo sapiens
tgcccccaccccggggaccctgt

SEQ ID NO: 1536251 - DNA, 19 bp, Homo sapiens
tgcccccagcccagagccc

SEQ ID NO: 1536252 - DNA, 16 bp, Homo sapiens
tgcccccagccccggg

SEQ ID NO: 1536253 - DNA, 11 bp, Homo sapiens
tgcccccagga

SEQ ID NO: 1536254 - DNA, 12 bp, Homo sapiens
tgcccccaggac

SEQ ID NO: 1536255 - DNA, 17 bp, Homo sapiens
tgcccccaggactgggc

SEQ ID NO: 1536256 - DNA, 17 bp, Homo sapiens
tgcccccatctccccag

SEQ ID NO: 1536257 - DNA, 20 bp, Homo sapiens
tgcccccatctccccaggcc

SEQ ID NO: 1536258 - DNA, 21 bp, Homo sapiens
tgcccccatctccccaggcct

SEQ ID NO: 1536259 - DNA, 17 bp, Homo sapiens
tgcccccatttcaccca

SEQ ID NO: 1536260 - DNA, 19 bp, Homo sapiens
tgccccccgaggctgctag

SEQ ID NO: 1536261 - DNA, 13 bp, Homo sapiens
tgcccccctccca

SEQ ID NO: 1536262 - DNA, 18 bp, Homo sapiens
tgcccccctcctccagta

SEQ ID NO: 1536263 - DNA, 17 bp, Homo sapiens
tgcccccgcctgccacc

SEQ ID NO: 1536264 - DNA, 20 bp, Homo sapiens
tgcccccgcgggttctagac

SEQ ID NO: 1536265 - DNA, 21 bp, Homo sapiens
tgcccccgctcccgctcccag

SEQ ID NO: 1536266 - DNA, 13 bp, Homo sapiens
tgccccctccagg

SEQ ID NO: 1536267 - DNA, 23 bp, Homo sapiens
tgccccctccaggagagagccag

SEQ ID NO: 1536268 - DNA, 14 bp, Homo sapiens
tgccccctccccca

SEQ ID NO: 1536269 - DNA, 21 bp, Homo sapiens
tgccccctcccccatgggctg

SEQ ID NO: 1536270 - DNA, 11 bp, Homo sapiens
tgccccctcct

SEQ ID NO: 1536271 - DNA, 12 bp, Homo sapiens
tgccccctcctc

SEQ ID NO: 1536272 - DNA, 22 bp, Homo sapiens
tgccccctcgggggcctgtggt

SEQ ID NO: 1536273 - DNA, 15 bp, Homo sapiens
tgccccctctcactt

SEQ ID NO: 1536274 - DNA, 14 bp, Homo sapiens
tgccccctgcagac

SEQ ID NO: 1536275 - DNA, 16 bp, Homo sapiens
tgccccctttcagatg

SEQ ID NO: 1536276 - DNA, 18 bp, Homo sapiens
tgccccctttcagatgtc

SEQ ID NO: 1536277 - DNA, 21 bp, Homo sapiens
tgccccctttcagatgtcttc

SEQ ID NO: 1536278 - DNA, 23 bp, Homo sapiens
tgccccctttcagatgtcttctg

SEQ ID NO: 1536279 - DNA, 13 bp, Homo sapiens
tgccccgcccagc

SEQ ID NO: 1536280 - DNA, 15 bp, Homo sapiens
tgccccgcctccccg

SEQ ID NO: 1536281 - DNA, 17 bp, Homo sapiens
tgccccgcttccccaca

SEQ ID NO: 1536282 - DNA, 18 bp, Homo sapiens
tgccccgcttccccacag

SEQ ID NO: 1536283 - DNA, 19 bp, Homo sapiens
tgccccgcttccccacaga

SEQ ID NO: 1536284 - DNA, 23 bp, Homo sapiens
tgccccgcttccccacagaactg

SEQ ID NO: 1536285 - DNA, 17 bp, Homo sapiens
tgccccgctttgcggac

SEQ ID NO: 1536286 - DNA, 13 bp, Homo sapiens
tgccccggagctg

SEQ ID NO: 1536287 - DNA, 23 bp, Homo sapiens
tgccccggccccggccccagcca

SEQ ID NO: 1536288 - DNA, 18 bp, Homo sapiens
tgccccgggtccccagct

SEQ ID NO: 1536289 - DNA, 22 bp, Homo sapiens
tgccccgggtccccagctcccc

SEQ ID NO: 1536290 - DNA, 19 bp, Homo sapiens
tgccccgttccctgtcaga

SEQ ID NO: 1536291 - DNA, 20 bp, Homo sapiens
tgcccctaatctctgtagga

SEQ ID NO: 1536292 - DNA, 21 bp, Homo sapiens
tgcccctaatctctgtaggaa

SEQ ID NO: 1536293 - DNA, 22 bp, Homo sapiens
tgcccctacgggcgctgcagcc

SEQ ID NO: 1536294 - DNA, 23 bp, Homo sapiens
tgcccctacgggcgctgcagcct

SEQ ID NO: 1536295 - DNA, 21 bp, Homo sapiens
tgcccctaggatgctgcagca

SEQ ID NO: 1536296 - DNA, 23 bp, Homo sapiens
tgcccctaggatgctgcagcaga

SEQ ID NO: 1536297 - DNA, 17 bp, Homo sapiens
tgcccctagggtccctc

SEQ ID NO: 1536298 - DNA, 12 bp, Homo sapiens
tgcccctccccc

SEQ ID NO: 1536299 - DNA, 15 bp, Homo sapiens
tgcccctcccttcaa

SEQ ID NO: 1536300 - DNA, 18 bp, Homo sapiens
tgcccctgatgcagcctg

SEQ ID NO: 1536301 - DNA, 22 bp, Homo sapiens
tgcccctgatgcagcctgtggc

SEQ ID NO: 1536302 - DNA, 13 bp, Homo sapiens
tgcccctgcagtt

SEQ ID NO: 1536303 - DNA, 21 bp, Homo sapiens
tgcccctgcagtttggccctg

SEQ ID NO: 1536304 - DNA, 12 bp, Homo sapiens
tgcccctggctt

SEQ ID NO: 1536305 - DNA, 15 bp, Homo sapiens
tgcccctggctttgc

SEQ ID NO: 1536306 - DNA, 23 bp, Homo sapiens
tgccccttaagggttgaaggcag

SEQ ID NO: 1536307 - DNA, 17 bp, Homo sapiens
tgcccgaggcgccagct

SEQ ID NO: 1536308 - DNA, 13 bp, Homo sapiens
tgcccgccagcct

SEQ ID NO: 1536309 - DNA, 15 bp, Homo sapiens
tgcccgccagcctca

SEQ ID NO: 1536310 - DNA, 16 bp, Homo sapiens
tgcccgccagcctcag

SEQ ID NO: 1536311 - DNA, 22 bp, Homo sapiens
tgcccgccagcctcagtgccac

SEQ ID NO: 1536312 - DNA, 13 bp, Homo sapiens
tgcccgcctttca

SEQ ID NO: 1536313 - DNA, 15 bp, Homo sapiens
tgcccgctcccaacc

SEQ ID NO: 1536314 - DNA, 21 bp, Homo sapiens
tgcccggagattggacggcct

SEQ ID NO: 1536315 - DNA, 15 bp, Homo sapiens
tgcccggattctggg

SEQ ID NO: 1536316 - DNA, 22 bp, Homo sapiens
tgcccggctgtgattgctgcca

SEQ ID NO: 1536317 - DNA, 21 bp, Homo sapiens
tgcccggggaaaggcaaggtc

SEQ ID NO: 1536318 - DNA, 21 bp, Homo sapiens
tgcccggggtggggtgcactc

SEQ ID NO: 1536319 - DNA, 19 bp, Homo sapiens
tgcccgtgtagtccccaac

SEQ ID NO: 1536320 - DNA, 23 bp, Homo sapiens
tgcccgtgtcggttcttcctgga

SEQ ID NO: 1536321 - DNA, 21 bp, Homo sapiens
tgccctaagcccccagggcct

SEQ ID NO: 1536322 - DNA, 23 bp, Homo sapiens
tgccctaagcccccagggcctcc

SEQ ID NO: 1536323 - DNA, 15 bp, Homo sapiens
tgccctatgctgtgc

SEQ ID NO: 1536324 - DNA, 21 bp, Homo sapiens
tgccctatggatttgaagttt

SEQ ID NO: 1536325 - DNA, 14 bp, Homo sapiens
tgccctcaccacca

SEQ ID NO: 1536326 - DNA, 18 bp, Homo sapiens
tgccctccacagccgcag

SEQ ID NO: 1536327 - DNA, 19 bp, Homo sapiens
tgccctccactccactgcc

SEQ ID NO: 1536328 - DNA, 22 bp, Homo sapiens
tgccctcccaagtcccaccctc

SEQ ID NO: 1536329 - DNA, 17 bp, Homo sapiens
tgccctcccctgctccc

SEQ ID NO: 1536330 - DNA, 20 bp, Homo sapiens
tgccctccctttctctctcc

SEQ ID NO: 1536331 - DNA, 12 bp, Homo sapiens
tgccctcctgga

SEQ ID NO: 1536332 - DNA, 13 bp, Homo sapiens
tgccctcgctgct

SEQ ID NO: 1536333 - DNA, 16 bp, Homo sapiens
tgccctcgtggccagc

SEQ ID NO: 1536334 - DNA, 21 bp, Homo sapiens
tgccctcgtggccagcccggc

SEQ ID NO: 1536335 - DNA, 12 bp, Homo sapiens
tgccctctgccc

SEQ ID NO: 1536336 - DNA, 17 bp, Homo sapiens
tgccctctgccccatca

SEQ ID NO: 1536337 - DNA, 15 bp, Homo sapiens
tgccctctgctctgc

SEQ ID NO: 1536338 - DNA, 17 bp, Homo sapiens
tgccctctgctctgcct

SEQ ID NO: 1536339 - DNA, 18 bp, Homo sapiens
tgccctctgctctgcctg

SEQ ID NO: 1536340 - DNA, 18 bp, Homo sapiens
tgccctctgctgctgccc

SEQ ID NO: 1536341 - DNA, 19 bp, Homo sapiens
tgccctctgctgctgcccg

SEQ ID NO: 1536342 - DNA, 17 bp, Homo sapiens
tgccctgcatgctgccc

SEQ ID NO: 1536343 - DNA, 13 bp, Homo sapiens
tgccctgccccca

SEQ ID NO: 1536344 - DNA, 16 bp, Homo sapiens
tgccctgccctagctc

SEQ ID NO: 1536345 - DNA, 12 bp, Homo sapiens
tgccctgcctga

SEQ ID NO: 1536346 - DNA, 16 bp, Homo sapiens
tgccctgcctgaggag

SEQ ID NO: 1536347 - DNA, 12 bp, Homo sapiens
tgccctgcctgc

SEQ ID NO: 1536348 - DNA, 17 bp, Homo sapiens
tgccctgcctgcccact

SEQ ID NO: 1536349 - DNA, 12 bp, Homo sapiens
tgccctggccct

SEQ ID NO: 1536350 - DNA, 17 bp, Homo sapiens
tgccctggccctgaggt

SEQ ID NO: 1536351 - DNA, 14 bp, Homo sapiens
tgccctggctgctg

SEQ ID NO: 1536352 - DNA, 15 bp, Homo sapiens
tgccctggctgctgc

SEQ ID NO: 1536353 - DNA, 16 bp, Homo sapiens
tgccctggctgctgcc

SEQ ID NO: 1536354 - DNA, 12 bp, Homo sapiens
tgccctgggcga

SEQ ID NO: 1536355 - DNA, 22 bp, Homo sapiens
tgccctgggcgagcccctcctt

SEQ ID NO: 1536356 - DNA, 12 bp, Homo sapiens
cctagccctggt

SEQ ID NO: 1536357 - DNA, 22 bp, Homo sapiens
cctagccctggttagctgacag

SEQ ID NO: 1536358 - DNA, 16 bp, Homo sapiens
cctagccgacctcagc

SEQ ID NO: 1536359 - DNA, 17 bp, Homo sapiens
cctagccgacctcagcc

SEQ ID NO: 1536360 - DNA, 18 bp, Homo sapiens
cctagccgacctcagcct

SEQ ID NO: 1536361 - DNA, 20 bp, Homo sapiens
cctagcctgtgcctctggga

SEQ ID NO: 1536362 - DNA, 17 bp, Homo sapiens
cctagcgatctctcctg

SEQ ID NO: 1536363 - DNA, 19 bp, Homo sapiens
cctagcgatctctcctggc

SEQ ID NO: 1536364 - DNA, 22 bp, Homo sapiens
cctagcgatctctcctggccta

SEQ ID NO: 1536365 - DNA, 19 bp, Homo sapiens
cctagctcaccaggcctgg

SEQ ID NO: 1536366 - DNA, 20 bp, Homo sapiens
cctagctcctccccttcctc

SEQ ID NO: 1536367 - DNA, 19 bp, Homo sapiens
cctagctcctcctcctggg

SEQ ID NO: 1536368 - DNA, 22 bp, Homo sapiens
cctagctcctgccacatggagc

SEQ ID NO: 1536369 - DNA, 14 bp, Homo sapiens
cctagctgaccccg

SEQ ID NO: 1536370 - DNA, 13 bp, Homo sapiens
cctagctggctct

SEQ ID NO: 1536371 - DNA, 17 bp, Homo sapiens
cctagctggctctgtga

SEQ ID NO: 1536372 - DNA, 22 bp, Homo sapiens
cctagctgtgtgaatacctgct

SEQ ID NO: 1536373 - DNA, 17 bp, Homo sapiens
cctagctttagaccctg

SEQ ID NO: 1536374 - DNA, 20 bp, Homo sapiens
cctagctttagaccctgggt

SEQ ID NO: 1536375 - DNA, 21 bp, Homo sapiens
cctagctttagaccctgggtg

SEQ ID NO: 1536376 - DNA, 22 bp, Homo sapiens
cctagctttagaccctgggtgg

SEQ ID NO: 1536377 - DNA, 19 bp, Homo sapiens
cctagctttttcctggaaa

SEQ ID NO: 1536378 - DNA, 17 bp, Homo sapiens
cctaggaaaccagctcg

SEQ ID NO: 1536379 - DNA, 16 bp, Homo sapiens
cctaggagctggctgg

SEQ ID NO: 1536380 - DNA, 22 bp, Homo sapiens
cctaggagctggctggcaggtg

SEQ ID NO: 1536381 - DNA, 14 bp, Homo sapiens
cctaggaggctggc

SEQ ID NO: 1536382 - DNA, 13 bp, Homo sapiens
cctaggagttgag

SEQ ID NO: 1536383 - DNA, 16 bp, Homo sapiens
cctaggatgctgcagc

SEQ ID NO: 1536384 - DNA, 14 bp, Homo sapiens
cctaggcacctccc

SEQ ID NO: 1536385 - DNA, 20 bp, Homo sapiens
cctaggccaaatgcacaagc

SEQ ID NO: 1536386 - DNA, 22 bp, Homo sapiens
cctaggccaaatgcacaagctc

SEQ ID NO: 1536387 - DNA, 23 bp, Homo sapiens
cctaggccacaccatctcctttc

SEQ ID NO: 1536388 - DNA, 23 bp, Homo sapiens
cctaggcccctcctagacccagg

SEQ ID NO: 1536389 - DNA, 14 bp, Homo sapiens
cctagggaaaagtt

SEQ ID NO: 1536390 - DNA, 20 bp, Homo sapiens
cctaggggtgcgctcacctg

SEQ ID NO: 1536391 - DNA, 17 bp, Homo sapiens
cctaggggtttctgttg

SEQ ID NO: 1536392 - DNA, 13 bp, Homo sapiens
cctagggtccctc

SEQ ID NO: 1536393 - DNA, 21 bp, Homo sapiens
cctagggtcttgggggtcagg

SEQ ID NO: 1536394 - DNA, 15 bp, Homo sapiens
cctagggtggcctga

SEQ ID NO: 1536395 - DNA, 16 bp, Homo sapiens
cctaggtgcccagggc

SEQ ID NO: 1536396 - DNA, 17 bp, Homo sapiens
cctaggtgcccagggcc

SEQ ID NO: 1536397 - DNA, 22 bp, Homo sapiens
cctaggtttttcctactgtcct

SEQ ID NO: 1536398 - DNA, 14 bp, Homo sapiens
cctagtaagaagac

SEQ ID NO: 1536399 - DNA, 17 bp, Homo sapiens
cctagtaattgcctaga

SEQ ID NO: 1536400 - DNA, 13 bp, Homo sapiens
cctagtactgccc

SEQ ID NO: 1536401 - DNA, 23 bp, Homo sapiens
cctagtagctggcgcccatccta

SEQ ID NO: 1536402 - DNA, 20 bp, Homo sapiens
cctagtattcctaacctgtc

SEQ ID NO: 1536403 - DNA, 21 bp, Homo sapiens
cctagtcccttcccctccctg

SEQ ID NO: 1536404 - DNA, 17 bp, Homo sapiens
cctagtgccccagactg

SEQ ID NO: 1536405 - DNA, 18 bp, Homo sapiens
cctagtgctattctgtgt

SEQ ID NO: 1536406 - DNA, 23 bp, Homo sapiens
cctagtgctattctgtgttgaac

SEQ ID NO: 1536407 - DNA, 20 bp, Homo sapiens
cctagtggggtctccctctc

SEQ ID NO: 1536408 - DNA, 24 bp, Homo sapiens
cctagtggggtctccctctcctgc

SEQ ID NO: 1536409 - DNA, 21 bp, Homo sapiens
cctagttcatccaatcctcac

SEQ ID NO: 1536410 - DNA, 19 bp, Homo sapiens
cctagttttctcctcccag

SEQ ID NO: 1536411 - DNA, 20 bp, Homo sapiens
cctagttttctcctcccagg

SEQ ID NO: 1536412 - DNA, 14 bp, Homo sapiens
cctataaaattaaa

SEQ ID NO: 1536413 - DNA, 18 bp, Homo sapiens
cctataaaattaaatgcc

SEQ ID NO: 1536414 - DNA, 21 bp, Homo sapiens
cctataaaattaaatgccttg

SEQ ID NO: 1536415 - DNA, 18 bp, Homo sapiens
cctataacactgtgaaga

SEQ ID NO: 1536416 - DNA, 15 bp, Homo sapiens
cctataatacaaata

SEQ ID NO: 1536417 - DNA, 16 bp, Homo sapiens
cctataatcccagcta

SEQ ID NO: 1536418 - DNA, 18 bp, Homo sapiens
cctatacctgagcctcaa

SEQ ID NO: 1536419 - DNA, 19 bp, Homo sapiens
cctatactgtagtattctt

SEQ ID NO: 1536420 - DNA, 20 bp, Homo sapiens
cctatagctacatgttcttt

SEQ ID NO: 1536421 - DNA, 16 bp, Homo sapiens
cctatatagtttattg

SEQ ID NO: 1536422 - DNA, 15 bp, Homo sapiens
cctatatctgagaga

SEQ ID NO: 1536423 - DNA, 14 bp, Homo sapiens
cctatatgtagtat

SEQ ID NO: 1536424 - DNA, 13 bp, Homo sapiens
cctatccacccag

SEQ ID NO: 1536425 - DNA, 14 bp, Homo sapiens
cctatccacccagc

SEQ ID NO: 1536426 - DNA, 21 bp, Homo sapiens
cctatccacccagcccattct

SEQ ID NO: 1536427 - DNA, 15 bp, Homo sapiens
cctatccctctccta

SEQ ID NO: 1536428 - DNA, 20 bp, Homo sapiens
cctatctccagcggccctgt

SEQ ID NO: 1536429 - DNA, 14 bp, Homo sapiens
cctatctccctggc

SEQ ID NO: 1536430 - DNA, 14 bp, Homo sapiens
cctatctcctgaca

SEQ ID NO: 1536431 - DNA, 16 bp, Homo sapiens
tgccatggcctgtgct

SEQ ID NO: 1536432 - DNA, 19 bp, Homo sapiens
tgccatggcctgtgctggg

SEQ ID NO: 1536433 - DNA, 20 bp, Homo sapiens
tgccatggtaaccagccaca

SEQ ID NO: 1536434 - DNA, 16 bp, Homo sapiens
tgccatgtgaagaggg

SEQ ID NO: 1536435 - DNA, 22 bp, Homo sapiens
tgccatgtggaaggcaagccag

SEQ ID NO: 1536436 - DNA, 13 bp, Homo sapiens
tgccatgtggcag

SEQ ID NO: 1536437 - DNA, 21 bp, Homo sapiens
tgccatgttggccaggctggt

SEQ ID NO: 1536438 - DNA, 18 bp, Homo sapiens
tgccatgttttgccaccc

SEQ ID NO: 1536439 - DNA, 22 bp, Homo sapiens
tgccattaaatccgcaaacagc

SEQ ID NO: 1536440 - DNA, 21 bp, Homo sapiens
tgccattatgcaaatggagat

SEQ ID NO: 1536441 - DNA, 19 bp, Homo sapiens
tgccattcaaggcttattt

SEQ ID NO: 1536442 - DNA, 22 bp, Homo sapiens
tgccattctcttgcattgtgac

SEQ ID NO: 1536443 - DNA, 13 bp, Homo sapiens
tgccattgggacc

SEQ ID NO: 1536444 - DNA, 19 bp, Homo sapiens
tgccattggggtagttgtg

SEQ ID NO: 1536445 - DNA, 22 bp, Homo sapiens
tgccatttaaagcttattaaaa

SEQ ID NO: 1536446 - DNA, 16 bp, Homo sapiens
tgccatttagaatcta

SEQ ID NO: 1536447 - DNA, 22 bp, Homo sapiens
tgccatttagaatctagaaatg

SEQ ID NO: 1536448 - DNA, 13 bp, Homo sapiens
tgccatttccctt

SEQ ID NO: 1536449 - DNA, 16 bp, Homo sapiens
tgccatttctctgctt

SEQ ID NO: 1536450 - DNA, 21 bp, Homo sapiens
tgccatttgcaccctccgcct

SEQ ID NO: 1536451 - DNA, 22 bp, Homo sapiens
tgccatttgcaccctccgcctt

SEQ ID NO: 1536452 - DNA, 23 bp, Homo sapiens
tgccatttttctataaatcagta

SEQ ID NO: 1536453 - DNA, 21 bp, Homo sapiens
tgcccaagaatagatgctgac

SEQ ID NO: 1536454 - DNA, 16 bp, Homo sapiens
tgcccaagccagaggc

SEQ ID NO: 1536455 - DNA, 22 bp, Homo sapiens
tgcccaagccagaggctgggtt

SEQ ID NO: 1536456 - DNA, 17 bp, Homo sapiens
tgcccaagctggagtga

SEQ ID NO: 1536457 - DNA, 16 bp, Homo sapiens
tgcccaatgctttggg

SEQ ID NO: 1536458 - DNA, 20 bp, Homo sapiens
tgcccaatgctttgggaggc

SEQ ID NO: 1536459 - DNA, 23 bp, Homo sapiens
tgcccacatcccaggcttcaccc

SEQ ID NO: 1536460 - DNA, 16 bp, Homo sapiens
tgcccacatttgggct

SEQ ID NO: 1536461 - DNA, 24 bp, Homo sapiens
tgcccaccccctcaagccaatccc

SEQ ID NO: 1536462 - DNA, 20 bp, Homo sapiens
tgcccaccccctgccctgca

SEQ ID NO: 1536463 - DNA, 19 bp, Homo sapiens
tgcccacctgcccatcaca

SEQ ID NO: 1536464 - DNA, 21 bp, Homo sapiens
tgcccacgatcccctccccca

SEQ ID NO: 1536465 - DNA, 22 bp, Homo sapiens
tgcccacgatcccctcccccaa

SEQ ID NO: 1536466 - DNA, 19 bp, Homo sapiens
tgcccacggagtcgtgggg

SEQ ID NO: 1536467 - DNA, 21 bp, Homo sapiens
tgcccactaggatcccactgg

SEQ ID NO: 1536468 - DNA, 22 bp, Homo sapiens
tgcccactaggatcccactggc

SEQ ID NO: 1536469 - DNA, 17 bp, Homo sapiens
tgcccactgcctgcctc

SEQ ID NO: 1536470 - DNA, 21 bp, Homo sapiens
tgcccactgtttctcttgagc

SEQ ID NO: 1536471 - DNA, 22 bp, Homo sapiens
tgcccacttgattgagaaagat

SEQ ID NO: 1536472 - DNA, 22 bp, Homo sapiens
tgcccagacccctctggccagg

SEQ ID NO: 1536473 - DNA, 17 bp, Homo sapiens
tgcccagactacagggc

SEQ ID NO: 1536474 - DNA, 16 bp, Homo sapiens
tgcccagagatgcctc

SEQ ID NO: 1536475 - DNA, 19 bp, Homo sapiens
tgcccagagatgcctccac

SEQ ID NO: 1536476 - DNA, 18 bp, Homo sapiens
tgcccagagggcccaggc

SEQ ID NO: 1536477 - DNA, 21 bp, Homo sapiens
tgcccagagggcccaggcagg

SEQ ID NO: 1536478 - DNA, 14 bp, Homo sapiens
tgcccagcacctgg

SEQ ID NO: 1536479 - DNA, 18 bp, Homo sapiens
tgcccagcagctcaagaa

SEQ ID NO: 1536480 - DNA, 13 bp, Homo sapiens
tgcccagcaggcc

SEQ ID NO: 1536481 - DNA, 17 bp, Homo sapiens
tgcccagcaggcccagc

SEQ ID NO: 1536482 - DNA, 14 bp, Homo sapiens
tgcccagccactcc

SEQ ID NO: 1536483 - DNA, 22 bp, Homo sapiens
tgcccagcccatttgggctctg

SEQ ID NO: 1536484 - DNA, 23 bp, Homo sapiens
tgcccagcccatttgggctctgg

SEQ ID NO: 1536485 - DNA, 12 bp, Homo sapiens
tgcccagcccct

SEQ ID NO: 1536486 - DNA, 13 bp, Homo sapiens
tgcccagcccctg

SEQ ID NO: 1536487 - DNA, 15 bp, Homo sapiens
tgcccagcccctgcc

SEQ ID NO: 1536488 - DNA, 16 bp, Homo sapiens
tgcccagcttgggccc

SEQ ID NO: 1536489 - DNA, 18 bp, Homo sapiens
tgcccagcttgggcccag

SEQ ID NO: 1536490 - DNA, 23 bp, Homo sapiens
tgcccagcttgggcccagctggg

SEQ ID NO: 1536491 - DNA, 19 bp, Homo sapiens
tgcccaggagacagaccac

SEQ ID NO: 1536492 - DNA, 20 bp, Homo sapiens
tgcccaggagagccagccct

SEQ ID NO: 1536493 - DNA, 22 bp, Homo sapiens
tgcccaggcatgaaattcttcc

SEQ ID NO: 1536494 - DNA, 18 bp, Homo sapiens
tgcccaggcctatctgga

SEQ ID NO: 1536495 - DNA, 19 bp, Homo sapiens
tgcccaggcctatctggaa

SEQ ID NO: 1536496 - DNA, 13 bp, Homo sapiens
tgcccaggcctct

SEQ ID NO: 1536497 - DNA, 22 bp, Homo sapiens
tgcccagggccactctgcctct

SEQ ID NO: 1536498 - DNA, 16 bp, Homo sapiens
tgcccagggctcagcc

SEQ ID NO: 1536499 - DNA, 23 bp, Homo sapiens
tgcccagggctcagcctggtggg

SEQ ID NO: 1536500 - DNA, 16 bp, Homo sapiens
tgcccaggggtgcccc

SEQ ID NO: 1536501 - DNA, 20 bp, Homo sapiens
tgcccaggttggagtgcagt

SEQ ID NO: 1536502 - DNA, 18 bp, Homo sapiens
tgcccagtgcaaaccact

SEQ ID NO: 1536503 - DNA, 20 bp, Homo sapiens
tgcccagtgcaaaccacttc

SEQ ID NO: 1536504 - DNA, 15 bp, Homo sapiens
tgcccagtggagcct

SEQ ID NO: 1536505 - DNA, 19 bp, Homo sapiens
tgcccagtggagcctgccg

SEQ ID NO: 1536506 - DNA, 20 bp, Homo sapiens
tgcccagtggagcctgccgc

SEQ ID NO: 1536507 - DNA, 21 bp, Homo sapiens
tgcccagtggagcctgccgcc

SEQ ID NO: 1536508 - DNA, 20 bp, Homo sapiens
tgcccagtgttgtttgtaaa

SEQ ID NO: 1536509 - DNA, 22 bp, Homo sapiens
tgcccagtgttgtttgtaaata

SEQ ID NO: 1536510 - DNA, 21 bp, Homo sapiens
tgcccatcatgtggccccacc

SEQ ID NO: 1536511 - DNA, 22 bp, Homo sapiens
tgcccatcatgtggccccaccc

SEQ ID NO: 1536512 - DNA, 22 bp, Homo sapiens
tgcccatcccagtccctcgccg

SEQ ID NO: 1536513 - DNA, 18 bp, Homo sapiens
tgcccatgagcaagccta

SEQ ID NO: 1536514 - DNA, 14 bp, Homo sapiens
tgcccatggctggg

SEQ ID NO: 1536515 - DNA, 16 bp, Homo sapiens
tgcccatgggagctgg

SEQ ID NO: 1536516 - DNA, 19 bp, Homo sapiens
tgcccatgtgtacattctg

SEQ ID NO: 1536517 - DNA, 19 bp, Homo sapiens
tgccccaagcagccagcca

SEQ ID NO: 1536518 - DNA, 21 bp, Homo sapiens
tgccccaagcagccagccagt

SEQ ID NO: 1536519 - DNA, 17 bp, Homo sapiens
tgccccaagggcccaga

SEQ ID NO: 1536520 - DNA, 18 bp, Homo sapiens
tgccccaagggcccagac

SEQ ID NO: 1536521 - DNA, 19 bp, Homo sapiens
tgccccaagggcccagacc

SEQ ID NO: 1536522 - DNA, 21 bp, Homo sapiens
tgccccaagggcccagaccct

SEQ ID NO: 1536523 - DNA, 22 bp, Homo sapiens
tgccccaagggcccagaccctg

SEQ ID NO: 1536524 - DNA, 15 bp, Homo sapiens
tgccccaagtcctca

SEQ ID NO: 1536525 - DNA, 12 bp, Homo sapiens
tgccccacccca

SEQ ID NO: 1536526 - DNA, 21 bp, Homo sapiens
tgccccaccccatccagccag

SEQ ID NO: 1536527 - DNA, 22 bp, Homo sapiens
tgccccaccccatccagccaga

SEQ ID NO: 1536528 - DNA, 15 bp, Homo sapiens
tgccccacctccccc

SEQ ID NO: 1536529 - DNA, 12 bp, Homo sapiens
tgccccacctgc

SEQ ID NO: 1536530 - DNA, 16 bp, Homo sapiens
tgccccacctgcctgg

SEQ ID NO: 1536531 - DNA, 17 bp, Homo sapiens
tgccccacctgcctggt

SEQ ID NO: 1536532 - DNA, 15 bp, Homo sapiens
tgccccactccagcc

SEQ ID NO: 1536533 - DNA, 18 bp, Homo sapiens
tgccccactccagcctgg

SEQ ID NO: 1536534 - DNA, 19 bp, Homo sapiens
tgccccactccagcctggg

SEQ ID NO: 1536535 - DNA, 18 bp, Homo sapiens
tgccccagactgagctct

SEQ ID NO: 1536536 - DNA, 19 bp, Homo sapiens
tgccccagactgagctctc

SEQ ID NO: 1536537 - DNA, 21 bp, Homo sapiens
tgccccagactgagctctcca

SEQ ID NO: 1536538 - DNA, 14 bp, Homo sapiens
tgccccagagctgt

SEQ ID NO: 1536539 - DNA, 15 bp, Homo sapiens
tgccccagagctgtt

SEQ ID NO: 1536540 - DNA, 22 bp, Homo sapiens
tgccccagaggtcgcagctacc

SEQ ID NO: 1536541 - DNA, 24 bp, Homo sapiens
tgccccagaggtcgcagctaccct

SEQ ID NO: 1536542 - DNA, 17 bp, Homo sapiens
tgccccagcgtcttgac

SEQ ID NO: 1536543 - DNA, 13 bp, Homo sapiens
tgccccagctctg

SEQ ID NO: 1536544 - DNA, 23 bp, Homo sapiens
tgccccagctctggatgaaggca

SEQ ID NO: 1536545 - DNA, 18 bp, Homo sapiens
tgaatgtggctgaagttg

SEQ ID NO: 1536546 - DNA, 14 bp, Homo sapiens
tgaatgtgtcacta

SEQ ID NO: 1536547 - DNA, 16 bp, Homo sapiens
tgaatgtgtgatgtga

SEQ ID NO: 1536548 - DNA, 16 bp, Homo sapiens
tgaatgttatatcatc

SEQ ID NO: 1536549 - DNA, 19 bp, Homo sapiens
tgaatgttatatcatcaat

SEQ ID NO: 1536550 - DNA, 22 bp, Homo sapiens
tgaatgttccaccattgctgga

SEQ ID NO: 1536551 - DNA, 11 bp, Homo sapiens
tgaattaaaac

SEQ ID NO: 1536552 - DNA, 11 bp, Homo sapiens
tgaattaaatt

SEQ ID NO: 1536553 - DNA, 16 bp, Homo sapiens
tgaattaaattaggaa

SEQ ID NO: 1536554 - DNA, 20 bp, Homo sapiens
tgaattaggctgtaactact

SEQ ID NO: 1536555 - DNA, 14 bp, Homo sapiens
tgaattataacagt

SEQ ID NO: 1536556 - DNA, 22 bp, Homo sapiens
tgaattataacagttatatttt

SEQ ID NO: 1536557 - DNA, 15 bp, Homo sapiens
tgaattatattcaat

SEQ ID NO: 1536558 - DNA, 22 bp, Homo sapiens
tgaattatccacatgaaaataa

SEQ ID NO: 1536559 - DNA, 13 bp, Homo sapiens
tgaattattgaca

SEQ ID NO: 1536560 - DNA, 16 bp, Homo sapiens
tgaattattgacactg

SEQ ID NO: 1536561 - DNA, 17 bp, Homo sapiens
tgaattattgacactga

SEQ ID NO: 1536562 - DNA, 21 bp, Homo sapiens
tgaattcactccagtcaacag

SEQ ID NO: 1536563 - DNA, 17 bp, Homo sapiens
tgaattccataatacat

SEQ ID NO: 1536564 - DNA, 15 bp, Homo sapiens
tgaattcctcctcta

SEQ ID NO: 1536565 - DNA, 23 bp, Homo sapiens
tgaattcggaactgtcctttcct

SEQ ID NO: 1536566 - DNA, 15 bp, Homo sapiens
tgaattgaaaaacaa

SEQ ID NO: 1536567 - DNA, 18 bp, Homo sapiens
tgaattgagctgcagaaa

SEQ ID NO: 1536568 - DNA, 12 bp, Homo sapiens
tgaattgataaa

SEQ ID NO: 1536569 - DNA, 13 bp, Homo sapiens
tgaattgataaaa

SEQ ID NO: 1536570 - DNA, 13 bp, Homo sapiens
tgaattgctttat

SEQ ID NO: 1536571 - DNA, 16 bp, Homo sapiens
tgaattggtgaataaa

SEQ ID NO: 1536572 - DNA, 12 bp, Homo sapiens
tgaattgtacag

SEQ ID NO: 1536573 - DNA, 17 bp, Homo sapiens
tgaattgtatcaatttg

SEQ ID NO: 1536574 - DNA, 15 bp, Homo sapiens
tgaattgtccccagt

SEQ ID NO: 1536575 - DNA, 22 bp, Homo sapiens
tgaattgtgtattgatgcaata

SEQ ID NO: 1536576 - DNA, 23 bp, Homo sapiens
tgaattgtgtattgatgcaatat

SEQ ID NO: 1536577 - DNA, 14 bp, Homo sapiens
tgaatttaaataaa

SEQ ID NO: 1536578 - DNA, 15 bp, Homo sapiens
tgaatttaaatataa

SEQ ID NO: 1536579 - DNA, 16 bp, Homo sapiens
tgaatttaaatataat

SEQ ID NO: 1536580 - DNA, 21 bp, Homo sapiens
tgaatttacttccttgcatgt

SEQ ID NO: 1536581 - DNA, 18 bp, Homo sapiens
tgaatttattgatattta

SEQ ID NO: 1536582 - DNA, 13 bp, Homo sapiens
tgaatttcaggca

SEQ ID NO: 1536583 - DNA, 19 bp, Homo sapiens
tgaatttcaggcattttgt

SEQ ID NO: 1536584 - DNA, 13 bp, Homo sapiens
tgaatttctggaa

SEQ ID NO: 1536585 - DNA, 15 bp, Homo sapiens
tgaatttggagactc

SEQ ID NO: 1536586 - DNA, 17 bp, Homo sapiens
tgaatttggagactctg

SEQ ID NO: 1536587 - DNA, 13 bp, Homo sapiens
tgaattttaaagt

SEQ ID NO: 1536588 - DNA, 23 bp, Homo sapiens
tgaattttaaatctaaatctatt

SEQ ID NO: 1536589 - DNA, 18 bp, Homo sapiens
tgaattttgcaatgtatt

SEQ ID NO: 1536590 - DNA, 15 bp, Homo sapiens
tgaattttgggactt

SEQ ID NO: 1536591 - DNA, 18 bp, Homo sapiens
tgaattttgtatgctgaa

SEQ ID NO: 1536592 - DNA, 18 bp, Homo sapiens
tgaattttgttctctggg

SEQ ID NO: 1536593 - DNA, 15 bp, Homo sapiens
tgaatttttctctaa

SEQ ID NO: 1536594 - DNA, 15 bp, Homo sapiens
tgaatttttctcttc

SEQ ID NO: 1536595 - DNA, 21 bp, Homo sapiens
tgaatttttcttcctctccac

SEQ ID NO: 1536596 - DNA, 21 bp, Homo sapiens
tgaatttttttcatcttctct

SEQ ID NO: 1536597 - DNA, 16 bp, Homo sapiens
tgaattttttttaaca

SEQ ID NO: 1536598 - DNA, 17 bp, Homo sapiens
tgaattttttttaacat

SEQ ID NO: 1536599 - DNA, 19 bp, Homo sapiens
tgaatttttttttcctagc

SEQ ID NO: 1536600 - DNA, 20 bp, Homo sapiens
tgacaaacccggaagatcag

SEQ ID NO: 1536601 - DNA, 17 bp, Homo sapiens
tgacaaacgtccccagc

SEQ ID NO: 1536602 - DNA, 14 bp, Homo sapiens
tgacaaaggatgaa

SEQ ID NO: 1536603 - DNA, 15 bp, Homo sapiens
tgacaaaggatgaag

SEQ ID NO: 1536604 - DNA, 20 bp, Homo sapiens
tgacaaataaattaggacca

SEQ ID NO: 1536605 - DNA, 17 bp, Homo sapiens
tgacaaatgtttctaag

SEQ ID NO: 1536606 - DNA, 12 bp, Homo sapiens
tgacaacagaaa

SEQ ID NO: 1536607 - DNA, 17 bp, Homo sapiens
tgacaacagaaaaacaa

SEQ ID NO: 1536608 - DNA, 16 bp, Homo sapiens
tgacaaccactggtct

SEQ ID NO: 1536609 - DNA, 17 bp, Homo sapiens
tgacaaccactggtctg

SEQ ID NO: 1536610 - DNA, 17 bp, Homo sapiens
tgacaaccattaaagtc

SEQ ID NO: 1536611 - DNA, 17 bp, Homo sapiens
tgacaacctagaatgtc

SEQ ID NO: 1536612 - DNA, 13 bp, Homo sapiens
tgacaactgtgac

SEQ ID NO: 1536613 - DNA, 18 bp, Homo sapiens
tgacaacttagctcaggt

SEQ ID NO: 1536614 - DNA, 22 bp, Homo sapiens
tgacaacttagctcaggtgcct

SEQ ID NO: 1536615 - DNA, 18 bp, Homo sapiens
tgacaacttttaaagaaa

SEQ ID NO: 1536616 - DNA, 20 bp, Homo sapiens
tgacaagaataattttggaa

SEQ ID NO: 1536617 - DNA, 13 bp, Homo sapiens
tgacaagatggga

SEQ ID NO: 1536618 - DNA, 19 bp, Homo sapiens
tgacaagatggtccatttg

SEQ ID NO: 1536619 - DNA, 12 bp, Homo sapiens
tgacaagatgtt

SEQ ID NO: 1536620 - DNA, 16 bp, Homo sapiens
tgacaagcctttgtgc

SEQ ID NO: 1536621 - DNA, 22 bp, Homo sapiens
tgacaagctcctggtcttgaga

SEQ ID NO: 1536622 - DNA, 15 bp, Homo sapiens
tgacaagctgacttg

SEQ ID NO: 1536623 - DNA, 18 bp, Homo sapiens
tgacaagctgacttggca

SEQ ID NO: 1536624 - DNA, 23 bp, Homo sapiens
tgacaataaagatatttccaaga

SEQ ID NO: 1536625 - DNA, 14 bp, Homo sapiens
tgacaataaatgtg

SEQ ID NO: 1536626 - DNA, 16 bp, Homo sapiens
tgacaatattccagat

SEQ ID NO: 1536627 - DNA, 24 bp, Homo sapiens
tgacaatattccagatctttcaga

SEQ ID NO: 1536628 - DNA, 15 bp, Homo sapiens
tgacaatcaactcta

SEQ ID NO: 1536629 - DNA, 18 bp, Homo sapiens
tgacaatcaactctaata

SEQ ID NO: 1536630 - DNA, 16 bp, Homo sapiens
tgacaatggcagctag

SEQ ID NO: 1536631 - DNA, 17 bp, Homo sapiens
tgacaattctgttttta

SEQ ID NO: 1536632 - DNA, 16 bp, Homo sapiens
tgacaattttgtacaa

SEQ ID NO: 1536633 - DNA, 16 bp, Homo sapiens
tgacaattttgtctta

SEQ ID NO: 1536634 - DNA, 17 bp, Homo sapiens
tgacaattttgtcttaa

SEQ ID NO: 1536635 - DNA, 21 bp, Homo sapiens
tgacaattttgtcttaagtgt

SEQ ID NO: 1536636 - DNA, 14 bp, Homo sapiens
tgacacaaagcttc

SEQ ID NO: 1536637 - DNA, 16 bp, Homo sapiens
tgacacaaagcttcta

SEQ ID NO: 1536638 - DNA, 14 bp, Homo sapiens
tgacacaaaggtgg

SEQ ID NO: 1536639 - DNA, 18 bp, Homo sapiens
tgacacaaaggtggaata

SEQ ID NO: 1536640 - DNA, 17 bp, Homo sapiens
tgacacaagtggacctt

SEQ ID NO: 1536641 - DNA, 19 bp, Homo sapiens
tgacacacgtatttatatt

SEQ ID NO: 1536642 - DNA, 12 bp, Homo sapiens
tgacacactaac

SEQ ID NO: 1536643 - DNA, 14 bp, Homo sapiens
tgacacagacattt

SEQ ID NO: 1536644 - DNA, 15 bp, Homo sapiens
tgacacagacatttt

SEQ ID NO: 1536645 - DNA, 18 bp, Homo sapiens
tgacacagacattttgtg

SEQ ID NO: 1536646 - DNA, 21 bp, Homo sapiens
tgacacagacattttgtgtga

SEQ ID NO: 1536647 - DNA, 19 bp, Homo sapiens
tgacacaggaaatgggaaa

SEQ ID NO: 1536648 - DNA, 18 bp, Homo sapiens
tgacacatatgaacacag

SEQ ID NO: 1536649 - DNA, 22 bp, Homo sapiens
tgacacatatgcaccttgtgtc

SEQ ID NO: 1536650 - DNA, 19 bp, Homo sapiens
tgacacattaatgataaac

SEQ ID NO: 1536651 - DNA, 17 bp, Homo sapiens
tgacaccaataaatgtt

SEQ ID NO: 1536652 - DNA, 19 bp, Homo sapiens
tgacaccaataaatgtttg

SEQ ID NO: 1536653 - DNA, 20 bp, Homo sapiens
tgacaccaataaatgtttgt

SEQ ID NO: 1536654 - DNA, 21 bp, Homo sapiens
tgacaccaataaatgtttgtt

SEQ ID NO: 1536655 - DNA, 13 bp, Homo sapiens
tgacaccagcctt

SEQ ID NO: 1536656 - DNA, 19 bp, Homo sapiens
tgacaccattctcctgcct

SEQ ID NO: 1536657 - DNA, 22 bp, Homo sapiens
tgacaccccctccccgcccctg

SEQ ID NO: 1536658 - DNA, 23 bp, Homo sapiens
tgacaccccctccccgcccctgt

SEQ ID NO: 1536659 - DNA, 16 bp, Homo sapiens
tgacaccctggcctga

SEQ ID NO: 1536660 - DNA, 15 bp, Homo sapiens
tgccagctgacatct

SEQ ID NO: 1536661 - DNA, 18 bp, Homo sapiens
tgccagctgacatcttga

SEQ ID NO: 1536662 - DNA, 14 bp, Homo sapiens
tgccagctgccttc

SEQ ID NO: 1536663 - DNA, 15 bp, Homo sapiens
tgccagctgccttcc

SEQ ID NO: 1536664 - DNA, 15 bp, Homo sapiens
tgccagcttctctct

SEQ ID NO: 1536665 - DNA, 20 bp, Homo sapiens
tgccagcttctctctccagg

SEQ ID NO: 1536666 - DNA, 14 bp, Homo sapiens
tgccaggaacctgt

SEQ ID NO: 1536667 - DNA, 23 bp, Homo sapiens
tgccaggacatgcaataaaattt

SEQ ID NO: 1536668 - DNA, 13 bp, Homo sapiens
tgccaggaccagc

SEQ ID NO: 1536669 - DNA, 19 bp, Homo sapiens
tgccaggacccgccagccc

SEQ ID NO: 1536670 - DNA, 13 bp, Homo sapiens
tgccaggcacctg

SEQ ID NO: 1536671 - DNA, 17 bp, Homo sapiens
tgccaggcacctggcct

SEQ ID NO: 1536672 - DNA, 20 bp, Homo sapiens
tgccaggcacctggcctgct

SEQ ID NO: 1536673 - DNA, 23 bp, Homo sapiens
tgccaggcacctggcctgctggg

SEQ ID NO: 1536674 - DNA, 14 bp, Homo sapiens
tgccaggccagcct

SEQ ID NO: 1536675 - DNA, 17 bp, Homo sapiens
tgccaggccagcctccg

SEQ ID NO: 1536676 - DNA, 18 bp, Homo sapiens
tgccaggccagcctccga

SEQ ID NO: 1536677 - DNA, 12 bp, Homo sapiens
tgccaggcccat

SEQ ID NO: 1536678 - DNA, 23 bp, Homo sapiens
tgccaggcccatctcaggtgcca

SEQ ID NO: 1536679 - DNA, 20 bp, Homo sapiens
tgccaggcgttggtgccact

SEQ ID NO: 1536680 - DNA, 21 bp, Homo sapiens
tgccaggcgttggtgccactt

SEQ ID NO: 1536681 - DNA, 14 bp, Homo sapiens
tgccaggctgcctc

SEQ ID NO: 1536682 - DNA, 17 bp, Homo sapiens
tgccaggctgcctcctg

SEQ ID NO: 1536683 - DNA, 17 bp, Homo sapiens
tgccaggctggagtgca

SEQ ID NO: 1536684 - DNA, 19 bp, Homo sapiens
tgccaggctggagtgcagt

SEQ ID NO: 1536685 - DNA, 16 bp, Homo sapiens
tgccaggctgtttcag

SEQ ID NO: 1536686 - DNA, 16 bp, Homo sapiens
tgccagggccgaccag

SEQ ID NO: 1536687 - DNA, 14 bp, Homo sapiens
tgccaggttgcagc

SEQ ID NO: 1536688 - DNA, 19 bp, Homo sapiens
tgccaggttgcagctgctc

SEQ ID NO: 1536689 - DNA, 23 bp, Homo sapiens
tgccagtaacgcgtcttcctgag

SEQ ID NO: 1536690 - DNA, 13 bp, Homo sapiens
tgccagtattttt

SEQ ID NO: 1536691 - DNA, 15 bp, Homo sapiens
tgccagtgaagactt

SEQ ID NO: 1536692 - DNA, 16 bp, Homo sapiens
tgccagtgacacttcc

SEQ ID NO: 1536693 - DNA, 19 bp, Homo sapiens
tgccagtgacagacaggct

SEQ ID NO: 1536694 - DNA, 15 bp, Homo sapiens
tgccagtgcactccg

SEQ ID NO: 1536695 - DNA, 17 bp, Homo sapiens
tgccagtgcactccggc

SEQ ID NO: 1536696 - DNA, 20 bp, Homo sapiens
tgccagtgcactccggcctg

SEQ ID NO: 1536697 - DNA, 15 bp, Homo sapiens
tgccagtgcagccac

SEQ ID NO: 1536698 - DNA, 15 bp, Homo sapiens
tgccagtgccttacc

SEQ ID NO: 1536699 - DNA, 22 bp, Homo sapiens
tgccagtgccttacctcctgcc

SEQ ID NO: 1536700 - DNA, 23 bp, Homo sapiens
tgccagtgccttacctcctgccc

SEQ ID NO: 1536701 - DNA, 22 bp, Homo sapiens
tgccagttgaaaatggattttt

SEQ ID NO: 1536702 - DNA, 18 bp, Homo sapiens
tgccagttttccctggaa

SEQ ID NO: 1536703 - DNA, 19 bp, Homo sapiens
tgccataaatatttctcaa

SEQ ID NO: 1536704 - DNA, 15 bp, Homo sapiens
tgccatactttgtct

SEQ ID NO: 1536705 - DNA, 14 bp, Homo sapiens
tgccatagccccat

SEQ ID NO: 1536706 - DNA, 15 bp, Homo sapiens
tgccatattgtgtaa

SEQ ID NO: 1536707 - DNA, 19 bp, Homo sapiens
tgccatattgtgtaattta

SEQ ID NO: 1536708 - DNA, 19 bp, Homo sapiens
tgccatcatgcccagctaa

SEQ ID NO: 1536709 - DNA, 16 bp, Homo sapiens
tgccatcatgtttaca

SEQ ID NO: 1536710 - DNA, 14 bp, Homo sapiens
tgccatcgctgtga

SEQ ID NO: 1536711 - DNA, 22 bp, Homo sapiens
tgccatcttctccccgaggctg

SEQ ID NO: 1536712 - DNA, 15 bp, Homo sapiens
tgccatgaacaaatt

SEQ ID NO: 1536713 - DNA, 17 bp, Homo sapiens
tgccatgaacaaattct

SEQ ID NO: 1536714 - DNA, 18 bp, Homo sapiens
tgccatgaacaaattctt

SEQ ID NO: 1536715 - DNA, 19 bp, Homo sapiens
tgccatgaacaaattcttt

SEQ ID NO: 1536716 - DNA, 20 bp, Homo sapiens
tgccatgaacaaattcttta

SEQ ID NO: 1536717 - DNA, 22 bp, Homo sapiens
tgccatgaacaaattctttagt

SEQ ID NO: 1536718 - DNA, 15 bp, Homo sapiens
tgccatgatagctgg

SEQ ID NO: 1536719 - DNA, 15 bp, Homo sapiens
tgccatgcaggaaga

SEQ ID NO: 1536720 - DNA, 22 bp, Homo sapiens
tgccatgcaggaagaggcccac

SEQ ID NO: 1536721 - DNA, 14 bp, Homo sapiens
tgccatgccactgc

SEQ ID NO: 1536722 - DNA, 22 bp, Homo sapiens
tgccatgccactgccaggcacc

SEQ ID NO: 1536723 - DNA, 17 bp, Homo sapiens
tgccatgcctgctccct

SEQ ID NO: 1536724 - DNA, 19 bp, Homo sapiens
tgccatgcctgctccctgt

SEQ ID NO: 1536725 - DNA, 13 bp, Homo sapiens
tgccatgctgggc

SEQ ID NO: 1536726 - DNA, 15 bp, Homo sapiens
tgccatgctgggcca

SEQ ID NO: 1536727 - DNA, 17 bp, Homo sapiens
tgccatggatctgatct

SEQ ID NO: 1536728 - DNA, 18 bp, Homo sapiens
tgccatggatctgatctg

SEQ ID NO: 1536729 - DNA, 13 bp, Homo sapiens
tgccatggcctgt

SEQ ID NO: 1536730 - DNA, 13 bp, Homo sapiens
tggcgtctgctct

SEQ ID NO: 1536731 - DNA, 15 bp, Homo sapiens
tggcgtctgctctgg

SEQ ID NO: 1536732 - DNA, 18 bp, Homo sapiens
tggcgtctgctctggtgg

SEQ ID NO: 1536733 - DNA, 19 bp, Homo sapiens
tggcgtctgctctggtggc

SEQ ID NO: 1536734 - DNA, 21 bp, Homo sapiens
tggcgtgctcagacccaacag

SEQ ID NO: 1536735 - DNA, 13 bp, Homo sapiens
tggcgtggaggag

SEQ ID NO: 1536736 - DNA, 19 bp, Homo sapiens
tggcgttctgctgcccctg

SEQ ID NO: 1536737 - DNA, 21 bp, Homo sapiens
tggctaacctgttacactggg

SEQ ID NO: 1536738 - DNA, 22 bp, Homo sapiens
tggctaagaccacagacgggca

SEQ ID NO: 1536739 - DNA, 11 bp, Homo sapiens
tggctaataaa

SEQ ID NO: 1536740 - DNA, 19 bp, Homo sapiens
tggctaataaactgtatta

SEQ ID NO: 1536741 - DNA, 22 bp, Homo sapiens
tggctaataaactgtattaaat

SEQ ID NO: 1536742 - DNA, 16 bp, Homo sapiens
tggctaatttaacacc

SEQ ID NO: 1536743 - DNA, 14 bp, Homo sapiens
tggctacagtacca

SEQ ID NO: 1536744 - DNA, 18 bp, Homo sapiens
tggctacatcccagcctg

SEQ ID NO: 1536745 - DNA, 15 bp, Homo sapiens
tggctacgcctcttc

SEQ ID NO: 1536746 - DNA, 18 bp, Homo sapiens
tggctacgcctcttctgt

SEQ ID NO: 1536747 - DNA, 19 bp, Homo sapiens
tggctacgcctcttctgtc

SEQ ID NO: 1536748 - DNA, 21 bp, Homo sapiens
tggctacgttttggttctatg

SEQ ID NO: 1536749 - DNA, 18 bp, Homo sapiens
tggctacttcccttcctc

SEQ ID NO: 1536750 - DNA, 22 bp, Homo sapiens
tggctagaggccagccccaccc

SEQ ID NO: 1536751 - DNA, 16 bp, Homo sapiens
tggctagagtcctcac

SEQ ID NO: 1536752 - DNA, 16 bp, Homo sapiens
tggctagtcagagaga

SEQ ID NO: 1536753 - DNA, 19 bp, Homo sapiens
tggctagtggggtgaacag

SEQ ID NO: 1536754 - DNA, 22 bp, Homo sapiens
tggctataacatgtctttcagc

SEQ ID NO: 1536755 - DNA, 15 bp, Homo sapiens
tggctataggtgcta

SEQ ID NO: 1536756 - DNA, 19 bp, Homo sapiens
tggctataggtgctacaaa

SEQ ID NO: 1536757 - DNA, 19 bp, Homo sapiens
tggctcaagacaaggctgg

SEQ ID NO: 1536758 - DNA, 17 bp, Homo sapiens
tggctcaagtagaaaag

SEQ ID NO: 1536759 - DNA, 18 bp, Homo sapiens
tggctcaagtagaaaagc

SEQ ID NO: 1536760 - DNA, 16 bp, Homo sapiens
tggctcaatcctctaa

SEQ ID NO: 1536761 - DNA, 17 bp, Homo sapiens
tggctcacaaggcccag

SEQ ID NO: 1536762 - DNA, 12 bp, Homo sapiens
tggctcacactg

SEQ ID NO: 1536763 - DNA, 16 bp, Homo sapiens
tggctcacactgagaa

SEQ ID NO: 1536764 - DNA, 20 bp, Homo sapiens
tggctcacagtggggccagc

SEQ ID NO: 1536765 - DNA, 13 bp, Homo sapiens
tggctcactactg

SEQ ID NO: 1536766 - DNA, 18 bp, Homo sapiens
tggctcagacatgttttc

SEQ ID NO: 1536767 - DNA, 24 bp, Homo sapiens
tggctcagctcggggagccttagc

SEQ ID NO: 1536768 - DNA, 20 bp, Homo sapiens
tggctccactcttgatctct

SEQ ID NO: 1536769 - DNA, 16 bp, Homo sapiens
tggctcccaaggttcc

SEQ ID NO: 1536770 - DNA, 13 bp, Homo sapiens
tggctcccaggac

SEQ ID NO: 1536771 - DNA, 15 bp, Homo sapiens
tggctcccaggacac

SEQ ID NO: 1536772 - DNA, 14 bp, Homo sapiens
tggctcccatgacc

SEQ ID NO: 1536773 - DNA, 15 bp, Homo sapiens
tggctccctcctcca

SEQ ID NO: 1536774 - DNA, 15 bp, Homo sapiens
tggctccctgggcag

SEQ ID NO: 1536775 - DNA, 15 bp, Homo sapiens
tggctccggcctctg

SEQ ID NO: 1536776 - DNA, 18 bp, Homo sapiens
tggctccggcctctgcct

SEQ ID NO: 1536777 - DNA, 20 bp, Homo sapiens
tggctcctgaggggcatctg

SEQ ID NO: 1536778 - DNA, 22 bp, Homo sapiens
tggctcgcagggtgcaggagcg

SEQ ID NO: 1536779 - DNA, 23 bp, Homo sapiens
tggctcgctccctgtagctctgc

SEQ ID NO: 1536780 - DNA, 21 bp, Homo sapiens
tggctcggggtaaaaagtggc

SEQ ID NO: 1536781 - DNA, 13 bp, Homo sapiens
tggctctaccctg

SEQ ID NO: 1536782 - DNA, 19 bp, Homo sapiens
tggctctaccctgtctgtc

SEQ ID NO: 1536783 - DNA, 13 bp, Homo sapiens
tggctctcagagg

SEQ ID NO: 1536784 - DNA, 13 bp, Homo sapiens
tggctctccaagt

SEQ ID NO: 1536785 - DNA, 17 bp, Homo sapiens
tggctctcccatttcct

SEQ ID NO: 1536786 - DNA, 19 bp, Homo sapiens
tggctctgccccctccccc

SEQ ID NO: 1536787 - DNA, 15 bp, Homo sapiens
tggctctttcagaga

SEQ ID NO: 1536788 - DNA, 16 bp, Homo sapiens
tggctgaaaatgcaaa

SEQ ID NO: 1536789 - DNA, 17 bp, Homo sapiens
tggctgaaaatgcaaag

SEQ ID NO: 1536790 - DNA, 22 bp, Homo sapiens
tggctgaaattctcctggaggt

SEQ ID NO: 1536791 - DNA, 23 bp, Homo sapiens
tggctgaaccctgtgctggtgtc

SEQ ID NO: 1536792 - DNA, 18 bp, Homo sapiens
tggctgaagaatgaagac

SEQ ID NO: 1536793 - DNA, 16 bp, Homo sapiens
tggctgaagctggagc

SEQ ID NO: 1536794 - DNA, 17 bp, Homo sapiens
tggctgaagctggagca

SEQ ID NO: 1536795 - DNA, 18 bp, Homo sapiens
tggctgaagctggagcag

SEQ ID NO: 1536796 - DNA, 18 bp, Homo sapiens
tggctgacatgaagctgt

SEQ ID NO: 1536797 - DNA, 15 bp, Homo sapiens
tggctgacccagtcc

SEQ ID NO: 1536798 - DNA, 16 bp, Homo sapiens
tggctgacccctctgg

SEQ ID NO: 1536799 - DNA, 20 bp, Homo sapiens
tggctgacttacatcatgtg

SEQ ID NO: 1536800 - DNA, 17 bp, Homo sapiens
tggctgagcccctgggg

SEQ ID NO: 1536801 - DNA, 20 bp, Homo sapiens
tggctgagcccctggggaaa

SEQ ID NO: 1536802 - DNA, 20 bp, Homo sapiens
tggctgaggatttcaagcct

SEQ ID NO: 1536803 - DNA, 17 bp, Homo sapiens
cctggagttttgatttg

SEQ ID NO: 1536804 - DNA, 16 bp, Homo sapiens
cctggatctaccagca

SEQ ID NO: 1536805 - DNA, 20 bp, Homo sapiens
cctggatctatccctgcggc

SEQ ID NO: 1536806 - DNA, 20 bp, Homo sapiens
cctggatgagaaacagctca

SEQ ID NO: 1536807 - DNA, 13 bp, Homo sapiens
cctggatgccaag

SEQ ID NO: 1536808 - DNA, 15 bp, Homo sapiens
cctggatgctgttga

SEQ ID NO: 1536809 - DNA, 16 bp, Homo sapiens
cctggatgggcattgg

SEQ ID NO: 1536810 - DNA, 14 bp, Homo sapiens
cctggatgggggtg

SEQ ID NO: 1536811 - DNA, 22 bp, Homo sapiens
cctggatgtcccctgtcccacc

SEQ ID NO: 1536812 - DNA, 17 bp, Homo sapiens
cctggatgtgtggggca

SEQ ID NO: 1536813 - DNA, 18 bp, Homo sapiens
cctggatgtgtggggcat

SEQ ID NO: 1536814 - DNA, 21 bp, Homo sapiens
cctggatgtgtggggcatggt

SEQ ID NO: 1536815 - DNA, 23 bp, Homo sapiens
cctggattccagcagtgaatgct

SEQ ID NO: 1536816 - DNA, 23 bp, Homo sapiens
cctggcaagaaagcttgagtctc

SEQ ID NO: 1536817 - DNA, 12 bp, Homo sapiens
cctggcacacat

SEQ ID NO: 1536818 - DNA, 15 bp, Homo sapiens
cctggcacacatcag

SEQ ID NO: 1536819 - DNA, 18 bp, Homo sapiens
cctggcacaggactgatt

SEQ ID NO: 1536820 - DNA, 16 bp, Homo sapiens
cctggcacagggcagt

SEQ ID NO: 1536821 - DNA, 13 bp, Homo sapiens
cctggcacctgtg

SEQ ID NO: 1536822 - DNA, 21 bp, Homo sapiens
cctggcacgccctactccact

SEQ ID NO: 1536823 - DNA, 18 bp, Homo sapiens
cctggcacggtggctcag

SEQ ID NO: 1536824 - DNA, 12 bp, Homo sapiens
cctggcagacac

SEQ ID NO: 1536825 - DNA, 13 bp, Homo sapiens
cctggcagacaca

SEQ ID NO: 1536826 - DNA, 13 bp, Homo sapiens
cctggcagcagca

SEQ ID NO: 1536827 - DNA, 16 bp, Homo sapiens
cctggcagcagcaggt

SEQ ID NO: 1536828 - DNA, 21 bp, Homo sapiens
cctggcagccgtgccttcagc

SEQ ID NO: 1536829 - DNA, 14 bp, Homo sapiens
cctggcagcctgct

SEQ ID NO: 1536830 - DNA, 16 bp, Homo sapiens
cctggcagcctgctgc

SEQ ID NO: 1536831 - DNA, 12 bp, Homo sapiens
cctggcagctct

SEQ ID NO: 1536832 - DNA, 13 bp, Homo sapiens
cctggcagctctg

SEQ ID NO: 1536833 - DNA, 15 bp, Homo sapiens
cctggcagctctgga

SEQ ID NO: 1536834 - DNA, 20 bp, Homo sapiens
cctggcagctctggacagcc

SEQ ID NO: 1536835 - DNA, 21 bp, Homo sapiens
cctggcagctctggacagccc

SEQ ID NO: 1536836 - DNA, 17 bp, Homo sapiens
cctggcaggatgaccct

SEQ ID NO: 1536837 - DNA, 21 bp, Homo sapiens
cctggcagtccgtgggacggg

SEQ ID NO: 1536838 - DNA, 23 bp, Homo sapiens
cctggcatcgcaccattctgact

SEQ ID NO: 1536839 - DNA, 15 bp, Homo sapiens
cctggcatcttctgg

SEQ ID NO: 1536840 - DNA, 15 bp, Homo sapiens
cctggcatggcacct

SEQ ID NO: 1536841 - DNA, 21 bp, Homo sapiens
cctggccaatgcggcccactt

SEQ ID NO: 1536842 - DNA, 13 bp, Homo sapiens
cctggccacctct

SEQ ID NO: 1536843 - DNA, 14 bp, Homo sapiens
cctggccacctctc

SEQ ID NO: 1536844 - DNA, 15 bp, Homo sapiens
cctggccacctctct

SEQ ID NO: 1536845 - DNA, 20 bp, Homo sapiens
cctgggaaccactcccacca

SEQ ID NO: 1536846 - DNA, 21 bp, Homo sapiens
cctgggaaggagggagctgct

SEQ ID NO: 1536847 - DNA, 18 bp, Homo sapiens
cctgggaaggccacctcc

SEQ ID NO: 1536848 - DNA, 12 bp, Homo sapiens
cctgggacccag

SEQ ID NO: 1536849 - DNA, 13 bp, Homo sapiens
cctgggacccagc

SEQ ID NO: 1536850 - DNA, 23 bp, Homo sapiens
cctgggacccagctactctgtcc

SEQ ID NO: 1536851 - DNA, 15 bp, Homo sapiens
cctgggactcccagt

SEQ ID NO: 1536852 - DNA, 18 bp, Homo sapiens
cctgggactcccagtgaa

SEQ ID NO: 1536853 - DNA, 18 bp, Homo sapiens
cctgggacttccatgcct

SEQ ID NO: 1536854 - DNA, 22 bp, Homo sapiens
cctgggagaaggtctccaaggg

SEQ ID NO: 1536855 - DNA, 20 bp, Homo sapiens
cctgggagccagtcctccac

SEQ ID NO: 1536856 - DNA, 15 bp, Homo sapiens
cctgggagcgcctga

SEQ ID NO: 1536857 - DNA, 18 bp, Homo sapiens
cctgggagcgcctgaccc

SEQ ID NO: 1536858 - DNA, 20 bp, Homo sapiens
cctgggaggcagaggttgca

SEQ ID NO: 1536859 - DNA, 20 bp, Homo sapiens
cctgggagggaggtggtcct

SEQ ID NO: 1536860 - DNA, 19 bp, Homo sapiens
cctgggagggttcccctgg

SEQ ID NO: 1536861 - DNA, 23 bp, Homo sapiens
cctgggagggttcccctggcctt

SEQ ID NO: 1536862 - DNA, 18 bp, Homo sapiens
cctgggatgggctcccac

SEQ ID NO: 1536863 - DNA, 17 bp, Homo sapiens
cctgggcaaacagagct

SEQ ID NO: 1536864 - DNA, 22 bp, Homo sapiens
cctgggcacccacctccacccc

SEQ ID NO: 1536865 - DNA, 21 bp, Homo sapiens
cctgggcaccgggaccccctc

SEQ ID NO: 1536866 - DNA, 19 bp, Homo sapiens
cctgggcactccgcgccga

SEQ ID NO: 1536867 - DNA, 22 bp, Homo sapiens
cctgggcagagggcctggacct

SEQ ID NO: 1536868 - DNA, 23 bp, Homo sapiens
cctgggcagccaggctgccaagg

SEQ ID NO: 1536869 - DNA, 22 bp, Homo sapiens
cctgggcagggatgatggcaga

SEQ ID NO: 1536870 - DNA, 20 bp, Homo sapiens
cctgggcaggtgggagctga

SEQ ID NO: 1536871 - DNA, 20 bp, Homo sapiens
cctgggcatcttctggcttg

SEQ ID NO: 1536872 - DNA, 20 bp, Homo sapiens
cctgggcatgggtccagggc

SEQ ID NO: 1536873 - DNA, 15 bp, Homo sapiens
cctgggcattgcttt

SEQ ID NO: 1536874 - DNA, 15 bp, Homo sapiens
cctgggccacacctg

SEQ ID NO: 1536875 - DNA, 15 bp, Homo sapiens
cctgggccctgggct

SEQ ID NO: 1536876 - DNA, 13 bp, Homo sapiens
cctgggccgctgc

SEQ ID NO: 1536877 - DNA, 21 bp, Homo sapiens
cctgggccggctgagtggcag

SEQ ID NO: 1536878 - DNA, 13 bp, Homo sapiens
cctgggcctcatg

SEQ ID NO: 1536879 - DNA, 16 bp, Homo sapiens
cctgggcctcatggct

SEQ ID NO: 1536880 - DNA, 17 bp, Homo sapiens
cctgggcctcctgggaa

SEQ ID NO: 1536881 - DNA, 18 bp, Homo sapiens
cctgggcctcctgggaag

SEQ ID NO: 1536882 - DNA, 16 bp, Homo sapiens
cctgggcctgcccctg

SEQ ID NO: 1536883 - DNA, 12 bp, Homo sapiens
cctgggcctgtc

SEQ ID NO: 1536884 - DNA, 20 bp, Homo sapiens
cctgggcctgtcccccaagg

SEQ ID NO: 1536885 - DNA, 19 bp, Homo sapiens
cctgggcctttgcaagatg

SEQ ID NO: 1536886 - DNA, 15 bp, Homo sapiens
cctgggcgagcccct

SEQ ID NO: 1536887 - DNA, 18 bp, Homo sapiens
cctgggcgagcccctcct

SEQ ID NO: 1536888 - DNA, 13 bp, Homo sapiens
cctgggcgccctg

SEQ ID NO: 1536889 - DNA, 16 bp, Homo sapiens
cctgggcgccctggaa

SEQ ID NO: 1536890 - DNA, 17 bp, Homo sapiens
cctgggcgccctggaag

SEQ ID NO: 1536891 - DNA, 22 bp, Homo sapiens
cctgggcggagtccccggggtt

SEQ ID NO: 1536892 - DNA, 18 bp, Homo sapiens
cctgggctaccatctgca

SEQ ID NO: 1536893 - DNA, 19 bp, Homo sapiens
cctgggctaccatctgcat

SEQ ID NO: 1536894 - DNA, 19 bp, Homo sapiens
cctgggctattgctgctgc

SEQ ID NO: 1536895 - DNA, 16 bp, Homo sapiens
cctgggctcactgtgc

SEQ ID NO: 1536896 - DNA, 18 bp, Homo sapiens
cctgggctccacacagca

SEQ ID NO: 1536897 - DNA, 20 bp, Homo sapiens
cctgggctccacacagcagt

SEQ ID NO: 1536898 - DNA, 23 bp, Homo sapiens
cctgggctccacacagcagtgtc

SEQ ID NO: 1536899 - DNA, 24 bp, Homo sapiens
cctgggctctcacccagtccccac

SEQ ID NO: 1536900 - DNA, 14 bp, Homo sapiens
cctgggctctgccc

SEQ ID NO: 1536901 - DNA, 13 bp, Homo sapiens
cctgggctgatgg

SEQ ID NO: 1536902 - DNA, 17 bp, Homo sapiens
cctgggctggggaggag

SEQ ID NO: 1536903 - DNA, 22 bp, Homo sapiens
cctgggctggggaggaggagag

SEQ ID NO: 1536904 - DNA, 14 bp, Homo sapiens
cctgggctgttggc

SEQ ID NO: 1536905 - DNA, 23 bp, Homo sapiens
cctgggctgttggcactcacaga

SEQ ID NO: 1536906 - DNA, 15 bp, Homo sapiens
cctgggcttggcctg

SEQ ID NO: 1536907 - DNA, 17 bp, Homo sapiens
cctgggcttggcctgct

SEQ ID NO: 1536908 - DNA, 20 bp, Homo sapiens
cctgggcttggcctgctgtg

SEQ ID NO: 1536909 - DNA, 16 bp, Homo sapiens
cctggggatcttccca

SEQ ID NO: 1536910 - DNA, 21 bp, Homo sapiens
cctggggatgtaaccaagctg

SEQ ID NO: 1536911 - DNA, 21 bp, Homo sapiens
cctggggcctccagaagctgc

SEQ ID NO: 1536912 - DNA, 12 bp, Homo sapiens
cctggggcctcg

SEQ ID NO: 1536913 - DNA, 13 bp, Homo sapiens
cctggggcctctt

SEQ ID NO: 1536914 - DNA, 13 bp, Homo sapiens
cctggggcctgac

SEQ ID NO: 1536915 - DNA, 14 bp, Homo sapiens
cctggggcctgact

SEQ ID NO: 1536916 - DNA, 18 bp, Homo sapiens
cctggggcctgactgctc

SEQ ID NO: 1536917 - DNA, 20 bp, Homo sapiens
cctggggctccctctctggt

SEQ ID NO: 1536918 - DNA, 16 bp, Homo sapiens
cctggggctcctttct

SEQ ID NO: 1536919 - DNA, 15 bp, Homo sapiens
cctggggctctgtgc

SEQ ID NO: 1536920 - DNA, 23 bp, Homo sapiens
cctggggctgagtctccagggcc

SEQ ID NO: 1536921 - DNA, 17 bp, Homo sapiens
cctggggcttctcctga

SEQ ID NO: 1536922 - DNA, 20 bp, Homo sapiens
tgggaaccccttcatcctct

SEQ ID NO: 1536923 - DNA, 23 bp, Homo sapiens
tgggaacctagtactctctgctc

SEQ ID NO: 1536924 - DNA, 16 bp, Homo sapiens
tgggaagaccaaagga

SEQ ID NO: 1536925 - DNA, 22 bp, Homo sapiens
tgggaagaccaaaggaaggaac

SEQ ID NO: 1536926 - DNA, 13 bp, Homo sapiens
tgggaagactcag

SEQ ID NO: 1536927 - DNA, 21 bp, Homo sapiens
tgggaagactcaggagtctgc

SEQ ID NO: 1536928 - DNA, 20 bp, Homo sapiens
tgggaagataggctctgcac

SEQ ID NO: 1536929 - DNA, 21 bp, Homo sapiens
tgggaagctgtactcagagca

SEQ ID NO: 1536930 - DNA, 19 bp, Homo sapiens
tgggaagcttgagcctccc

SEQ ID NO: 1536931 - DNA, 20 bp, Homo sapiens
tgggaaggagggagctgctc

SEQ ID NO: 1536932 - DNA, 17 bp, Homo sapiens
tgggaaggccggcagcg

SEQ ID NO: 1536933 - DNA, 13 bp, Homo sapiens
tgggaagggagag

SEQ ID NO: 1536934 - DNA, 18 bp, Homo sapiens
tgggaagggagagggcct

SEQ ID NO: 1536935 - DNA, 21 bp, Homo sapiens
tgggaaggttagaaaggcagc

SEQ ID NO: 1536936 - DNA, 18 bp, Homo sapiens
tgggaagtcgaggctgca

SEQ ID NO: 1536937 - DNA, 17 bp, Homo sapiens
tgggaagtgtgtttaga

SEQ ID NO: 1536938 - DNA, 16 bp, Homo sapiens
tgggaataattgcttt

SEQ ID NO: 1536939 - DNA, 13 bp, Homo sapiens
tgggaatgggaga

SEQ ID NO: 1536940 - DNA, 14 bp, Homo sapiens
tgggaatgggagag

SEQ ID NO: 1536941 - DNA, 15 bp, Homo sapiens
tgggaatgggagagg

SEQ ID NO: 1536942 - DNA, 13 bp, Homo sapiens
tgggaattgtgtg

SEQ ID NO: 1536943 - DNA, 21 bp, Homo sapiens
tgggacacctgggagaaggtc

SEQ ID NO: 1536944 - DNA, 22 bp, Homo sapiens
tgggacactgggcagcaaggct

SEQ ID NO: 1536945 - DNA, 16 bp, Homo sapiens
tgggacagggcatggc

SEQ ID NO: 1536946 - DNA, 16 bp, Homo sapiens
tgggacatagccagca

SEQ ID NO: 1536947 - DNA, 12 bp, Homo sapiens
tgggaccagagc

SEQ ID NO: 1536948 - DNA, 13 bp, Homo sapiens
tgggaccagagcc

SEQ ID NO: 1536949 - DNA, 14 bp, Homo sapiens
tgggacccacctcc

SEQ ID NO: 1536950 - DNA, 17 bp, Homo sapiens
tgggacccacctccccc

SEQ ID NO: 1536951 - DNA, 21 bp, Homo sapiens
tgggacccatagatcttctga

SEQ ID NO: 1536952 - DNA, 14 bp, Homo sapiens
tgggacccccgtgg

SEQ ID NO: 1536953 - DNA, 21 bp, Homo sapiens
tgggacccgaggatttctggg

SEQ ID NO: 1536954 - DNA, 13 bp, Homo sapiens
tgggaccctccag

SEQ ID NO: 1536955 - DNA, 20 bp, Homo sapiens
tgggaccctccagtgctgga

SEQ ID NO: 1536956 - DNA, 21 bp, Homo sapiens
tgggaccctccagtgctggat

SEQ ID NO: 1536957 - DNA, 23 bp, Homo sapiens
tgggacctcagttttatcatttt

SEQ ID NO: 1536958 - DNA, 19 bp, Homo sapiens
tgggacctgccaggcaggg

SEQ ID NO: 1536959 - DNA, 16 bp, Homo sapiens
tgggcaccccactgca

SEQ ID NO: 1536960 - DNA, 16 bp, Homo sapiens
tgggcaccgggacccc

SEQ ID NO: 1536961 - DNA, 21 bp, Homo sapiens
tgggcactccgcgccgatgcc

SEQ ID NO: 1536962 - DNA, 14 bp, Homo sapiens
tgggcactggtggg

SEQ ID NO: 1536963 - DNA, 12 bp, Homo sapiens
tgggcagagctg

SEQ ID NO: 1536964 - DNA, 17 bp, Homo sapiens
tgggcagattttcagca

SEQ ID NO: 1536965 - DNA, 15 bp, Homo sapiens
tgggcagccaggctg

SEQ ID NO: 1536966 - DNA, 15 bp, Homo sapiens
tgggcagcccaacag

SEQ ID NO: 1536967 - DNA, 19 bp, Homo sapiens
tgggcagctgtcccttgct

SEQ ID NO: 1536968 - DNA, 16 bp, Homo sapiens
tgggcagcttgagagg

SEQ ID NO: 1536969 - DNA, 20 bp, Homo sapiens
tgggcaggaggccccaggct

SEQ ID NO: 1536970 - DNA, 23 bp, Homo sapiens
tgggcaggatctcaagccagccc

SEQ ID NO: 1536971 - DNA, 11 bp, Homo sapiens
tgggcaggtgg

SEQ ID NO: 1536972 - DNA, 22 bp, Homo sapiens
tgggcaggtggccgcccctgag

SEQ ID NO: 1536973 - DNA, 16 bp, Homo sapiens
tgggcaggtgggagct

SEQ ID NO: 1536974 - DNA, 14 bp, Homo sapiens
tgggcaggtggtgg

SEQ ID NO: 1536975 - DNA, 15 bp, Homo sapiens
tgggcaggtggtggc

SEQ ID NO: 1536976 - DNA, 22 bp, Homo sapiens
tgggcagtgtggcctcttggct

SEQ ID NO: 1536977 - DNA, 19 bp, Homo sapiens
tgggcatactttctctcta

SEQ ID NO: 1536978 - DNA, 15 bp, Homo sapiens
tgggcatagtcagtg

SEQ ID NO: 1536979 - DNA, 19 bp, Homo sapiens
tgggcatccacccagtgct

SEQ ID NO: 1536980 - DNA, 21 bp, Homo sapiens
tgggcatccacccagtgctgc

SEQ ID NO: 1536981 - DNA, 23 bp, Homo sapiens
tgggcatccacccagtgctgcca

SEQ ID NO: 1536982 - DNA, 16 bp, Homo sapiens
tgggcatcttctggct

SEQ ID NO: 1536983 - DNA, 13 bp, Homo sapiens
tgggcatcttttg

SEQ ID NO: 1536984 - DNA, 19 bp, Homo sapiens
tgggcatgccatgtctgag

SEQ ID NO: 1536985 - DNA, 13 bp, Homo sapiens
tgggcattgcttt

SEQ ID NO: 1536986 - DNA, 15 bp, Homo sapiens
tgggcattgctttcc

SEQ ID NO: 1536987 - DNA, 13 bp, Homo sapiens
tgggcattgggct

SEQ ID NO: 1536988 - DNA, 16 bp, Homo sapiens
tgggcattgggctgac

SEQ ID NO: 1536989 - DNA, 14 bp, Homo sapiens
tgggcatttcaatc

SEQ ID NO: 1536990 - DNA, 16 bp, Homo sapiens
tgggcatttggtgaga

SEQ ID NO: 1536991 - DNA, 16 bp, Homo sapiens
tgggccaactcacctg

SEQ ID NO: 1536992 - DNA, 16 bp, Homo sapiens
tgggccaagagccgcc

SEQ ID NO: 1536993 - DNA, 18 bp, Homo sapiens
tgggccaaggtgtttcca

SEQ ID NO: 1536994 - DNA, 15 bp, Homo sapiens
tgggccactggggac

SEQ ID NO: 1536995 - DNA, 23 bp, Homo sapiens
tgggccactggggactttattta

SEQ ID NO: 1536996 - DNA, 22 bp, Homo sapiens
tgggccacttctgggtggggca

SEQ ID NO: 1536997 - DNA, 21 bp, Homo sapiens
tgggccagaagtaccagacta

SEQ ID NO: 1536998 - DNA, 13 bp, Homo sapiens
tgggccagagaag

SEQ ID NO: 1536999 - DNA, 11 bp, Homo sapiens
tgggccagagc

SEQ ID NO: 1537000 - DNA, 13 bp, Homo sapiens
tgggccagccctg

SEQ ID NO: 1537001 - DNA, 21 bp, Homo sapiens
tgggccagccctgcagcccaa

SEQ ID NO: 1537002 - DNA, 14 bp, Homo sapiens
tgggccaggacagg

SEQ ID NO: 1537003 - DNA, 17 bp, Homo sapiens
tgggccaggacaggccc

SEQ ID NO: 1537004 - DNA, 18 bp, Homo sapiens
tgggccaggacaggcccg

SEQ ID NO: 1537005 - DNA, 17 bp, Homo sapiens
tgggccagtccccgagg

SEQ ID NO: 1537006 - DNA, 18 bp, Homo sapiens
tgggccagtccccgagga

SEQ ID NO: 1537007 - DNA, 19 bp, Homo sapiens
tgggccatgtccaaagagg

SEQ ID NO: 1537008 - DNA, 23 bp, Homo sapiens
tgggccatgtccaaagaggctgc

SEQ ID NO: 1537009 - DNA, 22 bp, Homo sapiens
tgggcccaagacagatgcccca

SEQ ID NO: 1537010 - DNA, 23 bp, Homo sapiens
tgggcccaagacagatgccccag

SEQ ID NO: 1537011 - DNA, 14 bp, Homo sapiens
tgggcccagatctg

SEQ ID NO: 1537012 - DNA, 13 bp, Homo sapiens
tgggcccagctgg

SEQ ID NO: 1537013 - DNA, 15 bp, Homo sapiens
tgggcccagctgggc

SEQ ID NO: 1537014 - DNA, 20 bp, Homo sapiens
tgggcccagctgggctctgc

SEQ ID NO: 1537015 - DNA, 18 bp, Homo sapiens
tgggcccaggaccagctg

SEQ ID NO: 1537016 - DNA, 22 bp, Homo sapiens
tgggcccaggaccagctggggc

SEQ ID NO: 1537017 - DNA, 13 bp, Homo sapiens
tgggcccaggcag

SEQ ID NO: 1537018 - DNA, 15 bp, Homo sapiens
tgggcccaggcaggt

SEQ ID NO: 1537019 - DNA, 22 bp, Homo sapiens
tgggcccataatagttagccct

SEQ ID NO: 1537020 - DNA, 17 bp, Homo sapiens
tgggccccaccacctag

SEQ ID NO: 1537021 - DNA, 23 bp, Homo sapiens
tgggccccaccacctaggccact

SEQ ID NO: 1537022 - DNA, 14 bp, Homo sapiens
tgggccccacctac

SEQ ID NO: 1537023 - DNA, 18 bp, Homo sapiens
tgggccccatgctctgcc

SEQ ID NO: 1537024 - DNA, 19 bp, Homo sapiens
tgggccccatgctctgccc

SEQ ID NO: 1537025 - DNA, 21 bp, Homo sapiens
tgggccccatgctctgcccca

SEQ ID NO: 1537026 - DNA, 14 bp, Homo sapiens
tgggcccccagcct

SEQ ID NO: 1537027 - DNA, 15 bp, Homo sapiens
tgggcccctgaggag

SEQ ID NO: 1537028 - DNA, 13 bp, Homo sapiens
tgggcccctgcac

SEQ ID NO: 1537029 - DNA, 23 bp, Homo sapiens
tgggcccctggccccgcctgcct

SEQ ID NO: 1537030 - DNA, 22 bp, Homo sapiens
tgggcccggagtaatcaggcag

SEQ ID NO: 1537031 - DNA, 13 bp, Homo sapiens
tgggccctctctc

SEQ ID NO: 1537032 - DNA, 18 bp, Homo sapiens
tgggccctctctctgggc

SEQ ID NO: 1537033 - DNA, 19 bp, Homo sapiens
tgggccctctttccctgcg

SEQ ID NO: 1537034 - DNA, 23 bp, Homo sapiens
tgggccctctttccctgcgagac

SEQ ID NO: 1537035 - DNA, 18 bp, Homo sapiens
tgggccctgagtcctggt

SEQ ID NO: 1537036 - DNA, 14 bp, Homo sapiens
tgggccctgcacag

SEQ ID NO: 1537037 - DNA, 19 bp, Homo sapiens
tgggccctgcattggcctg

SEQ ID NO: 1537038 - DNA, 21 bp, Homo sapiens
tgggccctgcattggcctggc

SEQ ID NO: 1537039 - DNA, 15 bp, Homo sapiens
tgggccctgggctga

SEQ ID NO: 1537040 - DNA, 16 bp, Homo sapiens
tgggccctgggctgga

SEQ ID NO: 1537041 - DNA, 13 bp, Homo sapiens
tggaggttctaag

SEQ ID NO: 1537042 - DNA, 21 bp, Homo sapiens
tggaggttgcagtgagccaag

SEQ ID NO: 1537043 - DNA, 15 bp, Homo sapiens
tggagtacttagcta

SEQ ID NO: 1537044 - DNA, 18 bp, Homo sapiens
tggagtccagctctacta

SEQ ID NO: 1537045 - DNA, 21 bp, Homo sapiens
tggagtcccaggggcagccac

SEQ ID NO: 1537046 - DNA, 23 bp, Homo sapiens
tggagtcccaggggcagccacac

SEQ ID NO: 1537047 - DNA, 14 bp, Homo sapiens
tggagtcccctcac

SEQ ID NO: 1537048 - DNA, 15 bp, Homo sapiens
tggagtcccctcacc

SEQ ID NO: 1537049 - DNA, 19 bp, Homo sapiens
tggagtcccctcacctcct

SEQ ID NO: 1537050 - DNA, 20 bp, Homo sapiens
tggagtcccctcacctcctc

SEQ ID NO: 1537051 - DNA, 15 bp, Homo sapiens
tggagtcccctcctc

SEQ ID NO: 1537052 - DNA, 18 bp, Homo sapiens
tggagtctcagagcacag

SEQ ID NO: 1537053 - DNA, 21 bp, Homo sapiens
tggagtcttttctgttattgt

SEQ ID NO: 1537054 - DNA, 20 bp, Homo sapiens
tggagtgagtcacctgctcc

SEQ ID NO: 1537055 - DNA, 19 bp, Homo sapiens
tggagtgcagggaggagag

SEQ ID NO: 1537056 - DNA, 22 bp, Homo sapiens
tggagtgcgctcttggtccctg

SEQ ID NO: 1537057 - DNA, 16 bp, Homo sapiens
tggagtgcttgtttac

SEQ ID NO: 1537058 - DNA, 15 bp, Homo sapiens
tggagtggaggcatt

SEQ ID NO: 1537059 - DNA, 21 bp, Homo sapiens
tggagtgtgcagacagccatg

SEQ ID NO: 1537060 - DNA, 20 bp, Homo sapiens
tggagtgtttctaataaact

SEQ ID NO: 1537061 - DNA, 20 bp, Homo sapiens
tggagttaacgggtgaataa

SEQ ID NO: 1537062 - DNA, 20 bp, Homo sapiens
tggagttacattaatgttaa

SEQ ID NO: 1537063 - DNA, 15 bp, Homo sapiens
tggagttcctgctcc

SEQ ID NO: 1537064 - DNA, 18 bp, Homo sapiens
tggagttgaaactgctat

SEQ ID NO: 1537065 - DNA, 22 bp, Homo sapiens
tggagttgatctggaacccaga

SEQ ID NO: 1537066 - DNA, 17 bp, Homo sapiens
tggagttttaactgtaa

SEQ ID NO: 1537067 - DNA, 16 bp, Homo sapiens
tggagttttgtttcct

SEQ ID NO: 1537068 - DNA, 20 bp, Homo sapiens
tggagttttgtttcctctgt

SEQ ID NO: 1537069 - DNA, 14 bp, Homo sapiens
tggataaactgagc

SEQ ID NO: 1537070 - DNA, 16 bp, Homo sapiens
tggataaagccactga

SEQ ID NO: 1537071 - DNA, 23 bp, Homo sapiens
tggataataaacctgggctcagc

SEQ ID NO: 1537072 - DNA, 19 bp, Homo sapiens
tggataatcttaaattttg

SEQ ID NO: 1537073 - DNA, 13 bp, Homo sapiens
tggatactgtaga

SEQ ID NO: 1537074 - DNA, 22 bp, Homo sapiens
tggatagacttgggatggggag

SEQ ID NO: 1537075 - DNA, 16 bp, Homo sapiens
tggatatagttttact

SEQ ID NO: 1537076 - DNA, 17 bp, Homo sapiens
tggatatagttttactt

SEQ ID NO: 1537077 - DNA, 13 bp, Homo sapiens
tggatatatttga

SEQ ID NO: 1537078 - DNA, 18 bp, Homo sapiens
tggatatatttgaaatag

SEQ ID NO: 1537079 - DNA, 19 bp, Homo sapiens
tggatatatttgaaatagt

SEQ ID NO: 1537080 - DNA, 13 bp, Homo sapiens
tggatatgctgct

SEQ ID NO: 1537081 - DNA, 16 bp, Homo sapiens
tggatattattagaaa

SEQ ID NO: 1537082 - DNA, 14 bp, Homo sapiens
tggatatttcaatc

SEQ ID NO: 1537083 - DNA, 22 bp, Homo sapiens
tggatcacacctcagtgggaag

SEQ ID NO: 1537084 - DNA, 23 bp, Homo sapiens
tggatcacacctcagtgggaaga

SEQ ID NO: 1537085 - DNA, 17 bp, Homo sapiens
tggatcactcaccattc

SEQ ID NO: 1537086 - DNA, 20 bp, Homo sapiens
tggatcatgaggtcaggaga

SEQ ID NO: 1537087 - DNA, 18 bp, Homo sapiens
tggatccatacaaaacta

SEQ ID NO: 1537088 - DNA, 21 bp, Homo sapiens
tggatcccaaagcaaggagat

SEQ ID NO: 1537089 - DNA, 18 bp, Homo sapiens
tggatcctgggctgggtg

SEQ ID NO: 1537090 - DNA, 19 bp, Homo sapiens
tggatcgagtgtagctgtg

SEQ ID NO: 1537091 - DNA, 16 bp, Homo sapiens
tggatctatcacctgt

SEQ ID NO: 1537092 - DNA, 18 bp, Homo sapiens
tggatctatcacctgtca

SEQ ID NO: 1537093 - DNA, 20 bp, Homo sapiens
tggatctatttcatgttttt

SEQ ID NO: 1537094 - DNA, 19 bp, Homo sapiens
tggatctccccactctagg

SEQ ID NO: 1537095 - DNA, 17 bp, Homo sapiens
tggatctcctgctgcct

SEQ ID NO: 1537096 - DNA, 22 bp, Homo sapiens
tggatctccttcccttctcttg

SEQ ID NO: 1537097 - DNA, 19 bp, Homo sapiens
tggatctgggaccctttcc

SEQ ID NO: 1537098 - DNA, 20 bp, Homo sapiens
tggatctgggaccctttcct

SEQ ID NO: 1537099 - DNA, 19 bp, Homo sapiens
tggatctgtgaggggctct

SEQ ID NO: 1537100 - DNA, 21 bp, Homo sapiens
tggatcttctatcattccaat

SEQ ID NO: 1537101 - DNA, 14 bp, Homo sapiens
tggatctttgctac

SEQ ID NO: 1537102 - DNA, 17 bp, Homo sapiens
tggcacgtattgctgtg

SEQ ID NO: 1537103 - DNA, 15 bp, Homo sapiens
tggcactgagccccc

SEQ ID NO: 1537104 - DNA, 22 bp, Homo sapiens
tggcactggtaggttgggacac

SEQ ID NO: 1537105 - DNA, 18 bp, Homo sapiens
tggcacttaagtgcactt

SEQ ID NO: 1537106 - DNA, 19 bp, Homo sapiens
tggcacttaagtgcacttt

SEQ ID NO: 1537107 - DNA, 11 bp, Homo sapiens
tggcacttgta

SEQ ID NO: 1537108 - DNA, 15 bp, Homo sapiens
tggcacttgtattta

SEQ ID NO: 1537109 - DNA, 13 bp, Homo sapiens
tggcagaaaagag

SEQ ID NO: 1537110 - DNA, 22 bp, Homo sapiens
tggcagaaaagaggagaccctg

SEQ ID NO: 1537111 - DNA, 23 bp, Homo sapiens
tggcagaaaagaggagaccctgg

SEQ ID NO: 1537112 - DNA, 24 bp, Homo sapiens
tggcagaaaagaggagaccctgga

SEQ ID NO: 1537113 - DNA, 23 bp, Homo sapiens
tggcagaaagcaaatgtgacctg

SEQ ID NO: 1537114 - DNA, 21 bp, Homo sapiens
tggcagaagcattgcctggac

SEQ ID NO: 1537115 - DNA, 20 bp, Homo sapiens
tggcagaataatctttgggt

SEQ ID NO: 1537116 - DNA, 12 bp, Homo sapiens
tggcagacagac

SEQ ID NO: 1537117 - DNA, 11 bp, Homo sapiens
tggcagagcca

SEQ ID NO: 1537118 - DNA, 16 bp, Homo sapiens
tggcagagccaggctg

SEQ ID NO: 1537119 - DNA, 19 bp, Homo sapiens
tggcagagcctcagctgta

SEQ ID NO: 1537120 - DNA, 17 bp, Homo sapiens
tggcagagtttgtgtgt

SEQ ID NO: 1537121 - DNA, 22 bp, Homo sapiens
tggcagatttagtgaaagctag

SEQ ID NO: 1537122 - DNA, 12 bp, Homo sapiens
tggcagcagccc

SEQ ID NO: 1537123 - DNA, 22 bp, Homo sapiens
tggcagcagccccccttgcccc

SEQ ID NO: 1537124 - DNA, 20 bp, Homo sapiens
tggcagccatgcctcatgcc

SEQ ID NO: 1537125 - DNA, 21 bp, Homo sapiens
tggcagccatgcctcatgcca

SEQ ID NO: 1537126 - DNA, 14 bp, Homo sapiens
tggcagccctgtag

SEQ ID NO: 1537127 - DNA, 15 bp, Homo sapiens
tggcagcctgcacct

SEQ ID NO: 1537128 - DNA, 16 bp, Homo sapiens
tggcagctagactgga

SEQ ID NO: 1537129 - DNA, 15 bp, Homo sapiens
tggcagctagtgcct

SEQ ID NO: 1537130 - DNA, 16 bp, Homo sapiens
tggcagctcctctcct

SEQ ID NO: 1537131 - DNA, 14 bp, Homo sapiens
tggcagctgcccct

SEQ ID NO: 1537132 - DNA, 15 bp, Homo sapiens
tggcagctgcccctg

SEQ ID NO: 1537133 - DNA, 20 bp, Homo sapiens
tggcagctgcccctggcacc

SEQ ID NO: 1537134 - DNA, 23 bp, Homo sapiens
tggcagctgtttctcatgaagct

SEQ ID NO: 1537135 - DNA, 17 bp, Homo sapiens
tggcaggacacatcccg

SEQ ID NO: 1537136 - DNA, 14 bp, Homo sapiens
tggcaggagaatca

SEQ ID NO: 1537137 - DNA, 17 bp, Homo sapiens
tggcaggagctcctgga

SEQ ID NO: 1537138 - DNA, 22 bp, Homo sapiens
tggcaggatgaccctgcgaagg

SEQ ID NO: 1537139 - DNA, 22 bp, Homo sapiens
tggcaggattcttcccgctccc

SEQ ID NO: 1537140 - DNA, 16 bp, Homo sapiens
tggcaggcccactccc

SEQ ID NO: 1537141 - DNA, 21 bp, Homo sapiens
tggcaggccgaggcaggtgga

SEQ ID NO: 1537142 - DNA, 17 bp, Homo sapiens
tggcagggacctgagag

SEQ ID NO: 1537143 - DNA, 19 bp, Homo sapiens
tggcagggacctgagagca

SEQ ID NO: 1537144 - DNA, 24 bp, Homo sapiens
tggcaggggagacaggagcctagc

SEQ ID NO: 1537145 - DNA, 14 bp, Homo sapiens
tggcaggggagcag

SEQ ID NO: 1537146 - DNA, 23 bp, Homo sapiens
tggcagggggccccgccagggct

SEQ ID NO: 1537147 - DNA, 15 bp, Homo sapiens
tggcaggtcactgtc

SEQ ID NO: 1537148 - DNA, 21 bp, Homo sapiens
tggcaggtcactgtcactgcc

SEQ ID NO: 1537149 - DNA, 20 bp, Homo sapiens
tggcaggtgcagatgggctg

SEQ ID NO: 1537150 - DNA, 15 bp, Homo sapiens
tggcaggtggccagg

SEQ ID NO: 1537151 - DNA, 18 bp, Homo sapiens
tggcaggtgggctgcctg

SEQ ID NO: 1537152 - DNA, 19 bp, Homo sapiens
tggcaggtgggctgcctgc

SEQ ID NO: 1537153 - DNA, 23 bp, Homo sapiens
tggcaggtgtcatatgactgatt

SEQ ID NO: 1537154 - DNA, 18 bp, Homo sapiens
tggcaggtgttgggacct

SEQ ID NO: 1537155 - DNA, 18 bp, Homo sapiens
tggcagtccgtgggacgg

SEQ ID NO: 1537156 - DNA, 21 bp, Homo sapiens
tggcagtgttttggttcagac

SEQ ID NO: 1537157 - DNA, 23 bp, Homo sapiens
tggcagttaattggatgttcact

SEQ ID NO: 1537158 - DNA, 12 bp, Homo sapiens
tggcataagaca

SEQ ID NO: 1537159 - DNA, 11 bp, Homo sapiens
tggcatacaaa

SEQ ID NO: 1537160 - DNA, 12 bp, Homo sapiens
cctgcctgagga

SEQ ID NO: 1537161 - DNA, 15 bp, Homo sapiens
cctgcctgaggagga

SEQ ID NO: 1537162 - DNA, 15 bp, Homo sapiens
cctgcctgatccctg

SEQ ID NO: 1537163 - DNA, 14 bp, Homo sapiens
cctgcctgccaccc

SEQ ID NO: 1537164 - DNA, 14 bp, Homo sapiens
cctgcctgcccact

SEQ ID NO: 1537165 - DNA, 13 bp, Homo sapiens
cctgcctggccag

SEQ ID NO: 1537166 - DNA, 14 bp, Homo sapiens
cctgcctggccagg

SEQ ID NO: 1537167 - DNA, 18 bp, Homo sapiens
cctgcctggccaggcaga

SEQ ID NO: 1537168 - DNA, 22 bp, Homo sapiens
cctgcctggccaggcagatctg

SEQ ID NO: 1537169 - DNA, 23 bp, Homo sapiens
cctgcctggccaggcagatctgt

SEQ ID NO: 1537170 - DNA, 13 bp, Homo sapiens
cctgcctggcccc

SEQ ID NO: 1537171 - DNA, 19 bp, Homo sapiens
cctgcctggtcctccctcc

SEQ ID NO: 1537172 - DNA, 22 bp, Homo sapiens
cctgcctggtgcattgctgtgt

SEQ ID NO: 1537173 - DNA, 12 bp, Homo sapiens
cctgcctgtctg

SEQ ID NO: 1537174 - DNA, 19 bp, Homo sapiens
cctgcctgttggcaggccc

SEQ ID NO: 1537175 - DNA, 19 bp, Homo sapiens
cctgccttcactgtgctcc

SEQ ID NO: 1537176 - DNA, 17 bp, Homo sapiens
cctgccttgaagccact

SEQ ID NO: 1537177 - DNA, 19 bp, Homo sapiens
cctgccttgaagccactga

SEQ ID NO: 1537178 - DNA, 19 bp, Homo sapiens
cctgccttgctgacaataa

SEQ ID NO: 1537179 - DNA, 20 bp, Homo sapiens
cctgccttgctgacaataaa

SEQ ID NO: 1537180 - DNA, 11 bp, Homo sapiens
cctgcctttta

SEQ ID NO: 1537181 - DNA, 19 bp, Homo sapiens
cctgcgaaggggccctggt

SEQ ID NO: 1537182 - DNA, 20 bp, Homo sapiens
cctgcgaaggggccctggtc

SEQ ID NO: 1537183 - DNA, 21 bp, Homo sapiens
cctgcgaccctgggggcacag

SEQ ID NO: 1537184 - DNA, 13 bp, Homo sapiens
cctgcgagacgca

SEQ ID NO: 1537185 - DNA, 18 bp, Homo sapiens
cctgcgagacgcacacag

SEQ ID NO: 1537186 - DNA, 20 bp, Homo sapiens
cctgcgagacgcacacagct

SEQ ID NO: 1537187 - DNA, 21 bp, Homo sapiens
cctgcgagacgcacacagctg

SEQ ID NO: 1537188 - DNA, 17 bp, Homo sapiens
cctgcgaggctatgagt

SEQ ID NO: 1537189 - DNA, 13 bp, Homo sapiens
cctgcgcacaggt

SEQ ID NO: 1537190 - DNA, 15 bp, Homo sapiens
cctgcgcacaggtgg

SEQ ID NO: 1537191 - DNA, 14 bp, Homo sapiens
cctgcgcctccaga

SEQ ID NO: 1537192 - DNA, 15 bp, Homo sapiens
cctgcgctgacaagg

SEQ ID NO: 1537193 - DNA, 16 bp, Homo sapiens
cctgcggagtgaagag

SEQ ID NO: 1537194 - DNA, 17 bp, Homo sapiens
cctgcggagtgaagagg

SEQ ID NO: 1537195 - DNA, 18 bp, Homo sapiens
cctgcggagtgaagaggg

SEQ ID NO: 1537196 - DNA, 12 bp, Homo sapiens
cctgcgggctgc

SEQ ID NO: 1537197 - DNA, 20 bp, Homo sapiens
cctgcgggtggggcttgggg

SEQ ID NO: 1537198 - DNA, 21 bp, Homo sapiens
cctgcgggtggggcttggggc

SEQ ID NO: 1537199 - DNA, 24 bp, Homo sapiens
cctgcgggtggggcttggggctca

SEQ ID NO: 1537200 - DNA, 13 bp, Homo sapiens
cctgcgtcctcct

SEQ ID NO: 1537201 - DNA, 20 bp, Homo sapiens
cctgcgtcctcctcacctca

SEQ ID NO: 1537202 - DNA, 22 bp, Homo sapiens
cctgcgtcctcctcacctcatg

SEQ ID NO: 1537203 - DNA, 17 bp, Homo sapiens
cctgcgttctccccatg

SEQ ID NO: 1537204 - DNA, 15 bp, Homo sapiens
cctgcgttggagcca

SEQ ID NO: 1537205 - DNA, 16 bp, Homo sapiens
cctgcgttggagccac

SEQ ID NO: 1537206 - DNA, 19 bp, Homo sapiens
cctgcgttggagccactcc

SEQ ID NO: 1537207 - DNA, 15 bp, Homo sapiens
cctgcgtttggaggc

SEQ ID NO: 1537208 - DNA, 21 bp, Homo sapiens
cctgcgtttggaggcccctgg

SEQ ID NO: 1537209 - DNA, 23 bp, Homo sapiens
cctgcgtttggaggcccctgggc

SEQ ID NO: 1537210 - DNA, 22 bp, Homo sapiens
cctgcgttttggaagctctgaa

SEQ ID NO: 1537211 - DNA, 14 bp, Homo sapiens
cctgctagagcaac

SEQ ID NO: 1537212 - DNA, 15 bp, Homo sapiens
cctgctagagcaacc

SEQ ID NO: 1537213 - DNA, 19 bp, Homo sapiens
cctgctagagcaacccctg

SEQ ID NO: 1537214 - DNA, 16 bp, Homo sapiens
cctgctagctgtagaa

SEQ ID NO: 1537215 - DNA, 17 bp, Homo sapiens
cctgctcaactctaccc

SEQ ID NO: 1537216 - DNA, 20 bp, Homo sapiens
tggccactccagacccctgg

SEQ ID NO: 1537217 - DNA, 14 bp, Homo sapiens
tggccactccgaga

SEQ ID NO: 1537218 - DNA, 23 bp, Homo sapiens
tggccactccgagaggtgggcca

SEQ ID NO: 1537219 - DNA, 23 bp, Homo sapiens
tggccactgggtctcactcctga

SEQ ID NO: 1537220 - DNA, 19 bp, Homo sapiens
tggccagaagagcttgtca

SEQ ID NO: 1537221 - DNA, 13 bp, Homo sapiens
tggccagacacag

SEQ ID NO: 1537222 - DNA, 13 bp, Homo sapiens
tggccagagaggg

SEQ ID NO: 1537223 - DNA, 20 bp, Homo sapiens
tggccagagagggcccagct

SEQ ID NO: 1537224 - DNA, 22 bp, Homo sapiens
tggccagcacaccaagtggctg

SEQ ID NO: 1537225 - DNA, 21 bp, Homo sapiens
tggccagccaacttttgcatg

SEQ ID NO: 1537226 - DNA, 12 bp, Homo sapiens
tggccagcccgg

SEQ ID NO: 1537227 - DNA, 19 bp, Homo sapiens
tggccagcccggctggttt

SEQ ID NO: 1537228 - DNA, 14 bp, Homo sapiens
tggccagcctggat

SEQ ID NO: 1537229 - DNA, 12 bp, Homo sapiens
tggccaggagca

SEQ ID NO: 1537230 - DNA, 15 bp, Homo sapiens
tggccaggagctctt

SEQ ID NO: 1537231 - DNA, 12 bp, Homo sapiens
tggccaggcaga

SEQ ID NO: 1537232 - DNA, 14 bp, Homo sapiens
tggccaggccaggg

SEQ ID NO: 1537233 - DNA, 17 bp, Homo sapiens
tggccaggccaggggac

SEQ ID NO: 1537234 - DNA, 13 bp, Homo sapiens
tggccaggctggt

SEQ ID NO: 1537235 - DNA, 20 bp, Homo sapiens
tggccaggctggtcttgaac

SEQ ID NO: 1537236 - DNA, 20 bp, Homo sapiens
tggccaggcttgtctcgaac

SEQ ID NO: 1537237 - DNA, 15 bp, Homo sapiens
tggccaggtggccac

SEQ ID NO: 1537238 - DNA, 17 bp, Homo sapiens
tggccaggtggccactc

SEQ ID NO: 1537239 - DNA, 14 bp, Homo sapiens
tggccagtccaggc

SEQ ID NO: 1537240 - DNA, 15 bp, Homo sapiens
tggccagtccaggct

SEQ ID NO: 1537241 - DNA, 16 bp, Homo sapiens
tggccagtccaggctg

SEQ ID NO: 1537242 - DNA, 21 bp, Homo sapiens
tggccagtccaggctgccgtg

SEQ ID NO: 1537243 - DNA, 23 bp, Homo sapiens
tggccagtccaggctgccgtggg

SEQ ID NO: 1537244 - DNA, 22 bp, Homo sapiens
tggccagtcctggtcctggctg

SEQ ID NO: 1537245 - DNA, 23 bp, Homo sapiens
tggccagtcctggtcctggctgc

SEQ ID NO: 1537246 - DNA, 15 bp, Homo sapiens
tggccagtcttcctc

SEQ ID NO: 1537247 - DNA, 17 bp, Homo sapiens
tggccagtcttcctctt

SEQ ID NO: 1537248 - DNA, 22 bp, Homo sapiens
tggccagtcttcctcttagcct

SEQ ID NO: 1537249 - DNA, 22 bp, Homo sapiens
tggccagtgctgcccatgagca

SEQ ID NO: 1537250 - DNA, 15 bp, Homo sapiens
tggccagtggctgga

SEQ ID NO: 1537251 - DNA, 16 bp, Homo sapiens
tggccagtgtgatccc

SEQ ID NO: 1537252 - DNA, 18 bp, Homo sapiens
tggccatagaggcccagg

SEQ ID NO: 1537253 - DNA, 20 bp, Homo sapiens
tggccatagaggcccaggca

SEQ ID NO: 1537254 - DNA, 15 bp, Homo sapiens
tggccatgcaggagg

SEQ ID NO: 1537255 - DNA, 18 bp, Homo sapiens
tggccatgcaggaggtgg

SEQ ID NO: 1537256 - DNA, 14 bp, Homo sapiens
tggccatggcctct

SEQ ID NO: 1537257 - DNA, 17 bp, Homo sapiens
tggccatggcctctgca

SEQ ID NO: 1537258 - DNA, 18 bp, Homo sapiens
tggccatggcctctgcaa

SEQ ID NO: 1537259 - DNA, 18 bp, Homo sapiens
tggccatgttatgctggt

SEQ ID NO: 1537260 - DNA, 21 bp, Homo sapiens
tggccattcttatgttccaga

SEQ ID NO: 1537261 - DNA, 14 bp, Homo sapiens
tggcccaaatccag

SEQ ID NO: 1537262 - DNA, 22 bp, Homo sapiens
tggcccacgccctccctctccc

SEQ ID NO: 1537263 - DNA, 21 bp, Homo sapiens
tggcccagaaagcctctctct

SEQ ID NO: 1537264 - DNA, 23 bp, Homo sapiens
tggcccagaaagcctctctctcc

SEQ ID NO: 1537265 - DNA, 17 bp, Homo sapiens
tggcccagccggcctct

SEQ ID NO: 1537266 - DNA, 20 bp, Homo sapiens
tggcccagcggcccctccca

SEQ ID NO: 1537267 - DNA, 21 bp, Homo sapiens
tggcccagcggcccctcccac

SEQ ID NO: 1537268 - DNA, 23 bp, Homo sapiens
tggcccaggaattagagaagctg

SEQ ID NO: 1537269 - DNA, 15 bp, Homo sapiens
tggcccaggagctct

SEQ ID NO: 1537270 - DNA, 17 bp, Homo sapiens
tggcccaggagctctgc

SEQ ID NO: 1537271 - DNA, 14 bp, Homo sapiens
tggcccagggccca

SEQ ID NO: 1537272 - DNA, 15 bp, Homo sapiens
tggcccagggcccag

SEQ ID NO: 1537273 - DNA, 18 bp, Homo sapiens
tggcccagggcccagagc

SEQ ID NO: 1537274 - DNA, 21 bp, Homo sapiens
tggcccagggcccagagccca

SEQ ID NO: 1537275 - DNA, 12 bp, Homo sapiens
tggcccaggggg

SEQ ID NO: 1537276 - DNA, 12 bp, Homo sapiens
tggcccagggtg

SEQ ID NO: 1537277 - DNA, 13 bp, Homo sapiens
tggcccagggtgt

SEQ ID NO: 1537278 - DNA, 22 bp, Homo sapiens
cctgctgggaaccccgcagccc

SEQ ID NO: 1537279 - DNA, 19 bp, Homo sapiens
cctgctgggaagagctccc

SEQ ID NO: 1537280 - DNA, 16 bp, Homo sapiens
cctgctgggcgtgtgt

SEQ ID NO: 1537281 - DNA, 19 bp, Homo sapiens
cctgctgggctctccacct

SEQ ID NO: 1537282 - DNA, 21 bp, Homo sapiens
cctgctgggctctccacctca

SEQ ID NO: 1537283 - DNA, 24 bp, Homo sapiens
cctgctgggctctccacctcagcc

SEQ ID NO: 1537284 - DNA, 21 bp, Homo sapiens
cctgctggggatccccgcctg

SEQ ID NO: 1537285 - DNA, 16 bp, Homo sapiens
cctgctggggccgcca

SEQ ID NO: 1537286 - DNA, 20 bp, Homo sapiens
cctgctggggccgccacggc

SEQ ID NO: 1537287 - DNA, 22 bp, Homo sapiens
cctgctggtacctgccctctat

SEQ ID NO: 1537288 - DNA, 23 bp, Homo sapiens
cctgctggttgttgccaggttgc

SEQ ID NO: 1537289 - DNA, 14 bp, Homo sapiens
cctgctgtatttcc

SEQ ID NO: 1537290 - DNA, 14 bp, Homo sapiens
cctgctgtcctggt

SEQ ID NO: 1537291 - DNA, 16 bp, Homo sapiens
cctgctgtcctggtgg

SEQ ID NO: 1537292 - DNA, 17 bp, Homo sapiens
cctgctgtctctctggg

SEQ ID NO: 1537293 - DNA, 10 bp, Homo sapiens
cctgctgtgc

SEQ ID NO: 1537294 - DNA, 22 bp, Homo sapiens
cctgctgtgccatgctgggcca

SEQ ID NO: 1537295 - DNA, 12 bp, Homo sapiens
cctgctgtgctg

SEQ ID NO: 1537296 - DNA, 13 bp, Homo sapiens
cctgctgtgctgg

SEQ ID NO: 1537297 - DNA, 22 bp, Homo sapiens
cctgctgtgctggaattccaca

SEQ ID NO: 1537298 - DNA, 11 bp, Homo sapiens
cctgctgtgga

SEQ ID NO: 1537299 - DNA, 22 bp, Homo sapiens
cctgctgttggtcctctctctg

SEQ ID NO: 1537300 - DNA, 23 bp, Homo sapiens
cctgcttaatcttcaaagccttc

SEQ ID NO: 1537301 - DNA, 14 bp, Homo sapiens
cctgcttcaaatat

SEQ ID NO: 1537302 - DNA, 13 bp, Homo sapiens
cctgcttccccct

SEQ ID NO: 1537303 - DNA, 18 bp, Homo sapiens
cctgcttcctcttttcct

SEQ ID NO: 1537304 - DNA, 16 bp, Homo sapiens
cctgcttccttcagtt

SEQ ID NO: 1537305 - DNA, 15 bp, Homo sapiens
cctgcttctgaactc

SEQ ID NO: 1537306 - DNA, 12 bp, Homo sapiens
cctgcttctgct

SEQ ID NO: 1537307 - DNA, 22 bp, Homo sapiens
cctgctttcaagacccctgtct

SEQ ID NO: 1537308 - DNA, 12 bp, Homo sapiens
cctgctttgcat

SEQ ID NO: 1537309 - DNA, 20 bp, Homo sapiens
cctgctttgggctgccctgg

SEQ ID NO: 1537310 - DNA, 21 bp, Homo sapiens
cctgctttgggctgccctggt

SEQ ID NO: 1537311 - DNA, 23 bp, Homo sapiens
cctgctttgggctgccctggtgc

SEQ ID NO: 1537312 - DNA, 18 bp, Homo sapiens
cctgcttttccaggatcc

SEQ ID NO: 1537313 - DNA, 22 bp, Homo sapiens
cctgcttttccaggatcctgca

SEQ ID NO: 1537314 - DNA, 21 bp, Homo sapiens
cctgcttttctgtcctgggca

SEQ ID NO: 1537315 - DNA, 15 bp, Homo sapiens
cctgctttttttctt

SEQ ID NO: 1537316 - DNA, 17 bp, Homo sapiens
cctgctttttttcttaa

SEQ ID NO: 1537317 - DNA, 19 bp, Homo sapiens
cctgctttttttcttaaaa

SEQ ID NO: 1537318 - DNA, 15 bp, Homo sapiens
cctggaaaattctat

SEQ ID NO: 1537319 - DNA, 19 bp, Homo sapiens
cctggaaaattctatggaa

SEQ ID NO: 1537320 - DNA, 14 bp, Homo sapiens
cctggaaacagacc

SEQ ID NO: 1537321 - DNA, 16 bp, Homo sapiens
cctggaaacccacctc

SEQ ID NO: 1537322 - DNA, 17 bp, Homo sapiens
cctggaaaccttccacc

SEQ ID NO: 1537323 - DNA, 15 bp, Homo sapiens
cctggaaaggctcag

SEQ ID NO: 1537324 - DNA, 21 bp, Homo sapiens
cctggaaaggctcagtctcag

SEQ ID NO: 1537325 - DNA, 19 bp, Homo sapiens
cctggaaaggggagttgag

SEQ ID NO: 1537326 - DNA, 22 bp, Homo sapiens
cctggaaatatcagttactcag

SEQ ID NO: 1537327 - DNA, 14 bp, Homo sapiens
cctggaaccaatcc

SEQ ID NO: 1537328 - DNA, 21 bp, Homo sapiens
cctggaaccagggaggagagg

SEQ ID NO: 1537329 - DNA, 13 bp, Homo sapiens
cctggaacttggg

SEQ ID NO: 1537330 - DNA, 18 bp, Homo sapiens
tggccctttccttccaga

SEQ ID NO: 1537331 - DNA, 19 bp, Homo sapiens
tggccgagggtcctggctc

SEQ ID NO: 1537332 - DNA, 21 bp, Homo sapiens
tggccgcacctaaagcagcca

SEQ ID NO: 1537333 - DNA, 16 bp, Homo sapiens
tggccgccacccccat

SEQ ID NO: 1537334 - DNA, 18 bp, Homo sapiens
tggccgccacccccatct

SEQ ID NO: 1537335 - DNA, 19 bp, Homo sapiens
tggccgccacccccatctt

SEQ ID NO: 1537336 - DNA, 17 bp, Homo sapiens
tggccgccccctgcccc

SEQ ID NO: 1537337 - DNA, 21 bp, Homo sapiens
tggccgccccctgccccccag

SEQ ID NO: 1537338 - DNA, 16 bp, Homo sapiens
tggccgcccctgaggc

SEQ ID NO: 1537339 - DNA, 16 bp, Homo sapiens
tggccgcctggcaggt

SEQ ID NO: 1537340 - DNA, 19 bp, Homo sapiens
tggccgctgagtggcaggg

SEQ ID NO: 1537341 - DNA, 23 bp, Homo sapiens
tggccgggcacagtggctcacgc

SEQ ID NO: 1537342 - DNA, 15 bp, Homo sapiens
tggccgggctgctgc

SEQ ID NO: 1537343 - DNA, 17 bp, Homo sapiens
tggccgggctgctgctg

SEQ ID NO: 1537344 - DNA, 19 bp, Homo sapiens
tggccgggtaaagcaaggg

SEQ ID NO: 1537345 - DNA, 12 bp, Homo sapiens
tggccggtgctg

SEQ ID NO: 1537346 - DNA, 14 bp, Homo sapiens
tggccggtgctggg

SEQ ID NO: 1537347 - DNA, 15 bp, Homo sapiens
tggccggtgctgggt

SEQ ID NO: 1537348 - DNA, 17 bp, Homo sapiens
tggccggtgctgggttc

SEQ ID NO: 1537349 - DNA, 23 bp, Homo sapiens
tggccggtgctgggttcccactc

SEQ ID NO: 1537350 - DNA, 21 bp, Homo sapiens
tggccggttgccactctcctc

SEQ ID NO: 1537351 - DNA, 14 bp, Homo sapiens
tggccgtggatggc

SEQ ID NO: 1537352 - DNA, 16 bp, Homo sapiens
tggccgtggtccagct

SEQ ID NO: 1537353 - DNA, 21 bp, Homo sapiens
tggcctagaccagcagacaga

SEQ ID NO: 1537354 - DNA, 21 bp, Homo sapiens
tggcctaggagatatctgagg

SEQ ID NO: 1537355 - DNA, 18 bp, Homo sapiens
tggcctaggggccagggc

SEQ ID NO: 1537356 - DNA, 20 bp, Homo sapiens
tggcctaggggccagggctt

SEQ ID NO: 1537357 - DNA, 18 bp, Homo sapiens
tggcctatccgctgccag

SEQ ID NO: 1537358 - DNA, 13 bp, Homo sapiens
tggcctatgcaca

SEQ ID NO: 1537359 - DNA, 17 bp, Homo sapiens
tggcctatgcacatatg

SEQ ID NO: 1537360 - DNA, 20 bp, Homo sapiens
tggcctatgcacatatggac

SEQ ID NO: 1537361 - DNA, 17 bp, Homo sapiens
tggcctattatattaaa

SEQ ID NO: 1537362 - DNA, 21 bp, Homo sapiens
tggcctattatattaaaatat

SEQ ID NO: 1537363 - DNA, 20 bp, Homo sapiens
tggcctcactggctggggca

SEQ ID NO: 1537364 - DNA, 17 bp, Homo sapiens
tggcctcagaattcaca

SEQ ID NO: 1537365 - DNA, 13 bp, Homo sapiens
tggcctcagctgc

SEQ ID NO: 1537366 - DNA, 14 bp, Homo sapiens
tggcctcagctgcc

SEQ ID NO: 1537367 - DNA, 19 bp, Homo sapiens
tggcctcagctgcctcact

SEQ ID NO: 1537368 - DNA, 13 bp, Homo sapiens
tggcctcatgtgg

SEQ ID NO: 1537369 - DNA, 21 bp, Homo sapiens
tggcctcatgtggctggaaga

SEQ ID NO: 1537370 - DNA, 19 bp, Homo sapiens
tggcctccagctcccactc

SEQ ID NO: 1537371 - DNA, 18 bp, Homo sapiens
tggcctccatttctgtct

SEQ ID NO: 1537372 - DNA, 20 bp, Homo sapiens
tggcctcccaaagtgctggg

SEQ ID NO: 1537373 - DNA, 11 bp, Homo sapiens
tggcctcccac

SEQ ID NO: 1537374 - DNA, 13 bp, Homo sapiens
tggcctcccaccc

SEQ ID NO: 1537375 - DNA, 15 bp, Homo sapiens
tggcctccggcctcc

SEQ ID NO: 1537376 - DNA, 13 bp, Homo sapiens
tggcctctctagc

SEQ ID NO: 1537377 - DNA, 12 bp, Homo sapiens
tggcctctgctt

SEQ ID NO: 1537378 - DNA, 13 bp, Homo sapiens
tggcctctgggca

SEQ ID NO: 1537379 - DNA, 14 bp, Homo sapiens
tggcctctgggcag

SEQ ID NO: 1537380 - DNA, 19 bp, Homo sapiens
tggcctctgggcagtgtgg

SEQ ID NO: 1537381 - DNA, 17 bp, Homo sapiens
tggcctctgtaccgccc

SEQ ID NO: 1537382 - DNA, 23 bp, Homo sapiens
tggcctctgtggagccccagcat

SEQ ID NO: 1537383 - DNA, 22 bp, Homo sapiens
tggcctcttgagcagtggctgg

SEQ ID NO: 1537384 - DNA, 13 bp, Homo sapiens
tggcctcttggct

SEQ ID NO: 1537385 - DNA, 14 bp, Homo sapiens
tggcctgagctggg

SEQ ID NO: 1537386 - DNA, 18 bp, Homo sapiens
tggcctgagctggggcca

SEQ ID NO: 1537387 - DNA, 16 bp, Homo sapiens
tggcctgcactaattt

SEQ ID NO: 1537388 - DNA, 12 bp, Homo sapiens
tggcctgctggg

SEQ ID NO: 1537389 - DNA, 11 bp, Homo sapiens
tggcctgctgt

SEQ ID NO: 1537390 - DNA, 12 bp, Homo sapiens
tggcctgctgtg

SEQ ID NO: 1537391 - DNA, 15 bp, Homo sapiens
tggcctggccaggag

SEQ ID NO: 1537392 - DNA, 17 bp, Homo sapiens
tggcctggccaggagct

SEQ ID NO: 1537393 - DNA, 21 bp, Homo sapiens
tggcctggccaggagctcttc

SEQ ID NO: 1537394 - DNA, 19 bp, Homo sapiens
tggcctggccatttccaag

SEQ ID NO: 1537395 - DNA, 15 bp, Homo sapiens
tggcctggcctccag

SEQ ID NO: 1537396 - DNA, 17 bp, Homo sapiens
tggcctgggccacacct

SEQ ID NO: 1537397 - DNA, 22 bp, Homo sapiens
tggacagtacctgattgtattt

SEQ ID NO: 1537398 - DNA, 14 bp, Homo sapiens
tggacagtcctggg

SEQ ID NO: 1537399 - DNA, 14 bp, Homo sapiens
tggacatcctcctc

SEQ ID NO: 1537400 - DNA, 23 bp, Homo sapiens
tggacatcctcctcccacccggc

SEQ ID NO: 1537401 - DNA, 18 bp, Homo sapiens
tggacatcgtaggcagcc

SEQ ID NO: 1537402 - DNA, 13 bp, Homo sapiens
tggacatgaagga

SEQ ID NO: 1537403 - DNA, 15 bp, Homo sapiens
tggacatgaaggaaa

SEQ ID NO: 1537404 - DNA, 16 bp, Homo sapiens
tggacatgagataatg

SEQ ID NO: 1537405 - DNA, 22 bp, Homo sapiens
tggacatgagatggagaggctg

SEQ ID NO: 1537406 - DNA, 13 bp, Homo sapiens
tggacatgtgggt

SEQ ID NO: 1537407 - DNA, 22 bp, Homo sapiens
tggacatgtgggtggagaaggg

SEQ ID NO: 1537408 - DNA, 23 bp, Homo sapiens
tggacatgtgggtggagaaggga

SEQ ID NO: 1537409 - DNA, 14 bp, Homo sapiens
tggacattctcttt

SEQ ID NO: 1537410 - DNA, 21 bp, Homo sapiens
tggacattctctttgataaca

SEQ ID NO: 1537411 - DNA, 22 bp, Homo sapiens
tggacattctctttgataacaa

SEQ ID NO: 1537412 - DNA, 15 bp, Homo sapiens
tggacattgtctgcg

SEQ ID NO: 1537413 - DNA, 17 bp, Homo sapiens
tggacatttagaagaaa

SEQ ID NO: 1537414 - DNA, 19 bp, Homo sapiens
tggaccaaaggaaggaagc

SEQ ID NO: 1537415 - DNA, 22 bp, Homo sapiens
tggaccacaggcatctacacag

SEQ ID NO: 1537416 - DNA, 19 bp, Homo sapiens
tggaccaccagccccagca

SEQ ID NO: 1537417 - DNA, 20 bp, Homo sapiens
tggaccaccagccccagcaa

SEQ ID NO: 1537418 - DNA, 18 bp, Homo sapiens
tggaccactcctgtccct

SEQ ID NO: 1537419 - DNA, 15 bp, Homo sapiens
tggaccactgggcaa

SEQ ID NO: 1537420 - DNA, 18 bp, Homo sapiens
tggaccaggacaggacca

SEQ ID NO: 1537421 - DNA, 19 bp, Homo sapiens
tggaccaggacaggaccag

SEQ ID NO: 1537422 - DNA, 16 bp, Homo sapiens
tggaccccagctggga

SEQ ID NO: 1537423 - DNA, 16 bp, Homo sapiens
tggaccgggtgggcct

SEQ ID NO: 1537424 - DNA, 21 bp, Homo sapiens
tggaccgggtgggcctggcct

SEQ ID NO: 1537425 - DNA, 17 bp, Homo sapiens
tggaccgtggacaggcc

SEQ ID NO: 1537426 - DNA, 18 bp, Homo sapiens
tggacctaaatggcctca

SEQ ID NO: 1537427 - DNA, 17 bp, Homo sapiens
tggacctaacattcgat

SEQ ID NO: 1537428 - DNA, 21 bp, Homo sapiens
tggacctgcctacggagggtg

SEQ ID NO: 1537429 - DNA, 17 bp, Homo sapiens
tggacctgcctcctgcc

SEQ ID NO: 1537430 - DNA, 18 bp, Homo sapiens
tggacctgcctcctgcct

SEQ ID NO: 1537431 - DNA, 14 bp, Homo sapiens
tggacctgcctgca

SEQ ID NO: 1537432 - DNA, 15 bp, Homo sapiens
tggaccttaggcctt

SEQ ID NO: 1537433 - DNA, 22 bp, Homo sapiens
tggaccttttcccttgctgtac

SEQ ID NO: 1537434 - DNA, 13 bp, Homo sapiens
tggacggcaggct

SEQ ID NO: 1537435 - DNA, 18 bp, Homo sapiens
tggacggcaggctcactg

SEQ ID NO: 1537436 - DNA, 21 bp, Homo sapiens
tggacggcaggctcactgcca

SEQ ID NO: 1537437 - DNA, 22 bp, Homo sapiens
tggacggcaggctcactgccag

SEQ ID NO: 1537438 - DNA, 23 bp, Homo sapiens
tggacggcaggctcactgccagg

SEQ ID NO: 1537439 - DNA, 17 bp, Homo sapiens
tggacgttcggggcatg

SEQ ID NO: 1537440 - DNA, 22 bp, Homo sapiens
tggactaaccccaacgcacagg

SEQ ID NO: 1537441 - DNA, 19 bp, Homo sapiens
tggactacacaatacagta

SEQ ID NO: 1537442 - DNA, 24 bp, Homo sapiens
tggactacccacgttctcacaccc

SEQ ID NO: 1537443 - DNA, 14 bp, Homo sapiens
tggactatctgtct

SEQ ID NO: 1537444 - DNA, 18 bp, Homo sapiens
tggactcagaaactccat

SEQ ID NO: 1537445 - DNA, 15 bp, Homo sapiens
tggactcaggaactt

SEQ ID NO: 1537446 - DNA, 16 bp, Homo sapiens
tggactcaggaacttt

SEQ ID NO: 1537447 - DNA, 16 bp, Homo sapiens
tggactccaggcctga

SEQ ID NO: 1537448 - DNA, 18 bp, Homo sapiens
tggactccaggcctgacc

SEQ ID NO: 1537449 - DNA, 17 bp, Homo sapiens
tggactcccactctttg

SEQ ID NO: 1537450 - DNA, 20 bp, Homo sapiens
tggactcccactctttgaat

SEQ ID NO: 1537451 - DNA, 12 bp, Homo sapiens
tggactctcagg

SEQ ID NO: 1537452 - DNA, 13 bp, Homo sapiens
tggactctcaggg

SEQ ID NO: 1537453 - DNA, 14 bp, Homo sapiens
tggactctcaggga

SEQ ID NO: 1537454 - DNA, 22 bp, Homo sapiens
tggactctgcacatgtcttgta

SEQ ID NO: 1537455 - DNA, 13 bp, Homo sapiens
tggactctgcccc

SEQ ID NO: 1537456 - DNA, 14 bp, Homo sapiens
tggactctgcccca

SEQ ID NO: 1537457 - DNA, 13 bp, Homo sapiens
tggactctgctag

SEQ ID NO: 1537458 - DNA, 14 bp, Homo sapiens
tggactctgctaga

SEQ ID NO: 1537459 - DNA, 20 bp, Homo sapiens
tggactctgctagactcctc

SEQ ID NO: 1537460 - DNA, 22 bp, Homo sapiens
tggactctggtgcctccagagg

SEQ ID NO: 1537461 - DNA, 17 bp, Homo sapiens
tggactgaagcctgcag

SEQ ID NO: 1537462 - DNA, 18 bp, Homo sapiens
tggactgaccaaagactg

SEQ ID NO: 1537463 - DNA, 22 bp, Homo sapiens
tggactgaccaaagactgcaga

SEQ ID NO: 1537464 - DNA, 23 bp, Homo sapiens
tggactgaccaaagactgcagaa

SEQ ID NO: 1537465 - DNA, 18 bp, Homo sapiens
tggactgactgcagcccc

SEQ ID NO: 1537466 - DNA, 16 bp, Homo sapiens
tggactgaggcctgag

SEQ ID NO: 1537467 - DNA, 17 bp, Homo sapiens
tggactgagtgggaagc

SEQ ID NO: 1537468 - DNA, 15 bp, Homo sapiens
tggactgatttgtgg

SEQ ID NO: 1537469 - DNA, 21 bp, Homo sapiens
tggactgatttgtggaaagga

SEQ ID NO: 1537470 - DNA, 20 bp, Homo sapiens
tggactgcatggggaggcag

SEQ ID NO: 1537471 - DNA, 21 bp, Homo sapiens
tggactgcatggggaggcagc

SEQ ID NO: 1537472 - DNA, 13 bp, Homo sapiens
tggactgcattta

SEQ ID NO: 1537473 - DNA, 23 bp, Homo sapiens
tggactgctacctttcaaagctt

SEQ ID NO: 1537474 - DNA, 19 bp, Homo sapiens
tggactggctgtgcccctg

SEQ ID NO: 1537475 - DNA, 14 bp, Homo sapiens
tggactgtctttat

SEQ ID NO: 1537476 - DNA, 15 bp, Homo sapiens
tggactgtgatgcca

SEQ ID NO: 1537477 - DNA, 20 bp, Homo sapiens
tggactgtgatgccacacag

SEQ ID NO: 1537478 - DNA, 21 bp, Homo sapiens
tggactgtgatgccacacaga

SEQ ID NO: 1537479 - DNA, 23 bp, Homo sapiens
tggactgtgcctcaggccagggc

SEQ ID NO: 1537480 - DNA, 12 bp, Homo sapiens
tggactgtggca

SEQ ID NO: 1537481 - DNA, 13 bp, Homo sapiens
tggactgtggcac

SEQ ID NO: 1537482 - DNA, 14 bp, Homo sapiens
tggacttacaaaat

SEQ ID NO: 1537483 - DNA, 17 bp, Homo sapiens
tggacttacaaaatgcc

SEQ ID NO: 1537484 - DNA, 17 bp, Homo sapiens
tggacttctacctgccc

SEQ ID NO: 1537485 - DNA, 17 bp, Homo sapiens
tggacttgagcttggca

SEQ ID NO: 1537486 - DNA, 15 bp, Homo sapiens
tggacttgtatattt

SEQ ID NO: 1537487 - DNA, 17 bp, Homo sapiens
tggacttgtatatttgt

SEQ ID NO: 1537488 - DNA, 15 bp, Homo sapiens
tggacttgtcctcag

SEQ ID NO: 1537489 - DNA, 22 bp, Homo sapiens
tggacttgtgattggctgcagg

SEQ ID NO: 1537490 - DNA, 16 bp, Homo sapiens
tggacttgttttaacg

SEQ ID NO: 1537491 - DNA, 13 bp, Homo sapiens
tggactttcctgc

SEQ ID NO: 1537492 - DNA, 18 bp, Homo sapiens
tggactttcctgcaactc

SEQ ID NO: 1537493 - DNA, 23 bp, Homo sapiens
tggactttggttctctccaggaa

SEQ ID NO: 1537494 - DNA, 18 bp, Homo sapiens
tggacttttcgttaacat

SEQ ID NO: 1537495 - DNA, 19 bp, Homo sapiens
tggacttttcgttaacatt

SEQ ID NO: 1537496 - DNA, 17 bp, Homo sapiens
tggagaaaataacaaga

SEQ ID NO: 1537497 - DNA, 22 bp, Homo sapiens
tggagaaaatgggtttattcac

SEQ ID NO: 1537498 - DNA, 22 bp, Homo sapiens
tggagaaactgtagtctcagga

SEQ ID NO: 1537499 - DNA, 14 bp, Homo sapiens
tggagaaagagctg

SEQ ID NO: 1537500 - DNA, 23 bp, Homo sapiens
tggagaaagagctgcctggatga

SEQ ID NO: 1537501 - DNA, 17 bp, Homo sapiens
tggagaaagcactgacc

SEQ ID NO: 1537502 - DNA, 19 bp, Homo sapiens
tggagaaagcactgacctg

SEQ ID NO: 1537503 - DNA, 21 bp, Homo sapiens
tggagaacagtggttgcctgg

SEQ ID NO: 1537504 - DNA, 23 bp, Homo sapiens
tggagaaccagggctcttctcag

SEQ ID NO: 1537505 - DNA, 20 bp, Homo sapiens
tggagaacgccagtctccca

SEQ ID NO: 1537506 - DNA, 23 bp, Homo sapiens
tggagaacgccagtctcccaggc

SEQ ID NO: 1537507 - DNA, 19 bp, Homo sapiens
tggagaagaatggctttca

SEQ ID NO: 1537508 - DNA, 17 bp, Homo sapiens
tggagaagaccctcccc

SEQ ID NO: 1537509 - DNA, 20 bp, Homo sapiens
tggagaatctcaacatgtct

SEQ ID NO: 1537510 - DNA, 23 bp, Homo sapiens
tggagaattgactgaagcacagc

SEQ ID NO: 1537511 - DNA, 16 bp, Homo sapiens
tggagacaaggtgcta

SEQ ID NO: 1537512 - DNA, 16 bp, Homo sapiens
cctgagggtccacctg

SEQ ID NO: 1537513 - DNA, 20 bp, Homo sapiens
cctgagggtccacctggaga

SEQ ID NO: 1537514 - DNA, 21 bp, Homo sapiens
cctgagggtccacctggagag

SEQ ID NO: 1537515 - DNA, 16 bp, Homo sapiens
cctgagggttttctca

SEQ ID NO: 1537516 - DNA, 16 bp, Homo sapiens
cctgaggtcactgcta

SEQ ID NO: 1537517 - DNA, 20 bp, Homo sapiens
cctgaggtgaaagggagcta

SEQ ID NO: 1537518 - DNA, 23 bp, Homo sapiens
cctgaggtgcaggggaagaccaa

SEQ ID NO: 1537519 - DNA, 17 bp, Homo sapiens
cctgaggtgggcccagg

SEQ ID NO: 1537520 - DNA, 21 bp, Homo sapiens
cctgaggtgggcccaggacca

SEQ ID NO: 1537521 - DNA, 15 bp, Homo sapiens
cctgaggtgtggggg

SEQ ID NO: 1537522 - DNA, 21 bp, Homo sapiens
cctgaggtgtgggggctgcag

SEQ ID NO: 1537523 - DNA, 19 bp, Homo sapiens
cctgagtagctggattaca

SEQ ID NO: 1537524 - DNA, 21 bp, Homo sapiens
cctgagtagctgggattacag

SEQ ID NO: 1537525 - DNA, 22 bp, Homo sapiens
cctgagtcaactggagcaagaa

SEQ ID NO: 1537526 - DNA, 15 bp, Homo sapiens
cctgagtcaccagga

SEQ ID NO: 1537527 - DNA, 18 bp, Homo sapiens
cctgagtcacccatgaag

SEQ ID NO: 1537528 - DNA, 23 bp, Homo sapiens
cctgagtcaccctacctgtgcct

SEQ ID NO: 1537529 - DNA, 14 bp, Homo sapiens
cctgagtcactggt

SEQ ID NO: 1537530 - DNA, 23 bp, Homo sapiens
cctgagtcctggtttcctggcag

SEQ ID NO: 1537531 - DNA, 15 bp, Homo sapiens
cctgagtcggcccca

SEQ ID NO: 1537532 - DNA, 18 bp, Homo sapiens
cctgagtcggccccacat

SEQ ID NO: 1537533 - DNA, 14 bp, Homo sapiens
cctgagtctcctgt

SEQ ID NO: 1537534 - DNA, 16 bp, Homo sapiens
cctgagtctcctgtgc

SEQ ID NO: 1537535 - DNA, 16 bp, Homo sapiens
cctgagtggtgccaaa

SEQ ID NO: 1537536 - DNA, 16 bp, Homo sapiens
cctgagtgtcccaagc

SEQ ID NO: 1537537 - DNA, 21 bp, Homo sapiens
cctgagtgtcccaagccggga

SEQ ID NO: 1537538 - DNA, 19 bp, Homo sapiens
cctgagttaggctttctct

SEQ ID NO: 1537539 - DNA, 22 bp, Homo sapiens
cctgagttaggctttctcttca

SEQ ID NO: 1537540 - DNA, 20 bp, Homo sapiens
cctgagttcatccaggccca

SEQ ID NO: 1537541 - DNA, 13 bp, Homo sapiens
cctgagttgaaga

SEQ ID NO: 1537542 - DNA, 16 bp, Homo sapiens
cctgagttggagctca

SEQ ID NO: 1537543 - DNA, 17 bp, Homo sapiens
cctgagtttccagcctg

SEQ ID NO: 1537544 - DNA, 17 bp, Homo sapiens
cctgataaagcacagct

SEQ ID NO: 1537545 - DNA, 16 bp, Homo sapiens
cctgatactttagcca

SEQ ID NO: 1537546 - DNA, 20 bp, Homo sapiens
cctgatagtcacctgctggt

SEQ ID NO: 1537547 - DNA, 15 bp, Homo sapiens
cctgatataaatgca

SEQ ID NO: 1537548 - DNA, 20 bp, Homo sapiens
cctgatcaagtcaccggagc

SEQ ID NO: 1537549 - DNA, 19 bp, Homo sapiens
cctgatcaggcttcctggt

SEQ ID NO: 1537550 - DNA, 20 bp, Homo sapiens
cctgatcaggcttcctggtg

SEQ ID NO: 1537551 - DNA, 15 bp, Homo sapiens
cctgatcccaccccc

SEQ ID NO: 1537552 - DNA, 13 bp, Homo sapiens
cctgatcccagac

SEQ ID NO: 1537553 - DNA, 22 bp, Homo sapiens
cctgatccctgaacccctggcc

SEQ ID NO: 1537554 - DNA, 19 bp, Homo sapiens
cctgatcctggaggcccag

SEQ ID NO: 1537555 - DNA, 19 bp, Homo sapiens
cctgatgacccaggctgcc

SEQ ID NO: 1537556 - DNA, 17 bp, Homo sapiens
cctgatgagatttttaa

SEQ ID NO: 1537557 - DNA, 17 bp, Homo sapiens
cctgatgcagcctgtgg

SEQ ID NO: 1537558 - DNA, 18 bp, Homo sapiens
cctgatgcagcctgtggc

SEQ ID NO: 1537559 - DNA, 17 bp, Homo sapiens
cctgatgcgtctaccca

SEQ ID NO: 1537560 - DNA, 18 bp, Homo sapiens
cctgatgcgtctacccag

SEQ ID NO: 1537561 - DNA, 20 bp, Homo sapiens
cctgatgcgtctacccagac

SEQ ID NO: 1537562 - DNA, 13 bp, Homo sapiens
cctgatgctccct

SEQ ID NO: 1537563 - DNA, 13 bp, Homo sapiens
cctgatgctgccc

SEQ ID NO: 1537564 - DNA, 14 bp, Homo sapiens
cctgatggccaaga

SEQ ID NO: 1537565 - DNA, 22 bp, Homo sapiens
cctgatgtcttaacgaataaag

SEQ ID NO: 1537566 - DNA, 16 bp, Homo sapiens
cctgatgttaaaattc

SEQ ID NO: 1537567 - DNA, 17 bp, Homo sapiens
cctgatgttaaaattcc

SEQ ID NO: 1537568 - DNA, 16 bp, Homo sapiens
cctgattcggacggcc

SEQ ID NO: 1537569 - DNA, 15 bp, Homo sapiens
cctgattgtattttt

SEQ ID NO: 1537570 - DNA, 15 bp, Homo sapiens
cctgattgtttacag

SEQ ID NO: 1537571 - DNA, 17 bp, Homo sapiens
cctgatttattgaaatt

SEQ ID NO: 1537572 - DNA, 22 bp, Homo sapiens
cctgatttattgaaatttttct

SEQ ID NO: 1537573 - DNA, 14 bp, Homo sapiens
cctgcaaaaatgag

SEQ ID NO: 1537574 - DNA, 15 bp, Homo sapiens
cctgcaaaaatgagt

SEQ ID NO: 1537575 - DNA, 14 bp, Homo sapiens
cctgcaaaatttta

SEQ ID NO: 1537576 - DNA, 16 bp, Homo sapiens
cctgcaaactcactgc

SEQ ID NO: 1537577 - DNA, 22 bp, Homo sapiens
cctgcaaactcactgctcaaga

SEQ ID NO: 1537578 - DNA, 17 bp, Homo sapiens
cctgcaacttccgctga

SEQ ID NO: 1537579 - DNA, 20 bp, Homo sapiens
cctgcaacttccgctgaggg

SEQ ID NO: 1537580 - DNA, 18 bp, Homo sapiens
cctgcaagaccacggagg

SEQ ID NO: 1537581 - DNA, 21 bp, Homo sapiens
cctgcaagatggacacgagcc

SEQ ID NO: 1537582 - DNA, 13 bp, Homo sapiens
cctgcaagcccca

SEQ ID NO: 1537583 - DNA, 18 bp, Homo sapiens
cctgcaagccccagggcc

SEQ ID NO: 1537584 - DNA, 21 bp, Homo sapiens
cctgcaagccccagggcctgg

SEQ ID NO: 1537585 - DNA, 13 bp, Homo sapiens
cctgcaatatttg

SEQ ID NO: 1537586 - DNA, 14 bp, Homo sapiens
cctgcaatgaaagg

SEQ ID NO: 1537587 - DNA, 22 bp, Homo sapiens
cctgcaatgaaaggtactatat

SEQ ID NO: 1537588 - DNA, 22 bp, Homo sapiens
cctgcaatgtggtgacacctcc

SEQ ID NO: 1537589 - DNA, 16 bp, Homo sapiens
cctgcaattctacagt

SEQ ID NO: 1537590 - DNA, 14 bp, Homo sapiens
cctgcacacaggac

SEQ ID NO: 1537591 - DNA, 17 bp, Homo sapiens
cctgcacacaggacagc

SEQ ID NO: 1537592 - DNA, 15 bp, Homo sapiens
cctgcacagcctcta

SEQ ID NO: 1537593 - DNA, 15 bp, Homo sapiens
cctgcacagtgactt

SEQ ID NO: 1537594 - DNA, 17 bp, Homo sapiens
cctgcaccaggagacag

SEQ ID NO: 1537595 - DNA, 15 bp, Homo sapiens
cctgcacccacccct

SEQ ID NO: 1537596 - DNA, 23 bp, Homo sapiens
cctgcacccacccctgcccaggc

SEQ ID NO: 1537597 - DNA, 17 bp, Homo sapiens
cctgcaccccagcattc

SEQ ID NO: 1537598 - DNA, 12 bp, Homo sapiens
cctgcaccctgg

SEQ ID NO: 1537599 - DNA, 13 bp, Homo sapiens
cctgcaccctgga

SEQ ID NO: 1537600 - DNA, 21 bp, Homo sapiens
cctgcaccctggaaaggggag

SEQ ID NO: 1537601 - DNA, 14 bp, Homo sapiens
cctgcacccttccc

SEQ ID NO: 1537602 - DNA, 21 bp, Homo sapiens
cctgcacctccccccactgca

SEQ ID NO: 1537603 - DNA, 12 bp, Homo sapiens
cctgcacctgct

SEQ ID NO: 1537604 - DNA, 16 bp, Homo sapiens
cctgcacctgctgcgt

SEQ ID NO: 1537605 - DNA, 19 bp, Homo sapiens
cctgcacctgctgcgtccc

SEQ ID NO: 1537606 - DNA, 12 bp, Homo sapiens
cctgcacctggt

SEQ ID NO: 1537607 - DNA, 18 bp, Homo sapiens
cctgcacgtcatgggagg

SEQ ID NO: 1537608 - DNA, 20 bp, Homo sapiens
cctgcactccctcctggagc

SEQ ID NO: 1537609 - DNA, 21 bp, Homo sapiens
cctgcactccctcctggagct

SEQ ID NO: 1537610 - DNA, 13 bp, Homo sapiens
cctgcactgagag

SEQ ID NO: 1537611 - DNA, 12 bp, Homo sapiens
cctgcactgtaa

SEQ ID NO: 1537612 - DNA, 13 bp, Homo sapiens
cctgcactgtaaa

SEQ ID NO: 1537613 - DNA, 14 bp, Homo sapiens
cctgcactgtaaaa

SEQ ID NO: 1537614 - DNA, 14 bp, Homo sapiens
cctgcacttacttg

SEQ ID NO: 1537615 - DNA, 22 bp, Homo sapiens
cctgcagactccaatggggcca

SEQ ID NO: 1537616 - DNA, 17 bp, Homo sapiens
cctgcagagagggaact

SEQ ID NO: 1537617 - DNA, 17 bp, Homo sapiens
cctgcagagcacacagg

SEQ ID NO: 1537618 - DNA, 19 bp, Homo sapiens
cctgcagaggggaaaccag

SEQ ID NO: 1537619 - DNA, 22 bp, Homo sapiens
cctgcagaggtctgtgctgagg

SEQ ID NO: 1537620 - DNA, 15 bp, Homo sapiens
cctgcagatgccacc

SEQ ID NO: 1537621 - DNA, 24 bp, Homo sapiens
cctgcagcaaacactccaccctcc

SEQ ID NO: 1537622 - DNA, 16 bp, Homo sapiens
cctgcaggaacgagca

SEQ ID NO: 1537623 - DNA, 22 bp, Homo sapiens
cctgcaggcaggaacaaacagg

SEQ ID NO: 1537624 - DNA, 21 bp, Homo sapiens
cctgcaggccaagagcagagg

SEQ ID NO: 1537625 - DNA, 15 bp, Homo sapiens
cctgcaggctccatg

SEQ ID NO: 1537626 - DNA, 14 bp, Homo sapiens
cctgcaggctggag

SEQ ID NO: 1537627 - DNA, 17 bp, Homo sapiens
cctgcaggctggctgtt

SEQ ID NO: 1537628 - DNA, 18 bp, Homo sapiens
tggagacaccctctgggg

SEQ ID NO: 1537629 - DNA, 14 bp, Homo sapiens
tggagaccacactg

SEQ ID NO: 1537630 - DNA, 21 bp, Homo sapiens
tggagaccgcttcacccctgc

SEQ ID NO: 1537631 - DNA, 17 bp, Homo sapiens
tggagactcctggtctg

SEQ ID NO: 1537632 - DNA, 20 bp, Homo sapiens
tggagactcctggtctgtga

SEQ ID NO: 1537633 - DNA, 17 bp, Homo sapiens
tggagactgcttcccat

SEQ ID NO: 1537634 - DNA, 19 bp, Homo sapiens
tggagactgcttcccatcc

SEQ ID NO: 1537635 - DNA, 20 bp, Homo sapiens
tggagactgcttcccatcct

SEQ ID NO: 1537636 - DNA, 17 bp, Homo sapiens
tggagactgtctcaaga

SEQ ID NO: 1537637 - DNA, 13 bp, Homo sapiens
tggagagaaatat

SEQ ID NO: 1537638 - DNA, 11 bp, Homo sapiens
tggagagaata

SEQ ID NO: 1537639 - DNA, 20 bp, Homo sapiens
tggagagagaggctgcctca

SEQ ID NO: 1537640 - DNA, 21 bp, Homo sapiens
tggagagagattctgttgcat

SEQ ID NO: 1537641 - DNA, 13 bp, Homo sapiens
tggagagagggga

SEQ ID NO: 1537642 - DNA, 14 bp, Homo sapiens
tggagagatgtttg

SEQ ID NO: 1537643 - DNA, 13 bp, Homo sapiens
tggagagcagcag

SEQ ID NO: 1537644 - DNA, 12 bp, Homo sapiens
tggagaggagag

SEQ ID NO: 1537645 - DNA, 21 bp, Homo sapiens
tggagaggagggatgctgcct

SEQ ID NO: 1537646 - DNA, 21 bp, Homo sapiens
tggagagtacatttgctttaa

SEQ ID NO: 1537647 - DNA, 22 bp, Homo sapiens
tggagatattataagggagagc

SEQ ID NO: 1537648 - DNA, 20 bp, Homo sapiens
tggagatgcagctactggaa

SEQ ID NO: 1537649 - DNA, 18 bp, Homo sapiens
tggagatgctgagggtgt

SEQ ID NO: 1537650 - DNA, 15 bp, Homo sapiens
tggagatggaagctt

SEQ ID NO: 1537651 - DNA, 14 bp, Homo sapiens
tggagatgggaagg

SEQ ID NO: 1537652 - DNA, 19 bp, Homo sapiens
tggagatgttttagagtta

SEQ ID NO: 1537653 - DNA, 19 bp, Homo sapiens
tggagattataataaatat

SEQ ID NO: 1537654 - DNA, 20 bp, Homo sapiens
tggagcaacctactgtctaa

SEQ ID NO: 1537655 - DNA, 22 bp, Homo sapiens
tggagcaagaaggaaggaggca

SEQ ID NO: 1537656 - DNA, 23 bp, Homo sapiens
tggagcaagaaggaaggaggcag

SEQ ID NO: 1537657 - DNA, 13 bp, Homo sapiens
tggagcaatcaga

SEQ ID NO: 1537658 - DNA, 21 bp, Homo sapiens
tggagcactctgagtttacca

SEQ ID NO: 1537659 - DNA, 17 bp, Homo sapiens
tggagcagaccaccccg

SEQ ID NO: 1537660 - DNA, 13 bp, Homo sapiens
tggagcagagctc

SEQ ID NO: 1537661 - DNA, 21 bp, Homo sapiens
tggagcagccagagctgtgcc

SEQ ID NO: 1537662 - DNA, 20 bp, Homo sapiens
tggagcagcggattgctctg

SEQ ID NO: 1537663 - DNA, 16 bp, Homo sapiens
tggagcaggggttggt

SEQ ID NO: 1537664 - DNA, 13 bp, Homo sapiens
tggagccaagtgg

SEQ ID NO: 1537665 - DNA, 23 bp, Homo sapiens
tggagccactcctgtcccgcctt

SEQ ID NO: 1537666 - DNA, 16 bp, Homo sapiens
tggagccagcagggct

SEQ ID NO: 1537667 - DNA, 22 bp, Homo sapiens
tggagccatcccttcggagcca

SEQ ID NO: 1537668 - DNA, 19 bp, Homo sapiens
tggagcccagaggagggca

SEQ ID NO: 1537669 - DNA, 14 bp, Homo sapiens
tggagcccagggca

SEQ ID NO: 1537670 - DNA, 18 bp, Homo sapiens
tggagccccaccttgtct

SEQ ID NO: 1537671 - DNA, 22 bp, Homo sapiens
tggagccccaccttgtctgcta

SEQ ID NO: 1537672 - DNA, 13 bp, Homo sapiens
tggagcccctggg

SEQ ID NO: 1537673 - DNA, 23 bp, Homo sapiens
tggagcccctgggtgggtggtgg

SEQ ID NO: 1537674 - DNA, 13 bp, Homo sapiens
tggagcccgtgca

SEQ ID NO: 1537675 - DNA, 13 bp, Homo sapiens
tggagccctgggc

SEQ ID NO: 1537676 - DNA, 17 bp, Homo sapiens
tggagccgaggcctacc

SEQ ID NO: 1537677 - DNA, 15 bp, Homo sapiens
tggagcctaaagaga

SEQ ID NO: 1537678 - DNA, 14 bp, Homo sapiens
tggagcctgccaag

SEQ ID NO: 1537679 - DNA, 14 bp, Homo sapiens
tggagcctggcaca

SEQ ID NO: 1537680 - DNA, 16 bp, Homo sapiens
tggagcgcacctgccc

SEQ ID NO: 1537681 - DNA, 22 bp, Homo sapiens
tggagctctgtgggtctctgga

SEQ ID NO: 1537682 - DNA, 23 bp, Homo sapiens
tggagctcttggaagagctcttc

SEQ ID NO: 1537683 - DNA, 21 bp, Homo sapiens
tggagctcttgggtcagagaa

SEQ ID NO: 1537684 - DNA, 16 bp, Homo sapiens
tggagctgactgttct

SEQ ID NO: 1537685 - DNA, 18 bp, Homo sapiens
tggagctgggagacaaag

SEQ ID NO: 1537686 - DNA, 12 bp, Homo sapiens
tggagctgtcct

SEQ ID NO: 1537687 - DNA, 19 bp, Homo sapiens
tggagcttttaaaaatgtt

SEQ ID NO: 1537688 - DNA, 11 bp, Homo sapiens
tggaggaaaaa

SEQ ID NO: 1537689 - DNA, 19 bp, Homo sapiens
tggaggaaatgttggaact

SEQ ID NO: 1537690 - DNA, 19 bp, Homo sapiens
tggaggaagatagcgcata

SEQ ID NO: 1537691 - DNA, 15 bp, Homo sapiens
tggaggaaggtgctg

SEQ ID NO: 1537692 - DNA, 16 bp, Homo sapiens
tggaggaaggtgctga

SEQ ID NO: 1537693 - DNA, 19 bp, Homo sapiens
tggaggaaggtgctgagct

SEQ ID NO: 1537694 - DNA, 20 bp, Homo sapiens
tggaggaaggtgctgagctt

SEQ ID NO: 1537695 - DNA, 15 bp, Homo sapiens
tggaggactctcctc

SEQ ID NO: 1537696 - DNA, 12 bp, Homo sapiens
cctccagggcat

SEQ ID NO: 1537697 - DNA, 20 bp, Homo sapiens
cctccagggcattgctcagc

SEQ ID NO: 1537698 - DNA, 17 bp, Homo sapiens
cctccagggccacgtgc

SEQ ID NO: 1537699 - DNA, 18 bp, Homo sapiens
cctccagggccacgtgcc

SEQ ID NO: 1537700 - DNA, 12 bp, Homo sapiens
cctccagggctg

SEQ ID NO: 1537701 - DNA, 20 bp, Homo sapiens
cctccaggtcggagtgcctg

SEQ ID NO: 1537702 - DNA, 15 bp, Homo sapiens
cctccaggtgcagag

SEQ ID NO: 1537703 - DNA, 18 bp, Homo sapiens
cctccaggtgcagaggta

SEQ ID NO: 1537704 - DNA, 14 bp, Homo sapiens
cctccaggtgtgca

SEQ ID NO: 1537705 - DNA, 22 bp, Homo sapiens
cctccagtattgccccctctca

SEQ ID NO: 1537706 - DNA, 18 bp, Homo sapiens
cctccagtgagtacctgc

SEQ ID NO: 1537707 - DNA, 19 bp, Homo sapiens
cctccagtgagtacctgca

SEQ ID NO: 1537708 - DNA, 20 bp, Homo sapiens
cctccagtgagtacctgcaa

SEQ ID NO: 1537709 - DNA, 24 bp, Homo sapiens
cctccagtgagtacctgcaaaaat

SEQ ID NO: 1537710 - DNA, 21 bp, Homo sapiens
cctccatactcaagctgtctc

SEQ ID NO: 1537711 - DNA, 16 bp, Homo sapiens
cctccatccatccttc

SEQ ID NO: 1537712 - DNA, 17 bp, Homo sapiens
cctccatccatccttcc

SEQ ID NO: 1537713 - DNA, 14 bp, Homo sapiens
cctccatgccccag

SEQ ID NO: 1537714 - DNA, 19 bp, Homo sapiens
cctccatgccccagctctg

SEQ ID NO: 1537715 - DNA, 23 bp, Homo sapiens
cctccatgctcctcacctgtcta

SEQ ID NO: 1537716 - DNA, 14 bp, Homo sapiens
cctccatggtggaa

SEQ ID NO: 1537717 - DNA, 17 bp, Homo sapiens
cctccattcatccttcc

SEQ ID NO: 1537718 - DNA, 20 bp, Homo sapiens
cctccattcctggagcccga

SEQ ID NO: 1537719 - DNA, 15 bp, Homo sapiens
cctccattctgacca

SEQ ID NO: 1537720 - DNA, 21 bp, Homo sapiens
cctcccaacctcaatgccctg

SEQ ID NO: 1537721 - DNA, 22 bp, Homo sapiens
cctcccaaggggcccaaattct

SEQ ID NO: 1537722 - DNA, 18 bp, Homo sapiens
cctcccaaggtcctctca

SEQ ID NO: 1537723 - DNA, 20 bp, Homo sapiens
cctcccaaggtcctctcagt

SEQ ID NO: 1537724 - DNA, 15 bp, Homo sapiens
cctcccaatcctctc

SEQ ID NO: 1537725 - DNA, 17 bp, Homo sapiens
cctcccaatcctctctc

SEQ ID NO: 1537726 - DNA, 23 bp, Homo sapiens
cctcccacaattaaaccgcatgt

SEQ ID NO: 1537727 - DNA, 15 bp, Homo sapiens
cctcccacactccca

SEQ ID NO: 1537728 - DNA, 16 bp, Homo sapiens
cctcccacactcccaa

SEQ ID NO: 1537729 - DNA, 12 bp, Homo sapiens
cctcccacagcc

SEQ ID NO: 1537730 - DNA, 15 bp, Homo sapiens
cctcccaccagagcc

SEQ ID NO: 1537731 - DNA, 12 bp, Homo sapiens
cctcccacccga

SEQ ID NO: 1537732 - DNA, 19 bp, Homo sapiens
cctcccacccgatgctgct

SEQ ID NO: 1537733 - DNA, 21 bp, Homo sapiens
cctcccacccgatgctgcttt

SEQ ID NO: 1537734 - DNA, 11 bp, Homo sapiens
cctcccacctc

SEQ ID NO: 1537735 - DNA, 19 bp, Homo sapiens
cctcccacctcagcctcct

SEQ ID NO: 1537736 - DNA, 16 bp, Homo sapiens
cctcccaccttggcct

SEQ ID NO: 1537737 - DNA, 13 bp, Homo sapiens
cctcccacgcctc

SEQ ID NO: 1537738 - DNA, 23 bp, Homo sapiens
cctcccagaggagccaccagttc

SEQ ID NO: 1537739 - DNA, 12 bp, Homo sapiens
cctcccagcggc

SEQ ID NO: 1537740 - DNA, 14 bp, Homo sapiens
cctcccagggccag

SEQ ID NO: 1537741 - DNA, 21 bp, Homo sapiens
cctcccagggccagggccctg

SEQ ID NO: 1537742 - DNA, 13 bp, Homo sapiens
cctcccaggggag

SEQ ID NO: 1537743 - DNA, 17 bp, Homo sapiens
cctcccaggggagccag

SEQ ID NO: 1537744 - DNA, 18 bp, Homo sapiens
cctcccaggggagccagc

SEQ ID NO: 1537745 - DNA, 19 bp, Homo sapiens
cctcccaggggagccagct

SEQ ID NO: 1537746 - DNA, 18 bp, Homo sapiens
cctcccaggtcgggcagt

SEQ ID NO: 1537747 - DNA, 16 bp, Homo sapiens
cctcccataattgctt

SEQ ID NO: 1537748 - DNA, 20 bp, Homo sapiens
cctcccatctccttccccca

SEQ ID NO: 1537749 - DNA, 23 bp, Homo sapiens
cctcccatctccttcccccagcc

SEQ ID NO: 1537750 - DNA, 13 bp, Homo sapiens
cctcccatctggg

SEQ ID NO: 1537751 - DNA, 16 bp, Homo sapiens
cctcccatctgggagt

SEQ ID NO: 1537752 - DNA, 21 bp, Homo sapiens
cctcccatctgggagtcccct

SEQ ID NO: 1537753 - DNA, 15 bp, Homo sapiens
cctcccatggcacct

SEQ ID NO: 1537754 - DNA, 20 bp, Homo sapiens
cctccccaaatcaatacact

SEQ ID NO: 1537755 - DNA, 14 bp, Homo sapiens
cctccccaactccc

SEQ ID NO: 1537756 - DNA, 17 bp, Homo sapiens
cctccccacactccact

SEQ ID NO: 1537757 - DNA, 18 bp, Homo sapiens
cctccccacactccactc

SEQ ID NO: 1537758 - DNA, 14 bp, Homo sapiens
cctccccacccgct

SEQ ID NO: 1537759 - DNA, 22 bp, Homo sapiens
cctccccagcattccagcccct

SEQ ID NO: 1537760 - DNA, 22 bp, Homo sapiens
cctccccaggggagagggtctg

SEQ ID NO: 1537761 - DNA, 15 bp, Homo sapiens
cctccccatttccca

SEQ ID NO: 1537762 - DNA, 14 bp, Homo sapiens
cctcccccactcct

SEQ ID NO: 1537763 - DNA, 15 bp, Homo sapiens
cctcccccactcctc

SEQ ID NO: 1537764 - DNA, 12 bp, Homo sapiens
cctcccccagtg

SEQ ID NO: 1537765 - DNA, 14 bp, Homo sapiens
cctccccccactgc

SEQ ID NO: 1537766 - DNA, 17 bp, Homo sapiens
cctccccccactgcagg

SEQ ID NO: 1537767 - DNA, 20 bp, Homo sapiens
cctccccccactgcaggccc

SEQ ID NO: 1537768 - DNA, 18 bp, Homo sapiens
cctcccccggctgggcct

SEQ ID NO: 1537769 - DNA, 13 bp, Homo sapiens
cctccccctcctg

SEQ ID NO: 1537770 - DNA, 16 bp, Homo sapiens
cctccccctcctgctg

SEQ ID NO: 1537771 - DNA, 17 bp, Homo sapiens
cctccccctcctgctgt

SEQ ID NO: 1537772 - DNA, 18 bp, Homo sapiens
cctccccctgccagtgcc

SEQ ID NO: 1537773 - DNA, 15 bp, Homo sapiens
cctcccccttcccct

SEQ ID NO: 1537774 - DNA, 15 bp, Homo sapiens
cctccccgcaccccc

SEQ ID NO: 1537775 - DNA, 14 bp, Homo sapiens
cctccccgcccctg

SEQ ID NO: 1537776 - DNA, 17 bp, Homo sapiens
cctccccggccacatgc

SEQ ID NO: 1537777 - DNA, 14 bp, Homo sapiens
cctccccggcccta

SEQ ID NO: 1537778 - DNA, 21 bp, Homo sapiens
cctccccggccctaccagcgc

SEQ ID NO: 1537779 - DNA, 23 bp, Homo sapiens
cctccccgtgtaaaaagcctcct

SEQ ID NO: 1537780 - DNA, 15 bp, Homo sapiens
cctcccctatccacc

SEQ ID NO: 1537781 - DNA, 17 bp, Homo sapiens
cctcccctatccaccca

SEQ ID NO: 1537782 - DNA, 18 bp, Homo sapiens
cctcccctccgcagcagg

SEQ ID NO: 1537783 - DNA, 17 bp, Homo sapiens
cctcccctcctcttccc

SEQ ID NO: 1537784 - DNA, 17 bp, Homo sapiens
cctcccctctcttgcac

SEQ ID NO: 1537785 - DNA, 13 bp, Homo sapiens
cctcccctgccac

SEQ ID NO: 1537786 - DNA, 14 bp, Homo sapiens
cctcccctgcccta

SEQ ID NO: 1537787 - DNA, 15 bp, Homo sapiens
cctcccctgccctgg

SEQ ID NO: 1537788 - DNA, 14 bp, Homo sapiens
cctcccctgctccc

SEQ ID NO: 1537789 - DNA, 13 bp, Homo sapiens
cctcccctgggca

SEQ ID NO: 1537790 - DNA, 22 bp, Homo sapiens
cctcccctgggttaacaaatga

SEQ ID NO: 1537791 - DNA, 13 bp, Homo sapiens
cctccccttcccc

SEQ ID NO: 1537792 - DNA, 14 bp, Homo sapiens
cctccccttgggcg

SEQ ID NO: 1537793 - DNA, 19 bp, Homo sapiens
cctcccgccccgcccctcc

SEQ ID NO: 1537794 - DNA, 16 bp, Homo sapiens
cctcccgcccttccat

SEQ ID NO: 1537795 - DNA, 14 bp, Homo sapiens
cctcccgggccctc

SEQ ID NO: 1537796 - DNA, 19 bp, Homo sapiens
cctcccgggccctcccttg

SEQ ID NO: 1537797 - DNA, 13 bp, Homo sapiens
cctcccggtgccc

SEQ ID NO: 1537798 - DNA, 15 bp, Homo sapiens
cctccctagccagca

SEQ ID NO: 1537799 - DNA, 16 bp, Homo sapiens
cctccctcccgtcctt

SEQ ID NO: 1537800 - DNA, 19 bp, Homo sapiens
cctcagggtggggggtgac

SEQ ID NO: 1537801 - DNA, 18 bp, Homo sapiens
cctcaggtacggagaaga

SEQ ID NO: 1537802 - DNA, 20 bp, Homo sapiens
cctcaggtacggagaagaat

SEQ ID NO: 1537803 - DNA, 17 bp, Homo sapiens
cctcagtaacatttctg

SEQ ID NO: 1537804 - DNA, 22 bp, Homo sapiens
cctcagtaacatttctgttctc

SEQ ID NO: 1537805 - DNA, 21 bp, Homo sapiens
cctcagtagtccctgcacagt

SEQ ID NO: 1537806 - DNA, 20 bp, Homo sapiens
cctcagtcagttcccggagc

SEQ ID NO: 1537807 - DNA, 19 bp, Homo sapiens
cctcagtgaaggtggtggg

SEQ ID NO: 1537808 - DNA, 14 bp, Homo sapiens
cctcagtgccactt

SEQ ID NO: 1537809 - DNA, 16 bp, Homo sapiens
cctcagtggctctggg

SEQ ID NO: 1537810 - DNA, 11 bp, Homo sapiens
cctcagtgtca

SEQ ID NO: 1537811 - DNA, 17 bp, Homo sapiens
cctcagttcccagctcc

SEQ ID NO: 1537812 - DNA, 16 bp, Homo sapiens
cctcagttcccttggc

SEQ ID NO: 1537813 - DNA, 18 bp, Homo sapiens
cctcagttcccttggcct

SEQ ID NO: 1537814 - DNA, 15 bp, Homo sapiens
cctcagttggaatca

SEQ ID NO: 1537815 - DNA, 21 bp, Homo sapiens
cctcagttgtttctaagagca

SEQ ID NO: 1537816 - DNA, 15 bp, Homo sapiens
cctcagtttccctat

SEQ ID NO: 1537817 - DNA, 13 bp, Homo sapiens
cctcagttttcct

SEQ ID NO: 1537818 - DNA, 14 bp, Homo sapiens
cctcagttttcctt

SEQ ID NO: 1537819 - DNA, 19 bp, Homo sapiens
cctcagttttccttctgtt

SEQ ID NO: 1537820 - DNA, 15 bp, Homo sapiens
cctcatacccatgca

SEQ ID NO: 1537821 - DNA, 22 bp, Homo sapiens
cctcatagcatagccagcattc

SEQ ID NO: 1537822 - DNA, 22 bp, Homo sapiens
cctcatagtaataagatggctg

SEQ ID NO: 1537823 - DNA, 21 bp, Homo sapiens
cctcatcactggactgcatgg

SEQ ID NO: 1537824 - DNA, 13 bp, Homo sapiens
cctcatccctgac

SEQ ID NO: 1537825 - DNA, 23 bp, Homo sapiens
cctcatctccaaggcagggacca

SEQ ID NO: 1537826 - DNA, 17 bp, Homo sapiens
cctcatctctctgccca

SEQ ID NO: 1537827 - DNA, 21 bp, Homo sapiens
cctcatctgagaggctctccg

SEQ ID NO: 1537828 - DNA, 21 bp, Homo sapiens
cctcatgaaaacacacataca

SEQ ID NO: 1537829 - DNA, 18 bp, Homo sapiens
cctcatgacagccagagc

SEQ ID NO: 1537830 - DNA, 15 bp, Homo sapiens
cctcatgccaaccct

SEQ ID NO: 1537831 - DNA, 20 bp, Homo sapiens
cctcatgccacaccttcttc

SEQ ID NO: 1537832 - DNA, 14 bp, Homo sapiens
cctcatgcccaccc

SEQ ID NO: 1537833 - DNA, 21 bp, Homo sapiens
cctcatgcccaccccctgccc

SEQ ID NO: 1537834 - DNA, 24 bp, Homo sapiens
cctcatgcccaccccctgccctgc

SEQ ID NO: 1537835 - DNA, 13 bp, Homo sapiens
cctcatgcccagc

SEQ ID NO: 1537836 - DNA, 22 bp, Homo sapiens
cctcatggcccctctgacctgc

SEQ ID NO: 1537837 - DNA, 19 bp, Homo sapiens
cctcatggtgggttcaggg

SEQ ID NO: 1537838 - DNA, 20 bp, Homo sapiens
cctcatgtaacattggtgaa

SEQ ID NO: 1537839 - DNA, 13 bp, Homo sapiens
cctcatgtggctg

SEQ ID NO: 1537840 - DNA, 17 bp, Homo sapiens
cctcatgtggctggaag

SEQ ID NO: 1537841 - DNA, 16 bp, Homo sapiens
cctcatgttctgtggg

SEQ ID NO: 1537842 - DNA, 13 bp, Homo sapiens
cctcattcaggaa

SEQ ID NO: 1537843 - DNA, 22 bp, Homo sapiens
cctcattcaggaaaactgacag

SEQ ID NO: 1537844 - DNA, 13 bp, Homo sapiens
cctcattcctgaa

SEQ ID NO: 1537845 - DNA, 12 bp, Homo sapiens
cctcattctgaa

SEQ ID NO: 1537846 - DNA, 16 bp, Homo sapiens
cctcattgcctcctgt

SEQ ID NO: 1537847 - DNA, 17 bp, Homo sapiens
cctcatttctgccagcg

SEQ ID NO: 1537848 - DNA, 20 bp, Homo sapiens
cctcatttgaatgtgtgaat

SEQ ID NO: 1537849 - DNA, 14 bp, Homo sapiens
cctccaaacctcca

SEQ ID NO: 1537850 - DNA, 18 bp, Homo sapiens
cctccaaacctccagcct

SEQ ID NO: 1537851 - DNA, 16 bp, Homo sapiens
cctccaaagagccttc

SEQ ID NO: 1537852 - DNA, 17 bp, Homo sapiens
cctccaaagtggagctg

SEQ ID NO: 1537853 - DNA, 20 bp, Homo sapiens
cctccaaccaaataagactt

SEQ ID NO: 1537854 - DNA, 16 bp, Homo sapiens
cctccaacgcccctgt

SEQ ID NO: 1537855 - DNA, 19 bp, Homo sapiens
cctccaacgcccctgtggc

SEQ ID NO: 1537856 - DNA, 21 bp, Homo sapiens
cctccaacgcccctgtggcca

SEQ ID NO: 1537857 - DNA, 14 bp, Homo sapiens
cctccaagcaagta

SEQ ID NO: 1537858 - DNA, 14 bp, Homo sapiens
cctccaagcatttc

SEQ ID NO: 1537859 - DNA, 17 bp, Homo sapiens
cctccaagcatttcatg

SEQ ID NO: 1537860 - DNA, 18 bp, Homo sapiens
cctccaagcatttcatga

SEQ ID NO: 1537861 - DNA, 22 bp, Homo sapiens
cctccaatcccaccaaccctca

SEQ ID NO: 1537862 - DNA, 21 bp, Homo sapiens
cctccaatgcattggcctctg

SEQ ID NO: 1537863 - DNA, 22 bp, Homo sapiens
cctccacacaaacctaaaaatt

SEQ ID NO: 1537864 - DNA, 13 bp, Homo sapiens
cctccacagagag

SEQ ID NO: 1537865 - DNA, 16 bp, Homo sapiens
cctccacagccgcagc

SEQ ID NO: 1537866 - DNA, 20 bp, Homo sapiens
cctccacagcgagggcagct

SEQ ID NO: 1537867 - DNA, 18 bp, Homo sapiens
cctccacagctgcagctg

SEQ ID NO: 1537868 - DNA, 14 bp, Homo sapiens
cctccacagtgctg

SEQ ID NO: 1537869 - DNA, 18 bp, Homo sapiens
cctccacagtgctgcttc

SEQ ID NO: 1537870 - DNA, 14 bp, Homo sapiens
cctccaccagcctg

SEQ ID NO: 1537871 - DNA, 18 bp, Homo sapiens
cctccaccagcctgctga

SEQ ID NO: 1537872 - DNA, 12 bp, Homo sapiens
cctccaccatgc

SEQ ID NO: 1537873 - DNA, 10 bp, Homo sapiens
cctccaccca

SEQ ID NO: 1537874 - DNA, 11 bp, Homo sapiens
cctccaccctg

SEQ ID NO: 1537875 - DNA, 13 bp, Homo sapiens
cctccaccctgca

SEQ ID NO: 1537876 - DNA, 16 bp, Homo sapiens
cctccaccctgtcccc

SEQ ID NO: 1537877 - DNA, 20 bp, Homo sapiens
cctccaccctgtcccccagc

SEQ ID NO: 1537878 - DNA, 24 bp, Homo sapiens
cctccaccctgtcccccagctctg

SEQ ID NO: 1537879 - DNA, 17 bp, Homo sapiens
cctccaccgagccagct

SEQ ID NO: 1537880 - DNA, 21 bp, Homo sapiens
cctccaccgagccagcttggt

SEQ ID NO: 1537881 - DNA, 13 bp, Homo sapiens
cctccaccgctgc

SEQ ID NO: 1537882 - DNA, 22 bp, Homo sapiens
cctccactccacatctgcatca

SEQ ID NO: 1537883 - DNA, 22 bp, Homo sapiens
cctccactctcccccaccccct

SEQ ID NO: 1537884 - DNA, 18 bp, Homo sapiens
cctccactgtgtccagag

SEQ ID NO: 1537885 - DNA, 19 bp, Homo sapiens
cctccagaagcctctggct

SEQ ID NO: 1537886 - DNA, 21 bp, Homo sapiens
cctccagaagcctctggctag

SEQ ID NO: 1537887 - DNA, 22 bp, Homo sapiens
cctccagaagcctctggctaga

SEQ ID NO: 1537888 - DNA, 13 bp, Homo sapiens
cctccagaagctg

SEQ ID NO: 1537889 - DNA, 24 bp, Homo sapiens
cctccagacacccagaatgtagca

SEQ ID NO: 1537890 - DNA, 18 bp, Homo sapiens
cctccagaccctgcctga

SEQ ID NO: 1537891 - DNA, 19 bp, Homo sapiens
cctccagaccctgcctgag

SEQ ID NO: 1537892 - DNA, 21 bp, Homo sapiens
cctccagaccctgcctgagcc

SEQ ID NO: 1537893 - DNA, 16 bp, Homo sapiens
cctccagagccagcct

SEQ ID NO: 1537894 - DNA, 17 bp, Homo sapiens
cctccagagccagcctg

SEQ ID NO: 1537895 - DNA, 15 bp, Homo sapiens
cctccagcacacaca

SEQ ID NO: 1537896 - DNA, 22 bp, Homo sapiens
cctcaaattttttgactttttt

SEQ ID NO: 1537897 - DNA, 19 bp, Homo sapiens
cctcaacgttgctccccat

SEQ ID NO: 1537898 - DNA, 21 bp, Homo sapiens
cctcaactcacctaatgttta

SEQ ID NO: 1537899 - DNA, 23 bp, Homo sapiens
cctcaactgagggccagggaccc

SEQ ID NO: 1537900 - DNA, 14 bp, Homo sapiens
cctcaactgcctac

SEQ ID NO: 1537901 - DNA, 13 bp, Homo sapiens
cctcaagcaacca

SEQ ID NO: 1537902 - DNA, 21 bp, Homo sapiens
cctcaaggacaaagtctccag

SEQ ID NO: 1537903 - DNA, 23 bp, Homo sapiens
cctcaaggttttaggttctaaag

SEQ ID NO: 1537904 - DNA, 14 bp, Homo sapiens
cctcaatgccctgc

SEQ ID NO: 1537905 - DNA, 16 bp, Homo sapiens
cctcaatgccctgcca

SEQ ID NO: 1537906 - DNA, 17 bp, Homo sapiens
cctcaatgccctgccat

SEQ ID NO: 1537907 - DNA, 21 bp, Homo sapiens
cctcaatgtgaatcagaccct

SEQ ID NO: 1537908 - DNA, 14 bp, Homo sapiens
cctcacaacccctg

SEQ ID NO: 1537909 - DNA, 12 bp, Homo sapiens
cctcacacccct

SEQ ID NO: 1537910 - DNA, 13 bp, Homo sapiens
cctcacacccctg

SEQ ID NO: 1537911 - DNA, 16 bp, Homo sapiens
cctcacatctttcaca

SEQ ID NO: 1537912 - DNA, 12 bp, Homo sapiens
cctcacatttgt

SEQ ID NO: 1537913 - DNA, 21 bp, Homo sapiens
cctcaccaaaacgatgaagtt

SEQ ID NO: 1537914 - DNA, 15 bp, Homo sapiens
cctcaccaccacact

SEQ ID NO: 1537915 - DNA, 15 bp, Homo sapiens
cctcaccacccactt

SEQ ID NO: 1537916 - DNA, 19 bp, Homo sapiens
cctcaccatccagtgggcc

SEQ ID NO: 1537917 - DNA, 21 bp, Homo sapiens
cctcaccatccagtgggcccg

SEQ ID NO: 1537918 - DNA, 16 bp, Homo sapiens
cctcacccacccctgc

SEQ ID NO: 1537919 - DNA, 17 bp, Homo sapiens
cctcacccccagctttg

SEQ ID NO: 1537920 - DNA, 19 bp, Homo sapiens
cctcacccccagctttgct

SEQ ID NO: 1537921 - DNA, 17 bp, Homo sapiens
cctcaccccgtctgggg

SEQ ID NO: 1537922 - DNA, 13 bp, Homo sapiens
cctcacccctgcc

SEQ ID NO: 1537923 - DNA, 17 bp, Homo sapiens
cctcacccctgccctgg

SEQ ID NO: 1537924 - DNA, 18 bp, Homo sapiens
cctcacccctgccctggg

SEQ ID NO: 1537925 - DNA, 14 bp, Homo sapiens
cctcacctcatgcc

SEQ ID NO: 1537926 - DNA, 15 bp, Homo sapiens
cctcacctcatgccc

SEQ ID NO: 1537927 - DNA, 17 bp, Homo sapiens
cctcacctcatgcccac

SEQ ID NO: 1537928 - DNA, 22 bp, Homo sapiens
cctcacctcatgcccaccccct

SEQ ID NO: 1537929 - DNA, 14 bp, Homo sapiens
cctcacctcctcta

SEQ ID NO: 1537930 - DNA, 16 bp, Homo sapiens
cctcacctctgaggac

SEQ ID NO: 1537931 - DNA, 18 bp, Homo sapiens
cctcacctctgaggacag

SEQ ID NO: 1537932 - DNA, 12 bp, Homo sapiens
cctcacctctgg

SEQ ID NO: 1537933 - DNA, 12 bp, Homo sapiens
cctcacctgggc

SEQ ID NO: 1537934 - DNA, 12 bp, Homo sapiens
cctcacctggtc

SEQ ID NO: 1537935 - DNA, 14 bp, Homo sapiens
cctcacctgtctag

SEQ ID NO: 1537936 - DNA, 18 bp, Homo sapiens
cctcacggggttggctgt

SEQ ID NO: 1537937 - DNA, 22 bp, Homo sapiens
cctcacggggttggctgttcca

SEQ ID NO: 1537938 - DNA, 21 bp, Homo sapiens
cctcacgtatttcacagagca

SEQ ID NO: 1537939 - DNA, 21 bp, Homo sapiens
cctcactatgttgcctaggct

SEQ ID NO: 1537940 - DNA, 20 bp, Homo sapiens
cctcactcaagaccaggctg

SEQ ID NO: 1537941 - DNA, 14 bp, Homo sapiens
cctcactccccagg

SEQ ID NO: 1537942 - DNA, 13 bp, Homo sapiens
cctcactccctct

SEQ ID NO: 1537943 - DNA, 14 bp, Homo sapiens
cctcactccctctg

SEQ ID NO: 1537944 - DNA, 18 bp, Homo sapiens
cctcactccctctgcaga

SEQ ID NO: 1537945 - DNA, 13 bp, Homo sapiens
cctcactcctgtt

SEQ ID NO: 1537946 - DNA, 12 bp, Homo sapiens
cctcactcttga

SEQ ID NO: 1537947 - DNA, 13 bp, Homo sapiens
cctcactcttgaa

SEQ ID NO: 1537948 - DNA, 21 bp, Homo sapiens
cctcactcttgaagtccagga

SEQ ID NO: 1537949 - DNA, 22 bp, Homo sapiens
cctcactcttgaagtccaggac

SEQ ID NO: 1537950 - DNA, 13 bp, Homo sapiens
cctcactgagagg

SEQ ID NO: 1537951 - DNA, 21 bp, Homo sapiens
cctcactgagaggcctggagc

SEQ ID NO: 1537952 - DNA, 18 bp, Homo sapiens
cctcactggaggagcagc

SEQ ID NO: 1537953 - DNA, 17 bp, Homo sapiens
cctcactggctggggca

SEQ ID NO: 1537954 - DNA, 20 bp, Homo sapiens
cctcactggggtcctggggc

SEQ ID NO: 1537955 - DNA, 23 bp, Homo sapiens
cctcactggggtcctggggcctc

SEQ ID NO: 1537956 - DNA, 22 bp, Homo sapiens
cctcacttcccgtagctgccag

SEQ ID NO: 1537957 - DNA, 14 bp, Homo sapiens
cctcacttctgtct

SEQ ID NO: 1537958 - DNA, 15 bp, Homo sapiens
cctcacttctgtctc

SEQ ID NO: 1537959 - DNA, 22 bp, Homo sapiens
cctcacttctgtctcctgtctt

SEQ ID NO: 1537960 - DNA, 18 bp, Homo sapiens
cctcacttggctgtctga

SEQ ID NO: 1537961 - DNA, 13 bp, Homo sapiens
cctcagaactctt

SEQ ID NO: 1537962 - DNA, 14 bp, Homo sapiens
cctcagaagaaaac

SEQ ID NO: 1537963 - DNA, 19 bp, Homo sapiens
cctcagaagaaaacaaagt

SEQ ID NO: 1537964 - DNA, 19 bp, Homo sapiens
cctcagaaggccccagaga

SEQ ID NO: 1537965 - DNA, 16 bp, Homo sapiens
cctcagagacaccaaa

SEQ ID NO: 1537966 - DNA, 18 bp, Homo sapiens
cctcagagacaccaaact

SEQ ID NO: 1537967 - DNA, 16 bp, Homo sapiens
cctcagagccacccct

SEQ ID NO: 1537968 - DNA, 17 bp, Homo sapiens
cctcagatctgaacaca

SEQ ID NO: 1537969 - DNA, 12 bp, Homo sapiens
cctcagatgggg

SEQ ID NO: 1537970 - DNA, 16 bp, Homo sapiens
cctcagattcttcatt

SEQ ID NO: 1537971 - DNA, 20 bp, Homo sapiens
cctcagcaccccttccatgt

SEQ ID NO: 1537972 - DNA, 16 bp, Homo sapiens
cctcagccacacccag

SEQ ID NO: 1537973 - DNA, 19 bp, Homo sapiens
cctcagccccactgacacc

SEQ ID NO: 1537974 - DNA, 19 bp, Homo sapiens
cctcagcccgccaaggtag

SEQ ID NO: 1537975 - DNA, 16 bp, Homo sapiens
cctcagcccttgcccc

SEQ ID NO: 1537976 - DNA, 16 bp, Homo sapiens
cctcagcctagaccct

SEQ ID NO: 1537977 - DNA, 19 bp, Homo sapiens
cctcagcctagaccctcct

SEQ ID NO: 1537978 - DNA, 18 bp, Homo sapiens
cctcagcctccaaagtgg

SEQ ID NO: 1537979 - DNA, 22 bp, Homo sapiens
cctcagcctccaaagtggagct

SEQ ID NO: 1537980 - DNA, 14 bp, Homo sapiens
cctcagcctcctga

SEQ ID NO: 1537981 - DNA, 12 bp, Homo sapiens
cctcagcctgca

SEQ ID NO: 1537982 - DNA, 14 bp, Homo sapiens
cctcagcctgcaca

SEQ ID NO: 1537983 - DNA, 12 bp, Homo sapiens
cctcagcctggc

SEQ ID NO: 1537984 - DNA, 14 bp, Homo sapiens
cctcagcctggcca

SEQ ID NO: 1537985 - DNA, 20 bp, Homo sapiens
cctcagccttgaaaaacaag

SEQ ID NO: 1537986 - DNA, 18 bp, Homo sapiens
cctcagccttgccagaga

SEQ ID NO: 1537987 - DNA, 20 bp, Homo sapiens
catggctgcttgattttgta

SEQ ID NO: 1537988 - DNA, 14 bp, Homo sapiens
catggctggcctgg

SEQ ID NO: 1537989 - DNA, 13 bp, Homo sapiens
gggttcccctggc

SEQ ID NO: 1537990 - DNA, 18 bp, Homo sapiens
gggttccctttccttcca

SEQ ID NO: 1537991 - DNA, 21 bp, Homo sapiens
gggttccctttccttccatcc

SEQ ID NO: 1537992 - DNA, 21 bp, Homo sapiens
gggttcgcaccattctcctgc

SEQ ID NO: 1537993 - DNA, 12 bp, Homo sapiens
gggttctagacg

SEQ ID NO: 1537994 - DNA, 21 bp, Homo sapiens
gggttctgcagcggcagagca

SEQ ID NO: 1537995 - DNA, 19 bp, Homo sapiens
gggttctgccctgcctgag

SEQ ID NO: 1537996 - DNA, 20 bp, Homo sapiens
gggttgaagacggaaaacaa

SEQ ID NO: 1537997 - DNA, 13 bp, Homo sapiens
gggttgaaggcag

SEQ ID NO: 1537998 - DNA, 18 bp, Homo sapiens
gggttgaaggcagtctga

SEQ ID NO: 1537999 - DNA, 12 bp, Homo sapiens
gggttgggccca

SEQ ID NO: 1538000 - DNA, 19 bp, Homo sapiens
gggttggtgcacagtgatt

SEQ ID NO: 1538001 - DNA, 18 bp, Homo sapiens
gggtttgcactccacaca

SEQ ID NO: 1538002 - DNA, 20 bp, Homo sapiens
gggtttggaccccagctggg

SEQ ID NO: 1538003 - DNA, 21 bp, Homo sapiens
gggtttgtgtttgattggctt

SEQ ID NO: 1538004 - DNA, 20 bp, Homo sapiens
gggttttattgtttaaaatc

SEQ ID NO: 1538005 - DNA, 18 bp, Homo sapiens
gggttttccaatgtgact

SEQ ID NO: 1538006 - DNA, 12 bp, Homo sapiens
gggttttgtatt

SEQ ID NO: 1538007 - DNA, 17 bp, Homo sapiens
cactgtgaggggaaggc

SEQ ID NO: 1538008 - DNA, 13 bp, Homo sapiens
cactgtgccctgg

SEQ ID NO: 1538009 - DNA, 21 bp, Homo sapiens
cactgtgcctcagagaccagg

SEQ ID NO: 1538010 - DNA, 22 bp, Homo sapiens
cactgtgcctcagagaccaggg

SEQ ID NO: 1538011 - DNA, 19 bp, Homo sapiens
cactgtgcgtcttggtgta

SEQ ID NO: 1538012 - DNA, 22 bp, Homo sapiens
cactgtgcgtcttggtgtaatt

SEQ ID NO: 1538013 - DNA, 15 bp, Homo sapiens
cactgtgctggggca

SEQ ID NO: 1538014 - DNA, 16 bp, Homo sapiens
cactgtggccacagcc

SEQ ID NO: 1538015 - DNA, 19 bp, Homo sapiens
cactgtggccacagccccc

SEQ ID NO: 1538016 - DNA, 20 bp, Homo sapiens
cactgtggccacagccccct

SEQ ID NO: 1538017 - DNA, 13 bp, Homo sapiens
cactgtggccaga

SEQ ID NO: 1538018 - DNA, 20 bp, Homo sapiens
cactgtggccagagctggaa

SEQ ID NO: 1538019 - DNA, 22 bp, Homo sapiens
cactgtggccagagctggaagg

SEQ ID NO: 1538020 - DNA, 16 bp, Homo sapiens
cactgtgggactcttc

SEQ ID NO: 1538021 - DNA, 15 bp, Homo sapiens
cactgtgtatttaac

SEQ ID NO: 1538022 - DNA, 21 bp, Homo sapiens
cactgttaatacacagtactt

SEQ ID NO: 1538023 - DNA, 17 bp, Homo sapiens
cactgttactccacagc

SEQ ID NO: 1538024 - DNA, 21 bp, Homo sapiens
cactgttatcattttttcctg

SEQ ID NO: 1538025 - DNA, 20 bp, Homo sapiens
cactgttccctctggcttcc

SEQ ID NO: 1538026 - DNA, 21 bp, Homo sapiens
cactgttctgaaaggagacat

SEQ ID NO: 1538027 - DNA, 13 bp, Homo sapiens
cactgttgaattt

SEQ ID NO: 1538028 - DNA, 21 bp, Homo sapiens
cactgttgcagtggcctggcc

SEQ ID NO: 1538029 - DNA, 21 bp, Homo sapiens
cactgtttatacactgtgtaa

SEQ ID NO: 1538030 - DNA, 20 bp, Homo sapiens
cactgtttctcttgagctgg

SEQ ID NO: 1538031 - DNA, 15 bp, Homo sapiens
cactgtttgttttta

SEQ ID NO: 1538032 - DNA, 18 bp, Homo sapiens
cactgtttgtttttattt

SEQ ID NO: 1538033 - DNA, 14 bp, Homo sapiens
cacttaaaaaatgt

SEQ ID NO: 1538034 - DNA, 12 bp, Homo sapiens
cacttaaatttc

SEQ ID NO: 1538035 - DNA, 20 bp, Homo sapiens
cacttaaatttcttggcaaa

SEQ ID NO: 1538036 - DNA, 22 bp, Homo sapiens
cacttaaatttgttctttgttt

SEQ ID NO: 1538037 - DNA, 22 bp, Homo sapiens
cacttaactataaggtgcctca

SEQ ID NO: 1538038 - DNA, 13 bp, Homo sapiens
cacttaagactgt

SEQ ID NO: 1538039 - DNA, 16 bp, Homo sapiens
cacttaagtcttcctt

SEQ ID NO: 1538040 - DNA, 16 bp, Homo sapiens
cacttaagtgcacttt

SEQ ID NO: 1538041 - DNA, 17 bp, Homo sapiens
cacttaagtgcactttt

SEQ ID NO: 1538042 - DNA, 14 bp, Homo sapiens
cacttaagtgtctg

SEQ ID NO: 1538043 - DNA, 21 bp, Homo sapiens
cacttaagttagcctccacca

SEQ ID NO: 1538044 - DNA, 14 bp, Homo sapiens
cacttaatgtatgt

SEQ ID NO: 1538045 - DNA, 20 bp, Homo sapiens
cacttacacttataaaataa

SEQ ID NO: 1538046 - DNA, 16 bp, Homo sapiens
cacttacgtaaaacat

SEQ ID NO: 1538047 - DNA, 18 bp, Homo sapiens
cacttacgtaaaacattt

SEQ ID NO: 1538048 - DNA, 17 bp, Homo sapiens
cacttacgtttgtcctt

SEQ ID NO: 1538049 - DNA, 21 bp, Homo sapiens
cacttactatccatttcttca

SEQ ID NO: 1538050 - DNA, 19 bp, Homo sapiens
cacttagaaattgcatttc

SEQ ID NO: 1538051 - DNA, 24 bp, Homo sapiens
cacttagaaattgcatttcctgac

SEQ ID NO: 1538052 - DNA, 23 bp, Homo sapiens
cacttagcaggcaccgccacgtc

SEQ ID NO: 1538053 - DNA, 15 bp, Homo sapiens
cacttagcccaagag

SEQ ID NO: 1538054 - DNA, 16 bp, Homo sapiens
cacttagcccaagagg

SEQ ID NO: 1538055 - DNA, 17 bp, Homo sapiens
cacttagccgcaccctg

SEQ ID NO: 1538056 - DNA, 12 bp, Homo sapiens
cacttagtcctt

SEQ ID NO: 1538057 - DNA, 21 bp, Homo sapiens
cacttataaaataacttgcat

SEQ ID NO: 1538058 - DNA, 21 bp, Homo sapiens
cacttatattttatgaacatt

SEQ ID NO: 1538059 - DNA, 23 bp, Homo sapiens
cacttatattttatgaacattgt

SEQ ID NO: 1538060 - DNA, 17 bp, Homo sapiens
cacttatcagcatgaag

SEQ ID NO: 1538061 - DNA, 20 bp, Homo sapiens
cacttattgtccaggtgagg

SEQ ID NO: 1538062 - DNA, 23 bp, Homo sapiens
cacttcaagctgttatttcttcc

SEQ ID NO: 1538063 - DNA, 13 bp, Homo sapiens
cacttcaccccca

SEQ ID NO: 1538064 - DNA, 21 bp, Homo sapiens
cacttcactgcgaagaccctc

SEQ ID NO: 1538065 - DNA, 13 bp, Homo sapiens
cacttcactgtga

SEQ ID NO: 1538066 - DNA, 20 bp, Homo sapiens
cacttcaggctcttctcctt

SEQ ID NO: 1538067 - DNA, 16 bp, Homo sapiens
cacttcattgagagtt

SEQ ID NO: 1538068 - DNA, 17 bp, Homo sapiens
cacttccaccagcctgc

SEQ ID NO: 1538069 - DNA, 18 bp, Homo sapiens
cacttccaccagcctgca

SEQ ID NO: 1538070 - DNA, 14 bp, Homo sapiens
cacttccagtgttg

SEQ ID NO: 1538071 - DNA, 13 bp, Homo sapiens
cacttccatggga

SEQ ID NO: 1538072 - DNA, 21 bp, Homo sapiens
cacttcccaggatctgctcca

SEQ ID NO: 1538073 - DNA, 14 bp, Homo sapiens
cacttccccatctt

SEQ ID NO: 1538074 - DNA, 16 bp, Homo sapiens
cacttcccgtttcctc

SEQ ID NO: 1538075 - DNA, 17 bp, Homo sapiens
cacttccctctgtttct

SEQ ID NO: 1538076 - DNA, 17 bp, Homo sapiens
cacttcctacaagagca

SEQ ID NO: 1538077 - DNA, 14 bp, Homo sapiens
cacttcctgaggcc

SEQ ID NO: 1538078 - DNA, 15 bp, Homo sapiens
cacttcctgaggcct

SEQ ID NO: 1538079 - DNA, 16 bp, Homo sapiens
cacttcctgaggcctc

SEQ ID NO: 1538080 - DNA, 17 bp, Homo sapiens
cacttcctgaggcctca

SEQ ID NO: 1538081 - DNA, 21 bp, Homo sapiens
cacttcgcgtgccctcgctgc

SEQ ID NO: 1538082 - DNA, 21 bp, Homo sapiens
cacttctagatctcagccatt

SEQ ID NO: 1538083 - DNA, 11 bp, Homo sapiens
cacttctattt

SEQ ID NO: 1538084 - DNA, 13 bp, Homo sapiens
cacttctatttaa

SEQ ID NO: 1538085 - DNA, 12 bp, Homo sapiens
cacttctccccg

SEQ ID NO: 1538086 - DNA, 17 bp, Homo sapiens
cacttctccccgcagcc

SEQ ID NO: 1538087 - DNA, 15 bp, Homo sapiens
cacttctgctttcac

SEQ ID NO: 1538088 - DNA, 15 bp, Homo sapiens
cacttctggtataat

SEQ ID NO: 1538089 - DNA, 13 bp, Homo sapiens
cacttctgtaaac

SEQ ID NO: 1538090 - DNA, 15 bp, Homo sapiens
cacttctgtctcctg

SEQ ID NO: 1538091 - DNA, 13 bp, Homo sapiens
cacttctgtgcca

SEQ ID NO: 1538092 - DNA, 13 bp, Homo sapiens
cacttctgtttag

SEQ ID NO: 1538093 - DNA, 15 bp, Homo sapiens
cacttcttcctattg

SEQ ID NO: 1538094 - DNA, 18 bp, Homo sapiens
cacttcttgttccccact

SEQ ID NO: 1538095 - DNA, 21 bp, Homo sapiens
cacttgaaacctttttttatc

SEQ ID NO: 1538096 - DNA, 12 bp, Homo sapiens
cacttgaaagat

SEQ ID NO: 1538097 - DNA, 19 bp, Homo sapiens
cacttgaaagattttattg

SEQ ID NO: 1538098 - DNA, 18 bp, Homo sapiens
cacttgaacccgggaggc

SEQ ID NO: 1538099 - DNA, 19 bp, Homo sapiens
cacttgaagcctaaatttg

SEQ ID NO: 1538100 - DNA, 18 bp, Homo sapiens
cacttgaatttattgata

SEQ ID NO: 1538101 - DNA, 17 bp, Homo sapiens
cacttgaggcctgatct

SEQ ID NO: 1538102 - DNA, 22 bp, Homo sapiens
cacttgaggtcaggagttccta

SEQ ID NO: 1538103 - DNA, 11 bp, Homo sapiens
cacttgagttt

SEQ ID NO: 1538104 - DNA, 18 bp, Homo sapiens
cacttgatgtttcctgga

SEQ ID NO: 1538105 - DNA, 12 bp, Homo sapiens
cacttgcatttc

SEQ ID NO: 1538106 - DNA, 17 bp, Homo sapiens
cacttgccatgcaggaa

SEQ ID NO: 1538107 - DNA, 23 bp, Homo sapiens
cacttgccatgcaggaagaggcc

SEQ ID NO: 1538108 - DNA, 14 bp, Homo sapiens
cacttgcctcttcc

SEQ ID NO: 1538109 - DNA, 17 bp, Homo sapiens
cacttgcctcttccttg

SEQ ID NO: 1538110 - DNA, 13 bp, Homo sapiens
cacttgcctgggt

SEQ ID NO: 1538111 - DNA, 15 bp, Homo sapiens
cacttgcgtcctgca

SEQ ID NO: 1538112 - DNA, 20 bp, Homo sapiens
cacttgctagtgatacactg

SEQ ID NO: 1538113 - DNA, 20 bp, Homo sapiens
cacttggcatacaaaatatt

SEQ ID NO: 1538114 - DNA, 15 bp, Homo sapiens
cacttggctgtctga

SEQ ID NO: 1538115 - DNA, 19 bp, Homo sapiens
cacttggctgtctgaccag

SEQ ID NO: 1538116 - DNA, 16 bp, Homo sapiens
cacttgggtcttccct

SEQ ID NO: 1538117 - DNA, 21 bp, Homo sapiens
cacttggttgggtcctcacat

SEQ ID NO: 1538118 - DNA, 18 bp, Homo sapiens
cacttggtttttggctct

SEQ ID NO: 1538119 - DNA, 17 bp, Homo sapiens
cacttgtattgacttta

SEQ ID NO: 1538120 - DNA, 21 bp, Homo sapiens
cacttgtgacttttgctttaa

SEQ ID NO: 1538121 - DNA, 12 bp, Homo sapiens
cacttgtgggct

SEQ ID NO: 1538122 - DNA, 13 bp, Homo sapiens
cacttgtgtgtgg

SEQ ID NO: 1538123 - DNA, 14 bp, Homo sapiens
cacttgtgtgtggg

SEQ ID NO: 1538124 - DNA, 19 bp, Homo sapiens
ggtaaaaacagcagctcat

SEQ ID NO: 1538125 - DNA, 20 bp, Homo sapiens
ggtaaaaacagcagctcata

SEQ ID NO: 1538126 - DNA, 18 bp, Homo sapiens
ggtaaaaagtattttttc

SEQ ID NO: 1538127 - DNA, 18 bp, Homo sapiens
ggtaaaaagtggctgcgg

SEQ ID NO: 1538128 - DNA, 16 bp, Homo sapiens
ggtaaaaatgctgctc

SEQ ID NO: 1538129 - DNA, 17 bp, Homo sapiens
ggtaaaaatgctgctct

SEQ ID NO: 1538130 - DNA, 15 bp, Homo sapiens
ggtaaataaaccact

SEQ ID NO: 1538131 - DNA, 14 bp, Homo sapiens
ggtaaatactgtga

SEQ ID NO: 1538132 - DNA, 15 bp, Homo sapiens
ggtaaatcagtaaga

SEQ ID NO: 1538133 - DNA, 16 bp, Homo sapiens
ggtaaatctagagttt

SEQ ID NO: 1538134 - DNA, 16 bp, Homo sapiens
ggtaaatgtttctttt

SEQ ID NO: 1538135 - DNA, 19 bp, Homo sapiens
ggtaaattcagacaacatt

SEQ ID NO: 1538136 - DNA, 22 bp, Homo sapiens
ggtaaattgtcgggggagagag

SEQ ID NO: 1538137 - DNA, 14 bp, Homo sapiens
ggtaacagtggctg

SEQ ID NO: 1538138 - DNA, 14 bp, Homo sapiens
ggtaactgtcctgt

SEQ ID NO: 1538139 - DNA, 16 bp, Homo sapiens
ggtaactgtcctgtcc

SEQ ID NO: 1538140 - DNA, 24 bp, Homo sapiens
ggtaacttttgtgaattaggctgt

SEQ ID NO: 1538141 - DNA, 15 bp, Homo sapiens
ggtaagaagaaagca

SEQ ID NO: 1538142 - DNA, 23 bp, Homo sapiens
ggtaagaagccgggaacagacaa

SEQ ID NO: 1538143 - DNA, 22 bp, Homo sapiens
ggtaagaggagcagagggcagg

SEQ ID NO: 1538144 - DNA, 13 bp, Homo sapiens
ggtaaggtgcctt

SEQ ID NO: 1538145 - DNA, 19 bp, Homo sapiens
ggtaatagtgacatgcagg

SEQ ID NO: 1538146 - DNA, 18 bp, Homo sapiens
ggtaatctacaccaatga

SEQ ID NO: 1538147 - DNA, 23 bp, Homo sapiens
ggtaattattttggtacttttat

SEQ ID NO: 1538148 - DNA, 18 bp, Homo sapiens
ggtaattgtacaataaat

SEQ ID NO: 1538149 - DNA, 20 bp, Homo sapiens
ggtaattgtacaataaattt

SEQ ID NO: 1538150 - DNA, 20 bp, Homo sapiens
ggtaattgttttttaaagca

SEQ ID NO: 1538151 - DNA, 16 bp, Homo sapiens
ggtacaactgtattta

SEQ ID NO: 1538152 - DNA, 20 bp, Homo sapiens
ggtacagaaaacatgtttaa

SEQ ID NO: 1538153 - DNA, 23 bp, Homo sapiens
ggtacagcaacaggaatctcaga

SEQ ID NO: 1538154 - DNA, 14 bp, Homo sapiens
ggtacagcttctgg

SEQ ID NO: 1538155 - DNA, 18 bp, Homo sapiens
ggtacagcttctggagca

SEQ ID NO: 1538156 - DNA, 16 bp, Homo sapiens
ggtacaggagaggcag

SEQ ID NO: 1538157 - DNA, 12 bp, Homo sapiens
ggtacagtttgg

SEQ ID NO: 1538158 - DNA, 17 bp, Homo sapiens
ggtaccaaacaaggaag

SEQ ID NO: 1538159 - DNA, 12 bp, Homo sapiens
ggtaccagctgc

SEQ ID NO: 1538160 - DNA, 11 bp, Homo sapiens
ggtaccctggg

SEQ ID NO: 1538161 - DNA, 17 bp, Homo sapiens
ggtaccgatttctgcta

SEQ ID NO: 1538162 - DNA, 18 bp, Homo sapiens
ggtacctgcaagcagaac

SEQ ID NO: 1538163 - DNA, 17 bp, Homo sapiens
ggtacctgccctctatt

SEQ ID NO: 1538164 - DNA, 16 bp, Homo sapiens
ggtaccttgtgcccag

SEQ ID NO: 1538165 - DNA, 17 bp, Homo sapiens
ggtaccttgtgcccagg

SEQ ID NO: 1538166 - DNA, 13 bp, Homo sapiens
ggtacggagaaga

SEQ ID NO: 1538167 - DNA, 18 bp, Homo sapiens
ggtactgactttgcttgc

SEQ ID NO: 1538168 - DNA, 20 bp, Homo sapiens
ggtactgcattctctcccat

SEQ ID NO: 1538169 - DNA, 16 bp, Homo sapiens
ggtacttacccggaga

SEQ ID NO: 1538170 - DNA, 15 bp, Homo sapiens
ggtacttcctcctga

SEQ ID NO: 1538171 - DNA, 23 bp, Homo sapiens
ggtagaaatatctgaaaatgtat

SEQ ID NO: 1538172 - DNA, 21 bp, Homo sapiens
ggtagaaggggaggacactgg

SEQ ID NO: 1538173 - DNA, 12 bp, Homo sapiens
ggtagagacccc

SEQ ID NO: 1538174 - DNA, 19 bp, Homo sapiens
ggtagagacccccaggcct

SEQ ID NO: 1538175 - DNA, 18 bp, Homo sapiens
ggtagatcacgagatcaa

SEQ ID NO: 1538176 - DNA, 16 bp, Homo sapiens
ggtagatcgcttgagc

SEQ ID NO: 1538177 - DNA, 21 bp, Homo sapiens
ggtagatcgcttgagcccagg

SEQ ID NO: 1538178 - DNA, 14 bp, Homo sapiens
ggtagattcgctgt

SEQ ID NO: 1538179 - DNA, 15 bp, Homo sapiens
ggtagattcgctgtc

SEQ ID NO: 1538180 - DNA, 19 bp, Homo sapiens
ggtagcaattggcagccct

SEQ ID NO: 1538181 - DNA, 14 bp, Homo sapiens
ggtagcacagcact

SEQ ID NO: 1538182 - DNA, 16 bp, Homo sapiens
ggtagcagcaggctca

SEQ ID NO: 1538183 - DNA, 16 bp, Homo sapiens
ggtagccatcatggat

SEQ ID NO: 1538184 - DNA, 12 bp, Homo sapiens
ggtagccatccc

SEQ ID NO: 1538185 - DNA, 21 bp, Homo sapiens
ggtagccatgatttgtcccag

SEQ ID NO: 1538186 - DNA, 14 bp, Homo sapiens
ggtagctccagcga

SEQ ID NO: 1538187 - DNA, 18 bp, Homo sapiens
ggtagctgggaaagcata

SEQ ID NO: 1538188 - DNA, 16 bp, Homo sapiens
ggtaggaactgctggg

SEQ ID NO: 1538189 - DNA, 19 bp, Homo sapiens
ggtaggaggtttggatggg

SEQ ID NO: 1538190 - DNA, 19 bp, Homo sapiens
ggtaggcccttgtcctgcc

SEQ ID NO: 1538191 - DNA, 22 bp, Homo sapiens
ggtaggcccttgtcctgccagc

SEQ ID NO: 1538192 - DNA, 23 bp, Homo sapiens
ggtaggcccttgtcctgccagct

SEQ ID NO: 1538193 - DNA, 17 bp, Homo sapiens
ggtaggttcagccaagg

SEQ ID NO: 1538194 - DNA, 16 bp, Homo sapiens
ggtagtgtagctgtgt

SEQ ID NO: 1538195 - DNA, 20 bp, Homo sapiens
ggtagttctgtgcctccccc

SEQ ID NO: 1538196 - DNA, 11 bp, Homo sapiens
ggtataaaagg

SEQ ID NO: 1538197 - DNA, 13 bp, Homo sapiens
ggtataaagacaa

SEQ ID NO: 1538198 - DNA, 20 bp, Homo sapiens
ggtataatggttgactgggt

SEQ ID NO: 1538199 - DNA, 19 bp, Homo sapiens
ggtataattgtgtgatatt

SEQ ID NO: 1538200 - DNA, 16 bp, Homo sapiens
ggtatacatgtgtaca

SEQ ID NO: 1538201 - DNA, 21 bp, Homo sapiens
ggtataggtctcatctcttca

SEQ ID NO: 1538202 - DNA, 22 bp, Homo sapiens
ggtatatcattataactgaagg

SEQ ID NO: 1538203 - DNA, 16 bp, Homo sapiens
ggtatatccaaaagct

SEQ ID NO: 1538204 - DNA, 15 bp, Homo sapiens
ggtatcaagaaagtc

SEQ ID NO: 1538205 - DNA, 23 bp, Homo sapiens
ggtatcattacaattttctgtaa

SEQ ID NO: 1538206 - DNA, 15 bp, Homo sapiens
ggtatcctgcccagt

SEQ ID NO: 1538207 - DNA, 22 bp, Homo sapiens
ggtatcgaaatttgttgtttgt

SEQ ID NO: 1538208 - DNA, 15 bp, Homo sapiens
ggtatctcagaaagt

SEQ ID NO: 1538209 - DNA, 20 bp, Homo sapiens
ggtatctcagaaagtgcctg

SEQ ID NO: 1538210 - DNA, 13 bp, Homo sapiens
ggtatctggcttc

SEQ ID NO: 1538211 - DNA, 21 bp, Homo sapiens
ggtatctggcttccctggaag

SEQ ID NO: 1538212 - DNA, 13 bp, Homo sapiens
ggtatgagggggt

SEQ ID NO: 1538213 - DNA, 14 bp, Homo sapiens
ggtatgcaatcaaa

SEQ ID NO: 1538214 - DNA, 15 bp, Homo sapiens
ggtatggaactctct

SEQ ID NO: 1538215 - DNA, 13 bp, Homo sapiens
ggtatgtctgcca

SEQ ID NO: 1538216 - DNA, 14 bp, Homo sapiens
ggtatgtctgccat

SEQ ID NO: 1538217 - DNA, 19 bp, Homo sapiens
ggtattaaaactaaatttc

SEQ ID NO: 1538218 - DNA, 22 bp, Homo sapiens
ggtattaatatatagtccagac

SEQ ID NO: 1538219 - DNA, 15 bp, Homo sapiens
cagaaatatagtgca

SEQ ID NO: 1538220 - DNA, 15 bp, Homo sapiens
cagaaatatgtggtt

SEQ ID NO: 1538221 - DNA, 14 bp, Homo sapiens
cagaaatcagagga

SEQ ID NO: 1538222 - DNA, 13 bp, Homo sapiens
cagaaatgcaaaa

SEQ ID NO: 1538223 - DNA, 17 bp, Homo sapiens
cagaaatgctgcctgcc

SEQ ID NO: 1538224 - DNA, 14 bp, Homo sapiens
cagaaatgctgctg

SEQ ID NO: 1538225 - DNA, 16 bp, Homo sapiens
cagaaatgctgctggc

SEQ ID NO: 1538226 - DNA, 11 bp, Homo sapiens
cagaaatgtct

SEQ ID NO: 1538227 - DNA, 14 bp, Homo sapiens
cagaaatgtctaaa

SEQ ID NO: 1538228 - DNA, 21 bp, Homo sapiens
cagaaatgtctaaatgctgaa

SEQ ID NO: 1538229 - DNA, 22 bp, Homo sapiens
cagaaatgttgagtctgtacta

SEQ ID NO: 1538230 - DNA, 20 bp, Homo sapiens
cagaaattcaatttggattt

SEQ ID NO: 1538231 - DNA, 17 bp, Homo sapiens
cagaaattctggcccag

SEQ ID NO: 1538232 - DNA, 15 bp, Homo sapiens
cagaaattgtatatt

SEQ ID NO: 1538233 - DNA, 16 bp, Homo sapiens
cagaaattgtatattg

SEQ ID NO: 1538234 - DNA, 18 bp, Homo sapiens
cagaaattgtatattgta

SEQ ID NO: 1538235 - DNA, 22 bp, Homo sapiens
cagaaatttaattcatgtttct

SEQ ID NO: 1538236 - DNA, 19 bp, Homo sapiens
cagaaatttttatttttct

SEQ ID NO: 1538237 - DNA, 14 bp, Homo sapiens
cagaacaaatgtgt

SEQ ID NO: 1538238 - DNA, 19 bp, Homo sapiens
cagaacaaatgtgtttttc

SEQ ID NO: 1538239 - DNA, 19 bp, Homo sapiens
cagaacacacagactttct

SEQ ID NO: 1538240 - DNA, 12 bp, Homo sapiens
cagaacagcaga

SEQ ID NO: 1538241 - DNA, 14 bp, Homo sapiens
cagaacagccctcg

SEQ ID NO: 1538242 - DNA, 20 bp, Homo sapiens
cagaacagccctcggcctcc

SEQ ID NO: 1538243 - DNA, 13 bp, Homo sapiens
ggtcactggaaag

SEQ ID NO: 1538244 - DNA, 16 bp, Homo sapiens
ggtcactggctctcca

SEQ ID NO: 1538245 - DNA, 23 bp, Homo sapiens
ggtcactttgccattatgcaaat

SEQ ID NO: 1538246 - DNA, 15 bp, Homo sapiens
ggtcagaacatgtta

SEQ ID NO: 1538247 - DNA, 17 bp, Homo sapiens
ggtcagagagacctcat

SEQ ID NO: 1538248 - DNA, 20 bp, Homo sapiens
ggtcagagggactgtcagct

SEQ ID NO: 1538249 - DNA, 23 bp, Homo sapiens
ggtcagagggactgtcagctgag

SEQ ID NO: 1538250 - DNA, 11 bp, Homo sapiens
ggtcagccatt

SEQ ID NO: 1538251 - DNA, 16 bp, Homo sapiens
ggtcagcccagcacct

SEQ ID NO: 1538252 - DNA, 22 bp, Homo sapiens
ggtcagcccagcacctgctccc

SEQ ID NO: 1538253 - DNA, 14 bp, Homo sapiens
ggtcagcctggaag

SEQ ID NO: 1538254 - DNA, 22 bp, Homo sapiens
ggtcaggagaggggcagaacag

SEQ ID NO: 1538255 - DNA, 21 bp, Homo sapiens
ggtcaggagttagaggccagc

SEQ ID NO: 1538256 - DNA, 18 bp, Homo sapiens
ggtcaggcggagctgctg

SEQ ID NO: 1538257 - DNA, 13 bp, Homo sapiens
ggtcagggccaga

SEQ ID NO: 1538258 - DNA, 15 bp, Homo sapiens
ggtcaggggggagaa

SEQ ID NO: 1538259 - DNA, 20 bp, Homo sapiens
ggtcagtagtttcatgtttt

SEQ ID NO: 1538260 - DNA, 14 bp, Homo sapiens
ggtcagtgtggaga

SEQ ID NO: 1538261 - DNA, 15 bp, Homo sapiens
ggtcagttgtaataa

SEQ ID NO: 1538262 - DNA, 12 bp, Homo sapiens
ggtcataaaata

SEQ ID NO: 1538263 - DNA, 13 bp, Homo sapiens
ggtcataaaatag

SEQ ID NO: 1538264 - DNA, 16 bp, Homo sapiens
ggtcatcaccaccctt

SEQ ID NO: 1538265 - DNA, 14 bp, Homo sapiens
ggtcatcagatgcc

SEQ ID NO: 1538266 - DNA, 22 bp, Homo sapiens
ggtcatccagactcagagctct

SEQ ID NO: 1538267 - DNA, 13 bp, Homo sapiens
ggtcatctggcgg

SEQ ID NO: 1538268 - DNA, 15 bp, Homo sapiens
ggtcatctggcggag

SEQ ID NO: 1538269 - DNA, 14 bp, Homo sapiens
ggtcatgctcagcc

SEQ ID NO: 1538270 - DNA, 15 bp, Homo sapiens
ggtcatgctcagcct

SEQ ID NO: 1538271 - DNA, 16 bp, Homo sapiens
ggtcatgggccactgc

SEQ ID NO: 1538272 - DNA, 13 bp, Homo sapiens
ggtcatgtgtgca

SEQ ID NO: 1538273 - DNA, 15 bp, Homo sapiens
ggtcatgtgtgcatg

SEQ ID NO: 1538274 - DNA, 20 bp, Homo sapiens
ggtccaaaaaaaggaaaaat

SEQ ID NO: 1538275 - DNA, 17 bp, Homo sapiens
ggtccacacctgggcat

SEQ ID NO: 1538276 - DNA, 17 bp, Homo sapiens
ggtccacagctggaaag

SEQ ID NO: 1538277 - DNA, 15 bp, Homo sapiens
ggtccacctggagag

SEQ ID NO: 1538278 - DNA, 12 bp, Homo sapiens
ggtccacgcctc

SEQ ID NO: 1538279 - DNA, 20 bp, Homo sapiens
ggtccagagaccacaccact

SEQ ID NO: 1538280 - DNA, 17 bp, Homo sapiens
ggtccagcgtcactcca

SEQ ID NO: 1538281 - DNA, 21 bp, Homo sapiens
ggtccagcgtcactccagtgc

SEQ ID NO: 1538282 - DNA, 13 bp, Homo sapiens
ggtccagctctga

SEQ ID NO: 1538283 - DNA, 18 bp, Homo sapiens
ggtccagctctgacatcc

SEQ ID NO: 1538284 - DNA, 15 bp, Homo sapiens
ggtccagctctggag

SEQ ID NO: 1538285 - DNA, 20 bp, Homo sapiens
ggtccagctcttggcccctg

SEQ ID NO: 1538286 - DNA, 13 bp, Homo sapiens
ggtccagctggcc

SEQ ID NO: 1538287 - DNA, 15 bp, Homo sapiens
ggtccagctggcctg

SEQ ID NO: 1538288 - DNA, 15 bp, Homo sapiens
ggtccagctgggcct

SEQ ID NO: 1538289 - DNA, 18 bp, Homo sapiens
ggtccaggaaggcagctg

SEQ ID NO: 1538290 - DNA, 19 bp, Homo sapiens
ggtccaggagaagtgctcc

SEQ ID NO: 1538291 - DNA, 22 bp, Homo sapiens
ggtccaggagaagtgctccctg

SEQ ID NO: 1538292 - DNA, 15 bp, Homo sapiens
ggtccaggcccgtgg

SEQ ID NO: 1538293 - DNA, 11 bp, Homo sapiens
ggtccagggaa

SEQ ID NO: 1538294 - DNA, 14 bp, Homo sapiens
ggtccagggcctga

SEQ ID NO: 1538295 - DNA, 12 bp, Homo sapiens
ggtccagggcta

SEQ ID NO: 1538296 - DNA, 19 bp, Homo sapiens
ggtccagtcgggaggagca

SEQ ID NO: 1538297 - DNA, 16 bp, Homo sapiens
ggtccagtctgtgatc

SEQ ID NO: 1538298 - DNA, 23 bp, Homo sapiens
ggtccagtgcattttgtttctgt

SEQ ID NO: 1538299 - DNA, 18 bp, Homo sapiens
ggtccatttgttcctgct

SEQ ID NO: 1538300 - DNA, 22 bp, Homo sapiens
ggtcccagtgggaggggcaggc

SEQ ID NO: 1538301 - DNA, 11 bp, Homo sapiens
ggtcccatcca

SEQ ID NO: 1538302 - DNA, 14 bp, Homo sapiens
ggtcccatccaggc

SEQ ID NO: 1538303 - DNA, 13 bp, Homo sapiens
ggtccccagctcc

SEQ ID NO: 1538304 - DNA, 17 bp, Homo sapiens
ggtccccagctccccag

SEQ ID NO: 1538305 - DNA, 18 bp, Homo sapiens
ggtccccagctccccagg

SEQ ID NO: 1538306 - DNA, 13 bp, Homo sapiens
ggtcccccctgag

SEQ ID NO: 1538307 - DNA, 16 bp, Homo sapiens
ggtcccccgactgcct

SEQ ID NO: 1538308 - DNA, 23 bp, Homo sapiens
ggtcccccgactgcctgtctcca

SEQ ID NO: 1538309 - DNA, 20 bp, Homo sapiens
ggtccccctcagcaagccct

SEQ ID NO: 1538310 - DNA, 17 bp, Homo sapiens
ggtccccgagtgcctag

SEQ ID NO: 1538311 - DNA, 13 bp, Homo sapiens
ggtcccctggcag

SEQ ID NO: 1538312 - DNA, 16 bp, Homo sapiens
ggtcccggccagctct

SEQ ID NO: 1538313 - DNA, 18 bp, Homo sapiens
ggtcccggccagctctgg

SEQ ID NO: 1538314 - DNA, 20 bp, Homo sapiens
ggtcccggccagctctggag

SEQ ID NO: 1538315 - DNA, 24 bp, Homo sapiens
ggtcccggttcagacccctgcctg

SEQ ID NO: 1538316 - DNA, 16 bp, Homo sapiens
ggtccctcactccaca

SEQ ID NO: 1538317 - DNA, 21 bp, Homo sapiens
ggtccctgccctcccctgctc

SEQ ID NO: 1538318 - DNA, 15 bp, Homo sapiens
ggtccctggaccagc

SEQ ID NO: 1538319 - DNA, 19 bp, Homo sapiens
ggtccctggaccagcctcc

SEQ ID NO: 1538320 - DNA, 19 bp, Homo sapiens
ggtccctggtccctcgtcc

SEQ ID NO: 1538321 - DNA, 16 bp, Homo sapiens
ggtccctggtccttca

SEQ ID NO: 1538322 - DNA, 21 bp, Homo sapiens
ggtccctgtgctgatcctgct

SEQ ID NO: 1538323 - DNA, 22 bp, Homo sapiens
ggtccctgtgctgatcctgctg

SEQ ID NO: 1538324 - DNA, 22 bp, Homo sapiens
ggtcccttaaggcacagtggga

SEQ ID NO: 1538325 - DNA, 20 bp, Homo sapiens
ggtcccttgaaggaagaggg

SEQ ID NO: 1538326 - DNA, 17 bp, Homo sapiens
ggtccgcaccagctgct

SEQ ID NO: 1538327 - DNA, 20 bp, Homo sapiens
ggtccgcaccagctgctctg

SEQ ID NO: 1538328 - DNA, 15 bp, Homo sapiens
ggtccgcatccctgc

SEQ ID NO: 1538329 - DNA, 16 bp, Homo sapiens
ggtccgtgcccaggcc

SEQ ID NO: 1538330 - DNA, 17 bp, Homo sapiens
ggtccgtgcccaggccc

SEQ ID NO: 1538331 - DNA, 13 bp, Homo sapiens
ggtccgtgggacg

SEQ ID NO: 1538332 - DNA, 21 bp, Homo sapiens
ggtcctaaggcatctatctgt

SEQ ID NO: 1538333 - DNA, 15 bp, Homo sapiens
ggtcctagtaagaag

SEQ ID NO: 1538334 - DNA, 14 bp, Homo sapiens
ggtcctcagagaat

SEQ ID NO: 1538335 - DNA, 13 bp, Homo sapiens
cagaatctctgag

SEQ ID NO: 1538336 - DNA, 17 bp, Homo sapiens
cagaatctctgagccaa

SEQ ID NO: 1538337 - DNA, 17 bp, Homo sapiens
cagaatcttgactttct

SEQ ID NO: 1538338 - DNA, 20 bp, Homo sapiens
cagaatcttgttttgaaaat

SEQ ID NO: 1538339 - DNA, 21 bp, Homo sapiens
cagaatgagacatccagcaga

SEQ ID NO: 1538340 - DNA, 15 bp, Homo sapiens
cagaatggaggcagg

SEQ ID NO: 1538341 - DNA, 17 bp, Homo sapiens
cagaatggcagtcctgg

SEQ ID NO: 1538342 - DNA, 18 bp, Homo sapiens
cagaatggcagtcctgga

SEQ ID NO: 1538343 - DNA, 19 bp, Homo sapiens
cagaatggcagtcctggag

SEQ ID NO: 1538344 - DNA, 21 bp, Homo sapiens
cagaatggcagtcctggaggc

SEQ ID NO: 1538345 - DNA, 18 bp, Homo sapiens
cagaatgtgaaaaaggaa

SEQ ID NO: 1538346 - DNA, 12 bp, Homo sapiens
cagaatgtgttc

SEQ ID NO: 1538347 - DNA, 14 bp, Homo sapiens
cagaatgtgttctt

SEQ ID NO: 1538348 - DNA, 18 bp, Homo sapiens
cagaatgtgttcttttct

SEQ ID NO: 1538349 - DNA, 16 bp, Homo sapiens
cagaatgttttactgt

SEQ ID NO: 1538350 - DNA, 15 bp, Homo sapiens
cagaattaaactttt

SEQ ID NO: 1538351 - DNA, 17 bp, Homo sapiens
cagaattaaacttttaa

SEQ ID NO: 1538352 - DNA, 13 bp, Homo sapiens
cagaattcccttg

SEQ ID NO: 1538353 - DNA, 15 bp, Homo sapiens
cagaattccttttct

SEQ ID NO: 1538354 - DNA, 16 bp, Homo sapiens
cagaattcggtgtgct

SEQ ID NO: 1538355 - DNA, 14 bp, Homo sapiens
cagaattctgctac

SEQ ID NO: 1538356 - DNA, 21 bp, Homo sapiens
cagaattctgctacctcactg

SEQ ID NO: 1538357 - DNA, 21 bp, Homo sapiens
cagaattgtatctcatactgt

SEQ ID NO: 1538358 - DNA, 12 bp, Homo sapiens
cagaatttgaga

SEQ ID NO: 1538359 - DNA, 14 bp, Homo sapiens
cagaatttgagaac

SEQ ID NO: 1538360 - DNA, 16 bp, Homo sapiens
cagaatttgagaacct

SEQ ID NO: 1538361 - DNA, 19 bp, Homo sapiens
cagaatttgggttctgcct

SEQ ID NO: 1538362 - DNA, 12 bp, Homo sapiens
ggtcgcccagga

SEQ ID NO: 1538363 - DNA, 13 bp, Homo sapiens
ggtcgcccaggag

SEQ ID NO: 1538364 - DNA, 14 bp, Homo sapiens
ggtcgcccaggaga

SEQ ID NO: 1538365 - DNA, 20 bp, Homo sapiens
ggtcggagtgcctggagtca

SEQ ID NO: 1538366 - DNA, 21 bp, Homo sapiens
ggtcggagtgcctggagtcag

SEQ ID NO: 1538367 - DNA, 14 bp, Homo sapiens
ggtcggatctcaca

SEQ ID NO: 1538368 - DNA, 17 bp, Homo sapiens
ggtctactctagaagag

SEQ ID NO: 1538369 - DNA, 16 bp, Homo sapiens
ggtctagtgttcctgc

SEQ ID NO: 1538370 - DNA, 22 bp, Homo sapiens
ggtctatgtcgagagctggcca

SEQ ID NO: 1538371 - DNA, 16 bp, Homo sapiens
ggtctatgttccccag

SEQ ID NO: 1538372 - DNA, 14 bp, Homo sapiens
ggtctattgtcgct

SEQ ID NO: 1538373 - DNA, 18 bp, Homo sapiens
ggtctcacagtgttgccc

SEQ ID NO: 1538374 - DNA, 19 bp, Homo sapiens
ggtctcacagtgttgccca

SEQ ID NO: 1538375 - DNA, 16 bp, Homo sapiens
ggtctccaagggaggg

SEQ ID NO: 1538376 - DNA, 18 bp, Homo sapiens
ggtctccaggggcctgca

SEQ ID NO: 1538377 - DNA, 18 bp, Homo sapiens
ggtctccatatcagctct

SEQ ID NO: 1538378 - DNA, 17 bp, Homo sapiens
ggtctccctctcctgcc

SEQ ID NO: 1538379 - DNA, 13 bp, Homo sapiens
ggtctccctggct

SEQ ID NO: 1538380 - DNA, 17 bp, Homo sapiens
ggtctccttggctgtct

SEQ ID NO: 1538381 - DNA, 16 bp, Homo sapiens
ggtctcgcagcctgaa

SEQ ID NO: 1538382 - DNA, 17 bp, Homo sapiens
ggtctcgcagcctgaag

SEQ ID NO: 1538383 - DNA, 19 bp, Homo sapiens
ggtctcgctttgttgccca

SEQ ID NO: 1538384 - DNA, 21 bp, Homo sapiens
ggtctcgctttgttgcccagg

SEQ ID NO: 1538385 - DNA, 20 bp, Homo sapiens
ggtctcggatgacaccctgg

SEQ ID NO: 1538386 - DNA, 11 bp, Homo sapiens
ggtctctcctt

SEQ ID NO: 1538387 - DNA, 18 bp, Homo sapiens
ggtctctccttcctcttg

SEQ ID NO: 1538388 - DNA, 14 bp, Homo sapiens
ggtctctctccagg

SEQ ID NO: 1538389 - DNA, 15 bp, Homo sapiens
ggtctctctccaggt

SEQ ID NO: 1538390 - DNA, 19 bp, Homo sapiens
ggtctctctctctctacaa

SEQ ID NO: 1538391 - DNA, 20 bp, Homo sapiens
ggtctctgaagggacccccc

SEQ ID NO: 1538392 - DNA, 19 bp, Homo sapiens
ggtctctgctggggaaggg

SEQ ID NO: 1538393 - DNA, 13 bp, Homo sapiens
ggtctctgggagc

SEQ ID NO: 1538394 - DNA, 20 bp, Homo sapiens
ggtctcttctgggcgtctga

SEQ ID NO: 1538395 - DNA, 21 bp, Homo sapiens
ggtctcttcttggggcccagt

SEQ ID NO: 1538396 - DNA, 21 bp, Homo sapiens
ggtctgaaggaatagccagag

SEQ ID NO: 1538397 - DNA, 23 bp, Homo sapiens
ggtctgaaggaatagccagagag

SEQ ID NO: 1538398 - DNA, 13 bp, Homo sapiens
ggtctgagccctg

SEQ ID NO: 1538399 - DNA, 14 bp, Homo sapiens
ggtctgagccctgg

SEQ ID NO: 1538400 - DNA, 17 bp, Homo sapiens
ggtctgagtctatgttc

SEQ ID NO: 1538401 - DNA, 12 bp, Homo sapiens
ggtctgattggc

SEQ ID NO: 1538402 - DNA, 13 bp, Homo sapiens
ggtctgattggct

SEQ ID NO: 1538403 - DNA, 20 bp, Homo sapiens
ggtctgctctttctctgcca

SEQ ID NO: 1538404 - DNA, 14 bp, Homo sapiens
ggtctggctgagcc

SEQ ID NO: 1538405 - DNA, 20 bp, Homo sapiens
ggtctgggagtcacacagtg

SEQ ID NO: 1538406 - DNA, 16 bp, Homo sapiens
ggtctgggatatggct

SEQ ID NO: 1538407 - DNA, 22 bp, Homo sapiens
ggtctgggcggcgggcggctgg

SEQ ID NO: 1538408 - DNA, 24 bp, Homo sapiens
ggtctggttgttgcaccatctgct

SEQ ID NO: 1538409 - DNA, 17 bp, Homo sapiens
ggtctgtgctgtgcctg

SEQ ID NO: 1538410 - DNA, 21 bp, Homo sapiens
ggtctgtgtaacatccaagcc

SEQ ID NO: 1538411 - DNA, 16 bp, Homo sapiens
ggtctgtgtcatttct

SEQ ID NO: 1538412 - DNA, 17 bp, Homo sapiens
ggtctgtgtgtgtgtat

SEQ ID NO: 1538413 - DNA, 20 bp, Homo sapiens
ggtctgtgtgtgtgtatgtg

SEQ ID NO: 1538414 - DNA, 12 bp, Homo sapiens
ggtctgtttgca

SEQ ID NO: 1538415 - DNA, 23 bp, Homo sapiens
ggtcttaaatgctcattttctgg

SEQ ID NO: 1538416 - DNA, 22 bp, Homo sapiens
ggtcttccctacctcaggcagg

SEQ ID NO: 1538417 - DNA, 19 bp, Homo sapiens
ggtcttgattcagtcacat

SEQ ID NO: 1538418 - DNA, 15 bp, Homo sapiens
ggtcttggctgcctg

SEQ ID NO: 1538419 - DNA, 17 bp, Homo sapiens
ggtctttgcacatgtga

SEQ ID NO: 1538420 - DNA, 22 bp, Homo sapiens
ggtgaaaattattttgttcata

SEQ ID NO: 1538421 - DNA, 14 bp, Homo sapiens
ggtgaacactgtga

SEQ ID NO: 1538422 - DNA, 18 bp, Homo sapiens
ggtgaagaggctgcttct

SEQ ID NO: 1538423 - DNA, 17 bp, Homo sapiens
ggtgaagctatttatct

SEQ ID NO: 1538424 - DNA, 16 bp, Homo sapiens
ggtgaaggctctcacc

SEQ ID NO: 1538425 - DNA, 18 bp, Homo sapiens
ggtgaagggaagtgggga

SEQ ID NO: 1538426 - DNA, 22 bp, Homo sapiens
ggtgaagtcgggtcaaaaataa

SEQ ID NO: 1538427 - DNA, 14 bp, Homo sapiens
ggtgaattttcaag

SEQ ID NO: 1538428 - DNA, 16 bp, Homo sapiens
ggtgacacctccccct

SEQ ID NO: 1538429 - DNA, 17 bp, Homo sapiens
ggtgacatcggaaaaat

SEQ ID NO: 1538430 - DNA, 19 bp, Homo sapiens
ggtgaccagccactcaaag

SEQ ID NO: 1538431 - DNA, 17 bp, Homo sapiens
ggtgaccgactacccca

SEQ ID NO: 1538432 - DNA, 12 bp, Homo sapiens
ggtgactctgtc

SEQ ID NO: 1538433 - DNA, 16 bp, Homo sapiens
ggtgactgtgctgtgc

SEQ ID NO: 1538434 - DNA, 23 bp, Homo sapiens
ggtgactgtgtaactttctctta

SEQ ID NO: 1538435 - DNA, 17 bp, Homo sapiens
ggtgagagtcaaagctg

SEQ ID NO: 1538436 - DNA, 19 bp, Homo sapiens
ggtgagcaggcagggctgg

SEQ ID NO: 1538437 - DNA, 13 bp, Homo sapiens
ggtgagccagtgg

SEQ ID NO: 1538438 - DNA, 22 bp, Homo sapiens
ggtgaggctgacatgctcacac

SEQ ID NO: 1538439 - DNA, 16 bp, Homo sapiens
ggtgaggggctttctc

SEQ ID NO: 1538440 - DNA, 18 bp, Homo sapiens
ggtgagtccattctccca

SEQ ID NO: 1538441 - DNA, 20 bp, Homo sapiens
ggtgagtcccctactccctc

SEQ ID NO: 1538442 - DNA, 21 bp, Homo sapiens
ggtgagtcccctactccctct

SEQ ID NO: 1538443 - DNA, 17 bp, Homo sapiens
ggtgagtcttggcggca

SEQ ID NO: 1538444 - DNA, 20 bp, Homo sapiens
ggtgagtcttggcggcagca

SEQ ID NO: 1538445 - DNA, 18 bp, Homo sapiens
ggtgagtcttggttctaa

SEQ ID NO: 1538446 - DNA, 21 bp, Homo sapiens
ggtgagtttgagctgccttcc

SEQ ID NO: 1538447 - DNA, 19 bp, Homo sapiens
ggtgatctgtagacttctg

SEQ ID NO: 1538448 - DNA, 18 bp, Homo sapiens
ggtgatgtagcccatcct

SEQ ID NO: 1538449 - DNA, 16 bp, Homo sapiens
ggtgatgtttccagct

SEQ ID NO: 1538450 - DNA, 19 bp, Homo sapiens
ggtggcccgacagcctggc

SEQ ID NO: 1538451 - DNA, 16 bp, Homo sapiens
ggtggccctgtgcctg

SEQ ID NO: 1538452 - DNA, 14 bp, Homo sapiens
ggtggcctgcgtct

SEQ ID NO: 1538453 - DNA, 18 bp, Homo sapiens
ggtggcctgttccctaga

SEQ ID NO: 1538454 - DNA, 21 bp, Homo sapiens
ggtggcgactctatagactct

SEQ ID NO: 1538455 - DNA, 16 bp, Homo sapiens
ggtggcggccccagca

SEQ ID NO: 1538456 - DNA, 18 bp, Homo sapiens
ggtggcgtctgcctagga

SEQ ID NO: 1538457 - DNA, 14 bp, Homo sapiens
ggtggctcacgcct

SEQ ID NO: 1538458 - DNA, 19 bp, Homo sapiens
ggtggctcacgcctgtaat

SEQ ID NO: 1538459 - DNA, 18 bp, Homo sapiens
ggtggctcactactgaac

SEQ ID NO: 1538460 - DNA, 13 bp, Homo sapiens
ggtggctcctcct

SEQ ID NO: 1538461 - DNA, 23 bp, Homo sapiens
ggtggctctgggaatgggagagg

SEQ ID NO: 1538462 - DNA, 15 bp, Homo sapiens
ggtggctgacccagt

SEQ ID NO: 1538463 - DNA, 21 bp, Homo sapiens
ggtggctgacccagtccctgg

SEQ ID NO: 1538464 - DNA, 18 bp, Homo sapiens
ggtggctgccccggcctc

SEQ ID NO: 1538465 - DNA, 21 bp, Homo sapiens
ggtggctgccccggcctcctc

SEQ ID NO: 1538466 - DNA, 14 bp, Homo sapiens
ggtggctgggccca

SEQ ID NO: 1538467 - DNA, 22 bp, Homo sapiens
ggtggctgtagatggtgacctg

SEQ ID NO: 1538468 - DNA, 15 bp, Homo sapiens
ggtgggaaggggagc

SEQ ID NO: 1538469 - DNA, 15 bp, Homo sapiens
ggtgggagagcccag

SEQ ID NO: 1538470 - DNA, 18 bp, Homo sapiens
ggtgggagctcctccgca

SEQ ID NO: 1538471 - DNA, 15 bp, Homo sapiens
ggtgggattttgcaa

SEQ ID NO: 1538472 - DNA, 16 bp, Homo sapiens
ggtgggcaggtggtgg

SEQ ID NO: 1538473 - DNA, 14 bp, Homo sapiens
ggtgggccagagct

SEQ ID NO: 1538474 - DNA, 23 bp, Homo sapiens
ggtgggcccaggaccagctgggg

SEQ ID NO: 1538475 - DNA, 19 bp, Homo sapiens
ggtgggccctgagtcctgg

SEQ ID NO: 1538476 - DNA, 13 bp, Homo sapiens
ggtgggcctggcc

SEQ ID NO: 1538477 - DNA, 17 bp, Homo sapiens
ggtgggcctggcctgag

SEQ ID NO: 1538478 - DNA, 18 bp, Homo sapiens
ggtgggcctggcctgagc

SEQ ID NO: 1538479 - DNA, 15 bp, Homo sapiens
ggtgggctgagccct

SEQ ID NO: 1538480 - DNA, 17 bp, Homo sapiens
ggtgggctgagccctgg

SEQ ID NO: 1538481 - DNA, 14 bp, Homo sapiens
ggtgggctgcctgc

SEQ ID NO: 1538482 - DNA, 20 bp, Homo sapiens
ggtggggacattgctctctg

SEQ ID NO: 1538483 - DNA, 13 bp, Homo sapiens
cagactcagagct

SEQ ID NO: 1538484 - DNA, 16 bp, Homo sapiens
cagactcagagctctc

SEQ ID NO: 1538485 - DNA, 17 bp, Homo sapiens
cagactcagagctctct

SEQ ID NO: 1538486 - DNA, 15 bp, Homo sapiens
cagactcagctgcta

SEQ ID NO: 1538487 - DNA, 17 bp, Homo sapiens
cagactcagctgctata

SEQ ID NO: 1538488 - DNA, 18 bp, Homo sapiens
cagactcaggttccagaa

SEQ ID NO: 1538489 - DNA, 19 bp, Homo sapiens
cagactcaggttccagaac

SEQ ID NO: 1538490 - DNA, 22 bp, Homo sapiens
cagactcaggttccagaacagc

SEQ ID NO: 1538491 - DNA, 18 bp, Homo sapiens
cagactcagtttgtcaga

SEQ ID NO: 1538492 - DNA, 19 bp, Homo sapiens
cagactccaatggggccag

SEQ ID NO: 1538493 - DNA, 20 bp, Homo sapiens
cagactccaatggggccagc

SEQ ID NO: 1538494 - DNA, 17 bp, Homo sapiens
cagactccatctcttct

SEQ ID NO: 1538495 - DNA, 21 bp, Homo sapiens
cagactccgccctcctcgggc

SEQ ID NO: 1538496 - DNA, 20 bp, Homo sapiens
cagactctttttttgagtga

SEQ ID NO: 1538497 - DNA, 23 bp, Homo sapiens
cagactgacagtttacagacgct

SEQ ID NO: 1538498 - DNA, 15 bp, Homo sapiens
cagactgagctctcc

SEQ ID NO: 1538499 - DNA, 19 bp, Homo sapiens
cagactgagctctccaggc

SEQ ID NO: 1538500 - DNA, 13 bp, Homo sapiens
cagactgctggga

SEQ ID NO: 1538501 - DNA, 16 bp, Homo sapiens
cagactgctgggactg

SEQ ID NO: 1538502 - DNA, 20 bp, Homo sapiens
cagactgctgggactggcca

SEQ ID NO: 1538503 - DNA, 23 bp, Homo sapiens
cagactgctgggactggccaggt

SEQ ID NO: 1538504 - DNA, 22 bp, Homo sapiens
cagactggaagacacttcagat

SEQ ID NO: 1538505 - DNA, 17 bp, Homo sapiens
cagactggcacagtttt

SEQ ID NO: 1538506 - DNA, 14 bp, Homo sapiens
cagactgggcccag

SEQ ID NO: 1538507 - DNA, 20 bp, Homo sapiens
cagactgggcccaggcaggt

SEQ ID NO: 1538508 - DNA, 16 bp, Homo sapiens
cagactggggcatcct

SEQ ID NO: 1538509 - DNA, 15 bp, Homo sapiens
cagactgggtttcta

SEQ ID NO: 1538510 - DNA, 21 bp, Homo sapiens
cagactgtgaacttgactggg

SEQ ID NO: 1538511 - DNA, 24 bp, Homo sapiens
cagactgttagaaaatggacactg

SEQ ID NO: 1538512 - DNA, 15 bp, Homo sapiens
cagacttcacactgc

SEQ ID NO: 1538513 - DNA, 15 bp, Homo sapiens
cagacttcacagcgt

SEQ ID NO: 1538514 - DNA, 14 bp, Homo sapiens
cagacttctccaga

SEQ ID NO: 1538515 - DNA, 19 bp, Homo sapiens
cagacttctggaaggctgg

SEQ ID NO: 1538516 - DNA, 20 bp, Homo sapiens
cagacttctggaaggctggc

SEQ ID NO: 1538517 - DNA, 20 bp, Homo sapiens
cagacttgccaggctccctt

SEQ ID NO: 1538518 - DNA, 17 bp, Homo sapiens
cagacttgcttcctgca

SEQ ID NO: 1538519 - DNA, 15 bp, Homo sapiens
cagactttcacacca

SEQ ID NO: 1538520 - DNA, 20 bp, Homo sapiens
cagactttgcttcccattgt

SEQ ID NO: 1538521 - DNA, 20 bp, Homo sapiens
cagagaaaaatgctccccac

SEQ ID NO: 1538522 - DNA, 19 bp, Homo sapiens
cagagaaaggggagcccac

SEQ ID NO: 1538523 - DNA, 21 bp, Homo sapiens
cagagaaccatcaaggcggga

SEQ ID NO: 1538524 - DNA, 20 bp, Homo sapiens
cagagaagccaaaagattgg

SEQ ID NO: 1538525 - DNA, 18 bp, Homo sapiens
cagagaagctcctgctac

SEQ ID NO: 1538526 - DNA, 21 bp, Homo sapiens
cagagaagctggaagcctgcc

SEQ ID NO: 1538527 - DNA, 22 bp, Homo sapiens
cagagaaggaaaagactgaatc

SEQ ID NO: 1538528 - DNA, 14 bp, Homo sapiens
cagagaaggcagga

SEQ ID NO: 1538529 - DNA, 22 bp, Homo sapiens
cagagaaggcctcttgtgctca

SEQ ID NO: 1538530 - DNA, 17 bp, Homo sapiens
cagagaagtttgtagcc

SEQ ID NO: 1538531 - DNA, 18 bp, Homo sapiens
cagagaagtttgtagcca

SEQ ID NO: 1538532 - DNA, 11 bp, Homo sapiens
cagagaatata

SEQ ID NO: 1538533 - DNA, 14 bp, Homo sapiens
cagagaatggctgg

SEQ ID NO: 1538534 - DNA, 19 bp, Homo sapiens
cagagaatggctgggtcag

SEQ ID NO: 1538535 - DNA, 22 bp, Homo sapiens
cagagaatttctaccatttcag

SEQ ID NO: 1538536 - DNA, 23 bp, Homo sapiens
cagagaatttctaccatttcaga

SEQ ID NO: 1538537 - DNA, 23 bp, Homo sapiens
cagagacaacaggtaaaacaggg

SEQ ID NO: 1538538 - DNA, 15 bp, Homo sapiens
cagagacaagtaatt

SEQ ID NO: 1538539 - DNA, 16 bp, Homo sapiens
cagagacaccaaactg

SEQ ID NO: 1538540 - DNA, 14 bp, Homo sapiens
cagagacacctgca

SEQ ID NO: 1538541 - DNA, 18 bp, Homo sapiens
cagagacacctgcacctc

SEQ ID NO: 1538542 - DNA, 14 bp, Homo sapiens
cagagacaggaaaa

SEQ ID NO: 1538543 - DNA, 21 bp, Homo sapiens
cagagacaggaaaatcctctg

SEQ ID NO: 1538544 - DNA, 22 bp, Homo sapiens
cagagacaggaaaatcctctgg

SEQ ID NO: 1538545 - DNA, 14 bp, Homo sapiens
cagagacaggtggc

SEQ ID NO: 1538546 - DNA, 17 bp, Homo sapiens
cagagacatacttgaag

SEQ ID NO: 1538547 - DNA, 21 bp, Homo sapiens
cagagacatacttgaagggcc

SEQ ID NO: 1538548 - DNA, 23 bp, Homo sapiens
cagagacatacttgaagggccag

SEQ ID NO: 1538549 - DNA, 19 bp, Homo sapiens
cagagaccagcactcagcc

SEQ ID NO: 1538550 - DNA, 16 bp, Homo sapiens
cagagaccaggctgtg

SEQ ID NO: 1538551 - DNA, 20 bp, Homo sapiens
cagagacccaacagcagtga

SEQ ID NO: 1538552 - DNA, 14 bp, Homo sapiens
cagagacccagatc

SEQ ID NO: 1538553 - DNA, 19 bp, Homo sapiens
cagagacccagatctcatg

SEQ ID NO: 1538554 - DNA, 17 bp, Homo sapiens
cagagaccgtgagcgcc

SEQ ID NO: 1538555 - DNA, 19 bp, Homo sapiens
cagagactcagggccccag

SEQ ID NO: 1538556 - DNA, 23 bp, Homo sapiens
cagagactcagggccccagcact

SEQ ID NO: 1538557 - DNA, 14 bp, Homo sapiens
cagagactttgtag

SEQ ID NO: 1538558 - DNA, 11 bp, Homo sapiens
cagagagacag

SEQ ID NO: 1538559 - DNA, 17 bp, Homo sapiens
cagagagacagacttga

SEQ ID NO: 1538560 - DNA, 18 bp, Homo sapiens
cagagagacagacttgag

SEQ ID NO: 1538561 - DNA, 15 bp, Homo sapiens
cagagagaccctgca

SEQ ID NO: 1538562 - DNA, 16 bp, Homo sapiens
cagagagaccctgcaa

SEQ ID NO: 1538563 - DNA, 17 bp, Homo sapiens
cagagagagaggacaga

SEQ ID NO: 1538564 - DNA, 23 bp, Homo sapiens
ggtttccccagggaaggaaaaat

SEQ ID NO: 1538565 - DNA, 12 bp, Homo sapiens
ggtttcctctgg

SEQ ID NO: 1538566 - DNA, 15 bp, Homo sapiens
ggtttcgactggtcc

SEQ ID NO: 1538567 - DNA, 16 bp, Homo sapiens
ggtttcgactggtcca

SEQ ID NO: 1538568 - DNA, 18 bp, Homo sapiens
ggtttcgactggtccagc

SEQ ID NO: 1538569 - DNA, 23 bp, Homo sapiens
ggtttcgactggtccagctctga

SEQ ID NO: 1538570 - DNA, 14 bp, Homo sapiens
ggtttctaagcagt

SEQ ID NO: 1538571 - DNA, 14 bp, Homo sapiens
ggtttctctcttcc

SEQ ID NO: 1538572 - DNA, 14 bp, Homo sapiens
ggtttctctgtgct

SEQ ID NO: 1538573 - DNA, 15 bp, Homo sapiens
ggtttctgttctgtt

SEQ ID NO: 1538574 - DNA, 15 bp, Homo sapiens
ggtttgccaggccaa

SEQ ID NO: 1538575 - DNA, 16 bp, Homo sapiens
ggtttgccagtgaaga

SEQ ID NO: 1538576 - DNA, 22 bp, Homo sapiens
ggtttgcccacttgattgagaa

SEQ ID NO: 1538577 - DNA, 17 bp, Homo sapiens
ggtttgggaaagatgga

SEQ ID NO: 1538578 - DNA, 19 bp, Homo sapiens
ggtttggggagcagagaca

SEQ ID NO: 1538579 - DNA, 19 bp, Homo sapiens
ggtttgtgtttgagtttta

SEQ ID NO: 1538580 - DNA, 17 bp, Homo sapiens
ggtttgtttataatgtt

SEQ ID NO: 1538581 - DNA, 13 bp, Homo sapiens
ggttttaaacttt

SEQ ID NO: 1538582 - DNA, 14 bp, Homo sapiens
ggttttaaactttc

SEQ ID NO: 1538583 - DNA, 16 bp, Homo sapiens
ggttttaaagtgatta

SEQ ID NO: 1538584 - DNA, 18 bp, Homo sapiens
ggttttaggtagaaaaac

SEQ ID NO: 1538585 - DNA, 16 bp, Homo sapiens
ggttttaggttctaaa

SEQ ID NO: 1538586 - DNA, 17 bp, Homo sapiens
ggttttataaggctgat

SEQ ID NO: 1538587 - DNA, 23 bp, Homo sapiens
ggttttatggttacttcttctct

SEQ ID NO: 1538588 - DNA, 22 bp, Homo sapiens
ggttttattctgacttcctctg

SEQ ID NO: 1538589 - DNA, 13 bp, Homo sapiens
ggttttcccctcc

SEQ ID NO: 1538590 - DNA, 18 bp, Homo sapiens
ggttttctggtggggctg

SEQ ID NO: 1538591 - DNA, 13 bp, Homo sapiens
ggttttcttttct

SEQ ID NO: 1538592 - DNA, 20 bp, Homo sapiens
ggttttgccccaagtcctca

SEQ ID NO: 1538593 - DNA, 17 bp, Homo sapiens
ggttttgtaagatgctg

SEQ ID NO: 1538594 - DNA, 15 bp, Homo sapiens
ggtttttagagaatg

SEQ ID NO: 1538595 - DNA, 23 bp, Homo sapiens
ggtttttgtttgtttcctttgtt

SEQ ID NO: 1538596 - DNA, 13 bp, Homo sapiens
gtaaaaaatgtct

SEQ ID NO: 1538597 - DNA, 22 bp, Homo sapiens
gtaaaaactagaaggcttctct

SEQ ID NO: 1538598 - DNA, 12 bp, Homo sapiens
gtaaaaagaaaa

SEQ ID NO: 1538599 - DNA, 21 bp, Homo sapiens
gtaaaaagcctccttgtgcaa

SEQ ID NO: 1538600 - DNA, 15 bp, Homo sapiens
gtaaaaatgctgctc

SEQ ID NO: 1538601 - DNA, 17 bp, Homo sapiens
gtaaaaatggaaactat

SEQ ID NO: 1538602 - DNA, 14 bp, Homo sapiens
gtaaaaattaaaaa

SEQ ID NO: 1538603 - DNA, 20 bp, Homo sapiens
gtaaaacaaaaatgtaatga

SEQ ID NO: 1538604 - DNA, 16 bp, Homo sapiens
cagagcatacaacaga

SEQ ID NO: 1538605 - DNA, 19 bp, Homo sapiens
cagagcatacaacagaggg

SEQ ID NO: 1538606 - DNA, 20 bp, Homo sapiens
cagagcatacaacagagggg

SEQ ID NO: 1538607 - DNA, 19 bp, Homo sapiens
cagagcatcaaaaacatca

SEQ ID NO: 1538608 - DNA, 13 bp, Homo sapiens
cagagccaacctg

SEQ ID NO: 1538609 - DNA, 18 bp, Homo sapiens
cagagccaacctggactt

SEQ ID NO: 1538610 - DNA, 20 bp, Homo sapiens
cagagccaagcactgctcac

SEQ ID NO: 1538611 - DNA, 14 bp, Homo sapiens
cagagccacctgga

SEQ ID NO: 1538612 - DNA, 12 bp, Homo sapiens
cagagccactct

SEQ ID NO: 1538613 - DNA, 21 bp, Homo sapiens
cagagccagatgcaggacagg

SEQ ID NO: 1538614 - DNA, 14 bp, Homo sapiens
cagagccagcctgg

SEQ ID NO: 1538615 - DNA, 18 bp, Homo sapiens
cagagccagcctggctct

SEQ ID NO: 1538616 - DNA, 21 bp, Homo sapiens
cagagccagcctggctctgcc

SEQ ID NO: 1538617 - DNA, 16 bp, Homo sapiens
cagagccaggagaagc

SEQ ID NO: 1538618 - DNA, 20 bp, Homo sapiens
cagagccaggagaagctcag

SEQ ID NO: 1538619 - DNA, 11 bp, Homo sapiens
cagagccaggc

SEQ ID NO: 1538620 - DNA, 19 bp, Homo sapiens
cagagccaggctgttggaa

SEQ ID NO: 1538621 - DNA, 13 bp, Homo sapiens
cagagccagtgaa

SEQ ID NO: 1538622 - DNA, 16 bp, Homo sapiens
cagagccatgggcctg

SEQ ID NO: 1538623 - DNA, 19 bp, Homo sapiens
cagagccatgggcctgggc

SEQ ID NO: 1538624 - DNA, 21 bp, Homo sapiens
cagagccatgggcctgggcct

SEQ ID NO: 1538625 - DNA, 23 bp, Homo sapiens
cagagccatgggcctgggcctgc

SEQ ID NO: 1538626 - DNA, 13 bp, Homo sapiens
cagagcccagctc

SEQ ID NO: 1538627 - DNA, 14 bp, Homo sapiens
cagagcccagctct

SEQ ID NO: 1538628 - DNA, 19 bp, Homo sapiens
cagagcccagctcttgctc

SEQ ID NO: 1538629 - DNA, 21 bp, Homo sapiens
cagagcccagctcttgctctc

SEQ ID NO: 1538630 - DNA, 13 bp, Homo sapiens
cagagccccacac

SEQ ID NO: 1538631 - DNA, 20 bp, Homo sapiens
cagagccccacacggaggca

SEQ ID NO: 1538632 - DNA, 15 bp, Homo sapiens
cagagccccacgctg

SEQ ID NO: 1538633 - DNA, 15 bp, Homo sapiens
cagagcccccagccc

SEQ ID NO: 1538634 - DNA, 17 bp, Homo sapiens
cagagcccccagccctg

SEQ ID NO: 1538635 - DNA, 18 bp, Homo sapiens
cagagcccccagccctgg

SEQ ID NO: 1538636 - DNA, 16 bp, Homo sapiens
cagagcccctcctcca

SEQ ID NO: 1538637 - DNA, 18 bp, Homo sapiens
cagagcccctcctccagc

SEQ ID NO: 1538638 - DNA, 21 bp, Homo sapiens
cagagcccctcctccagcccc

SEQ ID NO: 1538639 - DNA, 17 bp, Homo sapiens
cagagccctccaggcct

SEQ ID NO: 1538640 - DNA, 20 bp, Homo sapiens
cagagccctccaggcctgca

SEQ ID NO: 1538641 - DNA, 16 bp, Homo sapiens
cagagcccttcactgc

SEQ ID NO: 1538642 - DNA, 18 bp, Homo sapiens
cagagcccttcactgcca

SEQ ID NO: 1538643 - DNA, 16 bp, Homo sapiens
cagagcctctgctgga

SEQ ID NO: 1538644 - DNA, 19 bp, Homo sapiens
cagagcctggggtgttctc

SEQ ID NO: 1538645 - DNA, 22 bp, Homo sapiens
cagagcctgtctttcagcattc

SEQ ID NO: 1538646 - DNA, 16 bp, Homo sapiens
cagagccttcaagtgc

SEQ ID NO: 1538647 - DNA, 16 bp, Homo sapiens
cagagccttctcagaa

SEQ ID NO: 1538648 - DNA, 18 bp, Homo sapiens
cagagccttctcagaagc

SEQ ID NO: 1538649 - DNA, 20 bp, Homo sapiens
cagagccttctcagaagcac

SEQ ID NO: 1538650 - DNA, 20 bp, Homo sapiens
cagagcctttttcacaattc

SEQ ID NO: 1538651 - DNA, 16 bp, Homo sapiens
cagagcgagactccat

SEQ ID NO: 1538652 - DNA, 20 bp, Homo sapiens
cagagcggggtcccctctgt

SEQ ID NO: 1538653 - DNA, 19 bp, Homo sapiens
cagagcgtccttccccctg

SEQ ID NO: 1538654 - DNA, 23 bp, Homo sapiens
cagagcgtccttccccctgtaga

SEQ ID NO: 1538655 - DNA, 18 bp, Homo sapiens
cagagctaaactccttcc

SEQ ID NO: 1538656 - DNA, 22 bp, Homo sapiens
cagagctcatcccccctgctgc

SEQ ID NO: 1538657 - DNA, 24 bp, Homo sapiens
cagagctctcccctcctgctgggc

SEQ ID NO: 1538658 - DNA, 16 bp, Homo sapiens
cagagctgagggccct

SEQ ID NO: 1538659 - DNA, 17 bp, Homo sapiens
cagagctgagggccctg

SEQ ID NO: 1538660 - DNA, 19 bp, Homo sapiens
cagagctgagggccctgtg

SEQ ID NO: 1538661 - DNA, 22 bp, Homo sapiens
cagagctgccgacttggagact

SEQ ID NO: 1538662 - DNA, 20 bp, Homo sapiens
cagagctggaaggcagggca

SEQ ID NO: 1538663 - DNA, 17 bp, Homo sapiens
cagagctggctctgagc

SEQ ID NO: 1538664 - DNA, 11 bp, Homo sapiens
cagagctgtgc

SEQ ID NO: 1538665 - DNA, 16 bp, Homo sapiens
cagagctgtgccagca

SEQ ID NO: 1538666 - DNA, 21 bp, Homo sapiens
cagagctgtgcctgctcagca

SEQ ID NO: 1538667 - DNA, 21 bp, Homo sapiens
cagagctgtttatggcctcag

SEQ ID NO: 1538668 - DNA, 22 bp, Homo sapiens
cagagctgtttatggcctcagc

SEQ ID NO: 1538669 - DNA, 21 bp, Homo sapiens
cagagcttattggccactggg

SEQ ID NO: 1538670 - DNA, 22 bp, Homo sapiens
cagagcttctctgggctgaatg

SEQ ID NO: 1538671 - DNA, 23 bp, Homo sapiens
cagagcttctctgggctgaatgt

SEQ ID NO: 1538672 - DNA, 23 bp, Homo sapiens
cagagcttgtgctcctcttgatt

SEQ ID NO: 1538673 - DNA, 21 bp, Homo sapiens
cagaggaaaaatgggagccag

SEQ ID NO: 1538674 - DNA, 22 bp, Homo sapiens
cagaggaaaaatgggagccagg

SEQ ID NO: 1538675 - DNA, 12 bp, Homo sapiens
cagaggaagagc

SEQ ID NO: 1538676 - DNA, 16 bp, Homo sapiens
cagaggaagagcaggc

SEQ ID NO: 1538677 - DNA, 19 bp, Homo sapiens
cagaggaatcctggcagcc

SEQ ID NO: 1538678 - DNA, 16 bp, Homo sapiens
cagagttattgaatct

SEQ ID NO: 1538679 - DNA, 22 bp, Homo sapiens
cagagttattgaatcttaattt

SEQ ID NO: 1538680 - DNA, 12 bp, Homo sapiens
cagagttcacta

SEQ ID NO: 1538681 - DNA, 20 bp, Homo sapiens
cagagttcactataaatggt

SEQ ID NO: 1538682 - DNA, 23 bp, Homo sapiens
cagagttcctgcggagtgaagag

SEQ ID NO: 1538683 - DNA, 15 bp, Homo sapiens
cagagttctgctcta

SEQ ID NO: 1538684 - DNA, 15 bp, Homo sapiens
cagagttctgtgaag

SEQ ID NO: 1538685 - DNA, 16 bp, Homo sapiens
cagagttctgtgaaga

SEQ ID NO: 1538686 - DNA, 15 bp, Homo sapiens
cagagttgctgggag

SEQ ID NO: 1538687 - DNA, 19 bp, Homo sapiens
cagagttgctgggagctga

SEQ ID NO: 1538688 - DNA, 16 bp, Homo sapiens
cagagttgctgtgccg

SEQ ID NO: 1538689 - DNA, 17 bp, Homo sapiens
cagagttgcttaatgaa

SEQ ID NO: 1538690 - DNA, 23 bp, Homo sapiens
cagagtttagaggaaaaaaatga

SEQ ID NO: 1538691 - DNA, 12 bp, Homo sapiens
cagagtttgtgt

SEQ ID NO: 1538692 - DNA, 15 bp, Homo sapiens
cagagtttgtgtgta

SEQ ID NO: 1538693 - DNA, 16 bp, Homo sapiens
cagagtttgtgtgtat

SEQ ID NO: 1538694 - DNA, 14 bp, Homo sapiens
cagagttttcatta

SEQ ID NO: 1538695 - DNA, 23 bp, Homo sapiens
cagagttttcattaaatcctttt

SEQ ID NO: 1538696 - DNA, 13 bp, Homo sapiens
cagagtttttaaa

SEQ ID NO: 1538697 - DNA, 18 bp, Homo sapiens
cagagtttttaaagcctt

SEQ ID NO: 1538698 - DNA, 21 bp, Homo sapiens
cagataaacctagataaagag

SEQ ID NO: 1538699 - DNA, 17 bp, Homo sapiens
cagataaagattgtgtg

SEQ ID NO: 1538700 - DNA, 22 bp, Homo sapiens
cagataactctctttccttgag

SEQ ID NO: 1538701 - DNA, 14 bp, Homo sapiens
cagataatcagtgt

SEQ ID NO: 1538702 - DNA, 15 bp, Homo sapiens
cagataattcatttg

SEQ ID NO: 1538703 - DNA, 16 bp, Homo sapiens
cagataattcatttgt

SEQ ID NO: 1538704 - DNA, 18 bp, Homo sapiens
cagataattcatttgtat

SEQ ID NO: 1538705 - DNA, 14 bp, Homo sapiens
cagatacaatgtat

SEQ ID NO: 1538706 - DNA, 23 bp, Homo sapiens
cagataccttatcttacaatatt

SEQ ID NO: 1538707 - DNA, 19 bp, Homo sapiens
cagataccttgaaaggaag

SEQ ID NO: 1538708 - DNA, 20 bp, Homo sapiens
cagatacgggggctgtgact

SEQ ID NO: 1538709 - DNA, 22 bp, Homo sapiens
cagatactggaagttttgcatt

SEQ ID NO: 1538710 - DNA, 21 bp, Homo sapiens
cagatactgtgagcttacatt

SEQ ID NO: 1538711 - DNA, 15 bp, Homo sapiens
cagatagaaagcatt

SEQ ID NO: 1538712 - DNA, 13 bp, Homo sapiens
cagatagagaaat

SEQ ID NO: 1538713 - DNA, 18 bp, Homo sapiens
cagatagtgtagctgagg

SEQ ID NO: 1538714 - DNA, 18 bp, Homo sapiens
cagatataaatggctggt

SEQ ID NO: 1538715 - DNA, 20 bp, Homo sapiens
cagatataaatggctggttt

SEQ ID NO: 1538716 - DNA, 22 bp, Homo sapiens
cagatataaatggctggttttt

SEQ ID NO: 1538717 - DNA, 13 bp, Homo sapiens
cagatataactgt

SEQ ID NO: 1538718 - DNA, 15 bp, Homo sapiens
cagatataactgtct

SEQ ID NO: 1538719 - DNA, 20 bp, Homo sapiens
cagatataactgtcttgttt

SEQ ID NO: 1538720 - DNA, 14 bp, Homo sapiens
cagatataagagaa

SEQ ID NO: 1538721 - DNA, 14 bp, Homo sapiens
cagatatatttttc

SEQ ID NO: 1538722 - DNA, 15 bp, Homo sapiens
cagatatatttttca

SEQ ID NO: 1538723 - DNA, 17 bp, Homo sapiens
cagatatcaaaattcta

SEQ ID NO: 1538724 - DNA, 16 bp, Homo sapiens
cagatatctgcatgtg

SEQ ID NO: 1538725 - DNA, 20 bp, Homo sapiens
cagatattacagcttatttt

SEQ ID NO: 1538726 - DNA, 20 bp, Homo sapiens
gtaattgttttttaaagcaa

SEQ ID NO: 1538727 - DNA, 20 bp, Homo sapiens
gtaatttaaaattgtgatgt

SEQ ID NO: 1538728 - DNA, 19 bp, Homo sapiens
gtaatttaaatgaaagaaa

SEQ ID NO: 1538729 - DNA, 23 bp, Homo sapiens
gtaatttaaatgaaagaaaattg

SEQ ID NO: 1538730 - DNA, 18 bp, Homo sapiens
gtaatttaagtgacacag

SEQ ID NO: 1538731 - DNA, 13 bp, Homo sapiens
gtaatttatgcaa

SEQ ID NO: 1538732 - DNA, 22 bp, Homo sapiens
gtaatttcctgagctaaatgct

SEQ ID NO: 1538733 - DNA, 18 bp, Homo sapiens
gtaatttcgccttaaact

SEQ ID NO: 1538734 - DNA, 19 bp, Homo sapiens
gtaatttcgccttaaactc

SEQ ID NO: 1538735 - DNA, 17 bp, Homo sapiens
gtaattttaaaagtcta

SEQ ID NO: 1538736 - DNA, 16 bp, Homo sapiens
gtaattttattttaaa

SEQ ID NO: 1538737 - DNA, 19 bp, Homo sapiens
gtaattttattttaaaatt

SEQ ID NO: 1538738 - DNA, 20 bp, Homo sapiens
gtacaaaaaaaaagttttat

SEQ ID NO: 1538739 - DNA, 18 bp, Homo sapiens
gtacaaaactctgtataa

SEQ ID NO: 1538740 - DNA, 22 bp, Homo sapiens
gtacaaaactgtaaataaaatg

SEQ ID NO: 1538741 - DNA, 16 bp, Homo sapiens
gtacaaacagtatttc

SEQ ID NO: 1538742 - DNA, 17 bp, Homo sapiens
gtacaaatgaagaaagt

SEQ ID NO: 1538743 - DNA, 17 bp, Homo sapiens
gtacaaatgtaagcaaa

SEQ ID NO: 1538744 - DNA, 13 bp, Homo sapiens
gtacaactgtatt

SEQ ID NO: 1538745 - DNA, 16 bp, Homo sapiens
gtacaagttttgtata

SEQ ID NO: 1538746 - DNA, 12 bp, Homo sapiens
gtacaataaatt

SEQ ID NO: 1538747 - DNA, 13 bp, Homo sapiens
gtacaataaattt

SEQ ID NO: 1538748 - DNA, 15 bp, Homo sapiens
gtacaataaattttt

SEQ ID NO: 1538749 - DNA, 15 bp, Homo sapiens
gtacaatacaatgta

SEQ ID NO: 1538750 - DNA, 16 bp, Homo sapiens
gtacaatacaatgtac

SEQ ID NO: 1538751 - DNA, 16 bp, Homo sapiens
gtacaatctggctcac

SEQ ID NO: 1538752 - DNA, 13 bp, Homo sapiens
gtacaatggttta

SEQ ID NO: 1538753 - DNA, 12 bp, Homo sapiens
gtacaatgtgag

SEQ ID NO: 1538754 - DNA, 14 bp, Homo sapiens
gtacaatgtgagat

SEQ ID NO: 1538755 - DNA, 23 bp, Homo sapiens
gtacaattttaaagttcttattt

SEQ ID NO: 1538756 - DNA, 13 bp, Homo sapiens
gtacacagagaag

SEQ ID NO: 1538757 - DNA, 20 bp, Homo sapiens
gtacacagctctagacactg

SEQ ID NO: 1538758 - DNA, 15 bp, Homo sapiens
gtacacctgcggggc

SEQ ID NO: 1538759 - DNA, 17 bp, Homo sapiens
gtacacgtgtcctgtag

SEQ ID NO: 1538760 - DNA, 15 bp, Homo sapiens
gtacagactgtttta

SEQ ID NO: 1538761 - DNA, 21 bp, Homo sapiens
gtacagagtgtggactctggt

SEQ ID NO: 1538762 - DNA, 16 bp, Homo sapiens
gtacagatactgtgag

SEQ ID NO: 1538763 - DNA, 16 bp, Homo sapiens
gtacagatcaagaaaa

SEQ ID NO: 1538764 - DNA, 15 bp, Homo sapiens
gtacagcttctggag

SEQ ID NO: 1538765 - DNA, 16 bp, Homo sapiens
gtacagcttctggagc

SEQ ID NO: 1538766 - DNA, 19 bp, Homo sapiens
gtacaggagaggcagcatg

SEQ ID NO: 1538767 - DNA, 24 bp, Homo sapiens
gtacaggcaaaacacgcaagggca

SEQ ID NO: 1538768 - DNA, 20 bp, Homo sapiens
gtacagtaccttgttgcaga

SEQ ID NO: 1538769 - DNA, 15 bp, Homo sapiens
gtacagtattctttt

SEQ ID NO: 1538770 - DNA, 16 bp, Homo sapiens
gtacagtattctttta

SEQ ID NO: 1538771 - DNA, 14 bp, Homo sapiens
gtacagtgaattgt

SEQ ID NO: 1538772 - DNA, 15 bp, Homo sapiens
gtacagtgaattgtc

SEQ ID NO: 1538773 - DNA, 21 bp, Homo sapiens
gtacagttatttatgcctctg

SEQ ID NO: 1538774 - DNA, 15 bp, Homo sapiens
gtacagtttctgctt

SEQ ID NO: 1538775 - DNA, 20 bp, Homo sapiens
gtacataactcctgtccctt

SEQ ID NO: 1538776 - DNA, 18 bp, Homo sapiens
gtacatatgtaaaataaa

SEQ ID NO: 1538777 - DNA, 13 bp, Homo sapiens
gtacatatgtaat

SEQ ID NO: 1538778 - DNA, 17 bp, Homo sapiens
gtacatatgtaattctt

SEQ ID NO: 1538779 - DNA, 15 bp, Homo sapiens
gtacatctgcaatat

SEQ ID NO: 1538780 - DNA, 16 bp, Homo sapiens
gtacatgtacatagta

SEQ ID NO: 1538781 - DNA, 23 bp, Homo sapiens
gtacatgtacatagtaaagtatt

SEQ ID NO: 1538782 - DNA, 16 bp, Homo sapiens
gtacatgtattaaatt

SEQ ID NO: 1538783 - DNA, 12 bp, Homo sapiens
gtacattctgcc

SEQ ID NO: 1538784 - DNA, 20 bp, Homo sapiens
gtacattcttccatcatcac

SEQ ID NO: 1538785 - DNA, 23 bp, Homo sapiens
gtacatttttaaattcttactct

SEQ ID NO: 1538786 - DNA, 16 bp, Homo sapiens
gtaccaaaattttaaa

SEQ ID NO: 1538787 - DNA, 15 bp, Homo sapiens
gtaccaatcatttta

SEQ ID NO: 1538788 - DNA, 14 bp, Homo sapiens
gtaccaatgctgtt

SEQ ID NO: 1538789 - DNA, 15 bp, Homo sapiens
gtaccacttcctgag

SEQ ID NO: 1538790 - DNA, 19 bp, Homo sapiens
gtaccagctgcgcttgctt

SEQ ID NO: 1538791 - DNA, 10 bp, Homo sapiens
gtaccagtta

SEQ ID NO: 1538792 - DNA, 22 bp, Homo sapiens
gtaccagttaatttttccaact

SEQ ID NO: 1538793 - DNA, 19 bp, Homo sapiens
cagatggggtctgtgactg

SEQ ID NO: 1538794 - DNA, 20 bp, Homo sapiens
cagatggggtctgtgactgg

SEQ ID NO: 1538795 - DNA, 21 bp, Homo sapiens
cagatgggtctgatattaatc

SEQ ID NO: 1538796 - DNA, 16 bp, Homo sapiens
cagatggtcatccaga

SEQ ID NO: 1538797 - DNA, 16 bp, Homo sapiens
cagatggtgaagcatt

SEQ ID NO: 1538798 - DNA, 13 bp, Homo sapiens
cagatgtcttctg

SEQ ID NO: 1538799 - DNA, 15 bp, Homo sapiens
cagatgtcttctgcc

SEQ ID NO: 1538800 - DNA, 16 bp, Homo sapiens
cagatgtgactgtata

SEQ ID NO: 1538801 - DNA, 22 bp, Homo sapiens
cagatgtgctataatctgtttt

SEQ ID NO: 1538802 - DNA, 22 bp, Homo sapiens
cagatgtgggccaccattgcaa

SEQ ID NO: 1538803 - DNA, 18 bp, Homo sapiens
cagatgtggggctgagct

SEQ ID NO: 1538804 - DNA, 15 bp, Homo sapiens
cagatgttcaaatat

SEQ ID NO: 1538805 - DNA, 20 bp, Homo sapiens
cagatgttgcttttgaaaag

SEQ ID NO: 1538806 - DNA, 21 bp, Homo sapiens
cagatgttgcttttgaaaagt

SEQ ID NO: 1538807 - DNA, 20 bp, Homo sapiens
cagatgttgttcctggctag

SEQ ID NO: 1538808 - DNA, 15 bp, Homo sapiens
cagatgtttccagac

SEQ ID NO: 1538809 - DNA, 23 bp, Homo sapiens
cagatgtttccagacttccttga

SEQ ID NO: 1538810 - DNA, 15 bp, Homo sapiens
cagatgtttgcctca

SEQ ID NO: 1538811 - DNA, 13 bp, Homo sapiens
cagatgttttgat

SEQ ID NO: 1538812 - DNA, 14 bp, Homo sapiens
cagatgttttgatg

SEQ ID NO: 1538813 - DNA, 21 bp, Homo sapiens
cagattactgctttaatcaga

SEQ ID NO: 1538814 - DNA, 18 bp, Homo sapiens
cagattagttctttttgc

SEQ ID NO: 1538815 - DNA, 14 bp, Homo sapiens
cagattatgttcct

SEQ ID NO: 1538816 - DNA, 16 bp, Homo sapiens
cagattcaggccagcc

SEQ ID NO: 1538817 - DNA, 20 bp, Homo sapiens
cagattcaggccagcccagc

SEQ ID NO: 1538818 - DNA, 14 bp, Homo sapiens
cagattcccactgc

SEQ ID NO: 1538819 - DNA, 18 bp, Homo sapiens
cagattcccagagcaaaa

SEQ ID NO: 1538820 - DNA, 14 bp, Homo sapiens
cagattcctgggcc

SEQ ID NO: 1538821 - DNA, 15 bp, Homo sapiens
cagattcctgggcct

SEQ ID NO: 1538822 - DNA, 16 bp, Homo sapiens
cagattcctgggcctg

SEQ ID NO: 1538823 - DNA, 14 bp, Homo sapiens
cagattctcttgaa

SEQ ID NO: 1538824 - DNA, 15 bp, Homo sapiens
cagattctgatgcat

SEQ ID NO: 1538825 - DNA, 18 bp, Homo sapiens
cagattctgcctatgtaa

SEQ ID NO: 1538826 - DNA, 13 bp, Homo sapiens
cagattctgtgag

SEQ ID NO: 1538827 - DNA, 16 bp, Homo sapiens
cagattgcctgtttct

SEQ ID NO: 1538828 - DNA, 18 bp, Homo sapiens
cagattggctcacactga

SEQ ID NO: 1538829 - DNA, 15 bp, Homo sapiens
cagattgtgtacata

SEQ ID NO: 1538830 - DNA, 13 bp, Homo sapiens
cagattgtttcct

SEQ ID NO: 1538831 - DNA, 17 bp, Homo sapiens
cagatttactaaatcaa

SEQ ID NO: 1538832 - DNA, 20 bp, Homo sapiens
cagatttagtgaaagctaga

SEQ ID NO: 1538833 - DNA, 22 bp, Homo sapiens
cagatttagtgaaagctagaga

SEQ ID NO: 1538834 - DNA, 16 bp, Homo sapiens
cagatttcatacctca

SEQ ID NO: 1538835 - DNA, 13 bp, Homo sapiens
cagatttctggtt

SEQ ID NO: 1538836 - DNA, 14 bp, Homo sapiens
cagatttctggttg

SEQ ID NO: 1538837 - DNA, 16 bp, Homo sapiens
cagatttctggttgat

SEQ ID NO: 1538838 - DNA, 18 bp, Homo sapiens
cagatttgaggctggttt

SEQ ID NO: 1538839 - DNA, 19 bp, Homo sapiens
cagatttgaggctggtttt

SEQ ID NO: 1538840 - DNA, 20 bp, Homo sapiens
cagatttgctaatttatcct

SEQ ID NO: 1538841 - DNA, 14 bp, Homo sapiens
cagatttgtctttt

SEQ ID NO: 1538842 - DNA, 19 bp, Homo sapiens
cagattttaagggggaaaa

SEQ ID NO: 1538843 - DNA, 18 bp, Homo sapiens
cagattttacaaaagatg

SEQ ID NO: 1538844 - DNA, 16 bp, Homo sapiens
cagattttatttgtaa

SEQ ID NO: 1538845 - DNA, 13 bp, Homo sapiens
cagattttcagca

SEQ ID NO: 1538846 - DNA, 23 bp, Homo sapiens
cagattttggggttgtgttgtca

SEQ ID NO: 1538847 - DNA, 15 bp, Homo sapiens
cagatttttacaaat

SEQ ID NO: 1538848 - DNA, 18 bp, Homo sapiens
gtagctctgcctccctct

SEQ ID NO: 1538849 - DNA, 17 bp, Homo sapiens
gtagctgaacctgtctg

SEQ ID NO: 1538850 - DNA, 17 bp, Homo sapiens
gtagctggattacaggc

SEQ ID NO: 1538851 - DNA, 15 bp, Homo sapiens
gtagctgtaagggca

SEQ ID NO: 1538852 - DNA, 17 bp, Homo sapiens
gtagcttaccagaagct

SEQ ID NO: 1538853 - DNA, 22 bp, Homo sapiens
gtagcttaccagaagcttccat

SEQ ID NO: 1538854 - DNA, 19 bp, Homo sapiens
gtagcttacctgacacaag

SEQ ID NO: 1538855 - DNA, 22 bp, Homo sapiens
gtagctttaaaaccacagctgg

SEQ ID NO: 1538856 - DNA, 19 bp, Homo sapiens
gtaggaaaaataaaaacag

SEQ ID NO: 1538857 - DNA, 14 bp, Homo sapiens
gtaggaaagggcgc

SEQ ID NO: 1538858 - DNA, 22 bp, Homo sapiens
gtaggaaccgtggtatgtctgc

SEQ ID NO: 1538859 - DNA, 14 bp, Homo sapiens
gtaggaaggggagg

SEQ ID NO: 1538860 - DNA, 18 bp, Homo sapiens
gtaggaaggttaatgttc

SEQ ID NO: 1538861 - DNA, 17 bp, Homo sapiens
gtaggaatcctttgaga

SEQ ID NO: 1538862 - DNA, 21 bp, Homo sapiens
gtaggaatgtacatgaagcaa

SEQ ID NO: 1538863 - DNA, 19 bp, Homo sapiens
gtaggaccaagcatcttgg

SEQ ID NO: 1538864 - DNA, 22 bp, Homo sapiens
gtaggagaggcgggagaactga

SEQ ID NO: 1538865 - DNA, 22 bp, Homo sapiens
gtaggagagtcggtctgctttg

SEQ ID NO: 1538866 - DNA, 23 bp, Homo sapiens
gtaggaggaaacagttctcactg

SEQ ID NO: 1538867 - DNA, 17 bp, Homo sapiens
gtaggagggtgggaagg

SEQ ID NO: 1538868 - DNA, 15 bp, Homo sapiens
gtaggatcacctgag

SEQ ID NO: 1538869 - DNA, 20 bp, Homo sapiens
gtaggatcacctgaggtcag

SEQ ID NO: 1538870 - DNA, 19 bp, Homo sapiens
gtaggattttgagggtggg

SEQ ID NO: 1538871 - DNA, 16 bp, Homo sapiens
gtaggcaaatctcttt

SEQ ID NO: 1538872 - DNA, 14 bp, Homo sapiens
gtaggcagaggctg

SEQ ID NO: 1538873 - DNA, 23 bp, Homo sapiens
gtaggcatgagggatcacagggc

SEQ ID NO: 1538874 - DNA, 18 bp, Homo sapiens
gtaggcccttgtcctgcc

SEQ ID NO: 1538875 - DNA, 20 bp, Homo sapiens
gtaggcccttgtcctgccag

SEQ ID NO: 1538876 - DNA, 22 bp, Homo sapiens
gtaggctgtattttcttttata

SEQ ID NO: 1538877 - DNA, 23 bp, Homo sapiens
gtagggaaaccttggagaggaga

SEQ ID NO: 1538878 - DNA, 22 bp, Homo sapiens
gtagggatgcggatcctgctgg

SEQ ID NO: 1538879 - DNA, 20 bp, Homo sapiens
gtaggggagggcaggcttgg

SEQ ID NO: 1538880 - DNA, 21 bp, Homo sapiens
gtaggggagggcaggcttggg

SEQ ID NO: 1538881 - DNA, 17 bp, Homo sapiens
gtaggggatgtggagtg

SEQ ID NO: 1538882 - DNA, 17 bp, Homo sapiens
gtaggggctcctgagtg

SEQ ID NO: 1538883 - DNA, 23 bp, Homo sapiens
gtaggggttaacttggtcagagc

SEQ ID NO: 1538884 - DNA, 17 bp, Homo sapiens
gtagggtggcactggga

SEQ ID NO: 1538885 - DNA, 12 bp, Homo sapiens
gtagggtgggag

SEQ ID NO: 1538886 - DNA, 17 bp, Homo sapiens
gtagggtgttctggctt

SEQ ID NO: 1538887 - DNA, 13 bp, Homo sapiens
gtaggtaagactg

SEQ ID NO: 1538888 - DNA, 14 bp, Homo sapiens
gtaggtccaagggc

SEQ ID NO: 1538889 - DNA, 14 bp, Homo sapiens
gtaggtcccggcca

SEQ ID NO: 1538890 - DNA, 17 bp, Homo sapiens
gtaggtcccggccagct

SEQ ID NO: 1538891 - DNA, 24 bp, Homo sapiens
gtaggtggaagctagacacatgaa

SEQ ID NO: 1538892 - DNA, 20 bp, Homo sapiens
gtaggtggttcgtgctgtgc

SEQ ID NO: 1538893 - DNA, 16 bp, Homo sapiens
gtaggttcagccaagg

SEQ ID NO: 1538894 - DNA, 14 bp, Homo sapiens
gtaggttgggagaa

SEQ ID NO: 1538895 - DNA, 18 bp, Homo sapiens
gtaggtttctctcttccc

SEQ ID NO: 1538896 - DNA, 21 bp, Homo sapiens
gtagtactcctgcaaaatttt

SEQ ID NO: 1538897 - DNA, 19 bp, Homo sapiens
gtagtactccttaagaaca

SEQ ID NO: 1538898 - DNA, 13 bp, Homo sapiens
gtagtatggcact

SEQ ID NO: 1538899 - DNA, 13 bp, Homo sapiens
gtagtatttttta

SEQ ID NO: 1538900 - DNA, 15 bp, Homo sapiens
gtagtattttttgta

SEQ ID NO: 1538901 - DNA, 20 bp, Homo sapiens
gtagtattttttgtataatt

SEQ ID NO: 1538902 - DNA, 23 bp, Homo sapiens
gtagtattttttgtataattgga

SEQ ID NO: 1538903 - DNA, 14 bp, Homo sapiens
gtagtcaataaaac

SEQ ID NO: 1538904 - DNA, 17 bp, Homo sapiens
gtagtccagccttccag

SEQ ID NO: 1538905 - DNA, 13 bp, Homo sapiens
gtagtcccagcta

SEQ ID NO: 1538906 - DNA, 23 bp, Homo sapiens
gtagtcccctgttgattatcttc

SEQ ID NO: 1538907 - DNA, 14 bp, Homo sapiens
ggccctcccagccc

SEQ ID NO: 1538908 - DNA, 21 bp, Homo sapiens
ggccctccctgttccccagag

SEQ ID NO: 1538909 - DNA, 23 bp, Homo sapiens
ggccctccctgttccccagagaa

SEQ ID NO: 1538910 - DNA, 15 bp, Homo sapiens
ggccctcccttggaa

SEQ ID NO: 1538911 - DNA, 11 bp, Homo sapiens
ggccctctgcc

SEQ ID NO: 1538912 - DNA, 14 bp, Homo sapiens
ggccctctgcctgc

SEQ ID NO: 1538913 - DNA, 16 bp, Homo sapiens
ggccctctgcctgcac

SEQ ID NO: 1538914 - DNA, 16 bp, Homo sapiens
ggccctctgtccacat

SEQ ID NO: 1538915 - DNA, 15 bp, Homo sapiens
ggccctctttccctg

SEQ ID NO: 1538916 - DNA, 17 bp, Homo sapiens
ggccctctttccctgcg

SEQ ID NO: 1538917 - DNA, 19 bp, Homo sapiens
ggccctctttccctgcgag

SEQ ID NO: 1538918 - DNA, 14 bp, Homo sapiens
ggccctgacttctg

SEQ ID NO: 1538919 - DNA, 17 bp, Homo sapiens
ggccctgacttctggag

SEQ ID NO: 1538920 - DNA, 14 bp, Homo sapiens
ggccctgagctcgg

SEQ ID NO: 1538921 - DNA, 21 bp, Homo sapiens
ggccctgagctcggtggaccc

SEQ ID NO: 1538922 - DNA, 17 bp, Homo sapiens
ggccctgaggtgtgggg

SEQ ID NO: 1538923 - DNA, 22 bp, Homo sapiens
ggccctgaggtgtgggggctgc

SEQ ID NO: 1538924 - DNA, 19 bp, Homo sapiens
ggccctgagtctgggcagc

SEQ ID NO: 1538925 - DNA, 17 bp, Homo sapiens
ggccctgcattggcctg

SEQ ID NO: 1538926 - DNA, 20 bp, Homo sapiens
ggccctgcattggcctggcc

SEQ ID NO: 1538927 - DNA, 21 bp, Homo sapiens
ggccctgccagtggggaagga

SEQ ID NO: 1538928 - DNA, 13 bp, Homo sapiens
ggccctgccccac

SEQ ID NO: 1538929 - DNA, 20 bp, Homo sapiens
ggccctgccccaccccatcc

SEQ ID NO: 1538930 - DNA, 15 bp, Homo sapiens
ggccctgccctctcc

SEQ ID NO: 1538931 - DNA, 14 bp, Homo sapiens
ggccctgccttctt

SEQ ID NO: 1538932 - DNA, 10 bp, Homo sapiens
ggccctgcta

SEQ ID NO: 1538933 - DNA, 19 bp, Homo sapiens
ggccctgctgaagctgctg

SEQ ID NO: 1538934 - DNA, 17 bp, Homo sapiens
ggccctgctttttttct

SEQ ID NO: 1538935 - DNA, 13 bp, Homo sapiens
ggccctggagcca

SEQ ID NO: 1538936 - DNA, 15 bp, Homo sapiens
ggccctggagccagg

SEQ ID NO: 1538937 - DNA, 18 bp, Homo sapiens
ggccctggagccagggca

SEQ ID NO: 1538938 - DNA, 19 bp, Homo sapiens
ggccctggagccagggcag

SEQ ID NO: 1538939 - DNA, 12 bp, Homo sapiens
ggccctggccag

SEQ ID NO: 1538940 - DNA, 15 bp, Homo sapiens
ggccttaaagaggga

SEQ ID NO: 1538941 - DNA, 16 bp, Homo sapiens
ggccttaaagagggac

SEQ ID NO: 1538942 - DNA, 19 bp, Homo sapiens
ggccttaaagagggacagg

SEQ ID NO: 1538943 - DNA, 20 bp, Homo sapiens
ggccttaacacactggccat

SEQ ID NO: 1538944 - DNA, 14 bp, Homo sapiens
ggccttaactttcc

SEQ ID NO: 1538945 - DNA, 14 bp, Homo sapiens
ggccttaagaactg

SEQ ID NO: 1538946 - DNA, 13 bp, Homo sapiens
ggccttaatttcc

SEQ ID NO: 1538947 - DNA, 15 bp, Homo sapiens
ggccttaatttcctt

SEQ ID NO: 1538948 - DNA, 16 bp, Homo sapiens
ggccttaatttccttt

SEQ ID NO: 1538949 - DNA, 17 bp, Homo sapiens
ggccttaatttcctttt

SEQ ID NO: 1538950 - DNA, 20 bp, Homo sapiens
ggccttaatttcctttttga

SEQ ID NO: 1538951 - DNA, 21 bp, Homo sapiens
ggccttatcgggctccagcca

SEQ ID NO: 1538952 - DNA, 20 bp, Homo sapiens
ggccttcacaatctgtcagt

SEQ ID NO: 1538953 - DNA, 13 bp, Homo sapiens
ggccttcaccaag

SEQ ID NO: 1538954 - DNA, 17 bp, Homo sapiens
ggccttcatcctcctcc

SEQ ID NO: 1538955 - DNA, 18 bp, Homo sapiens
ggccttccacgtcttcct

SEQ ID NO: 1538956 - DNA, 19 bp, Homo sapiens
ggccttccccttttgcctg

SEQ ID NO: 1538957 - DNA, 23 bp, Homo sapiens
ggccttccttttgaggagctgga

SEQ ID NO: 1538958 - DNA, 18 bp, Homo sapiens
ggccttgcagctggccca

SEQ ID NO: 1538959 - DNA, 22 bp, Homo sapiens
ggccttgcccgccagcctcagt

SEQ ID NO: 1538960 - DNA, 12 bp, Homo sapiens
ggccttggaaat

SEQ ID NO: 1538961 - DNA, 18 bp, Homo sapiens
ggccttggtggagcagcc

SEQ ID NO: 1538962 - DNA, 19 bp, Homo sapiens
ggccttgtgtgtcaggccc

SEQ ID NO: 1538963 - DNA, 19 bp, Homo sapiens
ggcctttgcaagatgcttg

SEQ ID NO: 1538964 - DNA, 17 bp, Homo sapiens
ggcctttgttctggggg

SEQ ID NO: 1538965 - DNA, 21 bp, Homo sapiens
ggcgacaaaatctcctggctt

SEQ ID NO: 1538966 - DNA, 17 bp, Homo sapiens
ggcgacaagagtgagac

SEQ ID NO: 1538967 - DNA, 14 bp, Homo sapiens
ggcgactctgcaga

SEQ ID NO: 1538968 - DNA, 13 bp, Homo sapiens
ggcgagcccctcc

SEQ ID NO: 1538969 - DNA, 17 bp, Homo sapiens
ggcgagctttctctccg

SEQ ID NO: 1538970 - DNA, 15 bp, Homo sapiens
ggcgagtcactgcct

SEQ ID NO: 1538971 - DNA, 17 bp, Homo sapiens
ggcgatccacctgtctc

SEQ ID NO: 1538972 - DNA, 18 bp, Homo sapiens
ggcgatccacctgtctca

SEQ ID NO: 1538973 - DNA, 22 bp, Homo sapiens
ggcgatccacctgtctcagcct

SEQ ID NO: 1538974 - DNA, 11 bp, Homo sapiens
ggcgcaggagg

SEQ ID NO: 1538975 - DNA, 15 bp, Homo sapiens
ggcgcaggtgggctg

SEQ ID NO: 1538976 - DNA, 14 bp, Homo sapiens
ggcgcccaccctgg

SEQ ID NO: 1538977 - DNA, 20 bp, Homo sapiens
ggcgcccattcgtctgtccc

SEQ ID NO: 1538978 - DNA, 14 bp, Homo sapiens
ggcgcccccagtgt

SEQ ID NO: 1538979 - DNA, 12 bp, Homo sapiens
ggcgccctggaa

SEQ ID NO: 1538980 - DNA, 18 bp, Homo sapiens
ggcgcccttggcttctgt

SEQ ID NO: 1538981 - DNA, 19 bp, Homo sapiens
ggcgccggcgggcgggccg

SEQ ID NO: 1538982 - DNA, 20 bp, Homo sapiens
ggcgccgtctccaggggctg

SEQ ID NO: 1538983 - DNA, 23 bp, Homo sapiens
ggcgcctataatcccagctactg

SEQ ID NO: 1538984 - DNA, 15 bp, Homo sapiens
ggcgccttctcggag

SEQ ID NO: 1538985 - DNA, 18 bp, Homo sapiens
ggcgcgggaggcaccagc

SEQ ID NO: 1538986 - DNA, 15 bp, Homo sapiens
ggcgcgggcagccac

SEQ ID NO: 1538987 - DNA, 18 bp, Homo sapiens
ggcgctattgcactccag

SEQ ID NO: 1538988 - DNA, 23 bp, Homo sapiens
ggcgctcagacggcggccaggca

SEQ ID NO: 1538989 - DNA, 11 bp, Homo sapiens
ggcgctcagga

SEQ ID NO: 1538990 - DNA, 14 bp, Homo sapiens
ggcgctcaggaccc

SEQ ID NO: 1538991 - DNA, 21 bp, Homo sapiens
ggcgctcaggacccaggccct

SEQ ID NO: 1538992 - DNA, 15 bp, Homo sapiens
ggcgctcgctcaggt

SEQ ID NO: 1538993 - DNA, 23 bp, Homo sapiens
ggcgctctccctaccttgcctcc

SEQ ID NO: 1538994 - DNA, 15 bp, Homo sapiens
ggcgctgcagcctcc

SEQ ID NO: 1538995 - DNA, 18 bp, Homo sapiens
ggcgctgcagcctccctt

SEQ ID NO: 1538996 - DNA, 12 bp, Homo sapiens
ggcgctgcaggt

SEQ ID NO: 1538997 - DNA, 11 bp, Homo sapiens
ggcgctggccc

SEQ ID NO: 1538998 - DNA, 13 bp, Homo sapiens
ggcgctggcccag

SEQ ID NO: 1538999 - DNA, 15 bp, Homo sapiens
ggcgctggcccagcc

SEQ ID NO: 1539000 - DNA, 18 bp, Homo sapiens
ggcgctggcccagccggc

SEQ ID NO: 1539001 - DNA, 19 bp, Homo sapiens
ggcgctggcccagccggcc

SEQ ID NO: 1539002 - DNA, 20 bp, Homo sapiens
ggcgctggcccagccggcct

SEQ ID NO: 1539003 - DNA, 18 bp, Homo sapiens
ggcggacggctgtggacc

SEQ ID NO: 1539004 - DNA, 16 bp, Homo sapiens
ggcggaggggatccag

SEQ ID NO: 1539005 - DNA, 21 bp, Homo sapiens
ggcggaggttccagtgagccg

SEQ ID NO: 1539006 - DNA, 20 bp, Homo sapiens
ggcggaggttgtggtgagcg

SEQ ID NO: 1539007 - DNA, 16 bp, Homo sapiens
ggcggcagcagccatc

SEQ ID NO: 1539008 - DNA, 13 bp, Homo sapiens
ggcggcagctggg

SEQ ID NO: 1539009 - DNA, 20 bp, Homo sapiens
ggcggcatccctgcagagga

SEQ ID NO: 1539010 - DNA, 21 bp, Homo sapiens
ggcggccacgcactgggccac

SEQ ID NO: 1539011 - DNA, 24 bp, Homo sapiens
ggcggccacgcactgggccacgga

SEQ ID NO: 1539012 - DNA, 13 bp, Homo sapiens
ggcggccaggcac

SEQ ID NO: 1539013 - DNA, 19 bp, Homo sapiens
ggcggccaggcacagggcc

SEQ ID NO: 1539014 - DNA, 13 bp, Homo sapiens
ggcggccccagca

SEQ ID NO: 1539015 - DNA, 14 bp, Homo sapiens
ggcggcccggccag

SEQ ID NO: 1539016 - DNA, 15 bp, Homo sapiens
ggcggcccggccagc

SEQ ID NO: 1539017 - DNA, 18 bp, Homo sapiens
ggcggcccggccagcggg

SEQ ID NO: 1539018 - DNA, 19 bp, Homo sapiens
ggcggcccggccagcgggc

SEQ ID NO: 1539019 - DNA, 20 bp, Homo sapiens
ggcggcccggccagcgggca

SEQ ID NO: 1539020 - DNA, 21 bp, Homo sapiens
ggcggccctgctgaagctgct

SEQ ID NO: 1539021 - DNA, 19 bp, Homo sapiens
ggcggcccttctgactgtt

SEQ ID NO: 1539022 - DNA, 21 bp, Homo sapiens
ggcggcccttctgactgttta

SEQ ID NO: 1539023 - DNA, 14 bp, Homo sapiens
ggcggcggccacgc

SEQ ID NO: 1539024 - DNA, 14 bp, Homo sapiens
ggcggctgagagcc

SEQ ID NO: 1539025 - DNA, 18 bp, Homo sapiens
ggcggctgagagccccag

SEQ ID NO: 1539026 - DNA, 21 bp, Homo sapiens
ggcggcttcctgtccactctc

SEQ ID NO: 1539027 - DNA, 18 bp, Homo sapiens
ggcgggcccagaccggct

SEQ ID NO: 1539028 - DNA, 17 bp, Homo sapiens
ggcggggcagcaggagc

SEQ ID NO: 1539029 - DNA, 19 bp, Homo sapiens
ggcacattaactccctcca

SEQ ID NO: 1539030 - DNA, 18 bp, Homo sapiens
ggcacattgagctgtgca

SEQ ID NO: 1539031 - DNA, 16 bp, Homo sapiens
ggcaccaccaggagca

SEQ ID NO: 1539032 - DNA, 17 bp, Homo sapiens
ggcaccagacacccagg

SEQ ID NO: 1539033 - DNA, 18 bp, Homo sapiens
ggcaccagccccctggat

SEQ ID NO: 1539034 - DNA, 14 bp, Homo sapiens
ggcaccagctctgt

SEQ ID NO: 1539035 - DNA, 20 bp, Homo sapiens
ggcaccagctctgtggcctg

SEQ ID NO: 1539036 - DNA, 17 bp, Homo sapiens
ggcaccaggggtttctc

SEQ ID NO: 1539037 - DNA, 21 bp, Homo sapiens
ggcacccaccgtggaggagga

SEQ ID NO: 1539038 - DNA, 19 bp, Homo sapiens
ggcacccatgtgggcgccc

SEQ ID NO: 1539039 - DNA, 20 bp, Homo sapiens
ggcacccccacaagctgtcc

SEQ ID NO: 1539040 - DNA, 23 bp, Homo sapiens
ggcacccccacaagctgtccctg

SEQ ID NO: 1539041 - DNA, 12 bp, Homo sapiens
ggcaccctccca

SEQ ID NO: 1539042 - DNA, 20 bp, Homo sapiens
ggcaccgccacgtcccagca

SEQ ID NO: 1539043 - DNA, 16 bp, Homo sapiens
ggcaccggcgctgcag

SEQ ID NO: 1539044 - DNA, 15 bp, Homo sapiens
ggcacctaatccagg

SEQ ID NO: 1539045 - DNA, 22 bp, Homo sapiens
ggcacctaatccaggcagatcc

SEQ ID NO: 1539046 - DNA, 21 bp, Homo sapiens
ggcacctacactcacctgcac

SEQ ID NO: 1539047 - DNA, 21 bp, Homo sapiens
ggcacctacatccccaggtct

SEQ ID NO: 1539048 - DNA, 18 bp, Homo sapiens
ggcacctatagtcccagc

SEQ ID NO: 1539049 - DNA, 19 bp, Homo sapiens
ggcacctatagtcccagct

SEQ ID NO: 1539050 - DNA, 22 bp, Homo sapiens
ggcacctatagtcccagctact

SEQ ID NO: 1539051 - DNA, 16 bp, Homo sapiens
ggcacctcacaggccc

SEQ ID NO: 1539052 - DNA, 16 bp, Homo sapiens
ggcacctccaggcagg

SEQ ID NO: 1539053 - DNA, 18 bp, Homo sapiens
ggcacctccaggcaggcc

SEQ ID NO: 1539054 - DNA, 22 bp, Homo sapiens
ggcacctccccgctctccctgt

SEQ ID NO: 1539055 - DNA, 15 bp, Homo sapiens
ggcacctggcctgct

SEQ ID NO: 1539056 - DNA, 18 bp, Homo sapiens
ggcacctggcctgctggg

SEQ ID NO: 1539057 - DNA, 20 bp, Homo sapiens
ggcacgaacccacctgctga

SEQ ID NO: 1539058 - DNA, 21 bp, Homo sapiens
ggcacgcaccactgcttccca

SEQ ID NO: 1539059 - DNA, 14 bp, Homo sapiens
ggcacgcacttgcc

SEQ ID NO: 1539060 - DNA, 16 bp, Homo sapiens
ggcacgccctcctcag

SEQ ID NO: 1539061 - DNA, 21 bp, Homo sapiens
ggcacggcgggatcctccaca

SEQ ID NO: 1539062 - DNA, 15 bp, Homo sapiens
ggcacgggtggtccc

SEQ ID NO: 1539063 - DNA, 21 bp, Homo sapiens
ggcactcacagacctggagcc

SEQ ID NO: 1539064 - DNA, 10 bp, Homo sapiens
ggcactccca

SEQ ID NO: 1539065 - DNA, 17 bp, Homo sapiens
ggcactgagatatttat

SEQ ID NO: 1539066 - DNA, 19 bp, Homo sapiens
ggcactgagcccccccaac

SEQ ID NO: 1539067 - DNA, 22 bp, Homo sapiens
ggcactgattgttttagagact

SEQ ID NO: 1539068 - DNA, 21 bp, Homo sapiens
ggcactggtaggttgggacac

SEQ ID NO: 1539069 - DNA, 13 bp, Homo sapiens
ggcactggtggca

SEQ ID NO: 1539070 - DNA, 15 bp, Homo sapiens
ggcactggtggcccg

SEQ ID NO: 1539071 - DNA, 20 bp, Homo sapiens
ggcactgtagttctaagact

SEQ ID NO: 1539072 - DNA, 12 bp, Homo sapiens
ggcactgttaat

SEQ ID NO: 1539073 - DNA, 20 bp, Homo sapiens
ggcacttaagtgcacttttt

SEQ ID NO: 1539074 - DNA, 22 bp, Homo sapiens
ggcacttagcccaagaggtctg

SEQ ID NO: 1539075 - DNA, 13 bp, Homo sapiens
ggcacttgtattt

SEQ ID NO: 1539076 - DNA, 14 bp, Homo sapiens
ggcacttgtattta

SEQ ID NO: 1539077 - DNA, 18 bp, Homo sapiens
ggcacttgtatttaattc

SEQ ID NO: 1539078 - DNA, 15 bp, Homo sapiens
ggcagaaaagaggag

SEQ ID NO: 1539079 - DNA, 21 bp, Homo sapiens
ggcagaaagatacagacattc

SEQ ID NO: 1539080 - DNA, 16 bp, Homo sapiens
ggcagaaagtggccat

SEQ ID NO: 1539081 - DNA, 23 bp, Homo sapiens
ggcagaaatcgagagtgtgctct

SEQ ID NO: 1539082 - DNA, 14 bp, Homo sapiens
ggcagaacagccgc

SEQ ID NO: 1539083 - DNA, 22 bp, Homo sapiens
ggcagaagaattgaacccagga

SEQ ID NO: 1539084 - DNA, 23 bp, Homo sapiens
ggcagaagactagaggccagggc

SEQ ID NO: 1539085 - DNA, 19 bp, Homo sapiens
ggcagaagagaaaggactc

SEQ ID NO: 1539086 - DNA, 20 bp, Homo sapiens
ggcagaagcattgcctggac

SEQ ID NO: 1539087 - DNA, 16 bp, Homo sapiens
ggcagaagtgctcttt

SEQ ID NO: 1539088 - DNA, 14 bp, Homo sapiens
ggcagacaagagct

SEQ ID NO: 1539089 - DNA, 20 bp, Homo sapiens
ggcagacaagagctgctgtc

SEQ ID NO: 1539090 - DNA, 20 bp, Homo sapiens
ggcagacacaccgcggccag

SEQ ID NO: 1539091 - DNA, 13 bp, Homo sapiens
ggcagacagcagc

SEQ ID NO: 1539092 - DNA, 16 bp, Homo sapiens
ggcagacagcagctca

SEQ ID NO: 1539093 - DNA, 17 bp, Homo sapiens
ggcagacagcagctcag

SEQ ID NO: 1539094 - DNA, 14 bp, Homo sapiens
ggcagactgggttt

SEQ ID NO: 1539095 - DNA, 15 bp, Homo sapiens
ggcagagaaggcctc

SEQ ID NO: 1539096 - DNA, 17 bp, Homo sapiens
ggcagagaaggcctctt

SEQ ID NO: 1539097 - DNA, 20 bp, Homo sapiens
ggcagagaatggctgggtca

SEQ ID NO: 1539098 - DNA, 19 bp, Homo sapiens
ggcagagcaattccaggct

SEQ ID NO: 1539099 - DNA, 19 bp, Homo sapiens
ggcagagccatgggcctgg

SEQ ID NO: 1539100 - DNA, 22 bp, Homo sapiens
ggcagagccatgggcctgggcc

SEQ ID NO: 1539101 - DNA, 23 bp, Homo sapiens
ggcagagccatgggcctgggcct

SEQ ID NO: 1539102 - DNA, 22 bp, Homo sapiens
ggcagaggctggaggcagggcc

SEQ ID NO: 1539103 - DNA, 14 bp, Homo sapiens
ggcagagggcagag

SEQ ID NO: 1539104 - DNA, 20 bp, Homo sapiens
ggcagagggcagaggctgga

SEQ ID NO: 1539105 - DNA, 15 bp, Homo sapiens
ggcagatctgtgccc

SEQ ID NO: 1539106 - DNA, 18 bp, Homo sapiens
ggcagatctgtgccccat

SEQ ID NO: 1539107 - DNA, 12 bp, Homo sapiens
ggcagcaaggct

SEQ ID NO: 1539108 - DNA, 16 bp, Homo sapiens
ggcagcaaggctgctg

SEQ ID NO: 1539109 - DNA, 17 bp, Homo sapiens
ggcagcaaggctgctgc

SEQ ID NO: 1539110 - DNA, 18 bp, Homo sapiens
ggcagcaaggctgctgcc

SEQ ID NO: 1539111 - DNA, 20 bp, Homo sapiens
ggcagcaagggacctgctca

SEQ ID NO: 1539112 - DNA, 15 bp, Homo sapiens
ggcagcaccacactg

SEQ ID NO: 1539113 - DNA, 14 bp, Homo sapiens
ggcagcactcccca

SEQ ID NO: 1539114 - DNA, 18 bp, Homo sapiens
ggcagcagaagggggtgg

SEQ ID NO: 1539115 - DNA, 22 bp, Homo sapiens
ggcagcagagagagaggacaga

SEQ ID NO: 1539116 - DNA, 11 bp, Homo sapiens
ggcagcagccg

SEQ ID NO: 1539117 - DNA, 16 bp, Homo sapiens
ggcagccaaacccatg

SEQ ID NO: 1539118 - DNA, 20 bp, Homo sapiens
ggcagccaaacccatgaggc

SEQ ID NO: 1539119 - DNA, 17 bp, Homo sapiens
ggcagccacccaagcct

SEQ ID NO: 1539120 - DNA, 19 bp, Homo sapiens
ggcagccacggccccgggt

SEQ ID NO: 1539121 - DNA, 13 bp, Homo sapiens
ggcagccagggct

SEQ ID NO: 1539122 - DNA, 16 bp, Homo sapiens
ggcagccatgcctcat

SEQ ID NO: 1539123 - DNA, 22 bp, Homo sapiens
ggcagcccagctcctgaataaa

SEQ ID NO: 1539124 - DNA, 21 bp, Homo sapiens
ggcagccccacttcaccccca

SEQ ID NO: 1539125 - DNA, 14 bp, Homo sapiens
ggcagccccttctg

SEQ ID NO: 1539126 - DNA, 14 bp, Homo sapiens
ggcagccctcacct

SEQ ID NO: 1539127 - DNA, 17 bp, Homo sapiens
ggcagccctcacctctg

SEQ ID NO: 1539128 - DNA, 15 bp, Homo sapiens
ggcagccctgtaggg

SEQ ID NO: 1539129 - DNA, 17 bp, Homo sapiens
ggcagccgaggcctggc

SEQ ID NO: 1539130 - DNA, 16 bp, Homo sapiens
ggcagccgtcccaggc

SEQ ID NO: 1539131 - DNA, 19 bp, Homo sapiens
ggcagccgtgccttcagct

SEQ ID NO: 1539132 - DNA, 21 bp, Homo sapiens
ggcagccgtgccttcagctct

SEQ ID NO: 1539133 - DNA, 16 bp, Homo sapiens
ggcagcctccagagcc

SEQ ID NO: 1539134 - DNA, 24 bp, Homo sapiens
ggcagcctccagagccagcctggg

SEQ ID NO: 1539135 - DNA, 11 bp, Homo sapiens
ggcagcctgct

SEQ ID NO: 1539136 - DNA, 11 bp, Homo sapiens
ggcagcctgga

SEQ ID NO: 1539137 - DNA, 19 bp, Homo sapiens
ggcagcctggctcccagga

SEQ ID NO: 1539138 - DNA, 20 bp, Homo sapiens
ggcagcctggctcccaggac

SEQ ID NO: 1539139 - DNA, 18 bp, Homo sapiens
ggcagcgcggggagcccg

SEQ ID NO: 1539140 - DNA, 16 bp, Homo sapiens
ggcagcgggccaggcc

SEQ ID NO: 1539141 - DNA, 23 bp, Homo sapiens
ggcagcgggcggaggggatccag

SEQ ID NO: 1539142 - DNA, 14 bp, Homo sapiens
ggcagctagactgg

SEQ ID NO: 1539143 - DNA, 15 bp, Homo sapiens
ggcagctagactgga

SEQ ID NO: 1539144 - DNA, 13 bp, Homo sapiens
ggcagctagtgcc

SEQ ID NO: 1539145 - DNA, 19 bp, Homo sapiens
ggccagtccccgaggagct

SEQ ID NO: 1539146 - DNA, 16 bp, Homo sapiens
ggccagtctgggctgc

SEQ ID NO: 1539147 - DNA, 13 bp, Homo sapiens
ggccagtctgtgg

SEQ ID NO: 1539148 - DNA, 15 bp, Homo sapiens
ggccagtctgtggat

SEQ ID NO: 1539149 - DNA, 18 bp, Homo sapiens
ggccagtctgtggatcag

SEQ ID NO: 1539150 - DNA, 23 bp, Homo sapiens
ggccagtctgtggatcagagatg

SEQ ID NO: 1539151 - DNA, 15 bp, Homo sapiens
ggccagtcttcctct

SEQ ID NO: 1539152 - DNA, 15 bp, Homo sapiens
ggccagtgctgccca

SEQ ID NO: 1539153 - DNA, 19 bp, Homo sapiens
ggccagtggctggatctgt

SEQ ID NO: 1539154 - DNA, 14 bp, Homo sapiens
ggccagtgtttaaa

SEQ ID NO: 1539155 - DNA, 16 bp, Homo sapiens
ggccagttttctggta

SEQ ID NO: 1539156 - DNA, 13 bp, Homo sapiens
ggccatactgcct

SEQ ID NO: 1539157 - DNA, 19 bp, Homo sapiens
ggccatacttttgagaggg

SEQ ID NO: 1539158 - DNA, 17 bp, Homo sapiens
ggccatagaggcccagg

SEQ ID NO: 1539159 - DNA, 22 bp, Homo sapiens
ggccatagaggcccaggcacca

SEQ ID NO: 1539160 - DNA, 18 bp, Homo sapiens
ggccatgatggcaacaga

SEQ ID NO: 1539161 - DNA, 11 bp, Homo sapiens
ggccatgcagg

SEQ ID NO: 1539162 - DNA, 18 bp, Homo sapiens
ggccatgcaggaggtgga

SEQ ID NO: 1539163 - DNA, 13 bp, Homo sapiens
ggccatgctgagg

SEQ ID NO: 1539164 - DNA, 15 bp, Homo sapiens
ggccatgctgaggcc

SEQ ID NO: 1539165 - DNA, 19 bp, Homo sapiens
ggccatgctgaggcctggg

SEQ ID NO: 1539166 - DNA, 22 bp, Homo sapiens
ggccatgctgaggcctgggccg

SEQ ID NO: 1539167 - DNA, 13 bp, Homo sapiens
ggccatggcctct

SEQ ID NO: 1539168 - DNA, 13 bp, Homo sapiens
ggccatgtccaaa

SEQ ID NO: 1539169 - DNA, 16 bp, Homo sapiens
ggccatgtccaaagag

SEQ ID NO: 1539170 - DNA, 20 bp, Homo sapiens
ggccattctgccgccccctc

SEQ ID NO: 1539171 - DNA, 23 bp, Homo sapiens
ggccattcttatgttccagatgg

SEQ ID NO: 1539172 - DNA, 21 bp, Homo sapiens
ggccatttccaagaggctgta

SEQ ID NO: 1539173 - DNA, 22 bp, Homo sapiens
ggccatttgctagttctgctgc

SEQ ID NO: 1539174 - DNA, 16 bp, Homo sapiens
ggccatttttctgggg

SEQ ID NO: 1539175 - DNA, 20 bp, Homo sapiens
ggcccaaatccagtgtgcac

SEQ ID NO: 1539176 - DNA, 23 bp, Homo sapiens
ggcccaaatccagtgtgcacccc

SEQ ID NO: 1539177 - DNA, 14 bp, Homo sapiens
ggcccaacattaaa

SEQ ID NO: 1539178 - DNA, 18 bp, Homo sapiens
ggcccaagccccatctca

SEQ ID NO: 1539179 - DNA, 21 bp, Homo sapiens
ggcccaaggagcttacccaag

SEQ ID NO: 1539180 - DNA, 14 bp, Homo sapiens
ggcccaagtccctg

SEQ ID NO: 1539181 - DNA, 13 bp, Homo sapiens
ggcccacacctgg

SEQ ID NO: 1539182 - DNA, 15 bp, Homo sapiens
ggcccacactgaggc

SEQ ID NO: 1539183 - DNA, 15 bp, Homo sapiens
ggcccacagctccca

SEQ ID NO: 1539184 - DNA, 18 bp, Homo sapiens
ggcccacagctcccaccc

SEQ ID NO: 1539185 - DNA, 20 bp, Homo sapiens
ggcccacaggaagctcagcc

SEQ ID NO: 1539186 - DNA, 14 bp, Homo sapiens
ggcccaccatcacc

SEQ ID NO: 1539187 - DNA, 23 bp, Homo sapiens
ggcccacccagtccatgctccag

SEQ ID NO: 1539188 - DNA, 18 bp, Homo sapiens
ggcccacctggccacctg

SEQ ID NO: 1539189 - DNA, 19 bp, Homo sapiens
ggcccacctggccacctga

SEQ ID NO: 1539190 - DNA, 20 bp, Homo sapiens
ggcccacgcgcttccctggg

SEQ ID NO: 1539191 - DNA, 22 bp, Homo sapiens
ggcccacgtgtatagtatctgt

SEQ ID NO: 1539192 - DNA, 18 bp, Homo sapiens
ggcccactagagggccca

SEQ ID NO: 1539193 - DNA, 13 bp, Homo sapiens
ggcccactcccca

SEQ ID NO: 1539194 - DNA, 17 bp, Homo sapiens
ggcccactgctggctgc

SEQ ID NO: 1539195 - DNA, 13 bp, Homo sapiens
ggcccactgtgcc

SEQ ID NO: 1539196 - DNA, 23 bp, Homo sapiens
ggcccactgtgcctcagagacca

SEQ ID NO: 1539197 - DNA, 19 bp, Homo sapiens
ggcccactttcctgagctg

SEQ ID NO: 1539198 - DNA, 18 bp, Homo sapiens
ggcccagaaagcctctct

SEQ ID NO: 1539199 - DNA, 21 bp, Homo sapiens
ggcccagaaagcctctctctc

SEQ ID NO: 1539200 - DNA, 14 bp, Homo sapiens
ggcccagaccctgg

SEQ ID NO: 1539201 - DNA, 15 bp, Homo sapiens
ggcccagagaagcaa

SEQ ID NO: 1539202 - DNA, 15 bp, Homo sapiens
ggcccagagaagcca

SEQ ID NO: 1539203 - DNA, 12 bp, Homo sapiens
ggcccagagccc

SEQ ID NO: 1539204 - DNA, 14 bp, Homo sapiens
ggcccagagcccag

SEQ ID NO: 1539205 - DNA, 22 bp, Homo sapiens
ggcccagatctggtcccttgca

SEQ ID NO: 1539206 - DNA, 20 bp, Homo sapiens
ggcccagcattgctggttct

SEQ ID NO: 1539207 - DNA, 12 bp, Homo sapiens
ggcccagcccag

SEQ ID NO: 1539208 - DNA, 15 bp, Homo sapiens
ggcccagcgcggcca

SEQ ID NO: 1539209 - DNA, 17 bp, Homo sapiens
ggcccagcggcccctcc

SEQ ID NO: 1539210 - DNA, 21 bp, Homo sapiens
ggcccagctgggctctgccac

SEQ ID NO: 1539211 - DNA, 14 bp, Homo sapiens
ggcccagctgtagc

SEQ ID NO: 1539212 - DNA, 22 bp, Homo sapiens
ggcccagctgtagccatggctc

SEQ ID NO: 1539213 - DNA, 12 bp, Homo sapiens
ggcccaggaatc

SEQ ID NO: 1539214 - DNA, 15 bp, Homo sapiens
ggcccaggaccagct

SEQ ID NO: 1539215 - DNA, 18 bp, Homo sapiens
ggcccaggaccagctggg

SEQ ID NO: 1539216 - DNA, 16 bp, Homo sapiens
ggcccaggagacctcc

SEQ ID NO: 1539217 - DNA, 12 bp, Homo sapiens
ggcccaggagct

SEQ ID NO: 1539218 - DNA, 13 bp, Homo sapiens
caccatatgaatt

SEQ ID NO: 1539219 - DNA, 15 bp, Homo sapiens
caccatcaccaccgc

SEQ ID NO: 1539220 - DNA, 12 bp, Homo sapiens
caccatcagcct

SEQ ID NO: 1539221 - DNA, 14 bp, Homo sapiens
caccatcagcctgt

SEQ ID NO: 1539222 - DNA, 18 bp, Homo sapiens
caccatccaccttccctt

SEQ ID NO: 1539223 - DNA, 20 bp, Homo sapiens
caccatccaccttcccttct

SEQ ID NO: 1539224 - DNA, 18 bp, Homo sapiens
caccatccagtgggcccg

SEQ ID NO: 1539225 - DNA, 15 bp, Homo sapiens
caccatcctgagcca

SEQ ID NO: 1539226 - DNA, 16 bp, Homo sapiens
caccatcctgagccag

SEQ ID NO: 1539227 - DNA, 11 bp, Homo sapiens
caccatgaaac

SEQ ID NO: 1539228 - DNA, 14 bp, Homo sapiens
caccatgcactcac

SEQ ID NO: 1539229 - DNA, 12 bp, Homo sapiens
caccatgcctgg

SEQ ID NO: 1539230 - DNA, 22 bp, Homo sapiens
caccatgctgctggggaagaca

SEQ ID NO: 1539231 - DNA, 16 bp, Homo sapiens
caccatggccagccaa

SEQ ID NO: 1539232 - DNA, 18 bp, Homo sapiens
caccatgtacatagcttg

SEQ ID NO: 1539233 - DNA, 14 bp, Homo sapiens
caccatgtctggct

SEQ ID NO: 1539234 - DNA, 19 bp, Homo sapiens
caccatgttggccaggctg

SEQ ID NO: 1539235 - DNA, 22 bp, Homo sapiens
caccatgtttgagctcagaccc

SEQ ID NO: 1539236 - DNA, 16 bp, Homo sapiens
caccattcacatttga

SEQ ID NO: 1539237 - DNA, 23 bp, Homo sapiens
caccattcctgcctttaagccaa

SEQ ID NO: 1539238 - DNA, 24 bp, Homo sapiens
caccattctcctgcctcaccctcc

SEQ ID NO: 1539239 - DNA, 14 bp, Homo sapiens
caccattgaaggct

SEQ ID NO: 1539240 - DNA, 19 bp, Homo sapiens
caccattgcaacaaaatac

SEQ ID NO: 1539241 - DNA, 17 bp, Homo sapiens
caccatttatgtgtaga

SEQ ID NO: 1539242 - DNA, 20 bp, Homo sapiens
caccatttatgtgtagaatt

SEQ ID NO: 1539243 - DNA, 23 bp, Homo sapiens
caccattttttttttctttttgg

SEQ ID NO: 1539244 - DNA, 23 bp, Homo sapiens
cacccaaaagtcaaaaggtgcct

SEQ ID NO: 1539245 - DNA, 18 bp, Homo sapiens
cacccaaacacttctgct

SEQ ID NO: 1539246 - DNA, 20 bp, Homo sapiens
cacccaaaccggcaggtgcg

SEQ ID NO: 1539247 - DNA, 21 bp, Homo sapiens
cacccaaaccggcaggtgcga

SEQ ID NO: 1539248 - DNA, 20 bp, Homo sapiens
cacccaaatgtgtacacctg

SEQ ID NO: 1539249 - DNA, 22 bp, Homo sapiens
cacccaaccctatctcctgaca

SEQ ID NO: 1539250 - DNA, 14 bp, Homo sapiens
cacccaagccacaa

SEQ ID NO: 1539251 - DNA, 13 bp, Homo sapiens
cacccaagcctga

SEQ ID NO: 1539252 - DNA, 19 bp, Homo sapiens
cacccaattttaaaaaata

SEQ ID NO: 1539253 - DNA, 23 bp, Homo sapiens
cacccaattttaaaaaataacat

SEQ ID NO: 1539254 - DNA, 21 bp, Homo sapiens
cacccacacactcgcccgccc

SEQ ID NO: 1539255 - DNA, 13 bp, Homo sapiens
cacccacagggct

SEQ ID NO: 1539256 - DNA, 17 bp, Homo sapiens
cacccacccctgcccag

SEQ ID NO: 1539257 - DNA, 24 bp, Homo sapiens
cacccacccgccgcctcccacggc

SEQ ID NO: 1539258 - DNA, 16 bp, Homo sapiens
cacccaccgtggagga

SEQ ID NO: 1539259 - DNA, 23 bp, Homo sapiens
cacccacctggtactgacccagg

SEQ ID NO: 1539260 - DNA, 21 bp, Homo sapiens
cacctcatgcccaccccctgc

SEQ ID NO: 1539261 - DNA, 22 bp, Homo sapiens
cacctcatgcccaccccctgcc

SEQ ID NO: 1539262 - DNA, 22 bp, Homo sapiens
cacctcattctgaaccctttcg

SEQ ID NO: 1539263 - DNA, 17 bp, Homo sapiens
cacctccaagcatttca

SEQ ID NO: 1539264 - DNA, 19 bp, Homo sapiens
cacctccaagcatttcatg

SEQ ID NO: 1539265 - DNA, 19 bp, Homo sapiens
cacctccacccccgccacg

SEQ ID NO: 1539266 - DNA, 21 bp, Homo sapiens
cacctccacccccgccacggc

SEQ ID NO: 1539267 - DNA, 13 bp, Homo sapiens
cacctccaggcct

SEQ ID NO: 1539268 - DNA, 14 bp, Homo sapiens
cacctccaggcctg

SEQ ID NO: 1539269 - DNA, 20 bp, Homo sapiens
cacctcccaccccactccag

SEQ ID NO: 1539270 - DNA, 21 bp, Homo sapiens
cacctcccaccccactccagc

SEQ ID NO: 1539271 - DNA, 23 bp, Homo sapiens
cacctcccactcctgctgcacag

SEQ ID NO: 1539272 - DNA, 16 bp, Homo sapiens
cacctccccagcattc

SEQ ID NO: 1539273 - DNA, 18 bp, Homo sapiens
cacctcccccaaaccctg

SEQ ID NO: 1539274 - DNA, 20 bp, Homo sapiens
cacctcccccaaaccctgct

SEQ ID NO: 1539275 - DNA, 17 bp, Homo sapiens
cacctccccccactgca

SEQ ID NO: 1539276 - DNA, 15 bp, Homo sapiens
cacctccccctcccc

SEQ ID NO: 1539277 - DNA, 12 bp, Homo sapiens
cacctccccctt

SEQ ID NO: 1539278 - DNA, 22 bp, Homo sapiens
cacctcccccttcccctaccca

SEQ ID NO: 1539279 - DNA, 20 bp, Homo sapiens
cacctccccctttcacactg

SEQ ID NO: 1539280 - DNA, 21 bp, Homo sapiens
cacctccccctttcacactgg

SEQ ID NO: 1539281 - DNA, 17 bp, Homo sapiens
cacctccccgctctccc

SEQ ID NO: 1539282 - DNA, 21 bp, Homo sapiens
cacctccccgctctccctgtc

SEQ ID NO: 1539283 - DNA, 22 bp, Homo sapiens
cacctccccgctctccctgtca

SEQ ID NO: 1539284 - DNA, 16 bp, Homo sapiens
cacctccccgctggga

SEQ ID NO: 1539285 - DNA, 17 bp, Homo sapiens
cacctcccgaagccacc

SEQ ID NO: 1539286 - DNA, 21 bp, Homo sapiens
cacctcctagaggtgggcagc

SEQ ID NO: 1539287 - DNA, 14 bp, Homo sapiens
cacctcctcatgta

SEQ ID NO: 1539288 - DNA, 14 bp, Homo sapiens
cacctcctccatgc

SEQ ID NO: 1539289 - DNA, 19 bp, Homo sapiens
cacctcctcgaacccactc

SEQ ID NO: 1539290 - DNA, 17 bp, Homo sapiens
cacctcctctgtgattt

SEQ ID NO: 1539291 - DNA, 19 bp, Homo sapiens
cacctcctgagaaggcgag

SEQ ID NO: 1539292 - DNA, 13 bp, Homo sapiens
cacctcggaggga

SEQ ID NO: 1539293 - DNA, 15 bp, Homo sapiens
cacctcggggacacc

SEQ ID NO: 1539294 - DNA, 18 bp, Homo sapiens
cacctcggggacaccaga

SEQ ID NO: 1539295 - DNA, 20 bp, Homo sapiens
cacctcgtcaagagcatgca

SEQ ID NO: 1539296 - DNA, 16 bp, Homo sapiens
cacctctccaagggct

SEQ ID NO: 1539297 - DNA, 18 bp, Homo sapiens
cacctctccaagggcttc

SEQ ID NO: 1539298 - DNA, 22 bp, Homo sapiens
cacctctccaagggcttctgca

SEQ ID NO: 1539299 - DNA, 12 bp, Homo sapiens
cacctctcctgc

SEQ ID NO: 1539300 - DNA, 12 bp, Homo sapiens
cacctctcttca

SEQ ID NO: 1539301 - DNA, 12 bp, Homo sapiens
cacctctgcctc

SEQ ID NO: 1539302 - DNA, 17 bp, Homo sapiens
cacctctggctagagcc

SEQ ID NO: 1539303 - DNA, 21 bp, Homo sapiens
cacctctggctagagccgagg

SEQ ID NO: 1539304 - DNA, 17 bp, Homo sapiens
cacctctggtggctcct

SEQ ID NO: 1539305 - DNA, 12 bp, Homo sapiens
cacctctgtggg

SEQ ID NO: 1539306 - DNA, 23 bp, Homo sapiens
cacctctgtgggcactggtgggc

SEQ ID NO: 1539307 - DNA, 18 bp, Homo sapiens
cacctcttatgcacacct

SEQ ID NO: 1539308 - DNA, 22 bp, Homo sapiens
cacctctttaaaaactcactta

SEQ ID NO: 1539309 - DNA, 19 bp, Homo sapiens
cacctgaaccccatgggct

SEQ ID NO: 1539310 - DNA, 22 bp, Homo sapiens
cacctgaaccccatgggcttgg

SEQ ID NO: 1539311 - DNA, 20 bp, Homo sapiens
cacctgacaatggcagctag

SEQ ID NO: 1539312 - DNA, 21 bp, Homo sapiens
cacctgacaatggcagctaga

SEQ ID NO: 1539313 - DNA, 17 bp, Homo sapiens
cacctgacgtcagtagt

SEQ ID NO: 1539314 - DNA, 11 bp, Homo sapiens
cacctgagacc

SEQ ID NO: 1539315 - DNA, 16 bp, Homo sapiens
cacctgagcgctgtgg

SEQ ID NO: 1539316 - DNA, 11 bp, Homo sapiens
cacctgaggaa

SEQ ID NO: 1539317 - DNA, 12 bp, Homo sapiens
cacctgaggtca

SEQ ID NO: 1539318 - DNA, 20 bp, Homo sapiens
cacctgaggtgggcccagga

SEQ ID NO: 1539319 - DNA, 21 bp, Homo sapiens
cacctgaggtgggcccaggac

SEQ ID NO: 1539320 - DNA, 24 bp, Homo sapiens
cacctgaggtgggcccaggaccag

SEQ ID NO: 1539321 - DNA, 17 bp, Homo sapiens
cacctgatattcaggct

SEQ ID NO: 1539322 - DNA, 17 bp, Homo sapiens
cacctgattttgaaggt

SEQ ID NO: 1539323 - DNA, 14 bp, Homo sapiens
cacctgcaagcccc

SEQ ID NO: 1539324 - DNA, 20 bp, Homo sapiens
cacctgcaagccccagggcc

SEQ ID NO: 1539325 - DNA, 23 bp, Homo sapiens
cacctgcaagccccagggcctgg

SEQ ID NO: 1539326 - DNA, 14 bp, Homo sapiens
cacctgcacctccc

SEQ ID NO: 1539327 - DNA, 17 bp, Homo sapiens
cacctgcacctcccccc

SEQ ID NO: 1539328 - DNA, 22 bp, Homo sapiens
cacctgcacctccccccactgc

SEQ ID NO: 1539329 - DNA, 16 bp, Homo sapiens
cacctgcactaacaga

SEQ ID NO: 1539330 - DNA, 23 bp, Homo sapiens
cacctgcacttaaggcactctgt

SEQ ID NO: 1539331 - DNA, 12 bp, Homo sapiens
cacctgcagtgc

SEQ ID NO: 1539332 - DNA, 22 bp, Homo sapiens
cacctgccacccccttccctgg

SEQ ID NO: 1539333 - DNA, 14 bp, Homo sapiens
cacctgccagcctg

SEQ ID NO: 1539334 - DNA, 15 bp, Homo sapiens
cacctgccagcctgg

SEQ ID NO: 1539335 - DNA, 16 bp, Homo sapiens
cacctgccagcctggc

SEQ ID NO: 1539336 - DNA, 18 bp, Homo sapiens
cacctgcccatcacaggg

SEQ ID NO: 1539337 - DNA, 20 bp, Homo sapiens
cacctgccgcatgctccctc

SEQ ID NO: 1539338 - DNA, 15 bp, Homo sapiens
cacctgcctccacca

SEQ ID NO: 1539339 - DNA, 14 bp, Homo sapiens
ggcccaggagctct

SEQ ID NO: 1539340 - DNA, 23 bp, Homo sapiens
ggcccaggagctctgcgccaggc

SEQ ID NO: 1539341 - DNA, 12 bp, Homo sapiens
ggcccaggcacc

SEQ ID NO: 1539342 - DNA, 15 bp, Homo sapiens
ggcccaggcaccacc

SEQ ID NO: 1539343 - DNA, 12 bp, Homo sapiens
ggcccaggcagg

SEQ ID NO: 1539344 - DNA, 16 bp, Homo sapiens
ggcccaggcaggtctg

SEQ ID NO: 1539345 - DNA, 18 bp, Homo sapiens
ggcccaggcaggtctgca

SEQ ID NO: 1539346 - DNA, 21 bp, Homo sapiens
ggcccaggcaggtctgcaagg

SEQ ID NO: 1539347 - DNA, 15 bp, Homo sapiens
ggcccagggcccaga

SEQ ID NO: 1539348 - DNA, 17 bp, Homo sapiens
ggcccagggcccagagc

SEQ ID NO: 1539349 - DNA, 19 bp, Homo sapiens
ggcccagggcccagagccc

SEQ ID NO: 1539350 - DNA, 15 bp, Homo sapiens
ggcccagggggcctg

SEQ ID NO: 1539351 - DNA, 16 bp, Homo sapiens
ggcccagggggcctgg

SEQ ID NO: 1539352 - DNA, 15 bp, Homo sapiens
ggcccagtgcatggt

SEQ ID NO: 1539353 - DNA, 22 bp, Homo sapiens
ggcccagtgcatggtggccaga

SEQ ID NO: 1539354 - DNA, 16 bp, Homo sapiens
ggcccagtgccactgc

SEQ ID NO: 1539355 - DNA, 23 bp, Homo sapiens
ggcccataatagttagccctcag

SEQ ID NO: 1539356 - DNA, 19 bp, Homo sapiens
ggcccatagaaacatgaca

SEQ ID NO: 1539357 - DNA, 17 bp, Homo sapiens
ggcccattgtcctcctt

SEQ ID NO: 1539358 - DNA, 14 bp, Homo sapiens
ggccccaccaccta

SEQ ID NO: 1539359 - DNA, 15 bp, Homo sapiens
ggccccaccacctag

SEQ ID NO: 1539360 - DNA, 23 bp, Homo sapiens
ggccccaccctgggccctgggct

SEQ ID NO: 1539361 - DNA, 19 bp, Homo sapiens
ggccccactttgaagggca

SEQ ID NO: 1539362 - DNA, 13 bp, Homo sapiens
ggccccagagaga

SEQ ID NO: 1539363 - DNA, 12 bp, Homo sapiens
ggccccagaggc

SEQ ID NO: 1539364 - DNA, 17 bp, Homo sapiens
ggccccagaggccctgg

SEQ ID NO: 1539365 - DNA, 21 bp, Homo sapiens
ggccccagaggccctggaggt

SEQ ID NO: 1539366 - DNA, 19 bp, Homo sapiens
ggccccagatctgcctggg

SEQ ID NO: 1539367 - DNA, 18 bp, Homo sapiens
ggccccagcacagcttga

SEQ ID NO: 1539368 - DNA, 17 bp, Homo sapiens
ggccccagcacctcagc

SEQ ID NO: 1539369 - DNA, 13 bp, Homo sapiens
ggccccagcacta

SEQ ID NO: 1539370 - DNA, 12 bp, Homo sapiens
ggccccagccag

SEQ ID NO: 1539371 - DNA, 15 bp, Homo sapiens
ggccccagccctgct

SEQ ID NO: 1539372 - DNA, 18 bp, Homo sapiens
ggccccagccctgctggg

SEQ ID NO: 1539373 - DNA, 22 bp, Homo sapiens
ggccccagccctgctggggatc

SEQ ID NO: 1539374 - DNA, 17 bp, Homo sapiens
ggcagggtccacgcctc

SEQ ID NO: 1539375 - DNA, 16 bp, Homo sapiens
ggcagggtgagaagct

SEQ ID NO: 1539376 - DNA, 23 bp, Homo sapiens
ggcagggtgggatggaggagaag

SEQ ID NO: 1539377 - DNA, 15 bp, Homo sapiens
ggcaggtactgtctg

SEQ ID NO: 1539378 - DNA, 16 bp, Homo sapiens
ggcaggtcactgtcac

SEQ ID NO: 1539379 - DNA, 21 bp, Homo sapiens
ggcaggtctagtgttcctgca

SEQ ID NO: 1539380 - DNA, 22 bp, Homo sapiens
ggcaggtctgcaagggcccaga

SEQ ID NO: 1539381 - DNA, 12 bp, Homo sapiens
ggcaggtgcaga

SEQ ID NO: 1539382 - DNA, 19 bp, Homo sapiens
ggcaggtgcagatgggctg

SEQ ID NO: 1539383 - DNA, 22 bp, Homo sapiens
ggcaggtgccatgtctgggaac

SEQ ID NO: 1539384 - DNA, 15 bp, Homo sapiens
ggcaggtgcctccag

SEQ ID NO: 1539385 - DNA, 20 bp, Homo sapiens
ggcaggtggatcacgaggtc

SEQ ID NO: 1539386 - DNA, 23 bp, Homo sapiens
ggcaggtggccgcccctgaggct

SEQ ID NO: 1539387 - DNA, 16 bp, Homo sapiens
ggcaggtgggagctga

SEQ ID NO: 1539388 - DNA, 22 bp, Homo sapiens
ggcaggtggtggcactgagccc

SEQ ID NO: 1539389 - DNA, 15 bp, Homo sapiens
ggcaggtgtcatatg

SEQ ID NO: 1539390 - DNA, 16 bp, Homo sapiens
ggcaggtttgccagtg

SEQ ID NO: 1539391 - DNA, 16 bp, Homo sapiens
ggcagtccgtgggacg

SEQ ID NO: 1539392 - DNA, 15 bp, Homo sapiens
ggcagtcgggggctg

SEQ ID NO: 1539393 - DNA, 22 bp, Homo sapiens
ggcagtcgggggctggcctagg

SEQ ID NO: 1539394 - DNA, 21 bp, Homo sapiens
ggcagtctgaacccttgtgct

SEQ ID NO: 1539395 - DNA, 13 bp, Homo sapiens
ggcagtgactggc

SEQ ID NO: 1539396 - DNA, 21 bp, Homo sapiens
ggcagtgactggcaggtgcag

SEQ ID NO: 1539397 - DNA, 20 bp, Homo sapiens
ggcagtgatgacttgctgtc

SEQ ID NO: 1539398 - DNA, 15 bp, Homo sapiens
ggcagtgccacccgc

SEQ ID NO: 1539399 - DNA, 13 bp, Homo sapiens
ggcagtgccatgg

SEQ ID NO: 1539400 - DNA, 19 bp, Homo sapiens
ggcagtggaggctgctgtg

SEQ ID NO: 1539401 - DNA, 12 bp, Homo sapiens
ggcagtggaggt

SEQ ID NO: 1539402 - DNA, 16 bp, Homo sapiens
ggcagtggccaggcag

SEQ ID NO: 1539403 - DNA, 13 bp, Homo sapiens
ggcagtgtggcct

SEQ ID NO: 1539404 - DNA, 14 bp, Homo sapiens
ggcagtgtggcctc

SEQ ID NO: 1539405 - DNA, 15 bp, Homo sapiens
ggcagtgtggcctct

SEQ ID NO: 1539406 - DNA, 15 bp, Homo sapiens
ggcagttaggtgctg

SEQ ID NO: 1539407 - DNA, 12 bp, Homo sapiens
ggcagttctaga

SEQ ID NO: 1539408 - DNA, 14 bp, Homo sapiens
ggcagttctagaag

SEQ ID NO: 1539409 - DNA, 10 bp, Homo sapiens
ggcagttttt

SEQ ID NO: 1539410 - DNA, 16 bp, Homo sapiens
ggcatagaggcttctc

SEQ ID NO: 1539411 - DNA, 16 bp, Homo sapiens
ggcataggcctgggtg

SEQ ID NO: 1539412 - DNA, 17 bp, Homo sapiens
ggcatatttttcacata

SEQ ID NO: 1539413 - DNA, 20 bp, Homo sapiens
ggcatcaagggagacaccag

SEQ ID NO: 1539414 - DNA, 21 bp, Homo sapiens
ggcatcacacttatattttat

SEQ ID NO: 1539415 - DNA, 22 bp, Homo sapiens
ggcatcacagggcagagccggg

SEQ ID NO: 1539416 - DNA, 18 bp, Homo sapiens
ggcatcaggcactggtgg

SEQ ID NO: 1539417 - DNA, 18 bp, Homo sapiens
ggcatcagtccctatgta

SEQ ID NO: 1539418 - DNA, 18 bp, Homo sapiens
ggcatccacccagtgctg

SEQ ID NO: 1539419 - DNA, 19 bp, Homo sapiens
ggcatccacccagtgctgc

SEQ ID NO: 1539420 - DNA, 15 bp, Homo sapiens
ggcatccaggccagg

SEQ ID NO: 1539421 - DNA, 17 bp, Homo sapiens
ggcatccaggccagggc

SEQ ID NO: 1539422 - DNA, 15 bp, Homo sapiens
ggcatccctgcagag

SEQ ID NO: 1539423 - DNA, 20 bp, Homo sapiens
ggcatcgaccacaccagcct

SEQ ID NO: 1539424 - DNA, 16 bp, Homo sapiens
ggcatctacacagcct

SEQ ID NO: 1539425 - DNA, 15 bp, Homo sapiens
ggcatctatctgtgc

SEQ ID NO: 1539426 - DNA, 21 bp, Homo sapiens
ggcatctcccctagctcacca

SEQ ID NO: 1539427 - DNA, 14 bp, Homo sapiens
ggcatctcctgtcc

SEQ ID NO: 1539428 - DNA, 21 bp, Homo sapiens
ggcatctcctgtgcatgggtg

SEQ ID NO: 1539429 - DNA, 15 bp, Homo sapiens
ggcatctgacacaaa

SEQ ID NO: 1539430 - DNA, 16 bp, Homo sapiens
ggcatctgacacaaaa

SEQ ID NO: 1539431 - DNA, 17 bp, Homo sapiens
ggcatctgacacaaaaa

SEQ ID NO: 1539432 - DNA, 22 bp, Homo sapiens
ggcatctgcaccctcgatgaag

SEQ ID NO: 1539433 - DNA, 14 bp, Homo sapiens
ggcatctgcccctc

SEQ ID NO: 1539434 - DNA, 18 bp, Homo sapiens
ggcatctgcccctccccc

SEQ ID NO: 1539435 - DNA, 16 bp, Homo sapiens
ggcatctttgccttgg

SEQ ID NO: 1539436 - DNA, 19 bp, Homo sapiens
ggcatctttgccttgggct

SEQ ID NO: 1539437 - DNA, 21 bp, Homo sapiens
ggcatcttttctagagacaca

SEQ ID NO: 1539438 - DNA, 11 bp, Homo sapiens
ggcatcttttg

SEQ ID NO: 1539439 - DNA, 14 bp, Homo sapiens
ggcatgagggatca

SEQ ID NO: 1539440 - DNA, 19 bp, Homo sapiens
caccaaaactatcctgatt

SEQ ID NO: 1539441 - DNA, 15 bp, Homo sapiens
caccaaactgccaaa

SEQ ID NO: 1539442 - DNA, 13 bp, Homo sapiens
caccaaactgcct

SEQ ID NO: 1539443 - DNA, 14 bp, Homo sapiens
caccaaagctgccc

SEQ ID NO: 1539444 - DNA, 22 bp, Homo sapiens
caccaaagttctaataatttct

SEQ ID NO: 1539445 - DNA, 15 bp, Homo sapiens
caccaacagtgtgaa

SEQ ID NO: 1539446 - DNA, 17 bp, Homo sapiens
caccaacatcccattgc

SEQ ID NO: 1539447 - DNA, 13 bp, Homo sapiens
caccaaccaggcc

SEQ ID NO: 1539448 - DNA, 19 bp, Homo sapiens
caccaacccatcagaagga

SEQ ID NO: 1539449 - DNA, 15 bp, Homo sapiens
caccaactctgcact

SEQ ID NO: 1539450 - DNA, 20 bp, Homo sapiens
caccaactctgcactccatg

SEQ ID NO: 1539451 - DNA, 22 bp, Homo sapiens
caccaactctgcactccatggc

SEQ ID NO: 1539452 - DNA, 15 bp, Homo sapiens
caccaagaaagcagg

SEQ ID NO: 1539453 - DNA, 19 bp, Homo sapiens
caccaagagcagctgggaa

SEQ ID NO: 1539454 - DNA, 16 bp, Homo sapiens
caccaagcaagtccct

SEQ ID NO: 1539455 - DNA, 12 bp, Homo sapiens
caccaaggaaac

SEQ ID NO: 1539456 - DNA, 16 bp, Homo sapiens
caccaagggacaggag

SEQ ID NO: 1539457 - DNA, 18 bp, Homo sapiens
caccaagggacaggagaa

SEQ ID NO: 1539458 - DNA, 20 bp, Homo sapiens
caccaagggacaggagaaga

SEQ ID NO: 1539459 - DNA, 15 bp, Homo sapiens
caccaagtgcaatag

SEQ ID NO: 1539460 - DNA, 13 bp, Homo sapiens
caccaagtggctg

SEQ ID NO: 1539461 - DNA, 21 bp, Homo sapiens
caccaataatggggcagacac

SEQ ID NO: 1539462 - DNA, 23 bp, Homo sapiens
caccaatattaacacgctgcctg

SEQ ID NO: 1539463 - DNA, 16 bp, Homo sapiens
caccaatgaaaacatg

SEQ ID NO: 1539464 - DNA, 21 bp, Homo sapiens
caccaatgaaaacatgtacta

SEQ ID NO: 1539465 - DNA, 13 bp, Homo sapiens
caccacagacaca

SEQ ID NO: 1539466 - DNA, 20 bp, Homo sapiens
caccacagacacacacacgc

SEQ ID NO: 1539467 - DNA, 19 bp, Homo sapiens
caccacagccagcacctgg

SEQ ID NO: 1539468 - DNA, 18 bp, Homo sapiens
caccaccacactacacag

SEQ ID NO: 1539469 - DNA, 15 bp, Homo sapiens
caccaccactggcca

SEQ ID NO: 1539470 - DNA, 15 bp, Homo sapiens
caccaccaggagcag

SEQ ID NO: 1539471 - DNA, 20 bp, Homo sapiens
caccaccaggagcagcagcc

SEQ ID NO: 1539472 - DNA, 16 bp, Homo sapiens
caccaccccaacaaac

SEQ ID NO: 1539473 - DNA, 16 bp, Homo sapiens
caccaccccctgtccc

SEQ ID NO: 1539474 - DNA, 17 bp, Homo sapiens
caccaccccctgtccca

SEQ ID NO: 1539475 - DNA, 15 bp, Homo sapiens
caccaccgcctctgg

SEQ ID NO: 1539476 - DNA, 18 bp, Homo sapiens
caccacctcactcctgtt

SEQ ID NO: 1539477 - DNA, 16 bp, Homo sapiens
caccacctctgtgggc

SEQ ID NO: 1539478 - DNA, 14 bp, Homo sapiens
caccaccttcccag

SEQ ID NO: 1539479 - DNA, 16 bp, Homo sapiens
caccaccttcccagct

SEQ ID NO: 1539480 - DNA, 18 bp, Homo sapiens
caccaccttcccagctct

SEQ ID NO: 1539481 - DNA, 22 bp, Homo sapiens
caccaccttcccagctctccct

SEQ ID NO: 1539482 - DNA, 16 bp, Homo sapiens
caccacgtctgccagg

SEQ ID NO: 1539483 - DNA, 19 bp, Homo sapiens
caccacgtctgccaggccc

SEQ ID NO: 1539484 - DNA, 20 bp, Homo sapiens
caccacgtctgccaggccca

SEQ ID NO: 1539485 - DNA, 20 bp, Homo sapiens
caccacgtctggctccctgc

SEQ ID NO: 1539486 - DNA, 21 bp, Homo sapiens
caccacgtctggctccctgcc

SEQ ID NO: 1539487 - DNA, 17 bp, Homo sapiens
caccactaaccatcccc

SEQ ID NO: 1539488 - DNA, 19 bp, Homo sapiens
caccactaaccatccccaa

SEQ ID NO: 1539489 - DNA, 22 bp, Homo sapiens
caccactaaccatccccaactc

SEQ ID NO: 1539490 - DNA, 17 bp, Homo sapiens
caccactgcactccagc

SEQ ID NO: 1539491 - DNA, 23 bp, Homo sapiens
caccactgccccctgctgccatg

SEQ ID NO: 1539492 - DNA, 14 bp, Homo sapiens
caccactgccctgc

SEQ ID NO: 1539493 - DNA, 17 bp, Homo sapiens
caccactgccctgcctg

SEQ ID NO: 1539494 - DNA, 19 bp, Homo sapiens
caccactgccctgcctgcc

SEQ ID NO: 1539495 - DNA, 22 bp, Homo sapiens
caccactgccctgcctgcccac

SEQ ID NO: 1539496 - DNA, 14 bp, Homo sapiens
caccactgcttccc

SEQ ID NO: 1539497 - DNA, 20 bp, Homo sapiens
caccactgcttcccactggg

SEQ ID NO: 1539498 - DNA, 14 bp, Homo sapiens
caccactggccacc

SEQ ID NO: 1539499 - DNA, 15 bp, Homo sapiens
caccactggccacca

SEQ ID NO: 1539500 - DNA, 19 bp, Homo sapiens
caccagacacccaggactt

SEQ ID NO: 1539501 - DNA, 19 bp, Homo sapiens
caccagagcccatgctcaa

SEQ ID NO: 1539502 - DNA, 13 bp, Homo sapiens
caccagaggccga

SEQ ID NO: 1539503 - DNA, 20 bp, Homo sapiens
caccagcaaggggaccccga

SEQ ID NO: 1539504 - DNA, 11 bp, Homo sapiens
caccagcagca

SEQ ID NO: 1539505 - DNA, 15 bp, Homo sapiens
caccagcagcactgg

SEQ ID NO: 1539506 - DNA, 14 bp, Homo sapiens
caccagcaggcagg

SEQ ID NO: 1539507 - DNA, 12 bp, Homo sapiens
caccagccagcg

SEQ ID NO: 1539508 - DNA, 20 bp, Homo sapiens
caccagccccactgccagca

SEQ ID NO: 1539509 - DNA, 16 bp, Homo sapiens
caccagccccctggat

SEQ ID NO: 1539510 - DNA, 22 bp, Homo sapiens
caccagccccctggatgggcat

SEQ ID NO: 1539511 - DNA, 17 bp, Homo sapiens
caccagcccggcctgct

SEQ ID NO: 1539512 - DNA, 18 bp, Homo sapiens
caccagccctagctgtcc

SEQ ID NO: 1539513 - DNA, 15 bp, Homo sapiens
caccagcctcctggg

SEQ ID NO: 1539514 - DNA, 14 bp, Homo sapiens
caccagcctgcact

SEQ ID NO: 1539515 - DNA, 22 bp, Homo sapiens
caccagcctgctgacagacact

SEQ ID NO: 1539516 - DNA, 21 bp, Homo sapiens
caccagcctggtgcccatcct

SEQ ID NO: 1539517 - DNA, 15 bp, Homo sapiens
caccagctctgtggc

SEQ ID NO: 1539518 - DNA, 16 bp, Homo sapiens
caccagctctgtggcc

SEQ ID NO: 1539519 - DNA, 18 bp, Homo sapiens
caccagctctgtggcctg

SEQ ID NO: 1539520 - DNA, 19 bp, Homo sapiens
caccagctctgtggcctgt

SEQ ID NO: 1539521 - DNA, 21 bp, Homo sapiens
caccagctctgtggcctgtgt

SEQ ID NO: 1539522 - DNA, 13 bp, Homo sapiens
caccagctgctct

SEQ ID NO: 1539523 - DNA, 15 bp, Homo sapiens
caccagctgctctgc

SEQ ID NO: 1539524 - DNA, 17 bp, Homo sapiens
caccagctgctctgccc

SEQ ID NO: 1539525 - DNA, 12 bp, Homo sapiens
caccaggaatgt

SEQ ID NO: 1539526 - DNA, 23 bp, Homo sapiens
caccaggaatgttaaagtcagtg

SEQ ID NO: 1539527 - DNA, 16 bp, Homo sapiens
caccaggactagggct

SEQ ID NO: 1539528 - DNA, 14 bp, Homo sapiens
caccaggactgaaa

SEQ ID NO: 1539529 - DNA, 19 bp, Homo sapiens
caccaggagaaccactaca

SEQ ID NO: 1539530 - DNA, 12 bp, Homo sapiens
caccaggagcag

SEQ ID NO: 1539531 - DNA, 17 bp, Homo sapiens
caccaggagcagcagcc

SEQ ID NO: 1539532 - DNA, 19 bp, Homo sapiens
caccaggcacgaacccacc

SEQ ID NO: 1539533 - DNA, 21 bp, Homo sapiens
caccaggcacgaacccacctg

SEQ ID NO: 1539534 - DNA, 13 bp, Homo sapiens
caccaggccacct

SEQ ID NO: 1539535 - DNA, 14 bp, Homo sapiens
caccaggccgggct

SEQ ID NO: 1539536 - DNA, 21 bp, Homo sapiens
caccaggccgtcctcccgggc

SEQ ID NO: 1539537 - DNA, 12 bp, Homo sapiens
caccaggcctgg

SEQ ID NO: 1539538 - DNA, 13 bp, Homo sapiens
caccaggcctggc

SEQ ID NO: 1539539 - DNA, 14 bp, Homo sapiens
caccaggcctggcc

SEQ ID NO: 1539540 - DNA, 16 bp, Homo sapiens
caccaggcctggcctc

SEQ ID NO: 1539541 - DNA, 19 bp, Homo sapiens
caccaggcctggcctctgg

SEQ ID NO: 1539542 - DNA, 22 bp, Homo sapiens
caccaggcctggcctctgggca

SEQ ID NO: 1539543 - DNA, 14 bp, Homo sapiens
caccaggctgctca

SEQ ID NO: 1539544 - DNA, 13 bp, Homo sapiens
caccaggctggcg

SEQ ID NO: 1539545 - DNA, 15 bp, Homo sapiens
caccaggctggcgca

SEQ ID NO: 1539546 - DNA, 22 bp, Homo sapiens
caccaggctggcgcagccaagg

SEQ ID NO: 1539547 - DNA, 14 bp, Homo sapiens
caccaggggaagga

SEQ ID NO: 1539548 - DNA, 19 bp, Homo sapiens
caccaggggtgctcacctc

SEQ ID NO: 1539549 - DNA, 22 bp, Homo sapiens
caccaggggtgctcacctctgc

SEQ ID NO: 1539550 - DNA, 15 bp, Homo sapiens
caccaggggtttctc

SEQ ID NO: 1539551 - DNA, 24 bp, Homo sapiens
caccagggtccgcaccagctgctc

SEQ ID NO: 1539552 - DNA, 18 bp, Homo sapiens
caccagtcacctcgtctc

SEQ ID NO: 1539553 - DNA, 16 bp, Homo sapiens
caccagtctgtctact

SEQ ID NO: 1539554 - DNA, 12 bp, Homo sapiens
caccagtgcctt

SEQ ID NO: 1539555 - DNA, 17 bp, Homo sapiens
caccagtgtcctcccct

SEQ ID NO: 1539556 - DNA, 18 bp, Homo sapiens
caccagtgtcctcccctc

SEQ ID NO: 1539557 - DNA, 18 bp, Homo sapiens
ggcatgcacacggctggt

SEQ ID NO: 1539558 - DNA, 21 bp, Homo sapiens
ggcatgcacacggctggtcac

SEQ ID NO: 1539559 - DNA, 15 bp, Homo sapiens
ggcatgcacagctgt

SEQ ID NO: 1539560 - DNA, 21 bp, Homo sapiens
ggcatgcacgggcatgcacac

SEQ ID NO: 1539561 - DNA, 12 bp, Homo sapiens
ggcatgccagga

SEQ ID NO: 1539562 - DNA, 14 bp, Homo sapiens
ggcatgccaggacc

SEQ ID NO: 1539563 - DNA, 15 bp, Homo sapiens
ggcatgccaggaccc

SEQ ID NO: 1539564 - DNA, 23 bp, Homo sapiens
ggcatgccaggacccgccagccc

SEQ ID NO: 1539565 - DNA, 16 bp, Homo sapiens
ggcatgcggtcgggca

SEQ ID NO: 1539566 - DNA, 19 bp, Homo sapiens
ggcatggaaggggcttctg

SEQ ID NO: 1539567 - DNA, 18 bp, Homo sapiens
ggcatggccaggtggcca

SEQ ID NO: 1539568 - DNA, 16 bp, Homo sapiens
ggcatggccctgggcg

SEQ ID NO: 1539569 - DNA, 17 bp, Homo sapiens
ggcatggcgaggctgag

SEQ ID NO: 1539570 - DNA, 21 bp, Homo sapiens
ggcatggctttatttgttttt

SEQ ID NO: 1539571 - DNA, 16 bp, Homo sapiens
ggcatggggcatgtcc

SEQ ID NO: 1539572 - DNA, 18 bp, Homo sapiens
ggcatggggcatgtcctt

SEQ ID NO: 1539573 - DNA, 17 bp, Homo sapiens
ggcatgggtccagggcc

SEQ ID NO: 1539574 - DNA, 24 bp, Homo sapiens
ggcatgggtccagggcctgacacc

SEQ ID NO: 1539575 - DNA, 19 bp, Homo sapiens
ggcatggtacggagatgtt

SEQ ID NO: 1539576 - DNA, 19 bp, Homo sapiens
ggcatggtggcgcaagcct

SEQ ID NO: 1539577 - DNA, 20 bp, Homo sapiens
ggcatggttccttccctggg

SEQ ID NO: 1539578 - DNA, 21 bp, Homo sapiens
ggcatggttccttccctggga

SEQ ID NO: 1539579 - DNA, 20 bp, Homo sapiens
ggcatgtcctttccatctgt

SEQ ID NO: 1539580 - DNA, 18 bp, Homo sapiens
ggcatgtctcctcaaccc

SEQ ID NO: 1539581 - DNA, 13 bp, Homo sapiens
ggcatgtggcctg

SEQ ID NO: 1539582 - DNA, 21 bp, Homo sapiens
ggcatgtggcctttatctcaa

SEQ ID NO: 1539583 - DNA, 16 bp, Homo sapiens
ggcattaacacaaagg

SEQ ID NO: 1539584 - DNA, 16 bp, Homo sapiens
ggcattaatgtttcta

SEQ ID NO: 1539585 - DNA, 19 bp, Homo sapiens
ggcattagaattatttaaa

SEQ ID NO: 1539586 - DNA, 20 bp, Homo sapiens
ggcattatgtccactgtgta

SEQ ID NO: 1539587 - DNA, 13 bp, Homo sapiens
ggcattcctgctt

SEQ ID NO: 1539588 - DNA, 13 bp, Homo sapiens
ggcattgctcagc

SEQ ID NO: 1539589 - DNA, 14 bp, Homo sapiens
ggcattgctcagcc

SEQ ID NO: 1539590 - DNA, 12 bp, Homo sapiens
ggcattgctttc

SEQ ID NO: 1539591 - DNA, 13 bp, Homo sapiens
ggcattgggctga

SEQ ID NO: 1539592 - DNA, 14 bp, Homo sapiens
ggcattgggctgac

SEQ ID NO: 1539593 - DNA, 15 bp, Homo sapiens
ggcattgggctgaca

SEQ ID NO: 1539594 - DNA, 20 bp, Homo sapiens
ggcatttgcagggtcctctt

SEQ ID NO: 1539595 - DNA, 21 bp, Homo sapiens
ggcattttaatctaagtggtt

SEQ ID NO: 1539596 - DNA, 23 bp, Homo sapiens
ggccaaacatcagacctgtcttc

SEQ ID NO: 1539597 - DNA, 19 bp, Homo sapiens
ggccaaacccttgctttcc

SEQ ID NO: 1539598 - DNA, 20 bp, Homo sapiens
ggccaaacccttgctttcct

SEQ ID NO: 1539599 - DNA, 21 bp, Homo sapiens
ggccaaacccttgctttcctg

SEQ ID NO: 1539600 - DNA, 16 bp, Homo sapiens
ggccaaagagtctcca

SEQ ID NO: 1539601 - DNA, 14 bp, Homo sapiens
ggccaaagataaaa

SEQ ID NO: 1539602 - DNA, 15 bp, Homo sapiens
ggccaaagcacagct

SEQ ID NO: 1539603 - DNA, 17 bp, Homo sapiens
ggccaaagcacagctgg

SEQ ID NO: 1539604 - DNA, 19 bp, Homo sapiens
ggccaaagcacagctgggc

SEQ ID NO: 1539605 - DNA, 16 bp, Homo sapiens
ggccaaaggctggtgg

SEQ ID NO: 1539606 - DNA, 13 bp, Homo sapiens
ggccaaagtgtta

SEQ ID NO: 1539607 - DNA, 14 bp, Homo sapiens
ggccaacaaagaac

SEQ ID NO: 1539608 - DNA, 13 bp, Homo sapiens
ggccaacatggtg

SEQ ID NO: 1539609 - DNA, 18 bp, Homo sapiens
ggccaacgtggacctgcc

SEQ ID NO: 1539610 - DNA, 19 bp, Homo sapiens
ggccaacgtggacctgcct

SEQ ID NO: 1539611 - DNA, 15 bp, Homo sapiens
ggccaagaagcagtg

SEQ ID NO: 1539612 - DNA, 13 bp, Homo sapiens
ggccaagacggga

SEQ ID NO: 1539613 - DNA, 13 bp, Homo sapiens
ggccaagaggctg

SEQ ID NO: 1539614 - DNA, 17 bp, Homo sapiens
ggccaagcagtgcctgc

SEQ ID NO: 1539615 - DNA, 23 bp, Homo sapiens
ggccaaggggtgggcctgtgaat

SEQ ID NO: 1539616 - DNA, 12 bp, Homo sapiens
ggccaaggtgcc

SEQ ID NO: 1539617 - DNA, 18 bp, Homo sapiens
ggccaagtctaatgaaga

SEQ ID NO: 1539618 - DNA, 23 bp, Homo sapiens
ggccacaaatcaaagcaagggct

SEQ ID NO: 1539619 - DNA, 21 bp, Homo sapiens
ggccacactattaccatgaga

SEQ ID NO: 1539620 - DNA, 16 bp, Homo sapiens
ggccacagcaggactg

SEQ ID NO: 1539621 - DNA, 15 bp, Homo sapiens
ggccacagccccctt

SEQ ID NO: 1539622 - DNA, 13 bp, Homo sapiens
ggccacagggcgg

SEQ ID NO: 1539623 - DNA, 12 bp, Homo sapiens
ggccacatggcg

SEQ ID NO: 1539624 - DNA, 16 bp, Homo sapiens
ggccacatggcggaga

SEQ ID NO: 1539625 - DNA, 16 bp, Homo sapiens
ggccacattgctggct

SEQ ID NO: 1539626 - DNA, 18 bp, Homo sapiens
ggccacattgctggctgc

SEQ ID NO: 1539627 - DNA, 19 bp, Homo sapiens
ggccacattgctggctgcc

SEQ ID NO: 1539628 - DNA, 15 bp, Homo sapiens
ggccaccaaagctgc

SEQ ID NO: 1539629 - DNA, 20 bp, Homo sapiens
ggccaccacctttggctggt

SEQ ID NO: 1539630 - DNA, 15 bp, Homo sapiens
ggccaccaggctggc

SEQ ID NO: 1539631 - DNA, 16 bp, Homo sapiens
ggccaccaggctggcg

SEQ ID NO: 1539632 - DNA, 21 bp, Homo sapiens
ggccaccaggctggcgcagcc

SEQ ID NO: 1539633 - DNA, 14 bp, Homo sapiens
ggccaccatggtca

SEQ ID NO: 1539634 - DNA, 15 bp, Homo sapiens
ggccaccatgtctgg

SEQ ID NO: 1539635 - DNA, 19 bp, Homo sapiens
ggccacccaaatgtgtaca

SEQ ID NO: 1539636 - DNA, 19 bp, Homo sapiens
ggccacccccatggaagca

SEQ ID NO: 1539637 - DNA, 21 bp, Homo sapiens
ggccacccgttctgctggcct

SEQ ID NO: 1539638 - DNA, 23 bp, Homo sapiens
ggccacccgttctgctggcctgg

SEQ ID NO: 1539639 - DNA, 12 bp, Homo sapiens
ggccaccctcct

SEQ ID NO: 1539640 - DNA, 15 bp, Homo sapiens
ggccaccctggcccg

SEQ ID NO: 1539641 - DNA, 24 bp, Homo sapiens
ggccaccgcaggggactgtctcag

SEQ ID NO: 1539642 - DNA, 13 bp, Homo sapiens
ggccacctcctcc

SEQ ID NO: 1539643 - DNA, 14 bp, Homo sapiens
ggccacctcctccc

SEQ ID NO: 1539644 - DNA, 15 bp, Homo sapiens
ggccacctctccaag

SEQ ID NO: 1539645 - DNA, 17 bp, Homo sapiens
ggccacctctgcctcta

SEQ ID NO: 1539646 - DNA, 22 bp, Homo sapiens
ggccacctgaggtgggcccagg

SEQ ID NO: 1539647 - DNA, 18 bp, Homo sapiens
ggccacgcactgggccac

SEQ ID NO: 1539648 - DNA, 14 bp, Homo sapiens
ggccacgctccctc

SEQ ID NO: 1539649 - DNA, 13 bp, Homo sapiens
ggccacggaggag

SEQ ID NO: 1539650 - DNA, 23 bp, Homo sapiens
ggccacggaggagggatgctgct

SEQ ID NO: 1539651 - DNA, 18 bp, Homo sapiens
ggccacgggggcagtgtg

SEQ ID NO: 1539652 - DNA, 11 bp, Homo sapiens
ggccacgtgcc

SEQ ID NO: 1539653 - DNA, 23 bp, Homo sapiens
ggccactcccggcactccatgct

SEQ ID NO: 1539654 - DNA, 13 bp, Homo sapiens
ggccactccgaga

SEQ ID NO: 1539655 - DNA, 15 bp, Homo sapiens
ggccactctgcctct

SEQ ID NO: 1539656 - DNA, 16 bp, Homo sapiens
ggccactctgcctctg

SEQ ID NO: 1539657 - DNA, 22 bp, Homo sapiens
ggccactctgcctctgcctgca

SEQ ID NO: 1539658 - DNA, 20 bp, Homo sapiens
ggccactggggactttattt

SEQ ID NO: 1539659 - DNA, 21 bp, Homo sapiens
ggccactgtggccagagctgg

SEQ ID NO: 1539660 - DNA, 15 bp, Homo sapiens
ggccacttctgggtg

SEQ ID NO: 1539661 - DNA, 19 bp, Homo sapiens
ggccactttcagagccccc

SEQ ID NO: 1539662 - DNA, 22 bp, Homo sapiens
ggccagaaggagggcagagcca

SEQ ID NO: 1539663 - DNA, 16 bp, Homo sapiens
ggccagaagtaccaga

SEQ ID NO: 1539664 - DNA, 15 bp, Homo sapiens
ggccagacatgccac

SEQ ID NO: 1539665 - DNA, 14 bp, Homo sapiens
ggccagacatggtg

SEQ ID NO: 1539666 - DNA, 15 bp, Homo sapiens
ggccagactggaaga

SEQ ID NO: 1539667 - DNA, 17 bp, Homo sapiens
ggccagactggaagaca

SEQ ID NO: 1539668 - DNA, 12 bp, Homo sapiens
ggccagagaggg

SEQ ID NO: 1539669 - DNA, 13 bp, Homo sapiens
ggccagagagggc

SEQ ID NO: 1539670 - DNA, 18 bp, Homo sapiens
ggccagagagggcccagc

SEQ ID NO: 1539671 - DNA, 19 bp, Homo sapiens
ggccagagagggcccagct

SEQ ID NO: 1539672 - DNA, 20 bp, Homo sapiens
ggccagagagggcccagctg

SEQ ID NO: 1539673 - DNA, 21 bp, Homo sapiens
ggccagagagggcccagctgt

SEQ ID NO: 1539674 - DNA, 23 bp, Homo sapiens
ggatctgagctcccacctccctt

SEQ ID NO: 1539675 - DNA, 18 bp, Homo sapiens
ggatctgctgaggcccag

SEQ ID NO: 1539676 - DNA, 23 bp, Homo sapiens
ggatctgggaccctttccttcct

SEQ ID NO: 1539677 - DNA, 18 bp, Homo sapiens
ggatctgggctgtggggc

SEQ ID NO: 1539678 - DNA, 19 bp, Homo sapiens
ggatctggggagagcggct

SEQ ID NO: 1539679 - DNA, 15 bp, Homo sapiens
ggatctgtgattggc

SEQ ID NO: 1539680 - DNA, 22 bp, Homo sapiens
ggatcttttctaaatgttatta

SEQ ID NO: 1539681 - DNA, 18 bp, Homo sapiens
ggatgaaaaatatttctg

SEQ ID NO: 1539682 - DNA, 11 bp, Homo sapiens
ggatgaaagct

SEQ ID NO: 1539683 - DNA, 19 bp, Homo sapiens
ggatgacaggcgcctgcca

SEQ ID NO: 1539684 - DNA, 15 bp, Homo sapiens
ggatgacatgtccct

SEQ ID NO: 1539685 - DNA, 14 bp, Homo sapiens
ggatgaccatactc

SEQ ID NO: 1539686 - DNA, 14 bp, Homo sapiens
ggatgactttttta

SEQ ID NO: 1539687 - DNA, 18 bp, Homo sapiens
ggatgacttttttataca

SEQ ID NO: 1539688 - DNA, 22 bp, Homo sapiens
ggatgagatacttatgcaagat

SEQ ID NO: 1539689 - DNA, 18 bp, Homo sapiens
ggatgagcagagggagga

SEQ ID NO: 1539690 - DNA, 21 bp, Homo sapiens
ggatgaggccgctagaggcct

SEQ ID NO: 1539691 - DNA, 21 bp, Homo sapiens
ggatgattcagaaattggaac

SEQ ID NO: 1539692 - DNA, 23 bp, Homo sapiens
ggatgattgcttgagctcaggag

SEQ ID NO: 1539693 - DNA, 18 bp, Homo sapiens
ggatgatttcatcttctg

SEQ ID NO: 1539694 - DNA, 14 bp, Homo sapiens
ggatgcacatttct

SEQ ID NO: 1539695 - DNA, 17 bp, Homo sapiens
ggatgcacatttctgga

SEQ ID NO: 1539696 - DNA, 20 bp, Homo sapiens
ggatgcattcgagatggcag

SEQ ID NO: 1539697 - DNA, 16 bp, Homo sapiens
ggatgccaatttcctc

SEQ ID NO: 1539698 - DNA, 22 bp, Homo sapiens
ggatgccacgcctggaagggcc

SEQ ID NO: 1539699 - DNA, 20 bp, Homo sapiens
ggatgccactcctccctccg

SEQ ID NO: 1539700 - DNA, 17 bp, Homo sapiens
ggatgccagggccgacc

SEQ ID NO: 1539701 - DNA, 16 bp, Homo sapiens
ggatgcgcagtgcctt

SEQ ID NO: 1539702 - DNA, 18 bp, Homo sapiens
ggatgcggatcctgctgg

SEQ ID NO: 1539703 - DNA, 20 bp, Homo sapiens
ggatgcggatcctgctgggg

SEQ ID NO: 1539704 - DNA, 22 bp, Homo sapiens
ggatgctccgacagcgtctcca

SEQ ID NO: 1539705 - DNA, 12 bp, Homo sapiens
ggatgctgcagc

SEQ ID NO: 1539706 - DNA, 15 bp, Homo sapiens
ggatgctgctccgcc

SEQ ID NO: 1539707 - DNA, 13 bp, Homo sapiens
ggatgctgggctg

SEQ ID NO: 1539708 - DNA, 17 bp, Homo sapiens
ggatggaatgatgggtc

SEQ ID NO: 1539709 - DNA, 18 bp, Homo sapiens
ggatggagaaagaagtgg

SEQ ID NO: 1539710 - DNA, 17 bp, Homo sapiens
ggatggagatgggaagg

SEQ ID NO: 1539711 - DNA, 15 bp, Homo sapiens
ggatggatggcaccc

SEQ ID NO: 1539712 - DNA, 16 bp, Homo sapiens
ggatggatggcaccct

SEQ ID NO: 1539713 - DNA, 12 bp, Homo sapiens
ggatggcaagat

SEQ ID NO: 1539714 - DNA, 11 bp, Homo sapiens
ggatggcaccc

SEQ ID NO: 1539715 - DNA, 17 bp, Homo sapiens
ggatggcatttggtctc

SEQ ID NO: 1539716 - DNA, 20 bp, Homo sapiens
ggatggcatttggtctcagg

SEQ ID NO: 1539717 - DNA, 14 bp, Homo sapiens
ggatggccccagca

SEQ ID NO: 1539718 - DNA, 16 bp, Homo sapiens
ggatggccccagcaca

SEQ ID NO: 1539719 - DNA, 16 bp, Homo sapiens
ggatgggcagctgggg

SEQ ID NO: 1539720 - DNA, 17 bp, Homo sapiens
ggatgggcattgggctg

SEQ ID NO: 1539721 - DNA, 21 bp, Homo sapiens
ggatgggccctatgtctcagg

SEQ ID NO: 1539722 - DNA, 13 bp, Homo sapiens
ggatgggggagag

SEQ ID NO: 1539723 - DNA, 14 bp, Homo sapiens
ggatgggggagagg

SEQ ID NO: 1539724 - DNA, 16 bp, Homo sapiens
ggatggggttctggaa

SEQ ID NO: 1539725 - DNA, 16 bp, Homo sapiens
ggatgggtcagagcta

SEQ ID NO: 1539726 - DNA, 17 bp, Homo sapiens
ggatgggttccagaggt

SEQ ID NO: 1539727 - DNA, 14 bp, Homo sapiens
ggatggtcctgggg

SEQ ID NO: 1539728 - DNA, 17 bp, Homo sapiens
ggatggtgcatgggctc

SEQ ID NO: 1539729 - DNA, 11 bp, Homo sapiens
ggatggtttgt

SEQ ID NO: 1539730 - DNA, 16 bp, Homo sapiens
ggatgtaaacagtgcc

SEQ ID NO: 1539731 - DNA, 19 bp, Homo sapiens
ggatgtaaacagtgcctgc

SEQ ID NO: 1539732 - DNA, 23 bp, Homo sapiens
ggatgtaaatcctgagctcaaat

SEQ ID NO: 1539733 - DNA, 15 bp, Homo sapiens
ggatgtaaccaagct

SEQ ID NO: 1539734 - DNA, 12 bp, Homo sapiens
ggatgtcacagt

SEQ ID NO: 1539735 - DNA, 15 bp, Homo sapiens
ggatgtcaggcccag

SEQ ID NO: 1539736 - DNA, 16 bp, Homo sapiens
ggatgtcccctgtccc

SEQ ID NO: 1539737 - DNA, 21 bp, Homo sapiens
ggatgtcccctgtcccaccaa

SEQ ID NO: 1539738 - DNA, 23 bp, Homo sapiens
ggatgtcctctttactcccttcc

SEQ ID NO: 1539739 - DNA, 14 bp, Homo sapiens
ggatgtctgccaat

SEQ ID NO: 1539740 - DNA, 22 bp, Homo sapiens
ggatgtctttgctgcagtcttc

SEQ ID NO: 1539741 - DNA, 23 bp, Homo sapiens
ggatgtcttttttaaggctctgt

SEQ ID NO: 1539742 - DNA, 16 bp, Homo sapiens
ggatgtgggtaagagg

SEQ ID NO: 1539743 - DNA, 17 bp, Homo sapiens
ggatgtgtggggcatgg

SEQ ID NO: 1539744 - DNA, 19 bp, Homo sapiens
ggatgttatgaacagctgt

SEQ ID NO: 1539745 - DNA, 15 bp, Homo sapiens
ggatgttctggccct

SEQ ID NO: 1539746 - DNA, 15 bp, Homo sapiens
ggatgtttggaaaaa

SEQ ID NO: 1539747 - DNA, 15 bp, Homo sapiens
ggattaacctctgca

SEQ ID NO: 1539748 - DNA, 17 bp, Homo sapiens
ggattaacctctgcact

SEQ ID NO: 1539749 - DNA, 13 bp, Homo sapiens
ggattaagggcaa

SEQ ID NO: 1539750 - DNA, 22 bp, Homo sapiens
ggattattcatttaaaatgatt

SEQ ID NO: 1539751 - DNA, 21 bp, Homo sapiens
ggattcaggaatgtgtggcct

SEQ ID NO: 1539752 - DNA, 13 bp, Homo sapiens
ggattcaggcagc

SEQ ID NO: 1539753 - DNA, 15 bp, Homo sapiens
ggattcaggctgctt

SEQ ID NO: 1539754 - DNA, 22 bp, Homo sapiens
ggattcattgtctctcacagat

SEQ ID NO: 1539755 - DNA, 16 bp, Homo sapiens
ggattcatttcctgcc

SEQ ID NO: 1539756 - DNA, 15 bp, Homo sapiens
ggattcccccagcca

SEQ ID NO: 1539757 - DNA, 15 bp, Homo sapiens
ggattcccttctggg

SEQ ID NO: 1539758 - DNA, 13 bp, Homo sapiens
ggattcctgaccc

SEQ ID NO: 1539759 - DNA, 20 bp, Homo sapiens
ggattcctgacccaggccgc

SEQ ID NO: 1539760 - DNA, 12 bp, Homo sapiens
ggattccttgtt

SEQ ID NO: 1539761 - DNA, 10 bp, Homo sapiens
ggattctggg

SEQ ID NO: 1539762 - DNA, 23 bp, Homo sapiens
ggattctgggaagcttgagcctc

SEQ ID NO: 1539763 - DNA, 22 bp, Homo sapiens
ggattctgggaggcaagaaaag

SEQ ID NO: 1539764 - DNA, 19 bp, Homo sapiens
ggattctggttccagggtc

SEQ ID NO: 1539765 - DNA, 14 bp, Homo sapiens
ggattgatcattct

SEQ ID NO: 1539766 - DNA, 21 bp, Homo sapiens
ggattgattcagtcttctgga

SEQ ID NO: 1539767 - DNA, 14 bp, Homo sapiens
ggattgattttaaa

SEQ ID NO: 1539768 - DNA, 19 bp, Homo sapiens
ggattgcaatatctgaagc

SEQ ID NO: 1539769 - DNA, 15 bp, Homo sapiens
ggattgcccctggct

SEQ ID NO: 1539770 - DNA, 17 bp, Homo sapiens
ggattgcccctggcttt

SEQ ID NO: 1539771 - DNA, 18 bp, Homo sapiens
ggattgggaaagaagttg

SEQ ID NO: 1539772 - DNA, 12 bp, Homo sapiens
ggattggggaag

SEQ ID NO: 1539773 - DNA, 18 bp, Homo sapiens
ggattggggaagactgtg

SEQ ID NO: 1539774 - DNA, 12 bp, Homo sapiens
ggattgtggaaa

SEQ ID NO: 1539775 - DNA, 14 bp, Homo sapiens
ggattgtggaaaac

SEQ ID NO: 1539776 - DNA, 17 bp, Homo sapiens
ggatttaaaaactggaa

SEQ ID NO: 1539777 - DNA, 18 bp, Homo sapiens
ggatttaaaagcctgctc

SEQ ID NO: 1539778 - DNA, 21 bp, Homo sapiens
ggatttaacagtcatttaaaa

SEQ ID NO: 1539779 - DNA, 20 bp, Homo sapiens
ggatttcatgatttcatttc

SEQ ID NO: 1539780 - DNA, 21 bp, Homo sapiens
ggatttctaacagtccttgct

SEQ ID NO: 1539781 - DNA, 22 bp, Homo sapiens
ggatttctaacagtccttgctt

SEQ ID NO: 1539782 - DNA, 16 bp, Homo sapiens
ggatttgattcatttt

SEQ ID NO: 1539783 - DNA, 22 bp, Homo sapiens
ggatttgattcattttcctgtt

SEQ ID NO: 1539784 - DNA, 16 bp, Homo sapiens
ggatttgcatatttat

SEQ ID NO: 1539785 - DNA, 17 bp, Homo sapiens
ggatttggagagaaata

SEQ ID NO: 1539786 - DNA, 18 bp, Homo sapiens
ggatttggagagaaatat

SEQ ID NO: 1539787 - DNA, 22 bp, Homo sapiens
ggattttaacaaaagcaagact

SEQ ID NO: 1539788 - DNA, 15 bp, Homo sapiens
ggattttaatttcag

SEQ ID NO: 1539789 - DNA, 13 bp, Homo sapiens
ggattttaccaaa

SEQ ID NO: 1539790 - DNA, 14 bp, Homo sapiens
ggattttaccaaag

SEQ ID NO: 1539791 - DNA, 15 bp, Homo sapiens
ggattttttcccttt

SEQ ID NO: 1539792 - DNA, 16 bp, Homo sapiens
ggcaaaatccttgctt

SEQ ID NO: 1539793 - DNA, 23 bp, Homo sapiens
ggcaaaatgagagggcagtgttt

SEQ ID NO: 1539794 - DNA, 14 bp, Homo sapiens
ggcaaacagagcta

SEQ ID NO: 1539795 - DNA, 17 bp, Homo sapiens
ggcaaataatggaaaaa

SEQ ID NO: 1539796 - DNA, 13 bp, Homo sapiens
ggcaaatattgaa

SEQ ID NO: 1539797 - DNA, 15 bp, Homo sapiens
ggcaaatattgaagt

SEQ ID NO: 1539798 - DNA, 16 bp, Homo sapiens
ggcaaatcagttacta

SEQ ID NO: 1539799 - DNA, 16 bp, Homo sapiens
ggcaaatctaaaattt

SEQ ID NO: 1539800 - DNA, 20 bp, Homo sapiens
ggcaaatctaaaatttaaaa

SEQ ID NO: 1539801 - DNA, 17 bp, Homo sapiens
ggcaaattttaaaacat

SEQ ID NO: 1539802 - DNA, 21 bp, Homo sapiens
ggcaaattttaaaacattttt

SEQ ID NO: 1539803 - DNA, 21 bp, Homo sapiens
ggcaacactggaacatggcta

SEQ ID NO: 1539804 - DNA, 20 bp, Homo sapiens
ggcaacagggagcacctgtc

SEQ ID NO: 1539805 - DNA, 21 bp, Homo sapiens
ggcaacctcccatcccacccc

SEQ ID NO: 1539806 - DNA, 19 bp, Homo sapiens
ggcaaccttgtctctatgc

SEQ ID NO: 1539807 - DNA, 16 bp, Homo sapiens
ggcaacgaagaaaaaa

SEQ ID NO: 1539808 - DNA, 13 bp, Homo sapiens
ggcaactgaggca

SEQ ID NO: 1539809 - DNA, 21 bp, Homo sapiens
ggcaagaaagcttgagtctca

SEQ ID NO: 1539810 - DNA, 16 bp, Homo sapiens
ggcaagaacagtgggc

SEQ ID NO: 1539811 - DNA, 16 bp, Homo sapiens
ggcaagacctcttccc

SEQ ID NO: 1539812 - DNA, 14 bp, Homo sapiens
ggcaagagactggg

SEQ ID NO: 1539813 - DNA, 13 bp, Homo sapiens
ggcaagcagctgg

SEQ ID NO: 1539814 - DNA, 14 bp, Homo sapiens
ggcaagcccctcag

SEQ ID NO: 1539815 - DNA, 19 bp, Homo sapiens
ggcaagcccctcagccctt

SEQ ID NO: 1539816 - DNA, 21 bp, Homo sapiens
ggcaagcccctcagcccttgc

SEQ ID NO: 1539817 - DNA, 16 bp, Homo sapiens
ggcaagctaggcccca

SEQ ID NO: 1539818 - DNA, 22 bp, Homo sapiens
ggcaagctaggccccagaggcc

SEQ ID NO: 1539819 - DNA, 13 bp, Homo sapiens
ggcaaggcaggtg

SEQ ID NO: 1539820 - DNA, 22 bp, Homo sapiens
ggcaaggcaggtgcctccaggt

SEQ ID NO: 1539821 - DNA, 23 bp, Homo sapiens
ggcaaggtctccttactctgagc

SEQ ID NO: 1539822 - DNA, 20 bp, Homo sapiens
ggcaaggttggcgactgtca

SEQ ID NO: 1539823 - DNA, 19 bp, Homo sapiens
ggcaatgactcgttacctg

SEQ ID NO: 1539824 - DNA, 11 bp, Homo sapiens
ggcaattagtg

SEQ ID NO: 1539825 - DNA, 13 bp, Homo sapiens
ggcaattgtctat

SEQ ID NO: 1539826 - DNA, 14 bp, Homo sapiens
ggcaatttcctggc

SEQ ID NO: 1539827 - DNA, 12 bp, Homo sapiens
ggcacaataaat

SEQ ID NO: 1539828 - DNA, 21 bp, Homo sapiens
ggcacacacctgtagtcccag

SEQ ID NO: 1539829 - DNA, 13 bp, Homo sapiens
ggcacaccactgc

SEQ ID NO: 1539830 - DNA, 14 bp, Homo sapiens
ggcacaccactgcc

SEQ ID NO: 1539831 - DNA, 19 bp, Homo sapiens
ggcacaccactgccctgcc

SEQ ID NO: 1539832 - DNA, 23 bp, Homo sapiens
ggcacaccactgccctgcctgcc

SEQ ID NO: 1539833 - DNA, 20 bp, Homo sapiens
ggcacacgcctgtagtccca

SEQ ID NO: 1539834 - DNA, 13 bp, Homo sapiens
ggcacactttctg

SEQ ID NO: 1539835 - DNA, 16 bp, Homo sapiens
ggcacactttctggca

SEQ ID NO: 1539836 - DNA, 16 bp, Homo sapiens
ggcacagaaacctcta

SEQ ID NO: 1539837 - DNA, 22 bp, Homo sapiens
ggcacagacacgctcgcgggca

SEQ ID NO: 1539838 - DNA, 19 bp, Homo sapiens
ggcacagacttctggaagg

SEQ ID NO: 1539839 - DNA, 14 bp, Homo sapiens
ggcacagccctgag

SEQ ID NO: 1539840 - DNA, 20 bp, Homo sapiens
ggcacagccctgagtgtccc

SEQ ID NO: 1539841 - DNA, 23 bp, Homo sapiens
ggcacagccctgagtgtcccaag

SEQ ID NO: 1539842 - DNA, 15 bp, Homo sapiens
ggcacagcctagggt

SEQ ID NO: 1539843 - DNA, 20 bp, Homo sapiens
ggcacagcggagtctgtcct

SEQ ID NO: 1539844 - DNA, 23 bp, Homo sapiens
ggcacaggaggcaggcatggccc

SEQ ID NO: 1539845 - DNA, 20 bp, Homo sapiens
ggcacaggagtgtcctcttc

SEQ ID NO: 1539846 - DNA, 17 bp, Homo sapiens
ggcacagggcaccagag

SEQ ID NO: 1539847 - DNA, 19 bp, Homo sapiens
ggcacagggtctgctcttt

SEQ ID NO: 1539848 - DNA, 13 bp, Homo sapiens
ggcacagtggctc

SEQ ID NO: 1539849 - DNA, 22 bp, Homo sapiens
ggaggcccaggctgggaactca

SEQ ID NO: 1539850 - DNA, 17 bp, Homo sapiens
ggaggcccatgccctcc

SEQ ID NO: 1539851 - DNA, 18 bp, Homo sapiens
ggaggcccctggcccagc

SEQ ID NO: 1539852 - DNA, 14 bp, Homo sapiens
ggaggcccctgggc

SEQ ID NO: 1539853 - DNA, 15 bp, Homo sapiens
ggaggcccctgggct

SEQ ID NO: 1539854 - DNA, 17 bp, Homo sapiens
ggaggcccctgggctct

SEQ ID NO: 1539855 - DNA, 16 bp, Homo sapiens
ggaggcctcaggtgct

SEQ ID NO: 1539856 - DNA, 20 bp, Homo sapiens
ggaggcctgcgaccctgggg

SEQ ID NO: 1539857 - DNA, 20 bp, Homo sapiens
ggaggccttccagctgctgt

SEQ ID NO: 1539858 - DNA, 21 bp, Homo sapiens
ggaggccttccagctgctgtc

SEQ ID NO: 1539859 - DNA, 14 bp, Homo sapiens
ggaggctctctgta

SEQ ID NO: 1539860 - DNA, 16 bp, Homo sapiens
ggaggctgagacagga

SEQ ID NO: 1539861 - DNA, 13 bp, Homo sapiens
ggaggctgaggca

SEQ ID NO: 1539862 - DNA, 15 bp, Homo sapiens
ggaggctgaggcagg

SEQ ID NO: 1539863 - DNA, 20 bp, Homo sapiens
ggaggctgagttctggttca

SEQ ID NO: 1539864 - DNA, 14 bp, Homo sapiens
ggaggctgcagagc

SEQ ID NO: 1539865 - DNA, 15 bp, Homo sapiens
ggaggctgcagcgcc

SEQ ID NO: 1539866 - DNA, 19 bp, Homo sapiens
ggaggctgcatgctctgga

SEQ ID NO: 1539867 - DNA, 10 bp, Homo sapiens
ggaggctgcg

SEQ ID NO: 1539868 - DNA, 14 bp, Homo sapiens
ggaggctgctgtga

SEQ ID NO: 1539869 - DNA, 15 bp, Homo sapiens
ggaggcttcctgcgt

SEQ ID NO: 1539870 - DNA, 23 bp, Homo sapiens
ggagggacttttaatcagtgaag

SEQ ID NO: 1539871 - DNA, 13 bp, Homo sapiens
ggagggagaagag

SEQ ID NO: 1539872 - DNA, 11 bp, Homo sapiens
ggagggaggcc

SEQ ID NO: 1539873 - DNA, 12 bp, Homo sapiens
ggagggaggctg

SEQ ID NO: 1539874 - DNA, 21 bp, Homo sapiens
ggagggagttttgtctgtctc

SEQ ID NO: 1539875 - DNA, 20 bp, Homo sapiens
ggagggatgaagggcgagtg

SEQ ID NO: 1539876 - DNA, 22 bp, Homo sapiens
ggagggattctggttccagggt

SEQ ID NO: 1539877 - DNA, 12 bp, Homo sapiens
ggagggcagagc

SEQ ID NO: 1539878 - DNA, 15 bp, Homo sapiens
ggagggcagagccat

SEQ ID NO: 1539879 - DNA, 23 bp, Homo sapiens
ggagggcagagccatgggcctgg

SEQ ID NO: 1539880 - DNA, 18 bp, Homo sapiens
ggagggcaggcttgggga

SEQ ID NO: 1539881 - DNA, 14 bp, Homo sapiens
ggagggccagcgct

SEQ ID NO: 1539882 - DNA, 16 bp, Homo sapiens
ggagggccctacctga

SEQ ID NO: 1539883 - DNA, 20 bp, Homo sapiens
ggagggcggcaggggcctgg

SEQ ID NO: 1539884 - DNA, 21 bp, Homo sapiens
ggagggcggcaggggcctgga

SEQ ID NO: 1539885 - DNA, 13 bp, Homo sapiens
ggagggctgcagt

SEQ ID NO: 1539886 - DNA, 21 bp, Homo sapiens
ggaggggactatttatgaagg

SEQ ID NO: 1539887 - DNA, 14 bp, Homo sapiens
ggaggggagggtaa

SEQ ID NO: 1539888 - DNA, 14 bp, Homo sapiens
ggaggggcagcgca

SEQ ID NO: 1539889 - DNA, 13 bp, Homo sapiens
ggaggggcctggc

SEQ ID NO: 1539890 - DNA, 21 bp, Homo sapiens
ggaggggcctggcagccgtgc

SEQ ID NO: 1539891 - DNA, 15 bp, Homo sapiens
ggagggggagggggt

SEQ ID NO: 1539892 - DNA, 18 bp, Homo sapiens
ggagggggcttgaagcca

SEQ ID NO: 1539893 - DNA, 21 bp, Homo sapiens
ggagggggtgggggatctggg

SEQ ID NO: 1539894 - DNA, 17 bp, Homo sapiens
ggaggggtggtcctgac

SEQ ID NO: 1539895 - DNA, 17 bp, Homo sapiens
ggaggggtgtggcagtg

SEQ ID NO: 1539896 - DNA, 15 bp, Homo sapiens
ggaggggtgtggctc

SEQ ID NO: 1539897 - DNA, 24 bp, Homo sapiens
ggagggtccctaattctcttcgct

SEQ ID NO: 1539898 - DNA, 15 bp, Homo sapiens
ggagggtgcagccct

SEQ ID NO: 1539899 - DNA, 13 bp, Homo sapiens
ggagggtgggaag

SEQ ID NO: 1539900 - DNA, 20 bp, Homo sapiens
ggagggttctaagtgggaga

SEQ ID NO: 1539901 - DNA, 21 bp, Homo sapiens
ggaggtcactggaaaggggag

SEQ ID NO: 1539902 - DNA, 13 bp, Homo sapiens
ggaggtccaagca

SEQ ID NO: 1539903 - DNA, 17 bp, Homo sapiens
ggaggtccagctgggcc

SEQ ID NO: 1539904 - DNA, 14 bp, Homo sapiens
ggaggtctccaggg

SEQ ID NO: 1539905 - DNA, 21 bp, Homo sapiens
ggaggtctccaggggcctgca

SEQ ID NO: 1539906 - DNA, 17 bp, Homo sapiens
ggaggtctctgggagcc

SEQ ID NO: 1539907 - DNA, 21 bp, Homo sapiens
ggaggtctctgggagcccaga

SEQ ID NO: 1539908 - DNA, 13 bp, Homo sapiens
ggaggtctggctg

SEQ ID NO: 1539909 - DNA, 18 bp, Homo sapiens
ggaggtgaagaggctgct

SEQ ID NO: 1539910 - DNA, 17 bp, Homo sapiens
ggaggtgattccagtga

SEQ ID NO: 1539911 - DNA, 20 bp, Homo sapiens
ggaggtgcgtgttcagcaga

SEQ ID NO: 1539912 - DNA, 17 bp, Homo sapiens
ggaggtgcttgaggccc

SEQ ID NO: 1539913 - DNA, 20 bp, Homo sapiens
ggaggtggaagaagggagaa

SEQ ID NO: 1539914 - DNA, 19 bp, Homo sapiens
ggaggtggagattgcagtg

SEQ ID NO: 1539915 - DNA, 13 bp, Homo sapiens
ggaggtggctggg

SEQ ID NO: 1539916 - DNA, 20 bp, Homo sapiens
ggaggtgtctggggtgaggg

SEQ ID NO: 1539917 - DNA, 18 bp, Homo sapiens
ggaggtgtggagccgagg

SEQ ID NO: 1539918 - DNA, 19 bp, Homo sapiens
ggaggttctgggcctctga

SEQ ID NO: 1539919 - DNA, 15 bp, Homo sapiens
ggaggttgggtgggc

SEQ ID NO: 1539920 - DNA, 14 bp, Homo sapiens
ggaggttgtggatg

SEQ ID NO: 1539921 - DNA, 21 bp, Homo sapiens
ggaggtttccttttggaacat

SEQ ID NO: 1539922 - DNA, 15 bp, Homo sapiens
ggaggtttgcctgtg

SEQ ID NO: 1539923 - DNA, 18 bp, Homo sapiens
ggagtaatcaggcagcct

SEQ ID NO: 1539924 - DNA, 16 bp, Homo sapiens
ggagtcaaaaattaaa

SEQ ID NO: 1539925 - DNA, 18 bp, Homo sapiens
ggagtcagccaggagctg

SEQ ID NO: 1539926 - DNA, 18 bp, Homo sapiens
ggagtcaggcttctcttg

SEQ ID NO: 1539927 - DNA, 17 bp, Homo sapiens
ggagtcccaaggaaagc

SEQ ID NO: 1539928 - DNA, 15 bp, Homo sapiens
ggagtcccctcacct

SEQ ID NO: 1539929 - DNA, 23 bp, Homo sapiens
ggagtcccctccccggccctacc

SEQ ID NO: 1539930 - DNA, 22 bp, Homo sapiens
ggagtcgtggggtgtgctggga

SEQ ID NO: 1539931 - DNA, 17 bp, Homo sapiens
ggagtctcagagcacag

SEQ ID NO: 1539932 - DNA, 16 bp, Homo sapiens
ggagtctgagtctgag

SEQ ID NO: 1539933 - DNA, 19 bp, Homo sapiens
ggagtctgagtctgagtcc

SEQ ID NO: 1539934 - DNA, 19 bp, Homo sapiens
ggagtcttcagacccagag

SEQ ID NO: 1539935 - DNA, 23 bp, Homo sapiens
ggagtgaaacctttagggcagct

SEQ ID NO: 1539936 - DNA, 16 bp, Homo sapiens
ggagtgaagaggggca

SEQ ID NO: 1539937 - DNA, 21 bp, Homo sapiens
ggagtgaggaatagttgagcc

SEQ ID NO: 1539938 - DNA, 18 bp, Homo sapiens
ggagtgaggcttccaggc

SEQ ID NO: 1539939 - DNA, 23 bp, Homo sapiens
ggagtgagtcacctgctccagaa

SEQ ID NO: 1539940 - DNA, 21 bp, Homo sapiens
ggagtgataatattgtttccc

SEQ ID NO: 1539941 - DNA, 19 bp, Homo sapiens
ggagtgattcccaactcct

SEQ ID NO: 1539942 - DNA, 15 bp, Homo sapiens
ggagtgattctagag

SEQ ID NO: 1539943 - DNA, 15 bp, Homo sapiens
ggagtgccaggacca

SEQ ID NO: 1539944 - DNA, 20 bp, Homo sapiens
ggagtgccaggaccagcctg

SEQ ID NO: 1539945 - DNA, 22 bp, Homo sapiens
ggagtgcccccagcccagagcc

SEQ ID NO: 1539946 - DNA, 13 bp, Homo sapiens
ggagtgcctggag

SEQ ID NO: 1539947 - DNA, 15 bp, Homo sapiens
ggagtgcctggagtc

SEQ ID NO: 1539948 - DNA, 17 bp, Homo sapiens
ggagtgcctggagtcag

SEQ ID NO: 1539949 - DNA, 21 bp, Homo sapiens
ggagtgcgctcttggtccctg

SEQ ID NO: 1539950 - DNA, 23 bp, Homo sapiens
ggagtgcgctcttggtccctggt

SEQ ID NO: 1539951 - DNA, 11 bp, Homo sapiens
ggagtggaggc

SEQ ID NO: 1539952 - DNA, 18 bp, Homo sapiens
ggagtggccaaataggag

SEQ ID NO: 1539953 - DNA, 17 bp, Homo sapiens
ggagtgggtggaggcag

SEQ ID NO: 1539954 - DNA, 20 bp, Homo sapiens
ggagtggtttaggctatttg

SEQ ID NO: 1539955 - DNA, 13 bp, Homo sapiens
ggagtgtcctctt

SEQ ID NO: 1539956 - DNA, 14 bp, Homo sapiens
ggagtgtcctgccc

SEQ ID NO: 1539957 - DNA, 16 bp, Homo sapiens
ggagtgtgcagacagc

SEQ ID NO: 1539958 - DNA, 14 bp, Homo sapiens
ggagtgtgggctgc

SEQ ID NO: 1539959 - DNA, 17 bp, Homo sapiens
ggagtgtgggctgccct

SEQ ID NO: 1539960 - DNA, 13 bp, Homo sapiens
ggagtgtgtgtct

SEQ ID NO: 1539961 - DNA, 16 bp, Homo sapiens
ggagttaagacctggc

SEQ ID NO: 1539962 - DNA, 18 bp, Homo sapiens
ggagttaagacctggcag

SEQ ID NO: 1539963 - DNA, 18 bp, Homo sapiens
ggagttagaggccagcct

SEQ ID NO: 1539964 - DNA, 21 bp, Homo sapiens
ggagttagaggccagcctggc

SEQ ID NO: 1539965 - DNA, 17 bp, Homo sapiens
ggagttagggagagaga

SEQ ID NO: 1539966 - DNA, 14 bp, Homo sapiens
gctctttctgggcc

SEQ ID NO: 1539967 - DNA, 12 bp, Homo sapiens
gctctttgagaa

SEQ ID NO: 1539968 - DNA, 15 bp, Homo sapiens
gctcttttcaatgaa

SEQ ID NO: 1539969 - DNA, 12 bp, Homo sapiens
gctcttttcctg

SEQ ID NO: 1539970 - DNA, 19 bp, Homo sapiens
gctcttttctaagtggcgt

SEQ ID NO: 1539971 - DNA, 17 bp, Homo sapiens
gctcttttgcacaagga

SEQ ID NO: 1539972 - DNA, 20 bp, Homo sapiens
gctcttttggtggggagcac

SEQ ID NO: 1539973 - DNA, 24 bp, Homo sapiens
gctcttttggtggggagcacttgc

SEQ ID NO: 1539974 - DNA, 15 bp, Homo sapiens
gctgaaaatgcaaag

SEQ ID NO: 1539975 - DNA, 16 bp, Homo sapiens
gctgaaacaacaaata

SEQ ID NO: 1539976 - DNA, 16 bp, Homo sapiens
gctgaaattctcctgg

SEQ ID NO: 1539977 - DNA, 16 bp, Homo sapiens
gctgaaattttagaaa

SEQ ID NO: 1539978 - DNA, 18 bp, Homo sapiens
gctgaacacatttctttt

SEQ ID NO: 1539979 - DNA, 19 bp, Homo sapiens
gctgaacacatttcttttt

SEQ ID NO: 1539980 - DNA, 15 bp, Homo sapiens
gctgaaccaaagcct

SEQ ID NO: 1539981 - DNA, 20 bp, Homo sapiens
gctgaaccaaagcctcttca

SEQ ID NO: 1539982 - DNA, 21 bp, Homo sapiens
gctgaaccctgtgctggtgtc

SEQ ID NO: 1539983 - DNA, 14 bp, Homo sapiens
gctgaacctgtctg

SEQ ID NO: 1539984 - DNA, 16 bp, Homo sapiens
gctgaacggggagaaa

SEQ ID NO: 1539985 - DNA, 17 bp, Homo sapiens
gctgaactaaaataaaa

SEQ ID NO: 1539986 - DNA, 15 bp, Homo sapiens
gctgaactcagcaca

SEQ ID NO: 1539987 - DNA, 19 bp, Homo sapiens
gctgaactcttcagaacac

SEQ ID NO: 1539988 - DNA, 17 bp, Homo sapiens
gctgaactgagcctagc

SEQ ID NO: 1539989 - DNA, 15 bp, Homo sapiens
gctgaagaatgaaga

SEQ ID NO: 1539990 - DNA, 16 bp, Homo sapiens
gctgaagagagggaca

SEQ ID NO: 1539991 - DNA, 20 bp, Homo sapiens
gctgaagaggttgaagctaa

SEQ ID NO: 1539992 - DNA, 15 bp, Homo sapiens
gctgaagctggagca

SEQ ID NO: 1539993 - DNA, 20 bp, Homo sapiens
gctgaagtcaaaatatgtaa

SEQ ID NO: 1539994 - DNA, 16 bp, Homo sapiens
gctgaagttctgagcc

SEQ ID NO: 1539995 - DNA, 19 bp, Homo sapiens
gctgaagttgcagatgtta

SEQ ID NO: 1539996 - DNA, 22 bp, Homo sapiens
gctgaatatatagaattcagaa

SEQ ID NO: 1539997 - DNA, 18 bp, Homo sapiens
gctgaatgccccctgctt

SEQ ID NO: 1539998 - DNA, 15 bp, Homo sapiens
gctgaatgcctcgct

SEQ ID NO: 1539999 - DNA, 17 bp, Homo sapiens
gctgaatttccctctct

SEQ ID NO: 1540000 - DNA, 18 bp, Homo sapiens
gctgacaaaaatattttc

SEQ ID NO: 1540001 - DNA, 20 bp, Homo sapiens
gctgacaaccattaaagtca

SEQ ID NO: 1540002 - DNA, 19 bp, Homo sapiens
gctgacaacttagctcagg

SEQ ID NO: 1540003 - DNA, 15 bp, Homo sapiens
gctgacaagggacta

SEQ ID NO: 1540004 - DNA, 13 bp, Homo sapiens
gctgacaataaag

SEQ ID NO: 1540005 - DNA, 14 bp, Homo sapiens
gctgacacctacca

SEQ ID NO: 1540006 - DNA, 20 bp, Homo sapiens
gctgacacctaccatgctgc

SEQ ID NO: 1540007 - DNA, 13 bp, Homo sapiens
gctgacagacact

SEQ ID NO: 1540008 - DNA, 17 bp, Homo sapiens
gctgacagagctctggg

SEQ ID NO: 1540009 - DNA, 16 bp, Homo sapiens
gctgacagtcagctgt

SEQ ID NO: 1540010 - DNA, 16 bp, Homo sapiens
gctgacatctgtgttt

SEQ ID NO: 1540011 - DNA, 16 bp, Homo sapiens
gctgacatcttgaatc

SEQ ID NO: 1540012 - DNA, 16 bp, Homo sapiens
gctgacatcttgcacg

SEQ ID NO: 1540013 - DNA, 21 bp, Homo sapiens
gctgacatgaagctgttgtgt

SEQ ID NO: 1540014 - DNA, 23 bp, Homo sapiens
gctgaccaaatggccagttttct

SEQ ID NO: 1540015 - DNA, 14 bp, Homo sapiens
gctgaccaagagag

SEQ ID NO: 1540016 - DNA, 16 bp, Homo sapiens
gctgaccaagagagaa

SEQ ID NO: 1540017 - DNA, 15 bp, Homo sapiens
gctgacccagcatct

SEQ ID NO: 1540018 - DNA, 20 bp, Homo sapiens
gctgacccagcatctcccag

SEQ ID NO: 1540019 - DNA, 22 bp, Homo sapiens
gctgacccagcatctcccagca

SEQ ID NO: 1540020 - DNA, 15 bp, Homo sapiens
gctgacccagtccct

SEQ ID NO: 1540021 - DNA, 16 bp, Homo sapiens
gctgacccagtccctg

SEQ ID NO: 1540022 - DNA, 19 bp, Homo sapiens
gctgacccagtccctgggg

SEQ ID NO: 1540023 - DNA, 22 bp, Homo sapiens
gctgaccccgagaagtgctctt

SEQ ID NO: 1540024 - DNA, 12 bp, Homo sapiens
gctgacccctct

SEQ ID NO: 1540025 - DNA, 18 bp, Homo sapiens
gctgacccctctggtgtg

SEQ ID NO: 1540026 - DNA, 14 bp, Homo sapiens
gctgaccctgggcc

SEQ ID NO: 1540027 - DNA, 15 bp, Homo sapiens
gctgaccctgggcct

SEQ ID NO: 1540028 - DNA, 15 bp, Homo sapiens
gctgacgcttccctt

SEQ ID NO: 1540029 - DNA, 21 bp, Homo sapiens
gctgactatttgacccccaca

SEQ ID NO: 1540030 - DNA, 17 bp, Homo sapiens
gctgactgaggcctgct

SEQ ID NO: 1540031 - DNA, 22 bp, Homo sapiens
gctgactgccaataacattctt

SEQ ID NO: 1540032 - DNA, 17 bp, Homo sapiens
gctgactgttcttggta

SEQ ID NO: 1540033 - DNA, 15 bp, Homo sapiens
gctgacttttccaaa

SEQ ID NO: 1540034 - DNA, 16 bp, Homo sapiens
gctgagaatgtggaat

SEQ ID NO: 1540035 - DNA, 17 bp, Homo sapiens
gctgagacctgggattt

SEQ ID NO: 1540036 - DNA, 13 bp, Homo sapiens
gctgagagccaga

SEQ ID NO: 1540037 - DNA, 20 bp, Homo sapiens
gctgagagccagatgcctcc

SEQ ID NO: 1540038 - DNA, 15 bp, Homo sapiens
gctgagagccccagc

SEQ ID NO: 1540039 - DNA, 15 bp, Homo sapiens
gctgagatgagcccc

SEQ ID NO: 1540040 - DNA, 13 bp, Homo sapiens
gctgagatgtgga

SEQ ID NO: 1540041 - DNA, 15 bp, Homo sapiens
gctgagccactcgca

SEQ ID NO: 1540042 - DNA, 17 bp, Homo sapiens
gctgagccactcgcagt

SEQ ID NO: 1540043 - DNA, 12 bp, Homo sapiens
gctgagccatga

SEQ ID NO: 1540044 - DNA, 14 bp, Homo sapiens
gctgagccatgagg

SEQ ID NO: 1540045 - DNA, 15 bp, Homo sapiens
gctgagccatgagga

SEQ ID NO: 1540046 - DNA, 16 bp, Homo sapiens
gctgagccatgaggag

SEQ ID NO: 1540047 - DNA, 18 bp, Homo sapiens
gctgagccatgaggagcg

SEQ ID NO: 1540048 - DNA, 23 bp, Homo sapiens
gctgagccccccatgcccctccc

SEQ ID NO: 1540049 - DNA, 17 bp, Homo sapiens
gctgagcccctacccca

SEQ ID NO: 1540050 - DNA, 12 bp, Homo sapiens
gctgagccctgg

SEQ ID NO: 1540051 - DNA, 16 bp, Homo sapiens
gctgagcctgaggcct

SEQ ID NO: 1540052 - DNA, 20 bp, Homo sapiens
gctgagcctgcagggaagcc

SEQ ID NO: 1540053 - DNA, 14 bp, Homo sapiens
gctgagcctggctg

SEQ ID NO: 1540054 - DNA, 16 bp, Homo sapiens
gctgagcttagccttg

SEQ ID NO: 1540055 - DNA, 23 bp, Homo sapiens
gctgagcttagccttgtgccctg

SEQ ID NO: 1540056 - DNA, 19 bp, Homo sapiens
gctgaggaggggcctgggc

SEQ ID NO: 1540057 - DNA, 18 bp, Homo sapiens
gctgaggcaccgtccagg

SEQ ID NO: 1540058 - DNA, 20 bp, Homo sapiens
gctgaggcaccgtccaggcc

SEQ ID NO: 1540059 - DNA, 15 bp, Homo sapiens
gctgaggcaggagga

SEQ ID NO: 1540060 - DNA, 22 bp, Homo sapiens
gctgaggcccctaggtgcccag

SEQ ID NO: 1540061 - DNA, 14 bp, Homo sapiens
gctgaggcctctca

SEQ ID NO: 1540062 - DNA, 14 bp, Homo sapiens
gctgaggcctggac

SEQ ID NO: 1540063 - DNA, 16 bp, Homo sapiens
gctgaggcctgggccg

SEQ ID NO: 1540064 - DNA, 23 bp, Homo sapiens
gctgagggaccgagcccagcaga

SEQ ID NO: 1540065 - DNA, 15 bp, Homo sapiens
gctgagggaccttgg

SEQ ID NO: 1540066 - DNA, 16 bp, Homo sapiens
gctgagggcagactgg

SEQ ID NO: 1540067 - DNA, 14 bp, Homo sapiens
gctgagggcctgct

SEQ ID NO: 1540068 - DNA, 20 bp, Homo sapiens
gctgaggtgaacaaggtaaa

SEQ ID NO: 1540069 - DNA, 15 bp, Homo sapiens
gctgaggtgagagga

SEQ ID NO: 1540070 - DNA, 16 bp, Homo sapiens
gctgaggttcctctgc

SEQ ID NO: 1540071 - DNA, 17 bp, Homo sapiens
gctgaggttcctctgcc

SEQ ID NO: 1540072 - DNA, 17 bp, Homo sapiens
gctgagtaggaggcctc

SEQ ID NO: 1540073 - DNA, 21 bp, Homo sapiens
gctgagtcatgatctccctgc

SEQ ID NO: 1540074 - DNA, 22 bp, Homo sapiens
gctgagtcatgatctccctgcc

SEQ ID NO: 1540075 - DNA, 23 bp, Homo sapiens
gctgagtcatgatctccctgccg

SEQ ID NO: 1540076 - DNA, 15 bp, Homo sapiens
gctgagtctccaggg

SEQ ID NO: 1540077 - DNA, 19 bp, Homo sapiens
caagaagaagggcacccta

SEQ ID NO: 1540078 - DNA, 14 bp, Homo sapiens
caagaagaatttat

SEQ ID NO: 1540079 - DNA, 14 bp, Homo sapiens
caagaagcagtggc

SEQ ID NO: 1540080 - DNA, 21 bp, Homo sapiens
caagaaggaaagatttgtgaa

SEQ ID NO: 1540081 - DNA, 23 bp, Homo sapiens
gctttggaaagttactgtaaatg

SEQ ID NO: 1540082 - DNA, 22 bp, Homo sapiens
gctttggaatattttatcctgt

SEQ ID NO: 1540083 - DNA, 15 bp, Homo sapiens
gctttgggagaatgt

SEQ ID NO: 1540084 - DNA, 18 bp, Homo sapiens
gctttgggaggccaaggc

SEQ ID NO: 1540085 - DNA, 18 bp, Homo sapiens
gctttgggcagttggcca

SEQ ID NO: 1540086 - DNA, 19 bp, Homo sapiens
gctttgggcagttggccag

SEQ ID NO: 1540087 - DNA, 14 bp, Homo sapiens
gctttgggctgccc

SEQ ID NO: 1540088 - DNA, 15 bp, Homo sapiens
gctttgggctgccct

SEQ ID NO: 1540089 - DNA, 18 bp, Homo sapiens
gctttgggctgccctggt

SEQ ID NO: 1540090 - DNA, 22 bp, Homo sapiens
gctttgggtggctcactactga

SEQ ID NO: 1540091 - DNA, 17 bp, Homo sapiens
gctttggttccttctct

SEQ ID NO: 1540092 - DNA, 20 bp, Homo sapiens
gctttggttccttctctggg

SEQ ID NO: 1540093 - DNA, 15 bp, Homo sapiens
gctttgtatgcactt

SEQ ID NO: 1540094 - DNA, 22 bp, Homo sapiens
gctttgtgcttgtcattccaga

SEQ ID NO: 1540095 - DNA, 15 bp, Homo sapiens
gctttgttttatata

SEQ ID NO: 1540096 - DNA, 17 bp, Homo sapiens
gcttttaaaaaaaaata

SEQ ID NO: 1540097 - DNA, 22 bp, Homo sapiens
gcttttaaaaacaaatgagttt

SEQ ID NO: 1540098 - DNA, 15 bp, Homo sapiens
gcttttaaaatgtag

SEQ ID NO: 1540099 - DNA, 23 bp, Homo sapiens
gcttttaactttataaatccagt

SEQ ID NO: 1540100 - DNA, 12 bp, Homo sapiens
gcttttaagaaa

SEQ ID NO: 1540101 - DNA, 15 bp, Homo sapiens
gcttttaagaaacac

SEQ ID NO: 1540102 - DNA, 22 bp, Homo sapiens
gcttttaattctcatttgttct

SEQ ID NO: 1540103 - DNA, 22 bp, Homo sapiens
gcttttaccctttttcttgaat

SEQ ID NO: 1540104 - DNA, 19 bp, Homo sapiens
gcttttaccttaaatgctt

SEQ ID NO: 1540105 - DNA, 13 bp, Homo sapiens
gcttttactttat

SEQ ID NO: 1540106 - DNA, 15 bp, Homo sapiens
gcttttattttttct

SEQ ID NO: 1540107 - DNA, 14 bp, Homo sapiens
gcttttcactgctg

SEQ ID NO: 1540108 - DNA, 18 bp, Homo sapiens
gcttttcactgctggctg

SEQ ID NO: 1540109 - DNA, 19 bp, Homo sapiens
gcttttccaggatcctgca

SEQ ID NO: 1540110 - DNA, 20 bp, Homo sapiens
gcttttccaggatcctgcag

SEQ ID NO: 1540111 - DNA, 20 bp, Homo sapiens
gcttttcccaccagctccca

SEQ ID NO: 1540112 - DNA, 16 bp, Homo sapiens
gcttttcctcaagcaa

SEQ ID NO: 1540113 - DNA, 17 bp, Homo sapiens
gcttttcctcaagcaat

SEQ ID NO: 1540114 - DNA, 13 bp, Homo sapiens
gcttttctgccac

SEQ ID NO: 1540115 - DNA, 15 bp, Homo sapiens
gcttttctgccctgg

SEQ ID NO: 1540116 - DNA, 14 bp, Homo sapiens
gcttttctgtattt

SEQ ID NO: 1540117 - DNA, 18 bp, Homo sapiens
gcttttctgtattttatt

SEQ ID NO: 1540118 - DNA, 19 bp, Homo sapiens
gcttttgaaaagttgaaat

SEQ ID NO: 1540119 - DNA, 23 bp, Homo sapiens
gcttttgaaaagttgaaatgtgt

SEQ ID NO: 1540120 - DNA, 11 bp, Homo sapiens
gcttttgccac

SEQ ID NO: 1540121 - DNA, 18 bp, Homo sapiens
gcttttgccactccttgt

SEQ ID NO: 1540122 - DNA, 17 bp, Homo sapiens
gcttttgcccacacact

SEQ ID NO: 1540123 - DNA, 15 bp, Homo sapiens
gcttttgcctgcaag

SEQ ID NO: 1540124 - DNA, 15 bp, Homo sapiens
gcttttgcctgtaag

SEQ ID NO: 1540125 - DNA, 15 bp, Homo sapiens
gcttttgctagatgg

SEQ ID NO: 1540126 - DNA, 11 bp, Homo sapiens
gcttttggcaa

SEQ ID NO: 1540127 - DNA, 20 bp, Homo sapiens
gcttttgttgtgacttttta

SEQ ID NO: 1540128 - DNA, 15 bp, Homo sapiens
gcttttgttttcata

SEQ ID NO: 1540129 - DNA, 19 bp, Homo sapiens
gcttttgttttcctgctgg

SEQ ID NO: 1540130 - DNA, 14 bp, Homo sapiens
gctttttaaaattt

SEQ ID NO: 1540131 - DNA, 18 bp, Homo sapiens
gctttttaagaatatttt

SEQ ID NO: 1540132 - DNA, 15 bp, Homo sapiens
gctttttaatattga

SEQ ID NO: 1540133 - DNA, 13 bp, Homo sapiens
gctttttccagag

SEQ ID NO: 1540134 - DNA, 16 bp, Homo sapiens
gctttttctcagatct

SEQ ID NO: 1540135 - DNA, 17 bp, Homo sapiens
gcttttttccaaaacaa

SEQ ID NO: 1540136 - DNA, 15 bp, Homo sapiens
gctttttttcttaaa

SEQ ID NO: 1540137 - DNA, 17 bp, Homo sapiens
gctttttttgtgtgtat

SEQ ID NO: 1540138 - DNA, 22 bp, Homo sapiens
gctttttttgtgtgtatttgct

SEQ ID NO: 1540139 - DNA, 17 bp, Homo sapiens
ggaaaaaaacataaaaa

SEQ ID NO: 1540140 - DNA, 23 bp, Homo sapiens
ggaaaaaattgcttttgagagaa

SEQ ID NO: 1540141 - DNA, 18 bp, Homo sapiens
ggaaaaaattgtattgaa

SEQ ID NO: 1540142 - DNA, 14 bp, Homo sapiens
ggaaaaataatcaa

SEQ ID NO: 1540143 - DNA, 20 bp, Homo sapiens
ggaaaacaaatcactgtatt

SEQ ID NO: 1540144 - DNA, 15 bp, Homo sapiens
ggaaaacagaacact

SEQ ID NO: 1540145 - DNA, 22 bp, Homo sapiens
ggaaaacagaacatcattagaa

SEQ ID NO: 1540146 - DNA, 13 bp, Homo sapiens
ggaaaacatttgc

SEQ ID NO: 1540147 - DNA, 21 bp, Homo sapiens
ggaaaaccaagccgtggcttc

SEQ ID NO: 1540148 - DNA, 16 bp, Homo sapiens
ggaaaactgacagagg

SEQ ID NO: 1540149 - DNA, 19 bp, Homo sapiens
ggaaaacttaataaaaatt

SEQ ID NO: 1540150 - DNA, 20 bp, Homo sapiens
ggaaaagaagttgcaagact

SEQ ID NO: 1540151 - DNA, 18 bp, Homo sapiens
ggaaaagaatacagaaag

SEQ ID NO: 1540152 - DNA, 22 bp, Homo sapiens
ggaaaagcaagaaacagtttct

SEQ ID NO: 1540153 - DNA, 12 bp, Homo sapiens
ggaaaaggcccc

SEQ ID NO: 1540154 - DNA, 17 bp, Homo sapiens
ggaaaaggcccctgcaa

SEQ ID NO: 1540155 - DNA, 16 bp, Homo sapiens
ggaaaaggctggtaca

SEQ ID NO: 1540156 - DNA, 21 bp, Homo sapiens
ggaaaataaacatcagtttct

SEQ ID NO: 1540157 - DNA, 19 bp, Homo sapiens
ggaaaatacctaattgtgg

SEQ ID NO: 1540158 - DNA, 19 bp, Homo sapiens
ggaaaataggcaggaagcc

SEQ ID NO: 1540159 - DNA, 15 bp, Homo sapiens
ggaaaatatttcctg

SEQ ID NO: 1540160 - DNA, 22 bp, Homo sapiens
ggaaaatctatatttgtcttcc

SEQ ID NO: 1540161 - DNA, 19 bp, Homo sapiens
ggaaaatgccatgaattac

SEQ ID NO: 1540162 - DNA, 20 bp, Homo sapiens
ggaaaatgcttaaaaaataa

SEQ ID NO: 1540163 - DNA, 14 bp, Homo sapiens
ggaaaattcatttt

SEQ ID NO: 1540164 - DNA, 18 bp, Homo sapiens
ggaaaattctaacccagg

SEQ ID NO: 1540165 - DNA, 18 bp, Homo sapiens
ggaaaattttaaaaatac

SEQ ID NO: 1540166 - DNA, 15 bp, Homo sapiens
ggaaacaatcctgtt

SEQ ID NO: 1540167 - DNA, 11 bp, Homo sapiens
ggaaacagcat

SEQ ID NO: 1540168 - DNA, 23 bp, Homo sapiens
ggaaacatacagaggatgccttt

SEQ ID NO: 1540169 - DNA, 15 bp, Homo sapiens
ggaaaccacagtcag

SEQ ID NO: 1540170 - DNA, 23 bp, Homo sapiens
ggaaaccagctcgtgggctggga

SEQ ID NO: 1540171 - DNA, 19 bp, Homo sapiens
ggaaaccctggagccatcc

SEQ ID NO: 1540172 - DNA, 14 bp, Homo sapiens
ggaaacctgccctg

SEQ ID NO: 1540173 - DNA, 18 bp, Homo sapiens
ggaaacctgccctgcctg

SEQ ID NO: 1540174 - DNA, 17 bp, Homo sapiens
ggaaaccttccacccag

SEQ ID NO: 1540175 - DNA, 13 bp, Homo sapiens
ggaaactcagccg

SEQ ID NO: 1540176 - DNA, 12 bp, Homo sapiens
ggaaactgaatg

SEQ ID NO: 1540177 - DNA, 13 bp, Homo sapiens
ggaaactgccagc

SEQ ID NO: 1540178 - DNA, 13 bp, Homo sapiens
ggaaactgggaaa

SEQ ID NO: 1540179 - DNA, 14 bp, Homo sapiens
ggaaactgggaaac

SEQ ID NO: 1540180 - DNA, 19 bp, Homo sapiens
ggaaactgggtttctcatt

SEQ ID NO: 1540181 - DNA, 19 bp, Homo sapiens
ggaaagaagggatccctaa

SEQ ID NO: 1540182 - DNA, 17 bp, Homo sapiens
ggaaagaagggggccct

SEQ ID NO: 1540183 - DNA, 19 bp, Homo sapiens
ggaaagacaactgttttaa

SEQ ID NO: 1540184 - DNA, 14 bp, Homo sapiens
ggaaagacactgcc

SEQ ID NO: 1540185 - DNA, 18 bp, Homo sapiens
ggaaagcatcacctcagg

SEQ ID NO: 1540186 - DNA, 15 bp, Homo sapiens
ggaaagctaggcttc

SEQ ID NO: 1540187 - DNA, 20 bp, Homo sapiens
ggaaagctatatctatttga

SEQ ID NO: 1540188 - DNA, 15 bp, Homo sapiens
ggaaaggacccaccc

SEQ ID NO: 1540189 - DNA, 19 bp, Homo sapiens
ggaaaggacccacccatct

SEQ ID NO: 1540190 - DNA, 21 bp, Homo sapiens
ggaaaggagtagaaaaagcag

SEQ ID NO: 1540191 - DNA, 15 bp, Homo sapiens
ggaaaggatctgtga

SEQ ID NO: 1540192 - DNA, 19 bp, Homo sapiens
ggaaaggattttaccaaag

SEQ ID NO: 1540193 - DNA, 16 bp, Homo sapiens
ggaaaggctcatttaa

SEQ ID NO: 1540194 - DNA, 17 bp, Homo sapiens
ggaaaggctcatttaaa

SEQ ID NO: 1540195 - DNA, 20 bp, Homo sapiens
ggaaaggctcatttaaaaca

SEQ ID NO: 1540196 - DNA, 14 bp, Homo sapiens
ggaagccaggctga

SEQ ID NO: 1540197 - DNA, 11 bp, Homo sapiens
ggaagccaggt

SEQ ID NO: 1540198 - DNA, 21 bp, Homo sapiens
ggaagccaggtacaggagagg

SEQ ID NO: 1540199 - DNA, 16 bp, Homo sapiens
ggaagcccagctccag

SEQ ID NO: 1540200 - DNA, 17 bp, Homo sapiens
ggaagcccatcctgacc

SEQ ID NO: 1540201 - DNA, 13 bp, Homo sapiens
ggaagcccctggg

SEQ ID NO: 1540202 - DNA, 19 bp, Homo sapiens
ggaagcccctgggcccagt

SEQ ID NO: 1540203 - DNA, 12 bp, Homo sapiens
ggaagccctcct

SEQ ID NO: 1540204 - DNA, 16 bp, Homo sapiens
ggaagccctccttcca

SEQ ID NO: 1540205 - DNA, 17 bp, Homo sapiens
ggaagccctccttccac

SEQ ID NO: 1540206 - DNA, 21 bp, Homo sapiens
ggaagccggggtgtaacttcc

SEQ ID NO: 1540207 - DNA, 19 bp, Homo sapiens
ggaagctagacacatgaag

SEQ ID NO: 1540208 - DNA, 19 bp, Homo sapiens
ggaagctctccgagctctg

SEQ ID NO: 1540209 - DNA, 20 bp, Homo sapiens
ggaagctctccgagctctgg

SEQ ID NO: 1540210 - DNA, 17 bp, Homo sapiens
ggaagctgcacatgtgc

SEQ ID NO: 1540211 - DNA, 17 bp, Homo sapiens
ggaagctgccctgccca

SEQ ID NO: 1540212 - DNA, 13 bp, Homo sapiens
ggaagctggaaga

SEQ ID NO: 1540213 - DNA, 21 bp, Homo sapiens
ggaagctgtactcagagcaga

SEQ ID NO: 1540214 - DNA, 15 bp, Homo sapiens
ggaaggaacaaagac

SEQ ID NO: 1540215 - DNA, 15 bp, Homo sapiens
ggaaggaaggctctc

SEQ ID NO: 1540216 - DNA, 17 bp, Homo sapiens
ggaaggacaggaagctg

SEQ ID NO: 1540217 - DNA, 20 bp, Homo sapiens
ggaaggagactcacctctgc

SEQ ID NO: 1540218 - DNA, 15 bp, Homo sapiens
ggaaggagagcctgc

SEQ ID NO: 1540219 - DNA, 14 bp, Homo sapiens
ggaaggaggcagac

SEQ ID NO: 1540220 - DNA, 12 bp, Homo sapiens
ggaaggagggca

SEQ ID NO: 1540221 - DNA, 18 bp, Homo sapiens
ggaaggataaagccactt

SEQ ID NO: 1540222 - DNA, 16 bp, Homo sapiens
ggaaggcagctgctct

SEQ ID NO: 1540223 - DNA, 15 bp, Homo sapiens
ggaaggcagggcggt

SEQ ID NO: 1540224 - DNA, 16 bp, Homo sapiens
ggaaggccccttccct

SEQ ID NO: 1540225 - DNA, 17 bp, Homo sapiens
ggaaggccccttccctg

SEQ ID NO: 1540226 - DNA, 12 bp, Homo sapiens
ggaaggcctgac

SEQ ID NO: 1540227 - DNA, 12 bp, Homo sapiens
ggaaggctctcg

SEQ ID NO: 1540228 - DNA, 17 bp, Homo sapiens
ggaaggctggctgggca

SEQ ID NO: 1540229 - DNA, 15 bp, Homo sapiens
ggaagggaaagtttt

SEQ ID NO: 1540230 - DNA, 17 bp, Homo sapiens
cacacctgaacttgcct

SEQ ID NO: 1540231 - DNA, 16 bp, Homo sapiens
cacacctgactctgaa

SEQ ID NO: 1540232 - DNA, 12 bp, Homo sapiens
cacacctgcagt

SEQ ID NO: 1540233 - DNA, 13 bp, Homo sapiens
cacacctgcagtg

SEQ ID NO: 1540234 - DNA, 15 bp, Homo sapiens
cacacctggccttaa

SEQ ID NO: 1540235 - DNA, 15 bp, Homo sapiens
cacacctgggcattt

SEQ ID NO: 1540236 - DNA, 23 bp, Homo sapiens
cacacctggtggatacctggttg

SEQ ID NO: 1540237 - DNA, 14 bp, Homo sapiens
cacacctgtgtcca

SEQ ID NO: 1540238 - DNA, 14 bp, Homo sapiens
cacaccttggcctt

SEQ ID NO: 1540239 - DNA, 22 bp, Homo sapiens
cacaccttttatgaatcaaata

SEQ ID NO: 1540240 - DNA, 14 bp, Homo sapiens
cacaccttttcccc

SEQ ID NO: 1540241 - DNA, 18 bp, Homo sapiens
cacaccttttccccagga

SEQ ID NO: 1540242 - DNA, 20 bp, Homo sapiens
cacaccttttccccaggagc

SEQ ID NO: 1540243 - DNA, 10 bp, Homo sapiens
cacacgatgc

SEQ ID NO: 1540244 - DNA, 20 bp, Homo sapiens
cacacgatgcatttaataaa

SEQ ID NO: 1540245 - DNA, 20 bp, Homo sapiens
cacacgatgttgtcaaggat

SEQ ID NO: 1540246 - DNA, 15 bp, Homo sapiens
cacacgcacgcacac

SEQ ID NO: 1540247 - DNA, 20 bp, Homo sapiens
cacacggaggcatctgcacc

SEQ ID NO: 1540248 - DNA, 21 bp, Homo sapiens
cacacggaggcatctgcaccc

SEQ ID NO: 1540249 - DNA, 13 bp, Homo sapiens
cacacgtggctgg

SEQ ID NO: 1540250 - DNA, 15 bp, Homo sapiens
cacacgtggctggcg

SEQ ID NO: 1540251 - DNA, 18 bp, Homo sapiens
cacacgtttaatcccagc

SEQ ID NO: 1540252 - DNA, 19 bp, Homo sapiens
cacacgtttaatcccagca

SEQ ID NO: 1540253 - DNA, 22 bp, Homo sapiens
cacacgtttaatcccagcactt

SEQ ID NO: 1540254 - DNA, 19 bp, Homo sapiens
cacactaaccaagctgagt

SEQ ID NO: 1540255 - DNA, 18 bp, Homo sapiens
cacactacacagcacacc

SEQ ID NO: 1540256 - DNA, 16 bp, Homo sapiens
cacactcgcccgccca

SEQ ID NO: 1540257 - DNA, 22 bp, Homo sapiens
cacactctccatcaccctcttc

SEQ ID NO: 1540258 - DNA, 23 bp, Homo sapiens
cacactgaccaagtgctggccca

SEQ ID NO: 1540259 - DNA, 21 bp, Homo sapiens
cacactgcaagagccttggtg

SEQ ID NO: 1540260 - DNA, 15 bp, Homo sapiens
cacactgcgcaggtc

SEQ ID NO: 1540261 - DNA, 12 bp, Homo sapiens
cacactggccac

SEQ ID NO: 1540262 - DNA, 13 bp, Homo sapiens
cacactggccaca

SEQ ID NO: 1540263 - DNA, 17 bp, Homo sapiens
cacactggccacaagga

SEQ ID NO: 1540264 - DNA, 21 bp, Homo sapiens
cacactgggtgcgtctccagt

SEQ ID NO: 1540265 - DNA, 23 bp, Homo sapiens
cacactgtagcattacagtgggt

SEQ ID NO: 1540266 - DNA, 18 bp, Homo sapiens
cacactgtcatgcttcat

SEQ ID NO: 1540267 - DNA, 20 bp, Homo sapiens
cacactgtcatgcttcatca

SEQ ID NO: 1540268 - DNA, 13 bp, Homo sapiens
cacactgtcttcc

SEQ ID NO: 1540269 - DNA, 14 bp, Homo sapiens
cacactgtcttccc

SEQ ID NO: 1540270 - DNA, 24 bp, Homo sapiens
cacactgtgtcctggtgctctctg

SEQ ID NO: 1540271 - DNA, 19 bp, Homo sapiens
cacactgttactccacagc

SEQ ID NO: 1540272 - DNA, 18 bp, Homo sapiens
cacacttcaggctcttct

SEQ ID NO: 1540273 - DNA, 16 bp, Homo sapiens
cacacttccaccagcc

SEQ ID NO: 1540274 - DNA, 19 bp, Homo sapiens
cacacttccaccagcctgc

SEQ ID NO: 1540275 - DNA, 17 bp, Homo sapiens
cacacttccccatcttt

SEQ ID NO: 1540276 - DNA, 15 bp, Homo sapiens
cacacttctgtgaga

SEQ ID NO: 1540277 - DNA, 16 bp, Homo sapiens
cacactttccatctct

SEQ ID NO: 1540278 - DNA, 15 bp, Homo sapiens
cacacttttccacat

SEQ ID NO: 1540279 - DNA, 13 bp, Homo sapiens
cacagaaaaagca

SEQ ID NO: 1540280 - DNA, 14 bp, Homo sapiens
cacagaaaaagcat

SEQ ID NO: 1540281 - DNA, 23 bp, Homo sapiens
cacagaaaataaggcacccatct

SEQ ID NO: 1540282 - DNA, 11 bp, Homo sapiens
cacagaaacac

SEQ ID NO: 1540283 - DNA, 21 bp, Homo sapiens
cacagaaacacaatattttgt

SEQ ID NO: 1540284 - DNA, 19 bp, Homo sapiens
cacagaaacactgcctttt

SEQ ID NO: 1540285 - DNA, 22 bp, Homo sapiens
cacagaaagactgagctcaagg

SEQ ID NO: 1540286 - DNA, 17 bp, Homo sapiens
cacagaaatcagaggag

SEQ ID NO: 1540287 - DNA, 19 bp, Homo sapiens
cacagaaatcagaggagag

SEQ ID NO: 1540288 - DNA, 22 bp, Homo sapiens
cacagaaatgctgctggccaaa

SEQ ID NO: 1540289 - DNA, 21 bp, Homo sapiens
cacagaaccttcaacccagtg

SEQ ID NO: 1540290 - DNA, 19 bp, Homo sapiens
cacagaaggaatctgtgca

SEQ ID NO: 1540291 - DNA, 18 bp, Homo sapiens
cacagaatatttttatat

SEQ ID NO: 1540292 - DNA, 19 bp, Homo sapiens
cacagaatgcaaccaagtc

SEQ ID NO: 1540293 - DNA, 17 bp, Homo sapiens
cacagaatgctcagggt

SEQ ID NO: 1540294 - DNA, 15 bp, Homo sapiens
cacagacaagcagcc

SEQ ID NO: 1540295 - DNA, 16 bp, Homo sapiens
cacagacaagcagccc

SEQ ID NO: 1540296 - DNA, 12 bp, Homo sapiens
cacagacacaca

SEQ ID NO: 1540297 - DNA, 20 bp, Homo sapiens
cacagacacacacacgcacg

SEQ ID NO: 1540298 - DNA, 22 bp, Homo sapiens
cacagacacgctcgcgggcagc

SEQ ID NO: 1540299 - DNA, 14 bp, Homo sapiens
cacagacattttgt

SEQ ID NO: 1540300 - DNA, 15 bp, Homo sapiens
cacagacccctggga

SEQ ID NO: 1540301 - DNA, 16 bp, Homo sapiens
cacagacccctgggag

SEQ ID NO: 1540302 - DNA, 17 bp, Homo sapiens
cacagacccctgggagc

SEQ ID NO: 1540303 - DNA, 16 bp, Homo sapiens
cacagacctggagccc

SEQ ID NO: 1540304 - DNA, 21 bp, Homo sapiens
cacagacctggagcccctggg

SEQ ID NO: 1540305 - DNA, 22 bp, Homo sapiens
cacagacgttaggcatttcctg

SEQ ID NO: 1540306 - DNA, 14 bp, Homo sapiens
cacagactattttt

SEQ ID NO: 1540307 - DNA, 21 bp, Homo sapiens
cacagacttctggaaggctgg

SEQ ID NO: 1540308 - DNA, 15 bp, Homo sapiens
cacagacttgcactg

SEQ ID NO: 1540309 - DNA, 19 bp, Homo sapiens
cacagacttgcactgaagc

SEQ ID NO: 1540310 - DNA, 14 bp, Homo sapiens
cacagactttctgt

SEQ ID NO: 1540311 - DNA, 17 bp, Homo sapiens
ggacccaggtgtgcctg

SEQ ID NO: 1540312 - DNA, 20 bp, Homo sapiens
ggacccaggtgtgcctgtgc

SEQ ID NO: 1540313 - DNA, 21 bp, Homo sapiens
ggacccaggtgtgcctgtgct

SEQ ID NO: 1540314 - DNA, 13 bp, Homo sapiens
ggacccagtgcag

SEQ ID NO: 1540315 - DNA, 19 bp, Homo sapiens
ggacccatagatcttctga

SEQ ID NO: 1540316 - DNA, 20 bp, Homo sapiens
ggaccccacttcagaaggta

SEQ ID NO: 1540317 - DNA, 12 bp, Homo sapiens
ggaccccagctg

SEQ ID NO: 1540318 - DNA, 13 bp, Homo sapiens
ggaccccagctgg

SEQ ID NO: 1540319 - DNA, 16 bp, Homo sapiens
ggacccccactaagac

SEQ ID NO: 1540320 - DNA, 22 bp, Homo sapiens
ggaccccctcaccatccagtgg

SEQ ID NO: 1540321 - DNA, 18 bp, Homo sapiens
ggaccccgagaaccctga

SEQ ID NO: 1540322 - DNA, 19 bp, Homo sapiens
ggaccccgagaaccctgag

SEQ ID NO: 1540323 - DNA, 12 bp, Homo sapiens
ggacccgccagc

SEQ ID NO: 1540324 - DNA, 20 bp, Homo sapiens
ggacccggaggggcctggca

SEQ ID NO: 1540325 - DNA, 21 bp, Homo sapiens
ggacccgggaccacagctgct

SEQ ID NO: 1540326 - DNA, 12 bp, Homo sapiens
ggaccctgtccg

SEQ ID NO: 1540327 - DNA, 23 bp, Homo sapiens
ggaccctgtccggcccagtgcca

SEQ ID NO: 1540328 - DNA, 16 bp, Homo sapiens
ggaccctttccttcct

SEQ ID NO: 1540329 - DNA, 17 bp, Homo sapiens
ggaccctttccttcctt

SEQ ID NO: 1540330 - DNA, 22 bp, Homo sapiens
ggaccctttccttccttccctg

SEQ ID NO: 1540331 - DNA, 19 bp, Homo sapiens
ggaccgggtgggcctggcc

SEQ ID NO: 1540332 - DNA, 15 bp, Homo sapiens
ggaccggtgctgcag

SEQ ID NO: 1540333 - DNA, 14 bp, Homo sapiens
ggaccgtccagggg

SEQ ID NO: 1540334 - DNA, 14 bp, Homo sapiens
ggaccgtggacagg

SEQ ID NO: 1540335 - DNA, 17 bp, Homo sapiens
ggacctaaatggcctca

SEQ ID NO: 1540336 - DNA, 22 bp, Homo sapiens
ggacctaacattcgatctcatt

SEQ ID NO: 1540337 - DNA, 16 bp, Homo sapiens
ggacctagggtggcct

SEQ ID NO: 1540338 - DNA, 19 bp, Homo sapiens
ggacctgaaattccaaagt

SEQ ID NO: 1540339 - DNA, 21 bp, Homo sapiens
ggacctgcatccttcctgggg

SEQ ID NO: 1540340 - DNA, 16 bp, Homo sapiens
ggacctgccaggcagg

SEQ ID NO: 1540341 - DNA, 13 bp, Homo sapiens
ggacctgctgctc

SEQ ID NO: 1540342 - DNA, 11 bp, Homo sapiens
ggacctggcag

SEQ ID NO: 1540343 - DNA, 17 bp, Homo sapiens
ggaccttcgggctgtgc

SEQ ID NO: 1540344 - DNA, 21 bp, Homo sapiens
ggaccttctttattctgtgtt

SEQ ID NO: 1540345 - DNA, 19 bp, Homo sapiens
ggaccttgacagagcagct

SEQ ID NO: 1540346 - DNA, 20 bp, Homo sapiens
ggaccttgcgtgaagagcag

SEQ ID NO: 1540347 - DNA, 13 bp, Homo sapiens
ggaccttggagag

SEQ ID NO: 1540348 - DNA, 20 bp, Homo sapiens
ggacctttccaccacagcca

SEQ ID NO: 1540349 - DNA, 21 bp, Homo sapiens
ggaccttttcccttgctgtac

SEQ ID NO: 1540350 - DNA, 14 bp, Homo sapiens
ggacgagaccccca

SEQ ID NO: 1540351 - DNA, 21 bp, Homo sapiens
ggacgagacccccatccagcc

SEQ ID NO: 1540352 - DNA, 16 bp, Homo sapiens
ggacgcaggtgctgcg

SEQ ID NO: 1540353 - DNA, 17 bp, Homo sapiens
ggacgggggctgcttct

SEQ ID NO: 1540354 - DNA, 19 bp, Homo sapiens
ggacggtgccaagggcccc

SEQ ID NO: 1540355 - DNA, 17 bp, Homo sapiens
ggacggtgcccaagcca

SEQ ID NO: 1540356 - DNA, 19 bp, Homo sapiens
ggactaacataaaatctgt

SEQ ID NO: 1540357 - DNA, 22 bp, Homo sapiens
ggactaccgagagcttggacta

SEQ ID NO: 1540358 - DNA, 17 bp, Homo sapiens
ggactaccgcaggcccg

SEQ ID NO: 1540359 - DNA, 13 bp, Homo sapiens
ggactcaccctca

SEQ ID NO: 1540360 - DNA, 23 bp, Homo sapiens
ggactcacttgatgtttcctgga

SEQ ID NO: 1540361 - DNA, 17 bp, Homo sapiens
ggactcagaaactccat

SEQ ID NO: 1540362 - DNA, 14 bp, Homo sapiens
ggactcaggaactt

SEQ ID NO: 1540363 - DNA, 24 bp, Homo sapiens
ggactcatttcattcctaacacag

SEQ ID NO: 1540364 - DNA, 14 bp, Homo sapiens
ggactccagctcgt

SEQ ID NO: 1540365 - DNA, 16 bp, Homo sapiens
ggactccaggcctgac

SEQ ID NO: 1540366 - DNA, 20 bp, Homo sapiens
ggactccaggcctgaccagg

SEQ ID NO: 1540367 - DNA, 15 bp, Homo sapiens
ggactcccctccctg

SEQ ID NO: 1540368 - DNA, 12 bp, Homo sapiens
ggactcctcttg

SEQ ID NO: 1540369 - DNA, 16 bp, Homo sapiens
ggactcggtgagccgg

SEQ ID NO: 1540370 - DNA, 13 bp, Homo sapiens
ggactctcaggga

SEQ ID NO: 1540371 - DNA, 15 bp, Homo sapiens
ggactctcagggatt

SEQ ID NO: 1540372 - DNA, 13 bp, Homo sapiens
ggactctcctcct

SEQ ID NO: 1540373 - DNA, 19 bp, Homo sapiens
ggactctcctcctcccctc

SEQ ID NO: 1540374 - DNA, 23 bp, Homo sapiens
ggactctcctcctcccctcctct

SEQ ID NO: 1540375 - DNA, 14 bp, Homo sapiens
ggactctgatctct

SEQ ID NO: 1540376 - DNA, 13 bp, Homo sapiens
ggactctgcccca

SEQ ID NO: 1540377 - DNA, 13 bp, Homo sapiens
ggactctgctaga

SEQ ID NO: 1540378 - DNA, 18 bp, Homo sapiens
ggactgaccacaccaacc

SEQ ID NO: 1540379 - DNA, 16 bp, Homo sapiens
ggactgactgcagccc

SEQ ID NO: 1540380 - DNA, 18 bp, Homo sapiens
ggactgactgcagccccc

SEQ ID NO: 1540381 - DNA, 23 bp, Homo sapiens
ggactgagactggcacttagccc

SEQ ID NO: 1540382 - DNA, 17 bp, Homo sapiens
ggactgagccagtccca

SEQ ID NO: 1540383 - DNA, 13 bp, Homo sapiens
ggactgaggagtg

SEQ ID NO: 1540384 - DNA, 14 bp, Homo sapiens
ggactgaggagtgg

SEQ ID NO: 1540385 - DNA, 11 bp, Homo sapiens
ggactgagggc

SEQ ID NO: 1540386 - DNA, 23 bp, Homo sapiens
ggactgagtcccctccaggaaga

SEQ ID NO: 1540387 - DNA, 17 bp, Homo sapiens
ggactgattctgtggct

SEQ ID NO: 1540388 - DNA, 11 bp, Homo sapiens
ggactgcatgg

SEQ ID NO: 1540389 - DNA, 12 bp, Homo sapiens
ggactgcattta

SEQ ID NO: 1540390 - DNA, 12 bp, Homo sapiens
ggactgccaaat

SEQ ID NO: 1540391 - DNA, 17 bp, Homo sapiens
ggactgccaggctgttt

SEQ ID NO: 1540392 - DNA, 13 bp, Homo sapiens
ggactgccagggc

SEQ ID NO: 1540393 - DNA, 22 bp, Homo sapiens
ggactgctacctttcaaagctt

SEQ ID NO: 1540394 - DNA, 21 bp, Homo sapiens
ggactgggtctgacctggtgg

SEQ ID NO: 1540395 - DNA, 20 bp, Homo sapiens
ggactgggttgcgtcctgac

SEQ ID NO: 1540396 - DNA, 11 bp, Homo sapiens
ggactgggttt

SEQ ID NO: 1540397 - DNA, 18 bp, Homo sapiens
ggactgggtttggacccc

SEQ ID NO: 1540398 - DNA, 9 bp, Homo sapiens
ggactggtg

SEQ ID NO: 1540399 - DNA, 14 bp, Homo sapiens
ggactgtaaagatt

SEQ ID NO: 1540400 - DNA, 13 bp, Homo sapiens
ggactgtcagctg

SEQ ID NO: 1540401 - DNA, 18 bp, Homo sapiens
ggactgtgcctcaggcca

SEQ ID NO: 1540402 - DNA, 16 bp, Homo sapiens
ggactgtgctggtgca

SEQ ID NO: 1540403 - DNA, 20 bp, Homo sapiens
ggacttaacggctccaggat

SEQ ID NO: 1540404 - DNA, 17 bp, Homo sapiens
ggacttaagacaaatgg

SEQ ID NO: 1540405 - DNA, 23 bp, Homo sapiens
ggacttaagcatctggctctaat

SEQ ID NO: 1540406 - DNA, 14 bp, Homo sapiens
ggacttacaaaatg

SEQ ID NO: 1540407 - DNA, 19 bp, Homo sapiens
ggacttcaaagcaagctgg

SEQ ID NO: 1540408 - DNA, 16 bp, Homo sapiens
ggacttccacacctcc

SEQ ID NO: 1540409 - DNA, 15 bp, Homo sapiens
ggacttcctggggcc

SEQ ID NO: 1540410 - DNA, 19 bp, Homo sapiens
ggacttcctgtccagctcc

SEQ ID NO: 1540411 - DNA, 23 bp, Homo sapiens
ggacttcctgtccagctccaacc

SEQ ID NO: 1540412 - DNA, 23 bp, Homo sapiens
ggacttctacctgccctcaaggg

SEQ ID NO: 1540413 - DNA, 16 bp, Homo sapiens
ggacttgatgttcctt

SEQ ID NO: 1540414 - DNA, 21 bp, Homo sapiens
ggacttgctaaagcactttgc

SEQ ID NO: 1540415 - DNA, 15 bp, Homo sapiens
ggacttgtatatttg

SEQ ID NO: 1540416 - DNA, 15 bp, Homo sapiens
ggacttgtatgctgc

SEQ ID NO: 1540417 - DNA, 15 bp, Homo sapiens
ggacttgtgattggc

SEQ ID NO: 1540418 - DNA, 20 bp, Homo sapiens
ggacttgtttagagagcctg

SEQ ID NO: 1540419 - DNA, 17 bp, Homo sapiens
ggacttgttttaatttt

SEQ ID NO: 1540420 - DNA, 16 bp, Homo sapiens
ggactttatttatttc

SEQ ID NO: 1540421 - DNA, 19 bp, Homo sapiens
ggacttttgatagttctat

SEQ ID NO: 1540422 - DNA, 11 bp, Homo sapiens
ggagaaaaaaa

SEQ ID NO: 1540423 - DNA, 16 bp, Homo sapiens
ggagaaaacccctccc

SEQ ID NO: 1540424 - DNA, 15 bp, Homo sapiens
ggagaaacagagaca

SEQ ID NO: 1540425 - DNA, 14 bp, Homo sapiens
ggagaaaccagctt

SEQ ID NO: 1540426 - DNA, 23 bp, Homo sapiens
ggagcagcttccttctgggactg

SEQ ID NO: 1540427 - DNA, 13 bp, Homo sapiens
ggagcaggaacaa

SEQ ID NO: 1540428 - DNA, 12 bp, Homo sapiens
ggagcaggagcc

SEQ ID NO: 1540429 - DNA, 16 bp, Homo sapiens
ggagcaggcacgggtg

SEQ ID NO: 1540430 - DNA, 17 bp, Homo sapiens
ggagcagtgtcttccat

SEQ ID NO: 1540431 - DNA, 22 bp, Homo sapiens
ggagcataactggagggtgggt

SEQ ID NO: 1540432 - DNA, 21 bp, Homo sapiens
ggagcatatgattgctccaga

SEQ ID NO: 1540433 - DNA, 16 bp, Homo sapiens
ggagcatctcttgagg

SEQ ID NO: 1540434 - DNA, 15 bp, Homo sapiens
ggagcatggacagtg

SEQ ID NO: 1540435 - DNA, 16 bp, Homo sapiens
ggagcatgggcctggc

SEQ ID NO: 1540436 - DNA, 20 bp, Homo sapiens
ggagcatttaatggcagcta

SEQ ID NO: 1540437 - DNA, 20 bp, Homo sapiens
ggagccaaatgaccgagccc

SEQ ID NO: 1540438 - DNA, 17 bp, Homo sapiens
ggagccaacaagaccgc

SEQ ID NO: 1540439 - DNA, 20 bp, Homo sapiens
ggagccaacagaagcttcca

SEQ ID NO: 1540440 - DNA, 23 bp, Homo sapiens
ggagccaagggttcagagactca

SEQ ID NO: 1540441 - DNA, 18 bp, Homo sapiens
ggagccaagtggtccagc

SEQ ID NO: 1540442 - DNA, 11 bp, Homo sapiens
ggagccactcc

SEQ ID NO: 1540443 - DNA, 16 bp, Homo sapiens
ggagccactcctgtcc

SEQ ID NO: 1540444 - DNA, 18 bp, Homo sapiens
ggagccactcctgtcccg

SEQ ID NO: 1540445 - DNA, 21 bp, Homo sapiens
ggagccagaattcactaggag

SEQ ID NO: 1540446 - DNA, 15 bp, Homo sapiens
ggagccagcctccct

SEQ ID NO: 1540447 - DNA, 15 bp, Homo sapiens
ggagccagctgcttg

SEQ ID NO: 1540448 - DNA, 23 bp, Homo sapiens
ggagccagctgcttgacctagct

SEQ ID NO: 1540449 - DNA, 21 bp, Homo sapiens
ggagccaggagtaagacaagt

SEQ ID NO: 1540450 - DNA, 13 bp, Homo sapiens
ggagccagggcag

SEQ ID NO: 1540451 - DNA, 13 bp, Homo sapiens
ggagccagggctg

SEQ ID NO: 1540452 - DNA, 22 bp, Homo sapiens
ggagccatcccttcggagccaa

SEQ ID NO: 1540453 - DNA, 23 bp, Homo sapiens
ggagccatcccttcggagccaac

SEQ ID NO: 1540454 - DNA, 23 bp, Homo sapiens
ggagccatgcgccccctccgccc

SEQ ID NO: 1540455 - DNA, 13 bp, Homo sapiens
ggagcccacaacc

SEQ ID NO: 1540456 - DNA, 20 bp, Homo sapiens
ggagcccactgtcctgggcc

SEQ ID NO: 1540457 - DNA, 15 bp, Homo sapiens
ggagcccagaaaacc

SEQ ID NO: 1540458 - DNA, 14 bp, Homo sapiens
ggagcccagaaccc

SEQ ID NO: 1540459 - DNA, 20 bp, Homo sapiens
ggagcccagcctgggagccc

SEQ ID NO: 1540460 - DNA, 12 bp, Homo sapiens
ggagccccacct

SEQ ID NO: 1540461 - DNA, 11 bp, Homo sapiens
ggagccccctc

SEQ ID NO: 1540462 - DNA, 17 bp, Homo sapiens
ggagcccctcctctgag

SEQ ID NO: 1540463 - DNA, 10 bp, Homo sapiens
ggagcccctg

SEQ ID NO: 1540464 - DNA, 11 bp, Homo sapiens
ggagcccctga

SEQ ID NO: 1540465 - DNA, 21 bp, Homo sapiens
ggagcccctgaaagcctcacg

SEQ ID NO: 1540466 - DNA, 13 bp, Homo sapiens
ggagcccctgggt

SEQ ID NO: 1540467 - DNA, 13 bp, Homo sapiens
ggagcccttgggt

SEQ ID NO: 1540468 - DNA, 21 bp, Homo sapiens
ggagccgagatcacgccactg

SEQ ID NO: 1540469 - DNA, 21 bp, Homo sapiens
ggagccgaggcctaccccgca

SEQ ID NO: 1540470 - DNA, 17 bp, Homo sapiens
ggagccggcggcctctc

SEQ ID NO: 1540471 - DNA, 14 bp, Homo sapiens
ggagccgggcctcc

SEQ ID NO: 1540472 - DNA, 23 bp, Homo sapiens
caacagagtgagaccctgtctct

SEQ ID NO: 1540473 - DNA, 14 bp, Homo sapiens
caacagatactgga

SEQ ID NO: 1540474 - DNA, 14 bp, Homo sapiens
caacagatctggaa

SEQ ID NO: 1540475 - DNA, 17 bp, Homo sapiens
caacagcaaacaggtgc

SEQ ID NO: 1540476 - DNA, 22 bp, Homo sapiens
caacagcacctccccgctggga

SEQ ID NO: 1540477 - DNA, 11 bp, Homo sapiens
caacagcactt

SEQ ID NO: 1540478 - DNA, 14 bp, Homo sapiens
caacagcagtctcc

SEQ ID NO: 1540479 - DNA, 15 bp, Homo sapiens
caacagctcaagtct

SEQ ID NO: 1540480 - DNA, 22 bp, Homo sapiens
caacagctcaagtcttccctga

SEQ ID NO: 1540481 - DNA, 13 bp, Homo sapiens
caacagcttccct

SEQ ID NO: 1540482 - DNA, 20 bp, Homo sapiens
caacagggagcacctgtctg

SEQ ID NO: 1540483 - DNA, 15 bp, Homo sapiens
caacaggggaaacta

SEQ ID NO: 1540484 - DNA, 21 bp, Homo sapiens
caacaggggaggaaaaaagaa

SEQ ID NO: 1540485 - DNA, 22 bp, Homo sapiens
caacagttctgagctgtaattt

SEQ ID NO: 1540486 - DNA, 22 bp, Homo sapiens
caacagttgtatgtttgctgat

SEQ ID NO: 1540487 - DNA, 16 bp, Homo sapiens
caacataatctagttt

SEQ ID NO: 1540488 - DNA, 14 bp, Homo sapiens
caacatatagttga

SEQ ID NO: 1540489 - DNA, 14 bp, Homo sapiens
caacatatatttat

SEQ ID NO: 1540490 - DNA, 17 bp, Homo sapiens
caacatatatttattga

SEQ ID NO: 1540491 - DNA, 20 bp, Homo sapiens
caacatatatttattgagta

SEQ ID NO: 1540492 - DNA, 22 bp, Homo sapiens
caacatcactaatttggctttc

SEQ ID NO: 1540493 - DNA, 15 bp, Homo sapiens
caacatcccattgcc

SEQ ID NO: 1540494 - DNA, 15 bp, Homo sapiens
caacatgaaactgcc

SEQ ID NO: 1540495 - DNA, 13 bp, Homo sapiens
caacatgaggaca

SEQ ID NO: 1540496 - DNA, 20 bp, Homo sapiens
caacatgaggacagaaggac

SEQ ID NO: 1540497 - DNA, 22 bp, Homo sapiens
caacatgaggacagaaggactg

SEQ ID NO: 1540498 - DNA, 17 bp, Homo sapiens
caacatgttactgacca

SEQ ID NO: 1540499 - DNA, 20 bp, Homo sapiens
caacatgttactgaccagca

SEQ ID NO: 1540500 - DNA, 23 bp, Homo sapiens
caacatgttgggaaacttggctc

SEQ ID NO: 1540501 - DNA, 18 bp, Homo sapiens
caacattatgatctaata

SEQ ID NO: 1540502 - DNA, 20 bp, Homo sapiens
caacattatgatctaataaa

SEQ ID NO: 1540503 - DNA, 22 bp, Homo sapiens
caacattatgatctaataaact

SEQ ID NO: 1540504 - DNA, 23 bp, Homo sapiens
caacattatgatctaataaactt

SEQ ID NO: 1540505 - DNA, 15 bp, Homo sapiens
caacatttattttga

SEQ ID NO: 1540506 - DNA, 18 bp, Homo sapiens
caaccaagatgcaaatgt

SEQ ID NO: 1540507 - DNA, 23 bp, Homo sapiens
caaccaagatgcaaatgttttga

SEQ ID NO: 1540508 - DNA, 18 bp, Homo sapiens
caaccaaggaatttaaaa

SEQ ID NO: 1540509 - DNA, 16 bp, Homo sapiens
caaccaatgtagaaag

SEQ ID NO: 1540510 - DNA, 21 bp, Homo sapiens
caaccactaagaattcaaact

SEQ ID NO: 1540511 - DNA, 17 bp, Homo sapiens
caaccactgtaaaatga

SEQ ID NO: 1540512 - DNA, 19 bp, Homo sapiens
caaccactgtaaaatgaaa

SEQ ID NO: 1540513 - DNA, 21 bp, Homo sapiens
caaccactgtaaaatgaaatt

SEQ ID NO: 1540514 - DNA, 14 bp, Homo sapiens
caaccactgtgcca

SEQ ID NO: 1540515 - DNA, 12 bp, Homo sapiens
caaccactgtgg

SEQ ID NO: 1540516 - DNA, 14 bp, Homo sapiens
caaccactgtggcg

SEQ ID NO: 1540517 - DNA, 23 bp, Homo sapiens
caaccactgtggcgttctgctgc

SEQ ID NO: 1540518 - DNA, 14 bp, Homo sapiens
caaccagaaaggga

SEQ ID NO: 1540519 - DNA, 20 bp, Homo sapiens
caaccagagtcacccagttg

SEQ ID NO: 1540520 - DNA, 12 bp, Homo sapiens
caaccagccagc

SEQ ID NO: 1540521 - DNA, 12 bp, Homo sapiens
caaccaggaaga

SEQ ID NO: 1540522 - DNA, 19 bp, Homo sapiens
caaccaggcacctcttcct

SEQ ID NO: 1540523 - DNA, 14 bp, Homo sapiens
caaccatagaactg

SEQ ID NO: 1540524 - DNA, 18 bp, Homo sapiens
caaccatgagaccactgt

SEQ ID NO: 1540525 - DNA, 16 bp, Homo sapiens
caaccatgtcatttca

SEQ ID NO: 1540526 - DNA, 17 bp, Homo sapiens
caaccattaaagtcaga

SEQ ID NO: 1540527 - DNA, 23 bp, Homo sapiens
caaccattagataaacacaggca

SEQ ID NO: 1540528 - DNA, 13 bp, Homo sapiens
caaccattccaga

SEQ ID NO: 1540529 - DNA, 14 bp, Homo sapiens
caaccattccagac

SEQ ID NO: 1540530 - DNA, 16 bp, Homo sapiens
caaccattccagactg

SEQ ID NO: 1540531 - DNA, 22 bp, Homo sapiens
caaccattccagactgcttcca

SEQ ID NO: 1540532 - DNA, 17 bp, Homo sapiens
caaccatttatcttgaa

SEQ ID NO: 1540533 - DNA, 17 bp, Homo sapiens
caacccaataggagtct

SEQ ID NO: 1540534 - DNA, 12 bp, Homo sapiens
caacccacagct

SEQ ID NO: 1540535 - DNA, 14 bp, Homo sapiens
caacccacagctca

SEQ ID NO: 1540536 - DNA, 18 bp, Homo sapiens
caacccacagctcagctg

SEQ ID NO: 1540537 - DNA, 13 bp, Homo sapiens
caacccacatggg

SEQ ID NO: 1540538 - DNA, 23 bp, Homo sapiens
caacccaccacaacaagcaagtg

SEQ ID NO: 1540539 - DNA, 12 bp, Homo sapiens
caacccagccac

SEQ ID NO: 1540540 - DNA, 19 bp, Homo sapiens
caacccagtgggtctggga

SEQ ID NO: 1540541 - DNA, 21 bp, Homo sapiens
caaccccagggcccccacagg

SEQ ID NO: 1540542 - DNA, 23 bp, Homo sapiens
caaccccagggcccccacaggcc

SEQ ID NO: 1540543 - DNA, 14 bp, Homo sapiens
caacccccacccca

SEQ ID NO: 1540544 - DNA, 15 bp, Homo sapiens
caacccccatctccc

SEQ ID NO: 1540545 - DNA, 16 bp, Homo sapiens
caacccccatttctat

SEQ ID NO: 1540546 - DNA, 13 bp, Homo sapiens
caaccccccagct

SEQ ID NO: 1540547 - DNA, 13 bp, Homo sapiens
caacccccctcct

SEQ ID NO: 1540548 - DNA, 14 bp, Homo sapiens
caacccccctcctg

SEQ ID NO: 1540549 - DNA, 21 bp, Homo sapiens
caacccccctcctgctcctcc

SEQ ID NO: 1540550 - DNA, 23 bp, Homo sapiens
caacccccgccacctcagggcac

SEQ ID NO: 1540551 - DNA, 21 bp, Homo sapiens
caaccccgcggtgctctggcg

SEQ ID NO: 1540552 - DNA, 22 bp, Homo sapiens
caacccctgacctaccccagcc

SEQ ID NO: 1540553 - DNA, 16 bp, Homo sapiens
caacccgaggcccgca

SEQ ID NO: 1540554 - DNA, 20 bp, Homo sapiens
caacccgtctggcccaccag

SEQ ID NO: 1540555 - DNA, 22 bp, Homo sapiens
caacccgtttcccggttcagga

SEQ ID NO: 1540556 - DNA, 12 bp, Homo sapiens
caaccctaccct

SEQ ID NO: 1540557 - DNA, 15 bp, Homo sapiens
caaccctaccctggc

SEQ ID NO: 1540558 - DNA, 19 bp, Homo sapiens
caaccctaccctggcaggg

SEQ ID NO: 1540559 - DNA, 16 bp, Homo sapiens
caaccctatctcctga

SEQ ID NO: 1540560 - DNA, 19 bp, Homo sapiens
caaccctatctcctgacag

SEQ ID NO: 1540561 - DNA, 14 bp, Homo sapiens
caaccctcagcctt

SEQ ID NO: 1540562 - DNA, 16 bp, Homo sapiens
caaccctcagccttga

SEQ ID NO: 1540563 - DNA, 13 bp, Homo sapiens
caaccctgtgggc

SEQ ID NO: 1540564 - DNA, 16 bp, Homo sapiens
caaccctgtgggctta

SEQ ID NO: 1540565 - DNA, 19 bp, Homo sapiens
caaccctgttttatactgt

SEQ ID NO: 1540566 - DNA, 20 bp, Homo sapiens
caacccttaccccttagcct

SEQ ID NO: 1540567 - DNA, 22 bp, Homo sapiens
caacccttaccccttagcctcc

SEQ ID NO: 1540568 - DNA, 14 bp, Homo sapiens
caaccgagaaggtt

SEQ ID NO: 1540569 - DNA, 18 bp, Homo sapiens
caacctaacccctttcct

SEQ ID NO: 1540570 - DNA, 14 bp, Homo sapiens
caacctaagcaaca

SEQ ID NO: 1540571 - DNA, 14 bp, Homo sapiens
caacctactgtcta

SEQ ID NO: 1540572 - DNA, 17 bp, Homo sapiens
caacctactgtctaagc

SEQ ID NO: 1540573 - DNA, 21 bp, Homo sapiens
caacctactgtctaagcagtt

SEQ ID NO: 1540574 - DNA, 14 bp, Homo sapiens
caacctagaatgtc

SEQ ID NO: 1540575 - DNA, 18 bp, Homo sapiens
caacctcaactgcctact

SEQ ID NO: 1540576 - DNA, 20 bp, Homo sapiens
caacctcaatgccctgccat

SEQ ID NO: 1540577 - DNA, 21 bp, Homo sapiens
caacctcaatgccctgccatt

SEQ ID NO: 1540578 - DNA, 18 bp, Homo sapiens
caacctcacctcccgggt

SEQ ID NO: 1540579 - DNA, 11 bp, Homo sapiens
caacctcactt

SEQ ID NO: 1540580 - DNA, 18 bp, Homo sapiens
caacctcagggctcccag

SEQ ID NO: 1540581 - DNA, 20 bp, Homo sapiens
caacctccgcatccggggtt

SEQ ID NO: 1540582 - DNA, 16 bp, Homo sapiens
caacctcctgctctgg

SEQ ID NO: 1540583 - DNA, 18 bp, Homo sapiens
caacctcctgctctggga

SEQ ID NO: 1540584 - DNA, 21 bp, Homo sapiens
caacctctctgatcttgtgct

SEQ ID NO: 1540585 - DNA, 23 bp, Homo sapiens
caacctctctgatcttgtgctca

SEQ ID NO: 1540586 - DNA, 18 bp, Homo sapiens
caacctcttctggctcaa

SEQ ID NO: 1540587 - DNA, 16 bp, Homo sapiens
caacctgaaatttatt

SEQ ID NO: 1540588 - DNA, 15 bp, Homo sapiens
gctctcctcccgccc

SEQ ID NO: 1540589 - DNA, 11 bp, Homo sapiens
gctctcctgga

SEQ ID NO: 1540590 - DNA, 19 bp, Homo sapiens
gctctcgcacacctctgca

SEQ ID NO: 1540591 - DNA, 15 bp, Homo sapiens
gctctctaggcctct

SEQ ID NO: 1540592 - DNA, 10 bp, Homo sapiens
gctctctctc

SEQ ID NO: 1540593 - DNA, 17 bp, Homo sapiens
gctctctgacgcttgtg

SEQ ID NO: 1540594 - DNA, 13 bp, Homo sapiens
gctctctgcagcc

SEQ ID NO: 1540595 - DNA, 20 bp, Homo sapiens
gctctctgcatctactccca

SEQ ID NO: 1540596 - DNA, 15 bp, Homo sapiens
gctctctgccctgtg

SEQ ID NO: 1540597 - DNA, 11 bp, Homo sapiens
gctctctggga

SEQ ID NO: 1540598 - DNA, 16 bp, Homo sapiens
gctctctgggcctggg

SEQ ID NO: 1540599 - DNA, 21 bp, Homo sapiens
gctctctgtaggcacagagct

SEQ ID NO: 1540600 - DNA, 14 bp, Homo sapiens
caacgaagaaaaaa

SEQ ID NO: 1540601 - DNA, 19 bp, Homo sapiens
caacgaagccggacacggc

SEQ ID NO: 1540602 - DNA, 14 bp, Homo sapiens
caacgcattgccac

SEQ ID NO: 1540603 - DNA, 13 bp, Homo sapiens
caacgcccctcca

SEQ ID NO: 1540604 - DNA, 22 bp, Homo sapiens
caacgcccctccaaacctccag

SEQ ID NO: 1540605 - DNA, 14 bp, Homo sapiens
caacgcccctgtgg

SEQ ID NO: 1540606 - DNA, 19 bp, Homo sapiens
caacgcccctgtggccaac

SEQ ID NO: 1540607 - DNA, 22 bp, Homo sapiens
caacgccgccttggccttgcag

SEQ ID NO: 1540608 - DNA, 16 bp, Homo sapiens
caacgcctccccctcc

SEQ ID NO: 1540609 - DNA, 23 bp, Homo sapiens
caacgcttgtagaactcactctg

SEQ ID NO: 1540610 - DNA, 21 bp, Homo sapiens
caacgggaccccctggccctg

SEQ ID NO: 1540611 - DNA, 21 bp, Homo sapiens
caacgggattgaagggtcctg

SEQ ID NO: 1540612 - DNA, 14 bp, Homo sapiens
caacgtcccctccg

SEQ ID NO: 1540613 - DNA, 17 bp, Homo sapiens
caacgtgagagaaagag

SEQ ID NO: 1540614 - DNA, 14 bp, Homo sapiens
caacgtgcaaagcc

SEQ ID NO: 1540615 - DNA, 18 bp, Homo sapiens
caacgtgcaaagccaagg

SEQ ID NO: 1540616 - DNA, 17 bp, Homo sapiens
caacgtggacctgccta

SEQ ID NO: 1540617 - DNA, 21 bp, Homo sapiens
caacgtgtaaccagttataaa

SEQ ID NO: 1540618 - DNA, 14 bp, Homo sapiens
caactaagccctcg

SEQ ID NO: 1540619 - DNA, 13 bp, Homo sapiens
caactactaatag

SEQ ID NO: 1540620 - DNA, 22 bp, Homo sapiens
caactactactggtgatgccta

SEQ ID NO: 1540621 - DNA, 12 bp, Homo sapiens
caactagatttg

SEQ ID NO: 1540622 - DNA, 14 bp, Homo sapiens
caactagatttgtc

SEQ ID NO: 1540623 - DNA, 18 bp, Homo sapiens
caactagatttgtccttt

SEQ ID NO: 1540624 - DNA, 18 bp, Homo sapiens
caactattatgattattt

SEQ ID NO: 1540625 - DNA, 20 bp, Homo sapiens
caactatttttccaaaataa

SEQ ID NO: 1540626 - DNA, 13 bp, Homo sapiens
caactatttttgt

SEQ ID NO: 1540627 - DNA, 20 bp, Homo sapiens
caactcacagcttctccaag

SEQ ID NO: 1540628 - DNA, 20 bp, Homo sapiens
caactccagcaacttcttct

SEQ ID NO: 1540629 - DNA, 21 bp, Homo sapiens
caactccatggggttcgagac

SEQ ID NO: 1540630 - DNA, 14 bp, Homo sapiens
caactcctaatttt

SEQ ID NO: 1540631 - DNA, 18 bp, Homo sapiens
caactccttttactgcgt

SEQ ID NO: 1540632 - DNA, 14 bp, Homo sapiens
caactcgctttagg

SEQ ID NO: 1540633 - DNA, 15 bp, Homo sapiens
caactctacccctgc

SEQ ID NO: 1540634 - DNA, 16 bp, Homo sapiens
caactctacccctgct

SEQ ID NO: 1540635 - DNA, 15 bp, Homo sapiens
caactctccccagtg

SEQ ID NO: 1540636 - DNA, 19 bp, Homo sapiens
caactctccccagtgcctg

SEQ ID NO: 1540637 - DNA, 22 bp, Homo sapiens
caactctccccagtgcctgcca

SEQ ID NO: 1540638 - DNA, 13 bp, Homo sapiens
caactctgagccc

SEQ ID NO: 1540639 - DNA, 12 bp, Homo sapiens
caactctgcact

SEQ ID NO: 1540640 - DNA, 15 bp, Homo sapiens
caactctgcactcca

SEQ ID NO: 1540641 - DNA, 13 bp, Homo sapiens
caactctgccttt

SEQ ID NO: 1540642 - DNA, 21 bp, Homo sapiens
caactctggctccaggcagaa

SEQ ID NO: 1540643 - DNA, 19 bp, Homo sapiens
caactcttttaagtgcctt

SEQ ID NO: 1540644 - DNA, 13 bp, Homo sapiens
caactgaaaagac

SEQ ID NO: 1540645 - DNA, 20 bp, Homo sapiens
caactgaacaaaagctcagg

SEQ ID NO: 1540646 - DNA, 21 bp, Homo sapiens
caactgaaggggtgcacccac

SEQ ID NO: 1540647 - DNA, 18 bp, Homo sapiens
caactgaatgaggtcagc

SEQ ID NO: 1540648 - DNA, 13 bp, Homo sapiens
caactgacacagg

SEQ ID NO: 1540649 - DNA, 20 bp, Homo sapiens
caactgagggccagggaccc

SEQ ID NO: 1540650 - DNA, 15 bp, Homo sapiens
caactgaggtaacct

SEQ ID NO: 1540651 - DNA, 14 bp, Homo sapiens
caactgatctgtta

SEQ ID NO: 1540652 - DNA, 15 bp, Homo sapiens
caactgatctgttat

SEQ ID NO: 1540653 - DNA, 18 bp, Homo sapiens
caactgcaaaaaaagcct

SEQ ID NO: 1540654 - DNA, 19 bp, Homo sapiens
caactgcaaagaaagtggg

SEQ ID NO: 1540655 - DNA, 18 bp, Homo sapiens
caactgcacatgaaagtt

SEQ ID NO: 1540656 - DNA, 16 bp, Homo sapiens
caactgccaggctgcc

SEQ ID NO: 1540657 - DNA, 12 bp, Homo sapiens
caactgccctaa

SEQ ID NO: 1540658 - DNA, 22 bp, Homo sapiens
caactgccctaagcccccaggg

SEQ ID NO: 1540659 - DNA, 14 bp, Homo sapiens
caactgcccttcca

SEQ ID NO: 1540660 - DNA, 17 bp, Homo sapiens
caactgctcagctctgg

SEQ ID NO: 1540661 - DNA, 18 bp, Homo sapiens
caactgctcagctctggt

SEQ ID NO: 1540662 - DNA, 17 bp, Homo sapiens
caactgctgttttatgt

SEQ ID NO: 1540663 - DNA, 16 bp, Homo sapiens
caactggagttcctta

SEQ ID NO: 1540664 - DNA, 12 bp, Homo sapiens
caactggcttct

SEQ ID NO: 1540665 - DNA, 18 bp, Homo sapiens
caactgggcatttcaatc

SEQ ID NO: 1540666 - DNA, 15 bp, Homo sapiens
caactgtatatattc

SEQ ID NO: 1540667 - DNA, 16 bp, Homo sapiens
caactgtcttcctcaa

SEQ ID NO: 1540668 - DNA, 23 bp, Homo sapiens
caactgtggtagctccagcgatg

SEQ ID NO: 1540669 - DNA, 16 bp, Homo sapiens
caactgtttccctgct

SEQ ID NO: 1540670 - DNA, 16 bp, Homo sapiens
caacttaacatgggct

SEQ ID NO: 1540671 - DNA, 21 bp, Homo sapiens
caacttaatgttctgaataat

SEQ ID NO: 1540672 - DNA, 13 bp, Homo sapiens
caacttagctcag

SEQ ID NO: 1540673 - DNA, 14 bp, Homo sapiens
caacttagctcagg

SEQ ID NO: 1540674 - DNA, 17 bp, Homo sapiens
caacttagctcaggtgc

SEQ ID NO: 1540675 - DNA, 19 bp, Homo sapiens
caacttagctcaggtgcct

SEQ ID NO: 1540676 - DNA, 19 bp, Homo sapiens
caacttattctttgagtaa

SEQ ID NO: 1540677 - DNA, 14 bp, Homo sapiens
caacttatttaaaa

SEQ ID NO: 1540678 - DNA, 17 bp, Homo sapiens
caacttatttaaaaata

SEQ ID NO: 1540679 - DNA, 20 bp, Homo sapiens
caacttatttaaaaatattt

SEQ ID NO: 1540680 - DNA, 16 bp, Homo sapiens
caacttcaccaccccc

SEQ ID NO: 1540681 - DNA, 17 bp, Homo sapiens
caacttcaccaccccct

SEQ ID NO: 1540682 - DNA, 19 bp, Homo sapiens
caacttccaaagggttagg

SEQ ID NO: 1540683 - DNA, 19 bp, Homo sapiens
caacttcctcccttacaga

SEQ ID NO: 1540684 - DNA, 20 bp, Homo sapiens
caacttctttttattttctt

SEQ ID NO: 1540685 - DNA, 15 bp, Homo sapiens
caacttgacaccact

SEQ ID NO: 1540686 - DNA, 18 bp, Homo sapiens
caacttgagtctttgaag

SEQ ID NO: 1540687 - DNA, 16 bp, Homo sapiens
caacttgcctttgaag

SEQ ID NO: 1540688 - DNA, 19 bp, Homo sapiens
caacttgcctttgaagagt

SEQ ID NO: 1540689 - DNA, 18 bp, Homo sapiens
caacttggttctgcttca

SEQ ID NO: 1540690 - DNA, 24 bp, Homo sapiens
caactttagctagtatcttcaaac

SEQ ID NO: 1540691 - DNA, 12 bp, Homo sapiens
caactttatacc

SEQ ID NO: 1540692 - DNA, 15 bp, Homo sapiens
caactttcacagtga

SEQ ID NO: 1540693 - DNA, 19 bp, Homo sapiens
caactttgtaaaaatcttt

SEQ ID NO: 1540694 - DNA, 23 bp, Homo sapiens
caacttttcttggaactgtccca

SEQ ID NO: 1540695 - DNA, 16 bp, Homo sapiens
caagaaacagtttctt

SEQ ID NO: 1540696 - DNA, 16 bp, Homo sapiens
caagaaacctgactca

SEQ ID NO: 1540697 - DNA, 13 bp, Homo sapiens
caagaaactgaat

SEQ ID NO: 1540698 - DNA, 19 bp, Homo sapiens
caagaaagaaatggctttt

SEQ ID NO: 1540699 - DNA, 15 bp, Homo sapiens
caagaaaggcagaca

SEQ ID NO: 1540700 - DNA, 19 bp, Homo sapiens
caagaaaggcagacacacc

SEQ ID NO: 1540701 - DNA, 20 bp, Homo sapiens
caagaaatatactctcccag

SEQ ID NO: 1540702 - DNA, 16 bp, Homo sapiens
caagaacaagcaatga

SEQ ID NO: 1540703 - DNA, 19 bp, Homo sapiens
caagaacccaagtgcctca

SEQ ID NO: 1540704 - DNA, 19 bp, Homo sapiens
caagaactctaaccagtgt

SEQ ID NO: 1540705 - DNA, 12 bp, Homo sapiens
caagaactgcat

SEQ ID NO: 1540706 - DNA, 19 bp, Homo sapiens
caagaactgcatggaccta

SEQ ID NO: 1540707 - DNA, 21 bp, Homo sapiens
caaagagaaaaagaaatgcaa

SEQ ID NO: 1540708 - DNA, 21 bp, Homo sapiens
caaagagaaatcacaggggcg

SEQ ID NO: 1540709 - DNA, 19 bp, Homo sapiens
caaagagagaaaataaaga

SEQ ID NO: 1540710 - DNA, 14 bp, Homo sapiens
caaagagattcgaa

SEQ ID NO: 1540711 - DNA, 17 bp, Homo sapiens
caaagagcctttccaaa

SEQ ID NO: 1540712 - DNA, 22 bp, Homo sapiens
caaagagcgagtcccctgcccg

SEQ ID NO: 1540713 - DNA, 23 bp, Homo sapiens
caaagagcgagtcccctgcccgg

SEQ ID NO: 1540714 - DNA, 12 bp, Homo sapiens
caaagaggctgc

SEQ ID NO: 1540715 - DNA, 13 bp, Homo sapiens
caaagaggctgcc

SEQ ID NO: 1540716 - DNA, 16 bp, Homo sapiens
caaagaggctgcccct

SEQ ID NO: 1540717 - DNA, 21 bp, Homo sapiens
caaagaggctgcccctctcac

SEQ ID NO: 1540718 - DNA, 15 bp, Homo sapiens
caaagagggatgttt

SEQ ID NO: 1540719 - DNA, 16 bp, Homo sapiens
caaagaggtatttatc

SEQ ID NO: 1540720 - DNA, 22 bp, Homo sapiens
caaagaggtgaacattaaaata

SEQ ID NO: 1540721 - DNA, 16 bp, Homo sapiens
caaagaggttggagca

SEQ ID NO: 1540722 - DNA, 21 bp, Homo sapiens
caaagataaaaggtttctttt

SEQ ID NO: 1540723 - DNA, 22 bp, Homo sapiens
caaagataaaaggtttcttttt

SEQ ID NO: 1540724 - DNA, 17 bp, Homo sapiens
caaagatagacaggtcc

SEQ ID NO: 1540725 - DNA, 12 bp, Homo sapiens
caaagatcactt

SEQ ID NO: 1540726 - DNA, 22 bp, Homo sapiens
caaagatgcattttgagtgttt

SEQ ID NO: 1540727 - DNA, 16 bp, Homo sapiens
caaagatgctgtgagt

SEQ ID NO: 1540728 - DNA, 18 bp, Homo sapiens
caaagatgtttgtcagat

SEQ ID NO: 1540729 - DNA, 22 bp, Homo sapiens
caaagatgtttgtcagatatga

SEQ ID NO: 1540730 - DNA, 13 bp, Homo sapiens
caaagattgagaa

SEQ ID NO: 1540731 - DNA, 14 bp, Homo sapiens
caaagattgagaag

SEQ ID NO: 1540732 - DNA, 12 bp, Homo sapiens
caaagcaaagaa

SEQ ID NO: 1540733 - DNA, 16 bp, Homo sapiens
caaagcaaatttctat

SEQ ID NO: 1540734 - DNA, 19 bp, Homo sapiens
caaagcaacaaattaacta

SEQ ID NO: 1540735 - DNA, 15 bp, Homo sapiens
caaagcaagggctcc

SEQ ID NO: 1540736 - DNA, 17 bp, Homo sapiens
caaagcacattgaaaga

SEQ ID NO: 1540737 - DNA, 22 bp, Homo sapiens
caaagcacgaaatgttattttt

SEQ ID NO: 1540738 - DNA, 20 bp, Homo sapiens
caaagcactgacttctaagt

SEQ ID NO: 1540739 - DNA, 22 bp, Homo sapiens
caaagcactgacttctaagtaa

SEQ ID NO: 1540740 - DNA, 19 bp, Homo sapiens
caaagcacttttaaaaaaa

SEQ ID NO: 1540741 - DNA, 18 bp, Homo sapiens
caaagcagaagtctggct

SEQ ID NO: 1540742 - DNA, 14 bp, Homo sapiens
caaagcataaaact

SEQ ID NO: 1540743 - DNA, 17 bp, Homo sapiens
caaagcatggacattta

SEQ ID NO: 1540744 - DNA, 14 bp, Homo sapiens
caaagcatggacta

SEQ ID NO: 1540745 - DNA, 15 bp, Homo sapiens
caaagccaaggcagc

SEQ ID NO: 1540746 - DNA, 22 bp, Homo sapiens
caaagccaaggcagcgacccca

SEQ ID NO: 1540747 - DNA, 16 bp, Homo sapiens
caaagccactggaagg

SEQ ID NO: 1540748 - DNA, 18 bp, Homo sapiens
caaagccactggaaggag

SEQ ID NO: 1540749 - DNA, 12 bp, Homo sapiens
caaagccctgcc

SEQ ID NO: 1540750 - DNA, 14 bp, Homo sapiens
caaagccctgcctc

SEQ ID NO: 1540751 - DNA, 15 bp, Homo sapiens
caaagccctgcctct

SEQ ID NO: 1540752 - DNA, 12 bp, Homo sapiens
caaagccctgtc

SEQ ID NO: 1540753 - DNA, 14 bp, Homo sapiens
caaagccctgtcct

SEQ ID NO: 1540754 - DNA, 15 bp, Homo sapiens
caaagccctgtcctt

SEQ ID NO: 1540755 - DNA, 23 bp, Homo sapiens
caaagcctagacaacctttctgt

SEQ ID NO: 1540756 - DNA, 16 bp, Homo sapiens
caaagcgcccacccag

SEQ ID NO: 1540757 - DNA, 15 bp, Homo sapiens
caaagcgtttcttta

SEQ ID NO: 1540758 - DNA, 20 bp, Homo sapiens
caaagctaaaaaattgttaa

SEQ ID NO: 1540759 - DNA, 13 bp, Homo sapiens
caaagctaggatg

SEQ ID NO: 1540760 - DNA, 18 bp, Homo sapiens
caaagctaggatggttct

SEQ ID NO: 1540761 - DNA, 14 bp, Homo sapiens
caaagctcaaagta

SEQ ID NO: 1540762 - DNA, 23 bp, Homo sapiens
caaagctcaagatgacagctctt

SEQ ID NO: 1540763 - DNA, 13 bp, Homo sapiens
caaagctgagcct

SEQ ID NO: 1540764 - DNA, 23 bp, Homo sapiens
caaagctgagcctgcagggaagc

SEQ ID NO: 1540765 - DNA, 21 bp, Homo sapiens
caaagctgagttacttgtctg

SEQ ID NO: 1540766 - DNA, 16 bp, Homo sapiens
caaagctggctcacct

SEQ ID NO: 1540767 - DNA, 17 bp, Homo sapiens
caaagctggctcacctt

SEQ ID NO: 1540768 - DNA, 20 bp, Homo sapiens
caaagcttctatcccaggag

SEQ ID NO: 1540769 - DNA, 16 bp, Homo sapiens
caaagcttgttaagat

SEQ ID NO: 1540770 - DNA, 16 bp, Homo sapiens
caaagctttactactg

SEQ ID NO: 1540771 - DNA, 17 bp, Homo sapiens
caaagctttactactgt

SEQ ID NO: 1540772 - DNA, 23 bp, Homo sapiens
caaagctttcctgccccaggcct

SEQ ID NO: 1540773 - DNA, 13 bp, Homo sapiens
caaagctttgcta

SEQ ID NO: 1540774 - DNA, 16 bp, Homo sapiens
caaagctttttccaga

SEQ ID NO: 1540775 - DNA, 23 bp, Homo sapiens
caaaggaaagagcagtctatcat

SEQ ID NO: 1540776 - DNA, 24 bp, Homo sapiens
caaaggaactttctggtcccttca

SEQ ID NO: 1540777 - DNA, 21 bp, Homo sapiens
caaaggaaggaccctgaggcc

SEQ ID NO: 1540778 - DNA, 19 bp, Homo sapiens
caaaggaatctccagtttt

SEQ ID NO: 1540779 - DNA, 17 bp, Homo sapiens
caaaggagctttctcaa

SEQ ID NO: 1540780 - DNA, 17 bp, Homo sapiens
caaaggaggctggcagg

SEQ ID NO: 1540781 - DNA, 19 bp, Homo sapiens
caaaggatgggggaaagaa

SEQ ID NO: 1540782 - DNA, 20 bp, Homo sapiens
caaaggatgggggaaagaag

SEQ ID NO: 1540783 - DNA, 21 bp, Homo sapiens
caaaggcattataaaaagaat

SEQ ID NO: 1540784 - DNA, 17 bp, Homo sapiens
caaaggccccagcatct

SEQ ID NO: 1540785 - DNA, 23 bp, Homo sapiens
caaaggccctcagtgagataaat

SEQ ID NO: 1540786 - DNA, 21 bp, Homo sapiens
caaaggcggggtggcggtgga

SEQ ID NO: 1540787 - DNA, 15 bp, Homo sapiens
caaaggctccctcgc

SEQ ID NO: 1540788 - DNA, 16 bp, Homo sapiens
caaaggctccctcgcc

SEQ ID NO: 1540789 - DNA, 22 bp, Homo sapiens
caaagggaccaggggagaggca

SEQ ID NO: 1540790 - DNA, 24 bp, Homo sapiens
caaagggagagaaaagctggacct

SEQ ID NO: 1540791 - DNA, 20 bp, Homo sapiens
caaagggcagccctccactt

SEQ ID NO: 1540792 - DNA, 13 bp, Homo sapiens
caaagggcagttt

SEQ ID NO: 1540793 - DNA, 13 bp, Homo sapiens
caaagggcctcct

SEQ ID NO: 1540794 - DNA, 14 bp, Homo sapiens
caaagggcctcctc

SEQ ID NO: 1540795 - DNA, 15 bp, Homo sapiens
caaagggcctcctca

SEQ ID NO: 1540796 - DNA, 13 bp, Homo sapiens
caaaggggacagc

SEQ ID NO: 1540797 - DNA, 16 bp, Homo sapiens
caaaggggctgctggg

SEQ ID NO: 1540798 - DNA, 21 bp, Homo sapiens
caaagggtgaagctatttatc

SEQ ID NO: 1540799 - DNA, 13 bp, Homo sapiens
caaaggtgcctca

SEQ ID NO: 1540800 - DNA, 19 bp, Homo sapiens
caaaggtggaataaacatt

SEQ ID NO: 1540801 - DNA, 20 bp, Homo sapiens
caaaggtggtaaattcagac

SEQ ID NO: 1540802 - DNA, 21 bp, Homo sapiens
caaaggtggtaaattcagaca

SEQ ID NO: 1540803 - DNA, 17 bp, Homo sapiens
caaaggtttggaaggag

SEQ ID NO: 1540804 - DNA, 19 bp, Homo sapiens
caaaggtttggaaggagca

SEQ ID NO: 1540805 - DNA, 21 bp, Homo sapiens
caaaggtttggaaggagcaga

SEQ ID NO: 1540806 - DNA, 21 bp, Homo sapiens
caaagtaaaaaattaaagccc

SEQ ID NO: 1540807 - DNA, 16 bp, Homo sapiens
caaagtaaaacttgct

SEQ ID NO: 1540808 - DNA, 14 bp, Homo sapiens
caaagtaaaatgaa

SEQ ID NO: 1540809 - DNA, 23 bp, Homo sapiens
caaagtagattcttacaaggccc

SEQ ID NO: 1540810 - DNA, 16 bp, Homo sapiens
caaagtaggattttga

SEQ ID NO: 1540811 - DNA, 13 bp, Homo sapiens
caaagtataacca

SEQ ID NO: 1540812 - DNA, 19 bp, Homo sapiens
caaagtatcaggacgagaa

SEQ ID NO: 1540813 - DNA, 19 bp, Homo sapiens
caaagtatctaacaaaacc

SEQ ID NO: 1540814 - DNA, 16 bp, Homo sapiens
caaagtcacaggaaga

SEQ ID NO: 1540815 - DNA, 16 bp, Homo sapiens
caaagtcctctgctcc

SEQ ID NO: 1540816 - DNA, 13 bp, Homo sapiens
caaagtctccagc

SEQ ID NO: 1540817 - DNA, 14 bp, Homo sapiens
caaagtctccagcc

SEQ ID NO: 1540818 - DNA, 12 bp, Homo sapiens
caaagtctctaa

SEQ ID NO: 1540819 - DNA, 20 bp, Homo sapiens
caaagtgatagaaaagtgtg

SEQ ID NO: 1540820 - DNA, 15 bp, Homo sapiens
caaagtgctgagatt

SEQ ID NO: 1540821 - DNA, 17 bp, Homo sapiens
caaatgggactgatgtc

SEQ ID NO: 1540822 - DNA, 20 bp, Homo sapiens
caaatgggactgatgtcatc

SEQ ID NO: 1540823 - DNA, 21 bp, Homo sapiens
caaatgggactgatgtcatct

SEQ ID NO: 1540824 - DNA, 19 bp, Homo sapiens
caaatggggccagatccag

SEQ ID NO: 1540825 - DNA, 23 bp, Homo sapiens
caaatggggccagatccagcctg

SEQ ID NO: 1540826 - DNA, 16 bp, Homo sapiens
caaatgtcagatacaa

SEQ ID NO: 1540827 - DNA, 22 bp, Homo sapiens
caaatgtgaaacggaagctcat

SEQ ID NO: 1540828 - DNA, 22 bp, Homo sapiens
caaatgtggcaattattttgga

SEQ ID NO: 1540829 - DNA, 14 bp, Homo sapiens
caaatgtgtaatat

SEQ ID NO: 1540830 - DNA, 20 bp, Homo sapiens
caaatgtgtaatattccagt

SEQ ID NO: 1540831 - DNA, 21 bp, Homo sapiens
caaatgtgtaatattccagtt

SEQ ID NO: 1540832 - DNA, 17 bp, Homo sapiens
caaatgtgtacacctgc

SEQ ID NO: 1540833 - DNA, 20 bp, Homo sapiens
caaatgtgtacatggcagag

SEQ ID NO: 1540834 - DNA, 23 bp, Homo sapiens
caaatgtgtacatggcagagttt

SEQ ID NO: 1540835 - DNA, 20 bp, Homo sapiens
caaatgtgtatcggatgctt

SEQ ID NO: 1540836 - DNA, 14 bp, Homo sapiens
caaatgtgtcagaa

SEQ ID NO: 1540837 - DNA, 12 bp, Homo sapiens
caaatgtgtttt

SEQ ID NO: 1540838 - DNA, 13 bp, Homo sapiens
caaatgttatgca

SEQ ID NO: 1540839 - DNA, 12 bp, Homo sapiens
caaatgttctaa

SEQ ID NO: 1540840 - DNA, 12 bp, Homo sapiens
caaatgtttaaa

SEQ ID NO: 1540841 - DNA, 15 bp, Homo sapiens
caaatgttttgacat

SEQ ID NO: 1540842 - DNA, 22 bp, Homo sapiens
caaattaaaacaaatatacatt

SEQ ID NO: 1540843 - DNA, 23 bp, Homo sapiens
caaattaaaacaaatatacattt

SEQ ID NO: 1540844 - DNA, 19 bp, Homo sapiens
caaattactctttctccat

SEQ ID NO: 1540845 - DNA, 19 bp, Homo sapiens
caaattagaagacatttat

SEQ ID NO: 1540846 - DNA, 14 bp, Homo sapiens
caaattagaggaga

SEQ ID NO: 1540847 - DNA, 23 bp, Homo sapiens
caaattagcaggtgcaccttctg

SEQ ID NO: 1540848 - DNA, 17 bp, Homo sapiens
caaattataatgtattc

SEQ ID NO: 1540849 - DNA, 14 bp, Homo sapiens
caaattattctagt

SEQ ID NO: 1540850 - DNA, 17 bp, Homo sapiens
caaattattctagtcaa

SEQ ID NO: 1540851 - DNA, 23 bp, Homo sapiens
caaattattttaatattttgtat

SEQ ID NO: 1540852 - DNA, 21 bp, Homo sapiens
caaattcaagagctagaaaaa

SEQ ID NO: 1540853 - DNA, 12 bp, Homo sapiens
caaattcagaac

SEQ ID NO: 1540854 - DNA, 23 bp, Homo sapiens
caaattcatggcatgcttaaatt

SEQ ID NO: 1540855 - DNA, 16 bp, Homo sapiens
caaattcgcaaacttt

SEQ ID NO: 1540856 - DNA, 14 bp, Homo sapiens
caaattcttctgaa

SEQ ID NO: 1540857 - DNA, 18 bp, Homo sapiens
caaattctttagtactca

SEQ ID NO: 1540858 - DNA, 20 bp, Homo sapiens
caaattgagtttaacaataa

SEQ ID NO: 1540859 - DNA, 22 bp, Homo sapiens
caaattgagtttaacaataata

SEQ ID NO: 1540860 - DNA, 14 bp, Homo sapiens
caaattgccttcag

SEQ ID NO: 1540861 - DNA, 19 bp, Homo sapiens
caaattgctgcatatttgt

SEQ ID NO: 1540862 - DNA, 20 bp, Homo sapiens
caaattgcttactttggaat

SEQ ID NO: 1540863 - DNA, 19 bp, Homo sapiens
caaatttaaaactgttgga

SEQ ID NO: 1540864 - DNA, 12 bp, Homo sapiens
caaatttatgca

SEQ ID NO: 1540865 - DNA, 15 bp, Homo sapiens
caaatttatgcattt

SEQ ID NO: 1540866 - DNA, 18 bp, Homo sapiens
caaatttatgcatttcat

SEQ ID NO: 1540867 - DNA, 23 bp, Homo sapiens
caaatttatgcatttcattcaaa

SEQ ID NO: 1540868 - DNA, 11 bp, Homo sapiens
caaatttgatg

SEQ ID NO: 1540869 - DNA, 19 bp, Homo sapiens
caaatttgatgatgttaaa

SEQ ID NO: 1540870 - DNA, 22 bp, Homo sapiens
caaatttggccttaagaactgt

SEQ ID NO: 1540871 - DNA, 23 bp, Homo sapiens
caaatttggccttaagaactgtg

SEQ ID NO: 1540872 - DNA, 11 bp, Homo sapiens
caaatttgtac

SEQ ID NO: 1540873 - DNA, 19 bp, Homo sapiens
caaatttgtacctctaagt

SEQ ID NO: 1540874 - DNA, 22 bp, Homo sapiens
caaatttgtcttgccttattaa

SEQ ID NO: 1540875 - DNA, 21 bp, Homo sapiens
caaatttgtgtcataccagaa

SEQ ID NO: 1540876 - DNA, 21 bp, Homo sapiens
caaattttggcgaatctcaaa

SEQ ID NO: 1540877 - DNA, 17 bp, Homo sapiens
caacaaaaaatacatta

SEQ ID NO: 1540878 - DNA, 12 bp, Homo sapiens
caacaaaataca

SEQ ID NO: 1540879 - DNA, 21 bp, Homo sapiens
caacaaagacatgctttccat

SEQ ID NO: 1540880 - DNA, 22 bp, Homo sapiens
caacaaagacatgctttccatt

SEQ ID NO: 1540881 - DNA, 17 bp, Homo sapiens
caacaaagattgagaag

SEQ ID NO: 1540882 - DNA, 19 bp, Homo sapiens
caacaaagattgagaagcc

SEQ ID NO: 1540883 - DNA, 21 bp, Homo sapiens
caacaaagattgagaagccat

SEQ ID NO: 1540884 - DNA, 19 bp, Homo sapiens
caacaaagccaacagtcaa

SEQ ID NO: 1540885 - DNA, 18 bp, Homo sapiens
caacaacctcaactgcct

SEQ ID NO: 1540886 - DNA, 17 bp, Homo sapiens
caacaacgggcagaaat

SEQ ID NO: 1540887 - DNA, 23 bp, Homo sapiens
caacaacgtgagagaaagagaga

SEQ ID NO: 1540888 - DNA, 14 bp, Homo sapiens
caacaactctgcct

SEQ ID NO: 1540889 - DNA, 21 bp, Homo sapiens
caacaagaatgcattccctga

SEQ ID NO: 1540890 - DNA, 18 bp, Homo sapiens
caacaagaccgccccagg

SEQ ID NO: 1540891 - DNA, 18 bp, Homo sapiens
caacaagactgccaggtg

SEQ ID NO: 1540892 - DNA, 13 bp, Homo sapiens
caacaagatttcc

SEQ ID NO: 1540893 - DNA, 13 bp, Homo sapiens
caacaagtaactt

SEQ ID NO: 1540894 - DNA, 20 bp, Homo sapiens
caacaataaacaggaatttt

SEQ ID NO: 1540895 - DNA, 13 bp, Homo sapiens
caacaataacact

SEQ ID NO: 1540896 - DNA, 13 bp, Homo sapiens
caacaataataaa

SEQ ID NO: 1540897 - DNA, 13 bp, Homo sapiens
caacacagcctgg

SEQ ID NO: 1540898 - DNA, 16 bp, Homo sapiens
caacacagcctgggcc

SEQ ID NO: 1540899 - DNA, 16 bp, Homo sapiens
caacacagttgggacc

SEQ ID NO: 1540900 - DNA, 17 bp, Homo sapiens
caacaccaaaaaatatc

SEQ ID NO: 1540901 - DNA, 23 bp, Homo sapiens
caacaccaaaaaatatctagtaa

SEQ ID NO: 1540902 - DNA, 13 bp, Homo sapiens
caacaccacagac

SEQ ID NO: 1540903 - DNA, 17 bp, Homo sapiens
caacaccacagacacac

SEQ ID NO: 1540904 - DNA, 20 bp, Homo sapiens
caacaccacagacacacaca

SEQ ID NO: 1540905 - DNA, 14 bp, Homo sapiens
caacaccaggactt

SEQ ID NO: 1540906 - DNA, 17 bp, Homo sapiens
caacaccccgcctgcct

SEQ ID NO: 1540907 - DNA, 15 bp, Homo sapiens
caacactattgtaat

SEQ ID NO: 1540908 - DNA, 21 bp, Homo sapiens
caacactcatcacacttcatt

SEQ ID NO: 1540909 - DNA, 13 bp, Homo sapiens
caacactgatgtg

SEQ ID NO: 1540910 - DNA, 15 bp, Homo sapiens
caacactgctgtcca

SEQ ID NO: 1540911 - DNA, 16 bp, Homo sapiens
caacactgctgtccac

SEQ ID NO: 1540912 - DNA, 17 bp, Homo sapiens
caacactgtgccctggt

SEQ ID NO: 1540913 - DNA, 15 bp, Homo sapiens
caacacttattttct

SEQ ID NO: 1540914 - DNA, 17 bp, Homo sapiens
caacagaaagagggaca

SEQ ID NO: 1540915 - DNA, 15 bp, Homo sapiens
caacagaagcttcca

SEQ ID NO: 1540916 - DNA, 22 bp, Homo sapiens
caacagaagtcatgaagcccaa

SEQ ID NO: 1540917 - DNA, 17 bp, Homo sapiens
caacagactgttgagtt

SEQ ID NO: 1540918 - DNA, 18 bp, Homo sapiens
caacagagaaggcaggaa

SEQ ID NO: 1540919 - DNA, 22 bp, Homo sapiens
caacagagaggaccaacatcca

SEQ ID NO: 1540920 - DNA, 19 bp, Homo sapiens
atccataaatgtgttcctg

SEQ ID NO: 1540921 - DNA, 20 bp, Homo sapiens
atccataggactaccgcagg

SEQ ID NO: 1540922 - DNA, 16 bp, Homo sapiens
atccatagtagtatga

SEQ ID NO: 1540923 - DNA, 15 bp, Homo sapiens
atccatagtgacttt

SEQ ID NO: 1540924 - DNA, 23 bp, Homo sapiens
atccatatcttaaagaaacagct

SEQ ID NO: 1540925 - DNA, 14 bp, Homo sapiens
atccatccatctcc

SEQ ID NO: 1540926 - DNA, 16 bp, Homo sapiens
atccatccatctccag

SEQ ID NO: 1540927 - DNA, 12 bp, Homo sapiens
atccatctccag

SEQ ID NO: 1540928 - DNA, 18 bp, Homo sapiens
atccatgacctagttttc

SEQ ID NO: 1540929 - DNA, 20 bp, Homo sapiens
atccatgagggactcctcct

SEQ ID NO: 1540930 - DNA, 15 bp, Homo sapiens
atccatgcattatat

SEQ ID NO: 1540931 - DNA, 19 bp, Homo sapiens
atccatgtaaggtatcagt

SEQ ID NO: 1540932 - DNA, 19 bp, Homo sapiens
atccatgttagtttttact

SEQ ID NO: 1540933 - DNA, 15 bp, Homo sapiens
atccattaggccagc

SEQ ID NO: 1540934 - DNA, 17 bp, Homo sapiens
atccattgaaagtgctt

SEQ ID NO: 1540935 - DNA, 14 bp, Homo sapiens
atccattggagaag

SEQ ID NO: 1540936 - DNA, 16 bp, Homo sapiens
atccatttatttcatt

SEQ ID NO: 1540937 - DNA, 23 bp, Homo sapiens
atccatttcatctatttctgaga

SEQ ID NO: 1540938 - DNA, 14 bp, Homo sapiens
atccatttcttcat

SEQ ID NO: 1540939 - DNA, 14 bp, Homo sapiens
atccattttctaaa

SEQ ID NO: 1540940 - DNA, 21 bp, Homo sapiens
atccattttctaaactgtttt

SEQ ID NO: 1540941 - DNA, 20 bp, Homo sapiens
atcccaaagcaaggagatca

SEQ ID NO: 1540942 - DNA, 12 bp, Homo sapiens
attttataattt

SEQ ID NO: 1540943 - DNA, 22 bp, Homo sapiens
attttatagctcagtttatcca

SEQ ID NO: 1540944 - DNA, 16 bp, Homo sapiens
attttatatcttgtag

SEQ ID NO: 1540945 - DNA, 15 bp, Homo sapiens
attttatatttttgt

SEQ ID NO: 1540946 - DNA, 18 bp, Homo sapiens
attttatatttttgtaca

SEQ ID NO: 1540947 - DNA, 12 bp, Homo sapiens
attttatcatta

SEQ ID NO: 1540948 - DNA, 15 bp, Homo sapiens
attttatctggaaca

SEQ ID NO: 1540949 - DNA, 22 bp, Homo sapiens
attttatctgtttcctgacatt

SEQ ID NO: 1540950 - DNA, 13 bp, Homo sapiens
attttatgaacat

SEQ ID NO: 1540951 - DNA, 17 bp, Homo sapiens
attttatgaacattgta

SEQ ID NO: 1540952 - DNA, 21 bp, Homo sapiens
attttatgaacattgtactgt

SEQ ID NO: 1540953 - DNA, 24 bp, Homo sapiens
attttatgaacattgtactgttgc

SEQ ID NO: 1540954 - DNA, 18 bp, Homo sapiens
attttatgtcatagaaat

SEQ ID NO: 1540955 - DNA, 15 bp, Homo sapiens
attttattaaacaca

SEQ ID NO: 1540956 - DNA, 22 bp, Homo sapiens
attttattaataatatttatgt

SEQ ID NO: 1540957 - DNA, 16 bp, Homo sapiens
attttattcttgatca

SEQ ID NO: 1540958 - DNA, 18 bp, Homo sapiens
attttattcttgatcagt

SEQ ID NO: 1540959 - DNA, 15 bp, Homo sapiens
attttattgtataaa

SEQ ID NO: 1540960 - DNA, 22 bp, Homo sapiens
attttatttgttctttttctga

SEQ ID NO: 1540961 - DNA, 14 bp, Homo sapiens
attttattttgctg

SEQ ID NO: 1540962 - DNA, 21 bp, Homo sapiens
attttattttgtgctcattta

SEQ ID NO: 1540963 - DNA, 15 bp, Homo sapiens
attttatttttctgt

SEQ ID NO: 1540964 - DNA, 11 bp, Homo sapiens
attttcaaaga

SEQ ID NO: 1540965 - DNA, 17 bp, Homo sapiens
attttcaaagacttaag

SEQ ID NO: 1540966 - DNA, 20 bp, Homo sapiens
attttcaacgcagccctgct

SEQ ID NO: 1540967 - DNA, 22 bp, Homo sapiens
attttcaagaaactgaggaatt

SEQ ID NO: 1540968 - DNA, 15 bp, Homo sapiens
attttcaagctttca

SEQ ID NO: 1540969 - DNA, 14 bp, Homo sapiens
attttcaaggcctt

SEQ ID NO: 1540970 - DNA, 20 bp, Homo sapiens
attttcaaggccttcagttt

SEQ ID NO: 1540971 - DNA, 15 bp, Homo sapiens
attttcaccccaccc

SEQ ID NO: 1540972 - DNA, 17 bp, Homo sapiens
attttcagaaaatatta

SEQ ID NO: 1540973 - DNA, 15 bp, Homo sapiens
attttcagatgaaat

SEQ ID NO: 1540974 - DNA, 20 bp, Homo sapiens
attttcagcattaagctgtt

SEQ ID NO: 1540975 - DNA, 23 bp, Homo sapiens
attttcagtatactgtgtgggat

SEQ ID NO: 1540976 - DNA, 12 bp, Homo sapiens
attttcagtccc

SEQ ID NO: 1540977 - DNA, 20 bp, Homo sapiens
attttcagtcccctctctct

SEQ ID NO: 1540978 - DNA, 21 bp, Homo sapiens
attttcagtcccctctctctg

SEQ ID NO: 1540979 - DNA, 19 bp, Homo sapiens
attttcagtcttgtagtgt

SEQ ID NO: 1540980 - DNA, 17 bp, Homo sapiens
attttcatgaaaatacc

SEQ ID NO: 1540981 - DNA, 13 bp, Homo sapiens
attttcatgattc

SEQ ID NO: 1540982 - DNA, 18 bp, Homo sapiens
attttcattaaacttgaa

SEQ ID NO: 1540983 - DNA, 12 bp, Homo sapiens
attttcatttgt

SEQ ID NO: 1540984 - DNA, 14 bp, Homo sapiens
attttcatttgtac

SEQ ID NO: 1540985 - DNA, 15 bp, Homo sapiens
attttcatttgtaca

SEQ ID NO: 1540986 - DNA, 14 bp, Homo sapiens
attttccaaatgta

SEQ ID NO: 1540987 - DNA, 15 bp, Homo sapiens
attttccatctaaaa

SEQ ID NO: 1540988 - DNA, 19 bp, Homo sapiens
attttccatctaaaaatat

SEQ ID NO: 1540989 - DNA, 21 bp, Homo sapiens
attttccatttttatttcaaa

SEQ ID NO: 1540990 - DNA, 22 bp, Homo sapiens
attttcccactcattctgaatt

SEQ ID NO: 1540991 - DNA, 15 bp, Homo sapiens
attttcccatcatcc

SEQ ID NO: 1540992 - DNA, 21 bp, Homo sapiens
attttccccccactctcccca

SEQ ID NO: 1540993 - DNA, 22 bp, Homo sapiens
attttcctggtgccaatttcaa

SEQ ID NO: 1540994 - DNA, 17 bp, Homo sapiens
attttcgggattctttg

SEQ ID NO: 1540995 - DNA, 17 bp, Homo sapiens
attttctaaactgtttt

SEQ ID NO: 1540996 - DNA, 20 bp, Homo sapiens
attttctaaataaaaatatg

SEQ ID NO: 1540997 - DNA, 15 bp, Homo sapiens
attttctacaattaa

SEQ ID NO: 1540998 - DNA, 18 bp, Homo sapiens
attttctcactgaactcc

SEQ ID NO: 1540999 - DNA, 21 bp, Homo sapiens
attttctcactgaactccacc

SEQ ID NO: 1541000 - DNA, 17 bp, Homo sapiens
attttctccttggtttg

SEQ ID NO: 1541001 - DNA, 12 bp, Homo sapiens
attttctctcca

SEQ ID NO: 1541002 - DNA, 13 bp, Homo sapiens
attttctcttaga

SEQ ID NO: 1541003 - DNA, 18 bp, Homo sapiens
attttctgaattcataaa

SEQ ID NO: 1541004 - DNA, 19 bp, Homo sapiens
attttctggaatacatgaa

SEQ ID NO: 1541005 - DNA, 22 bp, Homo sapiens
attttctggaatacatgaaata

SEQ ID NO: 1541006 - DNA, 15 bp, Homo sapiens
attttctggttctaa

SEQ ID NO: 1541007 - DNA, 19 bp, Homo sapiens
attttctggttctaacatt

SEQ ID NO: 1541008 - DNA, 13 bp, Homo sapiens
attttctgtaaga

SEQ ID NO: 1541009 - DNA, 17 bp, Homo sapiens
attttctgtaatctttt

SEQ ID NO: 1541010 - DNA, 15 bp, Homo sapiens
gctccaacctgcaaa

SEQ ID NO: 1541011 - DNA, 22 bp, Homo sapiens
gctccaactcctttcagccaca

SEQ ID NO: 1541012 - DNA, 23 bp, Homo sapiens
gctccaactcctttcagccacat

SEQ ID NO: 1541013 - DNA, 19 bp, Homo sapiens
gctccaagccccatcttct

SEQ ID NO: 1541014 - DNA, 17 bp, Homo sapiens
gctccacacagcagtgt

SEQ ID NO: 1541015 - DNA, 13 bp, Homo sapiens
gctccaccagcag

SEQ ID NO: 1541016 - DNA, 14 bp, Homo sapiens
gctccaccagcagc

SEQ ID NO: 1541017 - DNA, 20 bp, Homo sapiens
gctccaccagcatcacctgc

SEQ ID NO: 1541018 - DNA, 15 bp, Homo sapiens
gctccacccttggcc

SEQ ID NO: 1541019 - DNA, 14 bp, Homo sapiens
gctccacctctggt

SEQ ID NO: 1541020 - DNA, 23 bp, Homo sapiens
gctccacggtgcgtggctgtggc

SEQ ID NO: 1541021 - DNA, 20 bp, Homo sapiens
gctccactctgcttctctga

SEQ ID NO: 1541022 - DNA, 20 bp, Homo sapiens
gctccagaaatgtctaaatg

SEQ ID NO: 1541023 - DNA, 21 bp, Homo sapiens
gctccagaagatgccagcttc

SEQ ID NO: 1541024 - DNA, 23 bp, Homo sapiens
gctccagaagatgccagcttctc

SEQ ID NO: 1541025 - DNA, 21 bp, Homo sapiens
gctccagacctgatcctggag

SEQ ID NO: 1541026 - DNA, 23 bp, Homo sapiens
gctccagacctgatcctggaggc

SEQ ID NO: 1541027 - DNA, 13 bp, Homo sapiens
gctccagattctg

SEQ ID NO: 1541028 - DNA, 14 bp, Homo sapiens
gctccagattctga

SEQ ID NO: 1541029 - DNA, 16 bp, Homo sapiens
gctccagattctgatg

SEQ ID NO: 1541030 - DNA, 22 bp, Homo sapiens
gctccagcaacacagcctgggc

SEQ ID NO: 1541031 - DNA, 18 bp, Homo sapiens
gctccagcaactgccctt

SEQ ID NO: 1541032 - DNA, 14 bp, Homo sapiens
gctccagcatccag

SEQ ID NO: 1541033 - DNA, 23 bp, Homo sapiens
gctccagcgatggtgctgcccag

SEQ ID NO: 1541034 - DNA, 13 bp, Homo sapiens
gctccagctgccc

SEQ ID NO: 1541035 - DNA, 16 bp, Homo sapiens
gctccagctgccccgg

SEQ ID NO: 1541036 - DNA, 21 bp, Homo sapiens
gctccagctttctgccatcta

SEQ ID NO: 1541037 - DNA, 21 bp, Homo sapiens
gctccagggaatccaagcctc

SEQ ID NO: 1541038 - DNA, 22 bp, Homo sapiens
gctccagggaatccaagcctcc

SEQ ID NO: 1541039 - DNA, 23 bp, Homo sapiens
gctccagggaatccaagcctcca

SEQ ID NO: 1541040 - DNA, 18 bp, Homo sapiens
gctccagggtcttgggct

SEQ ID NO: 1541041 - DNA, 22 bp, Homo sapiens
gctccagggtcttgggctactg

SEQ ID NO: 1541042 - DNA, 21 bp, Homo sapiens
gctccagtcaacaaactattt

SEQ ID NO: 1541043 - DNA, 19 bp, Homo sapiens
gctccagtttccccatggg

SEQ ID NO: 1541044 - DNA, 14 bp, Homo sapiens
gctccagtttgcat

SEQ ID NO: 1541045 - DNA, 16 bp, Homo sapiens
gctccataccttttct

SEQ ID NO: 1541046 - DNA, 22 bp, Homo sapiens
gctccatcccaaccaggcacct

SEQ ID NO: 1541047 - DNA, 22 bp, Homo sapiens
gctccatctccgcctccacact

SEQ ID NO: 1541048 - DNA, 17 bp, Homo sapiens
gctccatgactggctgt

SEQ ID NO: 1541049 - DNA, 18 bp, Homo sapiens
gctccatgactggctgtc

SEQ ID NO: 1541050 - DNA, 22 bp, Homo sapiens
gctccattttcttattgcgctg

SEQ ID NO: 1541051 - DNA, 20 bp, Homo sapiens
gctcccaacagaggcctccc

SEQ ID NO: 1541052 - DNA, 23 bp, Homo sapiens
gctcccaacccccctcctgctcc

SEQ ID NO: 1541053 - DNA, 14 bp, Homo sapiens
gctcccaatcagct

SEQ ID NO: 1541054 - DNA, 16 bp, Homo sapiens
gctcccacaggccctt

SEQ ID NO: 1541055 - DNA, 20 bp, Homo sapiens
gctcccacaggcccttcctc

SEQ ID NO: 1541056 - DNA, 14 bp, Homo sapiens
caaacaatgaagaa

SEQ ID NO: 1541057 - DNA, 19 bp, Homo sapiens
caaacaatggaaactgaat

SEQ ID NO: 1541058 - DNA, 20 bp, Homo sapiens
caaacaatggaaactgaatg

SEQ ID NO: 1541059 - DNA, 14 bp, Homo sapiens
caaacacctcccag

SEQ ID NO: 1541060 - DNA, 21 bp, Homo sapiens
caaacactgcagtttcctgga

SEQ ID NO: 1541061 - DNA, 13 bp, Homo sapiens
caaacactgccat

SEQ ID NO: 1541062 - DNA, 21 bp, Homo sapiens
caaacactgccatattgtgta

SEQ ID NO: 1541063 - DNA, 15 bp, Homo sapiens
caaacacttctgctt

SEQ ID NO: 1541064 - DNA, 23 bp, Homo sapiens
caaacagaaacgagatttgccaa

SEQ ID NO: 1541065 - DNA, 19 bp, Homo sapiens
caaacagagctactgagac

SEQ ID NO: 1541066 - DNA, 20 bp, Homo sapiens
caaacagccaactagcccct

SEQ ID NO: 1541067 - DNA, 13 bp, Homo sapiens
caaacagccacac

SEQ ID NO: 1541068 - DNA, 21 bp, Homo sapiens
caaacagtaatctaggtgtgg

SEQ ID NO: 1541069 - DNA, 14 bp, Homo sapiens
caaacagtatttct

SEQ ID NO: 1541070 - DNA, 15 bp, Homo sapiens
caaacagtatttctg

SEQ ID NO: 1541071 - DNA, 18 bp, Homo sapiens
caaacatcagctgaattc

SEQ ID NO: 1541072 - DNA, 17 bp, Homo sapiens
caaacatggagaaatct

SEQ ID NO: 1541073 - DNA, 15 bp, Homo sapiens
caaacatgtatgtat

SEQ ID NO: 1541074 - DNA, 21 bp, Homo sapiens
caaacattcgtgagctgggga

SEQ ID NO: 1541075 - DNA, 22 bp, Homo sapiens
caaacattcgtgagctggggac

SEQ ID NO: 1541076 - DNA, 14 bp, Homo sapiens
caaacattggaaga

SEQ ID NO: 1541077 - DNA, 20 bp, Homo sapiens
caaacattttctcttagaaa

SEQ ID NO: 1541078 - DNA, 21 bp, Homo sapiens
caaaccacaactgacacagga

SEQ ID NO: 1541079 - DNA, 15 bp, Homo sapiens
caaaccacagcagga

SEQ ID NO: 1541080 - DNA, 22 bp, Homo sapiens
caaaccaccaggactgaaagaa

SEQ ID NO: 1541081 - DNA, 14 bp, Homo sapiens
caaaccaggaccct

SEQ ID NO: 1541082 - DNA, 16 bp, Homo sapiens
caaaccatgagaattt

SEQ ID NO: 1541083 - DNA, 14 bp, Homo sapiens
caaaccatttccaa

SEQ ID NO: 1541084 - DNA, 21 bp, Homo sapiens
caaaccatttttaaagtagaa

SEQ ID NO: 1541085 - DNA, 16 bp, Homo sapiens
caaacccagaggtgga

SEQ ID NO: 1541086 - DNA, 20 bp, Homo sapiens
caaacccagtctcctctcca

SEQ ID NO: 1541087 - DNA, 22 bp, Homo sapiens
caaacccagtctcctctccatt

SEQ ID NO: 1541088 - DNA, 17 bp, Homo sapiens
caaaccccaccctagtt

SEQ ID NO: 1541089 - DNA, 20 bp, Homo sapiens
caaaccctgcttctgctgcc

SEQ ID NO: 1541090 - DNA, 24 bp, Homo sapiens
caaaccctgcttctgctgccctga

SEQ ID NO: 1541091 - DNA, 21 bp, Homo sapiens
caaacctaagtccttccacct

SEQ ID NO: 1541092 - DNA, 21 bp, Homo sapiens
caaacctaatgatcatctgaa

SEQ ID NO: 1541093 - DNA, 13 bp, Homo sapiens
caaacctactgcc

SEQ ID NO: 1541094 - DNA, 15 bp, Homo sapiens
caaacctactgccca

SEQ ID NO: 1541095 - DNA, 19 bp, Homo sapiens
caaacctactgcccacatt

SEQ ID NO: 1541096 - DNA, 20 bp, Homo sapiens
caaacctactgcccacattt

SEQ ID NO: 1541097 - DNA, 18 bp, Homo sapiens
caaacctcacatttgtga

SEQ ID NO: 1541098 - DNA, 13 bp, Homo sapiens
caaacctccagcc

SEQ ID NO: 1541099 - DNA, 20 bp, Homo sapiens
caaacctccagcctccctgt

SEQ ID NO: 1541100 - DNA, 13 bp, Homo sapiens
caaacctggttca

SEQ ID NO: 1541101 - DNA, 17 bp, Homo sapiens
caaacctgtgatctagt

SEQ ID NO: 1541102 - DNA, 22 bp, Homo sapiens
caaacctgtttaaatatttcaa

SEQ ID NO: 1541103 - DNA, 18 bp, Homo sapiens
caaacctttattttagaa

SEQ ID NO: 1541104 - DNA, 23 bp, Homo sapiens
caaacgatgtgcaatacattttt

SEQ ID NO: 1541105 - DNA, 23 bp, Homo sapiens
caaacgccctttcctcctcaggc

SEQ ID NO: 1541106 - DNA, 22 bp, Homo sapiens
caaacgctaaagagcccttgcc

SEQ ID NO: 1541107 - DNA, 20 bp, Homo sapiens
caaacggcaacgtagcctgg

SEQ ID NO: 1541108 - DNA, 21 bp, Homo sapiens
caaacggcaacgtagcctggg

SEQ ID NO: 1541109 - DNA, 13 bp, Homo sapiens
caaacgtccccag

SEQ ID NO: 1541110 - DNA, 23 bp, Homo sapiens
caaacgttgggcatcatggtttt

SEQ ID NO: 1541111 - DNA, 15 bp, Homo sapiens
caaactaaattcaaa

SEQ ID NO: 1541112 - DNA, 16 bp, Homo sapiens
caaactaaattcaaag

SEQ ID NO: 1541113 - DNA, 14 bp, Homo sapiens
caaactacctctgg

SEQ ID NO: 1541114 - DNA, 21 bp, Homo sapiens
caaactactgaatgaagcagt

SEQ ID NO: 1541115 - DNA, 18 bp, Homo sapiens
caaactatttcttatata

SEQ ID NO: 1541116 - DNA, 14 bp, Homo sapiens
caaactcaggccca

SEQ ID NO: 1541117 - DNA, 16 bp, Homo sapiens
caaactcagttccaaa

SEQ ID NO: 1541118 - DNA, 14 bp, Homo sapiens
caaactcagttcga

SEQ ID NO: 1541119 - DNA, 16 bp, Homo sapiens
caaactcttaattaga

SEQ ID NO: 1541120 - DNA, 14 bp, Homo sapiens
caaactcttcagtt

SEQ ID NO: 1541121 - DNA, 23 bp, Homo sapiens
caaactgaagcagcctctcccca

SEQ ID NO: 1541122 - DNA, 14 bp, Homo sapiens
caaactgaatttgt

SEQ ID NO: 1541123 - DNA, 17 bp, Homo sapiens
caaactgaggaatttca

SEQ ID NO: 1541124 - DNA, 23 bp, Homo sapiens
caaactgattaaatatttgaaga

SEQ ID NO: 1541125 - DNA, 11 bp, Homo sapiens
caaactgcaat

SEQ ID NO: 1541126 - DNA, 13 bp, Homo sapiens
caaactgcaatag

SEQ ID NO: 1541127 - DNA, 19 bp, Homo sapiens
caaactgcaatagagactg

SEQ ID NO: 1541128 - DNA, 20 bp, Homo sapiens
caaactgcaatagagactgt

SEQ ID NO: 1541129 - DNA, 21 bp, Homo sapiens
caaactgcacacacagctcct

SEQ ID NO: 1541130 - DNA, 18 bp, Homo sapiens
caaactgcctaagccctc

SEQ ID NO: 1541131 - DNA, 21 bp, Homo sapiens
caaactgcttcccttactttg

SEQ ID NO: 1541132 - DNA, 21 bp, Homo sapiens
caaactggggcctccagaact

SEQ ID NO: 1541133 - DNA, 11 bp, Homo sapiens
caaactgtgaa

SEQ ID NO: 1541134 - DNA, 15 bp, Homo sapiens
caaactgtgaaaata

SEQ ID NO: 1541135 - DNA, 14 bp, Homo sapiens
caaactgtgaagca

SEQ ID NO: 1541136 - DNA, 16 bp, Homo sapiens
caaactgttaaatgtg

SEQ ID NO: 1541137 - DNA, 16 bp, Homo sapiens
caaactgttcaagaaa

SEQ ID NO: 1541138 - DNA, 13 bp, Homo sapiens
caaacttaaacaa

SEQ ID NO: 1541139 - DNA, 17 bp, Homo sapiens
caaacttaagaaacact

SEQ ID NO: 1541140 - DNA, 19 bp, Homo sapiens
caaacttaagaaacactga

SEQ ID NO: 1541141 - DNA, 13 bp, Homo sapiens
caaacttgcttta

SEQ ID NO: 1541142 - DNA, 16 bp, Homo sapiens
caaagaaacaaagatg

SEQ ID NO: 1541143 - DNA, 18 bp, Homo sapiens
caaagaaacaagctgtgc

SEQ ID NO: 1541144 - DNA, 19 bp, Homo sapiens
caaagaaacaagctgtgca

SEQ ID NO: 1541145 - DNA, 19 bp, Homo sapiens
atttaaatataattctgta

SEQ ID NO: 1541146 - DNA, 13 bp, Homo sapiens
atttaaatatctg

SEQ ID NO: 1541147 - DNA, 16 bp, Homo sapiens
atttaaatattaaata

SEQ ID NO: 1541148 - DNA, 14 bp, Homo sapiens
atttaaatggcttt

SEQ ID NO: 1541149 - DNA, 16 bp, Homo sapiens
atttaaatggcttttg

SEQ ID NO: 1541150 - DNA, 21 bp, Homo sapiens
atttaaatgtttaacatcatt

SEQ ID NO: 1541151 - DNA, 13 bp, Homo sapiens
atttaacaagatc

SEQ ID NO: 1541152 - DNA, 13 bp, Homo sapiens
atttaacaatgac

SEQ ID NO: 1541153 - DNA, 13 bp, Homo sapiens
atttaacagaaat

SEQ ID NO: 1541154 - DNA, 15 bp, Homo sapiens
atttaacattattta

SEQ ID NO: 1541155 - DNA, 19 bp, Homo sapiens
atttaacccatttgtctct

SEQ ID NO: 1541156 - DNA, 18 bp, Homo sapiens
atttaactactaagaata

SEQ ID NO: 1541157 - DNA, 13 bp, Homo sapiens
atttaactgacta

SEQ ID NO: 1541158 - DNA, 14 bp, Homo sapiens
atttaactgcatat

SEQ ID NO: 1541159 - DNA, 15 bp, Homo sapiens
atttaactgcatata

SEQ ID NO: 1541160 - DNA, 20 bp, Homo sapiens
atttaagaaaatacaataaa

SEQ ID NO: 1541161 - DNA, 14 bp, Homo sapiens
atttaagcaaacgt

SEQ ID NO: 1541162 - DNA, 15 bp, Homo sapiens
atttaagcctaaaga

SEQ ID NO: 1541163 - DNA, 17 bp, Homo sapiens
atttaagcctaaagatt

SEQ ID NO: 1541164 - DNA, 18 bp, Homo sapiens
atttaagcttatgtcaga

SEQ ID NO: 1541165 - DNA, 15 bp, Homo sapiens
atttaaggatggatg

SEQ ID NO: 1541166 - DNA, 16 bp, Homo sapiens
atttaaggatggatgg

SEQ ID NO: 1541167 - DNA, 17 bp, Homo sapiens
atttaaggatggatggc

SEQ ID NO: 1541168 - DNA, 18 bp, Homo sapiens
atttaaggatggatggca

SEQ ID NO: 1541169 - DNA, 20 bp, Homo sapiens
atttaaggtctgtttgctgt

SEQ ID NO: 1541170 - DNA, 21 bp, Homo sapiens
atttaagtatatagtatattt

SEQ ID NO: 1541171 - DNA, 14 bp, Homo sapiens
atttaagtgaagga

SEQ ID NO: 1541172 - DNA, 20 bp, Homo sapiens
atttaagtgacacagacatt

SEQ ID NO: 1541173 - DNA, 14 bp, Homo sapiens
atttaataaaactg

SEQ ID NO: 1541174 - DNA, 16 bp, Homo sapiens
atttaataaagatgag

SEQ ID NO: 1541175 - DNA, 14 bp, Homo sapiens
atttaatatactgc

SEQ ID NO: 1541176 - DNA, 16 bp, Homo sapiens
atttaatatactgcat

SEQ ID NO: 1541177 - DNA, 18 bp, Homo sapiens
atttaatatactgcatat

SEQ ID NO: 1541178 - DNA, 20 bp, Homo sapiens
atttaatatcaaaagaaaat

SEQ ID NO: 1541179 - DNA, 22 bp, Homo sapiens
atttaatatctggcactgttaa

SEQ ID NO: 1541180 - DNA, 14 bp, Homo sapiens
atttaatgaaagac

SEQ ID NO: 1541181 - DNA, 15 bp, Homo sapiens
atttaatgaaagact

SEQ ID NO: 1541182 - DNA, 20 bp, Homo sapiens
atttaatgaaagactgtaca

SEQ ID NO: 1541183 - DNA, 12 bp, Homo sapiens
atttaatgctgc

SEQ ID NO: 1541184 - DNA, 13 bp, Homo sapiens
atttaatgctgcc

SEQ ID NO: 1541185 - DNA, 22 bp, Homo sapiens
atttaatggaagtgtatttatt

SEQ ID NO: 1541186 - DNA, 21 bp, Homo sapiens
atttaatggcagctagtgcct

SEQ ID NO: 1541187 - DNA, 12 bp, Homo sapiens
atttaatgttga

SEQ ID NO: 1541188 - DNA, 17 bp, Homo sapiens
atttaattcatgtttct

SEQ ID NO: 1541189 - DNA, 23 bp, Homo sapiens
atttaattcctctttttagggct

SEQ ID NO: 1541190 - DNA, 22 bp, Homo sapiens
atttaattttttaactgctgca

SEQ ID NO: 1541191 - DNA, 19 bp, Homo sapiens
atttacaaaagatttattg

SEQ ID NO: 1541192 - DNA, 12 bp, Homo sapiens
atttacaaataa

SEQ ID NO: 1541193 - DNA, 20 bp, Homo sapiens
atttacaagagctgttcatg

SEQ ID NO: 1541194 - DNA, 22 bp, Homo sapiens
atttacaagatattattaattt

SEQ ID NO: 1541195 - DNA, 19 bp, Homo sapiens
atttacactattatttcct

SEQ ID NO: 1541196 - DNA, 20 bp, Homo sapiens
atttacactattatttccta

SEQ ID NO: 1541197 - DNA, 14 bp, Homo sapiens
atttacactgccat

SEQ ID NO: 1541198 - DNA, 14 bp, Homo sapiens
atttacactggtct

SEQ ID NO: 1541199 - DNA, 19 bp, Homo sapiens
atttacactggtctaatgt

SEQ ID NO: 1541200 - DNA, 19 bp, Homo sapiens
atttacagatgaatgtatt

SEQ ID NO: 1541201 - DNA, 17 bp, Homo sapiens
atttacaggttcttagg

SEQ ID NO: 1541202 - DNA, 16 bp, Homo sapiens
atttacagttactgcc

SEQ ID NO: 1541203 - DNA, 16 bp, Homo sapiens
atttacatcatttctt

SEQ ID NO: 1541204 - DNA, 16 bp, Homo sapiens
atttacatgtattatt

SEQ ID NO: 1541205 - DNA, 16 bp, Homo sapiens
atttacattcaactct

SEQ ID NO: 1541206 - DNA, 14 bp, Homo sapiens
atttaccacttttt

SEQ ID NO: 1541207 - DNA, 16 bp, Homo sapiens
atttaccatcatctct

SEQ ID NO: 1541208 - DNA, 14 bp, Homo sapiens
atttaccctttggc

SEQ ID NO: 1541209 - DNA, 20 bp, Homo sapiens
atttaccctttggccccact

SEQ ID NO: 1541210 - DNA, 14 bp, Homo sapiens
atttacctaagatt

SEQ ID NO: 1541211 - DNA, 15 bp, Homo sapiens
atttacctaagatta

SEQ ID NO: 1541212 - DNA, 17 bp, Homo sapiens
atttacctaagattaca

SEQ ID NO: 1541213 - DNA, 16 bp, Homo sapiens
atttactaactaaata

SEQ ID NO: 1541214 - DNA, 15 bp, Homo sapiens
atttactacagtagt

SEQ ID NO: 1541215 - DNA, 21 bp, Homo sapiens
atttactatgcacaacagagt

SEQ ID NO: 1541216 - DNA, 22 bp, Homo sapiens
atttactatgcacaacagagta

SEQ ID NO: 1541217 - DNA, 13 bp, Homo sapiens
atttactcttctt

SEQ ID NO: 1541218 - DNA, 13 bp, Homo sapiens
atttactgagctt

SEQ ID NO: 1541219 - DNA, 21 bp, Homo sapiens
atttactgagcttctctgtga

SEQ ID NO: 1541220 - DNA, 17 bp, Homo sapiens
atttactgctctttatt

SEQ ID NO: 1541221 - DNA, 21 bp, Homo sapiens
atttactgctctttattgcag

SEQ ID NO: 1541222 - DNA, 21 bp, Homo sapiens
atttccccagccacaggccaa

SEQ ID NO: 1541223 - DNA, 21 bp, Homo sapiens
atttccccaggggaaaatgaa

SEQ ID NO: 1541224 - DNA, 22 bp, Homo sapiens
atttcccctctgcacccagaac

SEQ ID NO: 1541225 - DNA, 23 bp, Homo sapiens
atttcccctctgcacccagaaca

SEQ ID NO: 1541226 - DNA, 14 bp, Homo sapiens
atttcccgcacatg

SEQ ID NO: 1541227 - DNA, 22 bp, Homo sapiens
atttccgttgtacatgttcctg

SEQ ID NO: 1541228 - DNA, 13 bp, Homo sapiens
atttcctcacgtg

SEQ ID NO: 1541229 - DNA, 16 bp, Homo sapiens
atttcctccatggtgg

SEQ ID NO: 1541230 - DNA, 17 bp, Homo sapiens
atttcctctccactgct

SEQ ID NO: 1541231 - DNA, 20 bp, Homo sapiens
atttcctctccactgctgga

SEQ ID NO: 1541232 - DNA, 16 bp, Homo sapiens
atttcctgacttgagt

SEQ ID NO: 1541233 - DNA, 22 bp, Homo sapiens
atttcctgagctaaatgcttca

SEQ ID NO: 1541234 - DNA, 20 bp, Homo sapiens
atttcctgcccttcctcagt

SEQ ID NO: 1541235 - DNA, 15 bp, Homo sapiens
atttcctgcttccct

SEQ ID NO: 1541236 - DNA, 16 bp, Homo sapiens
atttcctggccctcca

SEQ ID NO: 1541237 - DNA, 15 bp, Homo sapiens
atttccttggaggcc

SEQ ID NO: 1541238 - DNA, 20 bp, Homo sapiens
atttccttggattttcctga

SEQ ID NO: 1541239 - DNA, 10 bp, Homo sapiens
atttccttta

SEQ ID NO: 1541240 - DNA, 15 bp, Homo sapiens
atttcctttatgtga

SEQ ID NO: 1541241 - DNA, 17 bp, Homo sapiens
atttcctttttgacact

SEQ ID NO: 1541242 - DNA, 20 bp, Homo sapiens
atttcctttttgacactgaa

SEQ ID NO: 1541243 - DNA, 17 bp, Homo sapiens
atttccttttttaaaaa

SEQ ID NO: 1541244 - DNA, 20 bp, Homo sapiens
atttcgttgtccaatttgta

SEQ ID NO: 1541245 - DNA, 21 bp, Homo sapiens
atttcgttgtccaatttgtaa

SEQ ID NO: 1541246 - DNA, 17 bp, Homo sapiens
atttctaaaatataaga

SEQ ID NO: 1541247 - DNA, 12 bp, Homo sapiens
atttctaacagt

SEQ ID NO: 1541248 - DNA, 21 bp, Homo sapiens
atttctaacagtccttgcttt

SEQ ID NO: 1541249 - DNA, 13 bp, Homo sapiens
atttctaactatt

SEQ ID NO: 1541250 - DNA, 20 bp, Homo sapiens
atttctaagcttatttctaa

SEQ ID NO: 1541251 - DNA, 21 bp, Homo sapiens
atttctaagtcaaacacttgt

SEQ ID NO: 1541252 - DNA, 21 bp, Homo sapiens
atttctaatccttttccttat

SEQ ID NO: 1541253 - DNA, 12 bp, Homo sapiens
atttctaattgt

SEQ ID NO: 1541254 - DNA, 16 bp, Homo sapiens
atttctaattgtaagt

SEQ ID NO: 1541255 - DNA, 18 bp, Homo sapiens
atttctacaactggagtt

SEQ ID NO: 1541256 - DNA, 19 bp, Homo sapiens
atttctacacagtgggaac

SEQ ID NO: 1541257 - DNA, 18 bp, Homo sapiens
atttctaccatttcagag

SEQ ID NO: 1541258 - DNA, 18 bp, Homo sapiens
atttctagggaaattttt

SEQ ID NO: 1541259 - DNA, 21 bp, Homo sapiens
atttctagttctttcctcccc

SEQ ID NO: 1541260 - DNA, 21 bp, Homo sapiens
atttctataaatagatgctgt

SEQ ID NO: 1541261 - DNA, 14 bp, Homo sapiens
atttctatctgcaa

SEQ ID NO: 1541262 - DNA, 17 bp, Homo sapiens
atttctatgacaaattc

SEQ ID NO: 1541263 - DNA, 11 bp, Homo sapiens
atttctatgtc

SEQ ID NO: 1541264 - DNA, 15 bp, Homo sapiens
atttctattaatatc

SEQ ID NO: 1541265 - DNA, 22 bp, Homo sapiens
atttctattattaattgcaaaa

SEQ ID NO: 1541266 - DNA, 15 bp, Homo sapiens
atttctcaggaagag

SEQ ID NO: 1541267 - DNA, 18 bp, Homo sapiens
atttctcataattttgca

SEQ ID NO: 1541268 - DNA, 20 bp, Homo sapiens
atttctcataattttgcaaa

SEQ ID NO: 1541269 - DNA, 20 bp, Homo sapiens
atttctcatacttagaaaca

SEQ ID NO: 1541270 - DNA, 16 bp, Homo sapiens
atttctccagttggga

SEQ ID NO: 1541271 - DNA, 19 bp, Homo sapiens
atttctccatctttataga

SEQ ID NO: 1541272 - DNA, 15 bp, Homo sapiens
atttctcctttgata

SEQ ID NO: 1541273 - DNA, 18 bp, Homo sapiens
atttctctgaacagaaaa

SEQ ID NO: 1541274 - DNA, 18 bp, Homo sapiens
atttctctgagcagtcag

SEQ ID NO: 1541275 - DNA, 15 bp, Homo sapiens
atttctcttcctaaa

SEQ ID NO: 1541276 - DNA, 13 bp, Homo sapiens
atttctgaactgt

SEQ ID NO: 1541277 - DNA, 16 bp, Homo sapiens
atttctgaactgttac

SEQ ID NO: 1541278 - DNA, 20 bp, Homo sapiens
atttctgaaggtagcattct

SEQ ID NO: 1541279 - DNA, 15 bp, Homo sapiens
atttctgactcttat

SEQ ID NO: 1541280 - DNA, 16 bp, Homo sapiens
atttctgactcttatt

SEQ ID NO: 1541281 - DNA, 23 bp, Homo sapiens
atttctgagaaggtccttaatga

SEQ ID NO: 1541282 - DNA, 12 bp, Homo sapiens
atttctgataaa

SEQ ID NO: 1541283 - DNA, 18 bp, Homo sapiens
atttctgcagatggaaag

SEQ ID NO: 1541284 - DNA, 12 bp, Homo sapiens
atttctgccagc

SEQ ID NO: 1541285 - DNA, 17 bp, Homo sapiens
atttctgctaagttctc

SEQ ID NO: 1541286 - DNA, 20 bp, Homo sapiens
atttctgctaagttctccca

SEQ ID NO: 1541287 - DNA, 15 bp, Homo sapiens
atttctgctctggaa

SEQ ID NO: 1541288 - DNA, 18 bp, Homo sapiens
atttctgggtcttttgct

SEQ ID NO: 1541289 - DNA, 12 bp, Homo sapiens
atttctggttga

SEQ ID NO: 1541290 - DNA, 13 bp, Homo sapiens
atttctgtatata

SEQ ID NO: 1541291 - DNA, 16 bp, Homo sapiens
atttctgtctctaacc

SEQ ID NO: 1541292 - DNA, 12 bp, Homo sapiens
atttctgtgtcc

SEQ ID NO: 1541293 - DNA, 16 bp, Homo sapiens
atttctgtgtccagtt

SEQ ID NO: 1541294 - DNA, 13 bp, Homo sapiens
atttctgttcagc

SEQ ID NO: 1541295 - DNA, 14 bp, Homo sapiens
atttctgttctcat

SEQ ID NO: 1541296 - DNA, 17 bp, Homo sapiens
atttcttaacctttgct

SEQ ID NO: 1541297 - DNA, 14 bp, Homo sapiens
atttcttaacttct

SEQ ID NO: 1541298 - DNA, 17 bp, Homo sapiens
atttcttaacttcttgc

SEQ ID NO: 1541299 - DNA, 20 bp, Homo sapiens
atttcttactaaacattttg

SEQ ID NO: 1541300 - DNA, 23 bp, Homo sapiens
atttcttagtgcttcagagtttg

SEQ ID NO: 1541301 - DNA, 14 bp, Homo sapiens
atttcttatgtgac

SEQ ID NO: 1541302 - DNA, 17 bp, Homo sapiens
atttcttatgtgacatt

SEQ ID NO: 1541303 - DNA, 11 bp, Homo sapiens
atttcttccca

SEQ ID NO: 1541304 - DNA, 20 bp, Homo sapiens
atttcttcccagaatctctg

SEQ ID NO: 1541305 - DNA, 20 bp, Homo sapiens
atttcttccctgctttgcat

SEQ ID NO: 1541306 - DNA, 18 bp, Homo sapiens
atttcttcctcactatga

SEQ ID NO: 1541307 - DNA, 19 bp, Homo sapiens
atttcttctctttagtata

SEQ ID NO: 1541308 - DNA, 15 bp, Homo sapiens
atttcttcttagaaa

SEQ ID NO: 1541309 - DNA, 17 bp, Homo sapiens
atttcttcttagaaaaa

SEQ ID NO: 1541310 - DNA, 18 bp, Homo sapiens
atttcttcttctaagaag

SEQ ID NO: 1541311 - DNA, 22 bp, Homo sapiens
atttcttcttctaagaagacat

SEQ ID NO: 1541312 - DNA, 14 bp, Homo sapiens
atttcttggcaaat

SEQ ID NO: 1541313 - DNA, 16 bp, Homo sapiens
atttcttggcattgga

SEQ ID NO: 1541314 - DNA, 19 bp, Homo sapiens
atttcttggtaagaagccg

SEQ ID NO: 1541315 - DNA, 13 bp, Homo sapiens
atttcttgtttgt

SEQ ID NO: 1541316 - DNA, 14 bp, Homo sapiens
atttcttgtttgtt

SEQ ID NO: 1541317 - DNA, 22 bp, Homo sapiens
atttctttcttgctggctctga

SEQ ID NO: 1541318 - DNA, 22 bp, Homo sapiens
atttctttctttgcaccaaaga

SEQ ID NO: 1541319 - DNA, 14 bp, Homo sapiens
atttctttgattgt

SEQ ID NO: 1541320 - DNA, 21 bp, Homo sapiens
atttctttgttatcaaacttc

SEQ ID NO: 1541321 - DNA, 22 bp, Homo sapiens
atttctttgttatcaaacttca

SEQ ID NO: 1541322 - DNA, 21 bp, Homo sapiens
atttctttgtttaacaaaaga

SEQ ID NO: 1541323 - DNA, 19 bp, Homo sapiens
atttctttttaattatttt

SEQ ID NO: 1541324 - DNA, 22 bp, Homo sapiens
atttctttttaattattttaaa

SEQ ID NO: 1541325 - DNA, 15 bp, Homo sapiens
atttctttttatagg

SEQ ID NO: 1541326 - DNA, 14 bp, Homo sapiens
atttgaaaaatata

SEQ ID NO: 1541327 - DNA, 17 bp, Homo sapiens
atttgaaatagtataca

SEQ ID NO: 1541328 - DNA, 23 bp, Homo sapiens
atttgaagctgcagtgagctgtg

SEQ ID NO: 1541329 - DNA, 24 bp, Homo sapiens
atttgaagtaacttatttgactat

SEQ ID NO: 1541330 - DNA, 22 bp, Homo sapiens
atttgaatgtgtgaattcaata

SEQ ID NO: 1541331 - DNA, 18 bp, Homo sapiens
atttgaattatcagcaaa

SEQ ID NO: 1541332 - DNA, 23 bp, Homo sapiens
atttgacaaaatttgttgaaatt

SEQ ID NO: 1541333 - DNA, 19 bp, Homo sapiens
atttgacacaaagcttcta

SEQ ID NO: 1541334 - DNA, 17 bp, Homo sapiens
atttgactaattttaca

SEQ ID NO: 1541335 - DNA, 13 bp, Homo sapiens
atttgacttgaat

SEQ ID NO: 1541336 - DNA, 22 bp, Homo sapiens
atttgacttttctgtaattcag

SEQ ID NO: 1541337 - DNA, 15 bp, Homo sapiens
atttgtcactgaata

SEQ ID NO: 1541338 - DNA, 19 bp, Homo sapiens
atttgtcagtatttttgcc

SEQ ID NO: 1541339 - DNA, 13 bp, Homo sapiens
atttgtccaaata

SEQ ID NO: 1541340 - DNA, 22 bp, Homo sapiens
atttgtcccaatagctctactg

SEQ ID NO: 1541341 - DNA, 19 bp, Homo sapiens
atttgtcccagcctggggc

SEQ ID NO: 1541342 - DNA, 20 bp, Homo sapiens
atttgtcctctttacatgaa

SEQ ID NO: 1541343 - DNA, 14 bp, Homo sapiens
atttgtcttccgat

SEQ ID NO: 1541344 - DNA, 15 bp, Homo sapiens
atttgtctttaaaca

SEQ ID NO: 1541345 - DNA, 15 bp, Homo sapiens
atttgtctttgtaat

SEQ ID NO: 1541346 - DNA, 21 bp, Homo sapiens
atttgtctttttgttgtaaaa

SEQ ID NO: 1541347 - DNA, 23 bp, Homo sapiens
atttgtctttttgttgtaaaaca

SEQ ID NO: 1541348 - DNA, 15 bp, Homo sapiens
atttgtgcaaacatg

SEQ ID NO: 1541349 - DNA, 20 bp, Homo sapiens
atttgtgccgtaattatgta

SEQ ID NO: 1541350 - DNA, 21 bp, Homo sapiens
atttgtgctttttaagaatat

SEQ ID NO: 1541351 - DNA, 22 bp, Homo sapiens
atttgtggtaatctacaccaat

SEQ ID NO: 1541352 - DNA, 22 bp, Homo sapiens
atttgtgtgtttttagctgtga

SEQ ID NO: 1541353 - DNA, 14 bp, Homo sapiens
atttgttataatga

SEQ ID NO: 1541354 - DNA, 15 bp, Homo sapiens
atttgttatatataa

SEQ ID NO: 1541355 - DNA, 19 bp, Homo sapiens
atttgttatatataataaa

SEQ ID NO: 1541356 - DNA, 21 bp, Homo sapiens
atttgttatatataataaata

SEQ ID NO: 1541357 - DNA, 13 bp, Homo sapiens
atttgttcctgga

SEQ ID NO: 1541358 - DNA, 20 bp, Homo sapiens
atttgttcctggagttttga

SEQ ID NO: 1541359 - DNA, 14 bp, Homo sapiens
atttgttggaatga

SEQ ID NO: 1541360 - DNA, 15 bp, Homo sapiens
atttgttggaatgaa

SEQ ID NO: 1541361 - DNA, 13 bp, Homo sapiens
atttgtttaaaag

SEQ ID NO: 1541362 - DNA, 15 bp, Homo sapiens
atttgtttaaaagga

SEQ ID NO: 1541363 - DNA, 16 bp, Homo sapiens
atttgtttaaagaata

SEQ ID NO: 1541364 - DNA, 17 bp, Homo sapiens
atttgtttaaagaataa

SEQ ID NO: 1541365 - DNA, 19 bp, Homo sapiens
atttgtttaaagaataaag

SEQ ID NO: 1541366 - DNA, 22 bp, Homo sapiens
atttgtttatggtaaaaaattt

SEQ ID NO: 1541367 - DNA, 22 bp, Homo sapiens
atttgtttcccccacagtttta

SEQ ID NO: 1541368 - DNA, 21 bp, Homo sapiens
atttgttttagcattacctaa

SEQ ID NO: 1541369 - DNA, 13 bp, Homo sapiens
atttgttttgctt

SEQ ID NO: 1541370 - DNA, 14 bp, Homo sapiens
atttgttttgcttt

SEQ ID NO: 1541371 - DNA, 22 bp, Homo sapiens
atttgtttttgtatttttaatg

SEQ ID NO: 1541372 - DNA, 22 bp, Homo sapiens
attttaaaaatacagatagata

SEQ ID NO: 1541373 - DNA, 13 bp, Homo sapiens
attttaaaataaa

SEQ ID NO: 1541374 - DNA, 15 bp, Homo sapiens
attttaaaatatatg

SEQ ID NO: 1541375 - DNA, 13 bp, Homo sapiens
attttaaaatatt

SEQ ID NO: 1541376 - DNA, 15 bp, Homo sapiens
attttaaaatattta

SEQ ID NO: 1541377 - DNA, 14 bp, Homo sapiens
attttaaaatgtac

SEQ ID NO: 1541378 - DNA, 15 bp, Homo sapiens
attttaaaatgtaca

SEQ ID NO: 1541379 - DNA, 14 bp, Homo sapiens
attttaaaatttca

SEQ ID NO: 1541380 - DNA, 15 bp, Homo sapiens
attttaaaatttgtt

SEQ ID NO: 1541381 - DNA, 17 bp, Homo sapiens
attttaaaatttgttct

SEQ ID NO: 1541382 - DNA, 17 bp, Homo sapiens
attttaaagtatgcatt

SEQ ID NO: 1541383 - DNA, 17 bp, Homo sapiens
attttaaagtgcaaaag

SEQ ID NO: 1541384 - DNA, 12 bp, Homo sapiens
attttaaagtta

SEQ ID NO: 1541385 - DNA, 14 bp, Homo sapiens
attttaaagttagt

SEQ ID NO: 1541386 - DNA, 18 bp, Homo sapiens
attttaaagttcttattt

SEQ ID NO: 1541387 - DNA, 23 bp, Homo sapiens
attttaaagttcttattttagta

SEQ ID NO: 1541388 - DNA, 17 bp, Homo sapiens
attttaaataatttcta

SEQ ID NO: 1541389 - DNA, 22 bp, Homo sapiens
attttaaattataacttaaaat

SEQ ID NO: 1541390 - DNA, 17 bp, Homo sapiens
attttaacaactgctct

SEQ ID NO: 1541391 - DNA, 16 bp, Homo sapiens
attttaactaaatttt

SEQ ID NO: 1541392 - DNA, 18 bp, Homo sapiens
attttaactaaattttaa

SEQ ID NO: 1541393 - DNA, 14 bp, Homo sapiens
attttaagagaaaa

SEQ ID NO: 1541394 - DNA, 19 bp, Homo sapiens
attttaagcctttgttgaa

SEQ ID NO: 1541395 - DNA, 22 bp, Homo sapiens
attttaagcctttgttgaactg

SEQ ID NO: 1541396 - DNA, 23 bp, Homo sapiens
attttaagcctttgttgaactgt

SEQ ID NO: 1541397 - DNA, 16 bp, Homo sapiens
attttaaggatatgat

SEQ ID NO: 1541398 - DNA, 17 bp, Homo sapiens
attttaaggttgcacac

SEQ ID NO: 1541399 - DNA, 14 bp, Homo sapiens
gcgtctgagctggg

SEQ ID NO: 1541400 - DNA, 18 bp, Homo sapiens
gcgtctgcctaggagctg

SEQ ID NO: 1541401 - DNA, 19 bp, Homo sapiens
gcgtctgctcataggacct

SEQ ID NO: 1541402 - DNA, 16 bp, Homo sapiens
gcgtctgctctggtgg

SEQ ID NO: 1541403 - DNA, 15 bp, Homo sapiens
gcgtctgttttgtgt

SEQ ID NO: 1541404 - DNA, 12 bp, Homo sapiens
gcgtcttcctga

SEQ ID NO: 1541405 - DNA, 21 bp, Homo sapiens
gcgtcttcctgagtggtgcca

SEQ ID NO: 1541406 - DNA, 18 bp, Homo sapiens
gcgtcttgcccagcagct

SEQ ID NO: 1541407 - DNA, 16 bp, Homo sapiens
gcgtgagacccagtgc

SEQ ID NO: 1541408 - DNA, 21 bp, Homo sapiens
gcgtgcccccctcctccagta

SEQ ID NO: 1541409 - DNA, 15 bp, Homo sapiens
gcgtgccgcctgctc

SEQ ID NO: 1541410 - DNA, 16 bp, Homo sapiens
gcgtgccgcctgctcc

SEQ ID NO: 1541411 - DNA, 17 bp, Homo sapiens
gcgtgccgcctgctcct

SEQ ID NO: 1541412 - DNA, 19 bp, Homo sapiens
gcgtgccgcctgctcctca

SEQ ID NO: 1541413 - DNA, 21 bp, Homo sapiens
gcgtgcgcatcttgcctccag

SEQ ID NO: 1541414 - DNA, 23 bp, Homo sapiens
gcgtgcgcatcttgcctccaggt

SEQ ID NO: 1541415 - DNA, 15 bp, Homo sapiens
gcgtgctccttttct

SEQ ID NO: 1541416 - DNA, 17 bp, Homo sapiens
gcgtgctgagaggcgag

SEQ ID NO: 1541417 - DNA, 12 bp, Homo sapiens
gcgtgctggaga

SEQ ID NO: 1541418 - DNA, 13 bp, Homo sapiens
gcgtggactctgc

SEQ ID NO: 1541419 - DNA, 14 bp, Homo sapiens
gcgtggactctgca

SEQ ID NO: 1541420 - DNA, 18 bp, Homo sapiens
gcgtggactctgcacatg

SEQ ID NO: 1541421 - DNA, 17 bp, Homo sapiens
gcgtggccacgggggca

SEQ ID NO: 1541422 - DNA, 14 bp, Homo sapiens
gcgtggctgtggca

SEQ ID NO: 1541423 - DNA, 15 bp, Homo sapiens
gcgtgggagccagcc

SEQ ID NO: 1541424 - DNA, 23 bp, Homo sapiens
gcgtggtgtgtccctggacacag

SEQ ID NO: 1541425 - DNA, 13 bp, Homo sapiens
gcgtgtgcacgtg

SEQ ID NO: 1541426 - DNA, 21 bp, Homo sapiens
gcgtgtgcatagcgtcctgcc

SEQ ID NO: 1541427 - DNA, 17 bp, Homo sapiens
gcgtgtggagcagagct

SEQ ID NO: 1541428 - DNA, 11 bp, Homo sapiens
gcgtgtgtata

SEQ ID NO: 1541429 - DNA, 22 bp, Homo sapiens
gcgtgttagtgtgtgtgcatgt

SEQ ID NO: 1541430 - DNA, 15 bp, Homo sapiens
gcgtgttcagcagaa

SEQ ID NO: 1541431 - DNA, 16 bp, Homo sapiens
gcgttactaattggcc

SEQ ID NO: 1541432 - DNA, 14 bp, Homo sapiens
gcgttagggctgct

SEQ ID NO: 1541433 - DNA, 11 bp, Homo sapiens
gcgttcctggc

SEQ ID NO: 1541434 - DNA, 18 bp, Homo sapiens
gcgttctgctgcccctgc

SEQ ID NO: 1541435 - DNA, 23 bp, Homo sapiens
gcgttggtgccacttcttaaagg

SEQ ID NO: 1541436 - DNA, 21 bp, Homo sapiens
gcgtttagtttctagaggcct

SEQ ID NO: 1541437 - DNA, 22 bp, Homo sapiens
gcgtttagtttctagaggcctc

SEQ ID NO: 1541438 - DNA, 15 bp, Homo sapiens
gcgtttgcacggttt

SEQ ID NO: 1541439 - DNA, 14 bp, Homo sapiens
gcgtttttacagtt

SEQ ID NO: 1541440 - DNA, 14 bp, Homo sapiens
gctaaaaaagcata

SEQ ID NO: 1541441 - DNA, 13 bp, Homo sapiens
gctaaaaaataaa

SEQ ID NO: 1541442 - DNA, 13 bp, Homo sapiens
gctaaagccagga

SEQ ID NO: 1541443 - DNA, 21 bp, Homo sapiens
gctaaagtaaacaactcaagg

SEQ ID NO: 1541444 - DNA, 12 bp, Homo sapiens
gctaaataaaca

SEQ ID NO: 1541445 - DNA, 19 bp, Homo sapiens
gctaaatggtcgcccagga

SEQ ID NO: 1541446 - DNA, 18 bp, Homo sapiens
gctaaatgtaacttattc

SEQ ID NO: 1541447 - DNA, 17 bp, Homo sapiens
gctaacaatttctcata

SEQ ID NO: 1541448 - DNA, 21 bp, Homo sapiens
gctaacccccttctactgagc

SEQ ID NO: 1541449 - DNA, 20 bp, Homo sapiens
gctaacctgttacactgggc

SEQ ID NO: 1541450 - DNA, 13 bp, Homo sapiens
gctaactgggtta

SEQ ID NO: 1541451 - DNA, 20 bp, Homo sapiens
gctaactgggttaaatattt

SEQ ID NO: 1541452 - DNA, 18 bp, Homo sapiens
gctaactggttaaacatt

SEQ ID NO: 1541453 - DNA, 16 bp, Homo sapiens
gctaactgtaaatcat

SEQ ID NO: 1541454 - DNA, 17 bp, Homo sapiens
gctaagaacctggaact

SEQ ID NO: 1541455 - DNA, 15 bp, Homo sapiens
gctaagaccctgtgt

SEQ ID NO: 1541456 - DNA, 20 bp, Homo sapiens
gctaagagctagcgctgccg

SEQ ID NO: 1541457 - DNA, 21 bp, Homo sapiens
gctaagatagaaagctggact

SEQ ID NO: 1541458 - DNA, 22 bp, Homo sapiens
gctaagatgagatttgccagca

SEQ ID NO: 1541459 - DNA, 21 bp, Homo sapiens
gctaagatgtggtgcttttct

SEQ ID NO: 1541460 - DNA, 16 bp, Homo sapiens
gctaagcatggcctgg

SEQ ID NO: 1541461 - DNA, 20 bp, Homo sapiens
gctaaggacatttcccaggg

SEQ ID NO: 1541462 - DNA, 19 bp, Homo sapiens
gctaaggctcctccttgcc

SEQ ID NO: 1541463 - DNA, 19 bp, Homo sapiens
gctaaggtttccagtcaga

SEQ ID NO: 1541464 - DNA, 17 bp, Homo sapiens
gctaagtatttcccagc

SEQ ID NO: 1541465 - DNA, 14 bp, Homo sapiens
gctaagtgcttatt

SEQ ID NO: 1541466 - DNA, 12 bp, Homo sapiens
gctaataaactg

SEQ ID NO: 1541467 - DNA, 19 bp, Homo sapiens
gctaataaactgtattaaa

SEQ ID NO: 1541468 - DNA, 22 bp, Homo sapiens
gctaataaactgtattaaatct

SEQ ID NO: 1541469 - DNA, 17 bp, Homo sapiens
gctaataaatctcttct

SEQ ID NO: 1541470 - DNA, 14 bp, Homo sapiens
gctaatcagcattc

SEQ ID NO: 1541471 - DNA, 22 bp, Homo sapiens
gctaatcatgtgggtgagccag

SEQ ID NO: 1541472 - DNA, 22 bp, Homo sapiens
gctaatctgaccgttctattgt

SEQ ID NO: 1541473 - DNA, 18 bp, Homo sapiens
gctaatctgtagggctgg

SEQ ID NO: 1541474 - DNA, 18 bp, Homo sapiens
gctaattatatattttgt

SEQ ID NO: 1541475 - DNA, 23 bp, Homo sapiens
gctaattatatattttgttgttc

SEQ ID NO: 1541476 - DNA, 12 bp, Homo sapiens
gctaattgagac

SEQ ID NO: 1541477 - DNA, 21 bp, Homo sapiens
gctaattgtactaatctgaga

SEQ ID NO: 1541478 - DNA, 14 bp, Homo sapiens
gctaatttaacacc

SEQ ID NO: 1541479 - DNA, 23 bp, Homo sapiens
gctaatttagagataggaaactg

SEQ ID NO: 1541480 - DNA, 12 bp, Homo sapiens
gctaatttttat

SEQ ID NO: 1541481 - DNA, 18 bp, Homo sapiens
gctaatttttattaattt

SEQ ID NO: 1541482 - DNA, 18 bp, Homo sapiens
gctaattttttgtacttt

SEQ ID NO: 1541483 - DNA, 18 bp, Homo sapiens
gctacaaaaacacagcaa

SEQ ID NO: 1541484 - DNA, 13 bp, Homo sapiens
gctacaattttaa

SEQ ID NO: 1541485 - DNA, 16 bp, Homo sapiens
gctacacagatcacag

SEQ ID NO: 1541486 - DNA, 19 bp, Homo sapiens
gctacagcaatttctaatt

SEQ ID NO: 1541487 - DNA, 23 bp, Homo sapiens
gctacaggaagcaccccatgcca

SEQ ID NO: 1541488 - DNA, 14 bp, Homo sapiens
gctacagtaccatg

SEQ ID NO: 1541489 - DNA, 19 bp, Homo sapiens
attgtagaattgtatatag

SEQ ID NO: 1541490 - DNA, 18 bp, Homo sapiens
attgtagcatttcttgat

SEQ ID NO: 1541491 - DNA, 19 bp, Homo sapiens
attgtagttctgtgtactt

SEQ ID NO: 1541492 - DNA, 18 bp, Homo sapiens
attgtataagtcaagcac

SEQ ID NO: 1541493 - DNA, 20 bp, Homo sapiens
attgtataagtcaagcacat

SEQ ID NO: 1541494 - DNA, 15 bp, Homo sapiens
attgtatacattttg

SEQ ID NO: 1541495 - DNA, 16 bp, Homo sapiens
attgtatcaatttgtt

SEQ ID NO: 1541496 - DNA, 13 bp, Homo sapiens
attgtatgaaaat

SEQ ID NO: 1541497 - DNA, 17 bp, Homo sapiens
attgtatgaaaatcctt

SEQ ID NO: 1541498 - DNA, 14 bp, Homo sapiens
attgtatgcaggga

SEQ ID NO: 1541499 - DNA, 14 bp, Homo sapiens
attgtatgtaagta

SEQ ID NO: 1541500 - DNA, 15 bp, Homo sapiens
attgtattaggaaaa

SEQ ID NO: 1541501 - DNA, 19 bp, Homo sapiens
attgtattgaaaacactta

SEQ ID NO: 1541502 - DNA, 13 bp, Homo sapiens
attgtcacttttt

SEQ ID NO: 1541503 - DNA, 19 bp, Homo sapiens
attgtcagctactaatgat

SEQ ID NO: 1541504 - DNA, 13 bp, Homo sapiens
attgtcatttata

SEQ ID NO: 1541505 - DNA, 20 bp, Homo sapiens
attgtccggccgctttgtga

SEQ ID NO: 1541506 - DNA, 13 bp, Homo sapiens
attgtcctgtagc

SEQ ID NO: 1541507 - DNA, 14 bp, Homo sapiens
attgtcctgtagct

SEQ ID NO: 1541508 - DNA, 17 bp, Homo sapiens
attgtccttcagagctc

SEQ ID NO: 1541509 - DNA, 19 bp, Homo sapiens
attgtcgctatgtgacttg

SEQ ID NO: 1541510 - DNA, 15 bp, Homo sapiens
attgtctaatgacag

SEQ ID NO: 1541511 - DNA, 21 bp, Homo sapiens
attgtctaatgacagataaat

SEQ ID NO: 1541512 - DNA, 21 bp, Homo sapiens
attgtctactcctagaagaac

SEQ ID NO: 1541513 - DNA, 14 bp, Homo sapiens
attgtctcaacgcc

SEQ ID NO: 1541514 - DNA, 20 bp, Homo sapiens
attgtctcctatatatttct

SEQ ID NO: 1541515 - DNA, 23 bp, Homo sapiens
attgtctcctatatatttctatt

SEQ ID NO: 1541516 - DNA, 21 bp, Homo sapiens
attgtctgtctacatttctgc

SEQ ID NO: 1541517 - DNA, 13 bp, Homo sapiens
attgtctttgctg

SEQ ID NO: 1541518 - DNA, 21 bp, Homo sapiens
gctactcagcagccctcctca

SEQ ID NO: 1541519 - DNA, 14 bp, Homo sapiens
gctactcaggaggc

SEQ ID NO: 1541520 - DNA, 23 bp, Homo sapiens
gctactcaggaggctgagacagg

SEQ ID NO: 1541521 - DNA, 22 bp, Homo sapiens
gctactcaggaggctgaggcag

SEQ ID NO: 1541522 - DNA, 23 bp, Homo sapiens
gctactcaggaggctgaggcaga

SEQ ID NO: 1541523 - DNA, 21 bp, Homo sapiens
gctactcagtggggctggcat

SEQ ID NO: 1541524 - DNA, 14 bp, Homo sapiens
gctactctgtccag

SEQ ID NO: 1541525 - DNA, 15 bp, Homo sapiens
gctactctgtccagg

SEQ ID NO: 1541526 - DNA, 18 bp, Homo sapiens
gctactctgtccaggcca

SEQ ID NO: 1541527 - DNA, 20 bp, Homo sapiens
gctactctgtccaggccact

SEQ ID NO: 1541528 - DNA, 17 bp, Homo sapiens
gctactctgttccttca

SEQ ID NO: 1541529 - DNA, 19 bp, Homo sapiens
gctactgaaaggcagtagt

SEQ ID NO: 1541530 - DNA, 15 bp, Homo sapiens
gctactgagacttgg

SEQ ID NO: 1541531 - DNA, 20 bp, Homo sapiens
gctactggaatggtgttttg

SEQ ID NO: 1541532 - DNA, 14 bp, Homo sapiens
gctactggcagctc

SEQ ID NO: 1541533 - DNA, 16 bp, Homo sapiens
gctactgtctcactga

SEQ ID NO: 1541534 - DNA, 20 bp, Homo sapiens
gctagaagtgggccaggaca

SEQ ID NO: 1541535 - DNA, 13 bp, Homo sapiens
gctagaatacttt

SEQ ID NO: 1541536 - DNA, 15 bp, Homo sapiens
gctagaatacttttt

SEQ ID NO: 1541537 - DNA, 19 bp, Homo sapiens
gctagacagaaaccaagcc

SEQ ID NO: 1541538 - DNA, 20 bp, Homo sapiens
gctagacagaaaccaagcca

SEQ ID NO: 1541539 - DNA, 16 bp, Homo sapiens
gctagactggagtgag

SEQ ID NO: 1541540 - DNA, 15 bp, Homo sapiens
gctagaggccaccta

SEQ ID NO: 1541541 - DNA, 16 bp, Homo sapiens
gctagagtcctcactc

SEQ ID NO: 1541542 - DNA, 18 bp, Homo sapiens
gctagagtcctcactccc

SEQ ID NO: 1541543 - DNA, 18 bp, Homo sapiens
gctagatggaatggaaaa

SEQ ID NO: 1541544 - DNA, 19 bp, Homo sapiens
gctagcagtaaaagatgaa

SEQ ID NO: 1541545 - DNA, 19 bp, Homo sapiens
gctagcccagtccctggag

SEQ ID NO: 1541546 - DNA, 17 bp, Homo sapiens
gctagccctggggtggc

SEQ ID NO: 1541547 - DNA, 22 bp, Homo sapiens
gctagccctggggtggcgtctg

SEQ ID NO: 1541548 - DNA, 13 bp, Homo sapiens
gctagcctttctt

SEQ ID NO: 1541549 - DNA, 14 bp, Homo sapiens
gctagcgctgccgc

SEQ ID NO: 1541550 - DNA, 22 bp, Homo sapiens
gctagcgctgccgcaccccaga

SEQ ID NO: 1541551 - DNA, 15 bp, Homo sapiens
gctagctgccacttt

SEQ ID NO: 1541552 - DNA, 13 bp, Homo sapiens
gctagctgtagaa

SEQ ID NO: 1541553 - DNA, 23 bp, Homo sapiens
gctagcttctgcttttctgccct

SEQ ID NO: 1541554 - DNA, 12 bp, Homo sapiens
gctaggaagagg

SEQ ID NO: 1541555 - DNA, 17 bp, Homo sapiens
gctaggactgaggagtg

SEQ ID NO: 1541556 - DNA, 19 bp, Homo sapiens
gctaggactgaggagtggg

SEQ ID NO: 1541557 - DNA, 18 bp, Homo sapiens
gctaggagccccagcttc

SEQ ID NO: 1541558 - DNA, 18 bp, Homo sapiens
gctaggatgttgctcaga

SEQ ID NO: 1541559 - DNA, 17 bp, Homo sapiens
gctaggccccagaggcc

SEQ ID NO: 1541560 - DNA, 19 bp, Homo sapiens
gctaggccccagaggccct

SEQ ID NO: 1541561 - DNA, 20 bp, Homo sapiens
gctagtaccctatagagagg

SEQ ID NO: 1541562 - DNA, 19 bp, Homo sapiens
gctagtagcaatgtgcctt

SEQ ID NO: 1541563 - DNA, 21 bp, Homo sapiens
gctagtagcaatgtgccttga

SEQ ID NO: 1541564 - DNA, 21 bp, Homo sapiens
gctagtatcttcaaactttca

SEQ ID NO: 1541565 - DNA, 22 bp, Homo sapiens
gctagtcactggcagcctgcac

SEQ ID NO: 1541566 - DNA, 17 bp, Homo sapiens
gctagtgaaatggctgg

SEQ ID NO: 1541567 - DNA, 20 bp, Homo sapiens
gctagtgaaatggctggggc

SEQ ID NO: 1541568 - DNA, 18 bp, Homo sapiens
gctagtgatacactgtat

SEQ ID NO: 1541569 - DNA, 11 bp, Homo sapiens
gctagtgcctt

SEQ ID NO: 1541570 - DNA, 17 bp, Homo sapiens
gctagtgtgagtggcag

SEQ ID NO: 1541571 - DNA, 18 bp, Homo sapiens
gctagtgtgagtggcagc

SEQ ID NO: 1541572 - DNA, 21 bp, Homo sapiens
gctagtgtgagtggcagccat

SEQ ID NO: 1541573 - DNA, 22 bp, Homo sapiens
gctagtgtgagtggcagccatg

SEQ ID NO: 1541574 - DNA, 18 bp, Homo sapiens
gctagtgtttaaaaggct

SEQ ID NO: 1541575 - DNA, 17 bp, Homo sapiens
gctagttaaggtgtgca

SEQ ID NO: 1541576 - DNA, 20 bp, Homo sapiens
gctagttctcagcttgcagc

SEQ ID NO: 1541577 - DNA, 15 bp, Homo sapiens
gctagttctgctgcc

SEQ ID NO: 1541578 - DNA, 19 bp, Homo sapiens
gctataaagcagtattttt

SEQ ID NO: 1541579 - DNA, 21 bp, Homo sapiens
gctataaagcagtatttttct

SEQ ID NO: 1541580 - DNA, 15 bp, Homo sapiens
gctataaatatataa

SEQ ID NO: 1541581 - DNA, 15 bp, Homo sapiens
gctataaatgccaga

SEQ ID NO: 1541582 - DNA, 19 bp, Homo sapiens
gctataaatgccagagcca

SEQ ID NO: 1541583 - DNA, 20 bp, Homo sapiens
gctataaatgccagagccaa

SEQ ID NO: 1541584 - DNA, 23 bp, Homo sapiens
gctataacaactctattttttac

SEQ ID NO: 1541585 - DNA, 20 bp, Homo sapiens
gctataagtgctcaatagct

SEQ ID NO: 1541586 - DNA, 22 bp, Homo sapiens
gctataatcattagttttagag

SEQ ID NO: 1541587 - DNA, 21 bp, Homo sapiens
gctatactgcatactttttaa

SEQ ID NO: 1541588 - DNA, 17 bp, Homo sapiens
gctatataagacaagaa

SEQ ID NO: 1541589 - DNA, 14 bp, Homo sapiens
gctatatataaaac

SEQ ID NO: 1541590 - DNA, 19 bp, Homo sapiens
gctatatatttaggaaatt

SEQ ID NO: 1541591 - DNA, 22 bp, Homo sapiens
gctatcaatcaccgtctgtgtt

SEQ ID NO: 1541592 - DNA, 14 bp, Homo sapiens
gctatcacctagca

SEQ ID NO: 1541593 - DNA, 23 bp, Homo sapiens
gctatcagaccctattctcggct

SEQ ID NO: 1541594 - DNA, 20 bp, Homo sapiens
gctatcagtgctttgttgat

SEQ ID NO: 1541595 - DNA, 13 bp, Homo sapiens
gctatccttggct

SEQ ID NO: 1541596 - DNA, 15 bp, Homo sapiens
gctatcgccctcctt

SEQ ID NO: 1541597 - DNA, 19 bp, Homo sapiens
gctatcgccctcctttccc

SEQ ID NO: 1541598 - DNA, 16 bp, Homo sapiens
gctatctctgtgtgca

SEQ ID NO: 1541599 - DNA, 20 bp, Homo sapiens
gctatctgttcctatctgca

SEQ ID NO: 1541600 - DNA, 14 bp, Homo sapiens
gctatcttttctgg

SEQ ID NO: 1541601 - DNA, 17 bp, Homo sapiens
gctatgatcgcgccact

SEQ ID NO: 1541602 - DNA, 15 bp, Homo sapiens
gctatgatggtgaca

SEQ ID NO: 1541603 - DNA, 13 bp, Homo sapiens
gctatgcaaaata

SEQ ID NO: 1541604 - DNA, 18 bp, Homo sapiens
gctatgctaaacctcctg

SEQ ID NO: 1541605 - DNA, 19 bp, Homo sapiens
gctatggcaggataagaaa

SEQ ID NO: 1541606 - DNA, 23 bp, Homo sapiens
gctatggcccagaaacaacaggg

SEQ ID NO: 1541607 - DNA, 14 bp, Homo sapiens
gctatgggagcccc

SEQ ID NO: 1541608 - DNA, 18 bp, Homo sapiens
gctatgggagccccaggg

SEQ ID NO: 1541609 - DNA, 18 bp, Homo sapiens
gctatgggaggcagccga

SEQ ID NO: 1541610 - DNA, 19 bp, Homo sapiens
gctatgggaggcagccgag

SEQ ID NO: 1541611 - DNA, 12 bp, Homo sapiens
gctatgtaaggg

SEQ ID NO: 1541612 - DNA, 22 bp, Homo sapiens
gctatgtatggaatacagtgtt

SEQ ID NO: 1541613 - DNA, 14 bp, Homo sapiens
gctatgtgacttgc

SEQ ID NO: 1541614 - DNA, 21 bp, Homo sapiens
gctatgttctgtcttcccaaa

SEQ ID NO: 1541615 - DNA, 16 bp, Homo sapiens
gctattaaaaaagtct

SEQ ID NO: 1541616 - DNA, 23 bp, Homo sapiens
gctattcacctcagtagaaaagg

SEQ ID NO: 1541617 - DNA, 20 bp, Homo sapiens
gctattctgtgttgaacaca

SEQ ID NO: 1541618 - DNA, 17 bp, Homo sapiens
gctattgaagatgctgc

SEQ ID NO: 1541619 - DNA, 13 bp, Homo sapiens
gctattgcataag

SEQ ID NO: 1541620 - DNA, 12 bp, Homo sapiens
gctattgttgtg

SEQ ID NO: 1541621 - DNA, 16 bp, Homo sapiens
gctatttatgggcccc

SEQ ID NO: 1541622 - DNA, 22 bp, Homo sapiens
gctatttatgggcccctggcac

SEQ ID NO: 1541623 - DNA, 14 bp, Homo sapiens
gctatttgagcatg

SEQ ID NO: 1541624 - DNA, 17 bp, Homo sapiens
gctatttgtaaatctgc

SEQ ID NO: 1541625 - DNA, 17 bp, Homo sapiens
gctatttgtacaaataa

SEQ ID NO: 1541626 - DNA, 20 bp, Homo sapiens
gctatttgtacaaataaacc

SEQ ID NO: 1541627 - DNA, 18 bp, Homo sapiens
gctatttgttcagagagg

SEQ ID NO: 1541628 - DNA, 13 bp, Homo sapiens
gctattttgtgaa

SEQ ID NO: 1541629 - DNA, 14 bp, Homo sapiens
gctcaaaaggaaac

SEQ ID NO: 1541630 - DNA, 14 bp, Homo sapiens
gctcaaaattgctt

SEQ ID NO: 1541631 - DNA, 14 bp, Homo sapiens
gctcaaataaaatt

SEQ ID NO: 1541632 - DNA, 15 bp, Homo sapiens
gctcaaatgaaatgt

SEQ ID NO: 1541633 - DNA, 19 bp, Homo sapiens
gctcaacagacaattagaa

SEQ ID NO: 1541634 - DNA, 21 bp, Homo sapiens
attgtcttttagacaactaga

SEQ ID NO: 1541635 - DNA, 23 bp, Homo sapiens
attgtcttttagacaactagatt

SEQ ID NO: 1541636 - DNA, 23 bp, Homo sapiens
attgtcttttttttcctttgaac

SEQ ID NO: 1541637 - DNA, 19 bp, Homo sapiens
attgtgaccaatacatttg

SEQ ID NO: 1541638 - DNA, 16 bp, Homo sapiens
attgtgaccactgaat

SEQ ID NO: 1541639 - DNA, 19 bp, Homo sapiens
attgtgaccactgaattca

SEQ ID NO: 1541640 - DNA, 21 bp, Homo sapiens
attgtgaccactgaattcact

SEQ ID NO: 1541641 - DNA, 22 bp, Homo sapiens
attgtgaccactgaattcactc

SEQ ID NO: 1541642 - DNA, 17 bp, Homo sapiens
attgtgacttcactgta

SEQ ID NO: 1541643 - DNA, 16 bp, Homo sapiens
attgtgagccaccacg

SEQ ID NO: 1541644 - DNA, 20 bp, Homo sapiens
attgtgagctctggttattt

SEQ ID NO: 1541645 - DNA, 14 bp, Homo sapiens
attgtgatgtgtcc

SEQ ID NO: 1541646 - DNA, 16 bp, Homo sapiens
attgtgattagacaga

SEQ ID NO: 1541647 - DNA, 22 bp, Homo sapiens
attgtgattagacagaacacct

SEQ ID NO: 1541648 - DNA, 18 bp, Homo sapiens
attgtgattctgcctttg

SEQ ID NO: 1541649 - DNA, 21 bp, Homo sapiens
attgtgcacaagtctttccag

SEQ ID NO: 1541650 - DNA, 22 bp, Homo sapiens
attgtgcacaagtctttccaga

SEQ ID NO: 1541651 - DNA, 20 bp, Homo sapiens
attgtgcagtactttgtgca

SEQ ID NO: 1541652 - DNA, 11 bp, Homo sapiens
attgtgctgcc

SEQ ID NO: 1541653 - DNA, 21 bp, Homo sapiens
attgtggattataaaaaatgt

SEQ ID NO: 1541654 - DNA, 20 bp, Homo sapiens
attgtggtcacaacttgatg

SEQ ID NO: 1541655 - DNA, 15 bp, Homo sapiens
attgtgtaaaaaatg

SEQ ID NO: 1541656 - DNA, 18 bp, Homo sapiens
attgtgtaaaaaatggaa

SEQ ID NO: 1541657 - DNA, 12 bp, Homo sapiens
attgtgtacata

SEQ ID NO: 1541658 - DNA, 20 bp, Homo sapiens
attgtgtacatagagcaatg

SEQ ID NO: 1541659 - DNA, 21 bp, Homo sapiens
attgtgtacatagagcaatgt

SEQ ID NO: 1541660 - DNA, 23 bp, Homo sapiens
attgtgtacatagagcaatgttg

SEQ ID NO: 1541661 - DNA, 22 bp, Homo sapiens
attgtgtagcctttttgtataa

SEQ ID NO: 1541662 - DNA, 15 bp, Homo sapiens
attgtgtatattcat

SEQ ID NO: 1541663 - DNA, 22 bp, Homo sapiens
attgtgtcagaaacatgaaatg

SEQ ID NO: 1541664 - DNA, 14 bp, Homo sapiens
attgtgtctgcatt

SEQ ID NO: 1541665 - DNA, 19 bp, Homo sapiens
attgtgtgaaaaaagaaaa

SEQ ID NO: 1541666 - DNA, 18 bp, Homo sapiens
attgtgtgcgctgcctgg

SEQ ID NO: 1541667 - DNA, 18 bp, Homo sapiens
attgtgtgttatttaaat

SEQ ID NO: 1541668 - DNA, 20 bp, Homo sapiens
attgtgttcccatttcagct

SEQ ID NO: 1541669 - DNA, 17 bp, Homo sapiens
attgttaactcttgtct

SEQ ID NO: 1541670 - DNA, 21 bp, Homo sapiens
attgttaagtctaaatatttc

SEQ ID NO: 1541671 - DNA, 19 bp, Homo sapiens
attgttaatacaaggtata

SEQ ID NO: 1541672 - DNA, 17 bp, Homo sapiens
attgttaatttttccta

SEQ ID NO: 1541673 - DNA, 16 bp, Homo sapiens
attgttacaagtgttc

SEQ ID NO: 1541674 - DNA, 17 bp, Homo sapiens
attgttacaagtgttct

SEQ ID NO: 1541675 - DNA, 18 bp, Homo sapiens
attgttacaagtgttctt

SEQ ID NO: 1541676 - DNA, 21 bp, Homo sapiens
attgttagaaaatgacttatt

SEQ ID NO: 1541677 - DNA, 22 bp, Homo sapiens
attgttattgtggaagatttac

SEQ ID NO: 1541678 - DNA, 20 bp, Homo sapiens
attgttatttaatagctgtg

SEQ ID NO: 1541679 - DNA, 22 bp, Homo sapiens
attgttatttaatagctgtgat

SEQ ID NO: 1541680 - DNA, 13 bp, Homo sapiens
attgttcatttgt

SEQ ID NO: 1541681 - DNA, 20 bp, Homo sapiens
attgttcattttgagctgaa

SEQ ID NO: 1541682 - DNA, 15 bp, Homo sapiens
attgttcccttcctc

SEQ ID NO: 1541683 - DNA, 21 bp, Homo sapiens
attgttcgatgcctgcatgct

SEQ ID NO: 1541684 - DNA, 17 bp, Homo sapiens
attgttgaaaaagtttg

SEQ ID NO: 1541685 - DNA, 18 bp, Homo sapiens
attgttgacaactgtgac

SEQ ID NO: 1541686 - DNA, 21 bp, Homo sapiens
attgttgacagttctgaagaa

SEQ ID NO: 1541687 - DNA, 20 bp, Homo sapiens
attgttggtaattattttgg

SEQ ID NO: 1541688 - DNA, 13 bp, Homo sapiens
attgttgtgctta

SEQ ID NO: 1541689 - DNA, 22 bp, Homo sapiens
attgttgtgggctttctccggg

SEQ ID NO: 1541690 - DNA, 15 bp, Homo sapiens
attgttgtgtctgtg

SEQ ID NO: 1541691 - DNA, 14 bp, Homo sapiens
attgtttaaaatgt

SEQ ID NO: 1541692 - DNA, 22 bp, Homo sapiens
attgtttatgtgttatgaacat

SEQ ID NO: 1541693 - DNA, 21 bp, Homo sapiens
attgtttccaacttgtctggg

SEQ ID NO: 1541694 - DNA, 22 bp, Homo sapiens
attgtttccaacttgtctggga

SEQ ID NO: 1541695 - DNA, 18 bp, Homo sapiens
attgtttcttgacaagct

SEQ ID NO: 1541696 - DNA, 20 bp, Homo sapiens
attgtttctttaagaaagta

SEQ ID NO: 1541697 - DNA, 12 bp, Homo sapiens
attgtttgctgc

SEQ ID NO: 1541698 - DNA, 15 bp, Homo sapiens
attgtttgctgctat

SEQ ID NO: 1541699 - DNA, 22 bp, Homo sapiens
attgttttaaaaagaaacaaga

SEQ ID NO: 1541700 - DNA, 17 bp, Homo sapiens
attgttttaccagctcc

SEQ ID NO: 1541701 - DNA, 15 bp, Homo sapiens
attgttttagagact

SEQ ID NO: 1541702 - DNA, 19 bp, Homo sapiens
attgttttagagactatgg

SEQ ID NO: 1541703 - DNA, 17 bp, Homo sapiens
attgttttcacttgtat

SEQ ID NO: 1541704 - DNA, 18 bp, Homo sapiens
attgttttcacttgtatt

SEQ ID NO: 1541705 - DNA, 21 bp, Homo sapiens
attgttttctgtaaataacct

SEQ ID NO: 1541706 - DNA, 20 bp, Homo sapiens
attgttttgcaaaagtgtat

SEQ ID NO: 1541707 - DNA, 20 bp, Homo sapiens
attgtttttgaatttaaata

SEQ ID NO: 1541708 - DNA, 13 bp, Homo sapiens
attgttttttaaa

SEQ ID NO: 1541709 - DNA, 14 bp, Homo sapiens
attgttttttaaag

SEQ ID NO: 1541710 - DNA, 16 bp, Homo sapiens
attgttttttaaagaa

SEQ ID NO: 1541711 - DNA, 17 bp, Homo sapiens
attgttttttaaagcaa

SEQ ID NO: 1541712 - DNA, 23 bp, Homo sapiens
attgttttttaaagcaagtcacc

SEQ ID NO: 1541713 - DNA, 14 bp, Homo sapiens
atttaaaaaaatca

SEQ ID NO: 1541714 - DNA, 20 bp, Homo sapiens
atttaaaaaagaaaaaagtc

SEQ ID NO: 1541715 - DNA, 22 bp, Homo sapiens
atttaaaaaataaataaaaact

SEQ ID NO: 1541716 - DNA, 13 bp, Homo sapiens
atttaaaaacaac

SEQ ID NO: 1541717 - DNA, 18 bp, Homo sapiens
atttaaaaacaaccaaca

SEQ ID NO: 1541718 - DNA, 15 bp, Homo sapiens
atttaaaaactggaa

SEQ ID NO: 1541719 - DNA, 21 bp, Homo sapiens
atttaaaaagtgctatactaa

SEQ ID NO: 1541720 - DNA, 18 bp, Homo sapiens
atttaaaaataagtcaac

SEQ ID NO: 1541721 - DNA, 23 bp, Homo sapiens
atttaaaaataagtcaacagtaa

SEQ ID NO: 1541722 - DNA, 15 bp, Homo sapiens
atttaaaaattgttt

SEQ ID NO: 1541723 - DNA, 18 bp, Homo sapiens
atttaaaacagacactgg

SEQ ID NO: 1541724 - DNA, 17 bp, Homo sapiens
atttaaaactgttattt

SEQ ID NO: 1541725 - DNA, 14 bp, Homo sapiens
atttaaaagcctgc

SEQ ID NO: 1541726 - DNA, 15 bp, Homo sapiens
atttaaaagcctgct

SEQ ID NO: 1541727 - DNA, 21 bp, Homo sapiens
atttaaaataccactgtaatt

SEQ ID NO: 1541728 - DNA, 14 bp, Homo sapiens
atttaaaatatttc

SEQ ID NO: 1541729 - DNA, 13 bp, Homo sapiens
atttaaaatgatt

SEQ ID NO: 1541730 - DNA, 14 bp, Homo sapiens
atttaaaatgatta

SEQ ID NO: 1541731 - DNA, 16 bp, Homo sapiens
atttaaaatgattaga

SEQ ID NO: 1541732 - DNA, 14 bp, Homo sapiens
atttaaaattaagt

SEQ ID NO: 1541733 - DNA, 15 bp, Homo sapiens
atttaaaattaagta

SEQ ID NO: 1541734 - DNA, 19 bp, Homo sapiens
atttaaacatttgttcctg

SEQ ID NO: 1541735 - DNA, 20 bp, Homo sapiens
atttaaacatttgttcctgg

SEQ ID NO: 1541736 - DNA, 22 bp, Homo sapiens
atttaaacctttttcttgatct

SEQ ID NO: 1541737 - DNA, 15 bp, Homo sapiens
atttaaactctgaat

SEQ ID NO: 1541738 - DNA, 18 bp, Homo sapiens
atttaaacttacaaactt

SEQ ID NO: 1541739 - DNA, 22 bp, Homo sapiens
atttaaagaaaataaacaccat

SEQ ID NO: 1541740 - DNA, 15 bp, Homo sapiens
atttaaagcctcctc

SEQ ID NO: 1541741 - DNA, 15 bp, Homo sapiens
atttaaagctaaatt

SEQ ID NO: 1541742 - DNA, 21 bp, Homo sapiens
atttaaaggcttaggcatgtt

SEQ ID NO: 1541743 - DNA, 22 bp, Homo sapiens
atttaaaggcttaggcatgttc

SEQ ID NO: 1541744 - DNA, 18 bp, Homo sapiens
atttaaagggaaaaccct

SEQ ID NO: 1541745 - DNA, 17 bp, Homo sapiens
atttaaagggaaattga

SEQ ID NO: 1541746 - DNA, 17 bp, Homo sapiens
atttaaagttgtatctt

SEQ ID NO: 1541747 - DNA, 13 bp, Homo sapiens
atttaaataaagt

SEQ ID NO: 1541748 - DNA, 18 bp, Homo sapiens
atttaaatataattctgt

SEQ ID NO: 1541749 - DNA, 14 bp, Homo sapiens
gctcaacctaccct

SEQ ID NO: 1541750 - DNA, 16 bp, Homo sapiens
gctcaacctaccctgg

SEQ ID NO: 1541751 - DNA, 18 bp, Homo sapiens
gctcaactcacagcttct

SEQ ID NO: 1541752 - DNA, 22 bp, Homo sapiens
gctcaactcacagcttctccaa

SEQ ID NO: 1541753 - DNA, 20 bp, Homo sapiens
gctcaactctacccctgctc

SEQ ID NO: 1541754 - DNA, 14 bp, Homo sapiens
gctcaagatgacag

SEQ ID NO: 1541755 - DNA, 18 bp, Homo sapiens
gctcaagatgacagctct

SEQ ID NO: 1541756 - DNA, 18 bp, Homo sapiens
gctcaagggttctttcct

SEQ ID NO: 1541757 - DNA, 17 bp, Homo sapiens
gctcaagtcttccctga

SEQ ID NO: 1541758 - DNA, 20 bp, Homo sapiens
gctcaagtcttccctgatca

SEQ ID NO: 1541759 - DNA, 22 bp, Homo sapiens
gctcaatattcctgaatgaaat

SEQ ID NO: 1541760 - DNA, 14 bp, Homo sapiens
gctcaatcctctaa

SEQ ID NO: 1541761 - DNA, 16 bp, Homo sapiens
gctcaatcctctaagc

SEQ ID NO: 1541762 - DNA, 19 bp, Homo sapiens
gctcacaaggcccaggaga

SEQ ID NO: 1541763 - DNA, 13 bp, Homo sapiens
gctcacacacctg

SEQ ID NO: 1541764 - DNA, 15 bp, Homo sapiens
gctcacaccaaattt

SEQ ID NO: 1541765 - DNA, 22 bp, Homo sapiens
gctcacactgagaatgtaagaa

SEQ ID NO: 1541766 - DNA, 22 bp, Homo sapiens
gctcacagaacccttggagcca

SEQ ID NO: 1541767 - DNA, 23 bp, Homo sapiens
gctcacagttcctcgccctgggt

SEQ ID NO: 1541768 - DNA, 21 bp, Homo sapiens
gctcaccaggcctggcctctg

SEQ ID NO: 1541769 - DNA, 14 bp, Homo sapiens
gctcaccctgcccg

SEQ ID NO: 1541770 - DNA, 19 bp, Homo sapiens
gctcaccctgcccgctccc

SEQ ID NO: 1541771 - DNA, 16 bp, Homo sapiens
gctcaccgcccatcag

SEQ ID NO: 1541772 - DNA, 21 bp, Homo sapiens
gctcacctcagagcagggcca

SEQ ID NO: 1541773 - DNA, 13 bp, Homo sapiens
gctcacctttgtt

SEQ ID NO: 1541774 - DNA, 21 bp, Homo sapiens
gctcacgcctgtaatcccagc

SEQ ID NO: 1541775 - DNA, 22 bp, Homo sapiens
gctcacgcctgtaatcccagca

SEQ ID NO: 1541776 - DNA, 16 bp, Homo sapiens
gctcacgtctctgccg

SEQ ID NO: 1541777 - DNA, 15 bp, Homo sapiens
gctcactactgaaca

SEQ ID NO: 1541778 - DNA, 16 bp, Homo sapiens
gctcactatgaatcta

SEQ ID NO: 1541779 - DNA, 17 bp, Homo sapiens
gctcactatgaatctat

SEQ ID NO: 1541780 - DNA, 18 bp, Homo sapiens
gctcactcacagagtcaa

SEQ ID NO: 1541781 - DNA, 13 bp, Homo sapiens
gctcactcacccc

SEQ ID NO: 1541782 - DNA, 20 bp, Homo sapiens
gctcactcagccaccctgag

SEQ ID NO: 1541783 - DNA, 20 bp, Homo sapiens
gctcactcccaagggacagc

SEQ ID NO: 1541784 - DNA, 18 bp, Homo sapiens
gctcactgaaacctctgc

SEQ ID NO: 1541785 - DNA, 12 bp, Homo sapiens
gctcactgccag

SEQ ID NO: 1541786 - DNA, 13 bp, Homo sapiens
gctcactgccagg

SEQ ID NO: 1541787 - DNA, 19 bp, Homo sapiens
gctcactgccaggccagcc

SEQ ID NO: 1541788 - DNA, 22 bp, Homo sapiens
gctcactgccaggccagcctcc

SEQ ID NO: 1541789 - DNA, 15 bp, Homo sapiens
gctcacttctgggct

SEQ ID NO: 1541790 - DNA, 17 bp, Homo sapiens
gctcagaacttgctgct

SEQ ID NO: 1541791 - DNA, 19 bp, Homo sapiens
gctcagaacttgctgctgt

SEQ ID NO: 1541792 - DNA, 20 bp, Homo sapiens
gctcagaatagatctgatgg

SEQ ID NO: 1541793 - DNA, 15 bp, Homo sapiens
gctcagaatccaagt

SEQ ID NO: 1541794 - DNA, 18 bp, Homo sapiens
gctcagaatccaagtgaa

SEQ ID NO: 1541795 - DNA, 16 bp, Homo sapiens
gctcagacatgttttc

SEQ ID NO: 1541796 - DNA, 12 bp, Homo sapiens
gctcagacattt

SEQ ID NO: 1541797 - DNA, 19 bp, Homo sapiens
gctcagacggcggccaggc

SEQ ID NO: 1541798 - DNA, 22 bp, Homo sapiens
gctcagacggcggccaggcaca

SEQ ID NO: 1541799 - DNA, 23 bp, Homo sapiens
gctcagacggcggccaggcacag

SEQ ID NO: 1541800 - DNA, 12 bp, Homo sapiens
gctcagaggccc

SEQ ID NO: 1541801 - DNA, 20 bp, Homo sapiens
gctcagatcggccacagggc

SEQ ID NO: 1541802 - DNA, 22 bp, Homo sapiens
gctcagatcggccacagggcgg

SEQ ID NO: 1541803 - DNA, 23 bp, Homo sapiens
gctcagatgtcgtaatttgcact

SEQ ID NO: 1541804 - DNA, 14 bp, Homo sapiens
gctcagcagccagt

SEQ ID NO: 1541805 - DNA, 16 bp, Homo sapiens
gctcagcagccagtct

SEQ ID NO: 1541806 - DNA, 19 bp, Homo sapiens
gctcagccaaatttcctgt

SEQ ID NO: 1541807 - DNA, 16 bp, Homo sapiens
gctcagccccaactct

SEQ ID NO: 1541808 - DNA, 12 bp, Homo sapiens
gctcagcccgct

SEQ ID NO: 1541809 - DNA, 12 bp, Homo sapiens
gctcagccctcc

SEQ ID NO: 1541810 - DNA, 15 bp, Homo sapiens
gctcagccctccctg

SEQ ID NO: 1541811 - DNA, 16 bp, Homo sapiens
gctcagccctccctgc

SEQ ID NO: 1541812 - DNA, 17 bp, Homo sapiens
gctcagccctccctgcc

SEQ ID NO: 1541813 - DNA, 12 bp, Homo sapiens
gctcagccctgc

SEQ ID NO: 1541814 - DNA, 17 bp, Homo sapiens
gctcagcctcatcctga

SEQ ID NO: 1541815 - DNA, 15 bp, Homo sapiens
gctcagcctggtggg

SEQ ID NO: 1541816 - DNA, 17 bp, Homo sapiens
gctcagcctggtgggcc

SEQ ID NO: 1541817 - DNA, 16 bp, Homo sapiens
gctcagccttctcctc

SEQ ID NO: 1541818 - DNA, 20 bp, Homo sapiens
gctcagccttctcctcccaa

SEQ ID NO: 1541819 - DNA, 14 bp, Homo sapiens
gctcagccttgctg

SEQ ID NO: 1541820 - DNA, 17 bp, Homo sapiens
gctcagccttgctgctc

SEQ ID NO: 1541821 - DNA, 18 bp, Homo sapiens
gctcagccttgctgctct

SEQ ID NO: 1541822 - DNA, 19 bp, Homo sapiens
gctcagccttgctgctctg

SEQ ID NO: 1541823 - DNA, 19 bp, Homo sapiens
gctcagctcggggagcctt

SEQ ID NO: 1541824 - DNA, 13 bp, Homo sapiens
gctcagctgccca

SEQ ID NO: 1541825 - DNA, 19 bp, Homo sapiens
gctcagctgtggctggagg

SEQ ID NO: 1541826 - DNA, 14 bp, Homo sapiens
gctcaggacccagg

SEQ ID NO: 1541827 - DNA, 15 bp, Homo sapiens
gctcaggacccaggc

SEQ ID NO: 1541828 - DNA, 11 bp, Homo sapiens
gctcaggaggg

SEQ ID NO: 1541829 - DNA, 21 bp, Homo sapiens
gctcaggagggtgacgcccag

SEQ ID NO: 1541830 - DNA, 12 bp, Homo sapiens
gctcaggcaagc

SEQ ID NO: 1541831 - DNA, 22 bp, Homo sapiens
gctcaggcaagcccctcagccc

SEQ ID NO: 1541832 - DNA, 23 bp, Homo sapiens
gctcaggcagacaagagctgctg

SEQ ID NO: 1541833 - DNA, 24 bp, Homo sapiens
gctcaggcgatccacctgtctcag

SEQ ID NO: 1541834 - DNA, 23 bp, Homo sapiens
gctcagggccatgctgaggcctg

SEQ ID NO: 1541835 - DNA, 13 bp, Homo sapiens
gctcagggctgga

SEQ ID NO: 1541836 - DNA, 23 bp, Homo sapiens
gctcagggctggagtgcgctctt

SEQ ID NO: 1541837 - DNA, 22 bp, Homo sapiens
gctcaggggcctggaggtctgg

SEQ ID NO: 1541838 - DNA, 22 bp, Homo sapiens
gctcagggtcaaagacagaatg

SEQ ID NO: 1541839 - DNA, 17 bp, Homo sapiens
gctcagggtcactgaac

SEQ ID NO: 1541840 - DNA, 23 bp, Homo sapiens
gctcagggtcactgaaccactgc

SEQ ID NO: 1541841 - DNA, 12 bp, Homo sapiens
gctcagggtggt

SEQ ID NO: 1541842 - DNA, 21 bp, Homo sapiens
gctcaggtcacataaaacttt

SEQ ID NO: 1541843 - DNA, 14 bp, Homo sapiens
gctcaggtgcctta

SEQ ID NO: 1541844 - DNA, 18 bp, Homo sapiens
gctcaggtttgtcctggt

SEQ ID NO: 1541845 - DNA, 17 bp, Homo sapiens
gctcagtattttaaatg

SEQ ID NO: 1541846 - DNA, 12 bp, Homo sapiens
gctcagtcccat

SEQ ID NO: 1541847 - DNA, 17 bp, Homo sapiens
gctcagtctcaggagca

SEQ ID NO: 1541848 - DNA, 22 bp, Homo sapiens
gctcatagaattttgagtattc

SEQ ID NO: 1541849 - DNA, 13 bp, Homo sapiens
gctcataggacct

SEQ ID NO: 1541850 - DNA, 17 bp, Homo sapiens
gctcatcccccctgctg

SEQ ID NO: 1541851 - DNA, 13 bp, Homo sapiens
gctcatctatttg

SEQ ID NO: 1541852 - DNA, 13 bp, Homo sapiens
gctcatctgctgg

SEQ ID NO: 1541853 - DNA, 14 bp, Homo sapiens
gctcatctgctggt

SEQ ID NO: 1541854 - DNA, 15 bp, Homo sapiens
gctcatctgctggtc

SEQ ID NO: 1541855 - DNA, 21 bp, Homo sapiens
gctcatctgctggtccgtggg

SEQ ID NO: 1541856 - DNA, 17 bp, Homo sapiens
gctcatgcatagtccca

SEQ ID NO: 1541857 - DNA, 18 bp, Homo sapiens
gctcatgcatagtcccag

SEQ ID NO: 1541858 - DNA, 22 bp, Homo sapiens
gctcatggcgtaatgggcctgc

SEQ ID NO: 1541859 - DNA, 20 bp, Homo sapiens
gctcatgtcctgtcctggtc

SEQ ID NO: 1541860 - DNA, 17 bp, Homo sapiens
gctcatgttgagccagt

SEQ ID NO: 1541861 - DNA, 16 bp, Homo sapiens
gctcattatgccactt

SEQ ID NO: 1541862 - DNA, 20 bp, Homo sapiens
gctcattctgtctcttttct

SEQ ID NO: 1541863 - DNA, 11 bp, Homo sapiens
gctcatttaaa

SEQ ID NO: 1541864 - DNA, 14 bp, Homo sapiens
gctcatttaaaaca

SEQ ID NO: 1541865 - DNA, 14 bp, Homo sapiens
gctcatttttgctg

SEQ ID NO: 1541866 - DNA, 14 bp, Homo sapiens
gcgctcgcccagca

SEQ ID NO: 1541867 - DNA, 15 bp, Homo sapiens
gcgctcgctcaggtg

SEQ ID NO: 1541868 - DNA, 13 bp, Homo sapiens
gcgctctccacca

SEQ ID NO: 1541869 - DNA, 19 bp, Homo sapiens
gcgctctccctaccttgcc

SEQ ID NO: 1541870 - DNA, 14 bp, Homo sapiens
gcgctctcctggac

SEQ ID NO: 1541871 - DNA, 16 bp, Homo sapiens
gcgctcttggtccctg

SEQ ID NO: 1541872 - DNA, 20 bp, Homo sapiens
gcgctcttggtccctggtcc

SEQ ID NO: 1541873 - DNA, 14 bp, Homo sapiens
gcgctgcagcctcc

SEQ ID NO: 1541874 - DNA, 16 bp, Homo sapiens
gcgctgcagcctccct

SEQ ID NO: 1541875 - DNA, 11 bp, Homo sapiens
gcgctgcaggt

SEQ ID NO: 1541876 - DNA, 12 bp, Homo sapiens
gcgctgcctggc

SEQ ID NO: 1541877 - DNA, 10 bp, Homo sapiens
gcgctggccc

SEQ ID NO: 1541878 - DNA, 11 bp, Homo sapiens
gcgctggccca

SEQ ID NO: 1541879 - DNA, 12 bp, Homo sapiens
gcgctggcccag

SEQ ID NO: 1541880 - DNA, 13 bp, Homo sapiens
gcgctggcccagc

SEQ ID NO: 1541881 - DNA, 16 bp, Homo sapiens
gcgctggttccgccag

SEQ ID NO: 1541882 - DNA, 13 bp, Homo sapiens
gcgctgtggactg

SEQ ID NO: 1541883 - DNA, 22 bp, Homo sapiens
gcgctgtttttgttgtgtgtgc

SEQ ID NO: 1541884 - DNA, 13 bp, Homo sapiens
gcgcttccctggg

SEQ ID NO: 1541885 - DNA, 14 bp, Homo sapiens
gcggagagagccaa

SEQ ID NO: 1541886 - DNA, 19 bp, Homo sapiens
gcggagcccagcctgggag

SEQ ID NO: 1541887 - DNA, 16 bp, Homo sapiens
gcggagcttgcagtga

SEQ ID NO: 1541888 - DNA, 18 bp, Homo sapiens
gcggaggagaccagctca

SEQ ID NO: 1541889 - DNA, 16 bp, Homo sapiens
gcggaggagagagagg

SEQ ID NO: 1541890 - DNA, 17 bp, Homo sapiens
gcggaggaggagggagg

SEQ ID NO: 1541891 - DNA, 22 bp, Homo sapiens
gcggaggtctctgggagcccag

SEQ ID NO: 1541892 - DNA, 19 bp, Homo sapiens
gcggaggttgcagtgagct

SEQ ID NO: 1541893 - DNA, 14 bp, Homo sapiens
gcggagtgaagagg

SEQ ID NO: 1541894 - DNA, 14 bp, Homo sapiens
gcggatcctgctgg

SEQ ID NO: 1541895 - DNA, 15 bp, Homo sapiens
gcggatcctgctggg

SEQ ID NO: 1541896 - DNA, 19 bp, Homo sapiens
gcggattaatttgcatctg

SEQ ID NO: 1541897 - DNA, 14 bp, Homo sapiens
gcggcagcagccat

SEQ ID NO: 1541898 - DNA, 15 bp, Homo sapiens
gcggcagctggggcc

SEQ ID NO: 1541899 - DNA, 22 bp, Homo sapiens
gcggcaggagggaggtttgtga

SEQ ID NO: 1541900 - DNA, 17 bp, Homo sapiens
gcggccacgcactgggc

SEQ ID NO: 1541901 - DNA, 18 bp, Homo sapiens
gcggccagcgtcccaggg

SEQ ID NO: 1541902 - DNA, 19 bp, Homo sapiens
gcggccaggcacagggccc

SEQ ID NO: 1541903 - DNA, 20 bp, Homo sapiens
gcggccaggcacagggcccg

SEQ ID NO: 1541904 - DNA, 20 bp, Homo sapiens
gcggccagtgcggctgccag

SEQ ID NO: 1541905 - DNA, 20 bp, Homo sapiens
gcggcccactttcctgagct

SEQ ID NO: 1541906 - DNA, 21 bp, Homo sapiens
gcggcccactttcctgagctg

SEQ ID NO: 1541907 - DNA, 19 bp, Homo sapiens
gcggcccagaagtttccct

SEQ ID NO: 1541908 - DNA, 15 bp, Homo sapiens
gcggcccctcccaca

SEQ ID NO: 1541909 - DNA, 15 bp, Homo sapiens
gcggcccggccagcg

SEQ ID NO: 1541910 - DNA, 19 bp, Homo sapiens
gcggcccggccagcgggca

SEQ ID NO: 1541911 - DNA, 21 bp, Homo sapiens
gcggcccggccagcgggcaca

SEQ ID NO: 1541912 - DNA, 17 bp, Homo sapiens
gcggccctgctgaagct

SEQ ID NO: 1541913 - DNA, 14 bp, Homo sapiens
gcggccctgtcatc

SEQ ID NO: 1541914 - DNA, 19 bp, Homo sapiens
gcggcccttctgactgttt

SEQ ID NO: 1541915 - DNA, 22 bp, Homo sapiens
gcggcccttctgactgtttatt

SEQ ID NO: 1541916 - DNA, 18 bp, Homo sapiens
gcggccgcattccctgag

SEQ ID NO: 1541917 - DNA, 22 bp, Homo sapiens
gcggccgcccgcacgtccgcgg

SEQ ID NO: 1541918 - DNA, 21 bp, Homo sapiens
gcggcctccggcgtcttgccc

SEQ ID NO: 1541919 - DNA, 22 bp, Homo sapiens
gcggctactcagcagccctcct

SEQ ID NO: 1541920 - DNA, 16 bp, Homo sapiens
gcggctgagagcccca

SEQ ID NO: 1541921 - DNA, 18 bp, Homo sapiens
gcggctgagagccccagc

SEQ ID NO: 1541922 - DNA, 22 bp, Homo sapiens
gcggctgagagccccagctgac

SEQ ID NO: 1541923 - DNA, 15 bp, Homo sapiens
gcggcttcctgtcca

SEQ ID NO: 1541924 - DNA, 17 bp, Homo sapiens
gcggcttcctgtccact

SEQ ID NO: 1541925 - DNA, 22 bp, Homo sapiens
gcggcttcctgtccactctcgg

SEQ ID NO: 1541926 - DNA, 19 bp, Homo sapiens
gcgggaccggtacagaaag

SEQ ID NO: 1541927 - DNA, 15 bp, Homo sapiens
gcgggagaactgaag

SEQ ID NO: 1541928 - DNA, 17 bp, Homo sapiens
gcgggagacctgtgcta

SEQ ID NO: 1541929 - DNA, 12 bp, Homo sapiens
gcgggaggcacc

SEQ ID NO: 1541930 - DNA, 23 bp, Homo sapiens
gcgggaggcaccagctctgtggc

SEQ ID NO: 1541931 - DNA, 21 bp, Homo sapiens
gcgggatcctccacagagagg

SEQ ID NO: 1541932 - DNA, 17 bp, Homo sapiens
gcgggcacagggcacca

SEQ ID NO: 1541933 - DNA, 18 bp, Homo sapiens
gcgggcacagggcaccag

SEQ ID NO: 1541934 - DNA, 22 bp, Homo sapiens
gcgggcacagggcaccagaggc

SEQ ID NO: 1541935 - DNA, 23 bp, Homo sapiens
gcgggcacagggcaccagaggcc

SEQ ID NO: 1541936 - DNA, 20 bp, Homo sapiens
gcgggcacctatagtcccag

SEQ ID NO: 1541937 - DNA, 18 bp, Homo sapiens
gcgggcagagggctggag

SEQ ID NO: 1541938 - DNA, 16 bp, Homo sapiens
gcgggcagcgggccag

SEQ ID NO: 1541939 - DNA, 18 bp, Homo sapiens
gcgggcaggttctgcctg

SEQ ID NO: 1541940 - DNA, 21 bp, Homo sapiens
gcgggccagccaggcgggctc

SEQ ID NO: 1541941 - DNA, 15 bp, Homo sapiens
gcgggccagggtggg

SEQ ID NO: 1541942 - DNA, 14 bp, Homo sapiens
gcgggcccagctga

SEQ ID NO: 1541943 - DNA, 12 bp, Homo sapiens
gcgggcctggac

SEQ ID NO: 1541944 - DNA, 14 bp, Homo sapiens
gcgggcctggccct

SEQ ID NO: 1541945 - DNA, 23 bp, Homo sapiens
gcgggcggaggggatccagccac

SEQ ID NO: 1541946 - DNA, 16 bp, Homo sapiens
gcgggcggccaggcaa

SEQ ID NO: 1541947 - DNA, 15 bp, Homo sapiens
gcggggcagcaggag

SEQ ID NO: 1541948 - DNA, 23 bp, Homo sapiens
gcggggcccagcgctctcctgga

SEQ ID NO: 1541949 - DNA, 11 bp, Homo sapiens
gcggggggagg

SEQ ID NO: 1541950 - DNA, 16 bp, Homo sapiens
gcggggtcccctctgt

SEQ ID NO: 1541951 - DNA, 19 bp, Homo sapiens
gcggggtcccctctgtgct

SEQ ID NO: 1541952 - DNA, 14 bp, Homo sapiens
gcgggtctcctccc

SEQ ID NO: 1541953 - DNA, 14 bp, Homo sapiens
gcgggtctgaagga

SEQ ID NO: 1541954 - DNA, 19 bp, Homo sapiens
gcgggtggatcacaaggtc

SEQ ID NO: 1541955 - DNA, 19 bp, Homo sapiens
gcgggtggatcacctgagg

SEQ ID NO: 1541956 - DNA, 15 bp, Homo sapiens
gcggtcatgtgtgca

SEQ ID NO: 1541957 - DNA, 19 bp, Homo sapiens
gcggtcatgtgtgcatgtg

SEQ ID NO: 1541958 - DNA, 14 bp, Homo sapiens
gcggtgctctggcg

SEQ ID NO: 1541959 - DNA, 22 bp, Homo sapiens
gcggtgctgactgaggcctgct

SEQ ID NO: 1541960 - DNA, 14 bp, Homo sapiens
gcggtggaccaaag

SEQ ID NO: 1541961 - DNA, 14 bp, Homo sapiens
gcggtggtttgtaa

SEQ ID NO: 1541962 - DNA, 23 bp, Homo sapiens
gcggttatgaaattcaccccctt

SEQ ID NO: 1541963 - DNA, 18 bp, Homo sapiens
gcgtactacccagctctg

SEQ ID NO: 1541964 - DNA, 19 bp, Homo sapiens
gcgtactacccagctctgt

SEQ ID NO: 1541965 - DNA, 20 bp, Homo sapiens
gcgtcactccagtgctcagc

SEQ ID NO: 1541966 - DNA, 21 bp, Homo sapiens
gcgtcagagagacccgggaag

SEQ ID NO: 1541967 - DNA, 16 bp, Homo sapiens
gcgtcccagggtaccc

SEQ ID NO: 1541968 - DNA, 17 bp, Homo sapiens
gcgtccccactcccttg

SEQ ID NO: 1541969 - DNA, 18 bp, Homo sapiens
gcgtccccctgccggccg

SEQ ID NO: 1541970 - DNA, 19 bp, Homo sapiens
gcgtcccctgctactcctg

SEQ ID NO: 1541971 - DNA, 18 bp, Homo sapiens
gcgtccctgccccgaccc

SEQ ID NO: 1541972 - DNA, 12 bp, Homo sapiens
gcgtccctggcg

SEQ ID NO: 1541973 - DNA, 21 bp, Homo sapiens
gcgtccggggtggtggacagg

SEQ ID NO: 1541974 - DNA, 19 bp, Homo sapiens
gcgtcctcatttcccctcc

SEQ ID NO: 1541975 - DNA, 17 bp, Homo sapiens
gcgtcctgacggcgccc

SEQ ID NO: 1541976 - DNA, 13 bp, Homo sapiens
gcgtcctgcagag

SEQ ID NO: 1541977 - DNA, 15 bp, Homo sapiens
gcgtcctgcagagga

SEQ ID NO: 1541978 - DNA, 20 bp, Homo sapiens
gcgtcctgcagaggaccaca

SEQ ID NO: 1541979 - DNA, 13 bp, Homo sapiens
gcgtcctgccctg

SEQ ID NO: 1541980 - DNA, 15 bp, Homo sapiens
gcgtcctgccctgcc

SEQ ID NO: 1541981 - DNA, 15 bp, Homo sapiens
gcgtctatcctgtgt

SEQ ID NO: 1541982 - DNA, 13 bp, Homo sapiens
gcgtctgagctgg

SEQ ID NO: 1541983 - DNA, 22 bp, Homo sapiens
attctgcaagcacatctgcatt

SEQ ID NO: 1541984 - DNA, 14 bp, Homo sapiens
attctgcaagtttc

SEQ ID NO: 1541985 - DNA, 19 bp, Homo sapiens
attctgcattgctagataa

SEQ ID NO: 1541986 - DNA, 19 bp, Homo sapiens
attctgccctccttaattt

SEQ ID NO: 1541987 - DNA, 21 bp, Homo sapiens
attctgccgccccctcctgaa

SEQ ID NO: 1541988 - DNA, 21 bp, Homo sapiens
attctgcctagagtgtagcct

SEQ ID NO: 1541989 - DNA, 21 bp, Homo sapiens
attctgcctcagcctcctgag

SEQ ID NO: 1541990 - DNA, 16 bp, Homo sapiens
attctgcctctctagg

SEQ ID NO: 1541991 - DNA, 24 bp, Homo sapiens
attctgctacttcactgtcatctt

SEQ ID NO: 1541992 - DNA, 19 bp, Homo sapiens
attctggaaacttttgtta

SEQ ID NO: 1541993 - DNA, 16 bp, Homo sapiens
attctggacagacaga

SEQ ID NO: 1541994 - DNA, 17 bp, Homo sapiens
attctggataaagccac

SEQ ID NO: 1541995 - DNA, 14 bp, Homo sapiens
attctggctttaag

SEQ ID NO: 1541996 - DNA, 22 bp, Homo sapiens
attctggggaaacaacatttat

SEQ ID NO: 1541997 - DNA, 23 bp, Homo sapiens
attctggttccagggtccctctg

SEQ ID NO: 1541998 - DNA, 12 bp, Homo sapiens
attctgtatccg

SEQ ID NO: 1541999 - DNA, 23 bp, Homo sapiens
attctgtcttcatcccctcagaa

SEQ ID NO: 1542000 - DNA, 11 bp, Homo sapiens
attctgtcttg

SEQ ID NO: 1542001 - DNA, 15 bp, Homo sapiens
attctgtcttgttca

SEQ ID NO: 1542002 - DNA, 23 bp, Homo sapiens
attctgtcttgttcattttgagt

SEQ ID NO: 1542003 - DNA, 11 bp, Homo sapiens
attctgtgtta

SEQ ID NO: 1542004 - DNA, 22 bp, Homo sapiens
attctgtgttgaacacaattga

SEQ ID NO: 1542005 - DNA, 12 bp, Homo sapiens
attctgtgtttt

SEQ ID NO: 1542006 - DNA, 17 bp, Homo sapiens
attctgttactttgcta

SEQ ID NO: 1542007 - DNA, 19 bp, Homo sapiens
attctgttccctgggctga

SEQ ID NO: 1542008 - DNA, 17 bp, Homo sapiens
attctgttgttccattt

SEQ ID NO: 1542009 - DNA, 20 bp, Homo sapiens
attctgtttattcttccaga

SEQ ID NO: 1542010 - DNA, 18 bp, Homo sapiens
attctgttttaggttaaa

SEQ ID NO: 1542011 - DNA, 19 bp, Homo sapiens
attctgttttcccccagca

SEQ ID NO: 1542012 - DNA, 19 bp, Homo sapiens
attctgtttttaaaaatta

SEQ ID NO: 1542013 - DNA, 20 bp, Homo sapiens
attcttaaaattcaagaaaa

SEQ ID NO: 1542014 - DNA, 22 bp, Homo sapiens
attcttaaaattcaagaaaata

SEQ ID NO: 1542015 - DNA, 17 bp, Homo sapiens
attcttaacaaactctt

SEQ ID NO: 1542016 - DNA, 22 bp, Homo sapiens
attcttaattctctgcaacact

SEQ ID NO: 1542017 - DNA, 19 bp, Homo sapiens
attcttacaattgcactgc

SEQ ID NO: 1542018 - DNA, 16 bp, Homo sapiens
attcttactctggagc

SEQ ID NO: 1542019 - DNA, 20 bp, Homo sapiens
attcttagctgtaacttaac

SEQ ID NO: 1542020 - DNA, 16 bp, Homo sapiens
attcttccagaatgct

SEQ ID NO: 1542021 - DNA, 17 bp, Homo sapiens
attcttccatcatcact

SEQ ID NO: 1542022 - DNA, 19 bp, Homo sapiens
attcttccatcatcactgt

SEQ ID NO: 1542023 - DNA, 23 bp, Homo sapiens
attcttcccaacttgcctttgaa

SEQ ID NO: 1542024 - DNA, 19 bp, Homo sapiens
attcttccgggggaagggg

SEQ ID NO: 1542025 - DNA, 12 bp, Homo sapiens
attcttcctagt

SEQ ID NO: 1542026 - DNA, 22 bp, Homo sapiens
attcttctggtgctactccatg

SEQ ID NO: 1542027 - DNA, 15 bp, Homo sapiens
attcttctgtcctga

SEQ ID NO: 1542028 - DNA, 12 bp, Homo sapiens
attcttgatgta

SEQ ID NO: 1542029 - DNA, 20 bp, Homo sapiens
attcttgctgggcatacttt

SEQ ID NO: 1542030 - DNA, 18 bp, Homo sapiens
attcttggcttaatcatt

SEQ ID NO: 1542031 - DNA, 13 bp, Homo sapiens
attcttgtaaatc

SEQ ID NO: 1542032 - DNA, 21 bp, Homo sapiens
attcttgtaaatctttttgct

SEQ ID NO: 1542033 - DNA, 12 bp, Homo sapiens
attcttgtatat

SEQ ID NO: 1542034 - DNA, 17 bp, Homo sapiens
attcttgtcacaataaa

SEQ ID NO: 1542035 - DNA, 18 bp, Homo sapiens
attcttgtcacaataaat

SEQ ID NO: 1542036 - DNA, 22 bp, Homo sapiens
attcttgtgggagacagcagcc

SEQ ID NO: 1542037 - DNA, 19 bp, Homo sapiens
attcttgtttgaattcctc

SEQ ID NO: 1542038 - DNA, 15 bp, Homo sapiens
attctttagtactca

SEQ ID NO: 1542039 - DNA, 17 bp, Homo sapiens
attctttatcttgacat

SEQ ID NO: 1542040 - DNA, 13 bp, Homo sapiens
attctttccccag

SEQ ID NO: 1542041 - DNA, 13 bp, Homo sapiens
attctttctgtct

SEQ ID NO: 1542042 - DNA, 15 bp, Homo sapiens
attctttctgtctcc

SEQ ID NO: 1542043 - DNA, 16 bp, Homo sapiens
attctttctgttgaaa

SEQ ID NO: 1542044 - DNA, 17 bp, Homo sapiens
attctttgaacatgaac

SEQ ID NO: 1542045 - DNA, 20 bp, Homo sapiens
attctttgacatttggtggt

SEQ ID NO: 1542046 - DNA, 15 bp, Homo sapiens
attctttgcaaaaat

SEQ ID NO: 1542047 - DNA, 15 bp, Homo sapiens
attctttggtaattt

SEQ ID NO: 1542048 - DNA, 14 bp, Homo sapiens
attctttgttctgt

SEQ ID NO: 1542049 - DNA, 15 bp, Homo sapiens
attctttgttctgtt

SEQ ID NO: 1542050 - DNA, 16 bp, Homo sapiens
attctttgttctgttt

SEQ ID NO: 1542051 - DNA, 16 bp, Homo sapiens
attcttttaaaattca

SEQ ID NO: 1542052 - DNA, 20 bp, Homo sapiens
attcttttaaaattcaaaag

SEQ ID NO: 1542053 - DNA, 18 bp, Homo sapiens
attcttttaggacaatta

SEQ ID NO: 1542054 - DNA, 22 bp, Homo sapiens
attcttttaggacaattactgt

SEQ ID NO: 1542055 - DNA, 17 bp, Homo sapiens
attcttttcatcaaaaa

SEQ ID NO: 1542056 - DNA, 14 bp, Homo sapiens
attctttttaaagt

SEQ ID NO: 1542057 - DNA, 15 bp, Homo sapiens
attctttttgctcta

SEQ ID NO: 1542058 - DNA, 18 bp, Homo sapiens
attctttttttctctaga

SEQ ID NO: 1542059 - DNA, 19 bp, Homo sapiens
attgaaaaacaattttctg

SEQ ID NO: 1542060 - DNA, 15 bp, Homo sapiens
attgaaaacagatat

SEQ ID NO: 1542061 - DNA, 14 bp, Homo sapiens
attgaaaacagtgt

SEQ ID NO: 1542062 - DNA, 21 bp, Homo sapiens
attgaaaagattttaacaagt

SEQ ID NO: 1542063 - DNA, 19 bp, Homo sapiens
attgaaaagtttttgtttg

SEQ ID NO: 1542064 - DNA, 20 bp, Homo sapiens
attgaaaagtttttgtttgg

SEQ ID NO: 1542065 - DNA, 18 bp, Homo sapiens
attgaaagagaaccagtt

SEQ ID NO: 1542066 - DNA, 13 bp, Homo sapiens
attgaaagccaac

SEQ ID NO: 1542067 - DNA, 23 bp, Homo sapiens
attgaaagccaacaactctgcct

SEQ ID NO: 1542068 - DNA, 14 bp, Homo sapiens
attgaaagcttcaa

SEQ ID NO: 1542069 - DNA, 20 bp, Homo sapiens
attgaaagcttcaaagttta

SEQ ID NO: 1542070 - DNA, 17 bp, Homo sapiens
attgaaattctgagaaa

SEQ ID NO: 1542071 - DNA, 14 bp, Homo sapiens
attgaacagcaaag

SEQ ID NO: 1542072 - DNA, 23 bp, Homo sapiens
attgaaccatttgggatggagaa

SEQ ID NO: 1542073 - DNA, 15 bp, Homo sapiens
attgaacccaggagg

SEQ ID NO: 1542074 - DNA, 15 bp, Homo sapiens
attgaactctgagag

SEQ ID NO: 1542075 - DNA, 16 bp, Homo sapiens
attgaacttttgtact

SEQ ID NO: 1542076 - DNA, 20 bp, Homo sapiens
attgaacttttgtactgaat

SEQ ID NO: 1542077 - DNA, 20 bp, Homo sapiens
attgaagatgctgcctgtat

SEQ ID NO: 1542078 - DNA, 18 bp, Homo sapiens
attgaagccgactctggc

SEQ ID NO: 1542079 - DNA, 15 bp, Homo sapiens
attgaaggcttaaac

SEQ ID NO: 1542080 - DNA, 22 bp, Homo sapiens
attgaaggtgataagggaaaag

SEQ ID NO: 1542081 - DNA, 20 bp, Homo sapiens
attgaaggttgtatgtaaat

SEQ ID NO: 1542082 - DNA, 16 bp, Homo sapiens
attgaaggttttagac

SEQ ID NO: 1542083 - DNA, 15 bp, Homo sapiens
attgaagtaatgaat

SEQ ID NO: 1542084 - DNA, 19 bp, Homo sapiens
attgaagtattttgctgga

SEQ ID NO: 1542085 - DNA, 18 bp, Homo sapiens
attgaagttgtttatcaa

SEQ ID NO: 1542086 - DNA, 15 bp, Homo sapiens
attgaagtttcaagt

SEQ ID NO: 1542087 - DNA, 20 bp, Homo sapiens
attgaatggatcaatacaca

SEQ ID NO: 1542088 - DNA, 22 bp, Homo sapiens
attgaatgtggctgaagttgaa

SEQ ID NO: 1542089 - DNA, 20 bp, Homo sapiens
attgaatgtgtgatgtgaac

SEQ ID NO: 1542090 - DNA, 16 bp, Homo sapiens
attgaatgttatatca

SEQ ID NO: 1542091 - DNA, 19 bp, Homo sapiens
attgacaaccgagaaggtt

SEQ ID NO: 1542092 - DNA, 13 bp, Homo sapiens
attgacacacagc

SEQ ID NO: 1542093 - DNA, 15 bp, Homo sapiens
attgacacacagcac

SEQ ID NO: 1542094 - DNA, 17 bp, Homo sapiens
attgacacacagcactc

SEQ ID NO: 1542095 - DNA, 12 bp, Homo sapiens
attgacactgaa

SEQ ID NO: 1542096 - DNA, 13 bp, Homo sapiens
attgacagaagct

SEQ ID NO: 1542097 - DNA, 18 bp, Homo sapiens
attgacaggattattgga

SEQ ID NO: 1542098 - DNA, 16 bp, Homo sapiens
attgacagggactttg

SEQ ID NO: 1542099 - DNA, 13 bp, Homo sapiens
ctcttgttgcaga

SEQ ID NO: 1542100 - DNA, 20 bp, Homo sapiens
ctcttgtttttattaattta

SEQ ID NO: 1542101 - DNA, 19 bp, Homo sapiens
ctctttaaaaggaaagaaa

SEQ ID NO: 1542102 - DNA, 12 bp, Homo sapiens
ctctttaacaag

SEQ ID NO: 1542103 - DNA, 20 bp, Homo sapiens
ctctttactcccttcctggc

SEQ ID NO: 1542104 - DNA, 17 bp, Homo sapiens
ctctttactctctccga

SEQ ID NO: 1542105 - DNA, 17 bp, Homo sapiens
ctctttatgatctggcc

SEQ ID NO: 1542106 - DNA, 11 bp, Homo sapiens
ctctttcaaag

SEQ ID NO: 1542107 - DNA, 22 bp, Homo sapiens
ctctttcaagcagtcgtgcctg

SEQ ID NO: 1542108 - DNA, 22 bp, Homo sapiens
ctctttccagtggatcataaga

SEQ ID NO: 1542109 - DNA, 14 bp, Homo sapiens
ctctttccctgcga

SEQ ID NO: 1542110 - DNA, 15 bp, Homo sapiens
ctctttccctgcgag

SEQ ID NO: 1542111 - DNA, 20 bp, Homo sapiens
ctctttctaactttctttac

SEQ ID NO: 1542112 - DNA, 12 bp, Homo sapiens
ctctttctccct

SEQ ID NO: 1542113 - DNA, 18 bp, Homo sapiens
ctctttctctgccagtga

SEQ ID NO: 1542114 - DNA, 17 bp, Homo sapiens
ctctttctgctctgcca

SEQ ID NO: 1542115 - DNA, 12 bp, Homo sapiens
ctctttcttcat

SEQ ID NO: 1542116 - DNA, 17 bp, Homo sapiens
ctctttcttgtttgtca

SEQ ID NO: 1542117 - DNA, 12 bp, Homo sapiens
ctctttgctgca

SEQ ID NO: 1542118 - DNA, 17 bp, Homo sapiens
ctctttgctgcagagaa

SEQ ID NO: 1542119 - DNA, 13 bp, Homo sapiens
ctctttgggcagt

SEQ ID NO: 1542120 - DNA, 16 bp, Homo sapiens
ctctttggtaggagtt

SEQ ID NO: 1542121 - DNA, 21 bp, Homo sapiens
ctctttggtggcatggaaggg

SEQ ID NO: 1542122 - DNA, 14 bp, Homo sapiens
ctctttgtggcagt

SEQ ID NO: 1542123 - DNA, 19 bp, Homo sapiens
ctcttttaatggcatttct

SEQ ID NO: 1542124 - DNA, 22 bp, Homo sapiens
ctcttttatatttgtaggagaa

SEQ ID NO: 1542125 - DNA, 19 bp, Homo sapiens
ctcttttcctggtgctctt

SEQ ID NO: 1542126 - DNA, 12 bp, Homo sapiens
ctcttttctttc

SEQ ID NO: 1542127 - DNA, 23 bp, Homo sapiens
ctcttttgcacaaggaaataaag

SEQ ID NO: 1542128 - DNA, 12 bp, Homo sapiens
ctcttttgctta

SEQ ID NO: 1542129 - DNA, 19 bp, Homo sapiens
ctcttttgtgatgaacata

SEQ ID NO: 1542130 - DNA, 16 bp, Homo sapiens
ctcttttttcagagaa

SEQ ID NO: 1542131 - DNA, 18 bp, Homo sapiens
ctctttttttggcccagg

SEQ ID NO: 1542132 - DNA, 18 bp, Homo sapiens
ctgaaaaaaaaaaagaag

SEQ ID NO: 1542133 - DNA, 21 bp, Homo sapiens
ctgaaaaaaaaaaagaagaag

SEQ ID NO: 1542134 - DNA, 21 bp, Homo sapiens
ctgaaaaaaacatatccaaaa

SEQ ID NO: 1542135 - DNA, 15 bp, Homo sapiens
ctgaaaaaatatatg

SEQ ID NO: 1542136 - DNA, 19 bp, Homo sapiens
ctgaaaacctaagtccttt

SEQ ID NO: 1542137 - DNA, 15 bp, Homo sapiens
ctgaaaacgaagggg

SEQ ID NO: 1542138 - DNA, 12 bp, Homo sapiens
ctgaaaagaagg

SEQ ID NO: 1542139 - DNA, 18 bp, Homo sapiens
ctgaaaagaaggaaagat

SEQ ID NO: 1542140 - DNA, 16 bp, Homo sapiens
ctgaaaagaaggaata

SEQ ID NO: 1542141 - DNA, 18 bp, Homo sapiens
ctgaaaagactcagtgtt

SEQ ID NO: 1542142 - DNA, 21 bp, Homo sapiens
ctgaaaagcaattgccctgta

SEQ ID NO: 1542143 - DNA, 22 bp, Homo sapiens
ctgaaaagcagttcatgtctga

SEQ ID NO: 1542144 - DNA, 14 bp, Homo sapiens
ctgaaaagggcact

SEQ ID NO: 1542145 - DNA, 20 bp, Homo sapiens
ctgaaaagggcactcccaac

SEQ ID NO: 1542146 - DNA, 20 bp, Homo sapiens
ctgaaaagggcggaagagtt

SEQ ID NO: 1542147 - DNA, 20 bp, Homo sapiens
ctgaaaatcgagtttttcct

SEQ ID NO: 1542148 - DNA, 20 bp, Homo sapiens
ctgaaaatgcaaagctgaag

SEQ ID NO: 1542149 - DNA, 16 bp, Homo sapiens
ctgaaaatgtcacatt

SEQ ID NO: 1542150 - DNA, 23 bp, Homo sapiens
ctgaaaattggacagattgcctg

SEQ ID NO: 1542151 - DNA, 20 bp, Homo sapiens
ctgaaacaacttggaaagat

SEQ ID NO: 1542152 - DNA, 13 bp, Homo sapiens
ctgaaacacacga

SEQ ID NO: 1542153 - DNA, 17 bp, Homo sapiens
ctgaaacagatttcata

SEQ ID NO: 1542154 - DNA, 22 bp, Homo sapiens
ctgaaacatgcacattttgtac

SEQ ID NO: 1542155 - DNA, 13 bp, Homo sapiens
ctgaaaccatttt

SEQ ID NO: 1542156 - DNA, 16 bp, Homo sapiens
ctgaaacctctgcctt

SEQ ID NO: 1542157 - DNA, 23 bp, Homo sapiens
ctgaaaccttagtttcaagagtc

SEQ ID NO: 1542158 - DNA, 19 bp, Homo sapiens
ctgaaacgctcctttgtgt

SEQ ID NO: 1542159 - DNA, 20 bp, Homo sapiens
ctgaaactggcttccccact

SEQ ID NO: 1542160 - DNA, 22 bp, Homo sapiens
ctgaaactggcttccccactcc

SEQ ID NO: 1542161 - DNA, 14 bp, Homo sapiens
ctgaaagaaacagt

SEQ ID NO: 1542162 - DNA, 16 bp, Homo sapiens
ctgaaagaaacagtta

SEQ ID NO: 1542163 - DNA, 21 bp, Homo sapiens
ctgaaagaaacagttaacttt

SEQ ID NO: 1542164 - DNA, 19 bp, Homo sapiens
ctgaaagaagaaaacagta

SEQ ID NO: 1542165 - DNA, 14 bp, Homo sapiens
ctgaaagaggccaa

SEQ ID NO: 1542166 - DNA, 15 bp, Homo sapiens
ctgaaagcagcagct

SEQ ID NO: 1542167 - DNA, 22 bp, Homo sapiens
ctgaaagcagcagctaggactg

SEQ ID NO: 1542168 - DNA, 16 bp, Homo sapiens
ctgaaagcaggatgaa

SEQ ID NO: 1542169 - DNA, 21 bp, Homo sapiens
ctgaaagccacgttccttact

SEQ ID NO: 1542170 - DNA, 14 bp, Homo sapiens
ctgaaagccagctg

SEQ ID NO: 1542171 - DNA, 16 bp, Homo sapiens
ctgaaaggaaaaatgt

SEQ ID NO: 1542172 - DNA, 19 bp, Homo sapiens
ctgaaaggcagtagtcatt

SEQ ID NO: 1542173 - DNA, 19 bp, Homo sapiens
ctgaaagggcccttcccct

SEQ ID NO: 1542174 - DNA, 20 bp, Homo sapiens
ctgaaagggcccttcccctc

SEQ ID NO: 1542175 - DNA, 21 bp, Homo sapiens
ctgaaagggggcatgtatgca

SEQ ID NO: 1542176 - DNA, 23 bp, Homo sapiens
ctgaaaggtgattgcagcttttg

SEQ ID NO: 1542177 - DNA, 16 bp, Homo sapiens
ctgaaagtagggggct

SEQ ID NO: 1542178 - DNA, 18 bp, Homo sapiens
ctgaaagtgacagagacc

SEQ ID NO: 1542179 - DNA, 21 bp, Homo sapiens
ctgaaagtgtgtgtagtttta

SEQ ID NO: 1542180 - DNA, 20 bp, Homo sapiens
ctgaaagttttgtaaaagaa

SEQ ID NO: 1542181 - DNA, 22 bp, Homo sapiens
ctgaaagttttgtaaaagaaat

SEQ ID NO: 1542182 - DNA, 16 bp, Homo sapiens
ctgaaataatatattt

SEQ ID NO: 1542183 - DNA, 18 bp, Homo sapiens
ctgaaataatatatttct

SEQ ID NO: 1542184 - DNA, 16 bp, Homo sapiens
ctgaaataggaaacaa

SEQ ID NO: 1542185 - DNA, 19 bp, Homo sapiens
ctgaaatctcagaattcct

SEQ ID NO: 1542186 - DNA, 19 bp, Homo sapiens
ctgaaatgaaacaaataat

SEQ ID NO: 1542187 - DNA, 16 bp, Homo sapiens
gacccactacccttct

SEQ ID NO: 1542188 - DNA, 20 bp, Homo sapiens
gacccactgaaatgaccaag

SEQ ID NO: 1542189 - DNA, 23 bp, Homo sapiens
gacccacttcacacacaggcaac

SEQ ID NO: 1542190 - DNA, 21 bp, Homo sapiens
gacccactttgtaatttttgc

SEQ ID NO: 1542191 - DNA, 13 bp, Homo sapiens
gacccagagtgga

SEQ ID NO: 1542192 - DNA, 18 bp, Homo sapiens
gacccagagtggagtctg

SEQ ID NO: 1542193 - DNA, 17 bp, Homo sapiens
gacccagatctcatgga

SEQ ID NO: 1542194 - DNA, 12 bp, Homo sapiens
gacccagcagga

SEQ ID NO: 1542195 - DNA, 22 bp, Homo sapiens
gacccagcaggaagccaggctg

SEQ ID NO: 1542196 - DNA, 15 bp, Homo sapiens
gacccagctactctg

SEQ ID NO: 1542197 - DNA, 19 bp, Homo sapiens
gacccagctactctgtcca

SEQ ID NO: 1542198 - DNA, 23 bp, Homo sapiens
gacccagctactctgtccaggcc

SEQ ID NO: 1542199 - DNA, 21 bp, Homo sapiens
gacccagcttagagttcttct

SEQ ID NO: 1542200 - DNA, 20 bp, Homo sapiens
gacccaggatatctgaaaat

SEQ ID NO: 1542201 - DNA, 21 bp, Homo sapiens
gacccaggatatctgaaaata

SEQ ID NO: 1542202 - DNA, 13 bp, Homo sapiens
gacccaggccctc

SEQ ID NO: 1542203 - DNA, 19 bp, Homo sapiens
gacccaggccgcagctctt

SEQ ID NO: 1542204 - DNA, 22 bp, Homo sapiens
gacccaggccgcagctcttgcc

SEQ ID NO: 1542205 - DNA, 16 bp, Homo sapiens
gacccaggctgcctga

SEQ ID NO: 1542206 - DNA, 12 bp, Homo sapiens
gacccaggtgtg

SEQ ID NO: 1542207 - DNA, 15 bp, Homo sapiens
gacccaggtgtgcct

SEQ ID NO: 1542208 - DNA, 18 bp, Homo sapiens
gacccaggtgtgcctgtg

SEQ ID NO: 1542209 - DNA, 21 bp, Homo sapiens
gacccaggtgtgcctgtgctc

SEQ ID NO: 1542210 - DNA, 15 bp, Homo sapiens
gacccagtccctggg

SEQ ID NO: 1542211 - DNA, 10 bp, Homo sapiens
gacccagtgc

SEQ ID NO: 1542212 - DNA, 15 bp, Homo sapiens
gacccagtgcactcc

SEQ ID NO: 1542213 - DNA, 18 bp, Homo sapiens
gacccatagatcttctga

SEQ ID NO: 1542214 - DNA, 22 bp, Homo sapiens
gacccattgcgatggccgctcc

SEQ ID NO: 1542215 - DNA, 14 bp, Homo sapiens
gaccccacccaagc

SEQ ID NO: 1542216 - DNA, 20 bp, Homo sapiens
gaccccacccaagcttggca

SEQ ID NO: 1542217 - DNA, 13 bp, Homo sapiens
gaccccagctggg

SEQ ID NO: 1542218 - DNA, 20 bp, Homo sapiens
gaccccagtcgtgatgtgga

SEQ ID NO: 1542219 - DNA, 22 bp, Homo sapiens
gaccccagtcgtgatgtggagg

SEQ ID NO: 1542220 - DNA, 19 bp, Homo sapiens
gacccccactctcattccc

SEQ ID NO: 1542221 - DNA, 14 bp, Homo sapiens
gacccccaggcctg

SEQ ID NO: 1542222 - DNA, 22 bp, Homo sapiens
gacccccaggcctgtccaccct

SEQ ID NO: 1542223 - DNA, 21 bp, Homo sapiens
gacccccatccagcctccagg

SEQ ID NO: 1542224 - DNA, 23 bp, Homo sapiens
gacccccccccaatcggactgcc

SEQ ID NO: 1542225 - DNA, 13 bp, Homo sapiens
gaccccctcacca

SEQ ID NO: 1542226 - DNA, 14 bp, Homo sapiens
gaccccctcaccat

SEQ ID NO: 1542227 - DNA, 20 bp, Homo sapiens
gaccccctcaccatccagtg

SEQ ID NO: 1542228 - DNA, 20 bp, Homo sapiens
gaccccgagaaccctgagca

SEQ ID NO: 1542229 - DNA, 15 bp, Homo sapiens
gaccccggcctgtct

SEQ ID NO: 1542230 - DNA, 22 bp, Homo sapiens
gaccccggtggcggccccagca

SEQ ID NO: 1542231 - DNA, 13 bp, Homo sapiens
gacccctctggcc

SEQ ID NO: 1542232 - DNA, 18 bp, Homo sapiens
gacccctctggccaggat

SEQ ID NO: 1542233 - DNA, 20 bp, Homo sapiens
gacccctctggccaggatgg

SEQ ID NO: 1542234 - DNA, 21 bp, Homo sapiens
gacccctgccagttctctgtg

SEQ ID NO: 1542235 - DNA, 22 bp, Homo sapiens
gacccctggaccaccagcccca

SEQ ID NO: 1542236 - DNA, 13 bp, Homo sapiens
gacccctggctct

SEQ ID NO: 1542237 - DNA, 17 bp, Homo sapiens
gacccctggctctgggc

SEQ ID NO: 1542238 - DNA, 21 bp, Homo sapiens
gacccctggcttttcactgct

SEQ ID NO: 1542239 - DNA, 22 bp, Homo sapiens
gacccctggcttttcactgctg

SEQ ID NO: 1542240 - DNA, 12 bp, Homo sapiens
gacccctgggag

SEQ ID NO: 1542241 - DNA, 13 bp, Homo sapiens
gacccctgggagc

SEQ ID NO: 1542242 - DNA, 13 bp, Homo sapiens
gacccctgtctcc

SEQ ID NO: 1542243 - DNA, 20 bp, Homo sapiens
gaccccttaatcttgctttc

SEQ ID NO: 1542244 - DNA, 19 bp, Homo sapiens
gacccgaggatttctggga

SEQ ID NO: 1542245 - DNA, 15 bp, Homo sapiens
gacccgccagccccg

SEQ ID NO: 1542246 - DNA, 19 bp, Homo sapiens
gacccgccagccccgctcc

SEQ ID NO: 1542247 - DNA, 19 bp, Homo sapiens
gacccggaggggcctggca

SEQ ID NO: 1542248 - DNA, 20 bp, Homo sapiens
gacccggaggggcctggcag

SEQ ID NO: 1542249 - DNA, 18 bp, Homo sapiens
gacccgggaccacagctg

SEQ ID NO: 1542250 - DNA, 20 bp, Homo sapiens
gacccgggaccacagctgct

SEQ ID NO: 1542251 - DNA, 16 bp, Homo sapiens
gacccggggtctcctg

SEQ ID NO: 1542252 - DNA, 19 bp, Homo sapiens
gaccctactgaagtggctg

SEQ ID NO: 1542253 - DNA, 18 bp, Homo sapiens
gaccctcatggcccccag

SEQ ID NO: 1542254 - DNA, 21 bp, Homo sapiens
gaccctcatggcccccagggg

SEQ ID NO: 1542255 - DNA, 24 bp, Homo sapiens
gaccctcatggcccccaggggcag

SEQ ID NO: 1542256 - DNA, 22 bp, Homo sapiens
gaccctccccacagtgccaccc

SEQ ID NO: 1542257 - DNA, 16 bp, Homo sapiens
gaccctcgcagaccta

SEQ ID NO: 1542258 - DNA, 16 bp, Homo sapiens
gaccctcgggccccat

SEQ ID NO: 1542259 - DNA, 15 bp, Homo sapiens
gaccctcgtggcctt

SEQ ID NO: 1542260 - DNA, 14 bp, Homo sapiens
gaccctcttgccca

SEQ ID NO: 1542261 - DNA, 17 bp, Homo sapiens
gaccctcttgcccatcc

SEQ ID NO: 1542262 - DNA, 19 bp, Homo sapiens
gaccctcttgcccatcctg

SEQ ID NO: 1542263 - DNA, 11 bp, Homo sapiens
gaccctgagac

SEQ ID NO: 1542264 - DNA, 18 bp, Homo sapiens
gaccctgcaagaccacgg

SEQ ID NO: 1542265 - DNA, 21 bp, Homo sapiens
gaccctgcaagaccacggagg

SEQ ID NO: 1542266 - DNA, 11 bp, Homo sapiens
gaccctgccct

SEQ ID NO: 1542267 - DNA, 20 bp, Homo sapiens
gaccctgcgaaggggccctg

SEQ ID NO: 1542268 - DNA, 21 bp, Homo sapiens
gaccctgcgaaggggccctgg

SEQ ID NO: 1542269 - DNA, 11 bp, Homo sapiens
gaccctggaat

SEQ ID NO: 1542270 - DNA, 19 bp, Homo sapiens
gaccctggaattcagcacc

SEQ ID NO: 1542271 - DNA, 22 bp, Homo sapiens
gaccctggaattcagcaccctg

SEQ ID NO: 1542272 - DNA, 17 bp, Homo sapiens
gaccctggacccagcct

SEQ ID NO: 1542273 - DNA, 21 bp, Homo sapiens
gaccctgggcaaacagagcta

SEQ ID NO: 1542274 - DNA, 21 bp, Homo sapiens
agtcacagaacaaatgtttgt

SEQ ID NO: 1542275 - DNA, 11 bp, Homo sapiens
agtcacagctg

SEQ ID NO: 1542276 - DNA, 20 bp, Homo sapiens
agtcacagctgcagctgggc

SEQ ID NO: 1542277 - DNA, 23 bp, Homo sapiens
agtcacagctgcagctgggcccc

SEQ ID NO: 1542278 - DNA, 17 bp, Homo sapiens
agtcacatcagtgagga

SEQ ID NO: 1542279 - DNA, 21 bp, Homo sapiens
agtcacatcagtgaggaggga

SEQ ID NO: 1542280 - DNA, 23 bp, Homo sapiens
agtcacatggcctatgcacatat

SEQ ID NO: 1542281 - DNA, 13 bp, Homo sapiens
agtcaccaggaat

SEQ ID NO: 1542282 - DNA, 18 bp, Homo sapiens
agtcacccaaacacttct

SEQ ID NO: 1542283 - DNA, 23 bp, Homo sapiens
agtcacccaaacacttctgcttt

SEQ ID NO: 1542284 - DNA, 20 bp, Homo sapiens
agtcaccctacctgtgcctg

SEQ ID NO: 1542285 - DNA, 13 bp, Homo sapiens
agtcacctcctcc

SEQ ID NO: 1542286 - DNA, 20 bp, Homo sapiens
agtcacctcctccactcact

SEQ ID NO: 1542287 - DNA, 22 bp, Homo sapiens
agtcacctcctccactcactcc

SEQ ID NO: 1542288 - DNA, 18 bp, Homo sapiens
agtcacctcgtctccctg

SEQ ID NO: 1542289 - DNA, 23 bp, Homo sapiens
agtcacctcgtctccctggtgcc

SEQ ID NO: 1542290 - DNA, 17 bp, Homo sapiens
agtcacctgctccagaa

SEQ ID NO: 1542291 - DNA, 13 bp, Homo sapiens
agtcacctgctgg

SEQ ID NO: 1542292 - DNA, 18 bp, Homo sapiens
agtcacgcatgcagtgtt

SEQ ID NO: 1542293 - DNA, 19 bp, Homo sapiens
agtcactcacactggccac

SEQ ID NO: 1542294 - DNA, 19 bp, Homo sapiens
agtcactccctctgccttc

SEQ ID NO: 1542295 - DNA, 14 bp, Homo sapiens
agtcactcctctct

SEQ ID NO: 1542296 - DNA, 15 bp, Homo sapiens
agtcactgaacaaaa

SEQ ID NO: 1542297 - DNA, 17 bp, Homo sapiens
agtcactgagcatcact

SEQ ID NO: 1542298 - DNA, 21 bp, Homo sapiens
agtcactgcctctccctggcc

SEQ ID NO: 1542299 - DNA, 14 bp, Homo sapiens
agtcactgcctgca

SEQ ID NO: 1542300 - DNA, 16 bp, Homo sapiens
agtcactgcctgcaga

SEQ ID NO: 1542301 - DNA, 20 bp, Homo sapiens
gaccgtgtcccaaggagctg

SEQ ID NO: 1542302 - DNA, 22 bp, Homo sapiens
gacctaaaagttgaaaagccaa

SEQ ID NO: 1542303 - DNA, 16 bp, Homo sapiens
gacctaaatggcctca

SEQ ID NO: 1542304 - DNA, 17 bp, Homo sapiens
gacctaacattcgatct

SEQ ID NO: 1542305 - DNA, 14 bp, Homo sapiens
gacctaagccctgc

SEQ ID NO: 1542306 - DNA, 16 bp, Homo sapiens
gacctaccccagccag

SEQ ID NO: 1542307 - DNA, 20 bp, Homo sapiens
gacctaccccagccaggctc

SEQ ID NO: 1542308 - DNA, 21 bp, Homo sapiens
gacctaccccagccaggctcc

SEQ ID NO: 1542309 - DNA, 13 bp, Homo sapiens
gacctactctcat

SEQ ID NO: 1542310 - DNA, 15 bp, Homo sapiens
gacctactgttctaa

SEQ ID NO: 1542311 - DNA, 21 bp, Homo sapiens
gacctagggatgttctggccc

SEQ ID NO: 1542312 - DNA, 18 bp, Homo sapiens
gacctcacagtgaccctt

SEQ ID NO: 1542313 - DNA, 17 bp, Homo sapiens
gacctcacctggtcctc

SEQ ID NO: 1542314 - DNA, 10 bp, Homo sapiens
gacctcagcc

SEQ ID NO: 1542315 - DNA, 11 bp, Homo sapiens
gacctcagcct

SEQ ID NO: 1542316 - DNA, 16 bp, Homo sapiens
gacctcagctgcacat

SEQ ID NO: 1542317 - DNA, 20 bp, Homo sapiens
gacctcagctgcacattcct

SEQ ID NO: 1542318 - DNA, 23 bp, Homo sapiens
gacctcatcattaataagtgaag

SEQ ID NO: 1542319 - DNA, 13 bp, Homo sapiens
gacctcatcctgc

SEQ ID NO: 1542320 - DNA, 15 bp, Homo sapiens
gacctcatctgtgga

SEQ ID NO: 1542321 - DNA, 17 bp, Homo sapiens
gacctcatctgtggagc

SEQ ID NO: 1542322 - DNA, 22 bp, Homo sapiens
gacctcatgcccagctctctga

SEQ ID NO: 1542323 - DNA, 23 bp, Homo sapiens
gacctcatgcccagctctctgac

SEQ ID NO: 1542324 - DNA, 20 bp, Homo sapiens
gacctccacacccgtgagaa

SEQ ID NO: 1542325 - DNA, 15 bp, Homo sapiens
gacctccgcccctgc

SEQ ID NO: 1542326 - DNA, 16 bp, Homo sapiens
gacctccgcccctgcc

SEQ ID NO: 1542327 - DNA, 21 bp, Homo sapiens
gacctccgcccctgcccccgc

SEQ ID NO: 1542328 - DNA, 21 bp, Homo sapiens
gacctcgagcagatgatgcca

SEQ ID NO: 1542329 - DNA, 22 bp, Homo sapiens
gacctcggatgaccatactcag

SEQ ID NO: 1542330 - DNA, 21 bp, Homo sapiens
gacctcgtcctccccctgcca

SEQ ID NO: 1542331 - DNA, 14 bp, Homo sapiens
gacctctaggagga

SEQ ID NO: 1542332 - DNA, 11 bp, Homo sapiens
gacctctgctt

SEQ ID NO: 1542333 - DNA, 12 bp, Homo sapiens
gacctctgttgt

SEQ ID NO: 1542334 - DNA, 13 bp, Homo sapiens
gacctcttccctc

SEQ ID NO: 1542335 - DNA, 16 bp, Homo sapiens
gacctcttccctctgg

SEQ ID NO: 1542336 - DNA, 18 bp, Homo sapiens
gacctcttccctctgggc

SEQ ID NO: 1542337 - DNA, 20 bp, Homo sapiens
gacctcttccctctgggcct

SEQ ID NO: 1542338 - DNA, 12 bp, Homo sapiens
gacctcttctgg

SEQ ID NO: 1542339 - DNA, 14 bp, Homo sapiens
gacctcttctggag

SEQ ID NO: 1542340 - DNA, 18 bp, Homo sapiens
gacctgaccccattcctg

SEQ ID NO: 1542341 - DNA, 20 bp, Homo sapiens
gacctgaccccattcctgat

SEQ ID NO: 1542342 - DNA, 16 bp, Homo sapiens
gacctgagagcatctc

SEQ ID NO: 1542343 - DNA, 13 bp, Homo sapiens
gacctgaggctgt

SEQ ID NO: 1542344 - DNA, 17 bp, Homo sapiens
gacctgagggacccttc

SEQ ID NO: 1542345 - DNA, 17 bp, Homo sapiens
gacctgagtcggcccca

SEQ ID NO: 1542346 - DNA, 16 bp, Homo sapiens
gacctgcactggggag

SEQ ID NO: 1542347 - DNA, 20 bp, Homo sapiens
gacctgcaggccaagagcag

SEQ ID NO: 1542348 - DNA, 12 bp, Homo sapiens
gacctgcatcct

SEQ ID NO: 1542349 - DNA, 18 bp, Homo sapiens
gacctgcatccttcctgg

SEQ ID NO: 1542350 - DNA, 20 bp, Homo sapiens
gacctgcatccttcctgggg

SEQ ID NO: 1542351 - DNA, 18 bp, Homo sapiens
gacctgccaggcaggggt

SEQ ID NO: 1542352 - DNA, 14 bp, Homo sapiens
gacctgccctctct

SEQ ID NO: 1542353 - DNA, 14 bp, Homo sapiens
gacctgcctcctgc

SEQ ID NO: 1542354 - DNA, 20 bp, Homo sapiens
gacctgcctcctgcctgccc

SEQ ID NO: 1542355 - DNA, 20 bp, Homo sapiens
gacctgcctctcacacacat

SEQ ID NO: 1542356 - DNA, 13 bp, Homo sapiens
gacctgcctgtgt

SEQ ID NO: 1542357 - DNA, 12 bp, Homo sapiens
gacctggagccc

SEQ ID NO: 1542358 - DNA, 16 bp, Homo sapiens
gacctggagcccctgg

SEQ ID NO: 1542359 - DNA, 20 bp, Homo sapiens
gacctggagcccctgggtgg

SEQ ID NO: 1542360 - DNA, 10 bp, Homo sapiens
gacctggcag

SEQ ID NO: 1542361 - DNA, 11 bp, Homo sapiens
gacctggcagt

SEQ ID NO: 1542362 - DNA, 14 bp, Homo sapiens
gacctggcgtgctc

SEQ ID NO: 1542363 - DNA, 16 bp, Homo sapiens
gacctggcgtgctcag

SEQ ID NO: 1542364 - DNA, 16 bp, Homo sapiens
gacctggctccactct

SEQ ID NO: 1542365 - DNA, 18 bp, Homo sapiens
gacctggctctcagagga

SEQ ID NO: 1542366 - DNA, 17 bp, Homo sapiens
gacctgggtatcccctg

SEQ ID NO: 1542367 - DNA, 20 bp, Homo sapiens
gacctgggtatcccctgcct

SEQ ID NO: 1542368 - DNA, 22 bp, Homo sapiens
gacctgggtatcccctgcctcc

SEQ ID NO: 1542369 - DNA, 23 bp, Homo sapiens
gacctgggtatcccctgcctcct

SEQ ID NO: 1542370 - DNA, 21 bp, Homo sapiens
gacctggtaccctcctggctc

SEQ ID NO: 1542371 - DNA, 13 bp, Homo sapiens
gacctggttttta

SEQ ID NO: 1542372 - DNA, 15 bp, Homo sapiens
gacctgtcatgcccc

SEQ ID NO: 1542373 - DNA, 17 bp, Homo sapiens
gacctgtcatgcccccc

SEQ ID NO: 1542374 - DNA, 20 bp, Homo sapiens
gacctgtcatgcccccctca

SEQ ID NO: 1542375 - DNA, 19 bp, Homo sapiens
gacctgtctataagagaat

SEQ ID NO: 1542376 - DNA, 20 bp, Homo sapiens
gacctgtcttccaaggagac

SEQ ID NO: 1542377 - DNA, 15 bp, Homo sapiens
gacctgtgaccagca

SEQ ID NO: 1542378 - DNA, 13 bp, Homo sapiens
gacctgtgctagt

SEQ ID NO: 1542379 - DNA, 20 bp, Homo sapiens
gacctgtgctagttttacag

SEQ ID NO: 1542380 - DNA, 23 bp, Homo sapiens
gaccttagaaatcattgtagaaa

SEQ ID NO: 1542381 - DNA, 12 bp, Homo sapiens
gaccttagcgtt

SEQ ID NO: 1542382 - DNA, 20 bp, Homo sapiens
gaccttagcgttctggactc

SEQ ID NO: 1542383 - DNA, 13 bp, Homo sapiens
gaccttaggcctt

SEQ ID NO: 1542384 - DNA, 16 bp, Homo sapiens
gaccttaggccttcct

SEQ ID NO: 1542385 - DNA, 21 bp, Homo sapiens
gaccttaggccttcctctctc

SEQ ID NO: 1542386 - DNA, 18 bp, Homo sapiens
gaccttcagagccagccg

SEQ ID NO: 1542387 - DNA, 21 bp, Homo sapiens
gaccttcatgcccttctgatt

SEQ ID NO: 1542388 - DNA, 12 bp, Homo sapiens
gaccttcctcat

SEQ ID NO: 1542389 - DNA, 19 bp, Homo sapiens
gaccttcgggctgtgcccg

SEQ ID NO: 1542390 - DNA, 18 bp, Homo sapiens
gaccttctccaaatgaga

SEQ ID NO: 1542391 - DNA, 19 bp, Homo sapiens
gaccttctttattctgtgt

SEQ ID NO: 1542392 - DNA, 15 bp, Homo sapiens
gaccttgacagagca

SEQ ID NO: 1542393 - DNA, 18 bp, Homo sapiens
gaccttgacagagcagct

SEQ ID NO: 1542394 - DNA, 19 bp, Homo sapiens
atgaattataacagttata

SEQ ID NO: 1542395 - DNA, 19 bp, Homo sapiens
atgaattcaagaaaggaaa

SEQ ID NO: 1542396 - DNA, 22 bp, Homo sapiens
atgaattcccttttaatcaact

SEQ ID NO: 1542397 - DNA, 13 bp, Homo sapiens
atgaattgcattt

SEQ ID NO: 1542398 - DNA, 15 bp, Homo sapiens
atgaatttatcttta

SEQ ID NO: 1542399 - DNA, 13 bp, Homo sapiens
atgaatttgctaa

SEQ ID NO: 1542400 - DNA, 18 bp, Homo sapiens
atgaatttgctaaataca

SEQ ID NO: 1542401 - DNA, 21 bp, Homo sapiens
atgaatttggagactctgtgg

SEQ ID NO: 1542402 - DNA, 17 bp, Homo sapiens
atgaattttaaagtatg

SEQ ID NO: 1542403 - DNA, 14 bp, Homo sapiens
atgacaaaaaatgt

SEQ ID NO: 1542404 - DNA, 21 bp, Homo sapiens
atgacaacagaaaaacaatct

SEQ ID NO: 1542405 - DNA, 20 bp, Homo sapiens
gcaggatccctcctgagctc

SEQ ID NO: 1542406 - DNA, 16 bp, Homo sapiens
gcaggatctcaagcca

SEQ ID NO: 1542407 - DNA, 21 bp, Homo sapiens
gcaggattcccttctgggctt

SEQ ID NO: 1542408 - DNA, 21 bp, Homo sapiens
gcaggattggcaactcttcag

SEQ ID NO: 1542409 - DNA, 14 bp, Homo sapiens
gcaggcacaggaca

SEQ ID NO: 1542410 - DNA, 22 bp, Homo sapiens
gcaggcaccgccacgtcccagc

SEQ ID NO: 1542411 - DNA, 19 bp, Homo sapiens
gcaggcacgggtggtcccc

SEQ ID NO: 1542412 - DNA, 14 bp, Homo sapiens
gcaggcagccttga

SEQ ID NO: 1542413 - DNA, 19 bp, Homo sapiens
gcaggcagggctgggccag

SEQ ID NO: 1542414 - DNA, 14 bp, Homo sapiens
gcaggcaggtggac

SEQ ID NO: 1542415 - DNA, 20 bp, Homo sapiens
gcaggccaagagcagaggca

SEQ ID NO: 1542416 - DNA, 22 bp, Homo sapiens
gcaggccaagagcagaggcagc

SEQ ID NO: 1542417 - DNA, 24 bp, Homo sapiens
gcaggccaagagcagaggcagcga

SEQ ID NO: 1542418 - DNA, 23 bp, Homo sapiens
gcaggcccactccccagccccag

SEQ ID NO: 1542419 - DNA, 16 bp, Homo sapiens
gcaggcccagcatgca

SEQ ID NO: 1542420 - DNA, 14 bp, Homo sapiens
gcaggccctggcct

SEQ ID NO: 1542421 - DNA, 15 bp, Homo sapiens
gcaggccctggcctc

SEQ ID NO: 1542422 - DNA, 16 bp, Homo sapiens
gcaggccctggcctcc

SEQ ID NO: 1542423 - DNA, 22 bp, Homo sapiens
gcaggcctccaacgcccctgtg

SEQ ID NO: 1542424 - DNA, 14 bp, Homo sapiens
gcaggcctgagaat

SEQ ID NO: 1542425 - DNA, 13 bp, Homo sapiens
gcaggcctgggac

SEQ ID NO: 1542426 - DNA, 14 bp, Homo sapiens
gcaggcctgggacc

SEQ ID NO: 1542427 - DNA, 22 bp, Homo sapiens
gcaggcggcctttgttgctcag

SEQ ID NO: 1542428 - DNA, 14 bp, Homo sapiens
gcaggctcactgcc

SEQ ID NO: 1542429 - DNA, 18 bp, Homo sapiens
gcaggctcactgccaggc

SEQ ID NO: 1542430 - DNA, 21 bp, Homo sapiens
gcaggctcactgccaggccag

SEQ ID NO: 1542431 - DNA, 14 bp, Homo sapiens
gcaggctccatgca

SEQ ID NO: 1542432 - DNA, 15 bp, Homo sapiens
gcaggctcctggctg

SEQ ID NO: 1542433 - DNA, 14 bp, Homo sapiens
gcaggctctgggct

SEQ ID NO: 1542434 - DNA, 11 bp, Homo sapiens
gcaggctgaca

SEQ ID NO: 1542435 - DNA, 20 bp, Homo sapiens
gcaggctgagtccagagctt

SEQ ID NO: 1542436 - DNA, 19 bp, Homo sapiens
gcaggctgcacctctggct

SEQ ID NO: 1542437 - DNA, 11 bp, Homo sapiens
gcaggctgggc

SEQ ID NO: 1542438 - DNA, 13 bp, Homo sapiens
gcaggctgggcca

SEQ ID NO: 1542439 - DNA, 21 bp, Homo sapiens
gcaggctttgggaacactggc

SEQ ID NO: 1542440 - DNA, 12 bp, Homo sapiens
gcagggaagctc

SEQ ID NO: 1542441 - DNA, 23 bp, Homo sapiens
gcagggaaggacaggaccctcag

SEQ ID NO: 1542442 - DNA, 15 bp, Homo sapiens
gcagggaaggcctga

SEQ ID NO: 1542443 - DNA, 16 bp, Homo sapiens
gcagggaaggcctgac

SEQ ID NO: 1542444 - DNA, 16 bp, Homo sapiens
gcagggaatgcagcag

SEQ ID NO: 1542445 - DNA, 18 bp, Homo sapiens
gcagggacacgggcagcc

SEQ ID NO: 1542446 - DNA, 22 bp, Homo sapiens
gcagggacacgggcagcctggc

SEQ ID NO: 1542447 - DNA, 14 bp, Homo sapiens
gcagggagtgtctg

SEQ ID NO: 1542448 - DNA, 15 bp, Homo sapiens
gcagggagtgtctgc

SEQ ID NO: 1542449 - DNA, 16 bp, Homo sapiens
gcagggagtgtctgca

SEQ ID NO: 1542450 - DNA, 19 bp, Homo sapiens
gcagggagtgtctgcagtc

SEQ ID NO: 1542451 - DNA, 22 bp, Homo sapiens
gcagggagtgtctgcagtcctg

SEQ ID NO: 1542452 - DNA, 16 bp, Homo sapiens
gcagggatattgcctt

SEQ ID NO: 1542453 - DNA, 22 bp, Homo sapiens
gcagggattaacctctgcacta

SEQ ID NO: 1542454 - DNA, 22 bp, Homo sapiens
gcagggattgctgccacttttt

SEQ ID NO: 1542455 - DNA, 14 bp, Homo sapiens
gcagggcagaggga

SEQ ID NO: 1542456 - DNA, 22 bp, Homo sapiens
gcagggcatctcctgtgcatgg

SEQ ID NO: 1542457 - DNA, 18 bp, Homo sapiens
gcagggccaaagcacagc

SEQ ID NO: 1542458 - DNA, 20 bp, Homo sapiens
gcagggccaaagcacagctg

SEQ ID NO: 1542459 - DNA, 17 bp, Homo sapiens
gcagggccatccactgt

SEQ ID NO: 1542460 - DNA, 24 bp, Homo sapiens
gcagggccatctgactgccaagcc

SEQ ID NO: 1542461 - DNA, 15 bp, Homo sapiens
gcagggccatgcaga

SEQ ID NO: 1542462 - DNA, 18 bp, Homo sapiens
gcagggccatggctcagg

SEQ ID NO: 1542463 - DNA, 22 bp, Homo sapiens
gcagggccatggctcagggtgg

SEQ ID NO: 1542464 - DNA, 16 bp, Homo sapiens
gcagggcccttatgga

SEQ ID NO: 1542465 - DNA, 22 bp, Homo sapiens
gcagggccgcccgggcccagag

SEQ ID NO: 1542466 - DNA, 11 bp, Homo sapiens
gcagggcctgg

SEQ ID NO: 1542467 - DNA, 17 bp, Homo sapiens
gcagggcctgggcctca

SEQ ID NO: 1542468 - DNA, 19 bp, Homo sapiens
gcagggcctgggcctcatg

SEQ ID NO: 1542469 - DNA, 19 bp, Homo sapiens
gcagggccttgcccagaga

SEQ ID NO: 1542470 - DNA, 18 bp, Homo sapiens
gcagggcgggcagagggc

SEQ ID NO: 1542471 - DNA, 20 bp, Homo sapiens
gcagggcgggcagagggctg

SEQ ID NO: 1542472 - DNA, 21 bp, Homo sapiens
gcagggcgggcagagggctgg

SEQ ID NO: 1542473 - DNA, 22 bp, Homo sapiens
gcagggcgggcagagggctgga

SEQ ID NO: 1542474 - DNA, 12 bp, Homo sapiens
gcagggctctga

SEQ ID NO: 1542475 - DNA, 18 bp, Homo sapiens
gcagggctgaagtctggc

SEQ ID NO: 1542476 - DNA, 21 bp, Homo sapiens
gcagggctgactccctctcag

SEQ ID NO: 1542477 - DNA, 14 bp, Homo sapiens
gcagggctgggcca

SEQ ID NO: 1542478 - DNA, 15 bp, Homo sapiens
gcagggctgggccag

SEQ ID NO: 1542479 - DNA, 23 bp, Homo sapiens
gcagggctgtgcttgaaggccct

SEQ ID NO: 1542480 - DNA, 13 bp, Homo sapiens
gcagggcttctcc

SEQ ID NO: 1542481 - DNA, 14 bp, Homo sapiens
gcagggcttctcct

SEQ ID NO: 1542482 - DNA, 22 bp, Homo sapiens
gcaggggacaagggaggcagtg

SEQ ID NO: 1542483 - DNA, 17 bp, Homo sapiens
gcaggggactgtctcag

SEQ ID NO: 1542484 - DNA, 20 bp, Homo sapiens
gcaggggagacaggagccta

SEQ ID NO: 1542485 - DNA, 18 bp, Homo sapiens
gcagggggccccgccagg

SEQ ID NO: 1542486 - DNA, 21 bp, Homo sapiens
gcagggggccccgccagggct

SEQ ID NO: 1542487 - DNA, 13 bp, Homo sapiens
gcagggggccctg

SEQ ID NO: 1542488 - DNA, 18 bp, Homo sapiens
gcagggggccctgcccca

SEQ ID NO: 1542489 - DNA, 14 bp, Homo sapiens
gcaggggtcctgca

SEQ ID NO: 1542490 - DNA, 17 bp, Homo sapiens
gcaggggtgggggtgga

SEQ ID NO: 1542491 - DNA, 20 bp, Homo sapiens
gcaggggtgggggtggaggc

SEQ ID NO: 1542492 - DNA, 17 bp, Homo sapiens
gcagggtcaggagaggg

SEQ ID NO: 1542493 - DNA, 16 bp, Homo sapiens
gcagggtccacagctg

SEQ ID NO: 1542494 - DNA, 17 bp, Homo sapiens
gcagggtccacagctgg

SEQ ID NO: 1542495 - DNA, 20 bp, Homo sapiens
gcagggtccacagctggaaa

SEQ ID NO: 1542496 - DNA, 15 bp, Homo sapiens
gcagggtgggatgga

SEQ ID NO: 1542497 - DNA, 17 bp, Homo sapiens
gcagggtggggagggag

SEQ ID NO: 1542498 - DNA, 15 bp, Homo sapiens
gcagggtgtgtactg

SEQ ID NO: 1542499 - DNA, 14 bp, Homo sapiens
gcagggtttctttt

SEQ ID NO: 1542500 - DNA, 18 bp, Homo sapiens
gcaggtacttcctcctga

SEQ ID NO: 1542501 - DNA, 24 bp, Homo sapiens
gcaggtacttcctcctgatggcca

SEQ ID NO: 1542502 - DNA, 23 bp, Homo sapiens
gcaggtagatcgcttgagcccag

SEQ ID NO: 1542503 - DNA, 12 bp, Homo sapiens
gcaggtctgaga

SEQ ID NO: 1542504 - DNA, 22 bp, Homo sapiens
gcaggtctgcaagggcccagag

SEQ ID NO: 1542505 - DNA, 15 bp, Homo sapiens
gcaggtgcagatggg

SEQ ID NO: 1542506 - DNA, 18 bp, Homo sapiens
gcaggtgcctccaggtgt

SEQ ID NO: 1542507 - DNA, 15 bp, Homo sapiens
gcaggtgctgccttg

SEQ ID NO: 1542508 - DNA, 17 bp, Homo sapiens
gcaggtgctggtcccgg

SEQ ID NO: 1542509 - DNA, 17 bp, Homo sapiens
gcaggtgctgtgcgcct

SEQ ID NO: 1542510 - DNA, 13 bp, Homo sapiens
gcaggtggatcta

SEQ ID NO: 1542511 - DNA, 20 bp, Homo sapiens
gcaggtggatctatttcatg

SEQ ID NO: 1542512 - DNA, 22 bp, Homo sapiens
gcaggtggccacagcaggactg

SEQ ID NO: 1542513 - DNA, 14 bp, Homo sapiens
gcaggtgggctgcc

SEQ ID NO: 1542514 - DNA, 14 bp, Homo sapiens
gcaggtggtggcac

SEQ ID NO: 1542515 - DNA, 18 bp, Homo sapiens
gcaggtgtggtggctcat

SEQ ID NO: 1542516 - DNA, 15 bp, Homo sapiens
gcaggtgttctgctg

SEQ ID NO: 1542517 - DNA, 19 bp, Homo sapiens
gcaggtgtttctttcctgt

SEQ ID NO: 1542518 - DNA, 21 bp, Homo sapiens
gcaggttccccaagggccctg

SEQ ID NO: 1542519 - DNA, 16 bp, Homo sapiens
gcaggttcttgatgtc

SEQ ID NO: 1542520 - DNA, 23 bp, Homo sapiens
gcaggttcttgatgtcatgtact

SEQ ID NO: 1542521 - DNA, 19 bp, Homo sapiens
atgacaacttttaaagaaa

SEQ ID NO: 1542522 - DNA, 14 bp, Homo sapiens
atgacaatgatgat

SEQ ID NO: 1542523 - DNA, 16 bp, Homo sapiens
atgacacataaatctg

SEQ ID NO: 1542524 - DNA, 17 bp, Homo sapiens
atgacacatttggcagt

SEQ ID NO: 1542525 - DNA, 16 bp, Homo sapiens
atgacacccatgccag

SEQ ID NO: 1542526 - DNA, 21 bp, Homo sapiens
atgacacccatgccagagagg

SEQ ID NO: 1542527 - DNA, 13 bp, Homo sapiens
atgacaccctggc

SEQ ID NO: 1542528 - DNA, 17 bp, Homo sapiens
atgacacgcgctctcca

SEQ ID NO: 1542529 - DNA, 21 bp, Homo sapiens
atgacactagaaaacttgact

SEQ ID NO: 1542530 - DNA, 12 bp, Homo sapiens
atgacactgacc

SEQ ID NO: 1542531 - DNA, 16 bp, Homo sapiens
atgacacttccaaaga

SEQ ID NO: 1542532 - DNA, 20 bp, Homo sapiens
atgacagaaaatatgtatta

SEQ ID NO: 1542533 - DNA, 23 bp, Homo sapiens
atgacagaaaatatgtattaaca

SEQ ID NO: 1542534 - DNA, 12 bp, Homo sapiens
atgacagccaga

SEQ ID NO: 1542535 - DNA, 21 bp, Homo sapiens
atgacagctgtccctgtcacc

SEQ ID NO: 1542536 - DNA, 15 bp, Homo sapiens
atgacaggctgttca

SEQ ID NO: 1542537 - DNA, 20 bp, Homo sapiens
atgacagtgaagcagcactg

SEQ ID NO: 1542538 - DNA, 20 bp, Homo sapiens
atgacagtggaagttttttt

SEQ ID NO: 1542539 - DNA, 17 bp, Homo sapiens
atgacagtgttccccga

SEQ ID NO: 1542540 - DNA, 22 bp, Homo sapiens
atgacagttatactgtcggttt

SEQ ID NO: 1542541 - DNA, 19 bp, Homo sapiens
atgacataaaaacaacttt

SEQ ID NO: 1542542 - DNA, 20 bp, Homo sapiens
atgacatcacttgtacaaaa

SEQ ID NO: 1542543 - DNA, 23 bp, Homo sapiens
atgacatcctagaggtagagaaa

SEQ ID NO: 1542544 - DNA, 24 bp, Homo sapiens
atgacatcttcaaagcttgaagat

SEQ ID NO: 1542545 - DNA, 14 bp, Homo sapiens
atgacatgaaatga

SEQ ID NO: 1542546 - DNA, 21 bp, Homo sapiens
atgacatttctttgtgctttg

SEQ ID NO: 1542547 - DNA, 12 bp, Homo sapiens
atgaccaaagat

SEQ ID NO: 1542548 - DNA, 18 bp, Homo sapiens
atgaccagatgcgtccca

SEQ ID NO: 1542549 - DNA, 23 bp, Homo sapiens
atgaccagggatgctgggctggg

SEQ ID NO: 1542550 - DNA, 23 bp, Homo sapiens
atgaccatatttactctttctaa

SEQ ID NO: 1542551 - DNA, 19 bp, Homo sapiens
atgaccattgagtccctgc

SEQ ID NO: 1542552 - DNA, 14 bp, Homo sapiens
atgacccacactgc

SEQ ID NO: 1542553 - DNA, 20 bp, Homo sapiens
atgacccacactgccagaag

SEQ ID NO: 1542554 - DNA, 13 bp, Homo sapiens
atgacccacccct

SEQ ID NO: 1542555 - DNA, 17 bp, Homo sapiens
atgacccacccctgtgc

SEQ ID NO: 1542556 - DNA, 14 bp, Homo sapiens
atgacccagcctga

SEQ ID NO: 1542557 - DNA, 18 bp, Homo sapiens
atgacccaggctgcctga

SEQ ID NO: 1542558 - DNA, 16 bp, Homo sapiens
atgaccgagccctgga

SEQ ID NO: 1542559 - DNA, 17 bp, Homo sapiens
atgaccgagccctggag

SEQ ID NO: 1542560 - DNA, 18 bp, Homo sapiens
atgaccgagccctggaga

SEQ ID NO: 1542561 - DNA, 21 bp, Homo sapiens
atgacctaaatccattttcta

SEQ ID NO: 1542562 - DNA, 16 bp, Homo sapiens
atgacctacagtgctg

SEQ ID NO: 1542563 - DNA, 20 bp, Homo sapiens
atgacctacagtgctgtgta

SEQ ID NO: 1542564 - DNA, 21 bp, Homo sapiens
atgacctacagtgctgtgtac

SEQ ID NO: 1542565 - DNA, 21 bp, Homo sapiens
atgacctgaaataatatattt

SEQ ID NO: 1542566 - DNA, 19 bp, Homo sapiens
atgacctgtgaccagcact

SEQ ID NO: 1542567 - DNA, 18 bp, Homo sapiens
atgacgcggctcaaaagg

SEQ ID NO: 1542568 - DNA, 21 bp, Homo sapiens
atgacggaagaacatagaact

SEQ ID NO: 1542569 - DNA, 19 bp, Homo sapiens
atgacgggttgtgagactt

SEQ ID NO: 1542570 - DNA, 18 bp, Homo sapiens
atgacggtaagtgttctc

SEQ ID NO: 1542571 - DNA, 19 bp, Homo sapiens
atgacggtaagtgttctca

SEQ ID NO: 1542572 - DNA, 16 bp, Homo sapiens
atgacgtgtgtggctg

SEQ ID NO: 1542573 - DNA, 21 bp, Homo sapiens
atgacgtgtgtggctgggacc

SEQ ID NO: 1542574 - DNA, 15 bp, Homo sapiens
atgactaaagagaga

SEQ ID NO: 1542575 - DNA, 21 bp, Homo sapiens
atgactaaagagagaatgtag

SEQ ID NO: 1542576 - DNA, 13 bp, Homo sapiens
atgactaatgctt

SEQ ID NO: 1542577 - DNA, 14 bp, Homo sapiens
atgactaatgcttt

SEQ ID NO: 1542578 - DNA, 16 bp, Homo sapiens
atgactcgggggtggg

SEQ ID NO: 1542579 - DNA, 17 bp, Homo sapiens
atgactcgttacctgcc

SEQ ID NO: 1542580 - DNA, 18 bp, Homo sapiens
atgactcttgactcttgc

SEQ ID NO: 1542581 - DNA, 13 bp, Homo sapiens
atgactgcacatg

SEQ ID NO: 1542582 - DNA, 12 bp, Homo sapiens
atgactggctgt

SEQ ID NO: 1542583 - DNA, 19 bp, Homo sapiens
atgactggctgtctgcctg

SEQ ID NO: 1542584 - DNA, 22 bp, Homo sapiens
atgacttagcgtcaagacattt

SEQ ID NO: 1542585 - DNA, 19 bp, Homo sapiens
atgacttattatgcataaa

SEQ ID NO: 1542586 - DNA, 14 bp, Homo sapiens
atgacttatttctg

SEQ ID NO: 1542587 - DNA, 18 bp, Homo sapiens
atgacttatttctgctct

SEQ ID NO: 1542588 - DNA, 18 bp, Homo sapiens
atgacttcctagggatct

SEQ ID NO: 1542589 - DNA, 14 bp, Homo sapiens
atgacttgctgtcc

SEQ ID NO: 1542590 - DNA, 23 bp, Homo sapiens
atgactttatatggatgattcag

SEQ ID NO: 1542591 - DNA, 16 bp, Homo sapiens
atgagaaacagctcag

SEQ ID NO: 1542592 - DNA, 20 bp, Homo sapiens
atgagaaacagctcagccag

SEQ ID NO: 1542593 - DNA, 18 bp, Homo sapiens
atgagaaaggacagagcc

SEQ ID NO: 1542594 - DNA, 19 bp, Homo sapiens
atgagaaaggacagagcca

SEQ ID NO: 1542595 - DNA, 17 bp, Homo sapiens
atgagaacaagtcacag

SEQ ID NO: 1542596 - DNA, 23 bp, Homo sapiens
atgagaacaagtcacagctgcag

SEQ ID NO: 1542597 - DNA, 17 bp, Homo sapiens
atgagaacagataaaga

SEQ ID NO: 1542598 - DNA, 19 bp, Homo sapiens
atgagaacagataaagatt

SEQ ID NO: 1542599 - DNA, 15 bp, Homo sapiens
atgagaagaaaaatg

SEQ ID NO: 1542600 - DNA, 16 bp, Homo sapiens
atgagaagagggcctg

SEQ ID NO: 1542601 - DNA, 21 bp, Homo sapiens
atgagaagagggcctgtggga

SEQ ID NO: 1542602 - DNA, 14 bp, Homo sapiens
atgagaagtacttg

SEQ ID NO: 1542603 - DNA, 13 bp, Homo sapiens
atgagaatagaaa

SEQ ID NO: 1542604 - DNA, 15 bp, Homo sapiens
atgagaatagaaacg

SEQ ID NO: 1542605 - DNA, 16 bp, Homo sapiens
atgagaatcatgcact

SEQ ID NO: 1542606 - DNA, 15 bp, Homo sapiens
atgagactctagggt

SEQ ID NO: 1542607 - DNA, 17 bp, Homo sapiens
atgagactctagggtcc

SEQ ID NO: 1542608 - DNA, 18 bp, Homo sapiens
atgagactctagggtcca

SEQ ID NO: 1542609 - DNA, 16 bp, Homo sapiens
atgagactgaactgtg

SEQ ID NO: 1542610 - DNA, 23 bp, Homo sapiens
atgagacttccaaacctgacaga

SEQ ID NO: 1542611 - DNA, 15 bp, Homo sapiens
atgagactttctgct

SEQ ID NO: 1542612 - DNA, 20 bp, Homo sapiens
atgagagcaaatgcaaaaat

SEQ ID NO: 1542613 - DNA, 21 bp, Homo sapiens
atgagagcaaatgcaaaaata

SEQ ID NO: 1542614 - DNA, 17 bp, Homo sapiens
atgagagttccttctca

SEQ ID NO: 1542615 - DNA, 22 bp, Homo sapiens
atgagatctaagcctttccata

SEQ ID NO: 1542616 - DNA, 19 bp, Homo sapiens
atgagatggttaaaaaggc

SEQ ID NO: 1542617 - DNA, 22 bp, Homo sapiens
atgagatggttaaaaaggccaa

SEQ ID NO: 1542618 - DNA, 20 bp, Homo sapiens
atgagattggttttcctgtg

SEQ ID NO: 1542619 - DNA, 20 bp, Homo sapiens
atgagatttttaaaaaatat

SEQ ID NO: 1542620 - DNA, 14 bp, Homo sapiens
atgagcagagggag

SEQ ID NO: 1542621 - DNA, 14 bp, Homo sapiens
atgagcagtcacac

SEQ ID NO: 1542622 - DNA, 18 bp, Homo sapiens
gcatactttgacaaggaa

SEQ ID NO: 1542623 - DNA, 19 bp, Homo sapiens
gcatactttgacaaggaaa

SEQ ID NO: 1542624 - DNA, 15 bp, Homo sapiens
gcatactttgtaaat

SEQ ID NO: 1542625 - DNA, 16 bp, Homo sapiens
gcatactttgtaaata

SEQ ID NO: 1542626 - DNA, 18 bp, Homo sapiens
gcatactttgtattttga

SEQ ID NO: 1542627 - DNA, 14 bp, Homo sapiens
gcatagactgaggt

SEQ ID NO: 1542628 - DNA, 23 bp, Homo sapiens
gcatagactgaggtataaagaca

SEQ ID NO: 1542629 - DNA, 20 bp, Homo sapiens
gcatagcagtatatgttaat

SEQ ID NO: 1542630 - DNA, 14 bp, Homo sapiens
gcatagcctgcctg

SEQ ID NO: 1542631 - DNA, 16 bp, Homo sapiens
gcatagcgtcctgccc

SEQ ID NO: 1542632 - DNA, 19 bp, Homo sapiens
gcatagcgtcctgccctgc

SEQ ID NO: 1542633 - DNA, 19 bp, Homo sapiens
gcataggacctttccacca

SEQ ID NO: 1542634 - DNA, 18 bp, Homo sapiens
gcataggagtttggagga

SEQ ID NO: 1542635 - DNA, 21 bp, Homo sapiens
gcataggagtttggaggaagt

SEQ ID NO: 1542636 - DNA, 16 bp, Homo sapiens
gcataggcctgggtgc

SEQ ID NO: 1542637 - DNA, 17 bp, Homo sapiens
gcataggcctgggtgct

SEQ ID NO: 1542638 - DNA, 22 bp, Homo sapiens
gcataggcctgggtgctggctg

SEQ ID NO: 1542639 - DNA, 12 bp, Homo sapiens
atgaggagacag

SEQ ID NO: 1542640 - DNA, 16 bp, Homo sapiens
atgaggagcgtggact

SEQ ID NO: 1542641 - DNA, 19 bp, Homo sapiens
atgaggagcgtggactctg

SEQ ID NO: 1542642 - DNA, 13 bp, Homo sapiens
atgaggaggggag

SEQ ID NO: 1542643 - DNA, 14 bp, Homo sapiens
atgaggaggggagg

SEQ ID NO: 1542644 - DNA, 17 bp, Homo sapiens
atgaggccatctcagga

SEQ ID NO: 1542645 - DNA, 11 bp, Homo sapiens
atgaggggaga

SEQ ID NO: 1542646 - DNA, 17 bp, Homo sapiens
atgaggtcccaggcaga

SEQ ID NO: 1542647 - DNA, 18 bp, Homo sapiens
atgaggtcccaggcagag

SEQ ID NO: 1542648 - DNA, 20 bp, Homo sapiens
atgaggtcccaggcagagaa

SEQ ID NO: 1542649 - DNA, 15 bp, Homo sapiens
atgaggtctgaaatg

SEQ ID NO: 1542650 - DNA, 16 bp, Homo sapiens
atgagtaacatttgct

SEQ ID NO: 1542651 - DNA, 17 bp, Homo sapiens
atgagtaacatttgctg

SEQ ID NO: 1542652 - DNA, 21 bp, Homo sapiens
atgagtccttgaaaatatttt

SEQ ID NO: 1542653 - DNA, 12 bp, Homo sapiens
atgagtctagat

SEQ ID NO: 1542654 - DNA, 17 bp, Homo sapiens
atgagtctagatgttta

SEQ ID NO: 1542655 - DNA, 18 bp, Homo sapiens
atgagtctgttgtgtgtc

SEQ ID NO: 1542656 - DNA, 21 bp, Homo sapiens
atgagtctttgagactaaatt

SEQ ID NO: 1542657 - DNA, 18 bp, Homo sapiens
atgagtgtattttttaaa

SEQ ID NO: 1542658 - DNA, 16 bp, Homo sapiens
atgagttagaggagaa

SEQ ID NO: 1542659 - DNA, 18 bp, Homo sapiens
atgagttccagaaagtaa

SEQ ID NO: 1542660 - DNA, 22 bp, Homo sapiens
atgagttccctaaacaaaagca

SEQ ID NO: 1542661 - DNA, 18 bp, Homo sapiens
atgagttggctgggaata

SEQ ID NO: 1542662 - DNA, 21 bp, Homo sapiens
atgagttgtcacagaaattat

SEQ ID NO: 1542663 - DNA, 22 bp, Homo sapiens
atgagttgttttcagactcaga

SEQ ID NO: 1542664 - DNA, 19 bp, Homo sapiens
atgagtttaaaaaaataac

SEQ ID NO: 1542665 - DNA, 21 bp, Homo sapiens
atgagtttaaaaaaataacat

SEQ ID NO: 1542666 - DNA, 23 bp, Homo sapiens
atgagtttcactgtactgcatgt

SEQ ID NO: 1542667 - DNA, 15 bp, Homo sapiens
atgagtttcttagac

SEQ ID NO: 1542668 - DNA, 13 bp, Homo sapiens
atgagtttttgat

SEQ ID NO: 1542669 - DNA, 18 bp, Homo sapiens
atgataaactcagatctg

SEQ ID NO: 1542670 - DNA, 21 bp, Homo sapiens
atgataaactcagatctgatc

SEQ ID NO: 1542671 - DNA, 22 bp, Homo sapiens
atgataccctgaatttggcctg

SEQ ID NO: 1542672 - DNA, 21 bp, Homo sapiens
atgatactatcatactactga

SEQ ID NO: 1542673 - DNA, 12 bp, Homo sapiens
atgatactgtgt

SEQ ID NO: 1542674 - DNA, 16 bp, Homo sapiens
atgatagaactgtact

SEQ ID NO: 1542675 - DNA, 23 bp, Homo sapiens
atgatagaactgtactgttttct

SEQ ID NO: 1542676 - DNA, 19 bp, Homo sapiens
atgatagttttctagatga

SEQ ID NO: 1542677 - DNA, 23 bp, Homo sapiens
atgatagttttctagatgacata

SEQ ID NO: 1542678 - DNA, 13 bp, Homo sapiens
atgatatgtaaac

SEQ ID NO: 1542679 - DNA, 18 bp, Homo sapiens
atgatatttcttgctttc

SEQ ID NO: 1542680 - DNA, 20 bp, Homo sapiens
atgatcaaaacctgtgccag

SEQ ID NO: 1542681 - DNA, 17 bp, Homo sapiens
atgatcaaggaaaagat

SEQ ID NO: 1542682 - DNA, 15 bp, Homo sapiens
atgatcacagtgact

SEQ ID NO: 1542683 - DNA, 18 bp, Homo sapiens
atgatcagctgtttgtca

SEQ ID NO: 1542684 - DNA, 19 bp, Homo sapiens
atgatcagctgtttgtcat

SEQ ID NO: 1542685 - DNA, 13 bp, Homo sapiens
atgatcagtgttg

SEQ ID NO: 1542686 - DNA, 21 bp, Homo sapiens
atgatcatctgaatcccgggc

SEQ ID NO: 1542687 - DNA, 20 bp, Homo sapiens
atgatccctgtgttgtctct

SEQ ID NO: 1542688 - DNA, 18 bp, Homo sapiens
atgatcctctatttcctg

SEQ ID NO: 1542689 - DNA, 17 bp, Homo sapiens
atgatcgagccactgca

SEQ ID NO: 1542690 - DNA, 20 bp, Homo sapiens
atgatcgttctgggtcagct

SEQ ID NO: 1542691 - DNA, 14 bp, Homo sapiens
atgatctaataaac

SEQ ID NO: 1542692 - DNA, 12 bp, Homo sapiens
atgatctcagga

SEQ ID NO: 1542693 - DNA, 13 bp, Homo sapiens
atgatctcaggag

SEQ ID NO: 1542694 - DNA, 18 bp, Homo sapiens
atgatctcggatgaccaa

SEQ ID NO: 1542695 - DNA, 21 bp, Homo sapiens
atgatctgagtcccaggagct

SEQ ID NO: 1542696 - DNA, 16 bp, Homo sapiens
atgatgataataataa

SEQ ID NO: 1542697 - DNA, 14 bp, Homo sapiens
atgatgatgataat

SEQ ID NO: 1542698 - DNA, 22 bp, Homo sapiens
atgatgcttctataattttgcc

SEQ ID NO: 1542699 - DNA, 21 bp, Homo sapiens
atgatgcttgtaacaagaaaa

SEQ ID NO: 1542700 - DNA, 21 bp, Homo sapiens
atgatggcagagccaggctgt

SEQ ID NO: 1542701 - DNA, 18 bp, Homo sapiens
atgatgggaaaatatttc

SEQ ID NO: 1542702 - DNA, 16 bp, Homo sapiens
atgatgggtcagttgt

SEQ ID NO: 1542703 - DNA, 14 bp, Homo sapiens
atgatggtttaata

SEQ ID NO: 1542704 - DNA, 14 bp, Homo sapiens
atgatgtacagatt

SEQ ID NO: 1542705 - DNA, 19 bp, Homo sapiens
atgatgtccagaagaatat

SEQ ID NO: 1542706 - DNA, 23 bp, Homo sapiens
atgatgtccagaagaatattcag

SEQ ID NO: 1542707 - DNA, 19 bp, Homo sapiens
atgatgtccagggggagaa

SEQ ID NO: 1542708 - DNA, 17 bp, Homo sapiens
atgatgttagaagaaga

SEQ ID NO: 1542709 - DNA, 19 bp, Homo sapiens
atgatgttggtccaaagtg

SEQ ID NO: 1542710 - DNA, 23 bp, Homo sapiens
atgatgttggtccaaagtgcgtg

SEQ ID NO: 1542711 - DNA, 21 bp, Homo sapiens
atgatgtttcgtgaagtatac

SEQ ID NO: 1542712 - DNA, 14 bp, Homo sapiens
atgatgtttgccca

SEQ ID NO: 1542713 - DNA, 21 bp, Homo sapiens
atgatgtttgcccaaaattta

SEQ ID NO: 1542714 - DNA, 22 bp, Homo sapiens
atgatgttttaaaaaaatttga

SEQ ID NO: 1542715 - DNA, 20 bp, Homo sapiens
atgattaaataagattctaa

SEQ ID NO: 1542716 - DNA, 24 bp, Homo sapiens
atgattaaataagattctaacggt

SEQ ID NO: 1542717 - DNA, 12 bp, Homo sapiens
atgattaatcaa

SEQ ID NO: 1542718 - DNA, 16 bp, Homo sapiens
atgattactttaaaat

SEQ ID NO: 1542719 - DNA, 23 bp, Homo sapiens
atgattagaaattacctgtggat

SEQ ID NO: 1542720 - DNA, 17 bp, Homo sapiens
atgattatattcacaga

SEQ ID NO: 1542721 - DNA, 14 bp, Homo sapiens
atgattattttcaa

SEQ ID NO: 1542722 - DNA, 21 bp, Homo sapiens
atgattcaaattgctgcttgg

SEQ ID NO: 1542723 - DNA, 22 bp, Homo sapiens
atgattcatgagctgggtactg

SEQ ID NO: 1542724 - DNA, 22 bp, Homo sapiens
atgattccttgatggagatatt

SEQ ID NO: 1542725 - DNA, 14 bp, Homo sapiens
atgattctctgtgg

SEQ ID NO: 1542726 - DNA, 16 bp, Homo sapiens
atgattgaaaagaaga

SEQ ID NO: 1542727 - DNA, 19 bp, Homo sapiens
atgattgaattatatgttc

SEQ ID NO: 1542728 - DNA, 15 bp, Homo sapiens
atgattgctccagag

SEQ ID NO: 1542729 - DNA, 13 bp, Homo sapiens
atgattggattat

SEQ ID NO: 1542730 - DNA, 15 bp, Homo sapiens
atgattggattattc

SEQ ID NO: 1542731 - DNA, 21 bp, Homo sapiens
atgattggattattcatttaa

SEQ ID NO: 1542732 - DNA, 16 bp, Homo sapiens
atgatttacagagaag

SEQ ID NO: 1542733 - DNA, 22 bp, Homo sapiens
atgatttcagttcatcaaatca

SEQ ID NO: 1542734 - DNA, 21 bp, Homo sapiens
atgatttcatgctatctctgt

SEQ ID NO: 1542735 - DNA, 17 bp, Homo sapiens
atgatttgtcccagcct

SEQ ID NO: 1542736 - DNA, 14 bp, Homo sapiens
atgcatatttgcca

SEQ ID NO: 1542737 - DNA, 17 bp, Homo sapiens
atgcatccattcctcag

SEQ ID NO: 1542738 - DNA, 18 bp, Homo sapiens
atgcatccattcctcagg

SEQ ID NO: 1542739 - DNA, 19 bp, Homo sapiens
atgcatctggcccaggaat

SEQ ID NO: 1542740 - DNA, 20 bp, Homo sapiens
atgcatgattgcagaattgt

SEQ ID NO: 1542741 - DNA, 17 bp, Homo sapiens
atgcatgcttcttctca

SEQ ID NO: 1542742 - DNA, 22 bp, Homo sapiens
atgcatggtgccccaggaccag

SEQ ID NO: 1542743 - DNA, 22 bp, Homo sapiens
atgcatgtcaaacatgagatgt

SEQ ID NO: 1542744 - DNA, 18 bp, Homo sapiens
atgcattatatcaaatct

SEQ ID NO: 1542745 - DNA, 16 bp, Homo sapiens
atgcattattaaattg

SEQ ID NO: 1542746 - DNA, 14 bp, Homo sapiens
atgcattgcctgta

SEQ ID NO: 1542747 - DNA, 18 bp, Homo sapiens
atgcattgcctgtaacaa

SEQ ID NO: 1542748 - DNA, 14 bp, Homo sapiens
atgcattggcctct

SEQ ID NO: 1542749 - DNA, 16 bp, Homo sapiens
atgcattgtcttgtgg

SEQ ID NO: 1542750 - DNA, 14 bp, Homo sapiens
atgcatttaaaata

SEQ ID NO: 1542751 - DNA, 16 bp, Homo sapiens
atgcatttaaaatacc

SEQ ID NO: 1542752 - DNA, 20 bp, Homo sapiens
atgcatttaaaataccactg

SEQ ID NO: 1542753 - DNA, 13 bp, Homo sapiens
atgcatttaataa

SEQ ID NO: 1542754 - DNA, 16 bp, Homo sapiens
atgcatttaataaaga

SEQ ID NO: 1542755 - DNA, 14 bp, Homo sapiens
atgcatttcattca

SEQ ID NO: 1542756 - DNA, 15 bp, Homo sapiens
atgcatttcattcaa

SEQ ID NO: 1542757 - DNA, 16 bp, Homo sapiens
atgcatttcattcaaa

SEQ ID NO: 1542758 - DNA, 18 bp, Homo sapiens
atgcatttcattcaaatc

SEQ ID NO: 1542759 - DNA, 15 bp, Homo sapiens
gcatgacagcctgca

SEQ ID NO: 1542760 - DNA, 21 bp, Homo sapiens
gcatgacatcctttcttttaa

SEQ ID NO: 1542761 - DNA, 14 bp, Homo sapiens
gcatgacatttctt

SEQ ID NO: 1542762 - DNA, 16 bp, Homo sapiens
gcatgacctgtgacca

SEQ ID NO: 1542763 - DNA, 22 bp, Homo sapiens
gcatgacctgtgaccagcactg

SEQ ID NO: 1542764 - DNA, 22 bp, Homo sapiens
gcatgacttgtgtgtgatgaga

SEQ ID NO: 1542765 - DNA, 21 bp, Homo sapiens
gcatgagactcagtgcagatg

SEQ ID NO: 1542766 - DNA, 21 bp, Homo sapiens
gcatgagccactgagcctggc

SEQ ID NO: 1542767 - DNA, 20 bp, Homo sapiens
gcatgagctcactccatcac

SEQ ID NO: 1542768 - DNA, 12 bp, Homo sapiens
gcatgagctggc

SEQ ID NO: 1542769 - DNA, 13 bp, Homo sapiens
gcatgagctggca

SEQ ID NO: 1542770 - DNA, 23 bp, Homo sapiens
gcatgagctggcaaccagccagc

SEQ ID NO: 1542771 - DNA, 12 bp, Homo sapiens
gcatgaggaggt

SEQ ID NO: 1542772 - DNA, 18 bp, Homo sapiens
gcatgatgggaaaatatt

SEQ ID NO: 1542773 - DNA, 20 bp, Homo sapiens
gcatgatgggaaaatatttc

SEQ ID NO: 1542774 - DNA, 21 bp, Homo sapiens
gcatgatgggaaaatatttcc

SEQ ID NO: 1542775 - DNA, 18 bp, Homo sapiens
gcatgcaaatgagctctg

SEQ ID NO: 1542776 - DNA, 14 bp, Homo sapiens
gcatgcaatttgaa

SEQ ID NO: 1542777 - DNA, 21 bp, Homo sapiens
gcatgcacacggctggtcact

SEQ ID NO: 1542778 - DNA, 24 bp, Homo sapiens
gcatgcacacggctggtcactctg

SEQ ID NO: 1542779 - DNA, 22 bp, Homo sapiens
gcatgcacagctgcttgtcctg

SEQ ID NO: 1542780 - DNA, 14 bp, Homo sapiens
gcatgcacagctgt

SEQ ID NO: 1542781 - DNA, 14 bp, Homo sapiens
gcatgcagctttgc

SEQ ID NO: 1542782 - DNA, 17 bp, Homo sapiens
gcatgcagctttgcaaa

SEQ ID NO: 1542783 - DNA, 14 bp, Homo sapiens
gcatgcatggagga

SEQ ID NO: 1542784 - DNA, 19 bp, Homo sapiens
gcatgcatggaggactctc

SEQ ID NO: 1542785 - DNA, 21 bp, Homo sapiens
gcatgcatggaggactctcct

SEQ ID NO: 1542786 - DNA, 22 bp, Homo sapiens
gcatgcatggaggactctcctc

SEQ ID NO: 1542787 - DNA, 20 bp, Homo sapiens
gcatgcatgggaggaattca

SEQ ID NO: 1542788 - DNA, 14 bp, Homo sapiens
gcatgcattttgca

SEQ ID NO: 1542789 - DNA, 15 bp, Homo sapiens
gcatgcattttgcag

SEQ ID NO: 1542790 - DNA, 21 bp, Homo sapiens
gcatgcattttgcagcagtga

SEQ ID NO: 1542791 - DNA, 23 bp, Homo sapiens
gcatgccacgccccgtgtctgga

SEQ ID NO: 1542792 - DNA, 19 bp, Homo sapiens
gcatgccaggacccgccag

SEQ ID NO: 1542793 - DNA, 16 bp, Homo sapiens
gcatgccatgtctgag

SEQ ID NO: 1542794 - DNA, 21 bp, Homo sapiens
gcatgcctctgatatgggact

SEQ ID NO: 1542795 - DNA, 22 bp, Homo sapiens
gcatgcctgtaatcccagaact

SEQ ID NO: 1542796 - DNA, 13 bp, Homo sapiens
gcatgctctctgc

SEQ ID NO: 1542797 - DNA, 18 bp, Homo sapiens
gcatgctctggaagcctg

SEQ ID NO: 1542798 - DNA, 18 bp, Homo sapiens
gcatgctgtagctgcagc

SEQ ID NO: 1542799 - DNA, 18 bp, Homo sapiens
gcatgcttaaattttaac

SEQ ID NO: 1542800 - DNA, 12 bp, Homo sapiens
gcatgcttcctt

SEQ ID NO: 1542801 - DNA, 16 bp, Homo sapiens
gcatgcttcctttctc

SEQ ID NO: 1542802 - DNA, 17 bp, Homo sapiens
gcatgcttcctttctct

SEQ ID NO: 1542803 - DNA, 22 bp, Homo sapiens
gcatgcttgggctgacccagca

SEQ ID NO: 1542804 - DNA, 15 bp, Homo sapiens
gcatgctttgctgct

SEQ ID NO: 1542805 - DNA, 17 bp, Homo sapiens
gcatgctttgctgctat

SEQ ID NO: 1542806 - DNA, 23 bp, Homo sapiens
gcatgctttgctgctatgaaaat

SEQ ID NO: 1542807 - DNA, 13 bp, Homo sapiens
gcatggaaaaatg

SEQ ID NO: 1542808 - DNA, 11 bp, Homo sapiens
gcatggaaggg

SEQ ID NO: 1542809 - DNA, 14 bp, Homo sapiens
gcatggaaggggct

SEQ ID NO: 1542810 - DNA, 21 bp, Homo sapiens
gcatggaaggggcttctggac

SEQ ID NO: 1542811 - DNA, 22 bp, Homo sapiens
gcatggacagtgtgggcgctct

SEQ ID NO: 1542812 - DNA, 20 bp, Homo sapiens
gcatggacatttagaagaaa

SEQ ID NO: 1542813 - DNA, 18 bp, Homo sapiens
gcatggacctaacattcg

SEQ ID NO: 1542814 - DNA, 19 bp, Homo sapiens
gcatggaggaggagggagg

SEQ ID NO: 1542815 - DNA, 17 bp, Homo sapiens
gcatggccaggtggcca

SEQ ID NO: 1542816 - DNA, 16 bp, Homo sapiens
gcatggcgtggaggag

SEQ ID NO: 1542817 - DNA, 19 bp, Homo sapiens
gcatggctcctgtctggct

SEQ ID NO: 1542818 - DNA, 13 bp, Homo sapiens
gcatggctggggt

SEQ ID NO: 1542819 - DNA, 17 bp, Homo sapiens
gcatggctttatttgtt

SEQ ID NO: 1542820 - DNA, 13 bp, Homo sapiens
gcatgggcctggc

SEQ ID NO: 1542821 - DNA, 15 bp, Homo sapiens
gcatggggaggcagc

SEQ ID NO: 1542822 - DNA, 16 bp, Homo sapiens
gcatggggaggcagca

SEQ ID NO: 1542823 - DNA, 23 bp, Homo sapiens
gcatggggataaaggagaaggca

SEQ ID NO: 1542824 - DNA, 15 bp, Homo sapiens
gcatggggcatgtcc

SEQ ID NO: 1542825 - DNA, 21 bp, Homo sapiens
gcatggggcgctcccactcag

SEQ ID NO: 1542826 - DNA, 22 bp, Homo sapiens
gcatggggcgctcccactcaga

SEQ ID NO: 1542827 - DNA, 15 bp, Homo sapiens
gcatgggtccagggc

SEQ ID NO: 1542828 - DNA, 17 bp, Homo sapiens
gcatgggtccagggcct

SEQ ID NO: 1542829 - DNA, 18 bp, Homo sapiens
gcatgggtccagggcctg

SEQ ID NO: 1542830 - DNA, 23 bp, Homo sapiens
gcatgggtccttgatgccagagg

SEQ ID NO: 1542831 - DNA, 22 bp, Homo sapiens
gcatggtgagtgttggggttga

SEQ ID NO: 1542832 - DNA, 23 bp, Homo sapiens
gcatggtgccccaggaccagctc

SEQ ID NO: 1542833 - DNA, 17 bp, Homo sapiens
gcatggttccttccctg

SEQ ID NO: 1542834 - DNA, 21 bp, Homo sapiens
gcatggttccttccctgggaa

SEQ ID NO: 1542835 - DNA, 21 bp, Homo sapiens
gcatggttttgtgccatctgt

SEQ ID NO: 1542836 - DNA, 17 bp, Homo sapiens
gcatgtaatcccagcta

SEQ ID NO: 1542837 - DNA, 20 bp, Homo sapiens
gcatgtagaggcttgtttac

SEQ ID NO: 1542838 - DNA, 14 bp, Homo sapiens
gcatgtaggagaat

SEQ ID NO: 1542839 - DNA, 22 bp, Homo sapiens
gcatgtagtaacactaatatat

SEQ ID NO: 1542840 - DNA, 15 bp, Homo sapiens
gcatgtattggcctg

SEQ ID NO: 1542841 - DNA, 19 bp, Homo sapiens
gcatgtcctgtaaaggtta

SEQ ID NO: 1542842 - DNA, 13 bp, Homo sapiens
gcatgtctactgc

SEQ ID NO: 1542843 - DNA, 15 bp, Homo sapiens
gcatgtcttttaaaa

SEQ ID NO: 1542844 - DNA, 19 bp, Homo sapiens
gcatgtgaagcatgctttg

SEQ ID NO: 1542845 - DNA, 23 bp, Homo sapiens
gcatgtgccaagattctactctt

SEQ ID NO: 1542846 - DNA, 15 bp, Homo sapiens
gcatgtgctgtgtga

SEQ ID NO: 1542847 - DNA, 16 bp, Homo sapiens
gcatgtgctgtgtgag

SEQ ID NO: 1542848 - DNA, 22 bp, Homo sapiens
gcatgtgctgtgtgagtgagca

SEQ ID NO: 1542849 - DNA, 19 bp, Homo sapiens
gcatgtgtgcatgtgctgt

SEQ ID NO: 1542850 - DNA, 18 bp, Homo sapiens
gccaacaactctgccttt

SEQ ID NO: 1542851 - DNA, 22 bp, Homo sapiens
gccaacaactctgcctttatga

SEQ ID NO: 1542852 - DNA, 22 bp, Homo sapiens
gccaacaagaccgccccagggc

SEQ ID NO: 1542853 - DNA, 23 bp, Homo sapiens
gccaacagttgtatgtttgctga

SEQ ID NO: 1542854 - DNA, 18 bp, Homo sapiens
gccaacatgaggacagaa

SEQ ID NO: 1542855 - DNA, 22 bp, Homo sapiens
gccaaccagcccgacagtgcca

SEQ ID NO: 1542856 - DNA, 13 bp, Homo sapiens
gccaaccagcctt

SEQ ID NO: 1542857 - DNA, 14 bp, Homo sapiens
gccaaccagccttt

SEQ ID NO: 1542858 - DNA, 23 bp, Homo sapiens
gccaaccataccttccttccctg

SEQ ID NO: 1542859 - DNA, 14 bp, Homo sapiens
gccaacgacaaagc

SEQ ID NO: 1542860 - DNA, 23 bp, Homo sapiens
gccaacgagacacattgccttct

SEQ ID NO: 1542861 - DNA, 16 bp, Homo sapiens
gccaactaagccctcg

SEQ ID NO: 1542862 - DNA, 23 bp, Homo sapiens
gccaactaagccctcgaaccaag

SEQ ID NO: 1542863 - DNA, 15 bp, Homo sapiens
gccaactagcccctg

SEQ ID NO: 1542864 - DNA, 17 bp, Homo sapiens
gccaactgccaggctgc

SEQ ID NO: 1542865 - DNA, 17 bp, Homo sapiens
gccaactggtgtttgaa

SEQ ID NO: 1542866 - DNA, 20 bp, Homo sapiens
gccaactgtttccctgctga

SEQ ID NO: 1542867 - DNA, 22 bp, Homo sapiens
gccaactgtttccctgctgaat

SEQ ID NO: 1542868 - DNA, 22 bp, Homo sapiens
gccaagaagcctgcaggagaaa

SEQ ID NO: 1542869 - DNA, 16 bp, Homo sapiens
gccaagaatacttgaa

SEQ ID NO: 1542870 - DNA, 19 bp, Homo sapiens
gccaagaatatagttatta

SEQ ID NO: 1542871 - DNA, 19 bp, Homo sapiens
gccaagacgggatgattgc

SEQ ID NO: 1542872 - DNA, 12 bp, Homo sapiens
gccaagactcct

SEQ ID NO: 1542873 - DNA, 14 bp, Homo sapiens
gccaagactcctca

SEQ ID NO: 1542874 - DNA, 19 bp, Homo sapiens
gccaagagccgccgtggct

SEQ ID NO: 1542875 - DNA, 19 bp, Homo sapiens
gccaagatggctgctgcct

SEQ ID NO: 1542876 - DNA, 21 bp, Homo sapiens
gccaagatggctgctgcctgc

SEQ ID NO: 1542877 - DNA, 16 bp, Homo sapiens
gccaagcactgctcac

SEQ ID NO: 1542878 - DNA, 18 bp, Homo sapiens
gcacacagctgagcactt

SEQ ID NO: 1542879 - DNA, 14 bp, Homo sapiens
gcacacaggacagc

SEQ ID NO: 1542880 - DNA, 17 bp, Homo sapiens
gcacacaggacagcggg

SEQ ID NO: 1542881 - DNA, 13 bp, Homo sapiens
gcacacagggccc

SEQ ID NO: 1542882 - DNA, 19 bp, Homo sapiens
gcacacagggcccggccac

SEQ ID NO: 1542883 - DNA, 20 bp, Homo sapiens
gcacacagggcccggccaca

SEQ ID NO: 1542884 - DNA, 16 bp, Homo sapiens
gcacaccaagtggctg

SEQ ID NO: 1542885 - DNA, 18 bp, Homo sapiens
gcacaccaagtggctggg

SEQ ID NO: 1542886 - DNA, 14 bp, Homo sapiens
gcacaccactgccc

SEQ ID NO: 1542887 - DNA, 20 bp, Homo sapiens
gcacaccactgccctgcctg

SEQ ID NO: 1542888 - DNA, 17 bp, Homo sapiens
gcacaccagccgctgca

SEQ ID NO: 1542889 - DNA, 23 bp, Homo sapiens
gcacaccagccgctgcagggctc

SEQ ID NO: 1542890 - DNA, 13 bp, Homo sapiens
gcacacccctggg

SEQ ID NO: 1542891 - DNA, 13 bp, Homo sapiens
gcacacctgtgtc

SEQ ID NO: 1542892 - DNA, 16 bp, Homo sapiens
gcacacctgtgtccaa

SEQ ID NO: 1542893 - DNA, 13 bp, Homo sapiens
gcacaccttttcc

SEQ ID NO: 1542894 - DNA, 17 bp, Homo sapiens
gcacacgagttccagac

SEQ ID NO: 1542895 - DNA, 17 bp, Homo sapiens
gcacacggctggtcact

SEQ ID NO: 1542896 - DNA, 21 bp, Homo sapiens
gcacacgggcgagctttctct

SEQ ID NO: 1542897 - DNA, 17 bp, Homo sapiens
gcacacgtcatgtttct

SEQ ID NO: 1542898 - DNA, 21 bp, Homo sapiens
gcacactcccctgcactggag

SEQ ID NO: 1542899 - DNA, 14 bp, Homo sapiens
gcacactggaatat

SEQ ID NO: 1542900 - DNA, 16 bp, Homo sapiens
gcacactttctggcaa

SEQ ID NO: 1542901 - DNA, 22 bp, Homo sapiens
gcacactttctggcaaacgttt

SEQ ID NO: 1542902 - DNA, 16 bp, Homo sapiens
gcacacttttccacat

SEQ ID NO: 1542903 - DNA, 19 bp, Homo sapiens
gcacagaaggaatctgtgc

SEQ ID NO: 1542904 - DNA, 22 bp, Homo sapiens
gcacagacacgctcgcgggcag

SEQ ID NO: 1542905 - DNA, 14 bp, Homo sapiens
gcacagacttctgg

SEQ ID NO: 1542906 - DNA, 15 bp, Homo sapiens
gcacagacttctgga

SEQ ID NO: 1542907 - DNA, 22 bp, Homo sapiens
gcacagacttctggaaggctgg

SEQ ID NO: 1542908 - DNA, 23 bp, Homo sapiens
gcacagacttctggaaggctggc

SEQ ID NO: 1542909 - DNA, 20 bp, Homo sapiens
gcacagatgccatggcctgt

SEQ ID NO: 1542910 - DNA, 13 bp, Homo sapiens
gcacagatggatt

SEQ ID NO: 1542911 - DNA, 15 bp, Homo sapiens
gcacagatggatttg

SEQ ID NO: 1542912 - DNA, 14 bp, Homo sapiens
gcacagatttgcat

SEQ ID NO: 1542913 - DNA, 20 bp, Homo sapiens
gcacagccaacgagacacat

SEQ ID NO: 1542914 - DNA, 14 bp, Homo sapiens
gcacagccacccgt

SEQ ID NO: 1542915 - DNA, 12 bp, Homo sapiens
gcacagccctcc

SEQ ID NO: 1542916 - DNA, 20 bp, Homo sapiens
gcacagccctccgaccctca

SEQ ID NO: 1542917 - DNA, 11 bp, Homo sapiens
gcacagccctg

SEQ ID NO: 1542918 - DNA, 13 bp, Homo sapiens
gcacagccctgag

SEQ ID NO: 1542919 - DNA, 14 bp, Homo sapiens
gcacagccctgagt

SEQ ID NO: 1542920 - DNA, 19 bp, Homo sapiens
gcacagccctgagtgtccc

SEQ ID NO: 1542921 - DNA, 15 bp, Homo sapiens
gcacagctaattcta

SEQ ID NO: 1542922 - DNA, 12 bp, Homo sapiens
gcacagctcagg

SEQ ID NO: 1542923 - DNA, 14 bp, Homo sapiens
gcacagctcctgcc

SEQ ID NO: 1542924 - DNA, 13 bp, Homo sapiens
gcacagctgcttg

SEQ ID NO: 1542925 - DNA, 23 bp, Homo sapiens
gcacagctgtagtggggttctag

SEQ ID NO: 1542926 - DNA, 15 bp, Homo sapiens
gcacaggaaaaggta

SEQ ID NO: 1542927 - DNA, 15 bp, Homo sapiens
gcacaggaggcaggc

SEQ ID NO: 1542928 - DNA, 12 bp, Homo sapiens
gcacaggcagct

SEQ ID NO: 1542929 - DNA, 14 bp, Homo sapiens
gcacaggccccctt

SEQ ID NO: 1542930 - DNA, 14 bp, Homo sapiens
gcacaggcctctgc

SEQ ID NO: 1542931 - DNA, 17 bp, Homo sapiens
gcacaggcctctgcctg

SEQ ID NO: 1542932 - DNA, 16 bp, Homo sapiens
gcacagggcaccagag

SEQ ID NO: 1542933 - DNA, 16 bp, Homo sapiens
gcacagggcagtggga

SEQ ID NO: 1542934 - DNA, 18 bp, Homo sapiens
gcacagggtctgctcttt

SEQ ID NO: 1542935 - DNA, 15 bp, Homo sapiens
gcacagtacacacaa

SEQ ID NO: 1542936 - DNA, 17 bp, Homo sapiens
gcacagtaggtcccggc

SEQ ID NO: 1542937 - DNA, 21 bp, Homo sapiens
gcacagtaggtcccggccagc

SEQ ID NO: 1542938 - DNA, 15 bp, Homo sapiens
gcacagtatttgtaa

SEQ ID NO: 1542939 - DNA, 16 bp, Homo sapiens
gcacagtcactgctct

SEQ ID NO: 1542940 - DNA, 16 bp, Homo sapiens
gcacagtgaagtgctg

SEQ ID NO: 1542941 - DNA, 16 bp, Homo sapiens
gcacagtgacttctga

SEQ ID NO: 1542942 - DNA, 13 bp, Homo sapiens
gcacagtggctca

SEQ ID NO: 1542943 - DNA, 22 bp, Homo sapiens
gcacagtggctcacgcctgtaa

SEQ ID NO: 1542944 - DNA, 13 bp, Homo sapiens
gcacagtgggagc

SEQ ID NO: 1542945 - DNA, 22 bp, Homo sapiens
gcacagtgtaatccaggggtgt

SEQ ID NO: 1542946 - DNA, 21 bp, Homo sapiens
gcacagttgaagggaggggct

SEQ ID NO: 1542947 - DNA, 15 bp, Homo sapiens
gcacagtttgaacaa

SEQ ID NO: 1542948 - DNA, 18 bp, Homo sapiens
gcacagttttctgagaaa

SEQ ID NO: 1542949 - DNA, 20 bp, Homo sapiens
gcacagttttctgagaaaga

SEQ ID NO: 1542950 - DNA, 23 bp, Homo sapiens
gcacagttttctgagaaagacta

SEQ ID NO: 1542951 - DNA, 19 bp, Homo sapiens
gcacatacggcagacctct

SEQ ID NO: 1542952 - DNA, 17 bp, Homo sapiens
gcacatactacctagaa

SEQ ID NO: 1542953 - DNA, 21 bp, Homo sapiens
gcacatactacctagaagtaa

SEQ ID NO: 1542954 - DNA, 23 bp, Homo sapiens
gcacatatggaattttgcaaaga

SEQ ID NO: 1542955 - DNA, 14 bp, Homo sapiens
gcacatgaaagttt

SEQ ID NO: 1542956 - DNA, 21 bp, Homo sapiens
gcacatgaataatttcactta

SEQ ID NO: 1542957 - DNA, 22 bp, Homo sapiens
gcacatgctgtctggccctggg

SEQ ID NO: 1542958 - DNA, 14 bp, Homo sapiens
gcacatggccatag

SEQ ID NO: 1542959 - DNA, 16 bp, Homo sapiens
gcacatggccatagag

SEQ ID NO: 1542960 - DNA, 15 bp, Homo sapiens
gcacatggtgtgggg

SEQ ID NO: 1542961 - DNA, 20 bp, Homo sapiens
gcacatgtcttgtacatgtg

SEQ ID NO: 1542962 - DNA, 15 bp, Homo sapiens
gcacatgtgccacac

SEQ ID NO: 1542963 - DNA, 18 bp, Homo sapiens
gcacatgtgccacacagt

SEQ ID NO: 1542964 - DNA, 18 bp, Homo sapiens
gcacattaactccctcca

SEQ ID NO: 1542965 - DNA, 13 bp, Homo sapiens
gcacattcctggc

SEQ ID NO: 1542966 - DNA, 18 bp, Homo sapiens
gcacattcgggaccaata

SEQ ID NO: 1542967 - DNA, 14 bp, Homo sapiens
gcacattgagctgt

SEQ ID NO: 1542968 - DNA, 13 bp, Homo sapiens
gcacattgcccat

SEQ ID NO: 1542969 - DNA, 13 bp, Homo sapiens
gcacattgcctgt

SEQ ID NO: 1542970 - DNA, 21 bp, Homo sapiens
gcacattgcctgttctgcttc

SEQ ID NO: 1542971 - DNA, 17 bp, Homo sapiens
gcacattggaaagcaca

SEQ ID NO: 1542972 - DNA, 14 bp, Homo sapiens
gcacatttatatat

SEQ ID NO: 1542973 - DNA, 16 bp, Homo sapiens
gcacatttatatatat

SEQ ID NO: 1542974 - DNA, 14 bp, Homo sapiens
gcacatttctggat

SEQ ID NO: 1542975 - DNA, 23 bp, Homo sapiens
gcaccaaacctaagtccttccac

SEQ ID NO: 1542976 - DNA, 13 bp, Homo sapiens
gcaccaaagacat

SEQ ID NO: 1542977 - DNA, 13 bp, Homo sapiens
gcaccaaccacag

SEQ ID NO: 1542978 - DNA, 13 bp, Homo sapiens
gcaccacactggg

SEQ ID NO: 1542979 - DNA, 19 bp, Homo sapiens
gcaccaccaggagcagcag

SEQ ID NO: 1542980 - DNA, 23 bp, Homo sapiens
gcaccaccaggagcagcagccag

SEQ ID NO: 1542981 - DNA, 17 bp, Homo sapiens
gcaccacctacacagga

SEQ ID NO: 1542982 - DNA, 23 bp, Homo sapiens
gcaccacgggacatcacagggtg

SEQ ID NO: 1542983 - DNA, 16 bp, Homo sapiens
gcaccactgcactcca

SEQ ID NO: 1542984 - DNA, 17 bp, Homo sapiens
gcaccactgcactccag

SEQ ID NO: 1542985 - DNA, 20 bp, Homo sapiens
gcaccactgcactccagcct

SEQ ID NO: 1542986 - DNA, 16 bp, Homo sapiens
gcaccactgcttccca

SEQ ID NO: 1542987 - DNA, 21 bp, Homo sapiens
gcaccactgcttcccactggg

SEQ ID NO: 1542988 - DNA, 18 bp, Homo sapiens
gcaccactgtgtatttaa

SEQ ID NO: 1542989 - DNA, 14 bp, Homo sapiens
gcaccagacaccca

SEQ ID NO: 1542990 - DNA, 17 bp, Homo sapiens
gcaccagacacccagga

SEQ ID NO: 1542991 - DNA, 20 bp, Homo sapiens
gcaccagacacccaggactt

SEQ ID NO: 1542992 - DNA, 13 bp, Homo sapiens
gcaccagaggccg

SEQ ID NO: 1542993 - DNA, 22 bp, Homo sapiens
gcaccagagtgaaagggctatg

SEQ ID NO: 1542994 - DNA, 19 bp, Homo sapiens
gcaccagccagcgtagcag

SEQ ID NO: 1542995 - DNA, 21 bp, Homo sapiens
atcctaatgacttctaaaaat

SEQ ID NO: 1542996 - DNA, 16 bp, Homo sapiens
atcctaatttctcctc

SEQ ID NO: 1542997 - DNA, 20 bp, Homo sapiens
atcctaatttctcctccctt

SEQ ID NO: 1542998 - DNA, 16 bp, Homo sapiens
atcctagaaccaagct

SEQ ID NO: 1542999 - DNA, 19 bp, Homo sapiens
atcctagaggtagagaaac

SEQ ID NO: 1543000 - DNA, 20 bp, Homo sapiens
atcctattaaaacacagctt

SEQ ID NO: 1543001 - DNA, 17 bp, Homo sapiens
atcctcaacactattgt

SEQ ID NO: 1543002 - DNA, 22 bp, Homo sapiens
atcctcaccatccacagcaaga

SEQ ID NO: 1543003 - DNA, 20 bp, Homo sapiens
atcctcatatggcccagtgt

SEQ ID NO: 1543004 - DNA, 14 bp, Homo sapiens
atcctcatccctga

SEQ ID NO: 1543005 - DNA, 14 bp, Homo sapiens
atcctcatcttgga

SEQ ID NO: 1543006 - DNA, 21 bp, Homo sapiens
atcctcattgcctcctgttct

SEQ ID NO: 1543007 - DNA, 19 bp, Homo sapiens
atcctccaaccaggctcct

SEQ ID NO: 1543008 - DNA, 20 bp, Homo sapiens
atcctccagtaccttgcttc

SEQ ID NO: 1543009 - DNA, 14 bp, Homo sapiens
atcctccattgctc

SEQ ID NO: 1543010 - DNA, 20 bp, Homo sapiens
atcctcccacttcagcctcc

SEQ ID NO: 1543011 - DNA, 17 bp, Homo sapiens
atcctccctggcagaca

SEQ ID NO: 1543012 - DNA, 24 bp, Homo sapiens
atcctcccttcccaggaggtgcag

SEQ ID NO: 1543013 - DNA, 15 bp, Homo sapiens
atcctcctccagggt

SEQ ID NO: 1543014 - DNA, 14 bp, Homo sapiens
atcctcctcccacc

SEQ ID NO: 1543015 - DNA, 13 bp, Homo sapiens
atcctcctcccca

SEQ ID NO: 1543016 - DNA, 16 bp, Homo sapiens
atcctcctccccagct

SEQ ID NO: 1543017 - DNA, 22 bp, Homo sapiens
atcctcctcctggactcccctc

SEQ ID NO: 1543018 - DNA, 23 bp, Homo sapiens
atcctcctcctggactcccctcc

SEQ ID NO: 1543019 - DNA, 11 bp, Homo sapiens
atcctcctgca

SEQ ID NO: 1543020 - DNA, 16 bp, Homo sapiens
atcctcctgttctgaa

SEQ ID NO: 1543021 - DNA, 19 bp, Homo sapiens
atcctctaaagcagaggca

SEQ ID NO: 1543022 - DNA, 16 bp, Homo sapiens
atcctctcacctcagc

SEQ ID NO: 1543023 - DNA, 14 bp, Homo sapiens
atcctctctcccct

SEQ ID NO: 1543024 - DNA, 12 bp, Homo sapiens
atcctctctctc

SEQ ID NO: 1543025 - DNA, 20 bp, Homo sapiens
atcctctcttcctcttcccc

SEQ ID NO: 1543026 - DNA, 17 bp, Homo sapiens
atcctgaaatttcagat

SEQ ID NO: 1543027 - DNA, 17 bp, Homo sapiens
atcctgaagcagttcag

SEQ ID NO: 1543028 - DNA, 19 bp, Homo sapiens
atcctgaagcagttcagaa

SEQ ID NO: 1543029 - DNA, 20 bp, Homo sapiens
atcctgaagcagttcagaag

SEQ ID NO: 1543030 - DNA, 20 bp, Homo sapiens
atcctgagagacctgccctc

SEQ ID NO: 1543031 - DNA, 19 bp, Homo sapiens
atcctgagccagggaacag

SEQ ID NO: 1543032 - DNA, 20 bp, Homo sapiens
atcctgataaacattaaaca

SEQ ID NO: 1543033 - DNA, 18 bp, Homo sapiens
atcctgattattgaatgt

SEQ ID NO: 1543034 - DNA, 14 bp, Homo sapiens
atcctgattccaaa

SEQ ID NO: 1543035 - DNA, 17 bp, Homo sapiens
atcctgattcctctcta

SEQ ID NO: 1543036 - DNA, 17 bp, Homo sapiens
atcctgcaccccagcat

SEQ ID NO: 1543037 - DNA, 17 bp, Homo sapiens
atcctgcagcctcctcc

SEQ ID NO: 1543038 - DNA, 20 bp, Homo sapiens
atcctgcaggaacgagcact

SEQ ID NO: 1543039 - DNA, 15 bp, Homo sapiens
atcctgcagggcttc

SEQ ID NO: 1543040 - DNA, 15 bp, Homo sapiens
atcctgcccagtgtt

SEQ ID NO: 1543041 - DNA, 13 bp, Homo sapiens
atcctgctccagc

SEQ ID NO: 1543042 - DNA, 12 bp, Homo sapiens
atcctgctcttt

SEQ ID NO: 1543043 - DNA, 17 bp, Homo sapiens
atcctgctcttttgtga

SEQ ID NO: 1543044 - DNA, 19 bp, Homo sapiens
atcctgctcttttgtgatg

SEQ ID NO: 1543045 - DNA, 15 bp, Homo sapiens
atcctgctgacctca

SEQ ID NO: 1543046 - DNA, 22 bp, Homo sapiens
atcctgctgacctcactgtcct

SEQ ID NO: 1543047 - DNA, 23 bp, Homo sapiens
atcctgctgacctcactgtcctg

SEQ ID NO: 1543048 - DNA, 19 bp, Homo sapiens
atcctggaaggacacagtg

SEQ ID NO: 1543049 - DNA, 22 bp, Homo sapiens
atcctggaaggacacagtgatg

SEQ ID NO: 1543050 - DNA, 15 bp, Homo sapiens
atcctggaggcccag

SEQ ID NO: 1543051 - DNA, 19 bp, Homo sapiens
atcctggaggcccagttca

SEQ ID NO: 1543052 - DNA, 14 bp, Homo sapiens
atcctggaggtctt

SEQ ID NO: 1543053 - DNA, 16 bp, Homo sapiens
atcctggcaagaaagc

SEQ ID NO: 1543054 - DNA, 16 bp, Homo sapiens
atcctggcagcccaga

SEQ ID NO: 1543055 - DNA, 18 bp, Homo sapiens
atcctggctaacatggtg

SEQ ID NO: 1543056 - DNA, 21 bp, Homo sapiens
atcctgggctgggtggcccct

SEQ ID NO: 1543057 - DNA, 20 bp, Homo sapiens
atcctggggcattaaaaaaa

SEQ ID NO: 1543058 - DNA, 15 bp, Homo sapiens
atcctggggctccct

SEQ ID NO: 1543059 - DNA, 21 bp, Homo sapiens
atcctgggggacccaatgtag

SEQ ID NO: 1543060 - DNA, 16 bp, Homo sapiens
atcctggtaaccaaat

SEQ ID NO: 1543061 - DNA, 14 bp, Homo sapiens
atcctggtttcata

SEQ ID NO: 1543062 - DNA, 15 bp, Homo sapiens
atcctgtattcttgt

SEQ ID NO: 1543063 - DNA, 21 bp, Homo sapiens
atcctgtctttaaggaaaaaa

SEQ ID NO: 1543064 - DNA, 23 bp, Homo sapiens
atcctgtctttaaggaaaaaaag

SEQ ID NO: 1543065 - DNA, 18 bp, Homo sapiens
atcctgtctttctgagca

SEQ ID NO: 1543066 - DNA, 11 bp, Homo sapiens
atcctgtgact

SEQ ID NO: 1543067 - DNA, 18 bp, Homo sapiens
atcctgtgtggagaggga

SEQ ID NO: 1543068 - DNA, 23 bp, Homo sapiens
atcctgtgtggagagggaatgtg

SEQ ID NO: 1543069 - DNA, 14 bp, Homo sapiens
atcctgtgtttcta

SEQ ID NO: 1543070 - DNA, 14 bp, Homo sapiens
atccttaacatttc

SEQ ID NO: 1543071 - DNA, 20 bp, Homo sapiens
atccttaacatttctctcca

SEQ ID NO: 1543072 - DNA, 15 bp, Homo sapiens
atccttactgatatt

SEQ ID NO: 1543073 - DNA, 18 bp, Homo sapiens
atccttagaggtcctctg

SEQ ID NO: 1543074 - DNA, 19 bp, Homo sapiens
atccttataggcctgtccc

SEQ ID NO: 1543075 - DNA, 17 bp, Homo sapiens
atccttatgcatgaaat

SEQ ID NO: 1543076 - DNA, 18 bp, Homo sapiens
atccttatgcatgaaatg

SEQ ID NO: 1543077 - DNA, 21 bp, Homo sapiens
atccttcacaggcagtgcatg

SEQ ID NO: 1543078 - DNA, 18 bp, Homo sapiens
atccttcagcacaggaat

SEQ ID NO: 1543079 - DNA, 15 bp, Homo sapiens
atccttccacctcag

SEQ ID NO: 1543080 - DNA, 16 bp, Homo sapiens
atccttccacctcagt

SEQ ID NO: 1543081 - DNA, 22 bp, Homo sapiens
atccttccagtggctcgctccc

SEQ ID NO: 1543082 - DNA, 14 bp, Homo sapiens
atccttccattcca

SEQ ID NO: 1543083 - DNA, 15 bp, Homo sapiens
atccttccattccac

SEQ ID NO: 1543084 - DNA, 17 bp, Homo sapiens
atccttccctttggaga

SEQ ID NO: 1543085 - DNA, 16 bp, Homo sapiens
atccttccttcccacc

SEQ ID NO: 1543086 - DNA, 22 bp, Homo sapiens
atccttctagtttcccacaata

SEQ ID NO: 1543087 - DNA, 20 bp, Homo sapiens
atccttctgagctccacctc

SEQ ID NO: 1543088 - DNA, 21 bp, Homo sapiens
atccttctgagctccacctct

SEQ ID NO: 1543089 - DNA, 15 bp, Homo sapiens
atccttgctgcagct

SEQ ID NO: 1543090 - DNA, 19 bp, Homo sapiens
atccttgctgcagcttcta

SEQ ID NO: 1543091 - DNA, 21 bp, Homo sapiens
atccttggctttcagagccag

SEQ ID NO: 1543092 - DNA, 18 bp, Homo sapiens
atccttgggggctcccag

SEQ ID NO: 1543093 - DNA, 17 bp, Homo sapiens
atccttggtgctgtgtg

SEQ ID NO: 1543094 - DNA, 18 bp, Homo sapiens
atccttggtgctgtgtgc

SEQ ID NO: 1543095 - DNA, 22 bp, Homo sapiens
atccttggtgctgtgtgcccca

SEQ ID NO: 1543096 - DNA, 15 bp, Homo sapiens
atccttgtcttttga

SEQ ID NO: 1543097 - DNA, 19 bp, Homo sapiens
atccttgtcttttgagcta

SEQ ID NO: 1543098 - DNA, 18 bp, Homo sapiens
atccttgttgaagttttt

SEQ ID NO: 1543099 - DNA, 20 bp, Homo sapiens
atccttgttgaagttttttt

SEQ ID NO: 1543100 - DNA, 17 bp, Homo sapiens
atcctttaaaatttaaa

SEQ ID NO: 1543101 - DNA, 17 bp, Homo sapiens
atcctttacgtgtttaa

SEQ ID NO: 1543102 - DNA, 19 bp, Homo sapiens
atcctttgagaatgtgatt

SEQ ID NO: 1543103 - DNA, 21 bp, Homo sapiens
atcctttgttttctgactaat

SEQ ID NO: 1543104 - DNA, 13 bp, Homo sapiens
atccttttcctta

SEQ ID NO: 1543105 - DNA, 22 bp, Homo sapiens
atcctttttaaattcagtccta

SEQ ID NO: 1543106 - DNA, 15 bp, Homo sapiens
atcctttttctttat

SEQ ID NO: 1543107 - DNA, 18 bp, Homo sapiens
atcgaagtgtttatgtaa

SEQ ID NO: 1543108 - DNA, 21 bp, Homo sapiens
atcgacttgtttttgcacatg

SEQ ID NO: 1543109 - DNA, 16 bp, Homo sapiens
atcgagaccatcctgg

SEQ ID NO: 1543110 - DNA, 15 bp, Homo sapiens
atcgatgtgctcagc

SEQ ID NO: 1543111 - DNA, 15 bp, Homo sapiens
gcaccagccccctgg

SEQ ID NO: 1543112 - DNA, 17 bp, Homo sapiens
gcaccagccccctggat

SEQ ID NO: 1543113 - DNA, 19 bp, Homo sapiens
gcaccagcccgaacaccat

SEQ ID NO: 1543114 - DNA, 17 bp, Homo sapiens
gcaccagcgcccccaga

SEQ ID NO: 1543115 - DNA, 16 bp, Homo sapiens
gcaccagctctgtggc

SEQ ID NO: 1543116 - DNA, 19 bp, Homo sapiens
gcaccagctctgtggcctg

SEQ ID NO: 1543117 - DNA, 12 bp, Homo sapiens
gcaccagctgct

SEQ ID NO: 1543118 - DNA, 16 bp, Homo sapiens
gcaccagctgctctgc

SEQ ID NO: 1543119 - DNA, 18 bp, Homo sapiens
gcaccagctgctctgccc

SEQ ID NO: 1543120 - DNA, 13 bp, Homo sapiens
gcaccaggaagcc

SEQ ID NO: 1543121 - DNA, 18 bp, Homo sapiens
gcaccaggaagccgtcct

SEQ ID NO: 1543122 - DNA, 13 bp, Homo sapiens
gcaccaggagaca

SEQ ID NO: 1543123 - DNA, 23 bp, Homo sapiens
gcaccaggcacgaacccacctgc

SEQ ID NO: 1543124 - DNA, 16 bp, Homo sapiens
gcaccaggggtttctc

SEQ ID NO: 1543125 - DNA, 19 bp, Homo sapiens
gcaccagtgtcctcccctc

SEQ ID NO: 1543126 - DNA, 20 bp, Homo sapiens
gcaccagtgtcctcccctca

SEQ ID NO: 1543127 - DNA, 14 bp, Homo sapiens
gcaccatcagcctg

SEQ ID NO: 1543128 - DNA, 17 bp, Homo sapiens
gcaccattctgactcgg

SEQ ID NO: 1543129 - DNA, 23 bp, Homo sapiens
gcaccattgcactctagcctggc

SEQ ID NO: 1543130 - DNA, 17 bp, Homo sapiens
gcacccacctccacccc

SEQ ID NO: 1543131 - DNA, 24 bp, Homo sapiens
gcacccacctggtactgacccagg

SEQ ID NO: 1543132 - DNA, 20 bp, Homo sapiens
gcacccacctgttttctgaa

SEQ ID NO: 1543133 - DNA, 21 bp, Homo sapiens
gcacccacctgttttctgaaa

SEQ ID NO: 1543134 - DNA, 17 bp, Homo sapiens
gcacccactcaccaggg

SEQ ID NO: 1543135 - DNA, 16 bp, Homo sapiens
gcacccaggcctccct

SEQ ID NO: 1543136 - DNA, 22 bp, Homo sapiens
gcacccatgtgggcgcccaccc

SEQ ID NO: 1543137 - DNA, 17 bp, Homo sapiens
gcaccccaaagctttcc

SEQ ID NO: 1543138 - DNA, 20 bp, Homo sapiens
gcaccccaaagctttcctgc

SEQ ID NO: 1543139 - DNA, 19 bp, Homo sapiens
gcaccccagcattccagct

SEQ ID NO: 1543140 - DNA, 23 bp, Homo sapiens
gcacccccacaagctgtccctgc

SEQ ID NO: 1543141 - DNA, 12 bp, Homo sapiens
gcaccccctccc

SEQ ID NO: 1543142 - DNA, 19 bp, Homo sapiens
gcaccccctgctccaccag

SEQ ID NO: 1543143 - DNA, 23 bp, Homo sapiens
gcaccccctgctccaccagcagc

SEQ ID NO: 1543144 - DNA, 15 bp, Homo sapiens
gcaccccggcctcag

SEQ ID NO: 1543145 - DNA, 16 bp, Homo sapiens
gcaccccggcctcagg

SEQ ID NO: 1543146 - DNA, 17 bp, Homo sapiens
gcaccccggcctcaggg

SEQ ID NO: 1543147 - DNA, 13 bp, Homo sapiens
gcacccctcccat

SEQ ID NO: 1543148 - DNA, 21 bp, Homo sapiens
gcacccctccctgcttgcaca

SEQ ID NO: 1543149 - DNA, 22 bp, Homo sapiens
gcacccctccctgcttgcacac

SEQ ID NO: 1543150 - DNA, 13 bp, Homo sapiens
gcaccccttccat

SEQ ID NO: 1543151 - DNA, 19 bp, Homo sapiens
gcaccccttctctcctccc

SEQ ID NO: 1543152 - DNA, 21 bp, Homo sapiens
gcaccctagttctacctcagg

SEQ ID NO: 1543153 - DNA, 14 bp, Homo sapiens
gcaccctccaccct

SEQ ID NO: 1543154 - DNA, 15 bp, Homo sapiens
gcaccctccaccctg

SEQ ID NO: 1543155 - DNA, 19 bp, Homo sapiens
gcaccctcgatgaagccca

SEQ ID NO: 1543156 - DNA, 13 bp, Homo sapiens
gcaccctgcagag

SEQ ID NO: 1543157 - DNA, 19 bp, Homo sapiens
gcaccctgcgcctccagag

SEQ ID NO: 1543158 - DNA, 12 bp, Homo sapiens
gcaccctggcct

SEQ ID NO: 1543159 - DNA, 14 bp, Homo sapiens
gcaccctggcctgg

SEQ ID NO: 1543160 - DNA, 15 bp, Homo sapiens
gcaccctggcctggt

SEQ ID NO: 1543161 - DNA, 19 bp, Homo sapiens
gcaccctggcctggtccct

SEQ ID NO: 1543162 - DNA, 22 bp, Homo sapiens
gcaccctggcctggtccctggt

SEQ ID NO: 1543163 - DNA, 17 bp, Homo sapiens
gcaccctggggcctgga

SEQ ID NO: 1543164 - DNA, 20 bp, Homo sapiens
gcaccctggggcctggacct

SEQ ID NO: 1543165 - DNA, 21 bp, Homo sapiens
gcaccctggggcctggacctg

SEQ ID NO: 1543166 - DNA, 17 bp, Homo sapiens
gcacccttatcatggga

SEQ ID NO: 1543167 - DNA, 14 bp, Homo sapiens
gcacccttccctct

SEQ ID NO: 1543168 - DNA, 17 bp, Homo sapiens
gcacccttgcccggctg

SEQ ID NO: 1543169 - DNA, 23 bp, Homo sapiens
gcaccgcctgccctcccgcacct

SEQ ID NO: 1543170 - DNA, 20 bp, Homo sapiens
gcaccgcttttgttctcgca

SEQ ID NO: 1543171 - DNA, 22 bp, Homo sapiens
gcaccgcttttgttctcgcaaa

SEQ ID NO: 1543172 - DNA, 12 bp, Homo sapiens
gcaccggcgctg

SEQ ID NO: 1543173 - DNA, 13 bp, Homo sapiens
gcaccgggacccc

SEQ ID NO: 1543174 - DNA, 14 bp, Homo sapiens
gcaccgggaccccc

SEQ ID NO: 1543175 - DNA, 13 bp, Homo sapiens
gcaccgtccaggc

SEQ ID NO: 1543176 - DNA, 20 bp, Homo sapiens
gcaccgtgtcaagctgctct

SEQ ID NO: 1543177 - DNA, 16 bp, Homo sapiens
gcacctaaagcagcca

SEQ ID NO: 1543178 - DNA, 17 bp, Homo sapiens
gcacctaaagcagccag

SEQ ID NO: 1543179 - DNA, 22 bp, Homo sapiens
gcacctaatccaggcagatcca

SEQ ID NO: 1543180 - DNA, 23 bp, Homo sapiens
gcacctaatccaggcagatccag

SEQ ID NO: 1543181 - DNA, 17 bp, Homo sapiens
gcacctacatccccagg

SEQ ID NO: 1543182 - DNA, 17 bp, Homo sapiens
gcacctatagtcccagc

SEQ ID NO: 1543183 - DNA, 15 bp, Homo sapiens
gcacctcagcctgca

SEQ ID NO: 1543184 - DNA, 14 bp, Homo sapiens
gcacctccaggcag

SEQ ID NO: 1543185 - DNA, 13 bp, Homo sapiens
gcacctccaggcc

SEQ ID NO: 1543186 - DNA, 17 bp, Homo sapiens
gcacctcccagcccctg

SEQ ID NO: 1543187 - DNA, 23 bp, Homo sapiens
gcacctccccccactgcaggccc

SEQ ID NO: 1543188 - DNA, 14 bp, Homo sapiens
gcacctccccgctc

SEQ ID NO: 1543189 - DNA, 23 bp, Homo sapiens
gcacctccccgctctccctgtca

SEQ ID NO: 1543190 - DNA, 15 bp, Homo sapiens
gcacctcctgagaag

SEQ ID NO: 1543191 - DNA, 20 bp, Homo sapiens
gcacctcctgagaaggcgag

SEQ ID NO: 1543192 - DNA, 20 bp, Homo sapiens
gcacctgaaccccatgggct

SEQ ID NO: 1543193 - DNA, 22 bp, Homo sapiens
gcacctgcatccgtagttccct

SEQ ID NO: 1543194 - DNA, 13 bp, Homo sapiens
gcacctgccagcc

SEQ ID NO: 1543195 - DNA, 14 bp, Homo sapiens
gcacctgccagcct

SEQ ID NO: 1543196 - DNA, 22 bp, Homo sapiens
gcacctgccccctggtggacag

SEQ ID NO: 1543197 - DNA, 19 bp, Homo sapiens
gcacctgccgacctcgtcc

SEQ ID NO: 1543198 - DNA, 17 bp, Homo sapiens
gcacctgcctccaccag

SEQ ID NO: 1543199 - DNA, 20 bp, Homo sapiens
gcacctgctgcgtccccact

SEQ ID NO: 1543200 - DNA, 21 bp, Homo sapiens
gcacctggaggggcaccaggt

SEQ ID NO: 1543201 - DNA, 18 bp, Homo sapiens
gcacctggcatcgcacca

SEQ ID NO: 1543202 - DNA, 13 bp, Homo sapiens
gcacctggcctgc

SEQ ID NO: 1543203 - DNA, 16 bp, Homo sapiens
gcacctggcctgctgg

SEQ ID NO: 1543204 - DNA, 15 bp, Homo sapiens
gcacctggcctgggc

SEQ ID NO: 1543205 - DNA, 20 bp, Homo sapiens
gcacctggcctgggccacac

SEQ ID NO: 1543206 - DNA, 22 bp, Homo sapiens
gcacctggtgggtggtgtcctg

SEQ ID NO: 1543207 - DNA, 21 bp, Homo sapiens
gcacctgtaatcccagctact

SEQ ID NO: 1543208 - DNA, 11 bp, Homo sapiens
gcacctgtccc

SEQ ID NO: 1543209 - DNA, 15 bp, Homo sapiens
gcacctgtccccacc

SEQ ID NO: 1543210 - DNA, 18 bp, Homo sapiens
gcacctgtccccaccctc

SEQ ID NO: 1543211 - DNA, 21 bp, Homo sapiens
gcacctgtccccaccctccac

SEQ ID NO: 1543212 - DNA, 19 bp, Homo sapiens
gcacctgtcgcccagtgcc

SEQ ID NO: 1543213 - DNA, 16 bp, Homo sapiens
gcaccttggcccagga

SEQ ID NO: 1543214 - DNA, 18 bp, Homo sapiens
gcaccttggcccaggagc

SEQ ID NO: 1543215 - DNA, 19 bp, Homo sapiens
gcaccttggcccaggagct

SEQ ID NO: 1543216 - DNA, 19 bp, Homo sapiens
gcaccttgtgcctggggtg

SEQ ID NO: 1543217 - DNA, 14 bp, Homo sapiens
gcaccttgtgtctg

SEQ ID NO: 1543218 - DNA, 15 bp, Homo sapiens
gcacgaaatgttatt

SEQ ID NO: 1543219 - DNA, 19 bp, Homo sapiens
gcacgaacccacctgctga

SEQ ID NO: 1543220 - DNA, 16 bp, Homo sapiens
gcacgaccgccccagt

SEQ ID NO: 1543221 - DNA, 20 bp, Homo sapiens
gcacgacgtcagcctcttac

SEQ ID NO: 1543222 - DNA, 16 bp, Homo sapiens
gcacgaggtctggcca

SEQ ID NO: 1543223 - DNA, 10 bp, Homo sapiens
gcacgcacac

SEQ ID NO: 1543224 - DNA, 14 bp, Homo sapiens
gcacgcacacacac

SEQ ID NO: 1543225 - DNA, 19 bp, Homo sapiens
gcacgcaccactgcttccc

SEQ ID NO: 1543226 - DNA, 13 bp, Homo sapiens
gcacgccctactc

SEQ ID NO: 1543227 - DNA, 18 bp, Homo sapiens
atcgattcaaactgctcc

SEQ ID NO: 1543228 - DNA, 17 bp, Homo sapiens
atcgcaaggcctgtgct

SEQ ID NO: 1543229 - DNA, 22 bp, Homo sapiens
atcgcaccactgcactccagcc

SEQ ID NO: 1543230 - DNA, 22 bp, Homo sapiens
atcgctgtgtgttagttcccaa

SEQ ID NO: 1543231 - DNA, 16 bp, Homo sapiens
atcgcttgaacctggg

SEQ ID NO: 1543232 - DNA, 14 bp, Homo sapiens
atcgcttgagccca

SEQ ID NO: 1543233 - DNA, 21 bp, Homo sapiens
atcgctttatgtttttggtta

SEQ ID NO: 1543234 - DNA, 15 bp, Homo sapiens
atcggaaaaataatc

SEQ ID NO: 1543235 - DNA, 13 bp, Homo sapiens
atcggactgccaa

SEQ ID NO: 1543236 - DNA, 14 bp, Homo sapiens
atcggactgccaaa

SEQ ID NO: 1543237 - DNA, 15 bp, Homo sapiens
atcggactgccaaat

SEQ ID NO: 1543238 - DNA, 13 bp, Homo sapiens
atcggagacagtg

SEQ ID NO: 1543239 - DNA, 16 bp, Homo sapiens
atcggagcgaagcaga

SEQ ID NO: 1543240 - DNA, 17 bp, Homo sapiens
atcggagcgaagcagag

SEQ ID NO: 1543241 - DNA, 21 bp, Homo sapiens
atcggatctggggctctggga

SEQ ID NO: 1543242 - DNA, 14 bp, Homo sapiens
atcggccacagggc

SEQ ID NO: 1543243 - DNA, 20 bp, Homo sapiens
atcggcccacagctcccacc

SEQ ID NO: 1543244 - DNA, 15 bp, Homo sapiens
atcgggagcacccag

SEQ ID NO: 1543245 - DNA, 17 bp, Homo sapiens
atcggttcaagttgatg

SEQ ID NO: 1543246 - DNA, 13 bp, Homo sapiens
atcgtagaagaga

SEQ ID NO: 1543247 - DNA, 13 bp, Homo sapiens
atcgtaggcagcc

SEQ ID NO: 1543248 - DNA, 21 bp, Homo sapiens
atcgtagtgtgtttaaataaa

SEQ ID NO: 1543249 - DNA, 16 bp, Homo sapiens
atcgtgacccttcagg

SEQ ID NO: 1543250 - DNA, 18 bp, Homo sapiens
atcgtgacccttcagggc

SEQ ID NO: 1543251 - DNA, 19 bp, Homo sapiens
atcgtgacccttcagggcc

SEQ ID NO: 1543252 - DNA, 20 bp, Homo sapiens
atcgtgacccttcagggcca

SEQ ID NO: 1543253 - DNA, 22 bp, Homo sapiens
atcgtgacccttcagggccaga

SEQ ID NO: 1543254 - DNA, 19 bp, Homo sapiens
atcgtgccgttactctcca

SEQ ID NO: 1543255 - DNA, 14 bp, Homo sapiens
atcgtgctactgca

SEQ ID NO: 1543256 - DNA, 21 bp, Homo sapiens
atcgtggcacgtattgctgtg

SEQ ID NO: 1543257 - DNA, 21 bp, Homo sapiens
atcgtgggtcactacagggag

SEQ ID NO: 1543258 - DNA, 22 bp, Homo sapiens
atcgtgtgccatggatctgatc

SEQ ID NO: 1543259 - DNA, 14 bp, Homo sapiens
atcgttctctgcct

SEQ ID NO: 1543260 - DNA, 14 bp, Homo sapiens
atcgtttttgtatt

SEQ ID NO: 1543261 - DNA, 18 bp, Homo sapiens
atctaaaaataactgtaa

SEQ ID NO: 1543262 - DNA, 20 bp, Homo sapiens
atctaaaaataactgtaatt

SEQ ID NO: 1543263 - DNA, 13 bp, Homo sapiens
atctaaaaatata

SEQ ID NO: 1543264 - DNA, 17 bp, Homo sapiens
atctaaaaatatacatg

SEQ ID NO: 1543265 - DNA, 18 bp, Homo sapiens
atctaaaaatatacatgt

SEQ ID NO: 1543266 - DNA, 17 bp, Homo sapiens
atctaaaatttaaaatt

SEQ ID NO: 1543267 - DNA, 19 bp, Homo sapiens
atctaaacgtggtcacctt

SEQ ID NO: 1543268 - DNA, 20 bp, Homo sapiens
atctaaagctttggacaagt

SEQ ID NO: 1543269 - DNA, 15 bp, Homo sapiens
atctaaatctattta

SEQ ID NO: 1543270 - DNA, 15 bp, Homo sapiens
atctaacaaaataag

SEQ ID NO: 1543271 - DNA, 19 bp, Homo sapiens
atctaacaataatatttca

SEQ ID NO: 1543272 - DNA, 22 bp, Homo sapiens
atctaacaataatatttcaagt

SEQ ID NO: 1543273 - DNA, 23 bp, Homo sapiens
atctaacaataatatttcaagtg

SEQ ID NO: 1543274 - DNA, 18 bp, Homo sapiens
atctaagcctttccataa

SEQ ID NO: 1543275 - DNA, 19 bp, Homo sapiens
atctaagggaagatcactg

SEQ ID NO: 1543276 - DNA, 23 bp, Homo sapiens
atctaagtcagtttcacatattt

SEQ ID NO: 1543277 - DNA, 13 bp, Homo sapiens
atctaagttataa

SEQ ID NO: 1543278 - DNA, 19 bp, Homo sapiens
atctaagttataagactct

SEQ ID NO: 1543279 - DNA, 22 bp, Homo sapiens
atctaatacctctgtgtgctcc

SEQ ID NO: 1543280 - DNA, 14 bp, Homo sapiens
atctaatctaaaag

SEQ ID NO: 1543281 - DNA, 18 bp, Homo sapiens
atctaatctcttattcta

SEQ ID NO: 1543282 - DNA, 23 bp, Homo sapiens
atctaatgcttgtttatgatatt

SEQ ID NO: 1543283 - DNA, 23 bp, Homo sapiens
atctaatttataaaaaggtgttt

SEQ ID NO: 1543284 - DNA, 13 bp, Homo sapiens
atctacaatcagt

SEQ ID NO: 1543285 - DNA, 23 bp, Homo sapiens
atctacaatctctttttgtttgc

SEQ ID NO: 1543286 - DNA, 13 bp, Homo sapiens
atctacacagcct

SEQ ID NO: 1543287 - DNA, 19 bp, Homo sapiens
atctacacagcctggactt

SEQ ID NO: 1543288 - DNA, 15 bp, Homo sapiens
atctacaccaatgaa

SEQ ID NO: 1543289 - DNA, 16 bp, Homo sapiens
atctacagaactacat

SEQ ID NO: 1543290 - DNA, 14 bp, Homo sapiens
atctacatcttttt

SEQ ID NO: 1543291 - DNA, 21 bp, Homo sapiens
atctacatcttttttcacaaa

SEQ ID NO: 1543292 - DNA, 20 bp, Homo sapiens
atctaccccagactagatgt

SEQ ID NO: 1543293 - DNA, 21 bp, Homo sapiens
atctaccccagactagatgta

SEQ ID NO: 1543294 - DNA, 20 bp, Homo sapiens
atctactaaaaatacaaaaa

SEQ ID NO: 1543295 - DNA, 22 bp, Homo sapiens
atctactaaaaatacaaaaatt

SEQ ID NO: 1543296 - DNA, 22 bp, Homo sapiens
atctactggaaatgtagcactt

SEQ ID NO: 1543297 - DNA, 13 bp, Homo sapiens
atctacttttttt

SEQ ID NO: 1543298 - DNA, 17 bp, Homo sapiens
atctagaaagctttgaa

SEQ ID NO: 1543299 - DNA, 21 bp, Homo sapiens
atctagaacacaggcaaaatc

SEQ ID NO: 1543300 - DNA, 12 bp, Homo sapiens
atctagaagact

SEQ ID NO: 1543301 - DNA, 16 bp, Homo sapiens
atctagatatcgactt

SEQ ID NO: 1543302 - DNA, 14 bp, Homo sapiens
atctagcaaatgtt

SEQ ID NO: 1543303 - DNA, 22 bp, Homo sapiens
atctagccagagcccttcactg

SEQ ID NO: 1543304 - DNA, 23 bp, Homo sapiens
atctagccagagcccttcactgc

SEQ ID NO: 1543305 - DNA, 12 bp, Homo sapiens
atctagccagcc

SEQ ID NO: 1543306 - DNA, 17 bp, Homo sapiens
atctaggatgtgatgat

SEQ ID NO: 1543307 - DNA, 21 bp, Homo sapiens
atctaggtggagttgaaagag

SEQ ID NO: 1543308 - DNA, 22 bp, Homo sapiens
atctaggtggagttgaaagagt

SEQ ID NO: 1543309 - DNA, 17 bp, Homo sapiens
atctagtatgaaattat

SEQ ID NO: 1543310 - DNA, 16 bp, Homo sapiens
atctagtcacaaagac

SEQ ID NO: 1543311 - DNA, 16 bp, Homo sapiens
atctagtttacagaaa

SEQ ID NO: 1543312 - DNA, 18 bp, Homo sapiens
atctagtttacagaaaaa

SEQ ID NO: 1543313 - DNA, 22 bp, Homo sapiens
atctagtttacagaaaaatctt

SEQ ID NO: 1543314 - DNA, 17 bp, Homo sapiens
atctagttttttttgta

SEQ ID NO: 1543315 - DNA, 12 bp, Homo sapiens
atctataaaata

SEQ ID NO: 1543316 - DNA, 16 bp, Homo sapiens
atctataaagaagaac

SEQ ID NO: 1543317 - DNA, 23 bp, Homo sapiens
atctataagtagtaaatcagaaa

SEQ ID NO: 1543318 - DNA, 11 bp, Homo sapiens
atctataattt

SEQ ID NO: 1543319 - DNA, 13 bp, Homo sapiens
atctataatttac

SEQ ID NO: 1543320 - DNA, 16 bp, Homo sapiens
atctatagaaagctat

SEQ ID NO: 1543321 - DNA, 17 bp, Homo sapiens
atctatagaaagctata

SEQ ID NO: 1543322 - DNA, 17 bp, Homo sapiens
atctataggcagcttct

SEQ ID NO: 1543323 - DNA, 18 bp, Homo sapiens
atctataggcagcttcta

SEQ ID NO: 1543324 - DNA, 19 bp, Homo sapiens
atctatatcatatttctgt

SEQ ID NO: 1543325 - DNA, 15 bp, Homo sapiens
atctatatttaacaa

SEQ ID NO: 1543326 - DNA, 20 bp, Homo sapiens
atctatctgcttatgcagtt

SEQ ID NO: 1543327 - DNA, 20 bp, Homo sapiens
atctatgaagtatataatgg

SEQ ID NO: 1543328 - DNA, 16 bp, Homo sapiens
atctatgcctttcaac

SEQ ID NO: 1543329 - DNA, 22 bp, Homo sapiens
atctatggcagtccagccagct

SEQ ID NO: 1543330 - DNA, 12 bp, Homo sapiens
atctattaatat

SEQ ID NO: 1543331 - DNA, 16 bp, Homo sapiens
atctattatactgtat

SEQ ID NO: 1543332 - DNA, 15 bp, Homo sapiens
atctattcagacaag

SEQ ID NO: 1543333 - DNA, 23 bp, Homo sapiens
atctattcctgtaaataagagtt

SEQ ID NO: 1543334 - DNA, 14 bp, Homo sapiens
atctatttctgaga

SEQ ID NO: 1543335 - DNA, 13 bp, Homo sapiens
atctatttggaac

SEQ ID NO: 1543336 - DNA, 17 bp, Homo sapiens
atctatttgtacaattt

SEQ ID NO: 1543337 - DNA, 20 bp, Homo sapiens
atctatttgtacaattttaa

SEQ ID NO: 1543338 - DNA, 19 bp, Homo sapiens
atctatttttggcagtctg

SEQ ID NO: 1543339 - DNA, 15 bp, Homo sapiens
atctcaaaacaaaac

SEQ ID NO: 1543340 - DNA, 20 bp, Homo sapiens
atctcaaaactgcactgtca

SEQ ID NO: 1543341 - DNA, 14 bp, Homo sapiens
atctcaaaggagaa

SEQ ID NO: 1543342 - DNA, 17 bp, Homo sapiens
atctcaaaggagaaaaa

SEQ ID NO: 1543343 - DNA, 14 bp, Homo sapiens
atctcaacatgtct

SEQ ID NO: 1543344 - DNA, 15 bp, Homo sapiens
atctcaagatattca

SEQ ID NO: 1543345 - DNA, 13 bp, Homo sapiens
atctcaagccagc

SEQ ID NO: 1543346 - DNA, 12 bp, Homo sapiens
atctcaagtata

SEQ ID NO: 1543347 - DNA, 23 bp, Homo sapiens
atctcaatgaaccataaattcaa

SEQ ID NO: 1543348 - DNA, 18 bp, Homo sapiens
atctcaatgaagccagct

SEQ ID NO: 1543349 - DNA, 17 bp, Homo sapiens
atctcaattgaaagctt

SEQ ID NO: 1543350 - DNA, 16 bp, Homo sapiens
atctcaccccatccca

SEQ ID NO: 1543351 - DNA, 22 bp, Homo sapiens
atctcaccccatcccacaccct

SEQ ID NO: 1543352 - DNA, 20 bp, Homo sapiens
atctcagaattccttttcta

SEQ ID NO: 1543353 - DNA, 22 bp, Homo sapiens
atctcagagacaggtggcctag

SEQ ID NO: 1543354 - DNA, 16 bp, Homo sapiens
atctcagatatttgca

SEQ ID NO: 1543355 - DNA, 12 bp, Homo sapiens
atctcagccatt

SEQ ID NO: 1543356 - DNA, 11 bp, Homo sapiens
atctcagctca

SEQ ID NO: 1543357 - DNA, 23 bp, Homo sapiens
atctcagctttgagaagccttca

SEQ ID NO: 1543358 - DNA, 21 bp, Homo sapiens
atctcaggagatggagggctt

SEQ ID NO: 1543359 - DNA, 22 bp, Homo sapiens
atctcaggaggggcagcgcatg

SEQ ID NO: 1543360 - DNA, 16 bp, Homo sapiens
atctcagggaagccca

SEQ ID NO: 1543361 - DNA, 13 bp, Homo sapiens
atctcagggcaga

SEQ ID NO: 1543362 - DNA, 17 bp, Homo sapiens
atctcagttgtttgctt

SEQ ID NO: 1543363 - DNA, 18 bp, Homo sapiens
atctcataatttatacag

SEQ ID NO: 1543364 - DNA, 18 bp, Homo sapiens
atctcatacctctgacca

SEQ ID NO: 1543365 - DNA, 15 bp, Homo sapiens
atctcatactgtctg

SEQ ID NO: 1543366 - DNA, 16 bp, Homo sapiens
atctcatactgtctgg

SEQ ID NO: 1543367 - DNA, 20 bp, Homo sapiens
atctcatcaggcaaattgta

SEQ ID NO: 1543368 - DNA, 14 bp, Homo sapiens
atctcatccctcaa

SEQ ID NO: 1543369 - DNA, 16 bp, Homo sapiens
atctcatccctcaact

SEQ ID NO: 1543370 - DNA, 17 bp, Homo sapiens
atctcatggaaactggc

SEQ ID NO: 1543371 - DNA, 20 bp, Homo sapiens
atctcattgttcaattccca

SEQ ID NO: 1543372 - DNA, 12 bp, Homo sapiens
atctccactttt

SEQ ID NO: 1543373 - DNA, 14 bp, Homo sapiens
atctccagggagca

SEQ ID NO: 1543374 - DNA, 21 bp, Homo sapiens
atctccagggagcaagacaga

SEQ ID NO: 1543375 - DNA, 19 bp, Homo sapiens
atctccagggagtcccctc

SEQ ID NO: 1543376 - DNA, 19 bp, Homo sapiens
atctccatccctgaaattt

SEQ ID NO: 1543377 - DNA, 13 bp, Homo sapiens
atctccccactct

SEQ ID NO: 1543378 - DNA, 18 bp, Homo sapiens
atctccccaggcctccag

SEQ ID NO: 1543379 - DNA, 21 bp, Homo sapiens
atctccccaggcctccagcct

SEQ ID NO: 1543380 - DNA, 22 bp, Homo sapiens
atctcccccatcccccactgcc

SEQ ID NO: 1543381 - DNA, 20 bp, Homo sapiens
atctcccctagctcaccagg

SEQ ID NO: 1543382 - DNA, 21 bp, Homo sapiens
atctcccctagctcaccaggc

SEQ ID NO: 1543383 - DNA, 22 bp, Homo sapiens
atctcccctagctcaccaggcc

SEQ ID NO: 1543384 - DNA, 22 bp, Homo sapiens
atctcccctcctggcgagttct

SEQ ID NO: 1543385 - DNA, 17 bp, Homo sapiens
atctccctagcccaccc

SEQ ID NO: 1543386 - DNA, 11 bp, Homo sapiens
atctccctggc

SEQ ID NO: 1543387 - DNA, 15 bp, Homo sapiens
atctccctggctcac

SEQ ID NO: 1543388 - DNA, 17 bp, Homo sapiens
atctcccttcagcaact

SEQ ID NO: 1543389 - DNA, 18 bp, Homo sapiens
atctccgtagaattttgc

SEQ ID NO: 1543390 - DNA, 13 bp, Homo sapiens
atctcctaacaaa

SEQ ID NO: 1543391 - DNA, 14 bp, Homo sapiens
atctcctgatttct

SEQ ID NO: 1543392 - DNA, 17 bp, Homo sapiens
atctcctgctgcctttt

SEQ ID NO: 1543393 - DNA, 15 bp, Homo sapiens
atctcctgtgcatgg

SEQ ID NO: 1543394 - DNA, 13 bp, Homo sapiens
atctccttccccc

SEQ ID NO: 1543395 - DNA, 17 bp, Homo sapiens
atctccttcccccagcc

SEQ ID NO: 1543396 - DNA, 23 bp, Homo sapiens
atctccttcccccagcccaataa

SEQ ID NO: 1543397 - DNA, 17 bp, Homo sapiens
atctccttcccctacac

SEQ ID NO: 1543398 - DNA, 12 bp, Homo sapiens
atctcggctcac

SEQ ID NO: 1543399 - DNA, 18 bp, Homo sapiens
atctcgggagtcctctag

SEQ ID NO: 1543400 - DNA, 17 bp, Homo sapiens
atctcgtaatagcttct

SEQ ID NO: 1543401 - DNA, 21 bp, Homo sapiens
atctcgtaatagcttctgtgt

SEQ ID NO: 1543402 - DNA, 21 bp, Homo sapiens
atctctaaaattctagtctct

SEQ ID NO: 1543403 - DNA, 21 bp, Homo sapiens
atctctactaccacaaggaaa

SEQ ID NO: 1543404 - DNA, 18 bp, Homo sapiens
atctctagaattttaagt

SEQ ID NO: 1543405 - DNA, 17 bp, Homo sapiens
atctctattattggaaa

SEQ ID NO: 1543406 - DNA, 15 bp, Homo sapiens
atctctcaaaacaat

SEQ ID NO: 1543407 - DNA, 17 bp, Homo sapiens
atctctcatcctccagt

SEQ ID NO: 1543408 - DNA, 15 bp, Homo sapiens
atctctccctcccct

SEQ ID NO: 1543409 - DNA, 23 bp, Homo sapiens
atctctccctcccctgccatttt

SEQ ID NO: 1543410 - DNA, 12 bp, Homo sapiens
atctctcctggc

SEQ ID NO: 1543411 - DNA, 19 bp, Homo sapiens
atctctcggttccacgtcc

SEQ ID NO: 1543412 - DNA, 15 bp, Homo sapiens
atctctctacctcca

SEQ ID NO: 1543413 - DNA, 18 bp, Homo sapiens
atctctctacctccaccc

SEQ ID NO: 1543414 - DNA, 22 bp, Homo sapiens
atctctctactcctacctcagc

SEQ ID NO: 1543415 - DNA, 19 bp, Homo sapiens
atctctctactgctggact

SEQ ID NO: 1543416 - DNA, 14 bp, Homo sapiens
atctctctgcagct

SEQ ID NO: 1543417 - DNA, 17 bp, Homo sapiens
atctctcttgtcctctt

SEQ ID NO: 1543418 - DNA, 19 bp, Homo sapiens
atctctcttgtcctcttct

SEQ ID NO: 1543419 - DNA, 21 bp, Homo sapiens
atctctcttgtcctcttctgc

SEQ ID NO: 1543420 - DNA, 15 bp, Homo sapiens
atctctgattaaatt

SEQ ID NO: 1543421 - DNA, 13 bp, Homo sapiens
atctctgcctgtc

SEQ ID NO: 1543422 - DNA, 14 bp, Homo sapiens
atctctgcctgtca

SEQ ID NO: 1543423 - DNA, 15 bp, Homo sapiens
atctctggaaaaata

SEQ ID NO: 1543424 - DNA, 20 bp, Homo sapiens
atctctggcccagaaagcct

SEQ ID NO: 1543425 - DNA, 21 bp, Homo sapiens
atctctggcccagaaagcctc

SEQ ID NO: 1543426 - DNA, 15 bp, Homo sapiens
atctctgtgccttcg

SEQ ID NO: 1543427 - DNA, 18 bp, Homo sapiens
atctctgttctgctccca

SEQ ID NO: 1543428 - DNA, 14 bp, Homo sapiens
atctcttattctaa

SEQ ID NO: 1543429 - DNA, 18 bp, Homo sapiens
atctcttattctaataaa

SEQ ID NO: 1543430 - DNA, 17 bp, Homo sapiens
atctcttcactaccctg

SEQ ID NO: 1543431 - DNA, 19 bp, Homo sapiens
atctcttcactaccctgat

SEQ ID NO: 1543432 - DNA, 19 bp, Homo sapiens
atctctttaaaaacaaaca

SEQ ID NO: 1543433 - DNA, 12 bp, Homo sapiens
atctctttccct

SEQ ID NO: 1543434 - DNA, 15 bp, Homo sapiens
atctctttgatctac

SEQ ID NO: 1543435 - DNA, 12 bp, Homo sapiens
atctcttttata

SEQ ID NO: 1543436 - DNA, 10 bp, Homo sapiens
atctcttttc

SEQ ID NO: 1543437 - DNA, 12 bp, Homo sapiens
atctgaaaagaa

SEQ ID NO: 1543438 - DNA, 14 bp, Homo sapiens
atctgaaaagaaat

SEQ ID NO: 1543439 - DNA, 12 bp, Homo sapiens
atctgaaaatgt

SEQ ID NO: 1543440 - DNA, 16 bp, Homo sapiens
atctgaaaatgtatgt

SEQ ID NO: 1543441 - DNA, 21 bp, Homo sapiens
atctgaaataggaaacaagtg

SEQ ID NO: 1543442 - DNA, 22 bp, Homo sapiens
atctgaagagtatccttccttc

SEQ ID NO: 1543443 - DNA, 17 bp, Homo sapiens
atctgaattaaataaat

SEQ ID NO: 1543444 - DNA, 17 bp, Homo sapiens
atctgacccactttgta

SEQ ID NO: 1543445 - DNA, 19 bp, Homo sapiens
atctgacccactttgtaat

SEQ ID NO: 1543446 - DNA, 13 bp, Homo sapiens
atctgacccagtg

SEQ ID NO: 1543447 - DNA, 21 bp, Homo sapiens
atctgaccctatgggtctagg

SEQ ID NO: 1543448 - DNA, 16 bp, Homo sapiens
atctgactgccaaata

SEQ ID NO: 1543449 - DNA, 16 bp, Homo sapiens
atctgactgccaagcc

SEQ ID NO: 1543450 - DNA, 17 bp, Homo sapiens
atctgactgccaagcca

SEQ ID NO: 1543451 - DNA, 18 bp, Homo sapiens
atctgactgccaagccag

SEQ ID NO: 1543452 - DNA, 23 bp, Homo sapiens
atctgagaaacctgttgaagatt

SEQ ID NO: 1543453 - DNA, 21 bp, Homo sapiens
atctgagaaactctacatgta

SEQ ID NO: 1543454 - DNA, 20 bp, Homo sapiens
atctgagaacacgttgccag

SEQ ID NO: 1543455 - DNA, 17 bp, Homo sapiens
atctgagagacctgtgt

SEQ ID NO: 1543456 - DNA, 20 bp, Homo sapiens
atctgagaggccacagtgca

SEQ ID NO: 1543457 - DNA, 21 bp, Homo sapiens
atctgagattgtgtttgttca

SEQ ID NO: 1543458 - DNA, 13 bp, Homo sapiens
atctgagcaagga

SEQ ID NO: 1543459 - DNA, 15 bp, Homo sapiens
atctgagccagtgct

SEQ ID NO: 1543460 - DNA, 23 bp, Homo sapiens
gcacgccctactccactgccctg

SEQ ID NO: 1543461 - DNA, 14 bp, Homo sapiens
gcacgcctgcaggc

SEQ ID NO: 1543462 - DNA, 19 bp, Homo sapiens
gcacgcctgcaggctggag

SEQ ID NO: 1543463 - DNA, 19 bp, Homo sapiens
gcacggcgggatcctccac

SEQ ID NO: 1543464 - DNA, 19 bp, Homo sapiens
gcacgggcatgcacacggc

SEQ ID NO: 1543465 - DNA, 13 bp, Homo sapiens
gcacgggtggtcc

SEQ ID NO: 1543466 - DNA, 15 bp, Homo sapiens
gcacgggtggtcccc

SEQ ID NO: 1543467 - DNA, 16 bp, Homo sapiens
atctgatggtgagctg

SEQ ID NO: 1543468 - DNA, 14 bp, Homo sapiens
atctgattgcactg

SEQ ID NO: 1543469 - DNA, 19 bp, Homo sapiens
atctgattggacattttct

SEQ ID NO: 1543470 - DNA, 17 bp, Homo sapiens
atctgcaccccttctct

SEQ ID NO: 1543471 - DNA, 22 bp, Homo sapiens
atctgcaccccttctctcctcc

SEQ ID NO: 1543472 - DNA, 18 bp, Homo sapiens
atctgcagatatgttgag

SEQ ID NO: 1543473 - DNA, 11 bp, Homo sapiens
atctgcatgtg

SEQ ID NO: 1543474 - DNA, 22 bp, Homo sapiens
atctgcattttcaccccaccct

SEQ ID NO: 1543475 - DNA, 23 bp, Homo sapiens
atctgcccaggggtgccccctcc

SEQ ID NO: 1543476 - DNA, 11 bp, Homo sapiens
atctgcccctc

SEQ ID NO: 1543477 - DNA, 12 bp, Homo sapiens
atctgcccctcc

SEQ ID NO: 1543478 - DNA, 16 bp, Homo sapiens
atctgcccctccccca

SEQ ID NO: 1543479 - DNA, 16 bp, Homo sapiens
atctgccgcctcagct

SEQ ID NO: 1543480 - DNA, 14 bp, Homo sapiens
atctgcctcccctg

SEQ ID NO: 1543481 - DNA, 12 bp, Homo sapiens
atctgcctgggc

SEQ ID NO: 1543482 - DNA, 13 bp, Homo sapiens
atctgcctgggcc

SEQ ID NO: 1543483 - DNA, 18 bp, Homo sapiens
atctgcctgggcctgtgc

SEQ ID NO: 1543484 - DNA, 18 bp, Homo sapiens
atctgcctgtggccttgc

SEQ ID NO: 1543485 - DNA, 20 bp, Homo sapiens
atctgcgtgcacttcccaga

SEQ ID NO: 1543486 - DNA, 18 bp, Homo sapiens
atctgctaccaaaacagt

SEQ ID NO: 1543487 - DNA, 20 bp, Homo sapiens
atctgctagggaatatcaat

SEQ ID NO: 1543488 - DNA, 14 bp, Homo sapiens
atctgctagtgctg

SEQ ID NO: 1543489 - DNA, 20 bp, Homo sapiens
atctgctagtgctgtaatat

SEQ ID NO: 1543490 - DNA, 13 bp, Homo sapiens
atctgctcctccc

SEQ ID NO: 1543491 - DNA, 19 bp, Homo sapiens
atctgctctagattcataa

SEQ ID NO: 1543492 - DNA, 23 bp, Homo sapiens
atctgctctagattcataaatac

SEQ ID NO: 1543493 - DNA, 13 bp, Homo sapiens
atctgctctcctt

SEQ ID NO: 1543494 - DNA, 20 bp, Homo sapiens
atctgctctccttcctggag

SEQ ID NO: 1543495 - DNA, 13 bp, Homo sapiens
atctgctgaggcc

SEQ ID NO: 1543496 - DNA, 13 bp, Homo sapiens
atctgctgcacct

SEQ ID NO: 1543497 - DNA, 12 bp, Homo sapiens
atctgctgcccc

SEQ ID NO: 1543498 - DNA, 15 bp, Homo sapiens
atctgctgttgccat

SEQ ID NO: 1543499 - DNA, 17 bp, Homo sapiens
atctgctgttgccatag

SEQ ID NO: 1543500 - DNA, 13 bp, Homo sapiens
atctgctttagtt

SEQ ID NO: 1543501 - DNA, 14 bp, Homo sapiens
atctggaacccaga

SEQ ID NO: 1543502 - DNA, 17 bp, Homo sapiens
atctggaacctcagcct

SEQ ID NO: 1543503 - DNA, 18 bp, Homo sapiens
atctggaacctcagcctg

SEQ ID NO: 1543504 - DNA, 22 bp, Homo sapiens
atctggaacctcagcctggcca

SEQ ID NO: 1543505 - DNA, 19 bp, Homo sapiens
atctggacttcctataata

SEQ ID NO: 1543506 - DNA, 15 bp, Homo sapiens
atctggagcctgatg

SEQ ID NO: 1543507 - DNA, 22 bp, Homo sapiens
atctggaggccttccagctgct

SEQ ID NO: 1543508 - DNA, 12 bp, Homo sapiens
atctggatgtaa

SEQ ID NO: 1543509 - DNA, 17 bp, Homo sapiens
atctggatgtaaatcct

SEQ ID NO: 1543510 - DNA, 16 bp, Homo sapiens
atctggcaacatcttt

SEQ ID NO: 1543511 - DNA, 16 bp, Homo sapiens
atctggcacactccct

SEQ ID NO: 1543512 - DNA, 15 bp, Homo sapiens
atctggcccagggtg

SEQ ID NO: 1543513 - DNA, 16 bp, Homo sapiens
atctggcccagggtgt

SEQ ID NO: 1543514 - DNA, 12 bp, Homo sapiens
atctggccctga

SEQ ID NO: 1543515 - DNA, 14 bp, Homo sapiens
atctggcgttcttt

SEQ ID NO: 1543516 - DNA, 16 bp, Homo sapiens
atctggcttagtgcca

SEQ ID NO: 1543517 - DNA, 15 bp, Homo sapiens
atctggcttccctgg

SEQ ID NO: 1543518 - DNA, 17 bp, Homo sapiens
atctggcttccctggaa

SEQ ID NO: 1543519 - DNA, 19 bp, Homo sapiens
atctggcttccctggaagc

SEQ ID NO: 1543520 - DNA, 17 bp, Homo sapiens
atctggctttttctgcc

SEQ ID NO: 1543521 - DNA, 20 bp, Homo sapiens
atctgggaccctttccttcc

SEQ ID NO: 1543522 - DNA, 20 bp, Homo sapiens
atctgggagtccccttttct

SEQ ID NO: 1543523 - DNA, 14 bp, Homo sapiens
atctgggccagaag

SEQ ID NO: 1543524 - DNA, 21 bp, Homo sapiens
atctgggcttatatgtacttt

SEQ ID NO: 1543525 - DNA, 22 bp, Homo sapiens
atctggggaggcaggcattcct

SEQ ID NO: 1543526 - DNA, 23 bp, Homo sapiens
atctggggaggcaggcattcctg

SEQ ID NO: 1543527 - DNA, 15 bp, Homo sapiens
atctgggtatctttc

SEQ ID NO: 1543528 - DNA, 13 bp, Homo sapiens
atctgggtgccct

SEQ ID NO: 1543529 - DNA, 20 bp, Homo sapiens
atctggtagggggaaaatgt

SEQ ID NO: 1543530 - DNA, 20 bp, Homo sapiens
atctggtgacaaatattctc

SEQ ID NO: 1543531 - DNA, 20 bp, Homo sapiens
atctgtaagagcttgctcca

SEQ ID NO: 1543532 - DNA, 16 bp, Homo sapiens
atctgtacctctgcct

SEQ ID NO: 1543533 - DNA, 13 bp, Homo sapiens
atctgtagtaatt

SEQ ID NO: 1543534 - DNA, 22 bp, Homo sapiens
atctgtagtaatttattgtctg

SEQ ID NO: 1543535 - DNA, 19 bp, Homo sapiens
atctgtatataaaatattt

SEQ ID NO: 1543536 - DNA, 15 bp, Homo sapiens
atctgtatttaattt

SEQ ID NO: 1543537 - DNA, 19 bp, Homo sapiens
atctgtccaaaggaggctg

SEQ ID NO: 1543538 - DNA, 23 bp, Homo sapiens
atctgtccaaaggaggctggcag

SEQ ID NO: 1543539 - DNA, 21 bp, Homo sapiens
atctgtccacatccccagagc

SEQ ID NO: 1543540 - DNA, 14 bp, Homo sapiens
atctgtcctcagcc

SEQ ID NO: 1543541 - DNA, 16 bp, Homo sapiens
atctgtcctcagcctt

SEQ ID NO: 1543542 - DNA, 17 bp, Homo sapiens
atctgtcctcagccttg

SEQ ID NO: 1543543 - DNA, 14 bp, Homo sapiens
atctgtcctctgta

SEQ ID NO: 1543544 - DNA, 17 bp, Homo sapiens
atctgtcctctgtagta

SEQ ID NO: 1543545 - DNA, 13 bp, Homo sapiens
atctgtctgattc

SEQ ID NO: 1543546 - DNA, 23 bp, Homo sapiens
atctgtctgccaacctaaaactc

SEQ ID NO: 1543547 - DNA, 21 bp, Homo sapiens
atctgtgaaatgctggcattt

SEQ ID NO: 1543548 - DNA, 20 bp, Homo sapiens
atctgtgaagaaagaggtta

SEQ ID NO: 1543549 - DNA, 15 bp, Homo sapiens
atctgtgactataaa

SEQ ID NO: 1543550 - DNA, 21 bp, Homo sapiens
atctgtgactataaagctgtt

SEQ ID NO: 1543551 - DNA, 15 bp, Homo sapiens
atctgtgccccatgc

SEQ ID NO: 1543552 - DNA, 21 bp, Homo sapiens
atctgtgcctgcactgagagg

SEQ ID NO: 1543553 - DNA, 19 bp, Homo sapiens
atctgtggagctgccacag

SEQ ID NO: 1543554 - DNA, 14 bp, Homo sapiens
atctgtggagttcc

SEQ ID NO: 1543555 - DNA, 19 bp, Homo sapiens
atctgtggagttcctgctc

SEQ ID NO: 1543556 - DNA, 22 bp, Homo sapiens
atctgtgggcatggtcaaaggc

SEQ ID NO: 1543557 - DNA, 23 bp, Homo sapiens
atctgtgggtctgggagtcacac

SEQ ID NO: 1543558 - DNA, 15 bp, Homo sapiens
atctgtgtggctcct

SEQ ID NO: 1543559 - DNA, 19 bp, Homo sapiens
atctgtgtggctcctgggc

SEQ ID NO: 1543560 - DNA, 18 bp, Homo sapiens
atctgtgtttttgaaata

SEQ ID NO: 1543561 - DNA, 13 bp, Homo sapiens
atctgttgaaaag

SEQ ID NO: 1543562 - DNA, 14 bp, Homo sapiens
atctgttggagaaa

SEQ ID NO: 1543563 - DNA, 16 bp, Homo sapiens
atctgtttcaaactga

SEQ ID NO: 1543564 - DNA, 22 bp, Homo sapiens
atctgtttcaaactgaatttgt

SEQ ID NO: 1543565 - DNA, 15 bp, Homo sapiens
atctgtttctctgct

SEQ ID NO: 1543566 - DNA, 19 bp, Homo sapiens
atctgtttctctgctgtca

SEQ ID NO: 1543567 - DNA, 15 bp, Homo sapiens
atctgtttgaggaga

SEQ ID NO: 1543568 - DNA, 21 bp, Homo sapiens
atctgttttctacctcctcct

SEQ ID NO: 1543569 - DNA, 16 bp, Homo sapiens
atctgttttctggaag

SEQ ID NO: 1543570 - DNA, 18 bp, Homo sapiens
atctgtttttacgtatgt

SEQ ID NO: 1543571 - DNA, 14 bp, Homo sapiens
atctgtttttctca

SEQ ID NO: 1543572 - DNA, 23 bp, Homo sapiens
atcttaaacaatgtataaagatt

SEQ ID NO: 1543573 - DNA, 19 bp, Homo sapiens
atcttaaaccttaagatac

SEQ ID NO: 1543574 - DNA, 12 bp, Homo sapiens
atcttaaactaa

SEQ ID NO: 1543575 - DNA, 17 bp, Homo sapiens
atcttaaactaatacgt

SEQ ID NO: 1543576 - DNA, 20 bp, Homo sapiens
atcttaaagaaacagctttc

SEQ ID NO: 1543577 - DNA, 17 bp, Homo sapiens
atcttaaattcatttct

SEQ ID NO: 1543578 - DNA, 20 bp, Homo sapiens
atcttaaattcatttctaga

SEQ ID NO: 1543579 - DNA, 21 bp, Homo sapiens
gcactttgggaggctgaggtg

SEQ ID NO: 1543580 - DNA, 16 bp, Homo sapiens
gcactttttaattcac

SEQ ID NO: 1543581 - DNA, 15 bp, Homo sapiens
gcacttttttaaata

SEQ ID NO: 1543582 - DNA, 22 bp, Homo sapiens
atcttaatactgttattctttg

SEQ ID NO: 1543583 - DNA, 13 bp, Homo sapiens
atcttaatatata

SEQ ID NO: 1543584 - DNA, 15 bp, Homo sapiens
atcttaatttattat

SEQ ID NO: 1543585 - DNA, 18 bp, Homo sapiens
atcttagatgtttcacac

SEQ ID NO: 1543586 - DNA, 13 bp, Homo sapiens
atcttagattctc

SEQ ID NO: 1543587 - DNA, 20 bp, Homo sapiens
atcttagattctctgtgtct

SEQ ID NO: 1543588 - DNA, 22 bp, Homo sapiens
atcttagattctctgtgtctaa

SEQ ID NO: 1543589 - DNA, 14 bp, Homo sapiens
atcttagcttttaa

SEQ ID NO: 1543590 - DNA, 20 bp, Homo sapiens
atcttaggggagagctttct

SEQ ID NO: 1543591 - DNA, 21 bp, Homo sapiens
atcttagtgcctgagagtatt

SEQ ID NO: 1543592 - DNA, 14 bp, Homo sapiens
atcttagtgtatga

SEQ ID NO: 1543593 - DNA, 16 bp, Homo sapiens
atcttagtgtatgatt

SEQ ID NO: 1543594 - DNA, 14 bp, Homo sapiens
atcttataattgtt

SEQ ID NO: 1543595 - DNA, 16 bp, Homo sapiens
atcttataattgttct

SEQ ID NO: 1543596 - DNA, 14 bp, Homo sapiens
atcttatctcagat

SEQ ID NO: 1543597 - DNA, 13 bp, Homo sapiens
atcttattcacat

SEQ ID NO: 1543598 - DNA, 15 bp, Homo sapiens
atcttcaaagccttc

SEQ ID NO: 1543599 - DNA, 23 bp, Homo sapiens
atcttcacgacaatgttgagaag

SEQ ID NO: 1543600 - DNA, 22 bp, Homo sapiens
atcttcactgcaattttgtgta

SEQ ID NO: 1543601 - DNA, 14 bp, Homo sapiens
atcttcagcccagg

SEQ ID NO: 1543602 - DNA, 23 bp, Homo sapiens
atcttcagcccaggcttttgcta

SEQ ID NO: 1543603 - DNA, 14 bp, Homo sapiens
atcttcatgatgtg

SEQ ID NO: 1543604 - DNA, 20 bp, Homo sapiens
atcttccacctgtgccctca

SEQ ID NO: 1543605 - DNA, 20 bp, Homo sapiens
atcttcccagcagggccact

SEQ ID NO: 1543606 - DNA, 23 bp, Homo sapiens
atcttcccagcagggccactccc

SEQ ID NO: 1543607 - DNA, 22 bp, Homo sapiens
atcttccgtggtcagagtgcca

SEQ ID NO: 1543608 - DNA, 23 bp, Homo sapiens
atcttccgtggtcagagtgccac

SEQ ID NO: 1543609 - DNA, 13 bp, Homo sapiens
atcttcctgctgc

SEQ ID NO: 1543610 - DNA, 15 bp, Homo sapiens
atcttcctgctgctg

SEQ ID NO: 1543611 - DNA, 18 bp, Homo sapiens
atcttcgacagctgggct

SEQ ID NO: 1543612 - DNA, 13 bp, Homo sapiens
atcttctaaatgg

SEQ ID NO: 1543613 - DNA, 19 bp, Homo sapiens
atcttctacttttaactaa

SEQ ID NO: 1543614 - DNA, 23 bp, Homo sapiens
atcttctatttttatcatgaatt

SEQ ID NO: 1543615 - DNA, 18 bp, Homo sapiens
atcttctcaagttctaag

SEQ ID NO: 1543616 - DNA, 15 bp, Homo sapiens
atcttctccatctgg

SEQ ID NO: 1543617 - DNA, 17 bp, Homo sapiens
atcttctccccgaggct

SEQ ID NO: 1543618 - DNA, 20 bp, Homo sapiens
atcttctccccgaggctgcc

SEQ ID NO: 1543619 - DNA, 21 bp, Homo sapiens
atcttctccccgaggctgccc

SEQ ID NO: 1543620 - DNA, 14 bp, Homo sapiens
atcttctgaagagg

SEQ ID NO: 1543621 - DNA, 12 bp, Homo sapiens
atcttctggaat

SEQ ID NO: 1543622 - DNA, 15 bp, Homo sapiens
atcttctggaatatt

SEQ ID NO: 1543623 - DNA, 20 bp, Homo sapiens
atcttctggagaaaaaggtg

SEQ ID NO: 1543624 - DNA, 23 bp, Homo sapiens
atcttcttcccttaactccaaga

SEQ ID NO: 1543625 - DNA, 14 bp, Homo sapiens
atcttctttcctca

SEQ ID NO: 1543626 - DNA, 18 bp, Homo sapiens
atcttgaaatcctggaaa

SEQ ID NO: 1543627 - DNA, 17 bp, Homo sapiens
atcttgaaggaaaaatt

SEQ ID NO: 1543628 - DNA, 11 bp, Homo sapiens
atcttgaagtc

SEQ ID NO: 1543629 - DNA, 15 bp, Homo sapiens
atcttgactttctga

SEQ ID NO: 1543630 - DNA, 23 bp, Homo sapiens
atcttgactttctgattggtgat

SEQ ID NO: 1543631 - DNA, 19 bp, Homo sapiens
atcttgcagcatttactat

SEQ ID NO: 1543632 - DNA, 16 bp, Homo sapiens
atcttgcctgtctggc

SEQ ID NO: 1543633 - DNA, 14 bp, Homo sapiens
atcttgctaccagt

SEQ ID NO: 1543634 - DNA, 19 bp, Homo sapiens
atcttgctaccagtattta

SEQ ID NO: 1543635 - DNA, 13 bp, Homo sapiens
atcttgctctgct

SEQ ID NO: 1543636 - DNA, 21 bp, Homo sapiens
atcttgctggattaatgtttt

SEQ ID NO: 1543637 - DNA, 16 bp, Homo sapiens
atcttgcttcattgtt

SEQ ID NO: 1543638 - DNA, 19 bp, Homo sapiens
atcttgctttctttagaat

SEQ ID NO: 1543639 - DNA, 16 bp, Homo sapiens
atcttggactgacatt

SEQ ID NO: 1543640 - DNA, 22 bp, Homo sapiens
atcttggctgtttcaaaaaaat

SEQ ID NO: 1543641 - DNA, 18 bp, Homo sapiens
atcttgggactgggtttg

SEQ ID NO: 1543642 - DNA, 23 bp, Homo sapiens
atcttgggggggtggccgctgag

SEQ ID NO: 1543643 - DNA, 14 bp, Homo sapiens
atcttgggtttcta

SEQ ID NO: 1543644 - DNA, 22 bp, Homo sapiens
atcttggtactactagatgtct

SEQ ID NO: 1543645 - DNA, 19 bp, Homo sapiens
atcttggtagttctgtgcc

SEQ ID NO: 1543646 - DNA, 21 bp, Homo sapiens
atcttggtttgtcagtttatc

SEQ ID NO: 1543647 - DNA, 16 bp, Homo sapiens
atcttgtatacacata

SEQ ID NO: 1543648 - DNA, 12 bp, Homo sapiens
atcttgtcatgt

SEQ ID NO: 1543649 - DNA, 14 bp, Homo sapiens
atcttgtcatgtgt

SEQ ID NO: 1543650 - DNA, 16 bp, Homo sapiens
atcttgtcatgtgtat

SEQ ID NO: 1543651 - DNA, 17 bp, Homo sapiens
atcttgtcatgtgtata

SEQ ID NO: 1543652 - DNA, 18 bp, Homo sapiens
atcttgtgctagaatact

SEQ ID NO: 1543653 - DNA, 20 bp, Homo sapiens
atcttgtgctagaatacttt

SEQ ID NO: 1543654 - DNA, 14 bp, Homo sapiens
atcttgtggggcca

SEQ ID NO: 1543655 - DNA, 16 bp, Homo sapiens
atcttgtggggccagg

SEQ ID NO: 1543656 - DNA, 18 bp, Homo sapiens
atcttgttaatgtcattg

SEQ ID NO: 1543657 - DNA, 22 bp, Homo sapiens
atcttgttaatgtcattgctaa

SEQ ID NO: 1543658 - DNA, 20 bp, Homo sapiens
atcttgttactgctgattct

SEQ ID NO: 1543659 - DNA, 15 bp, Homo sapiens
atcttgttactgtga

SEQ ID NO: 1543660 - DNA, 14 bp, Homo sapiens
atcttgttcaggaa

SEQ ID NO: 1543661 - DNA, 23 bp, Homo sapiens
atcttgtttttccactactgcta

SEQ ID NO: 1543662 - DNA, 12 bp, Homo sapiens
atctttaacata

SEQ ID NO: 1543663 - DNA, 23 bp, Homo sapiens
atctttaacatagtcctgttact

SEQ ID NO: 1543664 - DNA, 13 bp, Homo sapiens
atctttaattaaa

SEQ ID NO: 1543665 - DNA, 18 bp, Homo sapiens
atctttaccaaaaaccat

SEQ ID NO: 1543666 - DNA, 22 bp, Homo sapiens
atctttatagaaggaatttgta

SEQ ID NO: 1543667 - DNA, 13 bp, Homo sapiens
atctttatgctgt

SEQ ID NO: 1543668 - DNA, 14 bp, Homo sapiens
atctttatgctgta

SEQ ID NO: 1543669 - DNA, 15 bp, Homo sapiens
atctttattgaaatt

SEQ ID NO: 1543670 - DNA, 13 bp, Homo sapiens
atctttcctcaag

SEQ ID NO: 1543671 - DNA, 23 bp, Homo sapiens
atctttcctcaagtatcttctat

SEQ ID NO: 1543672 - DNA, 12 bp, Homo sapiens
atctttctctta

SEQ ID NO: 1543673 - DNA, 14 bp, Homo sapiens
atctttctcttccc

SEQ ID NO: 1543674 - DNA, 13 bp, Homo sapiens
atctttcttgatc

SEQ ID NO: 1543675 - DNA, 14 bp, Homo sapiens
atctttctttacct

SEQ ID NO: 1543676 - DNA, 21 bp, Homo sapiens
atctttctttacctgagacca

SEQ ID NO: 1543677 - DNA, 22 bp, Homo sapiens
atctttctttacctgagaccag

SEQ ID NO: 1543678 - DNA, 22 bp, Homo sapiens
atctttctttccaaaacatttc

SEQ ID NO: 1543679 - DNA, 17 bp, Homo sapiens
atctttgactgaaaaaa

SEQ ID NO: 1543680 - DNA, 14 bp, Homo sapiens
atctttgattctcc

SEQ ID NO: 1543681 - DNA, 15 bp, Homo sapiens
atctttgattctcct

SEQ ID NO: 1543682 - DNA, 14 bp, Homo sapiens
atctttgcgaaaag

SEQ ID NO: 1543683 - DNA, 19 bp, Homo sapiens
atctttgtaccaaaatttt

SEQ ID NO: 1543684 - DNA, 23 bp, Homo sapiens
atctttgtataaataaatatttt

SEQ ID NO: 1543685 - DNA, 17 bp, Homo sapiens
atctttgttacttcctt

SEQ ID NO: 1543686 - DNA, 19 bp, Homo sapiens
atctttgttacttccttat

SEQ ID NO: 1543687 - DNA, 14 bp, Homo sapiens
atcttttaaaatca

SEQ ID NO: 1543688 - DNA, 20 bp, Homo sapiens
atcttttaaagtgttacttt

SEQ ID NO: 1543689 - DNA, 11 bp, Homo sapiens
atcttttacat

SEQ ID NO: 1543690 - DNA, 21 bp, Homo sapiens
atcttttctaatcacagtgtt

SEQ ID NO: 1543691 - DNA, 14 bp, Homo sapiens
atcttttcttgcct

SEQ ID NO: 1543692 - DNA, 13 bp, Homo sapiens
atcttttgaattc

SEQ ID NO: 1543693 - DNA, 23 bp, Homo sapiens
atcttttgatatgcatatttgtt

SEQ ID NO: 1543694 - DNA, 14 bp, Homo sapiens
atcttttgtatatc

SEQ ID NO: 1543695 - DNA, 14 bp, Homo sapiens
atctttttatattc

SEQ ID NO: 1543696 - DNA, 18 bp, Homo sapiens
atctttttgaaagcaata

SEQ ID NO: 1543697 - DNA, 13 bp, Homo sapiens
gcagcctggctcc

SEQ ID NO: 1543698 - DNA, 21 bp, Homo sapiens
gcagcctggctcccaggacac

SEQ ID NO: 1543699 - DNA, 19 bp, Homo sapiens
gagcagagggcaggggtgc

SEQ ID NO: 1543700 - DNA, 17 bp, Homo sapiens
gagcagatgccattttg

SEQ ID NO: 1543701 - DNA, 14 bp, Homo sapiens
gagcagcagcacca

SEQ ID NO: 1543702 - DNA, 22 bp, Homo sapiens
gagcagcagcaccaaccacagc

SEQ ID NO: 1543703 - DNA, 14 bp, Homo sapiens
gagcagcagccagc

SEQ ID NO: 1543704 - DNA, 12 bp, Homo sapiens
gagcagcaggtg

SEQ ID NO: 1543705 - DNA, 13 bp, Homo sapiens
gagcagcaggtgc

SEQ ID NO: 1543706 - DNA, 16 bp, Homo sapiens
agtgtatgtcttgtat

SEQ ID NO: 1543707 - DNA, 12 bp, Homo sapiens
agtgtatttatt

SEQ ID NO: 1543708 - DNA, 20 bp, Homo sapiens
agtgtcaagttgtgcttgtt

SEQ ID NO: 1543709 - DNA, 17 bp, Homo sapiens
agtgtcactgagctgtg

SEQ ID NO: 1543710 - DNA, 15 bp, Homo sapiens
agtgtcataaagatt

SEQ ID NO: 1543711 - DNA, 20 bp, Homo sapiens
agtgtcatataaactcattt

SEQ ID NO: 1543712 - DNA, 20 bp, Homo sapiens
agtgtcatcagaagataact

SEQ ID NO: 1543713 - DNA, 19 bp, Homo sapiens
agtgtcattcccctttgca

SEQ ID NO: 1543714 - DNA, 21 bp, Homo sapiens
agtgtcattcccctttgcact

SEQ ID NO: 1543715 - DNA, 19 bp, Homo sapiens
agtgtcatttatgaaaaga

SEQ ID NO: 1543716 - DNA, 14 bp, Homo sapiens
agtgtccagcttcc

SEQ ID NO: 1543717 - DNA, 17 bp, Homo sapiens
agtgtccagcttccaaa

SEQ ID NO: 1543718 - DNA, 14 bp, Homo sapiens
agtgtcccccaggt

SEQ ID NO: 1543719 - DNA, 15 bp, Homo sapiens
agtgtcccctgcccc

SEQ ID NO: 1543720 - DNA, 18 bp, Homo sapiens
agtgtcctgcccatgccc

SEQ ID NO: 1543721 - DNA, 17 bp, Homo sapiens
agtgtccttcttgctcc

SEQ ID NO: 1543722 - DNA, 17 bp, Homo sapiens
agtgtcggatcctgtga

SEQ ID NO: 1543723 - DNA, 16 bp, Homo sapiens
agtgtctattatcaca

SEQ ID NO: 1543724 - DNA, 23 bp, Homo sapiens
agtgtctcaaaggagctttctca

SEQ ID NO: 1543725 - DNA, 13 bp, Homo sapiens
agtgtctccacct

SEQ ID NO: 1543726 - DNA, 17 bp, Homo sapiens
agtgtctccccgtgtcc

SEQ ID NO: 1543727 - DNA, 19 bp, Homo sapiens
agtgtctgccagctgggcc

SEQ ID NO: 1543728 - DNA, 22 bp, Homo sapiens
agtgtctgtatcggagacagtg

SEQ ID NO: 1543729 - DNA, 16 bp, Homo sapiens
agtgtctgttcagcaa

SEQ ID NO: 1543730 - DNA, 21 bp, Homo sapiens
agtgtcttaattaaaagaata

SEQ ID NO: 1543731 - DNA, 14 bp, Homo sapiens
agtgtcttccataa

SEQ ID NO: 1543732 - DNA, 15 bp, Homo sapiens
agtgtcttccataat

SEQ ID NO: 1543733 - DNA, 16 bp, Homo sapiens
agtgtgaaatatatta

SEQ ID NO: 1543734 - DNA, 22 bp, Homo sapiens
agtgtgaacaaaagatgctctt

SEQ ID NO: 1543735 - DNA, 14 bp, Homo sapiens
agtgtgaatattaa

SEQ ID NO: 1543736 - DNA, 20 bp, Homo sapiens
agtgtgaattgcaaaaccca

SEQ ID NO: 1543737 - DNA, 14 bp, Homo sapiens
agtgtgaccaggca

SEQ ID NO: 1543738 - DNA, 12 bp, Homo sapiens
agtgtgagaatc

SEQ ID NO: 1543739 - DNA, 13 bp, Homo sapiens
agtgtgagctctt

SEQ ID NO: 1543740 - DNA, 19 bp, Homo sapiens
agtgtgaggacctccctgt

SEQ ID NO: 1543741 - DNA, 21 bp, Homo sapiens
agtgtgaggacctccctgtct

SEQ ID NO: 1543742 - DNA, 17 bp, Homo sapiens
agtgtgagtaagagctg

SEQ ID NO: 1543743 - DNA, 19 bp, Homo sapiens
agtgtgagtaagagctggt

SEQ ID NO: 1543744 - DNA, 14 bp, Homo sapiens
agtgtgagtggcag

SEQ ID NO: 1543745 - DNA, 16 bp, Homo sapiens
agtgtgatccagttgt

SEQ ID NO: 1543746 - DNA, 19 bp, Homo sapiens
agtgtgatttgaattctgt

SEQ ID NO: 1543747 - DNA, 19 bp, Homo sapiens
agtgtgcacccctccccat

SEQ ID NO: 1543748 - DNA, 17 bp, Homo sapiens
agtgtgcacgcctgcag

SEQ ID NO: 1543749 - DNA, 23 bp, Homo sapiens
agtgtgctctccccggcaggcct

SEQ ID NO: 1543750 - DNA, 22 bp, Homo sapiens
agtgtggagtgggtaatccagg

SEQ ID NO: 1543751 - DNA, 15 bp, Homo sapiens
agtgtgggaagggag

SEQ ID NO: 1543752 - DNA, 13 bp, Homo sapiens
agtgtgggctgcc

SEQ ID NO: 1543753 - DNA, 15 bp, Homo sapiens
agtgtggggggtcct

SEQ ID NO: 1543754 - DNA, 23 bp, Homo sapiens
agtgtgggtttggttagaggaag

SEQ ID NO: 1543755 - DNA, 22 bp, Homo sapiens
agtgtggttatgaactttatag

SEQ ID NO: 1543756 - DNA, 9 bp, Homo sapiens
agtgtgtaa

SEQ ID NO: 1543757 - DNA, 11 bp, Homo sapiens
agtgtgtaaag

SEQ ID NO: 1543758 - DNA, 16 bp, Homo sapiens
agtgtgtatgccaaga

SEQ ID NO: 1543759 - DNA, 15 bp, Homo sapiens
agtgtgtctgctgag

SEQ ID NO: 1543760 - DNA, 13 bp, Homo sapiens
agtgtgtcttcct

SEQ ID NO: 1543761 - DNA, 17 bp, Homo sapiens
agtgtgtgggcagggtt

SEQ ID NO: 1543762 - DNA, 16 bp, Homo sapiens
agtgtgtgtaagattt

SEQ ID NO: 1543763 - DNA, 11 bp, Homo sapiens
agtgtgtgtct

SEQ ID NO: 1543764 - DNA, 14 bp, Homo sapiens
agtgtgtgtctttc

SEQ ID NO: 1543765 - DNA, 14 bp, Homo sapiens
agtgtgtgtgcaga

SEQ ID NO: 1543766 - DNA, 19 bp, Homo sapiens
agtgtgtgtgcatgtgtgt

SEQ ID NO: 1543767 - DNA, 20 bp, Homo sapiens
agtgtgtgtgcatgtgtgtg

SEQ ID NO: 1543768 - DNA, 18 bp, Homo sapiens
agtgtgtttaaataaaca

SEQ ID NO: 1543769 - DNA, 17 bp, Homo sapiens
agtgttactttttgtaa

SEQ ID NO: 1543770 - DNA, 14 bp, Homo sapiens
agtgttagagaaat

SEQ ID NO: 1543771 - DNA, 13 bp, Homo sapiens
agtgttagtgctg

SEQ ID NO: 1543772 - DNA, 23 bp, Homo sapiens
agtgttagtgctggtcagagaga

SEQ ID NO: 1543773 - DNA, 16 bp, Homo sapiens
agtgttcacaaactgt

SEQ ID NO: 1543774 - DNA, 19 bp, Homo sapiens
agtgttcacaaactgtgaa

SEQ ID NO: 1543775 - DNA, 19 bp, Homo sapiens
agtgttcctttttaaatgt

SEQ ID NO: 1543776 - DNA, 21 bp, Homo sapiens
agtgttcctttttaaatgtga

SEQ ID NO: 1543777 - DNA, 14 bp, Homo sapiens
agtgttctcatgaa

SEQ ID NO: 1543778 - DNA, 23 bp, Homo sapiens
agtgttctgcatggattcagcat

SEQ ID NO: 1543779 - DNA, 22 bp, Homo sapiens
agtgttctgctcctgcttttct

SEQ ID NO: 1543780 - DNA, 12 bp, Homo sapiens
agtgttctgtgc

SEQ ID NO: 1543781 - DNA, 13 bp, Homo sapiens
agtgttcttaggt

SEQ ID NO: 1543782 - DNA, 19 bp, Homo sapiens
agtgttgaagggaggtggc

SEQ ID NO: 1543783 - DNA, 14 bp, Homo sapiens
agtgttgctcttgg

SEQ ID NO: 1543784 - DNA, 18 bp, Homo sapiens
agtgttgctcttggaaag

SEQ ID NO: 1543785 - DNA, 14 bp, Homo sapiens
agtgttgtgcccct

SEQ ID NO: 1543786 - DNA, 20 bp, Homo sapiens
agtgttgtgccccttcactc

SEQ ID NO: 1543787 - DNA, 22 bp, Homo sapiens
agtgttgtgccccttcactcat

SEQ ID NO: 1543788 - DNA, 20 bp, Homo sapiens
agtgttgtgttaaaaggaaa

SEQ ID NO: 1543789 - DNA, 15 bp, Homo sapiens
agtgttgtgttcctg

SEQ ID NO: 1543790 - DNA, 18 bp, Homo sapiens
agtgttgtgttcctggct

SEQ ID NO: 1543791 - DNA, 14 bp, Homo sapiens
agtgttgtttgtaa

SEQ ID NO: 1543792 - DNA, 15 bp, Homo sapiens
agtgttgtttgtaaa

SEQ ID NO: 1543793 - DNA, 20 bp, Homo sapiens
agtgttgtttgtaaataaga

SEQ ID NO: 1543794 - DNA, 18 bp, Homo sapiens
agtgtttatagatcactg

SEQ ID NO: 1543795 - DNA, 20 bp, Homo sapiens
agtgtttatgtttaaaagaa

SEQ ID NO: 1543796 - DNA, 13 bp, Homo sapiens
agtgtttcctttt

SEQ ID NO: 1543797 - DNA, 17 bp, Homo sapiens
agtgtttctaataaact

SEQ ID NO: 1543798 - DNA, 14 bp, Homo sapiens
agtgtttctcaaaa

SEQ ID NO: 1543799 - DNA, 22 bp, Homo sapiens
agtgtttctcaaaagaggttac

SEQ ID NO: 1543800 - DNA, 18 bp, Homo sapiens
agtgtttggtgtattatc

SEQ ID NO: 1543801 - DNA, 22 bp, Homo sapiens
agtgttttattattatcgcttt

SEQ ID NO: 1543802 - DNA, 17 bp, Homo sapiens
agtgttttcattttaga

SEQ ID NO: 1543803 - DNA, 18 bp, Homo sapiens
agtgttttggactccatc

SEQ ID NO: 1543804 - DNA, 23 bp, Homo sapiens
agtgttttggactccatctctca

SEQ ID NO: 1543805 - DNA, 21 bp, Homo sapiens
agttaaaagactgcagctgct

SEQ ID NO: 1543806 - DNA, 13 bp, Homo sapiens
agttaaaatgttt

SEQ ID NO: 1543807 - DNA, 19 bp, Homo sapiens
agttaaaatgtttactgta

SEQ ID NO: 1543808 - DNA, 16 bp, Homo sapiens
agttaaactgtgaagc

SEQ ID NO: 1543809 - DNA, 12 bp, Homo sapiens
agttaaagccac

SEQ ID NO: 1543810 - DNA, 11 bp, Homo sapiens
agttaaataaa

SEQ ID NO: 1543811 - DNA, 12 bp, Homo sapiens
agttaaataaat

SEQ ID NO: 1543812 - DNA, 23 bp, Homo sapiens
agttaaatagagtatatgcactt

SEQ ID NO: 1543813 - DNA, 14 bp, Homo sapiens
agttaacaaggaat

SEQ ID NO: 1543814 - DNA, 17 bp, Homo sapiens
agttaacaatgatatat

SEQ ID NO: 1543815 - DNA, 20 bp, Homo sapiens
agttaacacaatgtgaattt

SEQ ID NO: 1543816 - DNA, 17 bp, Homo sapiens
agttaacacatcaaata

SEQ ID NO: 1543817 - DNA, 19 bp, Homo sapiens
agttaacaggcaaacattt

SEQ ID NO: 1543818 - DNA, 14 bp, Homo sapiens
agttaactgtgaaa

SEQ ID NO: 1543819 - DNA, 18 bp, Homo sapiens
agttaactgtgaaatacc

SEQ ID NO: 1543820 - DNA, 16 bp, Homo sapiens
agttaacttgaagaaa

SEQ ID NO: 1543821 - DNA, 17 bp, Homo sapiens
agttaacttgaagaaac

SEQ ID NO: 1543822 - DNA, 17 bp, Homo sapiens
agttaagacctggcagc

SEQ ID NO: 1543823 - DNA, 21 bp, Homo sapiens
gagcagccaaggccgccagcg

SEQ ID NO: 1543824 - DNA, 13 bp, Homo sapiens
gagcagccagagc

SEQ ID NO: 1543825 - DNA, 16 bp, Homo sapiens
gagcagccagagctgt

SEQ ID NO: 1543826 - DNA, 17 bp, Homo sapiens
gagcagcccagggccta

SEQ ID NO: 1543827 - DNA, 15 bp, Homo sapiens
gagcagccgccagct

SEQ ID NO: 1543828 - DNA, 17 bp, Homo sapiens
gagcagcctctgccagg

SEQ ID NO: 1543829 - DNA, 15 bp, Homo sapiens
gagcagcctgatggc

SEQ ID NO: 1543830 - DNA, 11 bp, Homo sapiens
gagcagcctgt

SEQ ID NO: 1543831 - DNA, 13 bp, Homo sapiens
gagcagcctgtgg

SEQ ID NO: 1543832 - DNA, 23 bp, Homo sapiens
gagcagcttccttctgggactgg

SEQ ID NO: 1543833 - DNA, 19 bp, Homo sapiens
gagcaggaaggacaggaag

SEQ ID NO: 1543834 - DNA, 19 bp, Homo sapiens
gagcaggactccaggccca

SEQ ID NO: 1543835 - DNA, 17 bp, Homo sapiens
gagcaggagcccctggg

SEQ ID NO: 1543836 - DNA, 17 bp, Homo sapiens
gagcaggaggcccctgg

SEQ ID NO: 1543837 - DNA, 17 bp, Homo sapiens
gagcaggccagcccgga

SEQ ID NO: 1543838 - DNA, 21 bp, Homo sapiens
gagcagggattaacctctgca

SEQ ID NO: 1543839 - DNA, 22 bp, Homo sapiens
gagcagggattaacctctgcac

SEQ ID NO: 1543840 - DNA, 20 bp, Homo sapiens
gagcagggccaaagcacagc

SEQ ID NO: 1543841 - DNA, 13 bp, Homo sapiens
gagcaggggcagg

SEQ ID NO: 1543842 - DNA, 12 bp, Homo sapiens
gagcagggtcca

SEQ ID NO: 1543843 - DNA, 15 bp, Homo sapiens
gagcagggtccacag

SEQ ID NO: 1543844 - DNA, 16 bp, Homo sapiens
gagcagggtccacagc

SEQ ID NO: 1543845 - DNA, 19 bp, Homo sapiens
gagcagggtccacagctgg

SEQ ID NO: 1543846 - DNA, 23 bp, Homo sapiens
gagcaggttccccaagggccctg

SEQ ID NO: 1543847 - DNA, 19 bp, Homo sapiens
gagcagtcacactgttact

SEQ ID NO: 1543848 - DNA, 20 bp, Homo sapiens
gagcagtcctgcctcagcct

SEQ ID NO: 1543849 - DNA, 11 bp, Homo sapiens
gagcagtgtct

SEQ ID NO: 1543850 - DNA, 12 bp, Homo sapiens
gagcagtgtctt

SEQ ID NO: 1543851 - DNA, 15 bp, Homo sapiens
gagcataatgctccc

SEQ ID NO: 1543852 - DNA, 16 bp, Homo sapiens
gagcatagtccaaaaa

SEQ ID NO: 1543853 - DNA, 22 bp, Homo sapiens
gagcatatttgccaataaagct

SEQ ID NO: 1543854 - DNA, 16 bp, Homo sapiens
gagcatctcaggaggg

SEQ ID NO: 1543855 - DNA, 18 bp, Homo sapiens
gagcatctcttgaggcca

SEQ ID NO: 1543856 - DNA, 20 bp, Homo sapiens
gagcatctcttgaggccagg

SEQ ID NO: 1543857 - DNA, 23 bp, Homo sapiens
gagcatctcttgaggccaggagt

SEQ ID NO: 1543858 - DNA, 17 bp, Homo sapiens
gagcatgacagcctgca

SEQ ID NO: 1543859 - DNA, 23 bp, Homo sapiens
gagcatgatgggaatagggagac

SEQ ID NO: 1543860 - DNA, 17 bp, Homo sapiens
gagcatgcacagctgct

SEQ ID NO: 1543861 - DNA, 18 bp, Homo sapiens
gagcatggaacacttcga

SEQ ID NO: 1543862 - DNA, 19 bp, Homo sapiens
gagcatggaacacttcgag

SEQ ID NO: 1543863 - DNA, 17 bp, Homo sapiens
gagcatgggcctggcca

SEQ ID NO: 1543864 - DNA, 17 bp, Homo sapiens
gagcatgggggctgcca

SEQ ID NO: 1543865 - DNA, 15 bp, Homo sapiens
gagcatgtcgtggac

SEQ ID NO: 1543866 - DNA, 19 bp, Homo sapiens
gagcatgtttcacagtggc

SEQ ID NO: 1543867 - DNA, 15 bp, Homo sapiens
gagcattggcccctg

SEQ ID NO: 1543868 - DNA, 23 bp, Homo sapiens
gagcatttccaacaccacagaca

SEQ ID NO: 1543869 - DNA, 20 bp, Homo sapiens
gagcattttgataccagaag

SEQ ID NO: 1543870 - DNA, 14 bp, Homo sapiens
gagccaacctggac

SEQ ID NO: 1543871 - DNA, 13 bp, Homo sapiens
gagccaagacgga

SEQ ID NO: 1543872 - DNA, 15 bp, Homo sapiens
gagccaagcactgct

SEQ ID NO: 1543873 - DNA, 23 bp, Homo sapiens
gagccaagggttcagagactcag

SEQ ID NO: 1543874 - DNA, 16 bp, Homo sapiens
gagccacaagctgcac

SEQ ID NO: 1543875 - DNA, 21 bp, Homo sapiens
gagccacaagctgcactgtga

SEQ ID NO: 1543876 - DNA, 18 bp, Homo sapiens
gagccacagaccacctgc

SEQ ID NO: 1543877 - DNA, 17 bp, Homo sapiens
gagccacagtcactgga

SEQ ID NO: 1543878 - DNA, 12 bp, Homo sapiens
gagccaccagtt

SEQ ID NO: 1543879 - DNA, 14 bp, Homo sapiens
gagccaccagttct

SEQ ID NO: 1543880 - DNA, 18 bp, Homo sapiens
gagccaccgcgcccagcc

SEQ ID NO: 1543881 - DNA, 14 bp, Homo sapiens
gagccaccgctgcc

SEQ ID NO: 1543882 - DNA, 16 bp, Homo sapiens
gagccaccgctgccag

SEQ ID NO: 1543883 - DNA, 14 bp, Homo sapiens
gagccacctgcaag

SEQ ID NO: 1543884 - DNA, 15 bp, Homo sapiens
gagccacctggatct

SEQ ID NO: 1543885 - DNA, 16 bp, Homo sapiens
gagccactcctgtccc

SEQ ID NO: 1543886 - DNA, 16 bp, Homo sapiens
gagccactgcactcca

SEQ ID NO: 1543887 - DNA, 15 bp, Homo sapiens
gagccacttctcccc

SEQ ID NO: 1543888 - DNA, 16 bp, Homo sapiens
gagccacttctcccca

SEQ ID NO: 1543889 - DNA, 20 bp, Homo sapiens
gagccactttcaagctgcac

SEQ ID NO: 1543890 - DNA, 21 bp, Homo sapiens
gagccactttcaagctgcact

SEQ ID NO: 1543891 - DNA, 16 bp, Homo sapiens
gagccagaattcacta

SEQ ID NO: 1543892 - DNA, 16 bp, Homo sapiens
gagccagagggagctg

SEQ ID NO: 1543893 - DNA, 19 bp, Homo sapiens
gagccagatgcaggacagg

SEQ ID NO: 1543894 - DNA, 20 bp, Homo sapiens
gagccagatgcaggacagga

SEQ ID NO: 1543895 - DNA, 21 bp, Homo sapiens
gagccagatgcaggacaggag

SEQ ID NO: 1543896 - DNA, 22 bp, Homo sapiens
gagccagatgcaggacaggagg

SEQ ID NO: 1543897 - DNA, 23 bp, Homo sapiens
gagccagatgcaggacaggaggc

SEQ ID NO: 1543898 - DNA, 16 bp, Homo sapiens
gagccagatgcctccc

SEQ ID NO: 1543899 - DNA, 14 bp, Homo sapiens
gagccagcagggct

SEQ ID NO: 1543900 - DNA, 14 bp, Homo sapiens
gagccagccctccc

SEQ ID NO: 1543901 - DNA, 21 bp, Homo sapiens
gagccagccctccctgtcctc

SEQ ID NO: 1543902 - DNA, 14 bp, Homo sapiens
gagccagcctggga

SEQ ID NO: 1543903 - DNA, 15 bp, Homo sapiens
gagccagcctgggac

SEQ ID NO: 1543904 - DNA, 12 bp, Homo sapiens
gagccagctgct

SEQ ID NO: 1543905 - DNA, 13 bp, Homo sapiens
gagccagctgctt

SEQ ID NO: 1543906 - DNA, 15 bp, Homo sapiens
gagccagctgctttt

SEQ ID NO: 1543907 - DNA, 10 bp, Homo sapiens
gagccaggag

SEQ ID NO: 1543908 - DNA, 14 bp, Homo sapiens
gagccaggagaagc

SEQ ID NO: 1543909 - DNA, 17 bp, Homo sapiens
gagccaggagaagctca

SEQ ID NO: 1543910 - DNA, 14 bp, Homo sapiens
gagccaggagtaag

SEQ ID NO: 1543911 - DNA, 20 bp, Homo sapiens
gagccagggaacagccccag

SEQ ID NO: 1543912 - DNA, 13 bp, Homo sapiens
gagccagggcaga

SEQ ID NO: 1543913 - DNA, 19 bp, Homo sapiens
gagccagggcagaggaatg

SEQ ID NO: 1543914 - DNA, 12 bp, Homo sapiens
gagccagggcct

SEQ ID NO: 1543915 - DNA, 19 bp, Homo sapiens
gagccagtctagttcctga

SEQ ID NO: 1543916 - DNA, 13 bp, Homo sapiens
gagccagtgatta

SEQ ID NO: 1543917 - DNA, 22 bp, Homo sapiens
gagccagtgggccagccacaga

SEQ ID NO: 1543918 - DNA, 17 bp, Homo sapiens
gagccagtttgccggat

SEQ ID NO: 1543919 - DNA, 18 bp, Homo sapiens
gagccataggaaggcact

SEQ ID NO: 1543920 - DNA, 21 bp, Homo sapiens
gagccatcccttcggagccaa

SEQ ID NO: 1543921 - DNA, 17 bp, Homo sapiens
gagccatcttggcaggg

SEQ ID NO: 1543922 - DNA, 18 bp, Homo sapiens
gagccatgaggagcgtgg

SEQ ID NO: 1543923 - DNA, 22 bp, Homo sapiens
gagccatgaggagcgtggactc

SEQ ID NO: 1543924 - DNA, 22 bp, Homo sapiens
gagccatgatcgagccactgca

SEQ ID NO: 1543925 - DNA, 15 bp, Homo sapiens
gagccatgggcctgg

SEQ ID NO: 1543926 - DNA, 22 bp, Homo sapiens
gagccatgggcctgggcctgct

SEQ ID NO: 1543927 - DNA, 14 bp, Homo sapiens
gagcccacccagca

SEQ ID NO: 1543928 - DNA, 19 bp, Homo sapiens
gagcccactgtcctgggcc

SEQ ID NO: 1543929 - DNA, 14 bp, Homo sapiens
gagcccagaggagg

SEQ ID NO: 1543930 - DNA, 19 bp, Homo sapiens
gagcccagagggtggcaag

SEQ ID NO: 1543931 - DNA, 22 bp, Homo sapiens
gagcccagccattaccatggag

SEQ ID NO: 1543932 - DNA, 13 bp, Homo sapiens
gagcccagcccag

SEQ ID NO: 1543933 - DNA, 15 bp, Homo sapiens
gagcccagccctccc

SEQ ID NO: 1543934 - DNA, 16 bp, Homo sapiens
gagcccagcctgggag

SEQ ID NO: 1543935 - DNA, 18 bp, Homo sapiens
gagcccagctacattcct

SEQ ID NO: 1543936 - DNA, 19 bp, Homo sapiens
gagcccagctacattcctc

SEQ ID NO: 1543937 - DNA, 20 bp, Homo sapiens
gagcccagctacattcctca

SEQ ID NO: 1543938 - DNA, 11 bp, Homo sapiens
gagcccagctc

SEQ ID NO: 1543939 - DNA, 13 bp, Homo sapiens
gagcccagctctt

SEQ ID NO: 1543940 - DNA, 19 bp, Homo sapiens
agttaaggaccgtggccct

SEQ ID NO: 1543941 - DNA, 18 bp, Homo sapiens
agttaaggagaatcatgt

SEQ ID NO: 1543942 - DNA, 21 bp, Homo sapiens
agttaaggagaatcatgtttc

SEQ ID NO: 1543943 - DNA, 21 bp, Homo sapiens
agttaattggatgttcactgc

SEQ ID NO: 1543944 - DNA, 23 bp, Homo sapiens
agttaatttttccaactactaat

SEQ ID NO: 1543945 - DNA, 23 bp, Homo sapiens
agttacaaattataatgtattca

SEQ ID NO: 1543946 - DNA, 18 bp, Homo sapiens
agttacaataaagtttac

SEQ ID NO: 1543947 - DNA, 20 bp, Homo sapiens
agttacacagaaatgctgct

SEQ ID NO: 1543948 - DNA, 21 bp, Homo sapiens
agttacacagaaatgctgctg

SEQ ID NO: 1543949 - DNA, 13 bp, Homo sapiens
agttacagttctg

SEQ ID NO: 1543950 - DNA, 14 bp, Homo sapiens
agttacagttctgt

SEQ ID NO: 1543951 - DNA, 20 bp, Homo sapiens
agttacatatgtatacatgt

SEQ ID NO: 1543952 - DNA, 21 bp, Homo sapiens
agttacatatgtatacatgtg

SEQ ID NO: 1543953 - DNA, 16 bp, Homo sapiens
agttacattaatgtta

SEQ ID NO: 1543954 - DNA, 22 bp, Homo sapiens
agttaccaaacattacaaaaaa

SEQ ID NO: 1543955 - DNA, 23 bp, Homo sapiens
agttactaagaagaaaattgctg

SEQ ID NO: 1543956 - DNA, 12 bp, Homo sapiens
agttactcagcc

SEQ ID NO: 1543957 - DNA, 15 bp, Homo sapiens
agttactcagccctg

SEQ ID NO: 1543958 - DNA, 15 bp, Homo sapiens
agttactgtaaaatg

SEQ ID NO: 1543959 - DNA, 16 bp, Homo sapiens
agttactgtaaaatgc

SEQ ID NO: 1543960 - DNA, 13 bp, Homo sapiens
agttactgtaaat

SEQ ID NO: 1543961 - DNA, 14 bp, Homo sapiens
agttactgtaaatg

SEQ ID NO: 1543962 - DNA, 11 bp, Homo sapiens
agttactgtgt

SEQ ID NO: 1543963 - DNA, 16 bp, Homo sapiens
agttactgtgtaatta

SEQ ID NO: 1543964 - DNA, 14 bp, Homo sapiens
agttacttgaattt

SEQ ID NO: 1543965 - DNA, 18 bp, Homo sapiens
agttacttgtctgaggcc

SEQ ID NO: 1543966 - DNA, 14 bp, Homo sapiens
agttactttatgtt

SEQ ID NO: 1543967 - DNA, 16 bp, Homo sapiens
agttagagattttaca

SEQ ID NO: 1543968 - DNA, 22 bp, Homo sapiens
agttagcaaactttgtatgtca

SEQ ID NO: 1543969 - DNA, 19 bp, Homo sapiens
agttagcagggatgttcct

SEQ ID NO: 1543970 - DNA, 20 bp, Homo sapiens
agttagcagggatgttcctt

SEQ ID NO: 1543971 - DNA, 22 bp, Homo sapiens
agttagcatccaggctggccag

SEQ ID NO: 1543972 - DNA, 23 bp, Homo sapiens
agttagccatctaatgcttgttt

SEQ ID NO: 1543973 - DNA, 20 bp, Homo sapiens
agttagccccagaaaatgaa

SEQ ID NO: 1543974 - DNA, 21 bp, Homo sapiens
agttagccccagaaaatgaaa

SEQ ID NO: 1543975 - DNA, 15 bp, Homo sapiens
agttagcctccacca

SEQ ID NO: 1543976 - DNA, 23 bp, Homo sapiens
agttagggagagagaagcaggca

SEQ ID NO: 1543977 - DNA, 14 bp, Homo sapiens
agttaggggcctta

SEQ ID NO: 1543978 - DNA, 21 bp, Homo sapiens
agttaggttgtctccaggcca

SEQ ID NO: 1543979 - DNA, 22 bp, Homo sapiens
agttaggttgtctccaggccat

SEQ ID NO: 1543980 - DNA, 20 bp, Homo sapiens
agttagtggattactgccat

SEQ ID NO: 1543981 - DNA, 21 bp, Homo sapiens
agttagttgtgaaagaaagct

SEQ ID NO: 1543982 - DNA, 16 bp, Homo sapiens
agttagtttctttggg

SEQ ID NO: 1543983 - DNA, 17 bp, Homo sapiens
agttagtttttaggtca

SEQ ID NO: 1543984 - DNA, 12 bp, Homo sapiens
agttataagaag

SEQ ID NO: 1543985 - DNA, 21 bp, Homo sapiens
agttataagtagcaggccaag

SEQ ID NO: 1543986 - DNA, 19 bp, Homo sapiens
agttatagatgtctaggta

SEQ ID NO: 1543987 - DNA, 19 bp, Homo sapiens
agttatagtatatctggac

SEQ ID NO: 1543988 - DNA, 14 bp, Homo sapiens
agttatagtgaata

SEQ ID NO: 1543989 - DNA, 20 bp, Homo sapiens
agttatagtgaatactgcta

SEQ ID NO: 1543990 - DNA, 17 bp, Homo sapiens
agttatcaaaaagtatt

SEQ ID NO: 1543991 - DNA, 18 bp, Homo sapiens
agttatcaactttagcta

SEQ ID NO: 1543992 - DNA, 13 bp, Homo sapiens
agttatcacactt

SEQ ID NO: 1543993 - DNA, 20 bp, Homo sapiens
agttatcatgaattttaaag

SEQ ID NO: 1543994 - DNA, 18 bp, Homo sapiens
agttatggcctatacact

SEQ ID NO: 1543995 - DNA, 21 bp, Homo sapiens
agttatggcctatacactatt

SEQ ID NO: 1543996 - DNA, 13 bp, Homo sapiens
agttatgtattta

SEQ ID NO: 1543997 - DNA, 12 bp, Homo sapiens
agttatgtgtat

SEQ ID NO: 1543998 - DNA, 14 bp, Homo sapiens
agttatgtgtatgt

SEQ ID NO: 1543999 - DNA, 19 bp, Homo sapiens
agttatgtgtatgtgagta

SEQ ID NO: 1544000 - DNA, 22 bp, Homo sapiens
agttatgtgtatgtgagtattc

SEQ ID NO: 1544001 - DNA, 13 bp, Homo sapiens
agttattaaaatt

SEQ ID NO: 1544002 - DNA, 14 bp, Homo sapiens
agttattaaaattg

SEQ ID NO: 1544003 - DNA, 18 bp, Homo sapiens
agttattcaaatttgtac

SEQ ID NO: 1544004 - DNA, 21 bp, Homo sapiens
agttattgaatcttaattttt

SEQ ID NO: 1544005 - DNA, 17 bp, Homo sapiens
agttattgataagttca

SEQ ID NO: 1544006 - DNA, 21 bp, Homo sapiens
agttattgataagttcataca

SEQ ID NO: 1544007 - DNA, 15 bp, Homo sapiens
agttatttaatcaaa

SEQ ID NO: 1544008 - DNA, 19 bp, Homo sapiens
agttatttccctttagctg

SEQ ID NO: 1544009 - DNA, 14 bp, Homo sapiens
agttattttctaca

SEQ ID NO: 1544010 - DNA, 12 bp, Homo sapiens
agttcaaaaaca

SEQ ID NO: 1544011 - DNA, 15 bp, Homo sapiens
agttcaaagaagtca

SEQ ID NO: 1544012 - DNA, 14 bp, Homo sapiens
agttcaaagtgtat

SEQ ID NO: 1544013 - DNA, 15 bp, Homo sapiens
agttcaaagtgtata

SEQ ID NO: 1544014 - DNA, 22 bp, Homo sapiens
agttcaaatcctcaccatccac

SEQ ID NO: 1544015 - DNA, 15 bp, Homo sapiens
agttcaatctcccgc

SEQ ID NO: 1544016 - DNA, 20 bp, Homo sapiens
agttcagaaggaataagcat

SEQ ID NO: 1544017 - DNA, 20 bp, Homo sapiens
agttcagagtccttaaaatg

SEQ ID NO: 1544018 - DNA, 16 bp, Homo sapiens
agttcagccaccctga

SEQ ID NO: 1544019 - DNA, 19 bp, Homo sapiens
agttcaggagtcccaagga

SEQ ID NO: 1544020 - DNA, 15 bp, Homo sapiens
agttcagttctgttt

SEQ ID NO: 1544021 - DNA, 10 bp, Homo sapiens
agttcataca

SEQ ID NO: 1544022 - DNA, 20 bp, Homo sapiens
agttcatatctggagcctga

SEQ ID NO: 1544023 - DNA, 18 bp, Homo sapiens
agttcatatgtaccatgt

SEQ ID NO: 1544024 - DNA, 19 bp, Homo sapiens
agttcatcaaatcatcatt

SEQ ID NO: 1544025 - DNA, 19 bp, Homo sapiens
agttcatcaccatttcctc

SEQ ID NO: 1544026 - DNA, 16 bp, Homo sapiens
agttcatccaatcctc

SEQ ID NO: 1544027 - DNA, 17 bp, Homo sapiens
agttcatgtttgcttca

SEQ ID NO: 1544028 - DNA, 23 bp, Homo sapiens
agttcattagaaatattttaaaa

SEQ ID NO: 1544029 - DNA, 18 bp, Homo sapiens
agttccaacatgcaatac

SEQ ID NO: 1544030 - DNA, 14 bp, Homo sapiens
agttccaagagtct

SEQ ID NO: 1544031 - DNA, 19 bp, Homo sapiens
agttccaagagtctaaaga

SEQ ID NO: 1544032 - DNA, 19 bp, Homo sapiens
agttccaagttgaagggaa

SEQ ID NO: 1544033 - DNA, 17 bp, Homo sapiens
agttccacatctgtgga

SEQ ID NO: 1544034 - DNA, 13 bp, Homo sapiens
agttccagtttct

SEQ ID NO: 1544035 - DNA, 23 bp, Homo sapiens
agttccatatagacaccaaggag

SEQ ID NO: 1544036 - DNA, 14 bp, Homo sapiens
agttcccagctccc

SEQ ID NO: 1544037 - DNA, 16 bp, Homo sapiens
agttcccagctccccc

SEQ ID NO: 1544038 - DNA, 17 bp, Homo sapiens
agttcccagctcccccc

SEQ ID NO: 1544039 - DNA, 21 bp, Homo sapiens
agttcccagctccccccgccc

SEQ ID NO: 1544040 - DNA, 23 bp, Homo sapiens
agttcccagctccccccgcccac

SEQ ID NO: 1544041 - DNA, 19 bp, Homo sapiens
agttccctgaaaacccaga

SEQ ID NO: 1544042 - DNA, 21 bp, Homo sapiens
agttccctgaaaacccagaga

SEQ ID NO: 1544043 - DNA, 16 bp, Homo sapiens
agttcccttggcctca

SEQ ID NO: 1544044 - DNA, 17 bp, Homo sapiens
agttcctcgccctgggt

SEQ ID NO: 1544045 - DNA, 22 bp, Homo sapiens
agttcctcttttgtgctgcttc

SEQ ID NO: 1544046 - DNA, 19 bp, Homo sapiens
agttcctgatgacccaggc

SEQ ID NO: 1544047 - DNA, 13 bp, Homo sapiens
agttcctgctccg

SEQ ID NO: 1544048 - DNA, 21 bp, Homo sapiens
agttcctggcccatcaactgt

SEQ ID NO: 1544049 - DNA, 18 bp, Homo sapiens
agttcctgtggccaggag

SEQ ID NO: 1544050 - DNA, 15 bp, Homo sapiens
agttcctgtggctcc

SEQ ID NO: 1544051 - DNA, 19 bp, Homo sapiens
agttccttatccctctctt

SEQ ID NO: 1544052 - DNA, 18 bp, Homo sapiens
agttccttctcacttaga

SEQ ID NO: 1544053 - DNA, 20 bp, Homo sapiens
agttccttgatctgtatata

SEQ ID NO: 1544054 - DNA, 14 bp, Homo sapiens
agttccttgcctta

SEQ ID NO: 1544055 - DNA, 20 bp, Homo sapiens
agttccttgccttaataaat

SEQ ID NO: 1544056 - DNA, 20 bp, Homo sapiens
agttcggtctgacagtcctt

SEQ ID NO: 1544057 - DNA, 23 bp, Homo sapiens
agttctaagactcaaatgttcta

SEQ ID NO: 1544058 - DNA, 13 bp, Homo sapiens
agttctaagattc

SEQ ID NO: 1544059 - DNA, 15 bp, Homo sapiens
agttctaagattcta

SEQ ID NO: 1544060 - DNA, 17 bp, Homo sapiens
agttctaagattctaat

SEQ ID NO: 1544061 - DNA, 19 bp, Homo sapiens
agttctaagattctaatga

SEQ ID NO: 1544062 - DNA, 16 bp, Homo sapiens
agttctaataatttct

SEQ ID NO: 1544063 - DNA, 17 bp, Homo sapiens
agttctaataatttcta

SEQ ID NO: 1544064 - DNA, 19 bp, Homo sapiens
agttctaataatttctaat

SEQ ID NO: 1544065 - DNA, 21 bp, Homo sapiens
agttctaataatttctaatgt

SEQ ID NO: 1544066 - DNA, 23 bp, Homo sapiens
agttctacctcaggcagctcaag

SEQ ID NO: 1544067 - DNA, 11 bp, Homo sapiens
agttctagaag

SEQ ID NO: 1544068 - DNA, 16 bp, Homo sapiens
agttctagtttgcatt

SEQ ID NO: 1544069 - DNA, 17 bp, Homo sapiens
agttctagtttgcattc

SEQ ID NO: 1544070 - DNA, 13 bp, Homo sapiens
agttctataagaa

SEQ ID NO: 1544071 - DNA, 18 bp, Homo sapiens
agttctataagtgaggaa

SEQ ID NO: 1544072 - DNA, 21 bp, Homo sapiens
agttctatccttttgcctgca

SEQ ID NO: 1544073 - DNA, 20 bp, Homo sapiens
agttctcagaactgttggct

SEQ ID NO: 1544074 - DNA, 12 bp, Homo sapiens
agttctcagctt

SEQ ID NO: 1544075 - DNA, 16 bp, Homo sapiens
agttctccagcttcag

SEQ ID NO: 1544076 - DNA, 17 bp, Homo sapiens
agttctccagcttcagc

SEQ ID NO: 1544077 - DNA, 18 bp, Homo sapiens
agttctccagcttcagct

SEQ ID NO: 1544078 - DNA, 23 bp, Homo sapiens
agttctctcatcggaggcccatg

SEQ ID NO: 1544079 - DNA, 22 bp, Homo sapiens
agttctctgggaagtggtcagc

SEQ ID NO: 1544080 - DNA, 19 bp, Homo sapiens
agttctgaactggaacatg

SEQ ID NO: 1544081 - DNA, 19 bp, Homo sapiens
agttctgctgccctcttaa

SEQ ID NO: 1544082 - DNA, 15 bp, Homo sapiens
agttctgtgcctccc

SEQ ID NO: 1544083 - DNA, 17 bp, Homo sapiens
agttctgtgcctccccc

SEQ ID NO: 1544084 - DNA, 18 bp, Homo sapiens
agttctgtgcctcccccc

SEQ ID NO: 1544085 - DNA, 20 bp, Homo sapiens
agttctgtgcctccccccag

SEQ ID NO: 1544086 - DNA, 21 bp, Homo sapiens
agttctgtgcctccccccaga

SEQ ID NO: 1544087 - DNA, 19 bp, Homo sapiens
agttctgtggtttcatgtt

SEQ ID NO: 1544088 - DNA, 23 bp, Homo sapiens
agttctgtggtttcatgttagtt

SEQ ID NO: 1544089 - DNA, 19 bp, Homo sapiens
agttctgttgacctgtgca

SEQ ID NO: 1544090 - DNA, 15 bp, Homo sapiens
agttcttaactgctg

SEQ ID NO: 1544091 - DNA, 21 bp, Homo sapiens
agttcttatgaggaggggagg

SEQ ID NO: 1544092 - DNA, 15 bp, Homo sapiens
agttcttattttagt

SEQ ID NO: 1544093 - DNA, 14 bp, Homo sapiens
agttcttgtgccat

SEQ ID NO: 1544094 - DNA, 19 bp, Homo sapiens
agttctttccataataaaa

SEQ ID NO: 1544095 - DNA, 13 bp, Homo sapiens
agttctttcctcc

SEQ ID NO: 1544096 - DNA, 15 bp, Homo sapiens
agttctttcctcccc

SEQ ID NO: 1544097 - DNA, 19 bp, Homo sapiens
agttctttcctccccctgc

SEQ ID NO: 1544098 - DNA, 22 bp, Homo sapiens
agttctttggattctaaataca

SEQ ID NO: 1544099 - DNA, 17 bp, Homo sapiens
agttctttgggccagac

SEQ ID NO: 1544100 - DNA, 21 bp, Homo sapiens
agttctttgggccagacatgc

SEQ ID NO: 1544101 - DNA, 21 bp, Homo sapiens
agttctttgttcatagcccag

SEQ ID NO: 1544102 - DNA, 22 bp, Homo sapiens
agttgaaaagactccaaagaaa

SEQ ID NO: 1544103 - DNA, 14 bp, Homo sapiens
agttgaaaagccaa

SEQ ID NO: 1544104 - DNA, 15 bp, Homo sapiens
agttgaaaagccaaa

SEQ ID NO: 1544105 - DNA, 22 bp, Homo sapiens
agttgaaaagccaaaggtcaaa

SEQ ID NO: 1544106 - DNA, 20 bp, Homo sapiens
agttgaaaatggatttttaa

SEQ ID NO: 1544107 - DNA, 15 bp, Homo sapiens
agttgaaactgctat

SEQ ID NO: 1544108 - DNA, 19 bp, Homo sapiens
agttgaacaagatttccct

SEQ ID NO: 1544109 - DNA, 17 bp, Homo sapiens
agttgaagttagtggaa

SEQ ID NO: 1544110 - DNA, 20 bp, Homo sapiens
agttgaatggcctgccttga

SEQ ID NO: 1544111 - DNA, 23 bp, Homo sapiens
agttgaattttttctaaaaagaa

SEQ ID NO: 1544112 - DNA, 16 bp, Homo sapiens
agttgacaacctagaa

SEQ ID NO: 1544113 - DNA, 19 bp, Homo sapiens
agttgacatccaaatctag

SEQ ID NO: 1544114 - DNA, 11 bp, Homo sapiens
agttgagcccc

SEQ ID NO: 1544115 - DNA, 12 bp, Homo sapiens
agttgagcccca

SEQ ID NO: 1544116 - DNA, 21 bp, Homo sapiens
agttgagtacagtgaggaggg

SEQ ID NO: 1544117 - DNA, 18 bp, Homo sapiens
agttgagtctcctctctg

SEQ ID NO: 1544118 - DNA, 22 bp, Homo sapiens
agttgagtctcctctctgagac

SEQ ID NO: 1544119 - DNA, 19 bp, Homo sapiens
agttgataacccctcttag

SEQ ID NO: 1544120 - DNA, 16 bp, Homo sapiens
agttgatatgtaacag

SEQ ID NO: 1544121 - DNA, 21 bp, Homo sapiens
agttgatctggaacccagact

SEQ ID NO: 1544122 - DNA, 23 bp, Homo sapiens
agttgattttacaattgaaatga

SEQ ID NO: 1544123 - DNA, 19 bp, Homo sapiens
agttgcaattgaattaaat

SEQ ID NO: 1544124 - DNA, 20 bp, Homo sapiens
agttgcaattgaattaaatt

SEQ ID NO: 1544125 - DNA, 16 bp, Homo sapiens
agttgcagactcagtt

SEQ ID NO: 1544126 - DNA, 23 bp, Homo sapiens
agttgcagactcagtttgtcaga

SEQ ID NO: 1544127 - DNA, 15 bp, Homo sapiens
agttgcatgtagtaa

SEQ ID NO: 1544128 - DNA, 17 bp, Homo sapiens
agttgcatgtagtaaca

SEQ ID NO: 1544129 - DNA, 19 bp, Homo sapiens
agttgcatgtagtaacact

SEQ ID NO: 1544130 - DNA, 22 bp, Homo sapiens
agttgcatgtagtaacactaat

SEQ ID NO: 1544131 - DNA, 21 bp, Homo sapiens
agttgcctgactcctgggtgg

SEQ ID NO: 1544132 - DNA, 21 bp, Homo sapiens
agttgcgacggagagaaaaaa

SEQ ID NO: 1544133 - DNA, 16 bp, Homo sapiens
agttgcgtggactctg

SEQ ID NO: 1544134 - DNA, 16 bp, Homo sapiens
agttgctcaaaaagaa

SEQ ID NO: 1544135 - DNA, 17 bp, Homo sapiens
agttgctcacatgtctt

SEQ ID NO: 1544136 - DNA, 12 bp, Homo sapiens
agttgctgagag

SEQ ID NO: 1544137 - DNA, 12 bp, Homo sapiens
agttgctgatcc

SEQ ID NO: 1544138 - DNA, 16 bp, Homo sapiens
agttgctgcaaacctg

SEQ ID NO: 1544139 - DNA, 17 bp, Homo sapiens
agttgctgggagctgaa

SEQ ID NO: 1544140 - DNA, 14 bp, Homo sapiens
agttgctgtcataa

SEQ ID NO: 1544141 - DNA, 19 bp, Homo sapiens
agttgctgtgaactttcat

SEQ ID NO: 1544142 - DNA, 20 bp, Homo sapiens
agttgcttaattttgatttt

SEQ ID NO: 1544143 - DNA, 16 bp, Homo sapiens
agttgctttgccagag

SEQ ID NO: 1544144 - DNA, 21 bp, Homo sapiens
agttgctttgccagagcagga

SEQ ID NO: 1544145 - DNA, 14 bp, Homo sapiens
agttggaaaggaaa

SEQ ID NO: 1544146 - DNA, 18 bp, Homo sapiens
agttggaaccgtgtccag

SEQ ID NO: 1544147 - DNA, 15 bp, Homo sapiens
agttggacttgtttt

SEQ ID NO: 1544148 - DNA, 18 bp, Homo sapiens
agttggagtactatattt

SEQ ID NO: 1544149 - DNA, 14 bp, Homo sapiens
agttggcagaaagg

SEQ ID NO: 1544150 - DNA, 19 bp, Homo sapiens
agttggcagagaaggcctc

SEQ ID NO: 1544151 - DNA, 23 bp, Homo sapiens
agttggctttgcccacccctcac

SEQ ID NO: 1544152 - DNA, 13 bp, Homo sapiens
agttggctttgct

SEQ ID NO: 1544153 - DNA, 14 bp, Homo sapiens
agttggctttgcta

SEQ ID NO: 1544154 - DNA, 15 bp, Homo sapiens
agttgggactcagga

SEQ ID NO: 1544155 - DNA, 22 bp, Homo sapiens
agttgggatgccaatttcctct

SEQ ID NO: 1544156 - DNA, 15 bp, Homo sapiens
agttgggtgtctcct

SEQ ID NO: 1544157 - DNA, 16 bp, Homo sapiens
gagcggcgcagagccc

SEQ ID NO: 1544158 - DNA, 20 bp, Homo sapiens
gagctaaactccttcctggc

SEQ ID NO: 1544159 - DNA, 21 bp, Homo sapiens
gagctaaattacaattgtcat

SEQ ID NO: 1544160 - DNA, 22 bp, Homo sapiens
gagctactagagatattcttat

SEQ ID NO: 1544161 - DNA, 13 bp, Homo sapiens
gagctactgatga

SEQ ID NO: 1544162 - DNA, 22 bp, Homo sapiens
gagctagaggccacctatgcca

SEQ ID NO: 1544163 - DNA, 19 bp, Homo sapiens
gagctagcgctgccgcacc

SEQ ID NO: 1544164 - DNA, 23 bp, Homo sapiens
gagctagcgctgccgcaccccag

SEQ ID NO: 1544165 - DNA, 15 bp, Homo sapiens
gagctagctgccact

SEQ ID NO: 1544166 - DNA, 16 bp, Homo sapiens
gagctagctgccactt

SEQ ID NO: 1544167 - DNA, 20 bp, Homo sapiens
gagctatgattatgccactg

SEQ ID NO: 1544168 - DNA, 19 bp, Homo sapiens
gagctatggcccagaaaca

SEQ ID NO: 1544169 - DNA, 22 bp, Homo sapiens
gagctcacactccagtggcaga

SEQ ID NO: 1544170 - DNA, 20 bp, Homo sapiens
gagctcagacccccactctc

SEQ ID NO: 1544171 - DNA, 22 bp, Homo sapiens
gagctcatcccccctgctgccc

SEQ ID NO: 1544172 - DNA, 23 bp, Homo sapiens
gagctcatcccccctgctgccca

SEQ ID NO: 1544173 - DNA, 14 bp, Homo sapiens
gacgctcttttcta

SEQ ID NO: 1544174 - DNA, 18 bp, Homo sapiens
gacgctgccctgcatgct

SEQ ID NO: 1544175 - DNA, 13 bp, Homo sapiens
gacgctggctact

SEQ ID NO: 1544176 - DNA, 12 bp, Homo sapiens
gacgctggctcc

SEQ ID NO: 1544177 - DNA, 12 bp, Homo sapiens
gacgcttccctt

SEQ ID NO: 1544178 - DNA, 22 bp, Homo sapiens
gacgcttcccttgccgttggct

SEQ ID NO: 1544179 - DNA, 21 bp, Homo sapiens
gacgcttgtgacagtgcctct

SEQ ID NO: 1544180 - DNA, 13 bp, Homo sapiens
gacggaaaacaat

SEQ ID NO: 1544181 - DNA, 14 bp, Homo sapiens
gacggagtctctca

SEQ ID NO: 1544182 - DNA, 13 bp, Homo sapiens
gacggcacgcact

SEQ ID NO: 1544183 - DNA, 16 bp, Homo sapiens
gacggcaggctcactg

SEQ ID NO: 1544184 - DNA, 19 bp, Homo sapiens
gacggcaggctcactgcca

SEQ ID NO: 1544185 - DNA, 16 bp, Homo sapiens
gacggccaagaatgta

SEQ ID NO: 1544186 - DNA, 20 bp, Homo sapiens
gacggccaatggtgcttccc

SEQ ID NO: 1544187 - DNA, 15 bp, Homo sapiens
gacggcctgatgctc

SEQ ID NO: 1544188 - DNA, 20 bp, Homo sapiens
gacggcctgatgctccctcc

SEQ ID NO: 1544189 - DNA, 18 bp, Homo sapiens
gacggcggccaggcacag

SEQ ID NO: 1544190 - DNA, 19 bp, Homo sapiens
gacggcggccaggcacagg

SEQ ID NO: 1544191 - DNA, 21 bp, Homo sapiens
gacggcggccaggcacagggc

SEQ ID NO: 1544192 - DNA, 17 bp, Homo sapiens
gacggcgtttcaccatg

SEQ ID NO: 1544193 - DNA, 13 bp, Homo sapiens
gacggctgtgacg

SEQ ID NO: 1544194 - DNA, 20 bp, Homo sapiens
gacgggcacacagactggag

SEQ ID NO: 1544195 - DNA, 15 bp, Homo sapiens
gacgggcacagacac

SEQ ID NO: 1544196 - DNA, 17 bp, Homo sapiens
gacggggcctcactatg

SEQ ID NO: 1544197 - DNA, 13 bp, Homo sapiens
gacggtgccaagg

SEQ ID NO: 1544198 - DNA, 16 bp, Homo sapiens
gacggtgcccaagcca

SEQ ID NO: 1544199 - DNA, 18 bp, Homo sapiens
gacggtgcccaagccaga

SEQ ID NO: 1544200 - DNA, 19 bp, Homo sapiens
gacggtgttaattttgcta

SEQ ID NO: 1544201 - DNA, 21 bp, Homo sapiens
gacggtgttaattttgctaac

SEQ ID NO: 1544202 - DNA, 17 bp, Homo sapiens
gacggttcaccagcctc

SEQ ID NO: 1544203 - DNA, 19 bp, Homo sapiens
gacgtatttataataggta

SEQ ID NO: 1544204 - DNA, 14 bp, Homo sapiens
gacgtcagcctctt

SEQ ID NO: 1544205 - DNA, 22 bp, Homo sapiens
gacgtcggccgaccaggctgga

SEQ ID NO: 1544206 - DNA, 20 bp, Homo sapiens
gacgtctggggtgtggggat

SEQ ID NO: 1544207 - DNA, 21 bp, Homo sapiens
gacgtgcagcgcccctctgca

SEQ ID NO: 1544208 - DNA, 23 bp, Homo sapiens
gacgtgccttttgcacccctccc

SEQ ID NO: 1544209 - DNA, 19 bp, Homo sapiens
gacgtggtcagggcagggc

SEQ ID NO: 1544210 - DNA, 13 bp, Homo sapiens
gacgtgtgtggct

SEQ ID NO: 1544211 - DNA, 20 bp, Homo sapiens
gacgttaggcatttcctgct

SEQ ID NO: 1544212 - DNA, 23 bp, Homo sapiens
gacgtttataaacagaaatggaa

SEQ ID NO: 1544213 - DNA, 13 bp, Homo sapiens
gacgtttctgggc

SEQ ID NO: 1544214 - DNA, 18 bp, Homo sapiens
gactaaactttttttctg

SEQ ID NO: 1544215 - DNA, 14 bp, Homo sapiens
gactaaagagagaa

SEQ ID NO: 1544216 - DNA, 18 bp, Homo sapiens
gactaaagagagaatgta

SEQ ID NO: 1544217 - DNA, 16 bp, Homo sapiens
gactaaagctatgtta

SEQ ID NO: 1544218 - DNA, 18 bp, Homo sapiens
gactaacataaaatctgt

SEQ ID NO: 1544219 - DNA, 20 bp, Homo sapiens
gactaacataaaatctgtga

SEQ ID NO: 1544220 - DNA, 19 bp, Homo sapiens
gactaaccccaacgcacag

SEQ ID NO: 1544221 - DNA, 22 bp, Homo sapiens
gactaaccccaacgcacaggaa

SEQ ID NO: 1544222 - DNA, 23 bp, Homo sapiens
gactaaccccaacgcacaggaaa

SEQ ID NO: 1544223 - DNA, 21 bp, Homo sapiens
gactaactagacaccaaagtt

SEQ ID NO: 1544224 - DNA, 23 bp, Homo sapiens
gactaagccctgtcgagacactt

SEQ ID NO: 1544225 - DNA, 22 bp, Homo sapiens
gactacccacgttctcacaccc

SEQ ID NO: 1544226 - DNA, 14 bp, Homo sapiens
gactaccccagtcc

SEQ ID NO: 1544227 - DNA, 14 bp, Homo sapiens
gactaccgcaggcc

SEQ ID NO: 1544228 - DNA, 20 bp, Homo sapiens
gactactgctcctgtggcag

SEQ ID NO: 1544229 - DNA, 23 bp, Homo sapiens
gactagaagggccagtcctgcct

SEQ ID NO: 1544230 - DNA, 19 bp, Homo sapiens
gactagaattctagtgctg

SEQ ID NO: 1544231 - DNA, 21 bp, Homo sapiens
gactagaattctagtgctgct

SEQ ID NO: 1544232 - DNA, 18 bp, Homo sapiens
gactagagctttctttca

SEQ ID NO: 1544233 - DNA, 20 bp, Homo sapiens
gactagaggcagggagggga

SEQ ID NO: 1544234 - DNA, 18 bp, Homo sapiens
gactagaggccagggcag

SEQ ID NO: 1544235 - DNA, 20 bp, Homo sapiens
gactagaggccagggcagca

SEQ ID NO: 1544236 - DNA, 17 bp, Homo sapiens
gactagatggacctgcc

SEQ ID NO: 1544237 - DNA, 17 bp, Homo sapiens
gactagcaatctcttca

SEQ ID NO: 1544238 - DNA, 17 bp, Homo sapiens
gactagccactcctgcc

SEQ ID NO: 1544239 - DNA, 18 bp, Homo sapiens
gactagggattcaggctg

SEQ ID NO: 1544240 - DNA, 18 bp, Homo sapiens
gactatatatataaatgt

SEQ ID NO: 1544241 - DNA, 22 bp, Homo sapiens
gactatatttgggcctgctcca

SEQ ID NO: 1544242 - DNA, 22 bp, Homo sapiens
gactatctaaatgttgaaagat

SEQ ID NO: 1544243 - DNA, 13 bp, Homo sapiens
gactatctttgct

SEQ ID NO: 1544244 - DNA, 16 bp, Homo sapiens
gactatctttgctgca

SEQ ID NO: 1544245 - DNA, 13 bp, Homo sapiens
gactatgacataa

SEQ ID NO: 1544246 - DNA, 12 bp, Homo sapiens
gactatggagcc

SEQ ID NO: 1544247 - DNA, 16 bp, Homo sapiens
gactatggagcctggc

SEQ ID NO: 1544248 - DNA, 15 bp, Homo sapiens
gactattcaaacagt

SEQ ID NO: 1544249 - DNA, 16 bp, Homo sapiens
gactattcaaacagtc

SEQ ID NO: 1544250 - DNA, 17 bp, Homo sapiens
gactattccttttctgt

SEQ ID NO: 1544251 - DNA, 21 bp, Homo sapiens
gactattcttgatgtaaaatc

SEQ ID NO: 1544252 - DNA, 22 bp, Homo sapiens
gactattcttgatgtaaaatct

SEQ ID NO: 1544253 - DNA, 13 bp, Homo sapiens
gactatttctttt

SEQ ID NO: 1544254 - DNA, 22 bp, Homo sapiens
gactatttgcttatttaataaa

SEQ ID NO: 1544255 - DNA, 15 bp, Homo sapiens
gactattttatatga

SEQ ID NO: 1544256 - DNA, 17 bp, Homo sapiens
gactcaaaacctggaga

SEQ ID NO: 1544257 - DNA, 18 bp, Homo sapiens
gactcaaagtttcagaga

SEQ ID NO: 1544258 - DNA, 19 bp, Homo sapiens
gactcaaatgttctaagtt

SEQ ID NO: 1544259 - DNA, 18 bp, Homo sapiens
gactcaagaagtgaagaa

SEQ ID NO: 1544260 - DNA, 22 bp, Homo sapiens
gactcaagaggaatctgtttct

SEQ ID NO: 1544261 - DNA, 23 bp, Homo sapiens
gactcaaggactgaattgtttta

SEQ ID NO: 1544262 - DNA, 18 bp, Homo sapiens
gactcaagtacccattct

SEQ ID NO: 1544263 - DNA, 23 bp, Homo sapiens
gactcaccctcataccatctgct

SEQ ID NO: 1544264 - DNA, 16 bp, Homo sapiens
gactcacctgaaagtt

SEQ ID NO: 1544265 - DNA, 23 bp, Homo sapiens
gactcacttatcccaagagaatg

SEQ ID NO: 1544266 - DNA, 23 bp, Homo sapiens
gactcacttgatgtttcctggaa

SEQ ID NO: 1544267 - DNA, 23 bp, Homo sapiens
gactcaggaccagatgtccgtct

SEQ ID NO: 1544268 - DNA, 15 bp, Homo sapiens
gactcaggatgccca

SEQ ID NO: 1544269 - DNA, 19 bp, Homo sapiens
gactcaggatgcccagggc

SEQ ID NO: 1544270 - DNA, 21 bp, Homo sapiens
agtccctgtgaagactgggtg

SEQ ID NO: 1544271 - DNA, 18 bp, Homo sapiens
agtccctgtgatggccag

SEQ ID NO: 1544272 - DNA, 13 bp, Homo sapiens
agtccctgttttc

SEQ ID NO: 1544273 - DNA, 17 bp, Homo sapiens
agtccctgttttctgag

SEQ ID NO: 1544274 - DNA, 19 bp, Homo sapiens
agtccctgttttctgagcc

SEQ ID NO: 1544275 - DNA, 15 bp, Homo sapiens
agtcccttgttttgt

SEQ ID NO: 1544276 - DNA, 17 bp, Homo sapiens
agtccgcagaagccctg

SEQ ID NO: 1544277 - DNA, 18 bp, Homo sapiens
agtccgcagaagccctga

SEQ ID NO: 1544278 - DNA, 17 bp, Homo sapiens
agtccgcagtctggcct

SEQ ID NO: 1544279 - DNA, 19 bp, Homo sapiens
agtccgcctggccggctcc

SEQ ID NO: 1544280 - DNA, 15 bp, Homo sapiens
agtccggatttctaa

SEQ ID NO: 1544281 - DNA, 17 bp, Homo sapiens
agtcctagccactcagg

SEQ ID NO: 1544282 - DNA, 16 bp, Homo sapiens
agtcctaggacttaaa

SEQ ID NO: 1544283 - DNA, 15 bp, Homo sapiens
agtcctatggaaaaa

SEQ ID NO: 1544284 - DNA, 17 bp, Homo sapiens
agtcctcactcccagtc

SEQ ID NO: 1544285 - DNA, 18 bp, Homo sapiens
agtcctcactcccagtcc

SEQ ID NO: 1544286 - DNA, 23 bp, Homo sapiens
agtcctcacttctagatctcagc

SEQ ID NO: 1544287 - DNA, 14 bp, Homo sapiens
agtcctcaggaagg

SEQ ID NO: 1544288 - DNA, 16 bp, Homo sapiens
agtcctcattgaatcc

SEQ ID NO: 1544289 - DNA, 22 bp, Homo sapiens
agtcctcccaccttggcctccc

SEQ ID NO: 1544290 - DNA, 18 bp, Homo sapiens
agtcctccctcctgcagg

SEQ ID NO: 1544291 - DNA, 21 bp, Homo sapiens
agtcctcgtagccatctctct

SEQ ID NO: 1544292 - DNA, 20 bp, Homo sapiens
agtcctctcccaagtccaca

SEQ ID NO: 1544293 - DNA, 14 bp, Homo sapiens
agtcctctgctcca

SEQ ID NO: 1544294 - DNA, 15 bp, Homo sapiens
agtcctctgctccag

SEQ ID NO: 1544295 - DNA, 16 bp, Homo sapiens
agtcctctgctccagc

SEQ ID NO: 1544296 - DNA, 17 bp, Homo sapiens
agtcctctgctccagca

SEQ ID NO: 1544297 - DNA, 19 bp, Homo sapiens
agtcctctgctccagcaac

SEQ ID NO: 1544298 - DNA, 12 bp, Homo sapiens
agtcctgaagag

SEQ ID NO: 1544299 - DNA, 19 bp, Homo sapiens
agtcctgaagaggcgggcc

SEQ ID NO: 1544300 - DNA, 21 bp, Homo sapiens
agtcctgaagaggcgggccag

SEQ ID NO: 1544301 - DNA, 15 bp, Homo sapiens
agtcctgaggagagg

SEQ ID NO: 1544302 - DNA, 19 bp, Homo sapiens
agtcctgagtgtggacttg

SEQ ID NO: 1544303 - DNA, 13 bp, Homo sapiens
agtcctgcctggc

SEQ ID NO: 1544304 - DNA, 15 bp, Homo sapiens
agtcctgcctggcca

SEQ ID NO: 1544305 - DNA, 20 bp, Homo sapiens
agtcctgcctggccaggcag

SEQ ID NO: 1544306 - DNA, 21 bp, Homo sapiens
agtcctgcctggccaggcaga

SEQ ID NO: 1544307 - DNA, 19 bp, Homo sapiens
agtcctgctacctcccttg

SEQ ID NO: 1544308 - DNA, 21 bp, Homo sapiens
agtcctgctacctcccttgcc

SEQ ID NO: 1544309 - DNA, 22 bp, Homo sapiens
agtcctgctacctcccttgcct

SEQ ID NO: 1544310 - DNA, 22 bp, Homo sapiens
agtcctgctggatcttgcctaa

SEQ ID NO: 1544311 - DNA, 17 bp, Homo sapiens
agtcctggatgttgtgt

SEQ ID NO: 1544312 - DNA, 18 bp, Homo sapiens
agtcctggatgttgtgtg

SEQ ID NO: 1544313 - DNA, 13 bp, Homo sapiens
agtcctggctaca

SEQ ID NO: 1544314 - DNA, 21 bp, Homo sapiens
agtcctgggagaacctcaggc

SEQ ID NO: 1544315 - DNA, 16 bp, Homo sapiens
agtcctggtcctggct

SEQ ID NO: 1544316 - DNA, 17 bp, Homo sapiens
agtcctggtcctggctg

SEQ ID NO: 1544317 - DNA, 15 bp, Homo sapiens
agtcctggtggggct

SEQ ID NO: 1544318 - DNA, 15 bp, Homo sapiens
agtcctggtttcctg

SEQ ID NO: 1544319 - DNA, 18 bp, Homo sapiens
agtcctgtgaatgccact

SEQ ID NO: 1544320 - DNA, 22 bp, Homo sapiens
agtcctgtgaatgccactgcct

SEQ ID NO: 1544321 - DNA, 14 bp, Homo sapiens
agtccttaaaaatc

SEQ ID NO: 1544322 - DNA, 21 bp, Homo sapiens
agtccttaaaaatcacactgt

SEQ ID NO: 1544323 - DNA, 22 bp, Homo sapiens
agtccttaagacggaagtaaat

SEQ ID NO: 1544324 - DNA, 22 bp, Homo sapiens
agtccttgaaaatattttttat

SEQ ID NO: 1544325 - DNA, 23 bp, Homo sapiens
agtccttgatttcaaagttttgt

SEQ ID NO: 1544326 - DNA, 17 bp, Homo sapiens
agtcgagagggctgttg

SEQ ID NO: 1544327 - DNA, 23 bp, Homo sapiens
agtcgccagtcactgctgcaagg

SEQ ID NO: 1544328 - DNA, 14 bp, Homo sapiens
agtcggcatgccag

SEQ ID NO: 1544329 - DNA, 12 bp, Homo sapiens
agtcgggaggag

SEQ ID NO: 1544330 - DNA, 16 bp, Homo sapiens
agtcgggaggagcagc

SEQ ID NO: 1544331 - DNA, 16 bp, Homo sapiens
agtcgggggctggcct

SEQ ID NO: 1544332 - DNA, 17 bp, Homo sapiens
agtcgggggctggccta

SEQ ID NO: 1544333 - DNA, 21 bp, Homo sapiens
agtcgggggctggcctaggag

SEQ ID NO: 1544334 - DNA, 13 bp, Homo sapiens
agtcgtgatgtgg

SEQ ID NO: 1544335 - DNA, 14 bp, Homo sapiens
agtcgttttagtgt

SEQ ID NO: 1544336 - DNA, 21 bp, Homo sapiens
agtcgttttagtgtctgacct

SEQ ID NO: 1544337 - DNA, 21 bp, Homo sapiens
agtctaaagatggagtttcta

SEQ ID NO: 1544338 - DNA, 18 bp, Homo sapiens
agtctaacgctgaactga

SEQ ID NO: 1544339 - DNA, 18 bp, Homo sapiens
agtctaagcaagatgttt

SEQ ID NO: 1544340 - DNA, 17 bp, Homo sapiens
agtctaatgaagagaaa

SEQ ID NO: 1544341 - DNA, 18 bp, Homo sapiens
agtctaatgaagagaaaa

SEQ ID NO: 1544342 - DNA, 23 bp, Homo sapiens
agtctagatgtttattcttctag

SEQ ID NO: 1544343 - DNA, 18 bp, Homo sapiens
agtctagattcaaaggtt

SEQ ID NO: 1544344 - DNA, 20 bp, Homo sapiens
agtctagattctctggctgt

SEQ ID NO: 1544345 - DNA, 16 bp, Homo sapiens
agtctaggagctggga

SEQ ID NO: 1544346 - DNA, 18 bp, Homo sapiens
agtctaggagctgggagg

SEQ ID NO: 1544347 - DNA, 20 bp, Homo sapiens
agtctaggagctgggaggaa

SEQ ID NO: 1544348 - DNA, 22 bp, Homo sapiens
agtctaggagctgggaggaaaa

SEQ ID NO: 1544349 - DNA, 21 bp, Homo sapiens
agtctatatggttctccaaga

SEQ ID NO: 1544350 - DNA, 13 bp, Homo sapiens
agtctatgttcaa

SEQ ID NO: 1544351 - DNA, 19 bp, Homo sapiens
agtctatgttcaaagactg

SEQ ID NO: 1544352 - DNA, 21 bp, Homo sapiens
agtctatttccactgaacaaa

SEQ ID NO: 1544353 - DNA, 14 bp, Homo sapiens
agtctattttatta

SEQ ID NO: 1544354 - DNA, 17 bp, Homo sapiens
agtctattttattatga

SEQ ID NO: 1544355 - DNA, 17 bp, Homo sapiens
agtctcacagagaagct

SEQ ID NO: 1544356 - DNA, 21 bp, Homo sapiens
agtctcacagagaagctcctg

SEQ ID NO: 1544357 - DNA, 14 bp, Homo sapiens
agtctcagagacca

SEQ ID NO: 1544358 - DNA, 17 bp, Homo sapiens
agtctcagagaccagca

SEQ ID NO: 1544359 - DNA, 18 bp, Homo sapiens
agtctcagagaccagcac

SEQ ID NO: 1544360 - DNA, 23 bp, Homo sapiens
agtctcagagaccagcactcagc

SEQ ID NO: 1544361 - DNA, 13 bp, Homo sapiens
agtctcagctaag

SEQ ID NO: 1544362 - DNA, 18 bp, Homo sapiens
agtctcagctgctgaaat

SEQ ID NO: 1544363 - DNA, 10 bp, Homo sapiens
agtctcagtt

SEQ ID NO: 1544364 - DNA, 18 bp, Homo sapiens
agtctcagtttgtgtgtc

SEQ ID NO: 1544365 - DNA, 21 bp, Homo sapiens
agtctcagtttgtgtgtctta

SEQ ID NO: 1544366 - DNA, 19 bp, Homo sapiens
agtctcataggttaaaaaa

SEQ ID NO: 1544367 - DNA, 20 bp, Homo sapiens
agtctcataggttaaaaaaa

SEQ ID NO: 1544368 - DNA, 23 bp, Homo sapiens
agtctcattcgcctttgtcttgt

SEQ ID NO: 1544369 - DNA, 12 bp, Homo sapiens
agtctccagccc

SEQ ID NO: 1544370 - DNA, 16 bp, Homo sapiens
agtctccctgcacagc

SEQ ID NO: 1544371 - DNA, 17 bp, Homo sapiens
agtctccctgcacagcc

SEQ ID NO: 1544372 - DNA, 19 bp, Homo sapiens
agtctccctgcacagcctc

SEQ ID NO: 1544373 - DNA, 20 bp, Homo sapiens
agtctccctgcacagcctct

SEQ ID NO: 1544374 - DNA, 15 bp, Homo sapiens
agtctccttcagcac

SEQ ID NO: 1544375 - DNA, 18 bp, Homo sapiens
agtctccttcagcacggc

SEQ ID NO: 1544376 - DNA, 14 bp, Homo sapiens
agtctccttcccct

SEQ ID NO: 1544377 - DNA, 17 bp, Homo sapiens
agtctcctttgcactga

SEQ ID NO: 1544378 - DNA, 21 bp, Homo sapiens
agtctcctttgcactgagggc

SEQ ID NO: 1544379 - DNA, 23 bp, Homo sapiens
agtctcctttgcactgagggcca

SEQ ID NO: 1544380 - DNA, 17 bp, Homo sapiens
agtctcgaatgtaattg

SEQ ID NO: 1544381 - DNA, 23 bp, Homo sapiens
agtctcgaatgtaattggaatct

SEQ ID NO: 1544382 - DNA, 15 bp, Homo sapiens
agtctctataccaat

SEQ ID NO: 1544383 - DNA, 22 bp, Homo sapiens
agtctctataccaataaagtga

SEQ ID NO: 1544384 - DNA, 18 bp, Homo sapiens
agtctctatattatgtct

SEQ ID NO: 1544385 - DNA, 16 bp, Homo sapiens
agtctctgctggccca

SEQ ID NO: 1544386 - DNA, 23 bp, Homo sapiens
gactcaggatgcccagggccact

SEQ ID NO: 1544387 - DNA, 19 bp, Homo sapiens
gactcagggccatgcctgc

SEQ ID NO: 1544388 - DNA, 20 bp, Homo sapiens
gactcagggccatgcctgcc

SEQ ID NO: 1544389 - DNA, 18 bp, Homo sapiens
gactcagggccccagcac

SEQ ID NO: 1544390 - DNA, 15 bp, Homo sapiens
gactcaggttgtctg

SEQ ID NO: 1544391 - DNA, 16 bp, Homo sapiens
gactcagtgagctggg

SEQ ID NO: 1544392 - DNA, 19 bp, Homo sapiens
gactcagttccaggcctga

SEQ ID NO: 1544393 - DNA, 15 bp, Homo sapiens
gactcagtttgtcag

SEQ ID NO: 1544394 - DNA, 12 bp, Homo sapiens
gactcatatatt

SEQ ID NO: 1544395 - DNA, 13 bp, Homo sapiens
gactcatccccac

SEQ ID NO: 1544396 - DNA, 17 bp, Homo sapiens
gactcatccccacagct

SEQ ID NO: 1544397 - DNA, 14 bp, Homo sapiens
gactcatggcagct

SEQ ID NO: 1544398 - DNA, 23 bp, Homo sapiens
gactcatggcagctgtttctcat

SEQ ID NO: 1544399 - DNA, 17 bp, Homo sapiens
gactccagaatctgctg

SEQ ID NO: 1544400 - DNA, 18 bp, Homo sapiens
gactccagagtctgagcc

SEQ ID NO: 1544401 - DNA, 19 bp, Homo sapiens
gactccagagtctgagccc

SEQ ID NO: 1544402 - DNA, 10 bp, Homo sapiens
gactccaggc

SEQ ID NO: 1544403 - DNA, 18 bp, Homo sapiens
gactccaggcccaaggct

SEQ ID NO: 1544404 - DNA, 18 bp, Homo sapiens
gactccaggcctgaccag

SEQ ID NO: 1544405 - DNA, 19 bp, Homo sapiens
gactccaggcctgaccagg

SEQ ID NO: 1544406 - DNA, 17 bp, Homo sapiens
gactccatctctcatcc

SEQ ID NO: 1544407 - DNA, 21 bp, Homo sapiens
gactccatctctcatcctcca

SEQ ID NO: 1544408 - DNA, 16 bp, Homo sapiens
gactccatctcttctg

SEQ ID NO: 1544409 - DNA, 16 bp, Homo sapiens
gactcccagtgaactt

SEQ ID NO: 1544410 - DNA, 13 bp, Homo sapiens
gactcccattcct

SEQ ID NO: 1544411 - DNA, 23 bp, Homo sapiens
gactcccattcctgaagaaccag

SEQ ID NO: 1544412 - DNA, 11 bp, Homo sapiens
gactcccctcc

SEQ ID NO: 1544413 - DNA, 15 bp, Homo sapiens
gactcccctccctgc

SEQ ID NO: 1544414 - DNA, 15 bp, Homo sapiens
gactccgccctcctc

SEQ ID NO: 1544415 - DNA, 19 bp, Homo sapiens
gactcctgctggtacctgc

SEQ ID NO: 1544416 - DNA, 22 bp, Homo sapiens
gactcgaataaaatctgctgca

SEQ ID NO: 1544417 - DNA, 14 bp, Homo sapiens
gactcgggggtggg

SEQ ID NO: 1544418 - DNA, 16 bp, Homo sapiens
gactcgggggtgggga

SEQ ID NO: 1544419 - DNA, 16 bp, Homo sapiens
gactcggtgagccggg

SEQ ID NO: 1544420 - DNA, 19 bp, Homo sapiens
gactcggtttctccaaact

SEQ ID NO: 1544421 - DNA, 15 bp, Homo sapiens
gactctaaatgcagt

SEQ ID NO: 1544422 - DNA, 14 bp, Homo sapiens
gactctagtattta

SEQ ID NO: 1544423 - DNA, 20 bp, Homo sapiens
gactctcacactgaatcagc

SEQ ID NO: 1544424 - DNA, 12 bp, Homo sapiens
gactctcacctg

SEQ ID NO: 1544425 - DNA, 15 bp, Homo sapiens
gactctcctcctccc

SEQ ID NO: 1544426 - DNA, 15 bp, Homo sapiens
gactctctgtgacct

SEQ ID NO: 1544427 - DNA, 19 bp, Homo sapiens
gactctctgtgacctgccc

SEQ ID NO: 1544428 - DNA, 14 bp, Homo sapiens
gactctgaaatctg

SEQ ID NO: 1544429 - DNA, 18 bp, Homo sapiens
gactctgaaatctgaaga

SEQ ID NO: 1544430 - DNA, 19 bp, Homo sapiens
gactctgaggctctttctg

SEQ ID NO: 1544431 - DNA, 15 bp, Homo sapiens
gactctgcacatgtc

SEQ ID NO: 1544432 - DNA, 19 bp, Homo sapiens
gactctgcacatgtcttgt

SEQ ID NO: 1544433 - DNA, 21 bp, Homo sapiens
gactctggaggtcatctggcg

SEQ ID NO: 1544434 - DNA, 13 bp, Homo sapiens
gactctggccctg

SEQ ID NO: 1544435 - DNA, 16 bp, Homo sapiens
gactctggccctggcc

SEQ ID NO: 1544436 - DNA, 22 bp, Homo sapiens
gactctgggtggaagtgcccag

SEQ ID NO: 1544437 - DNA, 18 bp, Homo sapiens
gactctggtgcctccaga

SEQ ID NO: 1544438 - DNA, 20 bp, Homo sapiens
gactcttccctctcgctccc

SEQ ID NO: 1544439 - DNA, 17 bp, Homo sapiens
gactcttttgccattaa

SEQ ID NO: 1544440 - DNA, 20 bp, Homo sapiens
gactctttttttgagtgaca

SEQ ID NO: 1544441 - DNA, 16 bp, Homo sapiens
gactgaaagcagcagc

SEQ ID NO: 1544442 - DNA, 21 bp, Homo sapiens
gactgaaagcagcagctagga

SEQ ID NO: 1544443 - DNA, 19 bp, Homo sapiens
gactgaaattacgggtacc

SEQ ID NO: 1544444 - DNA, 23 bp, Homo sapiens
gactgaaattgttttaccagctc

SEQ ID NO: 1544445 - DNA, 16 bp, Homo sapiens
gactgaaggggcacac

SEQ ID NO: 1544446 - DNA, 12 bp, Homo sapiens
gactgaattcca

SEQ ID NO: 1544447 - DNA, 15 bp, Homo sapiens
gactgaatttaacta

SEQ ID NO: 1544448 - DNA, 21 bp, Homo sapiens
gactgacagtttacagacgct

SEQ ID NO: 1544449 - DNA, 14 bp, Homo sapiens
gactgaccaaagac

SEQ ID NO: 1544450 - DNA, 21 bp, Homo sapiens
gactgaccaaagactgcagaa

SEQ ID NO: 1544451 - DNA, 21 bp, Homo sapiens
gactgacttgtttgtcttcca

SEQ ID NO: 1544452 - DNA, 18 bp, Homo sapiens
gactgagcaagaccctgt

SEQ ID NO: 1544453 - DNA, 17 bp, Homo sapiens
gactgagcaccctctgg

SEQ ID NO: 1544454 - DNA, 18 bp, Homo sapiens
gactgagcaccctctgga

SEQ ID NO: 1544455 - DNA, 16 bp, Homo sapiens
gactgagcagccgcca

SEQ ID NO: 1544456 - DNA, 19 bp, Homo sapiens
gactgagcagccgccagct

SEQ ID NO: 1544457 - DNA, 13 bp, Homo sapiens
gactgagctcaag

SEQ ID NO: 1544458 - DNA, 23 bp, Homo sapiens
gactgaggcctgagcgctcctgc

SEQ ID NO: 1544459 - DNA, 14 bp, Homo sapiens
gactgaggcctgct

SEQ ID NO: 1544460 - DNA, 13 bp, Homo sapiens
gactgagggcagt

SEQ ID NO: 1544461 - DNA, 18 bp, Homo sapiens
gactgaggtataaagaca

SEQ ID NO: 1544462 - DNA, 21 bp, Homo sapiens
gactgagtcccctccaggaag

SEQ ID NO: 1544463 - DNA, 22 bp, Homo sapiens
gactgagtcctcgtagccatct

SEQ ID NO: 1544464 - DNA, 14 bp, Homo sapiens
gactgagtgggaag

SEQ ID NO: 1544465 - DNA, 22 bp, Homo sapiens
gactgagtgggaagcccatcct

SEQ ID NO: 1544466 - DNA, 21 bp, Homo sapiens
gactgataacaaccttttaca

SEQ ID NO: 1544467 - DNA, 21 bp, Homo sapiens
gactgatagcttacactgagg

SEQ ID NO: 1544468 - DNA, 23 bp, Homo sapiens
gactgatagcttacactgaggac

SEQ ID NO: 1544469 - DNA, 17 bp, Homo sapiens
gactgatgattttcctt

SEQ ID NO: 1544470 - DNA, 14 bp, Homo sapiens
gactgatgtcatct

SEQ ID NO: 1544471 - DNA, 15 bp, Homo sapiens
gactgatgtcatctt

SEQ ID NO: 1544472 - DNA, 21 bp, Homo sapiens
gactgatgttgagggaacaga

SEQ ID NO: 1544473 - DNA, 16 bp, Homo sapiens
gactgatgtttgtgca

SEQ ID NO: 1544474 - DNA, 16 bp, Homo sapiens
gactgattctgggatg

SEQ ID NO: 1544475 - DNA, 14 bp, Homo sapiens
gactgattggcctg

SEQ ID NO: 1544476 - DNA, 16 bp, Homo sapiens
gactgatttcagagtg

SEQ ID NO: 1544477 - DNA, 13 bp, Homo sapiens
gactgatttgtgg

SEQ ID NO: 1544478 - DNA, 13 bp, Homo sapiens
gactgattttaat

SEQ ID NO: 1544479 - DNA, 19 bp, Homo sapiens
gactgcaccagcgccccca

SEQ ID NO: 1544480 - DNA, 16 bp, Homo sapiens
gactgcagaggggaaa

SEQ ID NO: 1544481 - DNA, 15 bp, Homo sapiens
gactgcagcccccta

SEQ ID NO: 1544482 - DNA, 15 bp, Homo sapiens
gactgcagctgctga

SEQ ID NO: 1544483 - DNA, 16 bp, Homo sapiens
gactgcagtcggcatg

SEQ ID NO: 1544484 - DNA, 16 bp, Homo sapiens
gactgcatcatatatt

SEQ ID NO: 1544485 - DNA, 17 bp, Homo sapiens
gactgcatggggaggca

SEQ ID NO: 1544486 - DNA, 13 bp, Homo sapiens
gactgccaagcca

SEQ ID NO: 1544487 - DNA, 16 bp, Homo sapiens
gactgccaggctgttt

SEQ ID NO: 1544488 - DNA, 11 bp, Homo sapiens
gactgccaggt

SEQ ID NO: 1544489 - DNA, 15 bp, Homo sapiens
gactgcctgtctcca

SEQ ID NO: 1544490 - DNA, 14 bp, Homo sapiens
gactgcgttctgca

SEQ ID NO: 1544491 - DNA, 19 bp, Homo sapiens
gactgctacctctgagaag

SEQ ID NO: 1544492 - DNA, 19 bp, Homo sapiens
gactgctgggactggccag

SEQ ID NO: 1544493 - DNA, 17 bp, Homo sapiens
gactgcttcccatccta

SEQ ID NO: 1544494 - DNA, 20 bp, Homo sapiens
gactgcttcccatcctaccc

SEQ ID NO: 1544495 - DNA, 16 bp, Homo sapiens
gactgcttttaaatga

SEQ ID NO: 1544496 - DNA, 23 bp, Homo sapiens
gactggagaccgcttcacccctg

SEQ ID NO: 1544497 - DNA, 20 bp, Homo sapiens
gactggaggcccctggagcc

SEQ ID NO: 1544498 - DNA, 14 bp, Homo sapiens
gactggcacagttt

SEQ ID NO: 1544499 - DNA, 22 bp, Homo sapiens
gactggcacagttttctgagaa

SEQ ID NO: 1544500 - DNA, 13 bp, Homo sapiens
gactggcagaagc

SEQ ID NO: 1544501 - DNA, 15 bp, Homo sapiens
gactggccagggcca

SEQ ID NO: 1544502 - DNA, 20 bp, Homo sapiens
gactggccatttttctgggg

SEQ ID NO: 1544503 - DNA, 12 bp, Homo sapiens
agtctctgtgag

SEQ ID NO: 1544504 - DNA, 19 bp, Homo sapiens
agtctcttctccactggat

SEQ ID NO: 1544505 - DNA, 15 bp, Homo sapiens
agtctctttaatctt

SEQ ID NO: 1544506 - DNA, 22 bp, Homo sapiens
agtctctttaatcttcagtttt

SEQ ID NO: 1544507 - DNA, 20 bp, Homo sapiens
agtctctttttttggcccag

SEQ ID NO: 1544508 - DNA, 21 bp, Homo sapiens
agtctgaaactggcttcccca

SEQ ID NO: 1544509 - DNA, 18 bp, Homo sapiens
agtctgaacagctgtaat

SEQ ID NO: 1544510 - DNA, 18 bp, Homo sapiens
agtctgaacccttgtgct

SEQ ID NO: 1544511 - DNA, 13 bp, Homo sapiens
agtctgagtcctg

SEQ ID NO: 1544512 - DNA, 19 bp, Homo sapiens
agtctgagtcctgtctctg

SEQ ID NO: 1544513 - DNA, 14 bp, Homo sapiens
agtctgagtctgag

SEQ ID NO: 1544514 - DNA, 17 bp, Homo sapiens
agtctgagtctgagtcc

SEQ ID NO: 1544515 - DNA, 15 bp, Homo sapiens
agtctgattttaatg

SEQ ID NO: 1544516 - DNA, 18 bp, Homo sapiens
agtctgattttaatgaaa

SEQ ID NO: 1544517 - DNA, 21 bp, Homo sapiens
agtctgcagatagaaagcatt

SEQ ID NO: 1544518 - DNA, 11 bp, Homo sapiens
agtctgccact

SEQ ID NO: 1544519 - DNA, 23 bp, Homo sapiens
agtctgcgtctctgctttaaagt

SEQ ID NO: 1544520 - DNA, 14 bp, Homo sapiens
agtctgctccacca

SEQ ID NO: 1544521 - DNA, 14 bp, Homo sapiens
agtctggagaaggt

SEQ ID NO: 1544522 - DNA, 17 bp, Homo sapiens
agtctggatctgggacc

SEQ ID NO: 1544523 - DNA, 15 bp, Homo sapiens
agtctggcctgggcg

SEQ ID NO: 1544524 - DNA, 15 bp, Homo sapiens
agtctggtgaagctc

SEQ ID NO: 1544525 - DNA, 17 bp, Homo sapiens
agtctgtactaaacagt

SEQ ID NO: 1544526 - DNA, 22 bp, Homo sapiens
agtctgtactaaacagtaagat

SEQ ID NO: 1544527 - DNA, 13 bp, Homo sapiens
agtctgtcatgaa

SEQ ID NO: 1544528 - DNA, 14 bp, Homo sapiens
agtctgtctactgt

SEQ ID NO: 1544529 - DNA, 18 bp, Homo sapiens
agtctgtctactgtggtg

SEQ ID NO: 1544530 - DNA, 11 bp, Homo sapiens
agtctgtgtga

SEQ ID NO: 1544531 - DNA, 21 bp, Homo sapiens
agtctgttatgcactgtggtt

SEQ ID NO: 1544532 - DNA, 23 bp, Homo sapiens
agtcttaacaaaccaacatcttt

SEQ ID NO: 1544533 - DNA, 23 bp, Homo sapiens
agtcttaataaaataaactagat

SEQ ID NO: 1544534 - DNA, 22 bp, Homo sapiens
agtcttatcttctgcagtgagt

SEQ ID NO: 1544535 - DNA, 17 bp, Homo sapiens
agtcttcactaaccttt

SEQ ID NO: 1544536 - DNA, 17 bp, Homo sapiens
agtcttcagacccagag

SEQ ID NO: 1544537 - DNA, 11 bp, Homo sapiens
agtcttcctct

SEQ ID NO: 1544538 - DNA, 16 bp, Homo sapiens
agtcttcctcttagcc

SEQ ID NO: 1544539 - DNA, 20 bp, Homo sapiens
agtcttcctcttagcctctg

SEQ ID NO: 1544540 - DNA, 16 bp, Homo sapiens
agtcttcctgacactt

SEQ ID NO: 1544541 - DNA, 17 bp, Homo sapiens
agtcttcctgacacttt

SEQ ID NO: 1544542 - DNA, 18 bp, Homo sapiens
agtcttcctgacacttta

SEQ ID NO: 1544543 - DNA, 19 bp, Homo sapiens
agtcttctctctggctcag

SEQ ID NO: 1544544 - DNA, 15 bp, Homo sapiens
agtcttgaaatgaaa

SEQ ID NO: 1544545 - DNA, 17 bp, Homo sapiens
agtcttgaaatgaaagg

SEQ ID NO: 1544546 - DNA, 21 bp, Homo sapiens
agtcttgaaatgaaagggaaa

SEQ ID NO: 1544547 - DNA, 12 bp, Homo sapiens
agtcttgaagtt

SEQ ID NO: 1544548 - DNA, 12 bp, Homo sapiens
agtcttgcctag

SEQ ID NO: 1544549 - DNA, 21 bp, Homo sapiens
agtcttgcctatattttcctg

SEQ ID NO: 1544550 - DNA, 21 bp, Homo sapiens
agtcttggcggcagcagccat

SEQ ID NO: 1544551 - DNA, 13 bp, Homo sapiens
agtcttggttcta

SEQ ID NO: 1544552 - DNA, 16 bp, Homo sapiens
agtcttggttctaaag

SEQ ID NO: 1544553 - DNA, 21 bp, Homo sapiens
agtcttggttctaaaggtacc

SEQ ID NO: 1544554 - DNA, 10 bp, Homo sapiens
agtcttgtct

SEQ ID NO: 1544555 - DNA, 12 bp, Homo sapiens
agtctttagaac

SEQ ID NO: 1544556 - DNA, 15 bp, Homo sapiens
agtctttcatggctg

SEQ ID NO: 1544557 - DNA, 13 bp, Homo sapiens
agtctttccagag

SEQ ID NO: 1544558 - DNA, 16 bp, Homo sapiens
agtctttcttcttcaa

SEQ ID NO: 1544559 - DNA, 22 bp, Homo sapiens
agtctttgccagtcattcagca

SEQ ID NO: 1544560 - DNA, 15 bp, Homo sapiens
agtctttgccttctc

SEQ ID NO: 1544561 - DNA, 16 bp, Homo sapiens
agtctttgccttctct

SEQ ID NO: 1544562 - DNA, 20 bp, Homo sapiens
agtctttgctcagtgtccag

SEQ ID NO: 1544563 - DNA, 15 bp, Homo sapiens
agtctttggttctaa

SEQ ID NO: 1544564 - DNA, 17 bp, Homo sapiens
agtctttggttctaagg

SEQ ID NO: 1544565 - DNA, 13 bp, Homo sapiens
agtcttttctgtc

SEQ ID NO: 1544566 - DNA, 14 bp, Homo sapiens
agtctttttatagg

SEQ ID NO: 1544567 - DNA, 20 bp, Homo sapiens
agtctttttataggttttat

SEQ ID NO: 1544568 - DNA, 17 bp, Homo sapiens
agtgaaaaatatgttga

SEQ ID NO: 1544569 - DNA, 20 bp, Homo sapiens
agtgaaaaatgttaggacat

SEQ ID NO: 1544570 - DNA, 21 bp, Homo sapiens
agtgaaaatttttacattcat

SEQ ID NO: 1544571 - DNA, 21 bp, Homo sapiens
agtgaaacctttagggcagct

SEQ ID NO: 1544572 - DNA, 18 bp, Homo sapiens
agtgaaagggctatggca

SEQ ID NO: 1544573 - DNA, 22 bp, Homo sapiens
agtgaaatggctggggccgctg

SEQ ID NO: 1544574 - DNA, 13 bp, Homo sapiens
agtgaacacacac

SEQ ID NO: 1544575 - DNA, 17 bp, Homo sapiens
agtgaacactagccaga

SEQ ID NO: 1544576 - DNA, 20 bp, Homo sapiens
agtgaacattcccagcccag

SEQ ID NO: 1544577 - DNA, 22 bp, Homo sapiens
agtgaaccaaaaatagaaatta

SEQ ID NO: 1544578 - DNA, 19 bp, Homo sapiens
agtgaactatttctacaca

SEQ ID NO: 1544579 - DNA, 14 bp, Homo sapiens
agtgaagaggggca

SEQ ID NO: 1544580 - DNA, 21 bp, Homo sapiens
agtgaagaggggcagcccttg

SEQ ID NO: 1544581 - DNA, 12 bp, Homo sapiens
agtgaaggagaa

SEQ ID NO: 1544582 - DNA, 17 bp, Homo sapiens
agtgaaggagccacgtg

SEQ ID NO: 1544583 - DNA, 20 bp, Homo sapiens
agtgaaggagccacgtgaat

SEQ ID NO: 1544584 - DNA, 23 bp, Homo sapiens
agtgaagggaagagacagcccag

SEQ ID NO: 1544585 - DNA, 18 bp, Homo sapiens
agtgaagtgaatctgatt

SEQ ID NO: 1544586 - DNA, 22 bp, Homo sapiens
agtgaagtgcctttttcctaga

SEQ ID NO: 1544587 - DNA, 19 bp, Homo sapiens
agtgaagttgcttcttcta

SEQ ID NO: 1544588 - DNA, 20 bp, Homo sapiens
agtgaatacattaacggtgc

SEQ ID NO: 1544589 - DNA, 21 bp, Homo sapiens
agtgaatctaaggataatgaa

SEQ ID NO: 1544590 - DNA, 23 bp, Homo sapiens
agtgaatgccatttagaatctag

SEQ ID NO: 1544591 - DNA, 17 bp, Homo sapiens
agtgaatgctagacaga

SEQ ID NO: 1544592 - DNA, 20 bp, Homo sapiens
agtgaatgtgtctggacctc

SEQ ID NO: 1544593 - DNA, 12 bp, Homo sapiens
agtgaattgaag

SEQ ID NO: 1544594 - DNA, 14 bp, Homo sapiens
agtgaattgtcttt

SEQ ID NO: 1544595 - DNA, 18 bp, Homo sapiens
agtgaatttctaaatgtt

SEQ ID NO: 1544596 - DNA, 19 bp, Homo sapiens
agtgaatttgggctgctgt

SEQ ID NO: 1544597 - DNA, 13 bp, Homo sapiens
agtgacaaaccat

SEQ ID NO: 1544598 - DNA, 20 bp, Homo sapiens
agtgacaaagccagaggaga

SEQ ID NO: 1544599 - DNA, 17 bp, Homo sapiens
agtgacacaagcacttt

SEQ ID NO: 1544600 - DNA, 16 bp, Homo sapiens
agtgacacagacattt

SEQ ID NO: 1544601 - DNA, 17 bp, Homo sapiens
agtgacacagacatttt

SEQ ID NO: 1544602 - DNA, 18 bp, Homo sapiens
agtgacacagacattttg

SEQ ID NO: 1544603 - DNA, 23 bp, Homo sapiens
agtgacacagacattttgtgtga

SEQ ID NO: 1544604 - DNA, 13 bp, Homo sapiens
agtgacacagcag

SEQ ID NO: 1544605 - DNA, 23 bp, Homo sapiens
agtgacacagcagcttcaccaga

SEQ ID NO: 1544606 - DNA, 22 bp, Homo sapiens
agtgacaccaataaatgtttgt

SEQ ID NO: 1544607 - DNA, 16 bp, Homo sapiens
agtgacagacaggctc

SEQ ID NO: 1544608 - DNA, 13 bp, Homo sapiens
agtgacagagacc

SEQ ID NO: 1544609 - DNA, 20 bp, Homo sapiens
agtgacagagacccagatct

SEQ ID NO: 1544610 - DNA, 13 bp, Homo sapiens
agtgacagagcga

SEQ ID NO: 1544611 - DNA, 14 bp, Homo sapiens
agtgacagctttcc

SEQ ID NO: 1544612 - DNA, 15 bp, Homo sapiens
agtgacagctttctg

SEQ ID NO: 1544613 - DNA, 16 bp, Homo sapiens
agtgacagctttctgg

SEQ ID NO: 1544614 - DNA, 21 bp, Homo sapiens
agtgacagctttctgggatgt

SEQ ID NO: 1544615 - DNA, 20 bp, Homo sapiens
agtgacagtggattgcattt

SEQ ID NO: 1544616 - DNA, 19 bp, Homo sapiens
agtgacagttgcagccctt

SEQ ID NO: 1544617 - DNA, 16 bp, Homo sapiens
agtgacatagcctcat

SEQ ID NO: 1544618 - DNA, 21 bp, Homo sapiens
agtgacccttcccaatcagca

SEQ ID NO: 1544619 - DNA, 17 bp, Homo sapiens
gactggctagagtcctc

SEQ ID NO: 1544620 - DNA, 21 bp, Homo sapiens
gactggctagagtcctcactc

SEQ ID NO: 1544621 - DNA, 16 bp, Homo sapiens
gactggctggctgcag

SEQ ID NO: 1544622 - DNA, 14 bp, Homo sapiens
gactggctgtgaga

SEQ ID NO: 1544623 - DNA, 23 bp, Homo sapiens
gactggctgtgtaaccttgggtg

SEQ ID NO: 1544624 - DNA, 17 bp, Homo sapiens
gactgggagccacttct

SEQ ID NO: 1544625 - DNA, 22 bp, Homo sapiens
gactgggagccacttctcccca

SEQ ID NO: 1544626 - DNA, 13 bp, Homo sapiens
gactgggcccagg

SEQ ID NO: 1544627 - DNA, 17 bp, Homo sapiens
gactggggagggctgca

SEQ ID NO: 1544628 - DNA, 17 bp, Homo sapiens
gactgggtaggaaagag

SEQ ID NO: 1544629 - DNA, 14 bp, Homo sapiens
gactgggtttctag

SEQ ID NO: 1544630 - DNA, 14 bp, Homo sapiens
gactggtccagctc

SEQ ID NO: 1544631 - DNA, 15 bp, Homo sapiens
gactggtccagctct

SEQ ID NO: 1544632 - DNA, 18 bp, Homo sapiens
gactggtccagctctgac

SEQ ID NO: 1544633 - DNA, 22 bp, Homo sapiens
gactggtgcgaccccccacccc

SEQ ID NO: 1544634 - DNA, 15 bp, Homo sapiens
gactggtgctgcagc

SEQ ID NO: 1544635 - DNA, 22 bp, Homo sapiens
gactgtacaaagtagaagtctt

SEQ ID NO: 1544636 - DNA, 23 bp, Homo sapiens
gactgtaccatggtttgatatgt

SEQ ID NO: 1544637 - DNA, 17 bp, Homo sapiens
gactgtactcctcccag

SEQ ID NO: 1544638 - DNA, 18 bp, Homo sapiens
gactgtactcctcccagg

SEQ ID NO: 1544639 - DNA, 13 bp, Homo sapiens
gactgtagggagg

SEQ ID NO: 1544640 - DNA, 14 bp, Homo sapiens
gactgtcagtgggg

SEQ ID NO: 1544641 - DNA, 13 bp, Homo sapiens
gactgtcagttct

SEQ ID NO: 1544642 - DNA, 15 bp, Homo sapiens
gactgtcatagaaat

SEQ ID NO: 1544643 - DNA, 17 bp, Homo sapiens
gactgtcattgcccctc

SEQ ID NO: 1544644 - DNA, 22 bp, Homo sapiens
gactgtctcaagagggcactgg

SEQ ID NO: 1544645 - DNA, 17 bp, Homo sapiens
gactgtctccacggcct

SEQ ID NO: 1544646 - DNA, 18 bp, Homo sapiens
gactgtgaacagcttgct

SEQ ID NO: 1544647 - DNA, 16 bp, Homo sapiens
gactgtgaggcggcag

SEQ ID NO: 1544648 - DNA, 20 bp, Homo sapiens
gactgtgaggcggcagctgg

SEQ ID NO: 1544649 - DNA, 21 bp, Homo sapiens
gactgtgaggcggcagctggg

SEQ ID NO: 1544650 - DNA, 19 bp, Homo sapiens
gactgtgatttatttggag

SEQ ID NO: 1544651 - DNA, 21 bp, Homo sapiens
gactgtgatttatttggagtg

SEQ ID NO: 1544652 - DNA, 14 bp, Homo sapiens
gactgtgcagaaga

SEQ ID NO: 1544653 - DNA, 17 bp, Homo sapiens
gactgtgcctcaggcca

SEQ ID NO: 1544654 - DNA, 23 bp, Homo sapiens
gactgtgcctcaggccagggctc

SEQ ID NO: 1544655 - DNA, 12 bp, Homo sapiens
gactgtgctgtg

SEQ ID NO: 1544656 - DNA, 17 bp, Homo sapiens
gactgtggcacttgcct

SEQ ID NO: 1544657 - DNA, 21 bp, Homo sapiens
gactgtggcacttgcctgggt

SEQ ID NO: 1544658 - DNA, 19 bp, Homo sapiens
gactgtgtaactttctctt

SEQ ID NO: 1544659 - DNA, 22 bp, Homo sapiens
gactgtgtattctagttttgtc

SEQ ID NO: 1544660 - DNA, 13 bp, Homo sapiens
gactgtgttgggc

SEQ ID NO: 1544661 - DNA, 19 bp, Homo sapiens
gactgtgtttgcattgtct

SEQ ID NO: 1544662 - DNA, 22 bp, Homo sapiens
gactgttactttggcaatttcc

SEQ ID NO: 1544663 - DNA, 12 bp, Homo sapiens
gactgtttattt

SEQ ID NO: 1544664 - DNA, 14 bp, Homo sapiens
gactgtttatttaa

SEQ ID NO: 1544665 - DNA, 19 bp, Homo sapiens
gactgtttatttaaggatg

SEQ ID NO: 1544666 - DNA, 15 bp, Homo sapiens
gactgtttcagtgtg

SEQ ID NO: 1544667 - DNA, 22 bp, Homo sapiens
gactgttttactgttttaattg

SEQ ID NO: 1544668 - DNA, 16 bp, Homo sapiens
gacttaaaacatggtg

SEQ ID NO: 1544669 - DNA, 23 bp, Homo sapiens
gacttaaagggcccaatgaatta

SEQ ID NO: 1544670 - DNA, 20 bp, Homo sapiens
gacttaactgcatttttaga

SEQ ID NO: 1544671 - DNA, 16 bp, Homo sapiens
gacttaagacaaatgg

SEQ ID NO: 1544672 - DNA, 20 bp, Homo sapiens
gacttaagcatctggctcta

SEQ ID NO: 1544673 - DNA, 14 bp, Homo sapiens
gacttaatgtgatt

SEQ ID NO: 1544674 - DNA, 23 bp, Homo sapiens
gacttaatgtgattactgctcta

SEQ ID NO: 1544675 - DNA, 14 bp, Homo sapiens
gacttacaaaatgc

SEQ ID NO: 1544676 - DNA, 17 bp, Homo sapiens
gacttacaaaatgccaa

SEQ ID NO: 1544677 - DNA, 21 bp, Homo sapiens
gacttactttaattactggaa

SEQ ID NO: 1544678 - DNA, 13 bp, Homo sapiens
gacttagagctgg

SEQ ID NO: 1544679 - DNA, 12 bp, Homo sapiens
gacttcaaagca

SEQ ID NO: 1544680 - DNA, 17 bp, Homo sapiens
gacttcaaagcaagctg

SEQ ID NO: 1544681 - DNA, 19 bp, Homo sapiens
gacttcacagcgtctgctc

SEQ ID NO: 1544682 - DNA, 11 bp, Homo sapiens
gacttcactgt

SEQ ID NO: 1544683 - DNA, 15 bp, Homo sapiens
gacttcactgtatat

SEQ ID NO: 1544684 - DNA, 14 bp, Homo sapiens
gacttcagggcagg

SEQ ID NO: 1544685 - DNA, 15 bp, Homo sapiens
gacttcagtcttgcc

SEQ ID NO: 1544686 - DNA, 18 bp, Homo sapiens
gacttcagtgaatatttt

SEQ ID NO: 1544687 - DNA, 23 bp, Homo sapiens
gacttcagtgtgtgtatttgtgt

SEQ ID NO: 1544688 - DNA, 20 bp, Homo sapiens
gacttccaaatcctggaagg

SEQ ID NO: 1544689 - DNA, 13 bp, Homo sapiens
gacttccaccctg

SEQ ID NO: 1544690 - DNA, 18 bp, Homo sapiens
gacttccccaatatcttg

SEQ ID NO: 1544691 - DNA, 22 bp, Homo sapiens
gacttcctagggatctgaaatc

SEQ ID NO: 1544692 - DNA, 19 bp, Homo sapiens
gacttcctgactctcacct

SEQ ID NO: 1544693 - DNA, 15 bp, Homo sapiens
gacttcctggggccc

SEQ ID NO: 1544694 - DNA, 15 bp, Homo sapiens
gacttccttgagaca

SEQ ID NO: 1544695 - DNA, 16 bp, Homo sapiens
gacttccttgagacac

SEQ ID NO: 1544696 - DNA, 15 bp, Homo sapiens
gacttcgactcagga

SEQ ID NO: 1544697 - DNA, 16 bp, Homo sapiens
gacttcgactcaggat

SEQ ID NO: 1544698 - DNA, 17 bp, Homo sapiens
gacttctaagtaaaacc

SEQ ID NO: 1544699 - DNA, 14 bp, Homo sapiens
gacttctacccaga

SEQ ID NO: 1544700 - DNA, 15 bp, Homo sapiens
gacttctacctgccc

SEQ ID NO: 1544701 - DNA, 13 bp, Homo sapiens
gacttctgagatc

SEQ ID NO: 1544702 - DNA, 15 bp, Homo sapiens
gacttctgcctggag

SEQ ID NO: 1544703 - DNA, 16 bp, Homo sapiens
gacttctggaaggctg

SEQ ID NO: 1544704 - DNA, 15 bp, Homo sapiens
gacttctggagatgg

SEQ ID NO: 1544705 - DNA, 20 bp, Homo sapiens
gacttctggttgtatttcta

SEQ ID NO: 1544706 - DNA, 21 bp, Homo sapiens
gacttctggttgtatttctat

SEQ ID NO: 1544707 - DNA, 20 bp, Homo sapiens
gacttctgtcttcacaacag

SEQ ID NO: 1544708 - DNA, 23 bp, Homo sapiens
gacttctgtcttcacaacagatt

SEQ ID NO: 1544709 - DNA, 21 bp, Homo sapiens
gacttcttggtttggggagaa

SEQ ID NO: 1544710 - DNA, 23 bp, Homo sapiens
gacttgacaacatcccacagtgg

SEQ ID NO: 1544711 - DNA, 15 bp, Homo sapiens
gacttgagccatcca

SEQ ID NO: 1544712 - DNA, 16 bp, Homo sapiens
gacttgagccatccaa

SEQ ID NO: 1544713 - DNA, 20 bp, Homo sapiens
gacttgccacccccagttcc

SEQ ID NO: 1544714 - DNA, 17 bp, Homo sapiens
gacttgctgtccaggca

SEQ ID NO: 1544715 - DNA, 19 bp, Homo sapiens
gacttgctgttttgttctg

SEQ ID NO: 1544716 - DNA, 11 bp, Homo sapiens
gacttgcttta

SEQ ID NO: 1544717 - DNA, 12 bp, Homo sapiens
gacttggcactt

SEQ ID NO: 1544718 - DNA, 14 bp, Homo sapiens
gacttggtctgatt

SEQ ID NO: 1544719 - DNA, 19 bp, Homo sapiens
gacttgtagggatgccttt

SEQ ID NO: 1544720 - DNA, 16 bp, Homo sapiens
gacttgtgattggctg

SEQ ID NO: 1544721 - DNA, 18 bp, Homo sapiens
gacttgtgtcccatgatc

SEQ ID NO: 1544722 - DNA, 12 bp, Homo sapiens
gacttgtgtctg

SEQ ID NO: 1544723 - DNA, 14 bp, Homo sapiens
gacttgttctagag

SEQ ID NO: 1544724 - DNA, 19 bp, Homo sapiens
gacttgtttagagagcctg

SEQ ID NO: 1544725 - DNA, 22 bp, Homo sapiens
gacttgtttgtcttccattcca

SEQ ID NO: 1544726 - DNA, 18 bp, Homo sapiens
gacttgttttatgctcag

SEQ ID NO: 1544727 - DNA, 15 bp, Homo sapiens
gacttgtttttgcac

SEQ ID NO: 1544728 - DNA, 16 bp, Homo sapiens
gacttgtttttgcaca

SEQ ID NO: 1544729 - DNA, 18 bp, Homo sapiens
gacttgtttttgcacatg

SEQ ID NO: 1544730 - DNA, 13 bp, Homo sapiens
gactttagaaata

SEQ ID NO: 1544731 - DNA, 17 bp, Homo sapiens
gactttagaaataaatg

SEQ ID NO: 1544732 - DNA, 16 bp, Homo sapiens
gactttagcttttcct

SEQ ID NO: 1544733 - DNA, 21 bp, Homo sapiens
gactttatctaatacctctgt

SEQ ID NO: 1544734 - DNA, 14 bp, Homo sapiens
gactttatgtatta

SEQ ID NO: 1544735 - DNA, 13 bp, Homo sapiens
gactttatttatt

SEQ ID NO: 1544736 - DNA, 15 bp, Homo sapiens
agtgactcctgctgg

SEQ ID NO: 1544737 - DNA, 17 bp, Homo sapiens
agtgactgaaaccattt

SEQ ID NO: 1544738 - DNA, 21 bp, Homo sapiens
agtgactgatggctaatgtac

SEQ ID NO: 1544739 - DNA, 16 bp, Homo sapiens
agtgactgtaattaat

SEQ ID NO: 1544740 - DNA, 21 bp, Homo sapiens
agtgacttggccccagacgca

SEQ ID NO: 1544741 - DNA, 16 bp, Homo sapiens
agtgacttgtgtccca

SEQ ID NO: 1544742 - DNA, 19 bp, Homo sapiens
agtgagaactctctccctg

SEQ ID NO: 1544743 - DNA, 12 bp, Homo sapiens
agtgagacagaa

SEQ ID NO: 1544744 - DNA, 13 bp, Homo sapiens
agtgagacagaag

SEQ ID NO: 1544745 - DNA, 17 bp, Homo sapiens
agtgagaccctgtctct

SEQ ID NO: 1544746 - DNA, 17 bp, Homo sapiens
gactttgacaattactc

SEQ ID NO: 1544747 - DNA, 22 bp, Homo sapiens
gactttgcccagggtcctgtgc

SEQ ID NO: 1544748 - DNA, 21 bp, Homo sapiens
gactttgctgatttcccctct

SEQ ID NO: 1544749 - DNA, 19 bp, Homo sapiens
gactttgctggtgtagtct

SEQ ID NO: 1544750 - DNA, 20 bp, Homo sapiens
gactttgtgttcatttcatt

SEQ ID NO: 1544751 - DNA, 18 bp, Homo sapiens
gacttttcaataaatcag

SEQ ID NO: 1544752 - DNA, 17 bp, Homo sapiens
gacttttccaatatgtg

SEQ ID NO: 1544753 - DNA, 18 bp, Homo sapiens
gacttttcgttaacattg

SEQ ID NO: 1544754 - DNA, 13 bp, Homo sapiens
gacttttctgcaa

SEQ ID NO: 1544755 - DNA, 18 bp, Homo sapiens
gacttttctgtaattcag

SEQ ID NO: 1544756 - DNA, 22 bp, Homo sapiens
gacttttgttaaattcagtaat

SEQ ID NO: 1544757 - DNA, 16 bp, Homo sapiens
gactttttagccagtg

SEQ ID NO: 1544758 - DNA, 16 bp, Homo sapiens
gactttttataaaatg

SEQ ID NO: 1544759 - DNA, 10 bp, Homo sapiens
gagaaaaaaa

SEQ ID NO: 1544760 - DNA, 16 bp, Homo sapiens
gagaaaaaaaaaatag

SEQ ID NO: 1544761 - DNA, 13 bp, Homo sapiens
gagaaaaaaaacc

SEQ ID NO: 1544762 - DNA, 23 bp, Homo sapiens
gagaaaaaaaaccttgtaaaaaa

SEQ ID NO: 1544763 - DNA, 10 bp, Homo sapiens
gagaaaaaga

SEQ ID NO: 1544764 - DNA, 14 bp, Homo sapiens
gagaaaaagaaatg

SEQ ID NO: 1544765 - DNA, 18 bp, Homo sapiens
gagaaaaatgctccccac

SEQ ID NO: 1544766 - DNA, 14 bp, Homo sapiens
gagaaaagaaaaat

SEQ ID NO: 1544767 - DNA, 21 bp, Homo sapiens
gagaaaagctggaccttttcc

SEQ ID NO: 1544768 - DNA, 18 bp, Homo sapiens
gagaaaatattacttatt

SEQ ID NO: 1544769 - DNA, 15 bp, Homo sapiens
gagaaaatcatcaag

SEQ ID NO: 1544770 - DNA, 17 bp, Homo sapiens
gagaaaatccaggtcat

SEQ ID NO: 1544771 - DNA, 14 bp, Homo sapiens
gagaaacagagaca

SEQ ID NO: 1544772 - DNA, 17 bp, Homo sapiens
gagaaacagctcagcca

SEQ ID NO: 1544773 - DNA, 14 bp, Homo sapiens
gagaaactgtgtat

SEQ ID NO: 1544774 - DNA, 21 bp, Homo sapiens
gagaaactttgagtacagata

SEQ ID NO: 1544775 - DNA, 19 bp, Homo sapiens
gagaaagaatttgagacgc

SEQ ID NO: 1544776 - DNA, 13 bp, Homo sapiens
gagaaagactatt

SEQ ID NO: 1544777 - DNA, 15 bp, Homo sapiens
gagaaagactattca

SEQ ID NO: 1544778 - DNA, 17 bp, Homo sapiens
gagaaagactattcaaa

SEQ ID NO: 1544779 - DNA, 14 bp, Homo sapiens
gagaaagagctgcc

SEQ ID NO: 1544780 - DNA, 15 bp, Homo sapiens
gagaaagagctgcct

SEQ ID NO: 1544781 - DNA, 17 bp, Homo sapiens
gagaaagagctgcctgg

SEQ ID NO: 1544782 - DNA, 14 bp, Homo sapiens
gagaaagctcaaag

SEQ ID NO: 1544783 - DNA, 13 bp, Homo sapiens
gagaaaggacaga

SEQ ID NO: 1544784 - DNA, 14 bp, Homo sapiens
gagaaaggacagag

SEQ ID NO: 1544785 - DNA, 20 bp, Homo sapiens
gagaaagggattgctgaggc

SEQ ID NO: 1544786 - DNA, 17 bp, Homo sapiens
gagaaaggggagcccac

SEQ ID NO: 1544787 - DNA, 23 bp, Homo sapiens
gagaaataaattttgtttcagaa

SEQ ID NO: 1544788 - DNA, 12 bp, Homo sapiens
gagaaatgcata

SEQ ID NO: 1544789 - DNA, 17 bp, Homo sapiens
gagaaatggattcagta

SEQ ID NO: 1544790 - DNA, 16 bp, Homo sapiens
gagaacaagtcacagc

SEQ ID NO: 1544791 - DNA, 22 bp, Homo sapiens
gagaacacctccagcttttctt

SEQ ID NO: 1544792 - DNA, 20 bp, Homo sapiens
gagaacacgttgccaggggc

SEQ ID NO: 1544793 - DNA, 20 bp, Homo sapiens
gagaaccgagcaaagatcaa

SEQ ID NO: 1544794 - DNA, 17 bp, Homo sapiens
gagaacctcagattctt

SEQ ID NO: 1544795 - DNA, 14 bp, Homo sapiens
gagaacctcaggct

SEQ ID NO: 1544796 - DNA, 22 bp, Homo sapiens
gagaacctcaggtacggagaag

SEQ ID NO: 1544797 - DNA, 16 bp, Homo sapiens
gagaacgccagtctcc

SEQ ID NO: 1544798 - DNA, 21 bp, Homo sapiens
gagaactcgttcacctccaag

SEQ ID NO: 1544799 - DNA, 18 bp, Homo sapiens
gagaactgcatatgtttc

SEQ ID NO: 1544800 - DNA, 16 bp, Homo sapiens
gagaactttcattttt

SEQ ID NO: 1544801 - DNA, 17 bp, Homo sapiens
gagaactttcatttttt

SEQ ID NO: 1544802 - DNA, 23 bp, Homo sapiens
gagaagaatagaggtcctcatgg

SEQ ID NO: 1544803 - DNA, 22 bp, Homo sapiens
gagaagaatgaaaatgcagtcc

SEQ ID NO: 1544804 - DNA, 20 bp, Homo sapiens
gagaagaattttcagacccc

SEQ ID NO: 1544805 - DNA, 14 bp, Homo sapiens
gagaagacaacaga

SEQ ID NO: 1544806 - DNA, 13 bp, Homo sapiens
gagaagagctgtt

SEQ ID NO: 1544807 - DNA, 15 bp, Homo sapiens
gagaagagctgttca

SEQ ID NO: 1544808 - DNA, 15 bp, Homo sapiens
gagaagagcttgcac

SEQ ID NO: 1544809 - DNA, 18 bp, Homo sapiens
gagaagagggcccagccc

SEQ ID NO: 1544810 - DNA, 16 bp, Homo sapiens
gagaagatcggaacag

SEQ ID NO: 1544811 - DNA, 20 bp, Homo sapiens
gagaagatcggaacagctcc

SEQ ID NO: 1544812 - DNA, 20 bp, Homo sapiens
gagaagcacagctcctgcca

SEQ ID NO: 1544813 - DNA, 15 bp, Homo sapiens
gagaagcaggcagat

SEQ ID NO: 1544814 - DNA, 14 bp, Homo sapiens
gagaagccaccttc

SEQ ID NO: 1544815 - DNA, 22 bp, Homo sapiens
gagaagccaggaatttcccagg

SEQ ID NO: 1544816 - DNA, 16 bp, Homo sapiens
gagaagcccgtgtgag

SEQ ID NO: 1544817 - DNA, 14 bp, Homo sapiens
gagaagccttcagc

SEQ ID NO: 1544818 - DNA, 16 bp, Homo sapiens
gagaagcggtcatgag

SEQ ID NO: 1544819 - DNA, 17 bp, Homo sapiens
gagaagctcagctgcat

SEQ ID NO: 1544820 - DNA, 15 bp, Homo sapiens
gagaagctcctgcta

SEQ ID NO: 1544821 - DNA, 23 bp, Homo sapiens
gagaagcttgtggtgttcctgaa

SEQ ID NO: 1544822 - DNA, 16 bp, Homo sapiens
gagaaggaagatagga

SEQ ID NO: 1544823 - DNA, 20 bp, Homo sapiens
gagaaggacccggaggggcc

SEQ ID NO: 1544824 - DNA, 23 bp, Homo sapiens
gagaaggcaggaatgtgtggcag

SEQ ID NO: 1544825 - DNA, 18 bp, Homo sapiens
gagaaggccctgtgccct

SEQ ID NO: 1544826 - DNA, 12 bp, Homo sapiens
gagaaggcctta

SEQ ID NO: 1544827 - DNA, 14 bp, Homo sapiens
gagaaggcgaggag

SEQ ID NO: 1544828 - DNA, 13 bp, Homo sapiens
gagaagggagggt

SEQ ID NO: 1544829 - DNA, 21 bp, Homo sapiens
gagaagggcagagttacttga

SEQ ID NO: 1544830 - DNA, 21 bp, Homo sapiens
gagaaggggaaaaatgggaaa

SEQ ID NO: 1544831 - DNA, 23 bp, Homo sapiens
gagaagggtggatgacagggcag

SEQ ID NO: 1544832 - DNA, 15 bp, Homo sapiens
gagaaggtccttaat

SEQ ID NO: 1544833 - DNA, 23 bp, Homo sapiens
gagaaggttggaggtggggaagg

SEQ ID NO: 1544834 - DNA, 17 bp, Homo sapiens
gagaaggtttattgtta

SEQ ID NO: 1544835 - DNA, 14 bp, Homo sapiens
gagaagtcaaacat

SEQ ID NO: 1544836 - DNA, 19 bp, Homo sapiens
gagaagtgaataactgcaa

SEQ ID NO: 1544837 - DNA, 13 bp, Homo sapiens
gagaagtgctccc

SEQ ID NO: 1544838 - DNA, 21 bp, Homo sapiens
gagaagtgctcttggctgacc

SEQ ID NO: 1544839 - DNA, 11 bp, Homo sapiens
gagaataaatt

SEQ ID NO: 1544840 - DNA, 20 bp, Homo sapiens
gagaataaattggattattt

SEQ ID NO: 1544841 - DNA, 18 bp, Homo sapiens
gagaataagagaaagaaa

SEQ ID NO: 1544842 - DNA, 11 bp, Homo sapiens
gagaatagaaa

SEQ ID NO: 1544843 - DNA, 20 bp, Homo sapiens
gagaatagcagagagccaaa

SEQ ID NO: 1544844 - DNA, 14 bp, Homo sapiens
gagaatcagactga

SEQ ID NO: 1544845 - DNA, 19 bp, Homo sapiens
gagaatcatgtttctttga

SEQ ID NO: 1544846 - DNA, 21 bp, Homo sapiens
gagaatcctctcctttcttat

SEQ ID NO: 1544847 - DNA, 18 bp, Homo sapiens
gagaatgagagcgacaca

SEQ ID NO: 1544848 - DNA, 13 bp, Homo sapiens
gagaatgagcctc

SEQ ID NO: 1544849 - DNA, 14 bp, Homo sapiens
gagaatgagtggga

SEQ ID NO: 1544850 - DNA, 17 bp, Homo sapiens
gagaatggctgggtcag

SEQ ID NO: 1544851 - DNA, 20 bp, Homo sapiens
gagaatggtgtgaacccggg

SEQ ID NO: 1544852 - DNA, 17 bp, Homo sapiens
gagaatgtcagtatgtg

SEQ ID NO: 1544853 - DNA, 20 bp, Homo sapiens
gagaatgtgattccttttga

SEQ ID NO: 1544854 - DNA, 22 bp, Homo sapiens
gagaatgtgtgtgtgtggcagg

SEQ ID NO: 1544855 - DNA, 13 bp, Homo sapiens
agtgccccagact

SEQ ID NO: 1544856 - DNA, 16 bp, Homo sapiens
agtgccccagactgag

SEQ ID NO: 1544857 - DNA, 20 bp, Homo sapiens
agtgccccagactgagctct

SEQ ID NO: 1544858 - DNA, 21 bp, Homo sapiens
agtgccccagactgagctctc

SEQ ID NO: 1544859 - DNA, 16 bp, Homo sapiens
agtgcccccactgacc

SEQ ID NO: 1544860 - DNA, 18 bp, Homo sapiens
agtgcccccagcccagag

SEQ ID NO: 1544861 - DNA, 21 bp, Homo sapiens
gagaattgactgaagcacagc

SEQ ID NO: 1544862 - DNA, 17 bp, Homo sapiens
gagaattgggattacat

SEQ ID NO: 1544863 - DNA, 21 bp, Homo sapiens
gagaattgtatcatttgaaca

SEQ ID NO: 1544864 - DNA, 20 bp, Homo sapiens
gagaattgtgctttcaccag

SEQ ID NO: 1544865 - DNA, 18 bp, Homo sapiens
gagacaaaatatttccca

SEQ ID NO: 1544866 - DNA, 19 bp, Homo sapiens
gagacaaacacctcccagg

SEQ ID NO: 1544867 - DNA, 21 bp, Homo sapiens
gagacaagaaaggcagacaca

SEQ ID NO: 1544868 - DNA, 16 bp, Homo sapiens
gagacaagccctggca

SEQ ID NO: 1544869 - DNA, 19 bp, Homo sapiens
gagacaagccctggcaaca

SEQ ID NO: 1544870 - DNA, 16 bp, Homo sapiens
gagacacagcgtccct

SEQ ID NO: 1544871 - DNA, 21 bp, Homo sapiens
gagacacatacagagtgggcc

SEQ ID NO: 1544872 - DNA, 15 bp, Homo sapiens
gagacacattgcctt

SEQ ID NO: 1544873 - DNA, 19 bp, Homo sapiens
gagacaccatcctgagcca

SEQ ID NO: 1544874 - DNA, 19 bp, Homo sapiens
gagacaccccttcctgctg

SEQ ID NO: 1544875 - DNA, 14 bp, Homo sapiens
gagacaccctctgg

SEQ ID NO: 1544876 - DNA, 18 bp, Homo sapiens
gagacaccctctgggggt

SEQ ID NO: 1544877 - DNA, 15 bp, Homo sapiens
gagacacctgcacct

SEQ ID NO: 1544878 - DNA, 18 bp, Homo sapiens
gagacacctgcacctccc

SEQ ID NO: 1544879 - DNA, 18 bp, Homo sapiens
gagacacgacagcacaca

SEQ ID NO: 1544880 - DNA, 22 bp, Homo sapiens
gagacacgacagcacacacagt

SEQ ID NO: 1544881 - DNA, 19 bp, Homo sapiens
gagacacgtgtggcgggca

SEQ ID NO: 1544882 - DNA, 13 bp, Homo sapiens
gagacagaaagcc

SEQ ID NO: 1544883 - DNA, 20 bp, Homo sapiens
gagacagaaagcctccgctg

SEQ ID NO: 1544884 - DNA, 21 bp, Homo sapiens
gagacagaaagcctccgctgg

SEQ ID NO: 1544885 - DNA, 15 bp, Homo sapiens
gagacagagccaagc

SEQ ID NO: 1544886 - DNA, 21 bp, Homo sapiens
gagacagagccaagcactgct

SEQ ID NO: 1544887 - DNA, 12 bp, Homo sapiens
gagacagcagcc

SEQ ID NO: 1544888 - DNA, 19 bp, Homo sapiens
gagacaggaaaatcctctg

SEQ ID NO: 1544889 - DNA, 13 bp, Homo sapiens
gagacaggacaga

SEQ ID NO: 1544890 - DNA, 16 bp, Homo sapiens
gagacaggacctgact

SEQ ID NO: 1544891 - DNA, 20 bp, Homo sapiens
gagacaggagaatcacctga

SEQ ID NO: 1544892 - DNA, 18 bp, Homo sapiens
gagacagggtaggaaagg

SEQ ID NO: 1544893 - DNA, 19 bp, Homo sapiens
gagacagggtaggaaaggg

SEQ ID NO: 1544894 - DNA, 17 bp, Homo sapiens
gagacaggtggcctagc

SEQ ID NO: 1544895 - DNA, 19 bp, Homo sapiens
gagacaggtggcctagcag

SEQ ID NO: 1544896 - DNA, 16 bp, Homo sapiens
gagacagtgaatttgg

SEQ ID NO: 1544897 - DNA, 18 bp, Homo sapiens
gagacagttcaagaaagc

SEQ ID NO: 1544898 - DNA, 12 bp, Homo sapiens
gagacatccagc

SEQ ID NO: 1544899 - DNA, 18 bp, Homo sapiens
gagacatgtaccttgacc

SEQ ID NO: 1544900 - DNA, 15 bp, Homo sapiens
gagaccaacctgacc

SEQ ID NO: 1544901 - DNA, 18 bp, Homo sapiens
gagaccaaggcgggagca

SEQ ID NO: 1544902 - DNA, 11 bp, Homo sapiens
gagaccagcac

SEQ ID NO: 1544903 - DNA, 14 bp, Homo sapiens
gagaccagctcaga

SEQ ID NO: 1544904 - DNA, 19 bp, Homo sapiens
gagaccagctcagaggccc

SEQ ID NO: 1544905 - DNA, 23 bp, Homo sapiens
gagaccagttgggagcactggag

SEQ ID NO: 1544906 - DNA, 15 bp, Homo sapiens
gagaccatcctggcc

SEQ ID NO: 1544907 - DNA, 16 bp, Homo sapiens
gagaccatcctggcca

SEQ ID NO: 1544908 - DNA, 15 bp, Homo sapiens
gagaccatcctggct

SEQ ID NO: 1544909 - DNA, 22 bp, Homo sapiens
gagacccaaagcggtccctgtc

SEQ ID NO: 1544910 - DNA, 17 bp, Homo sapiens
gagacccaacagcagtg

SEQ ID NO: 1544911 - DNA, 19 bp, Homo sapiens
gagacccaacagcagtgat

SEQ ID NO: 1544912 - DNA, 15 bp, Homo sapiens
gagacccagctgcag

SEQ ID NO: 1544913 - DNA, 18 bp, Homo sapiens
gagaccccaaagactctg

SEQ ID NO: 1544914 - DNA, 23 bp, Homo sapiens
gagaccccaaagactctggaggt

SEQ ID NO: 1544915 - DNA, 20 bp, Homo sapiens
gagaccccagtcgtgatgtg

SEQ ID NO: 1544916 - DNA, 15 bp, Homo sapiens
gagacccccacacct

SEQ ID NO: 1544917 - DNA, 23 bp, Homo sapiens
gagacccccacacctcagttccc

SEQ ID NO: 1544918 - DNA, 18 bp, Homo sapiens
gagacccccatccagcct

SEQ ID NO: 1544919 - DNA, 13 bp, Homo sapiens
gagaccccgcacc

SEQ ID NO: 1544920 - DNA, 16 bp, Homo sapiens
gagaccccgcacccgg

SEQ ID NO: 1544921 - DNA, 18 bp, Homo sapiens
gagaccccgcacccggct

SEQ ID NO: 1544922 - DNA, 14 bp, Homo sapiens
gagacccctcccct

SEQ ID NO: 1544923 - DNA, 22 bp, Homo sapiens
gagacccgggaaggaaggctct

SEQ ID NO: 1544924 - DNA, 23 bp, Homo sapiens
gagaccctccccacagtgccacc

SEQ ID NO: 1544925 - DNA, 19 bp, Homo sapiens
gagaccctcgtggccttcc

SEQ ID NO: 1544926 - DNA, 16 bp, Homo sapiens
gagaccctgcaagacc

SEQ ID NO: 1544927 - DNA, 13 bp, Homo sapiens
gagacccttttct

SEQ ID NO: 1544928 - DNA, 20 bp, Homo sapiens
gagaccggggtatcctgggg

SEQ ID NO: 1544929 - DNA, 16 bp, Homo sapiens
gagaccgtgagcgccc

SEQ ID NO: 1544930 - DNA, 16 bp, Homo sapiens
gagacctcatcctgct

SEQ ID NO: 1544931 - DNA, 21 bp, Homo sapiens
gagacctcatcctgctctttt

SEQ ID NO: 1544932 - DNA, 13 bp, Homo sapiens
gagacctccagct

SEQ ID NO: 1544933 - DNA, 16 bp, Homo sapiens
gagacctgccctctct

SEQ ID NO: 1544934 - DNA, 14 bp, Homo sapiens
gagacctgctctcc

SEQ ID NO: 1544935 - DNA, 10 bp, Homo sapiens
gagacctggt

SEQ ID NO: 1544936 - DNA, 15 bp, Homo sapiens
gagacctgtgtgaac

SEQ ID NO: 1544937 - DNA, 19 bp, Homo sapiens
gagacgcacacagctgagc

SEQ ID NO: 1544938 - DNA, 21 bp, Homo sapiens
gagacgccctatttctatgtc

SEQ ID NO: 1544939 - DNA, 22 bp, Homo sapiens
gagacggcgattttcgggctga

SEQ ID NO: 1544940 - DNA, 19 bp, Homo sapiens
gagacgtggtgggactcca

SEQ ID NO: 1544941 - DNA, 22 bp, Homo sapiens
gagacgtttttggaagagtagt

SEQ ID NO: 1544942 - DNA, 14 bp, Homo sapiens
gagactaagccctg

SEQ ID NO: 1544943 - DNA, 15 bp, Homo sapiens
gagactaagccctgt

SEQ ID NO: 1544944 - DNA, 21 bp, Homo sapiens
gagactatggagcctggcaca

SEQ ID NO: 1544945 - DNA, 17 bp, Homo sapiens
gagactcacctctgcct

SEQ ID NO: 1544946 - DNA, 20 bp, Homo sapiens
gagactcacctctgcctcaa

SEQ ID NO: 1544947 - DNA, 13 bp, Homo sapiens
gagactcagtgca

SEQ ID NO: 1544948 - DNA, 17 bp, Homo sapiens
gagactccagaatctgc

SEQ ID NO: 1544949 - DNA, 20 bp, Homo sapiens
gagactccagaatctgctgt

SEQ ID NO: 1544950 - DNA, 18 bp, Homo sapiens
gagactccgtctcaagga

SEQ ID NO: 1544951 - DNA, 17 bp, Homo sapiens
gagactcctgccctgtt

SEQ ID NO: 1544952 - DNA, 14 bp, Homo sapiens
gagactcctggtct

SEQ ID NO: 1544953 - DNA, 16 bp, Homo sapiens
gagactcctggtctgt

SEQ ID NO: 1544954 - DNA, 17 bp, Homo sapiens
gagactcgactctgtgc

SEQ ID NO: 1544955 - DNA, 16 bp, Homo sapiens
gagactctagggtcca

SEQ ID NO: 1544956 - DNA, 12 bp, Homo sapiens
gagactctgtgg

SEQ ID NO: 1544957 - DNA, 21 bp, Homo sapiens
gagactgaaagcagcagctag

SEQ ID NO: 1544958 - DNA, 21 bp, Homo sapiens
gagactgagatcactgactct

SEQ ID NO: 1544959 - DNA, 15 bp, Homo sapiens
gagactgagcagccg

SEQ ID NO: 1544960 - DNA, 16 bp, Homo sapiens
gagactgagcagccgc

SEQ ID NO: 1544961 - DNA, 17 bp, Homo sapiens
gagactgagcagccgcc

SEQ ID NO: 1544962 - DNA, 12 bp, Homo sapiens
gagactgatggg

SEQ ID NO: 1544963 - DNA, 18 bp, Homo sapiens
gagactgatggggtcgct

SEQ ID NO: 1544964 - DNA, 21 bp, Homo sapiens
gagactgccccacggccctgt

SEQ ID NO: 1544965 - DNA, 22 bp, Homo sapiens
gagactgcgggatggtcctggg

SEQ ID NO: 1544966 - DNA, 17 bp, Homo sapiens
gagactgcgttctgcaa

SEQ ID NO: 1544967 - DNA, 23 bp, Homo sapiens
gagactgcgttctgcaagcatca

SEQ ID NO: 1544968 - DNA, 14 bp, Homo sapiens
gagactgctaagta

SEQ ID NO: 1544969 - DNA, 20 bp, Homo sapiens
gagactgcttcccatcctac

SEQ ID NO: 1544970 - DNA, 16 bp, Homo sapiens
gagactgggagccact

SEQ ID NO: 1544971 - DNA, 22 bp, Homo sapiens
gagactgtctcaagagggcact

SEQ ID NO: 1544972 - DNA, 23 bp, Homo sapiens
gagactgtgaggcggcagctggg

SEQ ID NO: 1544973 - DNA, 20 bp, Homo sapiens
agtggatggaatatcagaag

SEQ ID NO: 1544974 - DNA, 12 bp, Homo sapiens
agtggatgggaa

SEQ ID NO: 1544975 - DNA, 21 bp, Homo sapiens
gagactgtggtaggggcaggg

SEQ ID NO: 1544976 - DNA, 13 bp, Homo sapiens
gagacttaaaaca

SEQ ID NO: 1544977 - DNA, 14 bp, Homo sapiens
gagacttaaaacat

SEQ ID NO: 1544978 - DNA, 21 bp, Homo sapiens
gagacttagggcaccaggggt

SEQ ID NO: 1544979 - DNA, 22 bp, Homo sapiens
gagacttctgtttgatcactgt

SEQ ID NO: 1544980 - DNA, 16 bp, Homo sapiens
gagacttgttctagag

SEQ ID NO: 1544981 - DNA, 16 bp, Homo sapiens
gagactttcccctctc

SEQ ID NO: 1544982 - DNA, 14 bp, Homo sapiens
gagactttctgctg

SEQ ID NO: 1544983 - DNA, 13 bp, Homo sapiens
gagactttgtaga

SEQ ID NO: 1544984 - DNA, 15 bp, Homo sapiens
gagagaaagagagaa

SEQ ID NO: 1544985 - DNA, 18 bp, Homo sapiens
gagagaaagagagaagcc

SEQ ID NO: 1544986 - DNA, 21 bp, Homo sapiens
gagagaaagagagaagccagc

SEQ ID NO: 1544987 - DNA, 13 bp, Homo sapiens
gagagaaatattt

SEQ ID NO: 1544988 - DNA, 13 bp, Homo sapiens
gagagaagaaagt

SEQ ID NO: 1544989 - DNA, 13 bp, Homo sapiens
gagagaagcaggc

SEQ ID NO: 1544990 - DNA, 15 bp, Homo sapiens
gagagaagcaggcag

SEQ ID NO: 1544991 - DNA, 17 bp, Homo sapiens
gagagaagccagccaca

SEQ ID NO: 1544992 - DNA, 15 bp, Homo sapiens
gagagaagggaattt

SEQ ID NO: 1544993 - DNA, 12 bp, Homo sapiens
gagagaataaat

SEQ ID NO: 1544994 - DNA, 13 bp, Homo sapiens
gagagaataaatt

SEQ ID NO: 1544995 - DNA, 14 bp, Homo sapiens
gagagaatctgcct

SEQ ID NO: 1544996 - DNA, 16 bp, Homo sapiens
gagagacccctcccct

SEQ ID NO: 1544997 - DNA, 20 bp, Homo sapiens
gagagacccctcccctccca

SEQ ID NO: 1544998 - DNA, 13 bp, Homo sapiens
gagagaccctcac

SEQ ID NO: 1544999 - DNA, 15 bp, Homo sapiens
gagagaccctcactg

SEQ ID NO: 1545000 - DNA, 22 bp, Homo sapiens
gagagaccctcactgctgggga

SEQ ID NO: 1545001 - DNA, 18 bp, Homo sapiens
gagagactgaaagcagca

SEQ ID NO: 1545002 - DNA, 13 bp, Homo sapiens
gagagactgatgg

SEQ ID NO: 1545003 - DNA, 22 bp, Homo sapiens
gagagactgatggggtcgctct

SEQ ID NO: 1545004 - DNA, 20 bp, Homo sapiens
gagagagaatagagctgcca

SEQ ID NO: 1545005 - DNA, 12 bp, Homo sapiens
gagagagactga

SEQ ID NO: 1545006 - DNA, 13 bp, Homo sapiens
gagagagaggaca

SEQ ID NO: 1545007 - DNA, 15 bp, Homo sapiens
gagagagaggcagaa

SEQ ID NO: 1545008 - DNA, 15 bp, Homo sapiens
gagagagaggctgcc

SEQ ID NO: 1545009 - DNA, 15 bp, Homo sapiens
gagagagcaaggaag

SEQ ID NO: 1545010 - DNA, 13 bp, Homo sapiens
gagagagccagga

SEQ ID NO: 1545011 - DNA, 14 bp, Homo sapiens
gagagaggctgcct

SEQ ID NO: 1545012 - DNA, 23 bp, Homo sapiens
gagagagggactcaagggaaagg

SEQ ID NO: 1545013 - DNA, 19 bp, Homo sapiens
gagagaggttgaaaaacaa

SEQ ID NO: 1545014 - DNA, 21 bp, Homo sapiens
gagagagttgttttaataact

SEQ ID NO: 1545015 - DNA, 13 bp, Homo sapiens
gagagcaaggaag

SEQ ID NO: 1545016 - DNA, 17 bp, Homo sapiens
gagagcagcagcaccaa

SEQ ID NO: 1545017 - DNA, 17 bp, Homo sapiens
gagagcagcaggtgctg

SEQ ID NO: 1545018 - DNA, 13 bp, Homo sapiens
gagagcagtgggc

SEQ ID NO: 1545019 - DNA, 13 bp, Homo sapiens
gagagcatctcag

SEQ ID NO: 1545020 - DNA, 23 bp, Homo sapiens
gagagcatctcaggaggggcagc

SEQ ID NO: 1545021 - DNA, 13 bp, Homo sapiens
gagagccaagacg

SEQ ID NO: 1545022 - DNA, 21 bp, Homo sapiens
gagagccagatgcctccccaa

SEQ ID NO: 1545023 - DNA, 14 bp, Homo sapiens
gagagccagcagca

SEQ ID NO: 1545024 - DNA, 16 bp, Homo sapiens
gagagccaggatgccc

SEQ ID NO: 1545025 - DNA, 11 bp, Homo sapiens
gagagcccagc

SEQ ID NO: 1545026 - DNA, 14 bp, Homo sapiens
gagagcccattccc

SEQ ID NO: 1545027 - DNA, 15 bp, Homo sapiens
gagagccccagctga

SEQ ID NO: 1545028 - DNA, 18 bp, Homo sapiens
gagagcccgcgtgctgga

SEQ ID NO: 1545029 - DNA, 14 bp, Homo sapiens
gagagccctgaggc

SEQ ID NO: 1545030 - DNA, 21 bp, Homo sapiens
gagagcctgctcccccacccc

SEQ ID NO: 1545031 - DNA, 23 bp, Homo sapiens
gagagcctgctcccccaccccct

SEQ ID NO: 1545032 - DNA, 14 bp, Homo sapiens
gagagcctgctggc

SEQ ID NO: 1545033 - DNA, 15 bp, Homo sapiens
gagagctcaggcagc

SEQ ID NO: 1545034 - DNA, 13 bp, Homo sapiens
gagagctgctgag

SEQ ID NO: 1545035 - DNA, 14 bp, Homo sapiens
gagagctgctgagg

SEQ ID NO: 1545036 - DNA, 17 bp, Homo sapiens
gagagctggtgcccgga

SEQ ID NO: 1545037 - DNA, 19 bp, Homo sapiens
gagagctgtcttcctgtgt

SEQ ID NO: 1545038 - DNA, 22 bp, Homo sapiens
gagaggaaataacagagagaat

SEQ ID NO: 1545039 - DNA, 18 bp, Homo sapiens
gagaggagacggagggga

SEQ ID NO: 1545040 - DNA, 18 bp, Homo sapiens
gagaggagcacctgaacc

SEQ ID NO: 1545041 - DNA, 18 bp, Homo sapiens
gagaggaggtttgcctgt
